United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 151

SEQ ID NO: 6407533 - DNA, 18 bp, Homo sapiens
tagcataaataaaactga

SEQ ID NO: 6407534 - DNA, 19 bp, Homo sapiens
tagcataaataaaactgaa

SEQ ID NO: 6407535 - DNA, 20 bp, Homo sapiens
tagcataaataaaactgaat

SEQ ID NO: 6407536 - DNA, 13 bp, Homo sapiens
tagcataactgta

SEQ ID NO: 6407537 - DNA, 13 bp, Homo sapiens
tagcataaggtct

SEQ ID NO: 6407538 - DNA, 16 bp, Homo sapiens
tagcataatattttct

SEQ ID NO: 6407539 - DNA, 21 bp, Homo sapiens
tagcataattttgtgttgtac

SEQ ID NO: 6407540 - DNA, 18 bp, Homo sapiens
tagcatacaggttaacct

SEQ ID NO: 6407541 - DNA, 16 bp, Homo sapiens
tagcatacgtacacat

SEQ ID NO: 6407542 - DNA, 18 bp, Homo sapiens
tagcatacgtacacattt

SEQ ID NO: 6407543 - DNA, 16 bp, Homo sapiens
tagcatactgatgaga

SEQ ID NO: 6407544 - DNA, 19 bp, Homo sapiens
tagcatactgatgagacaa

SEQ ID NO: 6407545 - DNA, 15 bp, Homo sapiens
tagcatactgtgtat

SEQ ID NO: 6407546 - DNA, 21 bp, Homo sapiens
tagcatactgtgtatgtttta

SEQ ID NO: 6407547 - DNA, 23 bp, Homo sapiens
tagcatactgtgtatgttttata

SEQ ID NO: 6407548 - DNA, 14 bp, Homo sapiens
tagcatagccagca

SEQ ID NO: 6407549 - DNA, 15 bp, Homo sapiens
tagcataggctgggg

SEQ ID NO: 6407550 - DNA, 15 bp, Homo sapiens
tagcatagtaaacta

SEQ ID NO: 6407551 - DNA, 15 bp, Homo sapiens
tagcatataaatgtt

SEQ ID NO: 6407552 - DNA, 21 bp, Homo sapiens
tagcatataaatgtttatatt

SEQ ID NO: 6407553 - DNA, 12 bp, Homo sapiens
tagcatatcaat

SEQ ID NO: 6407554 - DNA, 13 bp, Homo sapiens
tagcatatcctca

SEQ ID NO: 6407555 - DNA, 18 bp, Homo sapiens
tagcatatgacaaatgtt

SEQ ID NO: 6407556 - DNA, 22 bp, Homo sapiens
tagcatccatggatgcagaaat

SEQ ID NO: 6407557 - DNA, 15 bp, Homo sapiens
tagcatcctaagaaa

SEQ ID NO: 6407558 - DNA, 17 bp, Homo sapiens
tagcatcctaagaaata

SEQ ID NO: 6407559 - DNA, 23 bp, Homo sapiens
tagcatcctaagaaatatgtgag

SEQ ID NO: 6407560 - DNA, 23 bp, Homo sapiens
tagcatcctgattattgaatgtt

SEQ ID NO: 6407561 - DNA, 18 bp, Homo sapiens
tagcatctggaagatcat

SEQ ID NO: 6407562 - DNA, 15 bp, Homo sapiens
tagcatctgtacaaa

SEQ ID NO: 6407563 - DNA, 17 bp, Homo sapiens
tagcatctgtacaaagg

SEQ ID NO: 6407564 - DNA, 16 bp, Homo sapiens
tagcatcttcctctgc

SEQ ID NO: 6407565 - DNA, 23 bp, Homo sapiens
tagcatcttctggagtctccagt

SEQ ID NO: 6407566 - DNA, 13 bp, Homo sapiens
tagcatctttcat

SEQ ID NO: 6407567 - DNA, 22 bp, Homo sapiens
tagcatgaaaggtaatctgaaa

SEQ ID NO: 6407568 - DNA, 16 bp, Homo sapiens
tagcatgaaataaaat

SEQ ID NO: 6407569 - DNA, 17 bp, Homo sapiens
tagcatgacaagcccca

SEQ ID NO: 6407570 - DNA, 18 bp, Homo sapiens
tagcatgacaagccccag

SEQ ID NO: 6407571 - DNA, 16 bp, Homo sapiens
tagcatgacatttctt

SEQ ID NO: 6407572 - DNA, 21 bp, Homo sapiens
tagcatgatgaaactgtcata

SEQ ID NO: 6407573 - DNA, 20 bp, Homo sapiens
tagcatgatttttcaaggat

SEQ ID NO: 6407574 - DNA, 21 bp, Homo sapiens
tagcatgcaagcttggtcaaa

SEQ ID NO: 6407575 - DNA, 17 bp, Homo sapiens
tagcatgcacaaagtgt

SEQ ID NO: 6407576 - DNA, 13 bp, Homo sapiens
tagcatgccaaca

SEQ ID NO: 6407577 - DNA, 14 bp, Homo sapiens
tagcatgccaacaa

SEQ ID NO: 6407578 - DNA, 19 bp, Homo sapiens
tagcatgcgcgctgtgggc

SEQ ID NO: 6407579 - DNA, 17 bp, Homo sapiens
tagcatgcttcctttct

SEQ ID NO: 6407580 - DNA, 21 bp, Homo sapiens
tagcatgcttcctttctctcc

SEQ ID NO: 6407581 - DNA, 22 bp, Homo sapiens
tagcatgcttcctttctctcct

SEQ ID NO: 6407582 - DNA, 18 bp, Homo sapiens
tagcatgcttgttgcaat

SEQ ID NO: 6407583 - DNA, 23 bp, Homo sapiens
tagcatgcttgttgcaattgcct

SEQ ID NO: 6407584 - DNA, 19 bp, Homo sapiens
tagcatggcccgggcctta

SEQ ID NO: 6407585 - DNA, 19 bp, Homo sapiens
tagcatggctgccaatggg

SEQ ID NO: 6407586 - DNA, 16 bp, Homo sapiens
tagcatggggcccctg

SEQ ID NO: 6407587 - DNA, 21 bp, Homo sapiens
tagcatgggtccaagagacat

SEQ ID NO: 6407588 - DNA, 22 bp, Homo sapiens
tagcatgggtccaagagacatg

SEQ ID NO: 6407589 - DNA, 22 bp, Homo sapiens
tagcatgtaatattaaattcct

SEQ ID NO: 6407590 - DNA, 15 bp, Homo sapiens
tagcatgtattgtgt

SEQ ID NO: 6407591 - DNA, 23 bp, Homo sapiens
tagcatgtattgtgtcttttgca

SEQ ID NO: 6407592 - DNA, 18 bp, Homo sapiens
tagcatgtcaacttttga

SEQ ID NO: 6407593 - DNA, 19 bp, Homo sapiens
tagcatgtcaacttttgac

SEQ ID NO: 6407594 - DNA, 21 bp, Homo sapiens
tagcatgtgtttggttctggg

SEQ ID NO: 6407595 - DNA, 13 bp, Homo sapiens
tagcatgtttgct

SEQ ID NO: 6407596 - DNA, 14 bp, Homo sapiens
tagcattaaaaata

SEQ ID NO: 6407597 - DNA, 14 bp, Homo sapiens
tagcattaaatata

SEQ ID NO: 6407598 - DNA, 17 bp, Homo sapiens
tagcattaaatataaaa

SEQ ID NO: 6407599 - DNA, 18 bp, Homo sapiens
tagcattaaatataaaat

SEQ ID NO: 6407600 - DNA, 23 bp, Homo sapiens
tagcattaaatataaaatacata

SEQ ID NO: 6407601 - DNA, 12 bp, Homo sapiens
tagcattaacta

SEQ ID NO: 6407602 - DNA, 14 bp, Homo sapiens
tagcattataccaa

SEQ ID NO: 6407603 - DNA, 16 bp, Homo sapiens
tagcattatcttatca

SEQ ID NO: 6407604 - DNA, 16 bp, Homo sapiens
tagcattatgcaatta

SEQ ID NO: 6407605 - DNA, 14 bp, Homo sapiens
tagcattattagtt

SEQ ID NO: 6407606 - DNA, 22 bp, Homo sapiens
tagcattcagggttatacacag

SEQ ID NO: 6407607 - DNA, 11 bp, Homo sapiens
tagcattctgt

SEQ ID NO: 6407608 - DNA, 18 bp, Homo sapiens
tagcattgataatcttca

SEQ ID NO: 6407609 - DNA, 19 bp, Homo sapiens
tagcattgataatcttcag

SEQ ID NO: 6407610 - DNA, 16 bp, Homo sapiens
tagcattgccaatatc

SEQ ID NO: 6407611 - DNA, 22 bp, Homo sapiens
tagcattgtaagcgtatggctt

SEQ ID NO: 6407612 - DNA, 20 bp, Homo sapiens
tagcattgtgaactgacagg

SEQ ID NO: 6407613 - DNA, 12 bp, Homo sapiens
tagcattgttat

SEQ ID NO: 6407614 - DNA, 23 bp, Homo sapiens
tagcattgttccacacatttaaa

SEQ ID NO: 6407615 - DNA, 15 bp, Homo sapiens
tagcattgtttctag

SEQ ID NO: 6407616 - DNA, 17 bp, Homo sapiens
tagcatttaaagatacc

SEQ ID NO: 6407617 - DNA, 17 bp, Homo sapiens
tagcatttaccaacatg

SEQ ID NO: 6407618 - DNA, 15 bp, Homo sapiens
tagcatttatggtaa

SEQ ID NO: 6407619 - DNA, 16 bp, Homo sapiens
tagcatttcattcttc

SEQ ID NO: 6407620 - DNA, 19 bp, Homo sapiens
tagcatttgtgttgaagag

SEQ ID NO: 6407621 - DNA, 17 bp, Homo sapiens
tagcatttgttttagca

SEQ ID NO: 6407622 - DNA, 14 bp, Homo sapiens
tagcattttaaaca

SEQ ID NO: 6407623 - DNA, 19 bp, Homo sapiens
tagcattttaatagtttct

SEQ ID NO: 6407624 - DNA, 17 bp, Homo sapiens
tagcattttctgcatct

SEQ ID NO: 6407625 - DNA, 19 bp, Homo sapiens
tagcattttctgcatctcc

SEQ ID NO: 6407626 - DNA, 16 bp, Homo sapiens
tagcattttcttgaac

SEQ ID NO: 6407627 - DNA, 16 bp, Homo sapiens
tagcattttgctaaat

SEQ ID NO: 6407628 - DNA, 14 bp, Homo sapiens
tagcatttttatgc

SEQ ID NO: 6407629 - DNA, 15 bp, Homo sapiens
tagcatttttatgca

SEQ ID NO: 6407630 - DNA, 20 bp, Homo sapiens
tagcatttttatgcagacag

SEQ ID NO: 6407631 - DNA, 14 bp, Homo sapiens
tagcatttttgatt

SEQ ID NO: 6407632 - DNA, 14 bp, Homo sapiens
tagcatttttgtaa

SEQ ID NO: 6407633 - DNA, 16 bp, Homo sapiens
tagcatttttgtaact

SEQ ID NO: 6407634 - DNA, 17 bp, Homo sapiens
tagcatttttgtaactt

SEQ ID NO: 6407635 - DNA, 21 bp, Homo sapiens
tagccaaaaaggcaaataatg

SEQ ID NO: 6407636 - DNA, 16 bp, Homo sapiens
tagccaaaatgtgagt

SEQ ID NO: 6407637 - DNA, 23 bp, Homo sapiens
tagccaaaatgtgagtggttgaa

SEQ ID NO: 6407638 - DNA, 22 bp, Homo sapiens
tagccaaacaccactttgtaaa

SEQ ID NO: 6407639 - DNA, 13 bp, Homo sapiens
tagccaaacagga

SEQ ID NO: 6407640 - DNA, 17 bp, Homo sapiens
tagccaaacctcaccaa

SEQ ID NO: 6407641 - DNA, 11 bp, Homo sapiens
tagccaaagag

SEQ ID NO: 6407642 - DNA, 13 bp, Homo sapiens
tagccaaagattt

SEQ ID NO: 6407643 - DNA, 14 bp, Homo sapiens
tagccaacatagta

SEQ ID NO: 6407644 - DNA, 23 bp, Homo sapiens
tagccaacccaactgacttctgc

SEQ ID NO: 6407645 - DNA, 16 bp, Homo sapiens
tagccaactcctcctt

SEQ ID NO: 6407646 - DNA, 17 bp, Homo sapiens
tagccaacttaaacctg

SEQ ID NO: 6407647 - DNA, 12 bp, Homo sapiens
tagccaaggcca

SEQ ID NO: 6407648 - DNA, 13 bp, Homo sapiens
tagccaaggccaa

SEQ ID NO: 6407649 - DNA, 23 bp, Homo sapiens
tagccaaggtgggctgagccctg

SEQ ID NO: 6407650 - DNA, 16 bp, Homo sapiens
tagccaagtagctttg

SEQ ID NO: 6407651 - DNA, 18 bp, Homo sapiens
tagccaatatttttctta

SEQ ID NO: 6407652 - DNA, 13 bp, Homo sapiens
tagccacaggagc

SEQ ID NO: 6407653 - DNA, 20 bp, Homo sapiens
tagccacatttggaatactt

SEQ ID NO: 6407654 - DNA, 21 bp, Homo sapiens
tagccacatttggaatacttt

SEQ ID NO: 6407655 - DNA, 22 bp, Homo sapiens
tagccaccaactcttgcaggtc

SEQ ID NO: 6407656 - DNA, 20 bp, Homo sapiens
tagccaccagtgtcctccaa

SEQ ID NO: 6407657 - DNA, 14 bp, Homo sapiens
tagccaccatcttt

SEQ ID NO: 6407658 - DNA, 18 bp, Homo sapiens
tagccaccgcctcctaca

SEQ ID NO: 6407659 - DNA, 19 bp, Homo sapiens
tagccaccgcctcctacag

SEQ ID NO: 6407660 - DNA, 19 bp, Homo sapiens
tagccacctcccaccccac

SEQ ID NO: 6407661 - DNA, 16 bp, Homo sapiens
tagccacctccttggc

SEQ ID NO: 6407662 - DNA, 14 bp, Homo sapiens
tagccacctgagtt

SEQ ID NO: 6407663 - DNA, 17 bp, Homo sapiens
tagccacctgagttcct

SEQ ID NO: 6407664 - DNA, 14 bp, Homo sapiens
tagccactcaggag

SEQ ID NO: 6407665 - DNA, 16 bp, Homo sapiens
tagccactccctccca

SEQ ID NO: 6407666 - DNA, 16 bp, Homo sapiens
tagccactcctgccag

SEQ ID NO: 6407667 - DNA, 14 bp, Homo sapiens
tagccactggaaat

SEQ ID NO: 6407668 - DNA, 22 bp, Homo sapiens
tagccacttaccttcaataaag

SEQ ID NO: 6407669 - DNA, 17 bp, Homo sapiens
tagccacttagacactt

SEQ ID NO: 6407670 - DNA, 14 bp, Homo sapiens
tagccagaatgttt

SEQ ID NO: 6407671 - DNA, 15 bp, Homo sapiens
tagccagaatgtttc

SEQ ID NO: 6407672 - DNA, 23 bp, Homo sapiens
tagccagaatgtttcctgtggaa

SEQ ID NO: 6407673 - DNA, 13 bp, Homo sapiens
tagccagaattct

SEQ ID NO: 6407674 - DNA, 20 bp, Homo sapiens
tagccagacaaaatttgaga

SEQ ID NO: 6407675 - DNA, 21 bp, Homo sapiens
tagccagacaaaatttgagaa

SEQ ID NO: 6407676 - DNA, 20 bp, Homo sapiens
tagccagacacgttctgatt

SEQ ID NO: 6407677 - DNA, 14 bp, Homo sapiens
tagccagacactct

SEQ ID NO: 6407678 - DNA, 15 bp, Homo sapiens
tagccagacactctg

SEQ ID NO: 6407679 - DNA, 16 bp, Homo sapiens
tagccagacactctgc

SEQ ID NO: 6407680 - DNA, 19 bp, Homo sapiens
tagccagagaggagcacct

SEQ ID NO: 6407681 - DNA, 24 bp, Homo sapiens
tagccagagcccttcactgccatg

SEQ ID NO: 6407682 - DNA, 15 bp, Homo sapiens
tagccagaggagaga

SEQ ID NO: 6407683 - DNA, 14 bp, Homo sapiens
tagccagaggctgg

SEQ ID NO: 6407684 - DNA, 14 bp, Homo sapiens
tccagattctgatg

SEQ ID NO: 6407685 - DNA, 15 bp, Homo sapiens
tccagattctgatgc

SEQ ID NO: 6407686 - DNA, 17 bp, Homo sapiens
tccagattctgatgcat

SEQ ID NO: 6407687 - DNA, 18 bp, Homo sapiens
tccagattctgatgcata

SEQ ID NO: 6407688 - DNA, 17 bp, Homo sapiens
tccagattgacgacaag

SEQ ID NO: 6407689 - DNA, 17 bp, Homo sapiens
tccagattgggggccct

SEQ ID NO: 6407690 - DNA, 13 bp, Homo sapiens
tccagattgtagc

SEQ ID NO: 6407691 - DNA, 14 bp, Homo sapiens
tccagattgtagct

SEQ ID NO: 6407692 - DNA, 18 bp, Homo sapiens
tccagatttacactggga

SEQ ID NO: 6407693 - DNA, 20 bp, Homo sapiens
tccagatttacactgggaga

SEQ ID NO: 6407694 - DNA, 19 bp, Homo sapiens
tccagatttttcggaggcc

SEQ ID NO: 6407695 - DNA, 22 bp, Homo sapiens
tccagcaaaatccaaactgctg

SEQ ID NO: 6407696 - DNA, 21 bp, Homo sapiens
tccagcaaaatggaagcaaag

SEQ ID NO: 6407697 - DNA, 21 bp, Homo sapiens
tccagcaaataaagcagtcat

SEQ ID NO: 6407698 - DNA, 17 bp, Homo sapiens
tccagcaacacagcctg

SEQ ID NO: 6407699 - DNA, 21 bp, Homo sapiens
tccagcaacacagcctgggcc

SEQ ID NO: 6407700 - DNA, 22 bp, Homo sapiens
tccagcaacacagcctgggccc

SEQ ID NO: 6407701 - DNA, 17 bp, Homo sapiens
tccagcaactgcccttc

SEQ ID NO: 6407702 - DNA, 18 bp, Homo sapiens
tccagcaacttcttctcc

SEQ ID NO: 6407703 - DNA, 19 bp, Homo sapiens
tccagcaacttcttctcca

SEQ ID NO: 6407704 - DNA, 20 bp, Homo sapiens
tccagcaacttcttctccat

SEQ ID NO: 6407705 - DNA, 21 bp, Homo sapiens
tccagcaagaccaaatcattg

SEQ ID NO: 6407706 - DNA, 23 bp, Homo sapiens
tccagcaagcagtctaccctgtc

SEQ ID NO: 6407707 - DNA, 14 bp, Homo sapiens
tccagcaatgcctg

SEQ ID NO: 6407708 - DNA, 22 bp, Homo sapiens
tccagcaattctcctgcctcag

SEQ ID NO: 6407709 - DNA, 14 bp, Homo sapiens
tccagcacaaacac

SEQ ID NO: 6407710 - DNA, 15 bp, Homo sapiens
tccagcacaaacaca

SEQ ID NO: 6407711 - DNA, 17 bp, Homo sapiens
tccagcacaaacacaag

SEQ ID NO: 6407712 - DNA, 21 bp, Homo sapiens
tccagcacaaccttcaagctg

SEQ ID NO: 6407713 - DNA, 20 bp, Homo sapiens
tccagcacaactcagtctgt

SEQ ID NO: 6407714 - DNA, 21 bp, Homo sapiens
tccagcacaactcagtctgtg

SEQ ID NO: 6407715 - DNA, 20 bp, Homo sapiens
tccagcacctgtggctgacg

SEQ ID NO: 6407716 - DNA, 13 bp, Homo sapiens
tccagcaccttct

SEQ ID NO: 6407717 - DNA, 18 bp, Homo sapiens
tccagcaccttctttctg

SEQ ID NO: 6407718 - DNA, 20 bp, Homo sapiens
tccagcaccttctttctgga

SEQ ID NO: 6407719 - DNA, 21 bp, Homo sapiens
tccagcaccttgtgcctgggg

SEQ ID NO: 6407720 - DNA, 22 bp, Homo sapiens
tccagcaccttgtgcctggggt

SEQ ID NO: 6407721 - DNA, 16 bp, Homo sapiens
tccagcacctttgtaa

SEQ ID NO: 6407722 - DNA, 16 bp, Homo sapiens
tccagcactcaataaa

SEQ ID NO: 6407723 - DNA, 20 bp, Homo sapiens
tccagcactcgattgttgta

SEQ ID NO: 6407724 - DNA, 12 bp, Homo sapiens
tccagcactggt

SEQ ID NO: 6407725 - DNA, 14 bp, Homo sapiens
tccagcagataagg

SEQ ID NO: 6407726 - DNA, 15 bp, Homo sapiens
tccagcagattattc

SEQ ID NO: 6407727 - DNA, 17 bp, Homo sapiens
tccagcagattattcac

SEQ ID NO: 6407728 - DNA, 16 bp, Homo sapiens
tccagcagcagcactt

SEQ ID NO: 6407729 - DNA, 21 bp, Homo sapiens
tccagcagcagcacttagacc

SEQ ID NO: 6407730 - DNA, 22 bp, Homo sapiens
tccagcaggcccatgggaggct

SEQ ID NO: 6407731 - DNA, 20 bp, Homo sapiens
tccagcaggggtctcccaac

SEQ ID NO: 6407732 - DNA, 21 bp, Homo sapiens
tccagcaggtaggggcacagt

SEQ ID NO: 6407733 - DNA, 19 bp, Homo sapiens
tccagcaggtgttttcctt

SEQ ID NO: 6407734 - DNA, 13 bp, Homo sapiens
tccagcagtcagt

SEQ ID NO: 6407735 - DNA, 17 bp, Homo sapiens
tccagcagtctctgcct

SEQ ID NO: 6407736 - DNA, 20 bp, Homo sapiens
tccagcagtctctgccttgc

SEQ ID NO: 6407737 - DNA, 17 bp, Homo sapiens
tccagcagtgctgggcc

SEQ ID NO: 6407738 - DNA, 23 bp, Homo sapiens
tccagcagtgctgggcccagccg

SEQ ID NO: 6407739 - DNA, 13 bp, Homo sapiens
tccagcagtgttg

SEQ ID NO: 6407740 - DNA, 14 bp, Homo sapiens
tccagcagttttca

SEQ ID NO: 6407741 - DNA, 14 bp, Homo sapiens
tccagcatccagcc

SEQ ID NO: 6407742 - DNA, 19 bp, Homo sapiens
tccagcatccagcctgtgt

SEQ ID NO: 6407743 - DNA, 12 bp, Homo sapiens
tccagcatccca

SEQ ID NO: 6407744 - DNA, 15 bp, Homo sapiens
tccagcatcccagcc

SEQ ID NO: 6407745 - DNA, 16 bp, Homo sapiens
tccagcatcccagcct

SEQ ID NO: 6407746 - DNA, 18 bp, Homo sapiens
tccagcatcccagcctca

SEQ ID NO: 6407747 - DNA, 19 bp, Homo sapiens
tccagcatcccagcctcag

SEQ ID NO: 6407748 - DNA, 22 bp, Homo sapiens
tccagcatcctgattaaatgtc

SEQ ID NO: 6407749 - DNA, 14 bp, Homo sapiens
tccagcatcttttc

SEQ ID NO: 6407750 - DNA, 22 bp, Homo sapiens
tccagcatcttttccatcctga

SEQ ID NO: 6407751 - DNA, 12 bp, Homo sapiens
tccagcatgtgt

SEQ ID NO: 6407752 - DNA, 14 bp, Homo sapiens
tccagcatgtgtgt

SEQ ID NO: 6407753 - DNA, 15 bp, Homo sapiens
tccagcatgtgtgtg

SEQ ID NO: 6407754 - DNA, 16 bp, Homo sapiens
tccagcatgtgtgtgt

SEQ ID NO: 6407755 - DNA, 20 bp, Homo sapiens
tccagcattctcagccacaa

SEQ ID NO: 6407756 - DNA, 22 bp, Homo sapiens
tccagcattctcagccacaacc

SEQ ID NO: 6407757 - DNA, 20 bp, Homo sapiens
tccagcatttagctggccac

SEQ ID NO: 6407758 - DNA, 13 bp, Homo sapiens
tccagcatttgcc

SEQ ID NO: 6407759 - DNA, 22 bp, Homo sapiens
tccagcatttgccattcctgga

SEQ ID NO: 6407760 - DNA, 23 bp, Homo sapiens
tccagccaaacgggagcttttgg

SEQ ID NO: 6407761 - DNA, 21 bp, Homo sapiens
tccagccaaagaaatgggcct

SEQ ID NO: 6407762 - DNA, 23 bp, Homo sapiens
tccagccaaagaaatgggcctgc

SEQ ID NO: 6407763 - DNA, 13 bp, Homo sapiens
tccagccaacccc

SEQ ID NO: 6407764 - DNA, 16 bp, Homo sapiens
tccagccaccaaggct

SEQ ID NO: 6407765 - DNA, 19 bp, Homo sapiens
tccagccacccagccagga

SEQ ID NO: 6407766 - DNA, 12 bp, Homo sapiens
tccagccacccc

SEQ ID NO: 6407767 - DNA, 17 bp, Homo sapiens
tccagccaccccgcagt

SEQ ID NO: 6407768 - DNA, 21 bp, Homo sapiens
tccagccaccccgcagtcact

SEQ ID NO: 6407769 - DNA, 10 bp, Homo sapiens
tccagccact

SEQ ID NO: 6407770 - DNA, 14 bp, Homo sapiens
tccagccagcgcct

SEQ ID NO: 6407771 - DNA, 23 bp, Homo sapiens
tccagccagcgcctccctccacc

SEQ ID NO: 6407772 - DNA, 18 bp, Homo sapiens
tccagccagctcctgcac

SEQ ID NO: 6407773 - DNA, 16 bp, Homo sapiens
tccagccagctcctgg

SEQ ID NO: 6407774 - DNA, 17 bp, Homo sapiens
tccagccaggcccaggc

SEQ ID NO: 6407775 - DNA, 18 bp, Homo sapiens
tccagccaggcccaggcc

SEQ ID NO: 6407776 - DNA, 20 bp, Homo sapiens
tccagccaggcccaggccag

SEQ ID NO: 6407777 - DNA, 23 bp, Homo sapiens
tccagccaggcccaggccagccc

SEQ ID NO: 6407778 - DNA, 20 bp, Homo sapiens
tccagccagggcaagagagc

SEQ ID NO: 6407779 - DNA, 14 bp, Homo sapiens
tccagccagggctg

SEQ ID NO: 6407780 - DNA, 19 bp, Homo sapiens
tccagccatcaagagactg

SEQ ID NO: 6407781 - DNA, 18 bp, Homo sapiens
tccagcccaaacctggga

SEQ ID NO: 6407782 - DNA, 19 bp, Homo sapiens
tccagcccaaacctgggaa

SEQ ID NO: 6407783 - DNA, 12 bp, Homo sapiens
tccagcccacac

SEQ ID NO: 6407784 - DNA, 22 bp, Homo sapiens
tccagcccacacccctccaaag

SEQ ID NO: 6407785 - DNA, 13 bp, Homo sapiens
tccagcccatcca

SEQ ID NO: 6407786 - DNA, 15 bp, Homo sapiens
tccagcccatgctgg

SEQ ID NO: 6407787 - DNA, 21 bp, Homo sapiens
tccagcccatgctggctgggg

SEQ ID NO: 6407788 - DNA, 16 bp, Homo sapiens
tccagccccccaggct

SEQ ID NO: 6407789 - DNA, 23 bp, Homo sapiens
tccagccccgcgaccatgtggcc

SEQ ID NO: 6407790 - DNA, 16 bp, Homo sapiens
tccagcccctcctccc

SEQ ID NO: 6407791 - DNA, 17 bp, Homo sapiens
tccagcccctcctccct

SEQ ID NO: 6407792 - DNA, 23 bp, Homo sapiens
tccagcccctcctccctcagacc

SEQ ID NO: 6407793 - DNA, 20 bp, Homo sapiens
tccagcccctcttggagaag

SEQ ID NO: 6407794 - DNA, 22 bp, Homo sapiens
tccagcccctggacccctgggg

SEQ ID NO: 6407795 - DNA, 15 bp, Homo sapiens
tccagcccctggatg

SEQ ID NO: 6407796 - DNA, 12 bp, Homo sapiens
tccagcccctgt

SEQ ID NO: 6407797 - DNA, 15 bp, Homo sapiens
tccagcccctgtccc

SEQ ID NO: 6407798 - DNA, 16 bp, Homo sapiens
tccagcccctgtccca

SEQ ID NO: 6407799 - DNA, 20 bp, Homo sapiens
tccagcccctgtcccacccc

SEQ ID NO: 6407800 - DNA, 19 bp, Homo sapiens
tccagcccctttgcctctg

SEQ ID NO: 6407801 - DNA, 22 bp, Homo sapiens
tccagcccgagtggtctcctct

SEQ ID NO: 6407802 - DNA, 15 bp, Homo sapiens
tccagcccgggagcc

SEQ ID NO: 6407803 - DNA, 21 bp, Homo sapiens
tccagcccgggagcctaggac

SEQ ID NO: 6407804 - DNA, 15 bp, Homo sapiens
tccagccctgactaa

SEQ ID NO: 6407805 - DNA, 22 bp, Homo sapiens
tccagccctgagttcctagcca

SEQ ID NO: 6407806 - DNA, 13 bp, Homo sapiens
tccagccctgccc

SEQ ID NO: 6407807 - DNA, 15 bp, Homo sapiens
tccagccctgcccac

SEQ ID NO: 6407808 - DNA, 20 bp, Homo sapiens
tccagccctggctgaaggac

SEQ ID NO: 6407809 - DNA, 14 bp, Homo sapiens
tccagccctgggca

SEQ ID NO: 6407810 - DNA, 14 bp, Homo sapiens
tccagccctggtgc

SEQ ID NO: 6407811 - DNA, 18 bp, Homo sapiens
tccagccctgtcccctga

SEQ ID NO: 6407812 - DNA, 18 bp, Homo sapiens
tccagccgaagtctgtgg

SEQ ID NO: 6407813 - DNA, 16 bp, Homo sapiens
tccagccgccattgcc

SEQ ID NO: 6407814 - DNA, 19 bp, Homo sapiens
tccagccgccattgccacc

SEQ ID NO: 6407815 - DNA, 17 bp, Homo sapiens
tccagccgtgtgtgcat

SEQ ID NO: 6407816 - DNA, 18 bp, Homo sapiens
tccagcctcacagatgct

SEQ ID NO: 6407817 - DNA, 20 bp, Homo sapiens
tccagcctcacagatgctgg

SEQ ID NO: 6407818 - DNA, 22 bp, Homo sapiens
tccagcctcacagatgctggcc

SEQ ID NO: 6407819 - DNA, 14 bp, Homo sapiens
tccagcctcagaga

SEQ ID NO: 6407820 - DNA, 23 bp, Homo sapiens
tccagcctcatgggaagtcctgg

SEQ ID NO: 6407821 - DNA, 15 bp, Homo sapiens
tccagcctccagggc

SEQ ID NO: 6407822 - DNA, 18 bp, Homo sapiens
tccagcctccagggcatt

SEQ ID NO: 6407823 - DNA, 12 bp, Homo sapiens
tccagcctcccc

SEQ ID NO: 6407824 - DNA, 13 bp, Homo sapiens
tccagcctcccca

SEQ ID NO: 6407825 - DNA, 16 bp, Homo sapiens
tccagcctccctgtct

SEQ ID NO: 6407826 - DNA, 17 bp, Homo sapiens
tccagcctccctgtctc

SEQ ID NO: 6407827 - DNA, 21 bp, Homo sapiens
tccagcctccctgtctccagc

SEQ ID NO: 6407828 - DNA, 15 bp, Homo sapiens
tccagcctctcccct

SEQ ID NO: 6407829 - DNA, 14 bp, Homo sapiens
tccagcctctgccg

SEQ ID NO: 6407830 - DNA, 15 bp, Homo sapiens
tccagcctctgccgc

SEQ ID NO: 6407831 - DNA, 17 bp, Homo sapiens
tccagcctctgccgctg

SEQ ID NO: 6407832 - DNA, 21 bp, Homo sapiens
tccagcctgagcgacagtgag

SEQ ID NO: 6407833 - DNA, 16 bp, Homo sapiens
tccagcctgagtgaca

SEQ ID NO: 6407834 - DNA, 17 bp, Homo sapiens
tccagcctgagtgacag

SEQ ID NO: 6407835 - DNA, 22 bp, Homo sapiens
tccagcctgagtgacagagcga

SEQ ID NO: 6407836 - DNA, 19 bp, Homo sapiens
tccagcctggacccccagc

SEQ ID NO: 6407837 - DNA, 14 bp, Homo sapiens
tccagcctggagat

SEQ ID NO: 6407838 - DNA, 12 bp, Homo sapiens
tccagcctggct

SEQ ID NO: 6407839 - DNA, 18 bp, Homo sapiens
tccagcctgggacacaca

SEQ ID NO: 6407840 - DNA, 13 bp, Homo sapiens
tccagcctgggag

SEQ ID NO: 6407841 - DNA, 22 bp, Homo sapiens
tccagcctgggcaacgagtgaa

SEQ ID NO: 6407842 - DNA, 21 bp, Homo sapiens
tccagcctgggggacagagca

SEQ ID NO: 6407843 - DNA, 19 bp, Homo sapiens
tccagcctggggtgataga

SEQ ID NO: 6407844 - DNA, 12 bp, Homo sapiens
tccagcctgggt

SEQ ID NO: 6407845 - DNA, 22 bp, Homo sapiens
tccagcctgggtcacagagtga

SEQ ID NO: 6407846 - DNA, 24 bp, Homo sapiens
tccagcctgggtcacagagtgaga

SEQ ID NO: 6407847 - DNA, 13 bp, Homo sapiens
tccagcctgggtg

SEQ ID NO: 6407848 - DNA, 11 bp, Homo sapiens
tccagcctggt

SEQ ID NO: 6407849 - DNA, 14 bp, Homo sapiens
tccagcctggtggc

SEQ ID NO: 6407850 - DNA, 18 bp, Homo sapiens
tccagcctggtggcccag

SEQ ID NO: 6407851 - DNA, 19 bp, Homo sapiens
tccagcctggtggcccagc

SEQ ID NO: 6407852 - DNA, 23 bp, Homo sapiens
tccagcctggtggcccagctatt

SEQ ID NO: 6407853 - DNA, 13 bp, Homo sapiens
tccagcctgtgtg

SEQ ID NO: 6407854 - DNA, 15 bp, Homo sapiens
tccagccttctctca

SEQ ID NO: 6407855 - DNA, 18 bp, Homo sapiens
tccagccttctctctctg

SEQ ID NO: 6407856 - DNA, 19 bp, Homo sapiens
tccagccttctctctctgg

SEQ ID NO: 6407857 - DNA, 23 bp, Homo sapiens
tccagcctttgctccctccccgc

SEQ ID NO: 6407858 - DNA, 12 bp, Homo sapiens
tccagccttttt

SEQ ID NO: 6407859 - DNA, 22 bp, Homo sapiens
tccagcgagagagtttcaaaag

SEQ ID NO: 6407860 - DNA, 15 bp, Homo sapiens
tccagcgagtacccc

SEQ ID NO: 6407861 - DNA, 22 bp, Homo sapiens
tccagcgatctctccactgtgc

SEQ ID NO: 6407862 - DNA, 21 bp, Homo sapiens
tccagcgggccctctgccgac

SEQ ID NO: 6407863 - DNA, 20 bp, Homo sapiens
tccagcggggcttctgggcg

SEQ ID NO: 6407864 - DNA, 23 bp, Homo sapiens
tccagcggttgccttttttatca

SEQ ID NO: 6407865 - DNA, 21 bp, Homo sapiens
tccagcgtcactccagtgctc

SEQ ID NO: 6407866 - DNA, 16 bp, Homo sapiens
tccagcgtcctcagca

SEQ ID NO: 6407867 - DNA, 14 bp, Homo sapiens
tccagcgtctctcc

SEQ ID NO: 6407868 - DNA, 15 bp, Homo sapiens
tccagcgtctgctgt

SEQ ID NO: 6407869 - DNA, 17 bp, Homo sapiens
tccagcgtctgctgttg

SEQ ID NO: 6407870 - DNA, 19 bp, Homo sapiens
tccagcgtctgctgttgat

SEQ ID NO: 6407871 - DNA, 16 bp, Homo sapiens
tccagcgtgcaccccg

SEQ ID NO: 6407872 - DNA, 17 bp, Homo sapiens
tccagcgtgcaccccgc

SEQ ID NO: 6407873 - DNA, 20 bp, Homo sapiens
tccagcgtgcaccccgccgg

SEQ ID NO: 6407874 - DNA, 21 bp, Homo sapiens
tccagctaaacaccaacccct

SEQ ID NO: 6407875 - DNA, 19 bp, Homo sapiens
tccagctaagcctgatgat

SEQ ID NO: 6407876 - DNA, 13 bp, Homo sapiens
tccagctaattca

SEQ ID NO: 6407877 - DNA, 19 bp, Homo sapiens
tccagctacttagctggcc

SEQ ID NO: 6407878 - DNA, 22 bp, Homo sapiens
tccagctagccaactcctcctt

SEQ ID NO: 6407879 - DNA, 15 bp, Homo sapiens
tccagctagtgaccc

SEQ ID NO: 6407880 - DNA, 23 bp, Homo sapiens
tccagctagtgccaaataattga

SEQ ID NO: 6407881 - DNA, 23 bp, Homo sapiens
tccagctcaccagccccagtgcc

SEQ ID NO: 6407882 - DNA, 14 bp, Homo sapiens
tccagctcagccct

SEQ ID NO: 6407883 - DNA, 15 bp, Homo sapiens
tccagctcagccctg

SEQ ID NO: 6407884 - DNA, 16 bp, Homo sapiens
tccagctcagccctgg

SEQ ID NO: 6407885 - DNA, 21 bp, Homo sapiens
tccagctcagccctggcctgg

SEQ ID NO: 6407886 - DNA, 17 bp, Homo sapiens
tccagctcagtcccaca

SEQ ID NO: 6407887 - DNA, 20 bp, Homo sapiens
tccagctcagtcccacagcc

SEQ ID NO: 6407888 - DNA, 18 bp, Homo sapiens
tccagctccaacctgcaa

SEQ ID NO: 6407889 - DNA, 13 bp, Homo sapiens
tccagctccagtt

SEQ ID NO: 6407890 - DNA, 13 bp, Homo sapiens
tccagctccccag

SEQ ID NO: 6407891 - DNA, 18 bp, Homo sapiens
tccagctcccgctgtggc

SEQ ID NO: 6407892 - DNA, 16 bp, Homo sapiens
tccagctccctagact

SEQ ID NO: 6407893 - DNA, 17 bp, Homo sapiens
tccagctccctcccctg

SEQ ID NO: 6407894 - DNA, 19 bp, Homo sapiens
tccagctccctgtgccccc

SEQ ID NO: 6407895 - DNA, 23 bp, Homo sapiens
tccagctccctgtgcccccaggg

SEQ ID NO: 6407896 - DNA, 18 bp, Homo sapiens
tccagctcctcatccagg

SEQ ID NO: 6407897 - DNA, 21 bp, Homo sapiens
tccagctcctccgtgcttcct

SEQ ID NO: 6407898 - DNA, 16 bp, Homo sapiens
tccagctcctctccag

SEQ ID NO: 6407899 - DNA, 16 bp, Homo sapiens
tccagctcctgccccg

SEQ ID NO: 6407900 - DNA, 14 bp, Homo sapiens
tccagctcctttgg

SEQ ID NO: 6407901 - DNA, 15 bp, Homo sapiens
tccagctcctttggg

SEQ ID NO: 6407902 - DNA, 16 bp, Homo sapiens
tccagctcctttgggc

SEQ ID NO: 6407903 - DNA, 17 bp, Homo sapiens
tccagctctcccatgga

SEQ ID NO: 6407904 - DNA, 23 bp, Homo sapiens
tccagctctcccatggagcccct

SEQ ID NO: 6407905 - DNA, 15 bp, Homo sapiens
tccagctctgacatc

SEQ ID NO: 6407906 - DNA, 17 bp, Homo sapiens
tccagctctgacatccc

SEQ ID NO: 6407907 - DNA, 21 bp, Homo sapiens
tccagctctgacatcccttcc

SEQ ID NO: 6407908 - DNA, 16 bp, Homo sapiens
tccagctctgcccccg

SEQ ID NO: 6407909 - DNA, 13 bp, Homo sapiens
tccagctctggag

SEQ ID NO: 6407910 - DNA, 15 bp, Homo sapiens
tccagctctggcaca

SEQ ID NO: 6407911 - DNA, 14 bp, Homo sapiens
tccagctctgtggg

SEQ ID NO: 6407912 - DNA, 15 bp, Homo sapiens
tccagctctgtgggc

SEQ ID NO: 6407913 - DNA, 10 bp, Homo sapiens
tccagctctt

SEQ ID NO: 6407914 - DNA, 13 bp, Homo sapiens
tccagctcttggc

SEQ ID NO: 6407915 - DNA, 14 bp, Homo sapiens
tccagctcttggcc

SEQ ID NO: 6407916 - DNA, 20 bp, Homo sapiens
tccagctcttggcccctgtg

SEQ ID NO: 6407917 - DNA, 16 bp, Homo sapiens
tccagctctttagaat

SEQ ID NO: 6407918 - DNA, 15 bp, Homo sapiens
tccagctctttcctc

SEQ ID NO: 6407919 - DNA, 17 bp, Homo sapiens
tccagctgacagccaca

SEQ ID NO: 6407920 - DNA, 19 bp, Homo sapiens
tccagctgagtcctggggt

SEQ ID NO: 6407921 - DNA, 21 bp, Homo sapiens
tccagctgagtcctggggttg

SEQ ID NO: 6407922 - DNA, 14 bp, Homo sapiens
tccagctgcaccag

SEQ ID NO: 6407923 - DNA, 11 bp, Homo sapiens
tccagctgcca

SEQ ID NO: 6407924 - DNA, 22 bp, Homo sapiens
tccagctgccaagtgctctttg

SEQ ID NO: 6407925 - DNA, 12 bp, Homo sapiens
tccagctgcccc

SEQ ID NO: 6407926 - DNA, 16 bp, Homo sapiens
tccagctgccccgggg

SEQ ID NO: 6407927 - DNA, 13 bp, Homo sapiens
tccagctgcccct

SEQ ID NO: 6407928 - DNA, 16 bp, Homo sapiens
tccagctgcccctccc

SEQ ID NO: 6407929 - DNA, 20 bp, Homo sapiens
tccagctgcccctccctcag

SEQ ID NO: 6407930 - DNA, 15 bp, Homo sapiens
tccagctgctgtctt

SEQ ID NO: 6407931 - DNA, 19 bp, Homo sapiens
tccagctggaattgctgct

SEQ ID NO: 6407932 - DNA, 20 bp, Homo sapiens
tccagctggaattgctgctc

SEQ ID NO: 6407933 - DNA, 18 bp, Homo sapiens
tccagctgggaagccctt

SEQ ID NO: 6407934 - DNA, 19 bp, Homo sapiens
tccagctgggaagcccttt

SEQ ID NO: 6407935 - DNA, 16 bp, Homo sapiens
tccagctgggacctaa

SEQ ID NO: 6407936 - DNA, 13 bp, Homo sapiens
tccagctgggcct

SEQ ID NO: 6407937 - DNA, 15 bp, Homo sapiens
tccagctgggcctcc

SEQ ID NO: 6407938 - DNA, 17 bp, Homo sapiens
tccagctgggcctcctg

SEQ ID NO: 6407939 - DNA, 20 bp, Homo sapiens
tccagctgggcctcctgcct

SEQ ID NO: 6407940 - DNA, 19 bp, Homo sapiens
tccagctggggccagaggc

SEQ ID NO: 6407941 - DNA, 13 bp, Homo sapiens
tccagctggtgcc

SEQ ID NO: 6407942 - DNA, 14 bp, Homo sapiens
tccagctggtgccc

SEQ ID NO: 6407943 - DNA, 17 bp, Homo sapiens
tccagctgtcagcctgg

SEQ ID NO: 6407944 - DNA, 15 bp, Homo sapiens
tccagctgtgcagca

SEQ ID NO: 6407945 - DNA, 19 bp, Homo sapiens
tccagctgtgcagcacgtc

SEQ ID NO: 6407946 - DNA, 14 bp, Homo sapiens
tccagctgtgtgtt

SEQ ID NO: 6407947 - DNA, 20 bp, Homo sapiens
tccagctgttgagcccctcc

SEQ ID NO: 6407948 - DNA, 20 bp, Homo sapiens
tccagcttcactgtcatgtg

SEQ ID NO: 6407949 - DNA, 16 bp, Homo sapiens
tccagcttcagctcaa

SEQ ID NO: 6407950 - DNA, 17 bp, Homo sapiens
tccagcttcaggcacca

SEQ ID NO: 6407951 - DNA, 22 bp, Homo sapiens
tccagcttcaggcaccagcatc

SEQ ID NO: 6407952 - DNA, 13 bp, Homo sapiens
tccagcttccaaa

SEQ ID NO: 6407953 - DNA, 11 bp, Homo sapiens
tccagcttccc

SEQ ID NO: 6407954 - DNA, 18 bp, Homo sapiens
tccagcttcctctgagcc

SEQ ID NO: 6407955 - DNA, 12 bp, Homo sapiens
tccagcttctca

SEQ ID NO: 6407956 - DNA, 14 bp, Homo sapiens
tccagcttctcagt

SEQ ID NO: 6407957 - DNA, 22 bp, Homo sapiens
tccagcttctcagtttctgcct

SEQ ID NO: 6407958 - DNA, 23 bp, Homo sapiens
tccagcttctcagtttctgcctg

SEQ ID NO: 6407959 - DNA, 20 bp, Homo sapiens
tccagcttctggtactctcc

SEQ ID NO: 6407960 - DNA, 23 bp, Homo sapiens
tccagcttctggtactctcctag

SEQ ID NO: 6407961 - DNA, 14 bp, Homo sapiens
tccagcttgaggga

SEQ ID NO: 6407962 - DNA, 17 bp, Homo sapiens
tccagcttgcattgatt

SEQ ID NO: 6407963 - DNA, 18 bp, Homo sapiens
tccagcttgcctgtttct

SEQ ID NO: 6407964 - DNA, 17 bp, Homo sapiens
tccagcttgctcttcag

SEQ ID NO: 6407965 - DNA, 16 bp, Homo sapiens
tccagcttgtggagcc

SEQ ID NO: 6407966 - DNA, 19 bp, Homo sapiens
tccagcttgtggagcccca

SEQ ID NO: 6407967 - DNA, 22 bp, Homo sapiens
tccagctttccttctgcccttc

SEQ ID NO: 6407968 - DNA, 19 bp, Homo sapiens
tccagctttctccccgcta

SEQ ID NO: 6407969 - DNA, 16 bp, Homo sapiens
tccagctttctgccat

SEQ ID NO: 6407970 - DNA, 19 bp, Homo sapiens
tccaggaaaactgggacat

SEQ ID NO: 6407971 - DNA, 21 bp, Homo sapiens
tccaggaaagatgtcccacag

SEQ ID NO: 6407972 - DNA, 16 bp, Homo sapiens
tccaggaaagtgtgaa

SEQ ID NO: 6407973 - DNA, 16 bp, Homo sapiens
tccaggaacacatgca

SEQ ID NO: 6407974 - DNA, 18 bp, Homo sapiens
tccaggaacacatgcaca

SEQ ID NO: 6407975 - DNA, 18 bp, Homo sapiens
tccaggaaccacaccaca

SEQ ID NO: 6407976 - DNA, 16 bp, Homo sapiens
tccaggaagcacaggc

SEQ ID NO: 6407977 - DNA, 15 bp, Homo sapiens
tccaggaaggcagct

SEQ ID NO: 6407978 - DNA, 20 bp, Homo sapiens
tccaggaaggcagctgctct

SEQ ID NO: 6407979 - DNA, 21 bp, Homo sapiens
tccaggaaggcagctgctctt

SEQ ID NO: 6407980 - DNA, 21 bp, Homo sapiens
tccaggaattcctcttttgct

SEQ ID NO: 6407981 - DNA, 22 bp, Homo sapiens
tccaggaattcctcttttgctt

SEQ ID NO: 6407982 - DNA, 22 bp, Homo sapiens
tccaggacacagattatcaact

SEQ ID NO: 6407983 - DNA, 18 bp, Homo sapiens
tccaggacaggagatgct

SEQ ID NO: 6407984 - DNA, 22 bp, Homo sapiens
tccaggacaggagatgctgtgc

SEQ ID NO: 6407985 - DNA, 15 bp, Homo sapiens
tccaggaccaggggc

SEQ ID NO: 6407986 - DNA, 15 bp, Homo sapiens
tccaggaccctgcca

SEQ ID NO: 6407987 - DNA, 19 bp, Homo sapiens
tccaggaccctgccaggca

SEQ ID NO: 6407988 - DNA, 23 bp, Homo sapiens
tccaggactatatttgggcctgc

SEQ ID NO: 6407989 - DNA, 12 bp, Homo sapiens
tccaggactcca

SEQ ID NO: 6407990 - DNA, 21 bp, Homo sapiens
tccaggactccactggacaga

SEQ ID NO: 6407991 - DNA, 14 bp, Homo sapiens
tccaggactctttg

SEQ ID NO: 6407992 - DNA, 16 bp, Homo sapiens
tccaggactctttgaa

SEQ ID NO: 6407993 - DNA, 20 bp, Homo sapiens
tccaggactgggtctgacct

SEQ ID NO: 6407994 - DNA, 21 bp, Homo sapiens
tccaggactgggtctgacctg

SEQ ID NO: 6407995 - DNA, 22 bp, Homo sapiens
tccaggactgtttcaaacatgc

SEQ ID NO: 6407996 - DNA, 17 bp, Homo sapiens
tccaggagaaagccggg

SEQ ID NO: 6407997 - DNA, 18 bp, Homo sapiens
tccaggagaagtgctccc

SEQ ID NO: 6407998 - DNA, 20 bp, Homo sapiens
tccaggagaagtgctccctg

SEQ ID NO: 6407999 - DNA, 21 bp, Homo sapiens
tccaggagaagtgctccctgg

SEQ ID NO: 6408000 - DNA, 23 bp, Homo sapiens
tccaggagaagtgctccctggag

SEQ ID NO: 6408001 - DNA, 17 bp, Homo sapiens
tccaggagacatatata

SEQ ID NO: 6408002 - DNA, 16 bp, Homo sapiens
tccaggagagagccag

SEQ ID NO: 6408003 - DNA, 17 bp, Homo sapiens
tccaggagagcctgggg

SEQ ID NO: 6408004 - DNA, 18 bp, Homo sapiens
tccaggagagcctggggg

SEQ ID NO: 6408005 - DNA, 16 bp, Homo sapiens
tccaggagatgaggct

SEQ ID NO: 6408006 - DNA, 21 bp, Homo sapiens
tccaggagcaatttgcacatg

SEQ ID NO: 6408007 - DNA, 12 bp, Homo sapiens
tccaggagcaca

SEQ ID NO: 6408008 - DNA, 20 bp, Homo sapiens
tccaggagcacacggccctg

SEQ ID NO: 6408009 - DNA, 13 bp, Homo sapiens
tccaggagcagcc

SEQ ID NO: 6408010 - DNA, 16 bp, Homo sapiens
tccaggagccccagcc

SEQ ID NO: 6408011 - DNA, 18 bp, Homo sapiens
tccaggagccccagccag

SEQ ID NO: 6408012 - DNA, 22 bp, Homo sapiens
tccaggagccccagccagccct

SEQ ID NO: 6408013 - DNA, 23 bp, Homo sapiens
tccaggagccccagccagccctt

SEQ ID NO: 6408014 - DNA, 14 bp, Homo sapiens
tccaggagccccgc

SEQ ID NO: 6408015 - DNA, 17 bp, Homo sapiens
tccaggagctaatctga

SEQ ID NO: 6408016 - DNA, 12 bp, Homo sapiens
tccaggagctca

SEQ ID NO: 6408017 - DNA, 23 bp, Homo sapiens
tccaggagctccagtgtcctgag

SEQ ID NO: 6408018 - DNA, 18 bp, Homo sapiens
tccaggaggactgttcta

SEQ ID NO: 6408019 - DNA, 21 bp, Homo sapiens
tccaggaggactgttctaact

SEQ ID NO: 6408020 - DNA, 22 bp, Homo sapiens
tccaggaggccggggggagcag

SEQ ID NO: 6408021 - DNA, 20 bp, Homo sapiens
tccaggaggccttattttga

SEQ ID NO: 6408022 - DNA, 21 bp, Homo sapiens
tccaggagggctaattagaaa

SEQ ID NO: 6408023 - DNA, 14 bp, Homo sapiens
tccaggagggctcg

SEQ ID NO: 6408024 - DNA, 13 bp, Homo sapiens
tccaggaggggcc

SEQ ID NO: 6408025 - DNA, 20 bp, Homo sapiens
tccaggaggggcctgggcag

SEQ ID NO: 6408026 - DNA, 21 bp, Homo sapiens
tccaggaggggcctgggcagc

SEQ ID NO: 6408027 - DNA, 18 bp, Homo sapiens
tccaggataaggagactg

SEQ ID NO: 6408028 - DNA, 20 bp, Homo sapiens
tccaggatcctcctggagca

SEQ ID NO: 6408029 - DNA, 14 bp, Homo sapiens
tccaggatcctgca

SEQ ID NO: 6408030 - DNA, 18 bp, Homo sapiens
tccaggatcctgcaggaa

SEQ ID NO: 6408031 - DNA, 20 bp, Homo sapiens
tccaggatctccactgataa

SEQ ID NO: 6408032 - DNA, 22 bp, Homo sapiens
tccaggatctccactgataaga

SEQ ID NO: 6408033 - DNA, 15 bp, Homo sapiens
tccaggatggagggt

SEQ ID NO: 6408034 - DNA, 15 bp, Homo sapiens
tccaggatggctgca

SEQ ID NO: 6408035 - DNA, 14 bp, Homo sapiens
tccaggatggggag

SEQ ID NO: 6408036 - DNA, 21 bp, Homo sapiens
tccaggatggggaggggctct

SEQ ID NO: 6408037 - DNA, 23 bp, Homo sapiens
tccaggatggtgttactgcagtt

SEQ ID NO: 6408038 - DNA, 19 bp, Homo sapiens
tccaggattgaagagcatt

SEQ ID NO: 6408039 - DNA, 19 bp, Homo sapiens
tccaggattggcctgtgtc

SEQ ID NO: 6408040 - DNA, 18 bp, Homo sapiens
tagccagagttgttctca

SEQ ID NO: 6408041 - DNA, 18 bp, Homo sapiens
tagccagcacacagggca

SEQ ID NO: 6408042 - DNA, 20 bp, Homo sapiens
tagccagcattcagcacaca

SEQ ID NO: 6408043 - DNA, 21 bp, Homo sapiens
tagccagcattcagcacacac

SEQ ID NO: 6408044 - DNA, 18 bp, Homo sapiens
tagccagcccctcttccc

SEQ ID NO: 6408045 - DNA, 18 bp, Homo sapiens
tagccagctgctccccag

SEQ ID NO: 6408046 - DNA, 17 bp, Homo sapiens
tagccaggagcgcatct

SEQ ID NO: 6408047 - DNA, 19 bp, Homo sapiens
tagccaggagcgcatctca

SEQ ID NO: 6408048 - DNA, 20 bp, Homo sapiens
tagccaggagtctgtgctct

SEQ ID NO: 6408049 - DNA, 15 bp, Homo sapiens
tagccaggatcatgg

SEQ ID NO: 6408050 - DNA, 23 bp, Homo sapiens
tagccaggatcatggtgtaataa

SEQ ID NO: 6408051 - DNA, 16 bp, Homo sapiens
tagccaggatggtctc

SEQ ID NO: 6408052 - DNA, 20 bp, Homo sapiens
tagccaggatggtcttgatc

SEQ ID NO: 6408053 - DNA, 21 bp, Homo sapiens
tagccaggtccccctgcagct

SEQ ID NO: 6408054 - DNA, 17 bp, Homo sapiens
tagccaggtctcctggg

SEQ ID NO: 6408055 - DNA, 19 bp, Homo sapiens
tagccaggtctcctgggaa

SEQ ID NO: 6408056 - DNA, 15 bp, Homo sapiens
tagccagtaatcctg

SEQ ID NO: 6408057 - DNA, 14 bp, Homo sapiens
tagccagtcatggt

SEQ ID NO: 6408058 - DNA, 20 bp, Homo sapiens
tagccagtgaaacacttgct

SEQ ID NO: 6408059 - DNA, 12 bp, Homo sapiens
tagccagtgact

SEQ ID NO: 6408060 - DNA, 14 bp, Homo sapiens
tagccagtgacttt

SEQ ID NO: 6408061 - DNA, 19 bp, Homo sapiens
tagccagttaaggaaagaa

SEQ ID NO: 6408062 - DNA, 16 bp, Homo sapiens
tagccagttcaaagtg

SEQ ID NO: 6408063 - DNA, 15 bp, Homo sapiens
tagccataaacctga

SEQ ID NO: 6408064 - DNA, 24 bp, Homo sapiens
tagccataattttgcatactgaaa

SEQ ID NO: 6408065 - DNA, 17 bp, Homo sapiens
tagccatatttgtaaaa

SEQ ID NO: 6408066 - DNA, 22 bp, Homo sapiens
tagccatatttgtaaaatgaca

SEQ ID NO: 6408067 - DNA, 23 bp, Homo sapiens
tagccatatttgtaaaatgacaa

SEQ ID NO: 6408068 - DNA, 13 bp, Homo sapiens
tagccatctcaag

SEQ ID NO: 6408069 - DNA, 11 bp, Homo sapiens
tagccatctgc

SEQ ID NO: 6408070 - DNA, 20 bp, Homo sapiens
tagccatgaggaggcagaga

SEQ ID NO: 6408071 - DNA, 18 bp, Homo sapiens
tagccatgatggcaacag

SEQ ID NO: 6408072 - DNA, 22 bp, Homo sapiens
tagccatgatttgtcccagcct

SEQ ID NO: 6408073 - DNA, 23 bp, Homo sapiens
tagccatgatttgtcccagcctg

SEQ ID NO: 6408074 - DNA, 15 bp, Homo sapiens
tagccatggctcagg

SEQ ID NO: 6408075 - DNA, 23 bp, Homo sapiens
tagccatggctcaggcaagcccc

SEQ ID NO: 6408076 - DNA, 20 bp, Homo sapiens
tagccatgtagtgctctcag

SEQ ID NO: 6408077 - DNA, 18 bp, Homo sapiens
tagccatgtgaaactcat

SEQ ID NO: 6408078 - DNA, 17 bp, Homo sapiens
tagccatgttaacatga

SEQ ID NO: 6408079 - DNA, 13 bp, Homo sapiens
tagccattcattt

SEQ ID NO: 6408080 - DNA, 16 bp, Homo sapiens
tagccattcatttaca

SEQ ID NO: 6408081 - DNA, 18 bp, Homo sapiens
tagccattcctggtaccc

SEQ ID NO: 6408082 - DNA, 17 bp, Homo sapiens
tagccattcttttccca

SEQ ID NO: 6408083 - DNA, 22 bp, Homo sapiens
tagccatttccatggctctgtt

SEQ ID NO: 6408084 - DNA, 16 bp, Homo sapiens
tagccatttgaagaag

SEQ ID NO: 6408085 - DNA, 17 bp, Homo sapiens
tagccattttgtaactg

SEQ ID NO: 6408086 - DNA, 16 bp, Homo sapiens
tagccatttttactgt

SEQ ID NO: 6408087 - DNA, 17 bp, Homo sapiens
tagccatttttactgtt

SEQ ID NO: 6408088 - DNA, 22 bp, Homo sapiens
tagccatttttcaaagcaattg

SEQ ID NO: 6408089 - DNA, 14 bp, Homo sapiens
tagcccaaaaccaa

SEQ ID NO: 6408090 - DNA, 12 bp, Homo sapiens
tagcccaaccta

SEQ ID NO: 6408091 - DNA, 19 bp, Homo sapiens
tagcccaacctacattcca

SEQ ID NO: 6408092 - DNA, 22 bp, Homo sapiens
tagcccaacctacattccaccc

SEQ ID NO: 6408093 - DNA, 18 bp, Homo sapiens
tagcccaatgaaatgaat

SEQ ID NO: 6408094 - DNA, 21 bp, Homo sapiens
tagcccacaataatgaataat

SEQ ID NO: 6408095 - DNA, 13 bp, Homo sapiens
tagcccacccccc

SEQ ID NO: 6408096 - DNA, 13 bp, Homo sapiens
tagcccaccctgc

SEQ ID NO: 6408097 - DNA, 18 bp, Homo sapiens
tagcccaccctgctgcct

SEQ ID NO: 6408098 - DNA, 16 bp, Homo sapiens
tagcccactccctgcc

SEQ ID NO: 6408099 - DNA, 15 bp, Homo sapiens
tagcccactctgctc

SEQ ID NO: 6408100 - DNA, 13 bp, Homo sapiens
tagcccagcactg

SEQ ID NO: 6408101 - DNA, 14 bp, Homo sapiens
tagcccagcactgt

SEQ ID NO: 6408102 - DNA, 16 bp, Homo sapiens
tagcccagcactgtga

SEQ ID NO: 6408103 - DNA, 20 bp, Homo sapiens
tagcccagcactgtgaagac

SEQ ID NO: 6408104 - DNA, 17 bp, Homo sapiens
tagcccagcgctctgcc

SEQ ID NO: 6408105 - DNA, 18 bp, Homo sapiens
tagcccagcgctctgcct

SEQ ID NO: 6408106 - DNA, 13 bp, Homo sapiens
tagcccaggagag

SEQ ID NO: 6408107 - DNA, 15 bp, Homo sapiens
tagcccaggagagag

SEQ ID NO: 6408108 - DNA, 16 bp, Homo sapiens
tagcccaggagagaga

SEQ ID NO: 6408109 - DNA, 22 bp, Homo sapiens
tagcccaggagagagaaagcca

SEQ ID NO: 6408110 - DNA, 13 bp, Homo sapiens
tagcccaggagca

SEQ ID NO: 6408111 - DNA, 21 bp, Homo sapiens
tagcccaggatatattttatt

SEQ ID NO: 6408112 - DNA, 19 bp, Homo sapiens
tagcccaggctggagtgca

SEQ ID NO: 6408113 - DNA, 19 bp, Homo sapiens
tagcccaggtcctctgata

SEQ ID NO: 6408114 - DNA, 19 bp, Homo sapiens
tagcccagtccctggagct

SEQ ID NO: 6408115 - DNA, 14 bp, Homo sapiens
tagcccagtgtttt

SEQ ID NO: 6408116 - DNA, 18 bp, Homo sapiens
tagcccataatctctttg

SEQ ID NO: 6408117 - DNA, 15 bp, Homo sapiens
tagcccatccctgcc

SEQ ID NO: 6408118 - DNA, 16 bp, Homo sapiens
tagcccatccctgcct

SEQ ID NO: 6408119 - DNA, 20 bp, Homo sapiens
tagcccatccctgcctggtc

SEQ ID NO: 6408120 - DNA, 18 bp, Homo sapiens
tagcccatcttcctgagc

SEQ ID NO: 6408121 - DNA, 19 bp, Homo sapiens
tagcccatcttcctgagct

SEQ ID NO: 6408122 - DNA, 20 bp, Homo sapiens
tagcccatcttcctgagcta

SEQ ID NO: 6408123 - DNA, 14 bp, Homo sapiens
tagccccactgctt

SEQ ID NO: 6408124 - DNA, 23 bp, Homo sapiens
tagccccagactgggcccaggca

SEQ ID NO: 6408125 - DNA, 12 bp, Homo sapiens
tagccccagaga

SEQ ID NO: 6408126 - DNA, 13 bp, Homo sapiens
tagccccataatt

SEQ ID NO: 6408127 - DNA, 21 bp, Homo sapiens
tagccccattgctccattcac

SEQ ID NO: 6408128 - DNA, 19 bp, Homo sapiens
tagcccccaggctgctgga

SEQ ID NO: 6408129 - DNA, 19 bp, Homo sapiens
tagccccgagacaccatcc

SEQ ID NO: 6408130 - DNA, 19 bp, Homo sapiens
tagccccgccccagccctc

SEQ ID NO: 6408131 - DNA, 20 bp, Homo sapiens
tagccccgccccagccctca

SEQ ID NO: 6408132 - DNA, 15 bp, Homo sapiens
tagccccggcccccc

SEQ ID NO: 6408133 - DNA, 17 bp, Homo sapiens
tagccccgggctgaccc

SEQ ID NO: 6408134 - DNA, 18 bp, Homo sapiens
tagcccctctctcacaca

SEQ ID NO: 6408135 - DNA, 12 bp, Homo sapiens
tagcccctctgg

SEQ ID NO: 6408136 - DNA, 22 bp, Homo sapiens
tagcccctggggtggccaccag

SEQ ID NO: 6408137 - DNA, 12 bp, Homo sapiens
tagcccctggtg

SEQ ID NO: 6408138 - DNA, 18 bp, Homo sapiens
tagccccttagcccccac

SEQ ID NO: 6408139 - DNA, 21 bp, Homo sapiens
tagccccttggattcctgcac

SEQ ID NO: 6408140 - DNA, 17 bp, Homo sapiens
tagccccttttctttgg

SEQ ID NO: 6408141 - DNA, 23 bp, Homo sapiens
tagcccgacagttctgaactgga

SEQ ID NO: 6408142 - DNA, 13 bp, Homo sapiens
tagcccgaggacc

SEQ ID NO: 6408143 - DNA, 14 bp, Homo sapiens
tagcccgcctgcca

SEQ ID NO: 6408144 - DNA, 14 bp, Homo sapiens
tagcccggtgcagc

SEQ ID NO: 6408145 - DNA, 18 bp, Homo sapiens
tagccctcaccctggggc

SEQ ID NO: 6408146 - DNA, 12 bp, Homo sapiens
tagccctcagcc

SEQ ID NO: 6408147 - DNA, 16 bp, Homo sapiens
tagccctcccactttg

SEQ ID NO: 6408148 - DNA, 16 bp, Homo sapiens
tagccctccccccagc

SEQ ID NO: 6408149 - DNA, 15 bp, Homo sapiens
tagccctccccctca

SEQ ID NO: 6408150 - DNA, 16 bp, Homo sapiens
tagccctccccctcaa

SEQ ID NO: 6408151 - DNA, 18 bp, Homo sapiens
tagccctccccctcaacc

SEQ ID NO: 6408152 - DNA, 16 bp, Homo sapiens
tagccctcctgagcac

SEQ ID NO: 6408153 - DNA, 18 bp, Homo sapiens
tagccctcctttttccaa

SEQ ID NO: 6408154 - DNA, 21 bp, Homo sapiens
tagccctctcatcgtctttta

SEQ ID NO: 6408155 - DNA, 15 bp, Homo sapiens
tagccctctccctct

SEQ ID NO: 6408156 - DNA, 19 bp, Homo sapiens
tagccctctttctctctgt

SEQ ID NO: 6408157 - DNA, 18 bp, Homo sapiens
tagccctggccagaggct

SEQ ID NO: 6408158 - DNA, 16 bp, Homo sapiens
tagccctggcccggtc

SEQ ID NO: 6408159 - DNA, 15 bp, Homo sapiens
tagccctgtcctggt

SEQ ID NO: 6408160 - DNA, 13 bp, Homo sapiens
tagccctgtgaag

SEQ ID NO: 6408161 - DNA, 14 bp, Homo sapiens
tagcccttccagcc

SEQ ID NO: 6408162 - DNA, 19 bp, Homo sapiens
tagcccttccagcctggga

SEQ ID NO: 6408163 - DNA, 20 bp, Homo sapiens
tagcccttccagcctgggac

SEQ ID NO: 6408164 - DNA, 21 bp, Homo sapiens
tagcccttccagcctgggaca

SEQ ID NO: 6408165 - DNA, 13 bp, Homo sapiens
tagccctttaaaa

SEQ ID NO: 6408166 - DNA, 17 bp, Homo sapiens
tagccctttccccactc

SEQ ID NO: 6408167 - DNA, 17 bp, Homo sapiens
tagccgactgcgctgct

SEQ ID NO: 6408168 - DNA, 14 bp, Homo sapiens
tagccgagagcctg

SEQ ID NO: 6408169 - DNA, 15 bp, Homo sapiens
tagccgagagcctgc

SEQ ID NO: 6408170 - DNA, 22 bp, Homo sapiens
tagccgatatcagaatttgtgt

SEQ ID NO: 6408171 - DNA, 13 bp, Homo sapiens
tagccgcaccctg

SEQ ID NO: 6408172 - DNA, 22 bp, Homo sapiens
tagccgcaccctgcacctgctg

SEQ ID NO: 6408173 - DNA, 14 bp, Homo sapiens
tagccgccctgaga

SEQ ID NO: 6408174 - DNA, 15 bp, Homo sapiens
tagccgccctgagag

SEQ ID NO: 6408175 - DNA, 18 bp, Homo sapiens
tagccgctgccctgggtc

SEQ ID NO: 6408176 - DNA, 16 bp, Homo sapiens
tagccggccactttgg

SEQ ID NO: 6408177 - DNA, 14 bp, Homo sapiens
tagccgggcatggt

SEQ ID NO: 6408178 - DNA, 17 bp, Homo sapiens
tagccgggctccaggga

SEQ ID NO: 6408179 - DNA, 21 bp, Homo sapiens
tagccggttcctgtccctgcg

SEQ ID NO: 6408180 - DNA, 15 bp, Homo sapiens
tagccgtccatggca

SEQ ID NO: 6408181 - DNA, 17 bp, Homo sapiens
tagccgtccatggcacc

SEQ ID NO: 6408182 - DNA, 18 bp, Homo sapiens
tagccgtccatggcacca

SEQ ID NO: 6408183 - DNA, 20 bp, Homo sapiens
tagccgtccatggcaccagc

SEQ ID NO: 6408184 - DNA, 13 bp, Homo sapiens
tagcctaaaagat

SEQ ID NO: 6408185 - DNA, 20 bp, Homo sapiens
tagcctaaagggcagggccc

SEQ ID NO: 6408186 - DNA, 20 bp, Homo sapiens
tagcctaacacactccaaga

SEQ ID NO: 6408187 - DNA, 22 bp, Homo sapiens
tagcctaagatatacttgtttt

SEQ ID NO: 6408188 - DNA, 22 bp, Homo sapiens
tagcctaagtgtggagaaggat

SEQ ID NO: 6408189 - DNA, 20 bp, Homo sapiens
tagcctaatacaacatgtag

SEQ ID NO: 6408190 - DNA, 22 bp, Homo sapiens
tagcctagaacaagccagagcc

SEQ ID NO: 6408191 - DNA, 19 bp, Homo sapiens
tagcctagctttctaaagc

SEQ ID NO: 6408192 - DNA, 14 bp, Homo sapiens
tagcctagggtgag

SEQ ID NO: 6408193 - DNA, 14 bp, Homo sapiens
tagcctatgtctgg

SEQ ID NO: 6408194 - DNA, 15 bp, Homo sapiens
tagcctatgtctggc

SEQ ID NO: 6408195 - DNA, 12 bp, Homo sapiens
tagcctattgtc

SEQ ID NO: 6408196 - DNA, 14 bp, Homo sapiens
tagcctattgtctt

SEQ ID NO: 6408197 - DNA, 21 bp, Homo sapiens
tagcctatttacctgcaggct

SEQ ID NO: 6408198 - DNA, 11 bp, Homo sapiens
tagcctcacgc

SEQ ID NO: 6408199 - DNA, 13 bp, Homo sapiens
tagcctcagccac

SEQ ID NO: 6408200 - DNA, 12 bp, Homo sapiens
tagcctcagggg

SEQ ID NO: 6408201 - DNA, 19 bp, Homo sapiens
tagcctcattttgtttttg

SEQ ID NO: 6408202 - DNA, 12 bp, Homo sapiens
tagcctccagct

SEQ ID NO: 6408203 - DNA, 13 bp, Homo sapiens
tagcctccctgaa

SEQ ID NO: 6408204 - DNA, 19 bp, Homo sapiens
tagcctcctcctgggctcc

SEQ ID NO: 6408205 - DNA, 15 bp, Homo sapiens
tagcctctccgccca

SEQ ID NO: 6408206 - DNA, 14 bp, Homo sapiens
tagcctctctttgt

SEQ ID NO: 6408207 - DNA, 13 bp, Homo sapiens
tagcctctggact

SEQ ID NO: 6408208 - DNA, 20 bp, Homo sapiens
tagcctctgggatctgccaa

SEQ ID NO: 6408209 - DNA, 22 bp, Homo sapiens
tagcctctgggatctgccaaca

SEQ ID NO: 6408210 - DNA, 21 bp, Homo sapiens
tagcctctgggttgttgtttt

SEQ ID NO: 6408211 - DNA, 19 bp, Homo sapiens
tagcctgaagagtttgtaa

SEQ ID NO: 6408212 - DNA, 12 bp, Homo sapiens
tagcctgaattt

SEQ ID NO: 6408213 - DNA, 15 bp, Homo sapiens
tagcctgcaaagctg

SEQ ID NO: 6408214 - DNA, 14 bp, Homo sapiens
tagcctgcactttg

SEQ ID NO: 6408215 - DNA, 23 bp, Homo sapiens
tagcctgcactttgatgtcatgt

SEQ ID NO: 6408216 - DNA, 10 bp, Homo sapiens
tagcctgcct

SEQ ID NO: 6408217 - DNA, 13 bp, Homo sapiens
tagcctgcctcag

SEQ ID NO: 6408218 - DNA, 21 bp, Homo sapiens
tagcctgcctcagtggcagca

SEQ ID NO: 6408219 - DNA, 11 bp, Homo sapiens
tagcctgctct

SEQ ID NO: 6408220 - DNA, 15 bp, Homo sapiens
tccaggatttataaa

SEQ ID NO: 6408221 - DNA, 20 bp, Homo sapiens
tccaggatttataaagcaaa

SEQ ID NO: 6408222 - DNA, 19 bp, Homo sapiens
tccaggattttaatttcag

SEQ ID NO: 6408223 - DNA, 21 bp, Homo sapiens
tccaggattttaatttcagga

SEQ ID NO: 6408224 - DNA, 23 bp, Homo sapiens
tccaggattttaatttcaggaaa

SEQ ID NO: 6408225 - DNA, 15 bp, Homo sapiens
tccaggcaaaaggag

SEQ ID NO: 6408226 - DNA, 16 bp, Homo sapiens
tccaggcacagctgag

SEQ ID NO: 6408227 - DNA, 22 bp, Homo sapiens
tccaggcacaggatgctgtgtt

SEQ ID NO: 6408228 - DNA, 15 bp, Homo sapiens
tccaggcaccatctc

SEQ ID NO: 6408229 - DNA, 19 bp, Homo sapiens
tccaggcaccctcagggag

SEQ ID NO: 6408230 - DNA, 16 bp, Homo sapiens
tccaggcactgagata

SEQ ID NO: 6408231 - DNA, 20 bp, Homo sapiens
tccaggcagatccaggacta

SEQ ID NO: 6408232 - DNA, 21 bp, Homo sapiens
tccaggcagatccaggactat

SEQ ID NO: 6408233 - DNA, 18 bp, Homo sapiens
tccaggcagctccctcct

SEQ ID NO: 6408234 - DNA, 19 bp, Homo sapiens
tccaggcagctccctcctg

SEQ ID NO: 6408235 - DNA, 22 bp, Homo sapiens
tccaggcaggaaaccccgagaa

SEQ ID NO: 6408236 - DNA, 21 bp, Homo sapiens
tccaggcaggacgagactcct

SEQ ID NO: 6408237 - DNA, 14 bp, Homo sapiens
tccaggcaggagga

SEQ ID NO: 6408238 - DNA, 15 bp, Homo sapiens
tccaggcaggccagg

SEQ ID NO: 6408239 - DNA, 16 bp, Homo sapiens
tccaggcaggccaggc

SEQ ID NO: 6408240 - DNA, 23 bp, Homo sapiens
tccaggcaggccaggctgcctcg

SEQ ID NO: 6408241 - DNA, 21 bp, Homo sapiens
tccaggcaggtctgaagctca

SEQ ID NO: 6408242 - DNA, 22 bp, Homo sapiens
tccaggcagtcgggggctggcc

SEQ ID NO: 6408243 - DNA, 16 bp, Homo sapiens
tccaggcatgaccctg

SEQ ID NO: 6408244 - DNA, 22 bp, Homo sapiens
tccaggcatgaccctggagccc

SEQ ID NO: 6408245 - DNA, 14 bp, Homo sapiens
tccaggcatgctgg

SEQ ID NO: 6408246 - DNA, 16 bp, Homo sapiens
tccaggcatgctggcc

SEQ ID NO: 6408247 - DNA, 21 bp, Homo sapiens
tccaggcatgtgtctggccct

SEQ ID NO: 6408248 - DNA, 18 bp, Homo sapiens
tccaggccactgtggcca

SEQ ID NO: 6408249 - DNA, 20 bp, Homo sapiens
tccaggccactgtggccaga

SEQ ID NO: 6408250 - DNA, 22 bp, Homo sapiens
tccaggccactgtggccagagc

SEQ ID NO: 6408251 - DNA, 23 bp, Homo sapiens
tccaggccactgtggccagagct

SEQ ID NO: 6408252 - DNA, 15 bp, Homo sapiens
tccaggccagctcct

SEQ ID NO: 6408253 - DNA, 18 bp, Homo sapiens
tccaggccagctcctttt

SEQ ID NO: 6408254 - DNA, 22 bp, Homo sapiens
tccaggccaggcctcatcctcc

SEQ ID NO: 6408255 - DNA, 18 bp, Homo sapiens
tccaggccagggctcctg

SEQ ID NO: 6408256 - DNA, 17 bp, Homo sapiens
tccaggcccaactgtga

SEQ ID NO: 6408257 - DNA, 10 bp, Homo sapiens
tccaggcccc

SEQ ID NO: 6408258 - DNA, 21 bp, Homo sapiens
tccaggccccaaaaccacagc

SEQ ID NO: 6408259 - DNA, 20 bp, Homo sapiens
tccaggccccacctcctcct

SEQ ID NO: 6408260 - DNA, 18 bp, Homo sapiens
tccaggccccaggctgga

SEQ ID NO: 6408261 - DNA, 21 bp, Homo sapiens
tccaggccccaggctggatgc

SEQ ID NO: 6408262 - DNA, 16 bp, Homo sapiens
tccaggccccaggtca

SEQ ID NO: 6408263 - DNA, 21 bp, Homo sapiens
tccaggcccccaacccctcct

SEQ ID NO: 6408264 - DNA, 22 bp, Homo sapiens
tccaggcccccaacccctcctc

SEQ ID NO: 6408265 - DNA, 18 bp, Homo sapiens
tccaggcccctgaggact

SEQ ID NO: 6408266 - DNA, 22 bp, Homo sapiens
tccaggcccctgaggactggag

SEQ ID NO: 6408267 - DNA, 17 bp, Homo sapiens
tccaggcccgtctgtcc

SEQ ID NO: 6408268 - DNA, 14 bp, Homo sapiens
tccaggccctccag

SEQ ID NO: 6408269 - DNA, 21 bp, Homo sapiens
tccaggccctgccccctccca

SEQ ID NO: 6408270 - DNA, 15 bp, Homo sapiens
tccaggcctcagcct

SEQ ID NO: 6408271 - DNA, 18 bp, Homo sapiens
tccaggcctctctctgct

SEQ ID NO: 6408272 - DNA, 19 bp, Homo sapiens
tccaggcctctctctgctc

SEQ ID NO: 6408273 - DNA, 22 bp, Homo sapiens
tccaggcctctctctgctccat

SEQ ID NO: 6408274 - DNA, 15 bp, Homo sapiens
tccaggcctgaccag

SEQ ID NO: 6408275 - DNA, 21 bp, Homo sapiens
tccaggcctgaggctgctgac

SEQ ID NO: 6408276 - DNA, 16 bp, Homo sapiens
tccaggcctgcctccc

SEQ ID NO: 6408277 - DNA, 17 bp, Homo sapiens
tccaggcctgcctccca

SEQ ID NO: 6408278 - DNA, 23 bp, Homo sapiens
tccaggcctgtcaagagggagga

SEQ ID NO: 6408279 - DNA, 22 bp, Homo sapiens
tccaggcctgtgaggtgcagag

SEQ ID NO: 6408280 - DNA, 22 bp, Homo sapiens
tccaggcgtagggccagggctc

SEQ ID NO: 6408281 - DNA, 21 bp, Homo sapiens
tccaggctacaatcttcattt

SEQ ID NO: 6408282 - DNA, 20 bp, Homo sapiens
tccaggctagtccggaccca

SEQ ID NO: 6408283 - DNA, 15 bp, Homo sapiens
tccaggctctgggca

SEQ ID NO: 6408284 - DNA, 22 bp, Homo sapiens
tccaggctcttcctggacctga

SEQ ID NO: 6408285 - DNA, 22 bp, Homo sapiens
tccaggctctttggggtcagcc

SEQ ID NO: 6408286 - DNA, 22 bp, Homo sapiens
tccaggctgactgggggcctct

SEQ ID NO: 6408287 - DNA, 16 bp, Homo sapiens
tccaggctgagccatg

SEQ ID NO: 6408288 - DNA, 17 bp, Homo sapiens
tccaggctgagccatga

SEQ ID NO: 6408289 - DNA, 21 bp, Homo sapiens
tccaggctgagccatgaggag

SEQ ID NO: 6408290 - DNA, 16 bp, Homo sapiens
tccaggctgccgtggg

SEQ ID NO: 6408291 - DNA, 11 bp, Homo sapiens
tccaggctgga

SEQ ID NO: 6408292 - DNA, 14 bp, Homo sapiens
tccaggctggaagt

SEQ ID NO: 6408293 - DNA, 17 bp, Homo sapiens
tccaggctgggagagcc

SEQ ID NO: 6408294 - DNA, 21 bp, Homo sapiens
tccaggctgggaggggaagag

SEQ ID NO: 6408295 - DNA, 19 bp, Homo sapiens
tccaggctggggcctggcc

SEQ ID NO: 6408296 - DNA, 18 bp, Homo sapiens
tccaggctgggtgacaga

SEQ ID NO: 6408297 - DNA, 18 bp, Homo sapiens
tccaggctggtctgaaac

SEQ ID NO: 6408298 - DNA, 21 bp, Homo sapiens
tccaggctggtgttctgtctg

SEQ ID NO: 6408299 - DNA, 12 bp, Homo sapiens
tccaggctgtcc

SEQ ID NO: 6408300 - DNA, 18 bp, Homo sapiens
tccaggctgttctcagcg

SEQ ID NO: 6408301 - DNA, 15 bp, Homo sapiens
tccaggcttcacagt

SEQ ID NO: 6408302 - DNA, 14 bp, Homo sapiens
tccaggcttcccct

SEQ ID NO: 6408303 - DNA, 17 bp, Homo sapiens
tccaggcttcctgccct

SEQ ID NO: 6408304 - DNA, 21 bp, Homo sapiens
tccaggcttcctgccctagca

SEQ ID NO: 6408305 - DNA, 20 bp, Homo sapiens
tccaggcttctcccggacct

SEQ ID NO: 6408306 - DNA, 23 bp, Homo sapiens
tccaggcttctgctggggcctgg

SEQ ID NO: 6408307 - DNA, 17 bp, Homo sapiens
tccagggaaacagcctc

SEQ ID NO: 6408308 - DNA, 23 bp, Homo sapiens
tccagggaaacagcctctctctt

SEQ ID NO: 6408309 - DNA, 23 bp, Homo sapiens
tccagggaagctggccgagggtc

SEQ ID NO: 6408310 - DNA, 22 bp, Homo sapiens
tccagggaaggtggccacagca

SEQ ID NO: 6408311 - DNA, 18 bp, Homo sapiens
tccagggaatccaagcct

SEQ ID NO: 6408312 - DNA, 23 bp, Homo sapiens
tccagggaatccgcctgcagagg

SEQ ID NO: 6408313 - DNA, 19 bp, Homo sapiens
tccagggaattcttacagc

SEQ ID NO: 6408314 - DNA, 14 bp, Homo sapiens
tccagggacaagct

SEQ ID NO: 6408315 - DNA, 17 bp, Homo sapiens
tccagggacacacagcc

SEQ ID NO: 6408316 - DNA, 14 bp, Homo sapiens
tccagggacagagg

SEQ ID NO: 6408317 - DNA, 12 bp, Homo sapiens
tccagggacagc

SEQ ID NO: 6408318 - DNA, 14 bp, Homo sapiens
tccagggacagcaa

SEQ ID NO: 6408319 - DNA, 22 bp, Homo sapiens
tccagggaccactgggtgagag

SEQ ID NO: 6408320 - DNA, 21 bp, Homo sapiens
tccagggactgtacctgtagg

SEQ ID NO: 6408321 - DNA, 19 bp, Homo sapiens
tccagggagcattttcctc

SEQ ID NO: 6408322 - DNA, 15 bp, Homo sapiens
tccagggagcctaga

SEQ ID NO: 6408323 - DNA, 21 bp, Homo sapiens
tccagggagcctagaagctgg

SEQ ID NO: 6408324 - DNA, 20 bp, Homo sapiens
tccagggaggcgatgccagc

SEQ ID NO: 6408325 - DNA, 17 bp, Homo sapiens
tccagggaggctggtcc

SEQ ID NO: 6408326 - DNA, 18 bp, Homo sapiens
tccagggaggctggtcct

SEQ ID NO: 6408327 - DNA, 11 bp, Homo sapiens
tccagggaggg

SEQ ID NO: 6408328 - DNA, 19 bp, Homo sapiens
tccagggatccagggacac

SEQ ID NO: 6408329 - DNA, 16 bp, Homo sapiens
tccagggatgagccaa

SEQ ID NO: 6408330 - DNA, 16 bp, Homo sapiens
tccagggcagcaggcc

SEQ ID NO: 6408331 - DNA, 18 bp, Homo sapiens
tccagggcagcaggccag

SEQ ID NO: 6408332 - DNA, 13 bp, Homo sapiens
tccagggcagcct

SEQ ID NO: 6408333 - DNA, 22 bp, Homo sapiens
tccagggcagcctccaccttgc

SEQ ID NO: 6408334 - DNA, 17 bp, Homo sapiens
tccagggcagcggctcc

SEQ ID NO: 6408335 - DNA, 22 bp, Homo sapiens
tccagggcagtgtccctccctg

SEQ ID NO: 6408336 - DNA, 18 bp, Homo sapiens
tccagggcattgctcagc

SEQ ID NO: 6408337 - DNA, 22 bp, Homo sapiens
tccagggccacgtgccaggccc

SEQ ID NO: 6408338 - DNA, 12 bp, Homo sapiens
tccagggccagg

SEQ ID NO: 6408339 - DNA, 17 bp, Homo sapiens
tccagggccaggattca

SEQ ID NO: 6408340 - DNA, 21 bp, Homo sapiens
tccagggcccatgtagctggc

SEQ ID NO: 6408341 - DNA, 17 bp, Homo sapiens
tccagggccctgagctc

SEQ ID NO: 6408342 - DNA, 15 bp, Homo sapiens
tccagggctcccgga

SEQ ID NO: 6408343 - DNA, 18 bp, Homo sapiens
tccagggctcttccagat

SEQ ID NO: 6408344 - DNA, 21 bp, Homo sapiens
tccagggctggactgaggcct

SEQ ID NO: 6408345 - DNA, 14 bp, Homo sapiens
tccagggctggggt

SEQ ID NO: 6408346 - DNA, 15 bp, Homo sapiens
tccagggctggggtg

SEQ ID NO: 6408347 - DNA, 22 bp, Homo sapiens
tccagggctggggtgagcctga

SEQ ID NO: 6408348 - DNA, 21 bp, Homo sapiens
tccaggggagggaaaagctaa

SEQ ID NO: 6408349 - DNA, 12 bp, Homo sapiens
tccaggggcacc

SEQ ID NO: 6408350 - DNA, 20 bp, Homo sapiens
tccaggggccaattttggat

SEQ ID NO: 6408351 - DNA, 13 bp, Homo sapiens
tccaggggcccct

SEQ ID NO: 6408352 - DNA, 23 bp, Homo sapiens
tccaggggcccttgggacagcca

SEQ ID NO: 6408353 - DNA, 16 bp, Homo sapiens
tccaggggcctgcaga

SEQ ID NO: 6408354 - DNA, 14 bp, Homo sapiens
tccaggggctcctg

SEQ ID NO: 6408355 - DNA, 16 bp, Homo sapiens
tccaggggctcctggg

SEQ ID NO: 6408356 - DNA, 17 bp, Homo sapiens
tccaggggctcctgggt

SEQ ID NO: 6408357 - DNA, 23 bp, Homo sapiens
tccaggggctggggacttcgggg

SEQ ID NO: 6408358 - DNA, 15 bp, Homo sapiens
tccaggggcttcacc

SEQ ID NO: 6408359 - DNA, 17 bp, Homo sapiens
tccagggggagaaggaa

SEQ ID NO: 6408360 - DNA, 18 bp, Homo sapiens
tccagggggtgccctccc

SEQ ID NO: 6408361 - DNA, 20 bp, Homo sapiens
tccagggggtgccctcccag

SEQ ID NO: 6408362 - DNA, 19 bp, Homo sapiens
tccaggggtcctaggcctc

SEQ ID NO: 6408363 - DNA, 17 bp, Homo sapiens
tccaggggtttacagtg

SEQ ID NO: 6408364 - DNA, 18 bp, Homo sapiens
tccagggtaggcaaggct

SEQ ID NO: 6408365 - DNA, 20 bp, Homo sapiens
tccagggtatgacctaggga

SEQ ID NO: 6408366 - DNA, 16 bp, Homo sapiens
tccagggtccagccct

SEQ ID NO: 6408367 - DNA, 17 bp, Homo sapiens
tccagggtccctctgtg

SEQ ID NO: 6408368 - DNA, 18 bp, Homo sapiens
tccagggtccctctgtgt

SEQ ID NO: 6408369 - DNA, 16 bp, Homo sapiens
tccagggtcctctagc

SEQ ID NO: 6408370 - DNA, 22 bp, Homo sapiens
tccagggtcctctcttccacag

SEQ ID NO: 6408371 - DNA, 16 bp, Homo sapiens
tccagggtctaaagag

SEQ ID NO: 6408372 - DNA, 18 bp, Homo sapiens
tccagggtctaaagagaa

SEQ ID NO: 6408373 - DNA, 13 bp, Homo sapiens
tccagggtctgag

SEQ ID NO: 6408374 - DNA, 13 bp, Homo sapiens
tccagggtctggc

SEQ ID NO: 6408375 - DNA, 18 bp, Homo sapiens
tccagggtctggcagagc

SEQ ID NO: 6408376 - DNA, 21 bp, Homo sapiens
tccagggtctggcagagcctc

SEQ ID NO: 6408377 - DNA, 15 bp, Homo sapiens
tccagggtcttgggc

SEQ ID NO: 6408378 - DNA, 18 bp, Homo sapiens
tccagggtggcagcaaca

SEQ ID NO: 6408379 - DNA, 11 bp, Homo sapiens
tccagggtggt

SEQ ID NO: 6408380 - DNA, 15 bp, Homo sapiens
tccaggtaaatggta

SEQ ID NO: 6408381 - DNA, 18 bp, Homo sapiens
tccaggtacgcacagaca

SEQ ID NO: 6408382 - DNA, 17 bp, Homo sapiens
tccaggtatctccagga

SEQ ID NO: 6408383 - DNA, 21 bp, Homo sapiens
tccaggtattcgttatctaat

SEQ ID NO: 6408384 - DNA, 15 bp, Homo sapiens
tccaggtcaacagaa

SEQ ID NO: 6408385 - DNA, 16 bp, Homo sapiens
tccaggtcaacagaat

SEQ ID NO: 6408386 - DNA, 17 bp, Homo sapiens
tccaggtcaacagaatg

SEQ ID NO: 6408387 - DNA, 19 bp, Homo sapiens
tccaggtcaacagaatgaa

SEQ ID NO: 6408388 - DNA, 16 bp, Homo sapiens
tccaggtcagcctgga

SEQ ID NO: 6408389 - DNA, 17 bp, Homo sapiens
tccaggtcagcctggaa

SEQ ID NO: 6408390 - DNA, 19 bp, Homo sapiens
tccaggtcagcctggaagg

SEQ ID NO: 6408391 - DNA, 21 bp, Homo sapiens
tccaggtcatgcagttcctgg

SEQ ID NO: 6408392 - DNA, 18 bp, Homo sapiens
tccaggtccaaacccttc

SEQ ID NO: 6408393 - DNA, 20 bp, Homo sapiens
tccaggtccaaacccttcaa

SEQ ID NO: 6408394 - DNA, 13 bp, Homo sapiens
tccaggtcccagc

SEQ ID NO: 6408395 - DNA, 21 bp, Homo sapiens
tccaggtcccagcccctcctc

SEQ ID NO: 6408396 - DNA, 16 bp, Homo sapiens
tagcctgctctgccac

SEQ ID NO: 6408397 - DNA, 12 bp, Homo sapiens
tagcctgctggt

SEQ ID NO: 6408398 - DNA, 20 bp, Homo sapiens
tagcctggatacagtataaa

SEQ ID NO: 6408399 - DNA, 20 bp, Homo sapiens
tagcctggatagccttgaaa

SEQ ID NO: 6408400 - DNA, 14 bp, Homo sapiens
tagcctggctctgc

SEQ ID NO: 6408401 - DNA, 13 bp, Homo sapiens
tagcctgggccag

SEQ ID NO: 6408402 - DNA, 12 bp, Homo sapiens
tagcctgggcct

SEQ ID NO: 6408403 - DNA, 16 bp, Homo sapiens
tagcctgggcctcctc

SEQ ID NO: 6408404 - DNA, 17 bp, Homo sapiens
tagcctgggcctcctcc

SEQ ID NO: 6408405 - DNA, 23 bp, Homo sapiens
tagcctggggcttgaatttgcat

SEQ ID NO: 6408406 - DNA, 14 bp, Homo sapiens
tagcctggtctgtg

SEQ ID NO: 6408407 - DNA, 12 bp, Homo sapiens
tagcctgtcctg

SEQ ID NO: 6408408 - DNA, 13 bp, Homo sapiens
tagcctgtcctgt

SEQ ID NO: 6408409 - DNA, 14 bp, Homo sapiens
tagcctgtcctgtc

SEQ ID NO: 6408410 - DNA, 16 bp, Homo sapiens
tagcctgtggccctgt

SEQ ID NO: 6408411 - DNA, 15 bp, Homo sapiens
tagcctgtttcttcc

SEQ ID NO: 6408412 - DNA, 15 bp, Homo sapiens
tagccttaaattttt

SEQ ID NO: 6408413 - DNA, 20 bp, Homo sapiens
tagccttaaatttttgtcat

SEQ ID NO: 6408414 - DNA, 21 bp, Homo sapiens
tagccttagaagtcacacagt

SEQ ID NO: 6408415 - DNA, 20 bp, Homo sapiens
tagccttagagcatctctgc

SEQ ID NO: 6408416 - DNA, 15 bp, Homo sapiens
tagccttatcctctg

SEQ ID NO: 6408417 - DNA, 17 bp, Homo sapiens
tagccttatcctctgat

SEQ ID NO: 6408418 - DNA, 20 bp, Homo sapiens
tagccttatcctctgatctc

SEQ ID NO: 6408419 - DNA, 14 bp, Homo sapiens
tagccttattcacc

SEQ ID NO: 6408420 - DNA, 16 bp, Homo sapiens
tagccttctctgttca

SEQ ID NO: 6408421 - DNA, 20 bp, Homo sapiens
tagccttctctgttcatttc

SEQ ID NO: 6408422 - DNA, 16 bp, Homo sapiens
tagccttgatttgttc

SEQ ID NO: 6408423 - DNA, 22 bp, Homo sapiens
tagccttgcccggattctggga

SEQ ID NO: 6408424 - DNA, 18 bp, Homo sapiens
tagccttgctcaggtgca

SEQ ID NO: 6408425 - DNA, 15 bp, Homo sapiens
tagccttgctgtaga

SEQ ID NO: 6408426 - DNA, 12 bp, Homo sapiens
tagccttggggt

SEQ ID NO: 6408427 - DNA, 22 bp, Homo sapiens
tagccttgtgccctgcccccat

SEQ ID NO: 6408428 - DNA, 22 bp, Homo sapiens
tagcctttacctgtgaagtgtt

SEQ ID NO: 6408429 - DNA, 14 bp, Homo sapiens
tagccttttgtaac

SEQ ID NO: 6408430 - DNA, 17 bp, Homo sapiens
tagcctttttgtataaa

SEQ ID NO: 6408431 - DNA, 22 bp, Homo sapiens
tagcctttttgtataaaataga

SEQ ID NO: 6408432 - DNA, 20 bp, Homo sapiens
tagccttttttccccagact

SEQ ID NO: 6408433 - DNA, 21 bp, Homo sapiens
tagcgaacgtatttctccaga

SEQ ID NO: 6408434 - DNA, 23 bp, Homo sapiens
tagcgaacgtatttctccagacc

SEQ ID NO: 6408435 - DNA, 17 bp, Homo sapiens
tagcgaccccagactgt

SEQ ID NO: 6408436 - DNA, 16 bp, Homo sapiens
tagcgatctctcctgg

SEQ ID NO: 6408437 - DNA, 16 bp, Homo sapiens
tagcgattataatctc

SEQ ID NO: 6408438 - DNA, 17 bp, Homo sapiens
tagcgcacccagagaaa

SEQ ID NO: 6408439 - DNA, 18 bp, Homo sapiens
tagcgcacccagagaaaa

SEQ ID NO: 6408440 - DNA, 16 bp, Homo sapiens
tagcgcactcttcatg

SEQ ID NO: 6408441 - DNA, 14 bp, Homo sapiens
tagcgcccagttgg

SEQ ID NO: 6408442 - DNA, 17 bp, Homo sapiens
tagcgcccagttgggtg

SEQ ID NO: 6408443 - DNA, 20 bp, Homo sapiens
tagcgcctgtataagtagat

SEQ ID NO: 6408444 - DNA, 17 bp, Homo sapiens
tagcgctcccttttcac

SEQ ID NO: 6408445 - DNA, 21 bp, Homo sapiens
tagcgctgccgcaccccagag

SEQ ID NO: 6408446 - DNA, 15 bp, Homo sapiens
tagcggagcccagcc

SEQ ID NO: 6408447 - DNA, 21 bp, Homo sapiens
tagcggcaaacctttccccct

SEQ ID NO: 6408448 - DNA, 13 bp, Homo sapiens
tagcggccctgga

SEQ ID NO: 6408449 - DNA, 15 bp, Homo sapiens
tagcggccctggagg

SEQ ID NO: 6408450 - DNA, 17 bp, Homo sapiens
tagcggccctggaggat

SEQ ID NO: 6408451 - DNA, 12 bp, Homo sapiens
tagcggctcctc

SEQ ID NO: 6408452 - DNA, 13 bp, Homo sapiens
tagcggctcctcg

SEQ ID NO: 6408453 - DNA, 13 bp, Homo sapiens
tagcggtttgcaa

SEQ ID NO: 6408454 - DNA, 15 bp, Homo sapiens
tagcgtcaagacatt

SEQ ID NO: 6408455 - DNA, 22 bp, Homo sapiens
tagcgtccatttcttatttaat

SEQ ID NO: 6408456 - DNA, 14 bp, Homo sapiens
tagcgtcctgagga

SEQ ID NO: 6408457 - DNA, 17 bp, Homo sapiens
tagcgtcctgaggaata

SEQ ID NO: 6408458 - DNA, 20 bp, Homo sapiens
tagcgtgagctaactgagag

SEQ ID NO: 6408459 - DNA, 17 bp, Homo sapiens
tagcgtgctcactgacc

SEQ ID NO: 6408460 - DNA, 18 bp, Homo sapiens
tagcgtgggttatcagtt

SEQ ID NO: 6408461 - DNA, 13 bp, Homo sapiens
tagcgttctggac

SEQ ID NO: 6408462 - DNA, 16 bp, Homo sapiens
tagcgttcttgtaatt

SEQ ID NO: 6408463 - DNA, 17 bp, Homo sapiens
tagcgttcttgtaattt

SEQ ID NO: 6408464 - DNA, 22 bp, Homo sapiens
tagcgtttaaggtgagcataaa

SEQ ID NO: 6408465 - DNA, 17 bp, Homo sapiens
tagcgttttttaaatgt

SEQ ID NO: 6408466 - DNA, 22 bp, Homo sapiens
tagcgttttttaaatgtatact

SEQ ID NO: 6408467 - DNA, 21 bp, Homo sapiens
tagctaaataacttgccattt

SEQ ID NO: 6408468 - DNA, 12 bp, Homo sapiens
tagctaaatgac

SEQ ID NO: 6408469 - DNA, 17 bp, Homo sapiens
tagctaaattcagggag

SEQ ID NO: 6408470 - DNA, 18 bp, Homo sapiens
tagctaaattcagggaga

SEQ ID NO: 6408471 - DNA, 14 bp, Homo sapiens
tagctaacagtgaa

SEQ ID NO: 6408472 - DNA, 19 bp, Homo sapiens
tagctaacagttgccacat

SEQ ID NO: 6408473 - DNA, 20 bp, Homo sapiens
tagctaacattttaaataaa

SEQ ID NO: 6408474 - DNA, 16 bp, Homo sapiens
tagctaagcaagccag

SEQ ID NO: 6408475 - DNA, 17 bp, Homo sapiens
tagctaagcaagccagg

SEQ ID NO: 6408476 - DNA, 18 bp, Homo sapiens
tagctaagcaagccagga

SEQ ID NO: 6408477 - DNA, 14 bp, Homo sapiens
tagctaagccaaga

SEQ ID NO: 6408478 - DNA, 14 bp, Homo sapiens
tagctaagtacaca

SEQ ID NO: 6408479 - DNA, 19 bp, Homo sapiens
tagctaataacatgtgaaa

SEQ ID NO: 6408480 - DNA, 14 bp, Homo sapiens
tagctaataagtag

SEQ ID NO: 6408481 - DNA, 16 bp, Homo sapiens
tagctaataataaatg

SEQ ID NO: 6408482 - DNA, 24 bp, Homo sapiens
tagctaataatgagctattaaaac

SEQ ID NO: 6408483 - DNA, 15 bp, Homo sapiens
tagctaattagctct

SEQ ID NO: 6408484 - DNA, 19 bp, Homo sapiens
tagctaatttatttcccca

SEQ ID NO: 6408485 - DNA, 19 bp, Homo sapiens
tagctacaatcctaccttt

SEQ ID NO: 6408486 - DNA, 15 bp, Homo sapiens
tagctacaatttgtt

SEQ ID NO: 6408487 - DNA, 23 bp, Homo sapiens
tagctacaatttgtttttgcatt

SEQ ID NO: 6408488 - DNA, 17 bp, Homo sapiens
tagctacactattgcat

SEQ ID NO: 6408489 - DNA, 13 bp, Homo sapiens
tagctacactgag

SEQ ID NO: 6408490 - DNA, 15 bp, Homo sapiens
tagctacactgagca

SEQ ID NO: 6408491 - DNA, 11 bp, Homo sapiens
tagctacagag

SEQ ID NO: 6408492 - DNA, 13 bp, Homo sapiens
tagctacagagaa

SEQ ID NO: 6408493 - DNA, 14 bp, Homo sapiens
tagctacagagaaa

SEQ ID NO: 6408494 - DNA, 21 bp, Homo sapiens
tagctacagagaaaccagctt

SEQ ID NO: 6408495 - DNA, 24 bp, Homo sapiens
tagctacagagaaaccagcttcct

SEQ ID NO: 6408496 - DNA, 23 bp, Homo sapiens
tagctacaggaagcaccccatgc

SEQ ID NO: 6408497 - DNA, 14 bp, Homo sapiens
tagctacatagcag

SEQ ID NO: 6408498 - DNA, 13 bp, Homo sapiens
tagctacccacag

SEQ ID NO: 6408499 - DNA, 23 bp, Homo sapiens
tagctaccttctctacccatctc

SEQ ID NO: 6408500 - DNA, 19 bp, Homo sapiens
tagctacggttccctgcct

SEQ ID NO: 6408501 - DNA, 16 bp, Homo sapiens
tagctactaattttaa

SEQ ID NO: 6408502 - DNA, 19 bp, Homo sapiens
tagctagaaatatgatttt

SEQ ID NO: 6408503 - DNA, 13 bp, Homo sapiens
tagctagaatcca

SEQ ID NO: 6408504 - DNA, 16 bp, Homo sapiens
tagctagaatgcacac

SEQ ID NO: 6408505 - DNA, 17 bp, Homo sapiens
tagctagactaggagac

SEQ ID NO: 6408506 - DNA, 18 bp, Homo sapiens
tagctagactggtgactg

SEQ ID NO: 6408507 - DNA, 22 bp, Homo sapiens
tagctagactggtgactgattc

SEQ ID NO: 6408508 - DNA, 14 bp, Homo sapiens
tagctagagaagga

SEQ ID NO: 6408509 - DNA, 14 bp, Homo sapiens
tagctagaggaacc

SEQ ID NO: 6408510 - DNA, 15 bp, Homo sapiens
tagctagaggaacca

SEQ ID NO: 6408511 - DNA, 18 bp, Homo sapiens
tagctagcaccatggcat

SEQ ID NO: 6408512 - DNA, 18 bp, Homo sapiens
tagctagctatttctatg

SEQ ID NO: 6408513 - DNA, 12 bp, Homo sapiens
tagctaggagca

SEQ ID NO: 6408514 - DNA, 15 bp, Homo sapiens
tagctaggtgacata

SEQ ID NO: 6408515 - DNA, 12 bp, Homo sapiens
tagctagtagca

SEQ ID NO: 6408516 - DNA, 17 bp, Homo sapiens
tagctagttagctcaca

SEQ ID NO: 6408517 - DNA, 18 bp, Homo sapiens
tagctagttatgtgagaa

SEQ ID NO: 6408518 - DNA, 22 bp, Homo sapiens
tagctagtttaaaattattaaa

SEQ ID NO: 6408519 - DNA, 15 bp, Homo sapiens
tagctatatccatgt

SEQ ID NO: 6408520 - DNA, 19 bp, Homo sapiens
tagctatatccatgtactg

SEQ ID NO: 6408521 - DNA, 21 bp, Homo sapiens
tagctatatttatatatatcc

SEQ ID NO: 6408522 - DNA, 16 bp, Homo sapiens
tagctatattttattt

SEQ ID NO: 6408523 - DNA, 14 bp, Homo sapiens
tagctatcatttct

SEQ ID NO: 6408524 - DNA, 20 bp, Homo sapiens
tagctatcatttcttttcca

SEQ ID NO: 6408525 - DNA, 15 bp, Homo sapiens
tagctattctttgac

SEQ ID NO: 6408526 - DNA, 23 bp, Homo sapiens
tagctattgcatgtaaaatgcag

SEQ ID NO: 6408527 - DNA, 12 bp, Homo sapiens
tagctatttaat

SEQ ID NO: 6408528 - DNA, 13 bp, Homo sapiens
tagctatttaata

SEQ ID NO: 6408529 - DNA, 20 bp, Homo sapiens
tagctatttaatactaattt

SEQ ID NO: 6408530 - DNA, 17 bp, Homo sapiens
tagctatttttatacac

SEQ ID NO: 6408531 - DNA, 19 bp, Homo sapiens
tagctatttttatggaatt

SEQ ID NO: 6408532 - DNA, 17 bp, Homo sapiens
tagctcaagaattgtta

SEQ ID NO: 6408533 - DNA, 20 bp, Homo sapiens
tagctcaagtttaaaagcca

SEQ ID NO: 6408534 - DNA, 21 bp, Homo sapiens
tagctcaagtttaaaagccat

SEQ ID NO: 6408535 - DNA, 17 bp, Homo sapiens
tagctcaatactctctg

SEQ ID NO: 6408536 - DNA, 13 bp, Homo sapiens
tagctcaatgagc

SEQ ID NO: 6408537 - DNA, 21 bp, Homo sapiens
tagctcaatgagcatgtttag

SEQ ID NO: 6408538 - DNA, 16 bp, Homo sapiens
tagctcacaagccgtg

SEQ ID NO: 6408539 - DNA, 11 bp, Homo sapiens
tagctcacact

SEQ ID NO: 6408540 - DNA, 12 bp, Homo sapiens
tagctcacagca

SEQ ID NO: 6408541 - DNA, 15 bp, Homo sapiens
tagctcaccaggcct

SEQ ID NO: 6408542 - DNA, 16 bp, Homo sapiens
tagctcaccaggcctg

SEQ ID NO: 6408543 - DNA, 20 bp, Homo sapiens
tagctcaccaggcctggcct

SEQ ID NO: 6408544 - DNA, 23 bp, Homo sapiens
tagctcaccaggcctggcctctg

SEQ ID NO: 6408545 - DNA, 17 bp, Homo sapiens
tagctcactgaatcttc

SEQ ID NO: 6408546 - DNA, 14 bp, Homo sapiens
tagctcaggtgcct

SEQ ID NO: 6408547 - DNA, 15 bp, Homo sapiens
tagctcaggtgcctt

SEQ ID NO: 6408548 - DNA, 20 bp, Homo sapiens
tagctcaggtgtccctgcac

SEQ ID NO: 6408549 - DNA, 18 bp, Homo sapiens
tagctcataagagtaaca

SEQ ID NO: 6408550 - DNA, 21 bp, Homo sapiens
tagctcataagctgtagaact

SEQ ID NO: 6408551 - DNA, 22 bp, Homo sapiens
tagctcattctccttgtgttac

SEQ ID NO: 6408552 - DNA, 20 bp, Homo sapiens
tagctccacaccctctccca

SEQ ID NO: 6408553 - DNA, 21 bp, Homo sapiens
tagctccataaagtacaaatg

SEQ ID NO: 6408554 - DNA, 19 bp, Homo sapiens
tagctcccaaaagaatgga

SEQ ID NO: 6408555 - DNA, 13 bp, Homo sapiens
tagctcccagcta

SEQ ID NO: 6408556 - DNA, 14 bp, Homo sapiens
tagctcccctggct

SEQ ID NO: 6408557 - DNA, 20 bp, Homo sapiens
tagctcccctggctggctcc

SEQ ID NO: 6408558 - DNA, 21 bp, Homo sapiens
tagctccctgatttggagcca

SEQ ID NO: 6408559 - DNA, 23 bp, Homo sapiens
tagctcctataaagggcccacac

SEQ ID NO: 6408560 - DNA, 11 bp, Homo sapiens
tagctcctccc

SEQ ID NO: 6408561 - DNA, 15 bp, Homo sapiens
tagctcctcccctgg

SEQ ID NO: 6408562 - DNA, 17 bp, Homo sapiens
tagctcctcctcctggg

SEQ ID NO: 6408563 - DNA, 24 bp, Homo sapiens
tagctcctctccctcacaagcgct

SEQ ID NO: 6408564 - DNA, 16 bp, Homo sapiens
tagctcctgtggcccc

SEQ ID NO: 6408565 - DNA, 13 bp, Homo sapiens
tagctccttagct

SEQ ID NO: 6408566 - DNA, 14 bp, Homo sapiens
tagctccttcatgc

SEQ ID NO: 6408567 - DNA, 14 bp, Homo sapiens
tagctccttgaaga

SEQ ID NO: 6408568 - DNA, 14 bp, Homo sapiens
tagctccttggagc

SEQ ID NO: 6408569 - DNA, 18 bp, Homo sapiens
tagctcggcaccaactaa

SEQ ID NO: 6408570 - DNA, 14 bp, Homo sapiens
tagctcgtgtgctt

SEQ ID NO: 6408571 - DNA, 15 bp, Homo sapiens
tagctcgtgtgctta

SEQ ID NO: 6408572 - DNA, 18 bp, Homo sapiens
tagctctaatgtttgcat

SEQ ID NO: 6408573 - DNA, 18 bp, Homo sapiens
tagctctactgccctccc

SEQ ID NO: 6408574 - DNA, 18 bp, Homo sapiens
tagctctaggtttcttga

SEQ ID NO: 6408575 - DNA, 17 bp, Homo sapiens
tagctctattttaaagt

SEQ ID NO: 6408576 - DNA, 23 bp, Homo sapiens
tccaggtcccagcccctcctccc

SEQ ID NO: 6408577 - DNA, 19 bp, Homo sapiens
tccaggtccggaggggttg

SEQ ID NO: 6408578 - DNA, 18 bp, Homo sapiens
tccaggtccgtagctccc

SEQ ID NO: 6408579 - DNA, 20 bp, Homo sapiens
tccaggtcctcagatgggaa

SEQ ID NO: 6408580 - DNA, 15 bp, Homo sapiens
tccaggtcctggtgg

SEQ ID NO: 6408581 - DNA, 18 bp, Homo sapiens
tccaggtcctttccttct

SEQ ID NO: 6408582 - DNA, 19 bp, Homo sapiens
tccaggtcggagtgcctgg

SEQ ID NO: 6408583 - DNA, 20 bp, Homo sapiens
tccaggtctagaaggccagg

SEQ ID NO: 6408584 - DNA, 15 bp, Homo sapiens
tccaggtgcacaagc

SEQ ID NO: 6408585 - DNA, 15 bp, Homo sapiens
tccaggtgcagaggt

SEQ ID NO: 6408586 - DNA, 17 bp, Homo sapiens
tccaggtgcctggccct

SEQ ID NO: 6408587 - DNA, 23 bp, Homo sapiens
tccaggtgcctggcccttggctt

SEQ ID NO: 6408588 - DNA, 13 bp, Homo sapiens
tccaggtgctcat

SEQ ID NO: 6408589 - DNA, 22 bp, Homo sapiens
tccaggtggaacaaacagaaat

SEQ ID NO: 6408590 - DNA, 14 bp, Homo sapiens
tccaggtggcagga

SEQ ID NO: 6408591 - DNA, 14 bp, Homo sapiens
tccaggtggcatca

SEQ ID NO: 6408592 - DNA, 21 bp, Homo sapiens
tccaggtggcgtgagaggcaa

SEQ ID NO: 6408593 - DNA, 14 bp, Homo sapiens
tccaggtgggagag

SEQ ID NO: 6408594 - DNA, 16 bp, Homo sapiens
tccaggtggggtgagg

SEQ ID NO: 6408595 - DNA, 16 bp, Homo sapiens
tccaggtgtagctaac

SEQ ID NO: 6408596 - DNA, 19 bp, Homo sapiens
tccaggtgtgcacagaaaa

SEQ ID NO: 6408597 - DNA, 22 bp, Homo sapiens
tccaggtgtgcccctccaagtc

SEQ ID NO: 6408598 - DNA, 23 bp, Homo sapiens
tccaggtgtggaccggccgcagc

SEQ ID NO: 6408599 - DNA, 21 bp, Homo sapiens
tccaggtgttgttgagggcat

SEQ ID NO: 6408600 - DNA, 17 bp, Homo sapiens
tccaggttatggggaga

SEQ ID NO: 6408601 - DNA, 21 bp, Homo sapiens
tccaggttccatccaccacct

SEQ ID NO: 6408602 - DNA, 17 bp, Homo sapiens
tccaggttcgtatagaa

SEQ ID NO: 6408603 - DNA, 18 bp, Homo sapiens
tccaggttgatcttgaac

SEQ ID NO: 6408604 - DNA, 18 bp, Homo sapiens
tccaggtttaagctgtta

SEQ ID NO: 6408605 - DNA, 20 bp, Homo sapiens
tccaggtttaagctgttact

SEQ ID NO: 6408606 - DNA, 23 bp, Homo sapiens
tccaggtttttcaattaaacgga

SEQ ID NO: 6408607 - DNA, 13 bp, Homo sapiens
tccagtaacccaa

SEQ ID NO: 6408608 - DNA, 14 bp, Homo sapiens
tccagtaacttttt

SEQ ID NO: 6408609 - DNA, 20 bp, Homo sapiens
tccagtaacttttttgtgta

SEQ ID NO: 6408610 - DNA, 21 bp, Homo sapiens
tccagtaacttttttgtgtat

SEQ ID NO: 6408611 - DNA, 18 bp, Homo sapiens
tccagtaagatcactgtt

SEQ ID NO: 6408612 - DNA, 21 bp, Homo sapiens
tccagtaagatcactgtttag

SEQ ID NO: 6408613 - DNA, 19 bp, Homo sapiens
tccagtaatctaatatggc

SEQ ID NO: 6408614 - DNA, 16 bp, Homo sapiens
tccagtaccataatct

SEQ ID NO: 6408615 - DNA, 20 bp, Homo sapiens
tccagtaccataatcttaga

SEQ ID NO: 6408616 - DNA, 18 bp, Homo sapiens
tccagtacgtcccgctgc

SEQ ID NO: 6408617 - DNA, 21 bp, Homo sapiens
tccagtacgtcccgctgctgt

SEQ ID NO: 6408618 - DNA, 17 bp, Homo sapiens
tccagtactattttaat

SEQ ID NO: 6408619 - DNA, 21 bp, Homo sapiens
tccagtactggagcttctctt

SEQ ID NO: 6408620 - DNA, 18 bp, Homo sapiens
tccagtagagatttccca

SEQ ID NO: 6408621 - DNA, 22 bp, Homo sapiens
tccagtagagcttcttatatta

SEQ ID NO: 6408622 - DNA, 15 bp, Homo sapiens
tccagtagctcctgg

SEQ ID NO: 6408623 - DNA, 13 bp, Homo sapiens
tccagtataaatt

SEQ ID NO: 6408624 - DNA, 17 bp, Homo sapiens
tccagtataaattacat

SEQ ID NO: 6408625 - DNA, 22 bp, Homo sapiens
tccagtataaattacatgcatg

SEQ ID NO: 6408626 - DNA, 14 bp, Homo sapiens
tccagtataaccag

SEQ ID NO: 6408627 - DNA, 17 bp, Homo sapiens
tccagtattatattatc

SEQ ID NO: 6408628 - DNA, 22 bp, Homo sapiens
tccagtcaacaaactatttctt

SEQ ID NO: 6408629 - DNA, 15 bp, Homo sapiens
tccagtcaacagatt

SEQ ID NO: 6408630 - DNA, 15 bp, Homo sapiens
tccagtcacactccc

SEQ ID NO: 6408631 - DNA, 15 bp, Homo sapiens
tccagtcatggtact

SEQ ID NO: 6408632 - DNA, 21 bp, Homo sapiens
tccagtcattatgttaatatt

SEQ ID NO: 6408633 - DNA, 22 bp, Homo sapiens
tccagtcattttattttgtaat

SEQ ID NO: 6408634 - DNA, 17 bp, Homo sapiens
tccagtccccctatcct

SEQ ID NO: 6408635 - DNA, 18 bp, Homo sapiens
tccagtccccctatcctt

SEQ ID NO: 6408636 - DNA, 21 bp, Homo sapiens
tccagtccccctatccttggc

SEQ ID NO: 6408637 - DNA, 22 bp, Homo sapiens
tccagtccccctatccttggca

SEQ ID NO: 6408638 - DNA, 18 bp, Homo sapiens
tccagtccctgggagcaa

SEQ ID NO: 6408639 - DNA, 23 bp, Homo sapiens
tccagtcctatctgggcttcctg

SEQ ID NO: 6408640 - DNA, 21 bp, Homo sapiens
tccagtcctcacatgcccgct

SEQ ID NO: 6408641 - DNA, 23 bp, Homo sapiens
tccagtcctcacatgcccgctgt

SEQ ID NO: 6408642 - DNA, 15 bp, Homo sapiens
tccagtcctgccacc

SEQ ID NO: 6408643 - DNA, 16 bp, Homo sapiens
tccagtcctgctctct

SEQ ID NO: 6408644 - DNA, 13 bp, Homo sapiens
tccagtcctgctg

SEQ ID NO: 6408645 - DNA, 14 bp, Homo sapiens
tccagtcctgctgg

SEQ ID NO: 6408646 - DNA, 16 bp, Homo sapiens
tccagtcctgctggcc

SEQ ID NO: 6408647 - DNA, 19 bp, Homo sapiens
tccagtcgttatttctgtt

SEQ ID NO: 6408648 - DNA, 15 bp, Homo sapiens
tccagtctccaccag

SEQ ID NO: 6408649 - DNA, 16 bp, Homo sapiens
tccagtctgctctcag

SEQ ID NO: 6408650 - DNA, 18 bp, Homo sapiens
tccagtctgctctcagct

SEQ ID NO: 6408651 - DNA, 23 bp, Homo sapiens
tccagtctgctctcagcttgtgc

SEQ ID NO: 6408652 - DNA, 15 bp, Homo sapiens
tccagtctgctgccc

SEQ ID NO: 6408653 - DNA, 20 bp, Homo sapiens
tccagtctgctgccctccat

SEQ ID NO: 6408654 - DNA, 17 bp, Homo sapiens
tccagtctggagagctg

SEQ ID NO: 6408655 - DNA, 20 bp, Homo sapiens
tccagtctgggtaacaggga

SEQ ID NO: 6408656 - DNA, 15 bp, Homo sapiens
tccagtcttagctga

SEQ ID NO: 6408657 - DNA, 18 bp, Homo sapiens
tccagtcttccacctgga

SEQ ID NO: 6408658 - DNA, 22 bp, Homo sapiens
tccagtcttcctgacactttaa

SEQ ID NO: 6408659 - DNA, 19 bp, Homo sapiens
tccagtgaaaataagccat

SEQ ID NO: 6408660 - DNA, 18 bp, Homo sapiens
tccagtgaaacttgggca

SEQ ID NO: 6408661 - DNA, 18 bp, Homo sapiens
tccagtgaccctggagct

SEQ ID NO: 6408662 - DNA, 14 bp, Homo sapiens
tccagtgacctctc

SEQ ID NO: 6408663 - DNA, 18 bp, Homo sapiens
tccagtgacttgcaatcc

SEQ ID NO: 6408664 - DNA, 22 bp, Homo sapiens
tccagtgacttgttctgagtaa

SEQ ID NO: 6408665 - DNA, 13 bp, Homo sapiens
tccagtgagctgg

SEQ ID NO: 6408666 - DNA, 21 bp, Homo sapiens
tccagtgaggcatctctctgg

SEQ ID NO: 6408667 - DNA, 15 bp, Homo sapiens
tccagtgaggctctg

SEQ ID NO: 6408668 - DNA, 23 bp, Homo sapiens
tccagtgaggctctgcccttggt

SEQ ID NO: 6408669 - DNA, 17 bp, Homo sapiens
tccagtgagtgaggttc

SEQ ID NO: 6408670 - DNA, 12 bp, Homo sapiens
tccagtgatgtt

SEQ ID NO: 6408671 - DNA, 18 bp, Homo sapiens
tccagtgcaacactgaag

SEQ ID NO: 6408672 - DNA, 15 bp, Homo sapiens
tccagtgcaaccaca

SEQ ID NO: 6408673 - DNA, 14 bp, Homo sapiens
tccagtgcaattgt

SEQ ID NO: 6408674 - DNA, 18 bp, Homo sapiens
tccagtgcagtagtgcca

SEQ ID NO: 6408675 - DNA, 16 bp, Homo sapiens
tccagtgcattttgtt

SEQ ID NO: 6408676 - DNA, 18 bp, Homo sapiens
tccagtgccaacaatcct

SEQ ID NO: 6408677 - DNA, 19 bp, Homo sapiens
tccagtgccgctcctgctt

SEQ ID NO: 6408678 - DNA, 10 bp, Homo sapiens
tccagtgcct

SEQ ID NO: 6408679 - DNA, 11 bp, Homo sapiens
tccagtgccta

SEQ ID NO: 6408680 - DNA, 14 bp, Homo sapiens
tccagtgctcagct

SEQ ID NO: 6408681 - DNA, 15 bp, Homo sapiens
tccagtgctcagctg

SEQ ID NO: 6408682 - DNA, 16 bp, Homo sapiens
tccagtgctcagctgt

SEQ ID NO: 6408683 - DNA, 17 bp, Homo sapiens
tccagtgctcagctgtg

SEQ ID NO: 6408684 - DNA, 19 bp, Homo sapiens
tccagtgctcagctgtggc

SEQ ID NO: 6408685 - DNA, 15 bp, Homo sapiens
tccagtgctctgcct

SEQ ID NO: 6408686 - DNA, 13 bp, Homo sapiens
tccagtgctggat

SEQ ID NO: 6408687 - DNA, 19 bp, Homo sapiens
tccagtgctggatttgatg

SEQ ID NO: 6408688 - DNA, 13 bp, Homo sapiens
tccagtgctggct

SEQ ID NO: 6408689 - DNA, 20 bp, Homo sapiens
tccagtgctggctgctggcc

SEQ ID NO: 6408690 - DNA, 21 bp, Homo sapiens
tccagtgctggctgctggccc

SEQ ID NO: 6408691 - DNA, 22 bp, Homo sapiens
tccagtgctggctgctggccca

SEQ ID NO: 6408692 - DNA, 16 bp, Homo sapiens
tccagtgcttccacag

SEQ ID NO: 6408693 - DNA, 23 bp, Homo sapiens
tccagtgcttggctgccccacag

SEQ ID NO: 6408694 - DNA, 20 bp, Homo sapiens
tccagtgctttatccacatt

SEQ ID NO: 6408695 - DNA, 21 bp, Homo sapiens
tccagtggaagttcttcaaga

SEQ ID NO: 6408696 - DNA, 19 bp, Homo sapiens
tccagtggcagacaaacag

SEQ ID NO: 6408697 - DNA, 16 bp, Homo sapiens
tccagtggcctggctc

SEQ ID NO: 6408698 - DNA, 13 bp, Homo sapiens
tccagtggcttct

SEQ ID NO: 6408699 - DNA, 17 bp, Homo sapiens
tccagtggcttctccca

SEQ ID NO: 6408700 - DNA, 19 bp, Homo sapiens
tccagtggcttctcccaac

SEQ ID NO: 6408701 - DNA, 17 bp, Homo sapiens
tccagtgggaggacaga

SEQ ID NO: 6408702 - DNA, 23 bp, Homo sapiens
tccagtgggaggtgagaccacct

SEQ ID NO: 6408703 - DNA, 22 bp, Homo sapiens
tccagtgggcccggagaaacct

SEQ ID NO: 6408704 - DNA, 21 bp, Homo sapiens
tccagtgggctgatgctggga

SEQ ID NO: 6408705 - DNA, 15 bp, Homo sapiens
tccagtggtaccagc

SEQ ID NO: 6408706 - DNA, 19 bp, Homo sapiens
tccagtggtaccagctcac

SEQ ID NO: 6408707 - DNA, 18 bp, Homo sapiens
tccagtggtcatgctcag

SEQ ID NO: 6408708 - DNA, 21 bp, Homo sapiens
tccagtggtcatgctcagcct

SEQ ID NO: 6408709 - DNA, 20 bp, Homo sapiens
tccagtggtccatggaatgc

SEQ ID NO: 6408710 - DNA, 21 bp, Homo sapiens
tccagtggtgggtaattgtac

SEQ ID NO: 6408711 - DNA, 19 bp, Homo sapiens
tccagtggttgctgttgat

SEQ ID NO: 6408712 - DNA, 16 bp, Homo sapiens
tccagtggtttgagac

SEQ ID NO: 6408713 - DNA, 23 bp, Homo sapiens
tccagtggtttgagacactggtt

SEQ ID NO: 6408714 - DNA, 13 bp, Homo sapiens
tccagtgtacata

SEQ ID NO: 6408715 - DNA, 16 bp, Homo sapiens
tccagtgtattttctg

SEQ ID NO: 6408716 - DNA, 23 bp, Homo sapiens
tccagtgtcacctctctcagagc

SEQ ID NO: 6408717 - DNA, 21 bp, Homo sapiens
tccagtgtccttagaacattt

SEQ ID NO: 6408718 - DNA, 15 bp, Homo sapiens
tccagtgtctcacag

SEQ ID NO: 6408719 - DNA, 16 bp, Homo sapiens
tccagtgtctcacagc

SEQ ID NO: 6408720 - DNA, 16 bp, Homo sapiens
tccagtgtctcggagg

SEQ ID NO: 6408721 - DNA, 16 bp, Homo sapiens
tccagtgtgcacccct

SEQ ID NO: 6408722 - DNA, 14 bp, Homo sapiens
tccagtgtggctcc

SEQ ID NO: 6408723 - DNA, 17 bp, Homo sapiens
tccagtgtggctcccac

SEQ ID NO: 6408724 - DNA, 18 bp, Homo sapiens
tccagtgtgggcttgacc

SEQ ID NO: 6408725 - DNA, 17 bp, Homo sapiens
tccagtgttctatgaac

SEQ ID NO: 6408726 - DNA, 13 bp, Homo sapiens
tccagtgttgcct

SEQ ID NO: 6408727 - DNA, 16 bp, Homo sapiens
tccagtgttgcctcct

SEQ ID NO: 6408728 - DNA, 17 bp, Homo sapiens
tccagtgttggctgtgt

SEQ ID NO: 6408729 - DNA, 23 bp, Homo sapiens
tccagtgttggctgtgtgacaga

SEQ ID NO: 6408730 - DNA, 14 bp, Homo sapiens
tccagtgtttccac

SEQ ID NO: 6408731 - DNA, 23 bp, Homo sapiens
tccagtgttttcttgtgttgttt

SEQ ID NO: 6408732 - DNA, 21 bp, Homo sapiens
tccagttagagtcttcatctg

SEQ ID NO: 6408733 - DNA, 15 bp, Homo sapiens
tccagttatttattt

SEQ ID NO: 6408734 - DNA, 21 bp, Homo sapiens
tccagttatttatttccaaaa

SEQ ID NO: 6408735 - DNA, 23 bp, Homo sapiens
tccagttcacaggccagaaaaca

SEQ ID NO: 6408736 - DNA, 20 bp, Homo sapiens
tccagttcatcgattttcta

SEQ ID NO: 6408737 - DNA, 19 bp, Homo sapiens
tccagttcatgagaatcta

SEQ ID NO: 6408738 - DNA, 15 bp, Homo sapiens
tccagttcctgctct

SEQ ID NO: 6408739 - DNA, 16 bp, Homo sapiens
tccagttcctgctctc

SEQ ID NO: 6408740 - DNA, 15 bp, Homo sapiens
tccagttctccgtaa

SEQ ID NO: 6408741 - DNA, 23 bp, Homo sapiens
tccagttgaacactagtctgtgt

SEQ ID NO: 6408742 - DNA, 18 bp, Homo sapiens
tccagttgcaataaaata

SEQ ID NO: 6408743 - DNA, 19 bp, Homo sapiens
tccagttgcaataaaatag

SEQ ID NO: 6408744 - DNA, 20 bp, Homo sapiens
tccagttgcaataaaatagt

SEQ ID NO: 6408745 - DNA, 12 bp, Homo sapiens
tccagttgcagg

SEQ ID NO: 6408746 - DNA, 22 bp, Homo sapiens
tccagttggactgtggcctcag

SEQ ID NO: 6408747 - DNA, 16 bp, Homo sapiens
tccagttgggactcag

SEQ ID NO: 6408748 - DNA, 18 bp, Homo sapiens
tccagttgggactcagga

SEQ ID NO: 6408749 - DNA, 17 bp, Homo sapiens
tccagttgtatttgaag

SEQ ID NO: 6408750 - DNA, 20 bp, Homo sapiens
tccagttgttactgaagtta

SEQ ID NO: 6408751 - DNA, 13 bp, Homo sapiens
tccagtttccaaa

SEQ ID NO: 6408752 - DNA, 16 bp, Homo sapiens
tagctctcacagacat

SEQ ID NO: 6408753 - DNA, 13 bp, Homo sapiens
tagctctgagaac

SEQ ID NO: 6408754 - DNA, 17 bp, Homo sapiens
tagctctgagccagttc

SEQ ID NO: 6408755 - DNA, 14 bp, Homo sapiens
tagctctgagccct

SEQ ID NO: 6408756 - DNA, 19 bp, Homo sapiens
tagctctgaggagtacccc

SEQ ID NO: 6408757 - DNA, 14 bp, Homo sapiens
tagctctgatcagc

SEQ ID NO: 6408758 - DNA, 18 bp, Homo sapiens
tagctctgccctggaacc

SEQ ID NO: 6408759 - DNA, 12 bp, Homo sapiens
tagctctgctgc

SEQ ID NO: 6408760 - DNA, 13 bp, Homo sapiens
tagctctggacgt

SEQ ID NO: 6408761 - DNA, 11 bp, Homo sapiens
tagctctgggg

SEQ ID NO: 6408762 - DNA, 17 bp, Homo sapiens
tagctctggggggcagt

SEQ ID NO: 6408763 - DNA, 19 bp, Homo sapiens
tagctctggggggcagttg

SEQ ID NO: 6408764 - DNA, 22 bp, Homo sapiens
tagctctggggtgggcagtttt

SEQ ID NO: 6408765 - DNA, 17 bp, Homo sapiens
tagctctgtacatcttt

SEQ ID NO: 6408766 - DNA, 17 bp, Homo sapiens
tagctctgtccactctg

SEQ ID NO: 6408767 - DNA, 20 bp, Homo sapiens
tagctcttaattgttcattt

SEQ ID NO: 6408768 - DNA, 13 bp, Homo sapiens
tagctcttacaca

SEQ ID NO: 6408769 - DNA, 18 bp, Homo sapiens
tagctcttaccaaaacag

SEQ ID NO: 6408770 - DNA, 22 bp, Homo sapiens
tagctcttagtcctccctgctc

SEQ ID NO: 6408771 - DNA, 15 bp, Homo sapiens
tagctcttgggcctg

SEQ ID NO: 6408772 - DNA, 21 bp, Homo sapiens
tagctcttggggaaatagctt

SEQ ID NO: 6408773 - DNA, 23 bp, Homo sapiens
tagctcttgttgagccgtgggca

SEQ ID NO: 6408774 - DNA, 12 bp, Homo sapiens
tagctctttctc

SEQ ID NO: 6408775 - DNA, 22 bp, Homo sapiens
tagctcttttttgtttgtttct

SEQ ID NO: 6408776 - DNA, 23 bp, Homo sapiens
tagctgaaaagggcactcccaac

SEQ ID NO: 6408777 - DNA, 16 bp, Homo sapiens
tagctgaaattccagt

SEQ ID NO: 6408778 - DNA, 17 bp, Homo sapiens
tagctgaacaatgaatg

SEQ ID NO: 6408779 - DNA, 17 bp, Homo sapiens
tagctgaagaattgaaa

SEQ ID NO: 6408780 - DNA, 18 bp, Homo sapiens
tagctgaatgtttttcta

SEQ ID NO: 6408781 - DNA, 19 bp, Homo sapiens
tagctgaatgtttttctaa

SEQ ID NO: 6408782 - DNA, 17 bp, Homo sapiens
tagctgacagaatctct

SEQ ID NO: 6408783 - DNA, 18 bp, Homo sapiens
tagctgacagtcagctgt

SEQ ID NO: 6408784 - DNA, 21 bp, Homo sapiens
tagctgacagtcagctgtggg

SEQ ID NO: 6408785 - DNA, 23 bp, Homo sapiens
tagctgacccagccccttgagaa

SEQ ID NO: 6408786 - DNA, 14 bp, Homo sapiens
tagctgactttcat

SEQ ID NO: 6408787 - DNA, 19 bp, Homo sapiens
tagctgagactacaggtga

SEQ ID NO: 6408788 - DNA, 14 bp, Homo sapiens
tagctgagaggaag

SEQ ID NO: 6408789 - DNA, 16 bp, Homo sapiens
tagctgagctggaaag

SEQ ID NO: 6408790 - DNA, 16 bp, Homo sapiens
tagctgagctgtgaca

SEQ ID NO: 6408791 - DNA, 16 bp, Homo sapiens
tagctgaggctgagaa

SEQ ID NO: 6408792 - DNA, 21 bp, Homo sapiens
tagctgaggctgagaaagcta

SEQ ID NO: 6408793 - DNA, 18 bp, Homo sapiens
tagctgagtgcactcctg

SEQ ID NO: 6408794 - DNA, 11 bp, Homo sapiens
tagctgagtgt

SEQ ID NO: 6408795 - DNA, 14 bp, Homo sapiens
tagctgataaagaa

SEQ ID NO: 6408796 - DNA, 15 bp, Homo sapiens
tagctgatagaagaa

SEQ ID NO: 6408797 - DNA, 23 bp, Homo sapiens
tagctgatgaacttattctgtag

SEQ ID NO: 6408798 - DNA, 15 bp, Homo sapiens
tagctgcaaaaataa

SEQ ID NO: 6408799 - DNA, 16 bp, Homo sapiens
tagctgcaaaggacag

SEQ ID NO: 6408800 - DNA, 17 bp, Homo sapiens
tagctgcaaaggacaga

SEQ ID NO: 6408801 - DNA, 23 bp, Homo sapiens
tagctgcactgtttatggaaata

SEQ ID NO: 6408802 - DNA, 20 bp, Homo sapiens
tagctgcatttgtctggcct

SEQ ID NO: 6408803 - DNA, 21 bp, Homo sapiens
tagctgccaagccccatcctg

SEQ ID NO: 6408804 - DNA, 23 bp, Homo sapiens
tagctgcccatttcgtgagcccc

SEQ ID NO: 6408805 - DNA, 13 bp, Homo sapiens
tagctgctacaaa

SEQ ID NO: 6408806 - DNA, 15 bp, Homo sapiens
tagctgctacaaaga

SEQ ID NO: 6408807 - DNA, 21 bp, Homo sapiens
tagctgctacaaagaagacat

SEQ ID NO: 6408808 - DNA, 12 bp, Homo sapiens
tagctgctcact

SEQ ID NO: 6408809 - DNA, 13 bp, Homo sapiens
tagctgctcactt

SEQ ID NO: 6408810 - DNA, 15 bp, Homo sapiens
tagctgctctgagca

SEQ ID NO: 6408811 - DNA, 12 bp, Homo sapiens
tagctgctgtca

SEQ ID NO: 6408812 - DNA, 13 bp, Homo sapiens
tagctgcttcctg

SEQ ID NO: 6408813 - DNA, 13 bp, Homo sapiens
tagctgctttaaa

SEQ ID NO: 6408814 - DNA, 23 bp, Homo sapiens
tagctggagatctgaacccagct

SEQ ID NO: 6408815 - DNA, 21 bp, Homo sapiens
tagctggagtgccatggctgg

SEQ ID NO: 6408816 - DNA, 13 bp, Homo sapiens
tagctggcaagct

SEQ ID NO: 6408817 - DNA, 15 bp, Homo sapiens
tagctggcaagctgc

SEQ ID NO: 6408818 - DNA, 11 bp, Homo sapiens
tagctggcagg

SEQ ID NO: 6408819 - DNA, 16 bp, Homo sapiens
tagctggcaggacaca

SEQ ID NO: 6408820 - DNA, 12 bp, Homo sapiens
tagctgggacta

SEQ ID NO: 6408821 - DNA, 14 bp, Homo sapiens
tagctgggactaca

SEQ ID NO: 6408822 - DNA, 18 bp, Homo sapiens
tagctgggactacaggtg

SEQ ID NO: 6408823 - DNA, 16 bp, Homo sapiens
tagctgggattacagg

SEQ ID NO: 6408824 - DNA, 15 bp, Homo sapiens
tagctgggattttaa

SEQ ID NO: 6408825 - DNA, 21 bp, Homo sapiens
tagctgggattttaaactaga

SEQ ID NO: 6408826 - DNA, 22 bp, Homo sapiens
tagctgggcggggctcgaggct

SEQ ID NO: 6408827 - DNA, 14 bp, Homo sapiens
tagctggggagccc

SEQ ID NO: 6408828 - DNA, 20 bp, Homo sapiens
tagctgggggtgggccaggc

SEQ ID NO: 6408829 - DNA, 16 bp, Homo sapiens
tagctgggttccggga

SEQ ID NO: 6408830 - DNA, 19 bp, Homo sapiens
tagctggtggttgtgcctt

SEQ ID NO: 6408831 - DNA, 17 bp, Homo sapiens
tagctggtggtttcacg

SEQ ID NO: 6408832 - DNA, 23 bp, Homo sapiens
tagctggtgtcagcccctcttcc

SEQ ID NO: 6408833 - DNA, 18 bp, Homo sapiens
tagctgtaaatacatgtg

SEQ ID NO: 6408834 - DNA, 23 bp, Homo sapiens
tagctgtacttcttgaatataaa

SEQ ID NO: 6408835 - DNA, 21 bp, Homo sapiens
tagctgtatgatttgttttga

SEQ ID NO: 6408836 - DNA, 18 bp, Homo sapiens
tagctgtattcatatatt

SEQ ID NO: 6408837 - DNA, 23 bp, Homo sapiens
tagctgtattcatatattgcatt

SEQ ID NO: 6408838 - DNA, 13 bp, Homo sapiens
tagctgtcaagcc

SEQ ID NO: 6408839 - DNA, 21 bp, Homo sapiens
tagctgtcatggtgcaatttg

SEQ ID NO: 6408840 - DNA, 21 bp, Homo sapiens
tagctgtcccatctggtcatt

SEQ ID NO: 6408841 - DNA, 14 bp, Homo sapiens
tagctgtcccatgg

SEQ ID NO: 6408842 - DNA, 21 bp, Homo sapiens
tagctgtcgtacattgagcaa

SEQ ID NO: 6408843 - DNA, 18 bp, Homo sapiens
tagctgtctctcttgttg

SEQ ID NO: 6408844 - DNA, 11 bp, Homo sapiens
tagctgtgaaa

SEQ ID NO: 6408845 - DNA, 21 bp, Homo sapiens
tagctgtgaatggctgtgccc

SEQ ID NO: 6408846 - DNA, 13 bp, Homo sapiens
tagctgtgacctg

SEQ ID NO: 6408847 - DNA, 15 bp, Homo sapiens
tagctgtgacctgct

SEQ ID NO: 6408848 - DNA, 18 bp, Homo sapiens
tagctgtgacctgctgag

SEQ ID NO: 6408849 - DNA, 14 bp, Homo sapiens
tagctgtgccccct

SEQ ID NO: 6408850 - DNA, 10 bp, Homo sapiens
tagctgtggg

SEQ ID NO: 6408851 - DNA, 17 bp, Homo sapiens
tagctgtggggagctgg

SEQ ID NO: 6408852 - DNA, 14 bp, Homo sapiens
tagctgtgggggtg

SEQ ID NO: 6408853 - DNA, 14 bp, Homo sapiens
tagctgtggtgagg

SEQ ID NO: 6408854 - DNA, 18 bp, Homo sapiens
tagctgtggtgaggtggg

SEQ ID NO: 6408855 - DNA, 17 bp, Homo sapiens
tagctgttgagctgttt

SEQ ID NO: 6408856 - DNA, 15 bp, Homo sapiens
tagctgttgtaaaga

SEQ ID NO: 6408857 - DNA, 15 bp, Homo sapiens
tagctgtttcaaatg

SEQ ID NO: 6408858 - DNA, 20 bp, Homo sapiens
tagctgttttaagaaatctg

SEQ ID NO: 6408859 - DNA, 15 bp, Homo sapiens
tagctgttttggaac

SEQ ID NO: 6408860 - DNA, 18 bp, Homo sapiens
tagctgttttgtgtatat

SEQ ID NO: 6408861 - DNA, 20 bp, Homo sapiens
tagctgttttgtgtatattg

SEQ ID NO: 6408862 - DNA, 13 bp, Homo sapiens
tagcttaaaaaaa

SEQ ID NO: 6408863 - DNA, 15 bp, Homo sapiens
tagcttaaataaatt

SEQ ID NO: 6408864 - DNA, 16 bp, Homo sapiens
tagcttaaataaattc

SEQ ID NO: 6408865 - DNA, 12 bp, Homo sapiens
tagcttaagaaa

SEQ ID NO: 6408866 - DNA, 14 bp, Homo sapiens
tagcttaagggaat

SEQ ID NO: 6408867 - DNA, 16 bp, Homo sapiens
tagcttaagggaatat

SEQ ID NO: 6408868 - DNA, 12 bp, Homo sapiens
tagcttaagtag

SEQ ID NO: 6408869 - DNA, 14 bp, Homo sapiens
tagcttacactgag

SEQ ID NO: 6408870 - DNA, 15 bp, Homo sapiens
tagcttacactgagg

SEQ ID NO: 6408871 - DNA, 17 bp, Homo sapiens
tagcttacatgagaaca

SEQ ID NO: 6408872 - DNA, 18 bp, Homo sapiens
tagcttacatgagaacag

SEQ ID NO: 6408873 - DNA, 16 bp, Homo sapiens
tagcttacctgacaca

SEQ ID NO: 6408874 - DNA, 21 bp, Homo sapiens
tagcttactgataaacctaat

SEQ ID NO: 6408875 - DNA, 16 bp, Homo sapiens
tagcttagacctcagc

SEQ ID NO: 6408876 - DNA, 19 bp, Homo sapiens
tagcttagacctcagcctg

SEQ ID NO: 6408877 - DNA, 20 bp, Homo sapiens
tagcttagacctcagcctgt

SEQ ID NO: 6408878 - DNA, 17 bp, Homo sapiens
tagcttagtttcagaga

SEQ ID NO: 6408879 - DNA, 14 bp, Homo sapiens
tagcttatcaattt

SEQ ID NO: 6408880 - DNA, 19 bp, Homo sapiens
tagcttatcaatttgtcat

SEQ ID NO: 6408881 - DNA, 20 bp, Homo sapiens
tagcttatcaatttgtcatt

SEQ ID NO: 6408882 - DNA, 22 bp, Homo sapiens
tagcttatctacttccaaacta

SEQ ID NO: 6408883 - DNA, 15 bp, Homo sapiens
tagcttatctgcccc

SEQ ID NO: 6408884 - DNA, 15 bp, Homo sapiens
tagcttattattgaa

SEQ ID NO: 6408885 - DNA, 18 bp, Homo sapiens
tagcttattgatcccaca

SEQ ID NO: 6408886 - DNA, 15 bp, Homo sapiens
tagcttcactcagct

SEQ ID NO: 6408887 - DNA, 15 bp, Homo sapiens
tagcttcagccaggc

SEQ ID NO: 6408888 - DNA, 12 bp, Homo sapiens
tagcttcaggaa

SEQ ID NO: 6408889 - DNA, 18 bp, Homo sapiens
tagcttcaggaacctcga

SEQ ID NO: 6408890 - DNA, 16 bp, Homo sapiens
tagcttccaataaagc

SEQ ID NO: 6408891 - DNA, 18 bp, Homo sapiens
tagcttccacctcatgga

SEQ ID NO: 6408892 - DNA, 15 bp, Homo sapiens
tagcttcctgcagga

SEQ ID NO: 6408893 - DNA, 17 bp, Homo sapiens
tagcttctagtctggaa

SEQ ID NO: 6408894 - DNA, 20 bp, Homo sapiens
tagcttctcttctttctgaa

SEQ ID NO: 6408895 - DNA, 18 bp, Homo sapiens
tagcttctgacctcagca

SEQ ID NO: 6408896 - DNA, 13 bp, Homo sapiens
tagcttctgcttt

SEQ ID NO: 6408897 - DNA, 23 bp, Homo sapiens
tagcttgacacagtcagcatgct

SEQ ID NO: 6408898 - DNA, 16 bp, Homo sapiens
tagcttgcaccttgtc

SEQ ID NO: 6408899 - DNA, 17 bp, Homo sapiens
tagcttgcagaactgta

SEQ ID NO: 6408900 - DNA, 17 bp, Homo sapiens
tagcttgcgcattctca

SEQ ID NO: 6408901 - DNA, 18 bp, Homo sapiens
tagcttgggacaaatcaa

SEQ ID NO: 6408902 - DNA, 19 bp, Homo sapiens
tagcttgggaggcttcccc

SEQ ID NO: 6408903 - DNA, 17 bp, Homo sapiens
tagcttgtacacatata

SEQ ID NO: 6408904 - DNA, 13 bp, Homo sapiens
tagcttgtatagt

SEQ ID NO: 6408905 - DNA, 15 bp, Homo sapiens
tagcttgtatcaaat

SEQ ID NO: 6408906 - DNA, 23 bp, Homo sapiens
tagcttgtctgtgatctctgctg

SEQ ID NO: 6408907 - DNA, 22 bp, Homo sapiens
tagcttgtttctgtcaagcata

SEQ ID NO: 6408908 - DNA, 17 bp, Homo sapiens
tagctttaaaaccacag

SEQ ID NO: 6408909 - DNA, 23 bp, Homo sapiens
tagctttaatgatatgcttgtaa

SEQ ID NO: 6408910 - DNA, 15 bp, Homo sapiens
tagctttaattaagc

SEQ ID NO: 6408911 - DNA, 14 bp, Homo sapiens
tagctttacatttt

SEQ ID NO: 6408912 - DNA, 14 bp, Homo sapiens
tagctttaccctca

SEQ ID NO: 6408913 - DNA, 18 bp, Homo sapiens
tagctttatatatggaca

SEQ ID NO: 6408914 - DNA, 18 bp, Homo sapiens
tagctttattatggcttg

SEQ ID NO: 6408915 - DNA, 14 bp, Homo sapiens
tagctttattcttc

SEQ ID NO: 6408916 - DNA, 15 bp, Homo sapiens
tagctttattcttca

SEQ ID NO: 6408917 - DNA, 20 bp, Homo sapiens
tagctttattttttaagtat

SEQ ID NO: 6408918 - DNA, 17 bp, Homo sapiens
tagctttcaattccgta

SEQ ID NO: 6408919 - DNA, 17 bp, Homo sapiens
tagctttccaaggaagc

SEQ ID NO: 6408920 - DNA, 19 bp, Homo sapiens
tagctttccaaggaagcag

SEQ ID NO: 6408921 - DNA, 20 bp, Homo sapiens
tagctttccaaggaagcaga

SEQ ID NO: 6408922 - DNA, 18 bp, Homo sapiens
tagctttccacatttgtc

SEQ ID NO: 6408923 - DNA, 19 bp, Homo sapiens
tagctttcccaaataaact

SEQ ID NO: 6408924 - DNA, 17 bp, Homo sapiens
tagctttccctgtgcca

SEQ ID NO: 6408925 - DNA, 18 bp, Homo sapiens
tagctttgctctttagat

SEQ ID NO: 6408926 - DNA, 15 bp, Homo sapiens
tagctttgctctttg

SEQ ID NO: 6408927 - DNA, 22 bp, Homo sapiens
tagctttgggcagatttgcaac

SEQ ID NO: 6408928 - DNA, 17 bp, Homo sapiens
tagctttgtatttttgt

SEQ ID NO: 6408929 - DNA, 18 bp, Homo sapiens
tagctttgtgtttacttt

SEQ ID NO: 6408930 - DNA, 14 bp, Homo sapiens
tagctttgtgtttg

SEQ ID NO: 6408931 - DNA, 22 bp, Homo sapiens
tagctttgtgtttggtttacat

SEQ ID NO: 6408932 - DNA, 15 bp, Homo sapiens
tccagtttccccatg

SEQ ID NO: 6408933 - DNA, 20 bp, Homo sapiens
tccagtttctagagggcact

SEQ ID NO: 6408934 - DNA, 17 bp, Homo sapiens
tccagtttgcacctgtc

SEQ ID NO: 6408935 - DNA, 13 bp, Homo sapiens
tccagtttgcatt

SEQ ID NO: 6408936 - DNA, 16 bp, Homo sapiens
tccagtttgcatttgg

SEQ ID NO: 6408937 - DNA, 14 bp, Homo sapiens
tccagtttgttctc

SEQ ID NO: 6408938 - DNA, 17 bp, Homo sapiens
tccagtttgttctccgg

SEQ ID NO: 6408939 - DNA, 19 bp, Homo sapiens
tccagtttgttctccgggt

SEQ ID NO: 6408940 - DNA, 12 bp, Homo sapiens
tccagtttgttt

SEQ ID NO: 6408941 - DNA, 15 bp, Homo sapiens
tccagttttgtttgg

SEQ ID NO: 6408942 - DNA, 22 bp, Homo sapiens
tccagtttttgtttttgcatga

SEQ ID NO: 6408943 - DNA, 23 bp, Homo sapiens
tccagttttttgccactgcaaac

SEQ ID NO: 6408944 - DNA, 15 bp, Homo sapiens
tccataaaaaaaaat

SEQ ID NO: 6408945 - DNA, 23 bp, Homo sapiens
tccataaacagactgttaattat

SEQ ID NO: 6408946 - DNA, 13 bp, Homo sapiens
tccataaacatga

SEQ ID NO: 6408947 - DNA, 17 bp, Homo sapiens
tccataaactaagagaa

SEQ ID NO: 6408948 - DNA, 18 bp, Homo sapiens
tccataaactaagagaaa

SEQ ID NO: 6408949 - DNA, 21 bp, Homo sapiens
tccataaagaagatgtttaac

SEQ ID NO: 6408950 - DNA, 20 bp, Homo sapiens
tccataaagacaatcactgc

SEQ ID NO: 6408951 - DNA, 20 bp, Homo sapiens
tccataaagtacaaatgaag

SEQ ID NO: 6408952 - DNA, 16 bp, Homo sapiens
tccataaagtgtaatt

SEQ ID NO: 6408953 - DNA, 17 bp, Homo sapiens
tccataaatgtgttcct

SEQ ID NO: 6408954 - DNA, 23 bp, Homo sapiens
tccataaccccaggcatcccatc

SEQ ID NO: 6408955 - DNA, 14 bp, Homo sapiens
tccataactgaaca

SEQ ID NO: 6408956 - DNA, 16 bp, Homo sapiens
tccataaggaatgtag

SEQ ID NO: 6408957 - DNA, 21 bp, Homo sapiens
tccataataaacttctggtgt

SEQ ID NO: 6408958 - DNA, 19 bp, Homo sapiens
tccataataattctgcttt

SEQ ID NO: 6408959 - DNA, 22 bp, Homo sapiens
tccataatctggactcctctgt

SEQ ID NO: 6408960 - DNA, 13 bp, Homo sapiens
tccataatgccac

SEQ ID NO: 6408961 - DNA, 16 bp, Homo sapiens
tccataatgctactgt

SEQ ID NO: 6408962 - DNA, 18 bp, Homo sapiens
tccataatgctactgtct

SEQ ID NO: 6408963 - DNA, 12 bp, Homo sapiens
tccataatgtat

SEQ ID NO: 6408964 - DNA, 12 bp, Homo sapiens
tccataattatg

SEQ ID NO: 6408965 - DNA, 14 bp, Homo sapiens
tccataatttggtc

SEQ ID NO: 6408966 - DNA, 14 bp, Homo sapiens
tccatacagcctct

SEQ ID NO: 6408967 - DNA, 16 bp, Homo sapiens
tccatacagcctctac

SEQ ID NO: 6408968 - DNA, 21 bp, Homo sapiens
tccatacagggtctcttcctt

SEQ ID NO: 6408969 - DNA, 20 bp, Homo sapiens
tccatacagtcaagatacat

SEQ ID NO: 6408970 - DNA, 15 bp, Homo sapiens
tccatacatttgtgt

SEQ ID NO: 6408971 - DNA, 15 bp, Homo sapiens
tccataccagctcgc

SEQ ID NO: 6408972 - DNA, 21 bp, Homo sapiens
tccatacccacaatctgagca

SEQ ID NO: 6408973 - DNA, 15 bp, Homo sapiens
tccataccccctgcc

SEQ ID NO: 6408974 - DNA, 16 bp, Homo sapiens
tccataccccctgccc

SEQ ID NO: 6408975 - DNA, 17 bp, Homo sapiens
tccataccccctgcccc

SEQ ID NO: 6408976 - DNA, 23 bp, Homo sapiens
tccataccccctgccccagagaa

SEQ ID NO: 6408977 - DNA, 20 bp, Homo sapiens
tccataccccgccaaggaaa

SEQ ID NO: 6408978 - DNA, 22 bp, Homo sapiens
tccatacctcgaacatcagttg

SEQ ID NO: 6408979 - DNA, 19 bp, Homo sapiens
tccatacctgcccctgcct

SEQ ID NO: 6408980 - DNA, 13 bp, Homo sapiens
tccataccttttc

SEQ ID NO: 6408981 - DNA, 18 bp, Homo sapiens
tccatactatgacaatct

SEQ ID NO: 6408982 - DNA, 13 bp, Homo sapiens
tccatactcagga

SEQ ID NO: 6408983 - DNA, 17 bp, Homo sapiens
tccatactgtagacact

SEQ ID NO: 6408984 - DNA, 18 bp, Homo sapiens
tccatactgtagacactc

SEQ ID NO: 6408985 - DNA, 17 bp, Homo sapiens
tccatactttggatgac

SEQ ID NO: 6408986 - DNA, 23 bp, Homo sapiens
tccatagacatcagtattctgcc

SEQ ID NO: 6408987 - DNA, 14 bp, Homo sapiens
tccatagagagcaa

SEQ ID NO: 6408988 - DNA, 18 bp, Homo sapiens
tccatagagatgagccca

SEQ ID NO: 6408989 - DNA, 21 bp, Homo sapiens
tccatagagatgagcccaccc

SEQ ID NO: 6408990 - DNA, 16 bp, Homo sapiens
tccatagagcagtgca

SEQ ID NO: 6408991 - DNA, 13 bp, Homo sapiens
tccatagcacaag

SEQ ID NO: 6408992 - DNA, 15 bp, Homo sapiens
tccatagctcaataa

SEQ ID NO: 6408993 - DNA, 17 bp, Homo sapiens
tccatagctcaataaaa

SEQ ID NO: 6408994 - DNA, 17 bp, Homo sapiens
tccatagctccttccca

SEQ ID NO: 6408995 - DNA, 17 bp, Homo sapiens
tccataggaatcatgtt

SEQ ID NO: 6408996 - DNA, 22 bp, Homo sapiens
tccataggagggaaggagcagt

SEQ ID NO: 6408997 - DNA, 21 bp, Homo sapiens
tccataggtttctctccctcc

SEQ ID NO: 6408998 - DNA, 22 bp, Homo sapiens
tccatagtatattaaaaatggt

SEQ ID NO: 6408999 - DNA, 23 bp, Homo sapiens
tccatagtggaccacttggaaat

SEQ ID NO: 6409000 - DNA, 23 bp, Homo sapiens
tccatagttttgatgactggcat

SEQ ID NO: 6409001 - DNA, 12 bp, Homo sapiens
tccatataaata

SEQ ID NO: 6409002 - DNA, 14 bp, Homo sapiens
tccatataacaatt

SEQ ID NO: 6409003 - DNA, 15 bp, Homo sapiens
tccatatacatatat

SEQ ID NO: 6409004 - DNA, 17 bp, Homo sapiens
tccatatagtctattca

SEQ ID NO: 6409005 - DNA, 23 bp, Homo sapiens
tccatatagtttgttttcttttt

SEQ ID NO: 6409006 - DNA, 17 bp, Homo sapiens
tccatatatatgaaatg

SEQ ID NO: 6409007 - DNA, 14 bp, Homo sapiens
tccatatattggca

SEQ ID NO: 6409008 - DNA, 16 bp, Homo sapiens
tccatatattggcact

SEQ ID NO: 6409009 - DNA, 19 bp, Homo sapiens
tccatatccatagtgactt

SEQ ID NO: 6409010 - DNA, 19 bp, Homo sapiens
tccatatccgggtgctcaa

SEQ ID NO: 6409011 - DNA, 18 bp, Homo sapiens
tccatatccttctggctg

SEQ ID NO: 6409012 - DNA, 14 bp, Homo sapiens
tccatatcttgcga

SEQ ID NO: 6409013 - DNA, 21 bp, Homo sapiens
tccatatcttgcgaatccaag

SEQ ID NO: 6409014 - DNA, 22 bp, Homo sapiens
tccatatcttgcgaatccaagc

SEQ ID NO: 6409015 - DNA, 19 bp, Homo sapiens
tccatatggatccactggc

SEQ ID NO: 6409016 - DNA, 13 bp, Homo sapiens
tccatatggattt

SEQ ID NO: 6409017 - DNA, 18 bp, Homo sapiens
tccatatggattttctat

SEQ ID NO: 6409018 - DNA, 19 bp, Homo sapiens
tccatattacgttgtttct

SEQ ID NO: 6409019 - DNA, 14 bp, Homo sapiens
tccatattcatgta

SEQ ID NO: 6409020 - DNA, 20 bp, Homo sapiens
tccatatttacattctagtt

SEQ ID NO: 6409021 - DNA, 19 bp, Homo sapiens
tccatatttataggtaccc

SEQ ID NO: 6409022 - DNA, 13 bp, Homo sapiens
tccatatttggaa

SEQ ID NO: 6409023 - DNA, 18 bp, Homo sapiens
tccatatttggatggtga

SEQ ID NO: 6409024 - DNA, 23 bp, Homo sapiens
tccatattttaaaagagaaaaac

SEQ ID NO: 6409025 - DNA, 18 bp, Homo sapiens
tccatattttattactgt

SEQ ID NO: 6409026 - DNA, 16 bp, Homo sapiens
tccatatttttacaac

SEQ ID NO: 6409027 - DNA, 17 bp, Homo sapiens
tccatatttttttcctt

SEQ ID NO: 6409028 - DNA, 14 bp, Homo sapiens
tccatcaaagagaa

SEQ ID NO: 6409029 - DNA, 14 bp, Homo sapiens
tccatcaaagccct

SEQ ID NO: 6409030 - DNA, 19 bp, Homo sapiens
tccatcaaagccctccctg

SEQ ID NO: 6409031 - DNA, 22 bp, Homo sapiens
tccatcaactcccaacttcttc

SEQ ID NO: 6409032 - DNA, 23 bp, Homo sapiens
tccatcaactcccaacttcttcc

SEQ ID NO: 6409033 - DNA, 15 bp, Homo sapiens
tccatcaataaatgc

SEQ ID NO: 6409034 - DNA, 23 bp, Homo sapiens
tccatcaataggcaaaagtgtaa

SEQ ID NO: 6409035 - DNA, 12 bp, Homo sapiens
tccatcacagac

SEQ ID NO: 6409036 - DNA, 13 bp, Homo sapiens
tccatcacagcca

SEQ ID NO: 6409037 - DNA, 19 bp, Homo sapiens
tccatcacagccagcccag

SEQ ID NO: 6409038 - DNA, 21 bp, Homo sapiens
tccatcacagccagcccagct

SEQ ID NO: 6409039 - DNA, 15 bp, Homo sapiens
tccatcacccctggt

SEQ ID NO: 6409040 - DNA, 21 bp, Homo sapiens
tccatcacctgaaacactgga

SEQ ID NO: 6409041 - DNA, 22 bp, Homo sapiens
tccatcacctgaaacactggac

SEQ ID NO: 6409042 - DNA, 16 bp, Homo sapiens
tccatcagatgacaag

SEQ ID NO: 6409043 - DNA, 21 bp, Homo sapiens
tccatcagatgtgttcctcca

SEQ ID NO: 6409044 - DNA, 13 bp, Homo sapiens
tccatcagccagg

SEQ ID NO: 6409045 - DNA, 21 bp, Homo sapiens
tccatcagcgggtctcctccc

SEQ ID NO: 6409046 - DNA, 13 bp, Homo sapiens
tccatcagcttta

SEQ ID NO: 6409047 - DNA, 14 bp, Homo sapiens
tccatcaggcagat

SEQ ID NO: 6409048 - DNA, 17 bp, Homo sapiens
tccatcatcactgtaaa

SEQ ID NO: 6409049 - DNA, 18 bp, Homo sapiens
tccatcatcactgtaaag

SEQ ID NO: 6409050 - DNA, 21 bp, Homo sapiens
tccatcatctcttttcccact

SEQ ID NO: 6409051 - DNA, 12 bp, Homo sapiens
tccatcatgtcc

SEQ ID NO: 6409052 - DNA, 14 bp, Homo sapiens
tccatcatttctgt

SEQ ID NO: 6409053 - DNA, 12 bp, Homo sapiens
tccatcatttta

SEQ ID NO: 6409054 - DNA, 14 bp, Homo sapiens
tccatcattttaca

SEQ ID NO: 6409055 - DNA, 21 bp, Homo sapiens
tccatccaaggccaggttctc

SEQ ID NO: 6409056 - DNA, 11 bp, Homo sapiens
tccatccaatc

SEQ ID NO: 6409057 - DNA, 20 bp, Homo sapiens
tccatccacacacagcagct

SEQ ID NO: 6409058 - DNA, 21 bp, Homo sapiens
tccatccacacacagcagctc

SEQ ID NO: 6409059 - DNA, 23 bp, Homo sapiens
tccatccacacacagcagctcca

SEQ ID NO: 6409060 - DNA, 14 bp, Homo sapiens
tccatccagctaca

SEQ ID NO: 6409061 - DNA, 16 bp, Homo sapiens
tccatccagcttgcca

SEQ ID NO: 6409062 - DNA, 14 bp, Homo sapiens
tccatccatctctc

SEQ ID NO: 6409063 - DNA, 12 bp, Homo sapiens
tccatccatctt

SEQ ID NO: 6409064 - DNA, 16 bp, Homo sapiens
tccatccatctttcca

SEQ ID NO: 6409065 - DNA, 19 bp, Homo sapiens
tccatcccaaccagtgcca

SEQ ID NO: 6409066 - DNA, 21 bp, Homo sapiens
tccatcccaaccagtgccaag

SEQ ID NO: 6409067 - DNA, 23 bp, Homo sapiens
tccatcccaaccagtgccaagga

SEQ ID NO: 6409068 - DNA, 15 bp, Homo sapiens
tccatcccactccac

SEQ ID NO: 6409069 - DNA, 21 bp, Homo sapiens
tccatcccaggacaccacacc

SEQ ID NO: 6409070 - DNA, 15 bp, Homo sapiens
tccatccccagttgg

SEQ ID NO: 6409071 - DNA, 16 bp, Homo sapiens
tccatcccccttcttc

SEQ ID NO: 6409072 - DNA, 12 bp, Homo sapiens
tccatcccctcc

SEQ ID NO: 6409073 - DNA, 16 bp, Homo sapiens
tccatcccctccctgc

SEQ ID NO: 6409074 - DNA, 21 bp, Homo sapiens
tccatccccttcccccatccc

SEQ ID NO: 6409075 - DNA, 20 bp, Homo sapiens
tccatcccgaaaatctctcg

SEQ ID NO: 6409076 - DNA, 13 bp, Homo sapiens
tccatccctagaa

SEQ ID NO: 6409077 - DNA, 15 bp, Homo sapiens
tccatccctctaatg

SEQ ID NO: 6409078 - DNA, 21 bp, Homo sapiens
tccatccctgaaatttctcat

SEQ ID NO: 6409079 - DNA, 14 bp, Homo sapiens
tccatccctgctct

SEQ ID NO: 6409080 - DNA, 20 bp, Homo sapiens
tccatccctggccccctccc

SEQ ID NO: 6409081 - DNA, 14 bp, Homo sapiens
tccatcccttcccc

SEQ ID NO: 6409082 - DNA, 13 bp, Homo sapiens
tccatcccttttc

SEQ ID NO: 6409083 - DNA, 15 bp, Homo sapiens
tccatcccttttcct

SEQ ID NO: 6409084 - DNA, 19 bp, Homo sapiens
tccatccgactgcccctgc

SEQ ID NO: 6409085 - DNA, 15 bp, Homo sapiens
tccatccgtccagcc

SEQ ID NO: 6409086 - DNA, 16 bp, Homo sapiens
tccatccgtccagcca

SEQ ID NO: 6409087 - DNA, 13 bp, Homo sapiens
tccatccgtctct

SEQ ID NO: 6409088 - DNA, 14 bp, Homo sapiens
tccatcctcatctc

SEQ ID NO: 6409089 - DNA, 21 bp, Homo sapiens
tccatcctcatctctcttggg

SEQ ID NO: 6409090 - DNA, 16 bp, Homo sapiens
tccatcctcccaggaa

SEQ ID NO: 6409091 - DNA, 15 bp, Homo sapiens
tccatcctcctctcc

SEQ ID NO: 6409092 - DNA, 21 bp, Homo sapiens
tccatcctcctctccatgcaa

SEQ ID NO: 6409093 - DNA, 12 bp, Homo sapiens
tccatcctgagc

SEQ ID NO: 6409094 - DNA, 16 bp, Homo sapiens
tccatcctgagccaaa

SEQ ID NO: 6409095 - DNA, 20 bp, Homo sapiens
tccatcctgaggtgcctccc

SEQ ID NO: 6409096 - DNA, 12 bp, Homo sapiens
tccatcctgcaa

SEQ ID NO: 6409097 - DNA, 19 bp, Homo sapiens
tccatcctgcaaaggccct

SEQ ID NO: 6409098 - DNA, 17 bp, Homo sapiens
tccatcctgccaggagc

SEQ ID NO: 6409099 - DNA, 12 bp, Homo sapiens
tccatcctgcta

SEQ ID NO: 6409100 - DNA, 12 bp, Homo sapiens
tccatcctggtc

SEQ ID NO: 6409101 - DNA, 14 bp, Homo sapiens
tccatcctgtgtcc

SEQ ID NO: 6409102 - DNA, 20 bp, Homo sapiens
tccatccttgagtcaaaaaa

SEQ ID NO: 6409103 - DNA, 18 bp, Homo sapiens
tccatccttttgcttcat

SEQ ID NO: 6409104 - DNA, 22 bp, Homo sapiens
tccatccttttgcttcatctgg

SEQ ID NO: 6409105 - DNA, 22 bp, Homo sapiens
tccatcgatttgtattaatgta

SEQ ID NO: 6409106 - DNA, 18 bp, Homo sapiens
tccatcgccatcttcttc

SEQ ID NO: 6409107 - DNA, 24 bp, Homo sapiens
tccatcgcccaggcctgggatgca

SEQ ID NO: 6409108 - DNA, 21 bp, Homo sapiens
tccatctaaaatactcaccaa

SEQ ID NO: 6409109 - DNA, 18 bp, Homo sapiens
tccatctaaactgccccc

SEQ ID NO: 6409110 - DNA, 18 bp, Homo sapiens
tccatctagcagctggcc

SEQ ID NO: 6409111 - DNA, 15 bp, Homo sapiens
tagcttttaccaacc

SEQ ID NO: 6409112 - DNA, 16 bp, Homo sapiens
tagcttttagcctggc

SEQ ID NO: 6409113 - DNA, 18 bp, Homo sapiens
tagcttttagcctggctg

SEQ ID NO: 6409114 - DNA, 14 bp, Homo sapiens
tagcttttatctgc

SEQ ID NO: 6409115 - DNA, 15 bp, Homo sapiens
tagcttttatgtgat

SEQ ID NO: 6409116 - DNA, 22 bp, Homo sapiens
tagcttttattgagtaatatta

SEQ ID NO: 6409117 - DNA, 19 bp, Homo sapiens
tagcttttcacttcttaag

SEQ ID NO: 6409118 - DNA, 23 bp, Homo sapiens
tagcttttcagttcccgctctgc

SEQ ID NO: 6409119 - DNA, 19 bp, Homo sapiens
tagcttttcatcaattctt

SEQ ID NO: 6409120 - DNA, 12 bp, Homo sapiens
tagcttttcctt

SEQ ID NO: 6409121 - DNA, 11 bp, Homo sapiens
tagcttttcta

SEQ ID NO: 6409122 - DNA, 16 bp, Homo sapiens
tagcttttgtgtctta

SEQ ID NO: 6409123 - DNA, 20 bp, Homo sapiens
tagctttttaattaagcaaa

SEQ ID NO: 6409124 - DNA, 15 bp, Homo sapiens
tagctttttaattgt

SEQ ID NO: 6409125 - DNA, 16 bp, Homo sapiens
tagctttttaattgtt

SEQ ID NO: 6409126 - DNA, 20 bp, Homo sapiens
tagctttttcatccccttac

SEQ ID NO: 6409127 - DNA, 15 bp, Homo sapiens
tagctttttcctgga

SEQ ID NO: 6409128 - DNA, 22 bp, Homo sapiens
taggaaaaaaactattaaggat

SEQ ID NO: 6409129 - DNA, 13 bp, Homo sapiens
taggaaaaactga

SEQ ID NO: 6409130 - DNA, 13 bp, Homo sapiens
taggaaaagatat

SEQ ID NO: 6409131 - DNA, 12 bp, Homo sapiens
taggaaaagcat

SEQ ID NO: 6409132 - DNA, 20 bp, Homo sapiens
taggaaaagctgttcccatg

SEQ ID NO: 6409133 - DNA, 14 bp, Homo sapiens
taggaaaatacatt

SEQ ID NO: 6409134 - DNA, 16 bp, Homo sapiens
taggaaaatacattgt

SEQ ID NO: 6409135 - DNA, 13 bp, Homo sapiens
taggaaaatattt

SEQ ID NO: 6409136 - DNA, 16 bp, Homo sapiens
taggaaaatgcttatt

SEQ ID NO: 6409137 - DNA, 13 bp, Homo sapiens
taggaaaatgtac

SEQ ID NO: 6409138 - DNA, 12 bp, Homo sapiens
taggaaaattat

SEQ ID NO: 6409139 - DNA, 15 bp, Homo sapiens
taggaaaattttctt

SEQ ID NO: 6409140 - DNA, 21 bp, Homo sapiens
taggaaacaaagcttagcagg

SEQ ID NO: 6409141 - DNA, 13 bp, Homo sapiens
taggaaacaagtg

SEQ ID NO: 6409142 - DNA, 20 bp, Homo sapiens
taggaaacaccattataaaa

SEQ ID NO: 6409143 - DNA, 18 bp, Homo sapiens
taggaaacagaaaagaga

SEQ ID NO: 6409144 - DNA, 21 bp, Homo sapiens
taggaaaccccccaatgtctg

SEQ ID NO: 6409145 - DNA, 20 bp, Homo sapiens
taggaaactgaagcataaag

SEQ ID NO: 6409146 - DNA, 19 bp, Homo sapiens
taggaaactttttccacct

SEQ ID NO: 6409147 - DNA, 19 bp, Homo sapiens
taggaaagaccatttttcc

SEQ ID NO: 6409148 - DNA, 22 bp, Homo sapiens
taggaaagcaccgcagcatgtg

SEQ ID NO: 6409149 - DNA, 23 bp, Homo sapiens
taggaaagcaccgcagcatgtgg

SEQ ID NO: 6409150 - DNA, 22 bp, Homo sapiens
taggaaagcgtggttccaagaa

SEQ ID NO: 6409151 - DNA, 17 bp, Homo sapiens
taggaaaggcagaaaca

SEQ ID NO: 6409152 - DNA, 20 bp, Homo sapiens
taggaaagtactgcatgatc

SEQ ID NO: 6409153 - DNA, 14 bp, Homo sapiens
taggaaataaaacc

SEQ ID NO: 6409154 - DNA, 20 bp, Homo sapiens
taggaaataaaacctttcaa

SEQ ID NO: 6409155 - DNA, 17 bp, Homo sapiens
taggaaatctgaagcct

SEQ ID NO: 6409156 - DNA, 23 bp, Homo sapiens
taggaaatggctttgtgattcaa

SEQ ID NO: 6409157 - DNA, 21 bp, Homo sapiens
taggaaatgtttttaataaaa

SEQ ID NO: 6409158 - DNA, 22 bp, Homo sapiens
taggaacaaatcttcctggtcg

SEQ ID NO: 6409159 - DNA, 18 bp, Homo sapiens
taggaacaagctggcttc

SEQ ID NO: 6409160 - DNA, 17 bp, Homo sapiens
taggaacagagtatata

SEQ ID NO: 6409161 - DNA, 18 bp, Homo sapiens
taggaacagagtatatat

SEQ ID NO: 6409162 - DNA, 19 bp, Homo sapiens
taggaacagagtatatatg

SEQ ID NO: 6409163 - DNA, 14 bp, Homo sapiens
taggaacagcccag

SEQ ID NO: 6409164 - DNA, 23 bp, Homo sapiens
taggaaccagccaaccatcatgt

SEQ ID NO: 6409165 - DNA, 19 bp, Homo sapiens
taggaacccggcatgccga

SEQ ID NO: 6409166 - DNA, 22 bp, Homo sapiens
taggaacccggcatgccgagtg

SEQ ID NO: 6409167 - DNA, 17 bp, Homo sapiens
taggaactttatgttct

SEQ ID NO: 6409168 - DNA, 11 bp, Homo sapiens
taggaagaaaa

SEQ ID NO: 6409169 - DNA, 19 bp, Homo sapiens
taggaagaaagaagacaaa

SEQ ID NO: 6409170 - DNA, 13 bp, Homo sapiens
taggaagaaatca

SEQ ID NO: 6409171 - DNA, 19 bp, Homo sapiens
taggaagaaatcacttaaa

SEQ ID NO: 6409172 - DNA, 21 bp, Homo sapiens
taggaagaacgcggtgtgtaa

SEQ ID NO: 6409173 - DNA, 13 bp, Homo sapiens
taggaagaatttt

SEQ ID NO: 6409174 - DNA, 15 bp, Homo sapiens
taggaagaattttaa

SEQ ID NO: 6409175 - DNA, 22 bp, Homo sapiens
taggaagaattttaaaaatgaa

SEQ ID NO: 6409176 - DNA, 14 bp, Homo sapiens
taggaagacataaa

SEQ ID NO: 6409177 - DNA, 22 bp, Homo sapiens
taggaagacataaaactttaaa

SEQ ID NO: 6409178 - DNA, 15 bp, Homo sapiens
taggaagactttgga

SEQ ID NO: 6409179 - DNA, 14 bp, Homo sapiens
taggaagagaaacc

SEQ ID NO: 6409180 - DNA, 19 bp, Homo sapiens
taggaagagaaaccaggga

SEQ ID NO: 6409181 - DNA, 21 bp, Homo sapiens
taggaagagaggtccagcccc

SEQ ID NO: 6409182 - DNA, 21 bp, Homo sapiens
taggaagagcccgcagggcca

SEQ ID NO: 6409183 - DNA, 21 bp, Homo sapiens
taggaagagccttccacccag

SEQ ID NO: 6409184 - DNA, 13 bp, Homo sapiens
taggaagcatatg

SEQ ID NO: 6409185 - DNA, 16 bp, Homo sapiens
taggaagcctgaggca

SEQ ID NO: 6409186 - DNA, 12 bp, Homo sapiens
taggaaggaaac

SEQ ID NO: 6409187 - DNA, 12 bp, Homo sapiens
taggaaggagag

SEQ ID NO: 6409188 - DNA, 17 bp, Homo sapiens
taggaaggcacttctgc

SEQ ID NO: 6409189 - DNA, 19 bp, Homo sapiens
taggaaggcacttctgcct

SEQ ID NO: 6409190 - DNA, 19 bp, Homo sapiens
taggaaggccatggggcag

SEQ ID NO: 6409191 - DNA, 18 bp, Homo sapiens
taggaagggaccaaggca

SEQ ID NO: 6409192 - DNA, 16 bp, Homo sapiens
taggaagtaaattata

SEQ ID NO: 6409193 - DNA, 17 bp, Homo sapiens
taggaagtgacttgaat

SEQ ID NO: 6409194 - DNA, 14 bp, Homo sapiens
taggaagtggctgg

SEQ ID NO: 6409195 - DNA, 18 bp, Homo sapiens
taggaagtgtaacagctg

SEQ ID NO: 6409196 - DNA, 19 bp, Homo sapiens
taggaagtgtaacagctga

SEQ ID NO: 6409197 - DNA, 20 bp, Homo sapiens
taggaagtgtaacagctgag

SEQ ID NO: 6409198 - DNA, 23 bp, Homo sapiens
taggaagttacctggatgccatt

SEQ ID NO: 6409199 - DNA, 19 bp, Homo sapiens
taggaagttcttttttgta

SEQ ID NO: 6409200 - DNA, 16 bp, Homo sapiens
taggaagttttctgta

SEQ ID NO: 6409201 - DNA, 17 bp, Homo sapiens
taggaagttttttctac

SEQ ID NO: 6409202 - DNA, 16 bp, Homo sapiens
taggaataaaattatg

SEQ ID NO: 6409203 - DNA, 15 bp, Homo sapiens
taggaataacactgc

SEQ ID NO: 6409204 - DNA, 16 bp, Homo sapiens
taggaatagaggaaga

SEQ ID NO: 6409205 - DNA, 18 bp, Homo sapiens
taggaatagaggaagaaa

SEQ ID NO: 6409206 - DNA, 19 bp, Homo sapiens
taggaatatgactcaggag

SEQ ID NO: 6409207 - DNA, 16 bp, Homo sapiens
taggaatattatattt

SEQ ID NO: 6409208 - DNA, 18 bp, Homo sapiens
taggaatattatatttgg

SEQ ID NO: 6409209 - DNA, 23 bp, Homo sapiens
taggaatattatatttggatgca

SEQ ID NO: 6409210 - DNA, 14 bp, Homo sapiens
taggaatcccagag

SEQ ID NO: 6409211 - DNA, 20 bp, Homo sapiens
taggaatcccagaggtggga

SEQ ID NO: 6409212 - DNA, 17 bp, Homo sapiens
taggaatctgccttcca

SEQ ID NO: 6409213 - DNA, 23 bp, Homo sapiens
taggaatggaggagccaggcccc

SEQ ID NO: 6409214 - DNA, 17 bp, Homo sapiens
taggaattcatcttttg

SEQ ID NO: 6409215 - DNA, 18 bp, Homo sapiens
taggaattcatcttttga

SEQ ID NO: 6409216 - DNA, 18 bp, Homo sapiens
taggaattgaattaataa

SEQ ID NO: 6409217 - DNA, 16 bp, Homo sapiens
taggaattgtgtttat

SEQ ID NO: 6409218 - DNA, 17 bp, Homo sapiens
taggaattgtttataca

SEQ ID NO: 6409219 - DNA, 18 bp, Homo sapiens
taggacaaagtatttgaa

SEQ ID NO: 6409220 - DNA, 21 bp, Homo sapiens
taggacaaggctgtgccaggc

SEQ ID NO: 6409221 - DNA, 23 bp, Homo sapiens
taggacaaggctgtgccaggctg

SEQ ID NO: 6409222 - DNA, 14 bp, Homo sapiens
taggacaaggggtg

SEQ ID NO: 6409223 - DNA, 19 bp, Homo sapiens
taggacaaggtgcaggcag

SEQ ID NO: 6409224 - DNA, 14 bp, Homo sapiens
taggacaagtttta

SEQ ID NO: 6409225 - DNA, 22 bp, Homo sapiens
taggacaagttttagttaaaac

SEQ ID NO: 6409226 - DNA, 18 bp, Homo sapiens
taggacaatcagtcccct

SEQ ID NO: 6409227 - DNA, 19 bp, Homo sapiens
taggacacagttcctggga

SEQ ID NO: 6409228 - DNA, 9 bp, Homo sapiens
taggacaga

SEQ ID NO: 6409229 - DNA, 20 bp, Homo sapiens
taggacatgttcccttctcc

SEQ ID NO: 6409230 - DNA, 18 bp, Homo sapiens
taggaccaagcatcttgg

SEQ ID NO: 6409231 - DNA, 15 bp, Homo sapiens
taggaccactcagcc

SEQ ID NO: 6409232 - DNA, 19 bp, Homo sapiens
taggaccactcagccccta

SEQ ID NO: 6409233 - DNA, 14 bp, Homo sapiens
taggaccagttttg

SEQ ID NO: 6409234 - DNA, 18 bp, Homo sapiens
taggaccagttttgtatc

SEQ ID NO: 6409235 - DNA, 23 bp, Homo sapiens
taggaccatggttaagagtccaa

SEQ ID NO: 6409236 - DNA, 14 bp, Homo sapiens
taggacccaagcag

SEQ ID NO: 6409237 - DNA, 16 bp, Homo sapiens
taggacccaagcagag

SEQ ID NO: 6409238 - DNA, 22 bp, Homo sapiens
taggacccccagtgctcacaca

SEQ ID NO: 6409239 - DNA, 22 bp, Homo sapiens
taggacctgcatccttcctggg

SEQ ID NO: 6409240 - DNA, 13 bp, Homo sapiens
taggaccttgggc

SEQ ID NO: 6409241 - DNA, 15 bp, Homo sapiens
taggacgttggcctc

SEQ ID NO: 6409242 - DNA, 16 bp, Homo sapiens
taggacgttggcctca

SEQ ID NO: 6409243 - DNA, 18 bp, Homo sapiens
taggactaccgcaggccc

SEQ ID NO: 6409244 - DNA, 19 bp, Homo sapiens
taggactaccgcaggcccg

SEQ ID NO: 6409245 - DNA, 20 bp, Homo sapiens
taggactccatttctttctt

SEQ ID NO: 6409246 - DNA, 16 bp, Homo sapiens
taggactctgaggctc

SEQ ID NO: 6409247 - DNA, 15 bp, Homo sapiens
taggactgtggaggg

SEQ ID NO: 6409248 - DNA, 18 bp, Homo sapiens
taggactgtggaggggag

SEQ ID NO: 6409249 - DNA, 11 bp, Homo sapiens
taggacttcaa

SEQ ID NO: 6409250 - DNA, 12 bp, Homo sapiens
taggacttcaaa

SEQ ID NO: 6409251 - DNA, 17 bp, Homo sapiens
taggacttgagcctcca

SEQ ID NO: 6409252 - DNA, 18 bp, Homo sapiens
taggactttcttctaaat

SEQ ID NO: 6409253 - DNA, 20 bp, Homo sapiens
taggacttttaaacaaaagt

SEQ ID NO: 6409254 - DNA, 14 bp, Homo sapiens
taggagaaacacat

SEQ ID NO: 6409255 - DNA, 20 bp, Homo sapiens
taggagaaccaaatctggaa

SEQ ID NO: 6409256 - DNA, 21 bp, Homo sapiens
taggagaacgtatcaatacag

SEQ ID NO: 6409257 - DNA, 14 bp, Homo sapiens
taggagaagggctg

SEQ ID NO: 6409258 - DNA, 15 bp, Homo sapiens
taggagaagggctga

SEQ ID NO: 6409259 - DNA, 20 bp, Homo sapiens
taggagacagatcactcctg

SEQ ID NO: 6409260 - DNA, 22 bp, Homo sapiens
taggagacagatcactcctgga

SEQ ID NO: 6409261 - DNA, 17 bp, Homo sapiens
taggagaccagaagtga

SEQ ID NO: 6409262 - DNA, 12 bp, Homo sapiens
taggagactgcg

SEQ ID NO: 6409263 - DNA, 17 bp, Homo sapiens
taggagacttgccagag

SEQ ID NO: 6409264 - DNA, 12 bp, Homo sapiens
taggagacttgt

SEQ ID NO: 6409265 - DNA, 11 bp, Homo sapiens
taggagacttt

SEQ ID NO: 6409266 - DNA, 22 bp, Homo sapiens
taggagagactgaaagcagcag

SEQ ID NO: 6409267 - DNA, 19 bp, Homo sapiens
taggagagataccttgaaa

SEQ ID NO: 6409268 - DNA, 20 bp, Homo sapiens
taggagagattgggagaaat

SEQ ID NO: 6409269 - DNA, 14 bp, Homo sapiens
taggagagcactgc

SEQ ID NO: 6409270 - DNA, 19 bp, Homo sapiens
taggagagcactgcctcta

SEQ ID NO: 6409271 - DNA, 22 bp, Homo sapiens
taggagagcactgcctctatgc

SEQ ID NO: 6409272 - DNA, 11 bp, Homo sapiens
taggagaggag

SEQ ID NO: 6409273 - DNA, 17 bp, Homo sapiens
taggagaggagaaccag

SEQ ID NO: 6409274 - DNA, 18 bp, Homo sapiens
taggagaggatgagagcc

SEQ ID NO: 6409275 - DNA, 12 bp, Homo sapiens
taggagatgtca

SEQ ID NO: 6409276 - DNA, 16 bp, Homo sapiens
taggagatgttgggaa

SEQ ID NO: 6409277 - DNA, 15 bp, Homo sapiens
taggagcaagaagaa

SEQ ID NO: 6409278 - DNA, 19 bp, Homo sapiens
taggagcaagaagaaaatg

SEQ ID NO: 6409279 - DNA, 19 bp, Homo sapiens
taggagcactggggtgggg

SEQ ID NO: 6409280 - DNA, 19 bp, Homo sapiens
taggagcaggcttgtggca

SEQ ID NO: 6409281 - DNA, 11 bp, Homo sapiens
taggagcccca

SEQ ID NO: 6409282 - DNA, 15 bp, Homo sapiens
taggagccccagctt

SEQ ID NO: 6409283 - DNA, 23 bp, Homo sapiens
taggagcctgctggtcacagcct

SEQ ID NO: 6409284 - DNA, 13 bp, Homo sapiens
taggagctaaggc

SEQ ID NO: 6409285 - DNA, 21 bp, Homo sapiens
taggagctggatttgggagct

SEQ ID NO: 6409286 - DNA, 15 bp, Homo sapiens
taggagcttccagat

SEQ ID NO: 6409287 - DNA, 15 bp, Homo sapiens
taggaggaaaagaca

SEQ ID NO: 6409288 - DNA, 17 bp, Homo sapiens
taggaggaaaagacaga

SEQ ID NO: 6409289 - DNA, 23 bp, Homo sapiens
taggaggaaaagacagagcctcc

SEQ ID NO: 6409290 - DNA, 18 bp, Homo sapiens
tccatctcaaaacaaaac

SEQ ID NO: 6409291 - DNA, 13 bp, Homo sapiens
tccatctcaacct

SEQ ID NO: 6409292 - DNA, 20 bp, Homo sapiens
tccatctccaagaatgctga

SEQ ID NO: 6409293 - DNA, 15 bp, Homo sapiens
tccatctcccaaggc

SEQ ID NO: 6409294 - DNA, 18 bp, Homo sapiens
tccatctcccaaggctgc

SEQ ID NO: 6409295 - DNA, 22 bp, Homo sapiens
tccatctcccaaggctgccaga

SEQ ID NO: 6409296 - DNA, 20 bp, Homo sapiens
tccatctcctataatctgtc

SEQ ID NO: 6409297 - DNA, 22 bp, Homo sapiens
tccatctcctataatctgtcaa

SEQ ID NO: 6409298 - DNA, 22 bp, Homo sapiens
tccatctcctgctcaccacctg

SEQ ID NO: 6409299 - DNA, 23 bp, Homo sapiens
tccatctctatataaaaacaaaa

SEQ ID NO: 6409300 - DNA, 14 bp, Homo sapiens
tccatctctcatcc

SEQ ID NO: 6409301 - DNA, 18 bp, Homo sapiens
tccatctctcatcctcca

SEQ ID NO: 6409302 - DNA, 14 bp, Homo sapiens
tccatctctctccc

SEQ ID NO: 6409303 - DNA, 17 bp, Homo sapiens
tccatctctctccctta

SEQ ID NO: 6409304 - DNA, 12 bp, Homo sapiens
tccatctctgaa

SEQ ID NO: 6409305 - DNA, 14 bp, Homo sapiens
tccatctctgactt

SEQ ID NO: 6409306 - DNA, 15 bp, Homo sapiens
tccatctctgcctgt

SEQ ID NO: 6409307 - DNA, 14 bp, Homo sapiens
tccatctctggtaa

SEQ ID NO: 6409308 - DNA, 17 bp, Homo sapiens
tccatctcttccttcag

SEQ ID NO: 6409309 - DNA, 20 bp, Homo sapiens
tccatctcttgtttaaattc

SEQ ID NO: 6409310 - DNA, 19 bp, Homo sapiens
tccatctctttaaaaacaa

SEQ ID NO: 6409311 - DNA, 14 bp, Homo sapiens
tccatctgacaaaa

SEQ ID NO: 6409312 - DNA, 21 bp, Homo sapiens
tccatctgcccgcctgcccac

SEQ ID NO: 6409313 - DNA, 15 bp, Homo sapiens
tccatctggcagggt

SEQ ID NO: 6409314 - DNA, 24 bp, Homo sapiens
tccatctgggcttatatgtacttt

SEQ ID NO: 6409315 - DNA, 17 bp, Homo sapiens
tccatctggttttctct

SEQ ID NO: 6409316 - DNA, 12 bp, Homo sapiens
tccatctgtctg

SEQ ID NO: 6409317 - DNA, 17 bp, Homo sapiens
tccatctgtctgtccta

SEQ ID NO: 6409318 - DNA, 19 bp, Homo sapiens
tccatctgtctgtcctacc

SEQ ID NO: 6409319 - DNA, 17 bp, Homo sapiens
tccatctgtttgataca

SEQ ID NO: 6409320 - DNA, 18 bp, Homo sapiens
tccatctgtttgtttttt

SEQ ID NO: 6409321 - DNA, 17 bp, Homo sapiens
tccatcttaatgttact

SEQ ID NO: 6409322 - DNA, 22 bp, Homo sapiens
tccatcttattcccaattaaaa

SEQ ID NO: 6409323 - DNA, 14 bp, Homo sapiens
tccatcttcagttt

SEQ ID NO: 6409324 - DNA, 18 bp, Homo sapiens
tccatcttcagtttctga

SEQ ID NO: 6409325 - DNA, 20 bp, Homo sapiens
tccatcttctccccacagcc

SEQ ID NO: 6409326 - DNA, 16 bp, Homo sapiens
tccatcttctttgcag

SEQ ID NO: 6409327 - DNA, 21 bp, Homo sapiens
tccatcttggtagttctgtgc

SEQ ID NO: 6409328 - DNA, 18 bp, Homo sapiens
tccatcttgtggggccag

SEQ ID NO: 6409329 - DNA, 21 bp, Homo sapiens
tccatcttgtggggccaggac

SEQ ID NO: 6409330 - DNA, 23 bp, Homo sapiens
tccatcttgtttcatttgcttgc

SEQ ID NO: 6409331 - DNA, 15 bp, Homo sapiens
tccatctttatagaa

SEQ ID NO: 6409332 - DNA, 14 bp, Homo sapiens
tccatctttgaact

SEQ ID NO: 6409333 - DNA, 13 bp, Homo sapiens
tccatctttttct

SEQ ID NO: 6409334 - DNA, 23 bp, Homo sapiens
tccatgaaagacctgaataccac

SEQ ID NO: 6409335 - DNA, 23 bp, Homo sapiens
tccatgaagaccacatccacaca

SEQ ID NO: 6409336 - DNA, 21 bp, Homo sapiens
tccatgaagatgtagaggaga

SEQ ID NO: 6409337 - DNA, 22 bp, Homo sapiens
tccatgaatcattgtggtggtt

SEQ ID NO: 6409338 - DNA, 18 bp, Homo sapiens
tccatgaatcgcttctct

SEQ ID NO: 6409339 - DNA, 16 bp, Homo sapiens
tccatgaatgtatcag

SEQ ID NO: 6409340 - DNA, 21 bp, Homo sapiens
tccatgaatgtatcaggaaat

SEQ ID NO: 6409341 - DNA, 16 bp, Homo sapiens
tccatgaatgttcata

SEQ ID NO: 6409342 - DNA, 15 bp, Homo sapiens
tccatgacacccaag

SEQ ID NO: 6409343 - DNA, 13 bp, Homo sapiens
tccatgacatttt

SEQ ID NO: 6409344 - DNA, 20 bp, Homo sapiens
tccatgaccaggccaccatc

SEQ ID NO: 6409345 - DNA, 16 bp, Homo sapiens
tccatgacctcccctc

SEQ ID NO: 6409346 - DNA, 15 bp, Homo sapiens
tccatgacgcaggag

SEQ ID NO: 6409347 - DNA, 17 bp, Homo sapiens
tccatgactgcatttta

SEQ ID NO: 6409348 - DNA, 13 bp, Homo sapiens
tccatgactgctt

SEQ ID NO: 6409349 - DNA, 20 bp, Homo sapiens
tccatgactgcttgccctaa

SEQ ID NO: 6409350 - DNA, 22 bp, Homo sapiens
tccatgactgcttgccctaagc

SEQ ID NO: 6409351 - DNA, 23 bp, Homo sapiens
tccatgactgcttgccctaagca

SEQ ID NO: 6409352 - DNA, 19 bp, Homo sapiens
tccatgactggctgtctgc

SEQ ID NO: 6409353 - DNA, 22 bp, Homo sapiens
tccatgactgtgtgttgtgaaa

SEQ ID NO: 6409354 - DNA, 13 bp, Homo sapiens
tccatgagcaccc

SEQ ID NO: 6409355 - DNA, 19 bp, Homo sapiens
tccatgagcaccccaaggc

SEQ ID NO: 6409356 - DNA, 22 bp, Homo sapiens
tccatgagggcaggcacatgtt

SEQ ID NO: 6409357 - DNA, 20 bp, Homo sapiens
tccatgagggtgggggtgat

SEQ ID NO: 6409358 - DNA, 17 bp, Homo sapiens
tccatgagtcccctgtt

SEQ ID NO: 6409359 - DNA, 18 bp, Homo sapiens
tccatgagtgtctgtgag

SEQ ID NO: 6409360 - DNA, 22 bp, Homo sapiens
tccatgagttatcatgaatttt

SEQ ID NO: 6409361 - DNA, 14 bp, Homo sapiens
tccatgatcaaaat

SEQ ID NO: 6409362 - DNA, 19 bp, Homo sapiens
tccatgatgcaagccagct

SEQ ID NO: 6409363 - DNA, 16 bp, Homo sapiens
tccatgatgcacagta

SEQ ID NO: 6409364 - DNA, 17 bp, Homo sapiens
tccatgatgcacagtat

SEQ ID NO: 6409365 - DNA, 23 bp, Homo sapiens
tccatgatgcacagtatctgctg

SEQ ID NO: 6409366 - DNA, 12 bp, Homo sapiens
tccatgatgtta

SEQ ID NO: 6409367 - DNA, 20 bp, Homo sapiens
tccatgattccaagggccca

SEQ ID NO: 6409368 - DNA, 22 bp, Homo sapiens
tccatgattccaagggcccaga

SEQ ID NO: 6409369 - DNA, 23 bp, Homo sapiens
tccatgattccaagggcccagag

SEQ ID NO: 6409370 - DNA, 15 bp, Homo sapiens
tccatgattctctga

SEQ ID NO: 6409371 - DNA, 20 bp, Homo sapiens
tccatgattttacagagaat

SEQ ID NO: 6409372 - DNA, 21 bp, Homo sapiens
tccatgcaactggagttcctt

SEQ ID NO: 6409373 - DNA, 21 bp, Homo sapiens
tccatgcacaggaaaagggca

SEQ ID NO: 6409374 - DNA, 15 bp, Homo sapiens
tccatgcacatgcac

SEQ ID NO: 6409375 - DNA, 18 bp, Homo sapiens
tccatgcagatctagcca

SEQ ID NO: 6409376 - DNA, 22 bp, Homo sapiens
tccatgcagatctagccaggcc

SEQ ID NO: 6409377 - DNA, 21 bp, Homo sapiens
tccatgcccactgctggtgcc

SEQ ID NO: 6409378 - DNA, 17 bp, Homo sapiens
tccatgccccagctctg

SEQ ID NO: 6409379 - DNA, 18 bp, Homo sapiens
tccatgcccccgccacct

SEQ ID NO: 6409380 - DNA, 19 bp, Homo sapiens
tccatgcccccgccacctc

SEQ ID NO: 6409381 - DNA, 17 bp, Homo sapiens
tccatgccctcccagga

SEQ ID NO: 6409382 - DNA, 17 bp, Homo sapiens
tccatgcctacagataa

SEQ ID NO: 6409383 - DNA, 18 bp, Homo sapiens
tccatgcctacagataat

SEQ ID NO: 6409384 - DNA, 21 bp, Homo sapiens
tccatgcctacagataattta

SEQ ID NO: 6409385 - DNA, 17 bp, Homo sapiens
tccatgcctgaccaaca

SEQ ID NO: 6409386 - DNA, 14 bp, Homo sapiens
tccatgcctgaggg

SEQ ID NO: 6409387 - DNA, 15 bp, Homo sapiens
tccatgcctgagggt

SEQ ID NO: 6409388 - DNA, 15 bp, Homo sapiens
tccatgcctggccct

SEQ ID NO: 6409389 - DNA, 18 bp, Homo sapiens
tccatgcctggcccttgc

SEQ ID NO: 6409390 - DNA, 22 bp, Homo sapiens
tccatgcctgtagctttcctgg

SEQ ID NO: 6409391 - DNA, 23 bp, Homo sapiens
tccatgcctgtagctttcctggt

SEQ ID NO: 6409392 - DNA, 18 bp, Homo sapiens
tccatgccttcaagactt

SEQ ID NO: 6409393 - DNA, 16 bp, Homo sapiens
tccatgcgctcagggc

SEQ ID NO: 6409394 - DNA, 22 bp, Homo sapiens
tccatgcggccggcctggggcc

SEQ ID NO: 6409395 - DNA, 22 bp, Homo sapiens
tccatgcgtgtttctgactctg

SEQ ID NO: 6409396 - DNA, 14 bp, Homo sapiens
tccatgctccaggg

SEQ ID NO: 6409397 - DNA, 16 bp, Homo sapiens
tccatgctcccaactc

SEQ ID NO: 6409398 - DNA, 13 bp, Homo sapiens
tccatgctcctca

SEQ ID NO: 6409399 - DNA, 20 bp, Homo sapiens
tccatgctcctcactgcccg

SEQ ID NO: 6409400 - DNA, 19 bp, Homo sapiens
tccatgctctttcaccctg

SEQ ID NO: 6409401 - DNA, 15 bp, Homo sapiens
tccatgctgcctcca

SEQ ID NO: 6409402 - DNA, 20 bp, Homo sapiens
tccatgctggatactggaca

SEQ ID NO: 6409403 - DNA, 21 bp, Homo sapiens
tccatgctggatactggacac

SEQ ID NO: 6409404 - DNA, 17 bp, Homo sapiens
tccatgctgggtctgag

SEQ ID NO: 6409405 - DNA, 22 bp, Homo sapiens
tccatgctgtccctgtgggctc

SEQ ID NO: 6409406 - DNA, 20 bp, Homo sapiens
tccatgctgtgcgcccaggg

SEQ ID NO: 6409407 - DNA, 23 bp, Homo sapiens
tccatgcttctcatcttgtgaaa

SEQ ID NO: 6409408 - DNA, 18 bp, Homo sapiens
tccatgctttgctctcaa

SEQ ID NO: 6409409 - DNA, 22 bp, Homo sapiens
tccatggaaataaaaagtatgt

SEQ ID NO: 6409410 - DNA, 20 bp, Homo sapiens
tccatggaaccatggaggag

SEQ ID NO: 6409411 - DNA, 21 bp, Homo sapiens
tccatggacaatataaactga

SEQ ID NO: 6409412 - DNA, 14 bp, Homo sapiens
tccatggactttgt

SEQ ID NO: 6409413 - DNA, 13 bp, Homo sapiens
tccatggagccta

SEQ ID NO: 6409414 - DNA, 12 bp, Homo sapiens
tccatggagttg

SEQ ID NO: 6409415 - DNA, 16 bp, Homo sapiens
tccatggatcttgctg

SEQ ID NO: 6409416 - DNA, 18 bp, Homo sapiens
tccatggatgcatgccct

SEQ ID NO: 6409417 - DNA, 15 bp, Homo sapiens
tccatggattgattc

SEQ ID NO: 6409418 - DNA, 14 bp, Homo sapiens
tccatggcaccagc

SEQ ID NO: 6409419 - DNA, 15 bp, Homo sapiens
tccatggcaccagcc

SEQ ID NO: 6409420 - DNA, 13 bp, Homo sapiens
tccatggcagcag

SEQ ID NO: 6409421 - DNA, 18 bp, Homo sapiens
tccatggcagcagccagg

SEQ ID NO: 6409422 - DNA, 14 bp, Homo sapiens
tccatggcaggaag

SEQ ID NO: 6409423 - DNA, 17 bp, Homo sapiens
tccatggcaggaaggcg

SEQ ID NO: 6409424 - DNA, 18 bp, Homo sapiens
tccatggcaggaaggctt

SEQ ID NO: 6409425 - DNA, 13 bp, Homo sapiens
tccatggccaccc

SEQ ID NO: 6409426 - DNA, 14 bp, Homo sapiens
tccatggccacccc

SEQ ID NO: 6409427 - DNA, 22 bp, Homo sapiens
tccatggcccatcactcggctg

SEQ ID NO: 6409428 - DNA, 20 bp, Homo sapiens
tccatggccctgcaaaagga

SEQ ID NO: 6409429 - DNA, 14 bp, Homo sapiens
tccatggccctgtc

SEQ ID NO: 6409430 - DNA, 18 bp, Homo sapiens
tccatggccctgtcccag

SEQ ID NO: 6409431 - DNA, 20 bp, Homo sapiens
tccatggccctgtcccaggc

SEQ ID NO: 6409432 - DNA, 12 bp, Homo sapiens
tccatggccctt

SEQ ID NO: 6409433 - DNA, 14 bp, Homo sapiens
tccatggcctttct

SEQ ID NO: 6409434 - DNA, 18 bp, Homo sapiens
tccatggcctttctaata

SEQ ID NO: 6409435 - DNA, 23 bp, Homo sapiens
tccatggcgaaaacatctcctta

SEQ ID NO: 6409436 - DNA, 20 bp, Homo sapiens
tccatggctaagaccacaga

SEQ ID NO: 6409437 - DNA, 13 bp, Homo sapiens
tccatggctctgt

SEQ ID NO: 6409438 - DNA, 23 bp, Homo sapiens
tccatggctctgttatgcaagca

SEQ ID NO: 6409439 - DNA, 17 bp, Homo sapiens
tccatggcttcctgaga

SEQ ID NO: 6409440 - DNA, 20 bp, Homo sapiens
tccatgggaaactttccctt

SEQ ID NO: 6409441 - DNA, 14 bp, Homo sapiens
tccatgggagccag

SEQ ID NO: 6409442 - DNA, 17 bp, Homo sapiens
tccatgggcacctctgc

SEQ ID NO: 6409443 - DNA, 15 bp, Homo sapiens
tccatgggcagagcc

SEQ ID NO: 6409444 - DNA, 18 bp, Homo sapiens
tccatgggcagagcccaa

SEQ ID NO: 6409445 - DNA, 23 bp, Homo sapiens
tccatgggcagagcccaagggaa

SEQ ID NO: 6409446 - DNA, 18 bp, Homo sapiens
tccatgggcccgctgcct

SEQ ID NO: 6409447 - DNA, 21 bp, Homo sapiens
tccatgggcccgctgcctctt

SEQ ID NO: 6409448 - DNA, 16 bp, Homo sapiens
tccatggggaagggat

SEQ ID NO: 6409449 - DNA, 22 bp, Homo sapiens
tccatggggaagtgctccccac

SEQ ID NO: 6409450 - DNA, 23 bp, Homo sapiens
tccatggggaagtgctccccaca

SEQ ID NO: 6409451 - DNA, 17 bp, Homo sapiens
tccatgggggcagggca

SEQ ID NO: 6409452 - DNA, 23 bp, Homo sapiens
tccatggggtctctcacagacag

SEQ ID NO: 6409453 - DNA, 21 bp, Homo sapiens
tccatggtcctgtctgtcctt

SEQ ID NO: 6409454 - DNA, 17 bp, Homo sapiens
tccatggtgcctctgga

SEQ ID NO: 6409455 - DNA, 14 bp, Homo sapiens
tccatggtgctgca

SEQ ID NO: 6409456 - DNA, 16 bp, Homo sapiens
tccatggttaccatgg

SEQ ID NO: 6409457 - DNA, 19 bp, Homo sapiens
tccatgtaatgatcttgga

SEQ ID NO: 6409458 - DNA, 20 bp, Homo sapiens
tccatgtactgtagtttttc

SEQ ID NO: 6409459 - DNA, 17 bp, Homo sapiens
tccatgtacttgtttgc

SEQ ID NO: 6409460 - DNA, 20 bp, Homo sapiens
tccatgtactttccctgtgt

SEQ ID NO: 6409461 - DNA, 18 bp, Homo sapiens
tccatgtagaacttgaac

SEQ ID NO: 6409462 - DNA, 23 bp, Homo sapiens
tccatgtagaacttgaactaaca

SEQ ID NO: 6409463 - DNA, 14 bp, Homo sapiens
tccatgtagcagga

SEQ ID NO: 6409464 - DNA, 17 bp, Homo sapiens
tccatgtagcaggactg

SEQ ID NO: 6409465 - DNA, 15 bp, Homo sapiens
tccatgtcaggccag

SEQ ID NO: 6409466 - DNA, 24 bp, Homo sapiens
taggaggaaacagttctcactggg

SEQ ID NO: 6409467 - DNA, 15 bp, Homo sapiens
taggaggaccccggg

SEQ ID NO: 6409468 - DNA, 20 bp, Homo sapiens
taggaggctgcatgctctgg

SEQ ID NO: 6409469 - DNA, 18 bp, Homo sapiens
taggaggctgtgggtttt

SEQ ID NO: 6409470 - DNA, 16 bp, Homo sapiens
taggagggaaaccttt

SEQ ID NO: 6409471 - DNA, 23 bp, Homo sapiens
taggagggactgtcgctgcttcg

SEQ ID NO: 6409472 - DNA, 21 bp, Homo sapiens
taggagggagttatctaaaag

SEQ ID NO: 6409473 - DNA, 12 bp, Homo sapiens
taggaggggctg

SEQ ID NO: 6409474 - DNA, 13 bp, Homo sapiens
taggagggtcctc

SEQ ID NO: 6409475 - DNA, 20 bp, Homo sapiens
taggagggtgcccctgggaa

SEQ ID NO: 6409476 - DNA, 21 bp, Homo sapiens
taggagggtgcccctgggaac

SEQ ID NO: 6409477 - DNA, 20 bp, Homo sapiens
taggaggttgaggctgcagt

SEQ ID NO: 6409478 - DNA, 15 bp, Homo sapiens
taggagtatttttgg

SEQ ID NO: 6409479 - DNA, 23 bp, Homo sapiens
taggagtctgagcatccatcaat

SEQ ID NO: 6409480 - DNA, 21 bp, Homo sapiens
taggagtcttatatcccaggt

SEQ ID NO: 6409481 - DNA, 23 bp, Homo sapiens
taggagtcttatatcccaggtga

SEQ ID NO: 6409482 - DNA, 17 bp, Homo sapiens
taggagtgagtgtatgt

SEQ ID NO: 6409483 - DNA, 17 bp, Homo sapiens
taggagtggttctcatt

SEQ ID NO: 6409484 - DNA, 20 bp, Homo sapiens
taggagtgtctaagttttgt

SEQ ID NO: 6409485 - DNA, 22 bp, Homo sapiens
taggagttaacccctgcgctct

SEQ ID NO: 6409486 - DNA, 21 bp, Homo sapiens
taggagttcacttcatcttct

SEQ ID NO: 6409487 - DNA, 19 bp, Homo sapiens
taggagttcatagaaggga

SEQ ID NO: 6409488 - DNA, 14 bp, Homo sapiens
taggagttctcctg

SEQ ID NO: 6409489 - DNA, 14 bp, Homo sapiens
taggagttctctga

SEQ ID NO: 6409490 - DNA, 18 bp, Homo sapiens
taggagttctctgatgca

SEQ ID NO: 6409491 - DNA, 22 bp, Homo sapiens
taggagttctctgatgcagaaa

SEQ ID NO: 6409492 - DNA, 23 bp, Homo sapiens
taggagtttagggaacaatttgg

SEQ ID NO: 6409493 - DNA, 12 bp, Homo sapiens
taggagttttat

SEQ ID NO: 6409494 - DNA, 22 bp, Homo sapiens
taggagttttgttccagaggag

SEQ ID NO: 6409495 - DNA, 16 bp, Homo sapiens
taggataaaaagccag

SEQ ID NO: 6409496 - DNA, 15 bp, Homo sapiens
taggataaaccaatc

SEQ ID NO: 6409497 - DNA, 17 bp, Homo sapiens
taggataactaaaattc

SEQ ID NO: 6409498 - DNA, 14 bp, Homo sapiens
taggataatataaa

SEQ ID NO: 6409499 - DNA, 17 bp, Homo sapiens
taggataatataaaaag

SEQ ID NO: 6409500 - DNA, 19 bp, Homo sapiens
taggataatataaaaagca

SEQ ID NO: 6409501 - DNA, 20 bp, Homo sapiens
taggataatataaaaagcag

SEQ ID NO: 6409502 - DNA, 13 bp, Homo sapiens
taggatagcattt

SEQ ID NO: 6409503 - DNA, 15 bp, Homo sapiens
taggatagttagttt

SEQ ID NO: 6409504 - DNA, 18 bp, Homo sapiens
taggatagttgatgcatg

SEQ ID NO: 6409505 - DNA, 17 bp, Homo sapiens
taggatataaaacacat

SEQ ID NO: 6409506 - DNA, 15 bp, Homo sapiens
taggatatgtatatt

SEQ ID NO: 6409507 - DNA, 20 bp, Homo sapiens
taggatattgctaattgtgt

SEQ ID NO: 6409508 - DNA, 20 bp, Homo sapiens
taggatattggaatgcacag

SEQ ID NO: 6409509 - DNA, 12 bp, Homo sapiens
taggatatttga

SEQ ID NO: 6409510 - DNA, 20 bp, Homo sapiens
taggatatttgagtcacttg

SEQ ID NO: 6409511 - DNA, 23 bp, Homo sapiens
taggatcatatgaccattgaaaa

SEQ ID NO: 6409512 - DNA, 15 bp, Homo sapiens
taggatcccactggc

SEQ ID NO: 6409513 - DNA, 15 bp, Homo sapiens
taggatcccccttct

SEQ ID NO: 6409514 - DNA, 22 bp, Homo sapiens
taggatctcgcctggaaacaga

SEQ ID NO: 6409515 - DNA, 21 bp, Homo sapiens
taggatctgaggacaaggaaa

SEQ ID NO: 6409516 - DNA, 16 bp, Homo sapiens
taggatcttcactgtc

SEQ ID NO: 6409517 - DNA, 18 bp, Homo sapiens
taggatcttcactgtctt

SEQ ID NO: 6409518 - DNA, 18 bp, Homo sapiens
taggatgaacaatgtata

SEQ ID NO: 6409519 - DNA, 18 bp, Homo sapiens
taggatgaatgggaaagt

SEQ ID NO: 6409520 - DNA, 16 bp, Homo sapiens
taggatgacaggctct

SEQ ID NO: 6409521 - DNA, 20 bp, Homo sapiens
taggatgacaggctctcctg

SEQ ID NO: 6409522 - DNA, 17 bp, Homo sapiens
taggatgactgctgtga

SEQ ID NO: 6409523 - DNA, 17 bp, Homo sapiens
taggatgagcaaaacat

SEQ ID NO: 6409524 - DNA, 23 bp, Homo sapiens
taggatgcggctttctctgcctc

SEQ ID NO: 6409525 - DNA, 24 bp, Homo sapiens
taggatgggagagctagaaagttg

SEQ ID NO: 6409526 - DNA, 21 bp, Homo sapiens
taggatggggcacggctctgg

SEQ ID NO: 6409527 - DNA, 15 bp, Homo sapiens
taggatgggggagag

SEQ ID NO: 6409528 - DNA, 17 bp, Homo sapiens
taggatgggggagaggg

SEQ ID NO: 6409529 - DNA, 17 bp, Homo sapiens
taggatggttctgtgac

SEQ ID NO: 6409530 - DNA, 17 bp, Homo sapiens
taggatgtatgctgttt

SEQ ID NO: 6409531 - DNA, 19 bp, Homo sapiens
taggatgttgcttctgaat

SEQ ID NO: 6409532 - DNA, 22 bp, Homo sapiens
taggatgttgcttctgaatcac

SEQ ID NO: 6409533 - DNA, 18 bp, Homo sapiens
taggatgtttttcatgaa

SEQ ID NO: 6409534 - DNA, 21 bp, Homo sapiens
taggattaagttcgaggtggc

SEQ ID NO: 6409535 - DNA, 14 bp, Homo sapiens
taggattaatttat

SEQ ID NO: 6409536 - DNA, 18 bp, Homo sapiens
taggattccccctgccct

SEQ ID NO: 6409537 - DNA, 22 bp, Homo sapiens
taggattgcttcaattaaaatt

SEQ ID NO: 6409538 - DNA, 22 bp, Homo sapiens
taggattgggggatgtgaagaa

SEQ ID NO: 6409539 - DNA, 23 bp, Homo sapiens
taggattgggggatgtgaagaaa

SEQ ID NO: 6409540 - DNA, 17 bp, Homo sapiens
taggatttatgtatttt

SEQ ID NO: 6409541 - DNA, 14 bp, Homo sapiens
taggatttcagcca

SEQ ID NO: 6409542 - DNA, 13 bp, Homo sapiens
taggatttcttaa

SEQ ID NO: 6409543 - DNA, 22 bp, Homo sapiens
taggattttcacattcttggct

SEQ ID NO: 6409544 - DNA, 18 bp, Homo sapiens
taggattttgagggtggg

SEQ ID NO: 6409545 - DNA, 13 bp, Homo sapiens
taggatttttaga

SEQ ID NO: 6409546 - DNA, 14 bp, Homo sapiens
taggatttttagaa

SEQ ID NO: 6409547 - DNA, 9 bp, Homo sapiens
taggcaaac

SEQ ID NO: 6409548 - DNA, 19 bp, Homo sapiens
taggcaaagataatttatt

SEQ ID NO: 6409549 - DNA, 13 bp, Homo sapiens
taggcaaagcaat

SEQ ID NO: 6409550 - DNA, 12 bp, Homo sapiens
taggcaaataag

SEQ ID NO: 6409551 - DNA, 18 bp, Homo sapiens
taggcaactattaataat

SEQ ID NO: 6409552 - DNA, 12 bp, Homo sapiens
taggcaagagaa

SEQ ID NO: 6409553 - DNA, 14 bp, Homo sapiens
taggcaagcaggac

SEQ ID NO: 6409554 - DNA, 17 bp, Homo sapiens
taggcaagcaggacctg

SEQ ID NO: 6409555 - DNA, 18 bp, Homo sapiens
taggcaagcaggacctgg

SEQ ID NO: 6409556 - DNA, 20 bp, Homo sapiens
taggcaagcaggacctggca

SEQ ID NO: 6409557 - DNA, 24 bp, Homo sapiens
taggcaagcaggacctggcatcat

SEQ ID NO: 6409558 - DNA, 19 bp, Homo sapiens
taggcaaggatgaaagaca

SEQ ID NO: 6409559 - DNA, 20 bp, Homo sapiens
taggcaaggatgaaagacaa

SEQ ID NO: 6409560 - DNA, 23 bp, Homo sapiens
taggcaaggatgaaagacaaaga

SEQ ID NO: 6409561 - DNA, 17 bp, Homo sapiens
taggcaagtcacactgc

SEQ ID NO: 6409562 - DNA, 18 bp, Homo sapiens
taggcaattagagaaagt

SEQ ID NO: 6409563 - DNA, 18 bp, Homo sapiens
taggcacccatcctagag

SEQ ID NO: 6409564 - DNA, 20 bp, Homo sapiens
taggcacccctttccccagc

SEQ ID NO: 6409565 - DNA, 20 bp, Homo sapiens
taggcacctccccgctctcc

SEQ ID NO: 6409566 - DNA, 18 bp, Homo sapiens
taggcactcttaaatgat

SEQ ID NO: 6409567 - DNA, 20 bp, Homo sapiens
taggcactgagcagggatct

SEQ ID NO: 6409568 - DNA, 17 bp, Homo sapiens
taggcactttaaaacac

SEQ ID NO: 6409569 - DNA, 21 bp, Homo sapiens
taggcacttttattttcattg

SEQ ID NO: 6409570 - DNA, 22 bp, Homo sapiens
taggcacttttattttcattgt

SEQ ID NO: 6409571 - DNA, 15 bp, Homo sapiens
taggcactttttaac

SEQ ID NO: 6409572 - DNA, 19 bp, Homo sapiens
taggcagaagaagctggga

SEQ ID NO: 6409573 - DNA, 22 bp, Homo sapiens
taggcagacacagggacttgaa

SEQ ID NO: 6409574 - DNA, 18 bp, Homo sapiens
taggcagacgtggggagg

SEQ ID NO: 6409575 - DNA, 23 bp, Homo sapiens
taggcagagcccgcccacctggg

SEQ ID NO: 6409576 - DNA, 20 bp, Homo sapiens
taggcagagggcaaagtcat

SEQ ID NO: 6409577 - DNA, 16 bp, Homo sapiens
taggcagatctttaaa

SEQ ID NO: 6409578 - DNA, 18 bp, Homo sapiens
taggcagatctttaaata

SEQ ID NO: 6409579 - DNA, 20 bp, Homo sapiens
taggcagattgaaaaggaca

SEQ ID NO: 6409580 - DNA, 19 bp, Homo sapiens
taggcagcaacagcagagc

SEQ ID NO: 6409581 - DNA, 14 bp, Homo sapiens
taggcagcagagag

SEQ ID NO: 6409582 - DNA, 15 bp, Homo sapiens
taggcagccacggcc

SEQ ID NO: 6409583 - DNA, 23 bp, Homo sapiens
taggcagccacggccccgggtcc

SEQ ID NO: 6409584 - DNA, 12 bp, Homo sapiens
taggcagcctct

SEQ ID NO: 6409585 - DNA, 16 bp, Homo sapiens
taggcagcctctctgc

SEQ ID NO: 6409586 - DNA, 14 bp, Homo sapiens
taggcagcctgccg

SEQ ID NO: 6409587 - DNA, 22 bp, Homo sapiens
taggcagcctgctataaagtta

SEQ ID NO: 6409588 - DNA, 16 bp, Homo sapiens
taggcagcttctctgt

SEQ ID NO: 6409589 - DNA, 22 bp, Homo sapiens
taggcaggaagcccaattgctg

SEQ ID NO: 6409590 - DNA, 18 bp, Homo sapiens
taggcaggaagtcaggag

SEQ ID NO: 6409591 - DNA, 23 bp, Homo sapiens
taggcaggaagtcaggagccagc

SEQ ID NO: 6409592 - DNA, 22 bp, Homo sapiens
taggcaggacatgctgaagcca

SEQ ID NO: 6409593 - DNA, 14 bp, Homo sapiens
taggcaggacctgt

SEQ ID NO: 6409594 - DNA, 15 bp, Homo sapiens
taggcaggacctgtg

SEQ ID NO: 6409595 - DNA, 17 bp, Homo sapiens
taggcagggatttgagg

SEQ ID NO: 6409596 - DNA, 19 bp, Homo sapiens
taggcagggatttgaggag

SEQ ID NO: 6409597 - DNA, 23 bp, Homo sapiens
taggcagggcagggtagtgcagg

SEQ ID NO: 6409598 - DNA, 16 bp, Homo sapiens
taggcagggggccctg

SEQ ID NO: 6409599 - DNA, 21 bp, Homo sapiens
taggcagggggccctgcccca

SEQ ID NO: 6409600 - DNA, 24 bp, Homo sapiens
taggcagtaggccggtgtgcctga

SEQ ID NO: 6409601 - DNA, 15 bp, Homo sapiens
taggcagtataaaga

SEQ ID NO: 6409602 - DNA, 22 bp, Homo sapiens
taggcagttagagatgcctccc

SEQ ID NO: 6409603 - DNA, 16 bp, Homo sapiens
taggcatcccagggga

SEQ ID NO: 6409604 - DNA, 15 bp, Homo sapiens
taggcatctaaagaa

SEQ ID NO: 6409605 - DNA, 20 bp, Homo sapiens
taggcatctgctgtaataat

SEQ ID NO: 6409606 - DNA, 20 bp, Homo sapiens
taggcatgtcagaggacccc

SEQ ID NO: 6409607 - DNA, 23 bp, Homo sapiens
taggcatgtcagaggaccccagg

SEQ ID NO: 6409608 - DNA, 16 bp, Homo sapiens
taggcattaaatgcaa

SEQ ID NO: 6409609 - DNA, 21 bp, Homo sapiens
taggcattacccaaaagcaag

SEQ ID NO: 6409610 - DNA, 16 bp, Homo sapiens
taggcattatttaatg

SEQ ID NO: 6409611 - DNA, 15 bp, Homo sapiens
taggcatttcctgct

SEQ ID NO: 6409612 - DNA, 16 bp, Homo sapiens
taggcatttcctgctg

SEQ ID NO: 6409613 - DNA, 13 bp, Homo sapiens
taggcatttgtaa

SEQ ID NO: 6409614 - DNA, 18 bp, Homo sapiens
taggcattttaagtaaaa

SEQ ID NO: 6409615 - DNA, 21 bp, Homo sapiens
taggcatttttaccatcactg

SEQ ID NO: 6409616 - DNA, 19 bp, Homo sapiens
taggccaactgcctccttg

SEQ ID NO: 6409617 - DNA, 21 bp, Homo sapiens
taggccacagaaggtgaactt

SEQ ID NO: 6409618 - DNA, 14 bp, Homo sapiens
taggccactcctcc

SEQ ID NO: 6409619 - DNA, 15 bp, Homo sapiens
taggccactcctcca

SEQ ID NO: 6409620 - DNA, 16 bp, Homo sapiens
taggccagagcccact

SEQ ID NO: 6409621 - DNA, 17 bp, Homo sapiens
taggccagagcccactc

SEQ ID NO: 6409622 - DNA, 12 bp, Homo sapiens
taggccagaggt

SEQ ID NO: 6409623 - DNA, 22 bp, Homo sapiens
taggccagccgcgcatcagact

SEQ ID NO: 6409624 - DNA, 12 bp, Homo sapiens
taggccagctcc

SEQ ID NO: 6409625 - DNA, 22 bp, Homo sapiens
taggccagggcatgtgtatgtg

SEQ ID NO: 6409626 - DNA, 15 bp, Homo sapiens
taggccatctgtaaa

SEQ ID NO: 6409627 - DNA, 16 bp, Homo sapiens
taggccatctgtaaat

SEQ ID NO: 6409628 - DNA, 19 bp, Homo sapiens
taggccatctgtaaatatc

SEQ ID NO: 6409629 - DNA, 20 bp, Homo sapiens
taggccatgaaaaaaatgat

SEQ ID NO: 6409630 - DNA, 16 bp, Homo sapiens
taggccatgggacagg

SEQ ID NO: 6409631 - DNA, 19 bp, Homo sapiens
taggccatttgttacagtt

SEQ ID NO: 6409632 - DNA, 23 bp, Homo sapiens
taggcccaaggtcccctccacat

SEQ ID NO: 6409633 - DNA, 15 bp, Homo sapiens
taggcccacacacag

SEQ ID NO: 6409634 - DNA, 17 bp, Homo sapiens
taggcccacacacaggt

SEQ ID NO: 6409635 - DNA, 22 bp, Homo sapiens
taggccccacaaggcctggtct

SEQ ID NO: 6409636 - DNA, 17 bp, Homo sapiens
taggccccagaggccct

SEQ ID NO: 6409637 - DNA, 23 bp, Homo sapiens
taggcccctgattcactgcctat

SEQ ID NO: 6409638 - DNA, 13 bp, Homo sapiens
taggcccctgggg

SEQ ID NO: 6409639 - DNA, 15 bp, Homo sapiens
taggcccctgtgtag

SEQ ID NO: 6409640 - DNA, 17 bp, Homo sapiens
taggcccgggcccctgg

SEQ ID NO: 6409641 - DNA, 20 bp, Homo sapiens
taggccctggatgtgcccac

SEQ ID NO: 6409642 - DNA, 12 bp, Homo sapiens
tccatgtcatcc

SEQ ID NO: 6409643 - DNA, 14 bp, Homo sapiens
tccatgtcctatgc

SEQ ID NO: 6409644 - DNA, 18 bp, Homo sapiens
tccatgtcgcctctgcat

SEQ ID NO: 6409645 - DNA, 19 bp, Homo sapiens
tccatgtctatgctccctc

SEQ ID NO: 6409646 - DNA, 14 bp, Homo sapiens
tccatgtctgtagt

SEQ ID NO: 6409647 - DNA, 16 bp, Homo sapiens
tccatgtgaaaataaa

SEQ ID NO: 6409648 - DNA, 17 bp, Homo sapiens
tccatgtgaacagcata

SEQ ID NO: 6409649 - DNA, 20 bp, Homo sapiens
tccatgtgaccattctgcct

SEQ ID NO: 6409650 - DNA, 19 bp, Homo sapiens
tccatgtgaccgaacactg

SEQ ID NO: 6409651 - DNA, 23 bp, Homo sapiens
tccatgtgataattgtaaaggtg

SEQ ID NO: 6409652 - DNA, 12 bp, Homo sapiens
tccatgtgcacc

SEQ ID NO: 6409653 - DNA, 20 bp, Homo sapiens
tccatgtgcacccggcctgg

SEQ ID NO: 6409654 - DNA, 16 bp, Homo sapiens
tccatgtgcccagtta

SEQ ID NO: 6409655 - DNA, 14 bp, Homo sapiens
tccatgtgccccct

SEQ ID NO: 6409656 - DNA, 12 bp, Homo sapiens
tccatgtgcctt

SEQ ID NO: 6409657 - DNA, 21 bp, Homo sapiens
tccatgtgcctttctttgcct

SEQ ID NO: 6409658 - DNA, 22 bp, Homo sapiens
tccatgtgcctttctttgcctc

SEQ ID NO: 6409659 - DNA, 17 bp, Homo sapiens
tccatgtgctgctgtgg

SEQ ID NO: 6409660 - DNA, 22 bp, Homo sapiens
tccatgtgcttccctaggctga

SEQ ID NO: 6409661 - DNA, 19 bp, Homo sapiens
tccatgtggacttaggaag

SEQ ID NO: 6409662 - DNA, 18 bp, Homo sapiens
tccatgtggccccaggtg

SEQ ID NO: 6409663 - DNA, 20 bp, Homo sapiens
tccatgtggccccaggtgcc

SEQ ID NO: 6409664 - DNA, 21 bp, Homo sapiens
tccatgtggccccaggtgcca

SEQ ID NO: 6409665 - DNA, 20 bp, Homo sapiens
tccatgtgtcccccctgtgg

SEQ ID NO: 6409666 - DNA, 21 bp, Homo sapiens
tccatgtgtggtggtgttttt

SEQ ID NO: 6409667 - DNA, 14 bp, Homo sapiens
tccatgtgtgtgca

SEQ ID NO: 6409668 - DNA, 23 bp, Homo sapiens
tccatgtgtgtgccaagccctgg

SEQ ID NO: 6409669 - DNA, 21 bp, Homo sapiens
tccatgtgttttgcttttatc

SEQ ID NO: 6409670 - DNA, 19 bp, Homo sapiens
tccatgttaaaatagacaa

SEQ ID NO: 6409671 - DNA, 22 bp, Homo sapiens
tccatgttagtaatggcagagc

SEQ ID NO: 6409672 - DNA, 16 bp, Homo sapiens
tccatgttgactgact

SEQ ID NO: 6409673 - DNA, 15 bp, Homo sapiens
tccatgttgctgcca

SEQ ID NO: 6409674 - DNA, 18 bp, Homo sapiens
tccatgtttccaccaaat

SEQ ID NO: 6409675 - DNA, 21 bp, Homo sapiens
tccatgtttctcacattgctg

SEQ ID NO: 6409676 - DNA, 11 bp, Homo sapiens
tccatgtttta

SEQ ID NO: 6409677 - DNA, 19 bp, Homo sapiens
tccattaaaaaaaacagaa

SEQ ID NO: 6409678 - DNA, 18 bp, Homo sapiens
tccattaaaacaatttat

SEQ ID NO: 6409679 - DNA, 19 bp, Homo sapiens
tccattaaacgatttttaa

SEQ ID NO: 6409680 - DNA, 14 bp, Homo sapiens
tccattaaacttct

SEQ ID NO: 6409681 - DNA, 13 bp, Homo sapiens
tccattaaatggt

SEQ ID NO: 6409682 - DNA, 14 bp, Homo sapiens
tccattaaatggtc

SEQ ID NO: 6409683 - DNA, 15 bp, Homo sapiens
tccattaactgcttt

SEQ ID NO: 6409684 - DNA, 15 bp, Homo sapiens
tccattaagaacact

SEQ ID NO: 6409685 - DNA, 21 bp, Homo sapiens
tccattaataactgaataaaa

SEQ ID NO: 6409686 - DNA, 13 bp, Homo sapiens
tccattaattaat

SEQ ID NO: 6409687 - DNA, 14 bp, Homo sapiens
tccattacaccaca

SEQ ID NO: 6409688 - DNA, 22 bp, Homo sapiens
tccattacgtgcatttaaactc

SEQ ID NO: 6409689 - DNA, 19 bp, Homo sapiens
tccattactgtgatttctg

SEQ ID NO: 6409690 - DNA, 20 bp, Homo sapiens
tccattactgtgatttctgg

SEQ ID NO: 6409691 - DNA, 20 bp, Homo sapiens
tccattagaaaattttgtaa

SEQ ID NO: 6409692 - DNA, 22 bp, Homo sapiens
tccattagaaaattttgtaaaa

SEQ ID NO: 6409693 - DNA, 23 bp, Homo sapiens
tccattagaaaattttgtaaaac

SEQ ID NO: 6409694 - DNA, 24 bp, Homo sapiens
tccattagaaaattttgtaaaaca

SEQ ID NO: 6409695 - DNA, 21 bp, Homo sapiens
tccattagagagtggcaatag

SEQ ID NO: 6409696 - DNA, 14 bp, Homo sapiens
tccattaggccagc

SEQ ID NO: 6409697 - DNA, 15 bp, Homo sapiens
tccattaggccagca

SEQ ID NO: 6409698 - DNA, 20 bp, Homo sapiens
tccattaggccagcaacgct

SEQ ID NO: 6409699 - DNA, 14 bp, Homo sapiens
tccattatcatgtg

SEQ ID NO: 6409700 - DNA, 12 bp, Homo sapiens
tccattatctta

SEQ ID NO: 6409701 - DNA, 17 bp, Homo sapiens
tccattatgaaaatctt

SEQ ID NO: 6409702 - DNA, 13 bp, Homo sapiens
tccattcagaaag

SEQ ID NO: 6409703 - DNA, 14 bp, Homo sapiens
tccattcagatgaa

SEQ ID NO: 6409704 - DNA, 20 bp, Homo sapiens
tccattcagtgcagcatata

SEQ ID NO: 6409705 - DNA, 20 bp, Homo sapiens
tccattcatccttccatcca

SEQ ID NO: 6409706 - DNA, 16 bp, Homo sapiens
tccattccaatacatt

SEQ ID NO: 6409707 - DNA, 19 bp, Homo sapiens
tccattccaatacattgaa

SEQ ID NO: 6409708 - DNA, 21 bp, Homo sapiens
tccattccacacagaatgcaa

SEQ ID NO: 6409709 - DNA, 12 bp, Homo sapiens
tccattccagaa

SEQ ID NO: 6409710 - DNA, 17 bp, Homo sapiens
tccattcccaagatgcc

SEQ ID NO: 6409711 - DNA, 22 bp, Homo sapiens
tccattcccaagatgcctgatc

SEQ ID NO: 6409712 - DNA, 14 bp, Homo sapiens
tccattcccacccc

SEQ ID NO: 6409713 - DNA, 13 bp, Homo sapiens
tccattcccagac

SEQ ID NO: 6409714 - DNA, 19 bp, Homo sapiens
tccattcccatcactgctg

SEQ ID NO: 6409715 - DNA, 12 bp, Homo sapiens
tccattccctag

SEQ ID NO: 6409716 - DNA, 15 bp, Homo sapiens
tccattccctagcag

SEQ ID NO: 6409717 - DNA, 15 bp, Homo sapiens
tccattccctttctt

SEQ ID NO: 6409718 - DNA, 12 bp, Homo sapiens
tccattcctcag

SEQ ID NO: 6409719 - DNA, 14 bp, Homo sapiens
tccattcctcaggg

SEQ ID NO: 6409720 - DNA, 19 bp, Homo sapiens
tccattctagatgcttccc

SEQ ID NO: 6409721 - DNA, 18 bp, Homo sapiens
tccattctcacaggtccc

SEQ ID NO: 6409722 - DNA, 12 bp, Homo sapiens
tccattctcatt

SEQ ID NO: 6409723 - DNA, 23 bp, Homo sapiens
tccattctccaggggtttacagt

SEQ ID NO: 6409724 - DNA, 14 bp, Homo sapiens
tccattctcccagg

SEQ ID NO: 6409725 - DNA, 15 bp, Homo sapiens
tccattctcctcagt

SEQ ID NO: 6409726 - DNA, 22 bp, Homo sapiens
tccattctcctcagtggcttct

SEQ ID NO: 6409727 - DNA, 13 bp, Homo sapiens
tccattctctctg

SEQ ID NO: 6409728 - DNA, 21 bp, Homo sapiens
tccattctgaaaatagcagga

SEQ ID NO: 6409729 - DNA, 21 bp, Homo sapiens
tccattctgcactcagaaaat

SEQ ID NO: 6409730 - DNA, 14 bp, Homo sapiens
tccattctggaagt

SEQ ID NO: 6409731 - DNA, 12 bp, Homo sapiens
tccattctgttt

SEQ ID NO: 6409732 - DNA, 21 bp, Homo sapiens
tccattcttcagtgtctctgt

SEQ ID NO: 6409733 - DNA, 17 bp, Homo sapiens
tccattcttcttgctac

SEQ ID NO: 6409734 - DNA, 13 bp, Homo sapiens
tccattctttcag

SEQ ID NO: 6409735 - DNA, 14 bp, Homo sapiens
tccattctttctga

SEQ ID NO: 6409736 - DNA, 17 bp, Homo sapiens
tccattctttcttcctc

SEQ ID NO: 6409737 - DNA, 15 bp, Homo sapiens
tccattgaaagtgct

SEQ ID NO: 6409738 - DNA, 21 bp, Homo sapiens
tccattgaagccgactctggc

SEQ ID NO: 6409739 - DNA, 22 bp, Homo sapiens
tccattgaagccgactctggcc

SEQ ID NO: 6409740 - DNA, 16 bp, Homo sapiens
tccattgacatgtaca

SEQ ID NO: 6409741 - DNA, 21 bp, Homo sapiens
tccattgacatgtacagagaa

SEQ ID NO: 6409742 - DNA, 14 bp, Homo sapiens
tccattgaccagct

SEQ ID NO: 6409743 - DNA, 17 bp, Homo sapiens
tccattgaccagctctc

SEQ ID NO: 6409744 - DNA, 14 bp, Homo sapiens
tccattgatttttt

SEQ ID NO: 6409745 - DNA, 20 bp, Homo sapiens
tccattgattttttttttct

SEQ ID NO: 6409746 - DNA, 19 bp, Homo sapiens
tccattgcaaaaggttaag

SEQ ID NO: 6409747 - DNA, 19 bp, Homo sapiens
tccattgcaaaatagaaga

SEQ ID NO: 6409748 - DNA, 21 bp, Homo sapiens
tccattgcaaaatagaagaag

SEQ ID NO: 6409749 - DNA, 18 bp, Homo sapiens
tccattgcctagctcttt

SEQ ID NO: 6409750 - DNA, 19 bp, Homo sapiens
tccattgcgttattttctt

SEQ ID NO: 6409751 - DNA, 20 bp, Homo sapiens
tccattgcgttattttcttt

SEQ ID NO: 6409752 - DNA, 19 bp, Homo sapiens
tccattgcttattcttgag

SEQ ID NO: 6409753 - DNA, 19 bp, Homo sapiens
tccattggatctgcaagaa

SEQ ID NO: 6409754 - DNA, 18 bp, Homo sapiens
tccattggtccaagattc

SEQ ID NO: 6409755 - DNA, 17 bp, Homo sapiens
tccattgtaaatctgaa

SEQ ID NO: 6409756 - DNA, 21 bp, Homo sapiens
tccattgtaaatctgaagaaa

SEQ ID NO: 6409757 - DNA, 14 bp, Homo sapiens
tccattgtgtgagt

SEQ ID NO: 6409758 - DNA, 21 bp, Homo sapiens
tccattgtgtgatccagccct

SEQ ID NO: 6409759 - DNA, 16 bp, Homo sapiens
tccattgtgtggcctg

SEQ ID NO: 6409760 - DNA, 16 bp, Homo sapiens
tccattgtttaaagat

SEQ ID NO: 6409761 - DNA, 14 bp, Homo sapiens
tccattgtttgaaa

SEQ ID NO: 6409762 - DNA, 20 bp, Homo sapiens
tccattgtttgaaacaaaga

SEQ ID NO: 6409763 - DNA, 21 bp, Homo sapiens
tccattgtttgaaacaaagaa

SEQ ID NO: 6409764 - DNA, 21 bp, Homo sapiens
tccatttaaaaatgatctgta

SEQ ID NO: 6409765 - DNA, 20 bp, Homo sapiens
tccatttaaaacaagctgat

SEQ ID NO: 6409766 - DNA, 21 bp, Homo sapiens
tccatttaaaacaagctgata

SEQ ID NO: 6409767 - DNA, 13 bp, Homo sapiens
tccatttaaacag

SEQ ID NO: 6409768 - DNA, 15 bp, Homo sapiens
tccatttaaacagat

SEQ ID NO: 6409769 - DNA, 21 bp, Homo sapiens
tccatttaaacagatgtccat

SEQ ID NO: 6409770 - DNA, 17 bp, Homo sapiens
tccatttaaacccggct

SEQ ID NO: 6409771 - DNA, 12 bp, Homo sapiens
tccatttaataa

SEQ ID NO: 6409772 - DNA, 22 bp, Homo sapiens
tccatttacaaactacttgatt

SEQ ID NO: 6409773 - DNA, 17 bp, Homo sapiens
tccatttacttaagact

SEQ ID NO: 6409774 - DNA, 20 bp, Homo sapiens
tccatttacttaagacttaa

SEQ ID NO: 6409775 - DNA, 16 bp, Homo sapiens
tccatttacttgatca

SEQ ID NO: 6409776 - DNA, 20 bp, Homo sapiens
tccatttagttctttgttat

SEQ ID NO: 6409777 - DNA, 17 bp, Homo sapiens
tccatttatatatgaaa

SEQ ID NO: 6409778 - DNA, 18 bp, Homo sapiens
tccatttatatatgaaaa

SEQ ID NO: 6409779 - DNA, 21 bp, Homo sapiens
tccatttatatatgaaaacta

SEQ ID NO: 6409780 - DNA, 23 bp, Homo sapiens
tccatttatatatgaaaactata

SEQ ID NO: 6409781 - DNA, 16 bp, Homo sapiens
tccatttattgtttga

SEQ ID NO: 6409782 - DNA, 18 bp, Homo sapiens
tccatttatttaaaacta

SEQ ID NO: 6409783 - DNA, 19 bp, Homo sapiens
tccatttatttatgaaaaa

SEQ ID NO: 6409784 - DNA, 16 bp, Homo sapiens
tccatttatttattca

SEQ ID NO: 6409785 - DNA, 14 bp, Homo sapiens
tccatttcactggc

SEQ ID NO: 6409786 - DNA, 15 bp, Homo sapiens
tccatttcactggct

SEQ ID NO: 6409787 - DNA, 15 bp, Homo sapiens
tccatttcaggactc

SEQ ID NO: 6409788 - DNA, 22 bp, Homo sapiens
tccatttcaggactctctccag

SEQ ID NO: 6409789 - DNA, 17 bp, Homo sapiens
tccatttcatgtgatct

SEQ ID NO: 6409790 - DNA, 22 bp, Homo sapiens
tccatttcatgtgatctattac

SEQ ID NO: 6409791 - DNA, 15 bp, Homo sapiens
tccatttccagttca

SEQ ID NO: 6409792 - DNA, 20 bp, Homo sapiens
tccatttccagttcatctat

SEQ ID NO: 6409793 - DNA, 18 bp, Homo sapiens
tccatttcccacatcttt

SEQ ID NO: 6409794 - DNA, 14 bp, Homo sapiens
tccatttcccactt

SEQ ID NO: 6409795 - DNA, 15 bp, Homo sapiens
tccatttcccacttc

SEQ ID NO: 6409796 - DNA, 17 bp, Homo sapiens
tccatttccttatgctg

SEQ ID NO: 6409797 - DNA, 19 bp, Homo sapiens
tccatttctcaatcagtgc

SEQ ID NO: 6409798 - DNA, 22 bp, Homo sapiens
tccatttctcaatcagtgcagt

SEQ ID NO: 6409799 - DNA, 24 bp, Homo sapiens
tccatttctcaatcagtgcagtga

SEQ ID NO: 6409800 - DNA, 17 bp, Homo sapiens
tccatttctcagtggct

SEQ ID NO: 6409801 - DNA, 17 bp, Homo sapiens
tccatttctcatgtttt

SEQ ID NO: 6409802 - DNA, 20 bp, Homo sapiens
tccatttctctccaggaagt

SEQ ID NO: 6409803 - DNA, 16 bp, Homo sapiens
tccatttctctctcca

SEQ ID NO: 6409804 - DNA, 18 bp, Homo sapiens
tccatttctctctccagt

SEQ ID NO: 6409805 - DNA, 12 bp, Homo sapiens
tccatttctgat

SEQ ID NO: 6409806 - DNA, 22 bp, Homo sapiens
tccatttctggcttctagtctg

SEQ ID NO: 6409807 - DNA, 13 bp, Homo sapiens
tccatttcttcca

SEQ ID NO: 6409808 - DNA, 14 bp, Homo sapiens
tccatttgaaagaa

SEQ ID NO: 6409809 - DNA, 12 bp, Homo sapiens
tccatttgcaag

SEQ ID NO: 6409810 - DNA, 15 bp, Homo sapiens
tccatttgcaaggga

SEQ ID NO: 6409811 - DNA, 16 bp, Homo sapiens
tccatttgcatttgtt

SEQ ID NO: 6409812 - DNA, 17 bp, Homo sapiens
tccatttgcctttctgg

SEQ ID NO: 6409813 - DNA, 14 bp, Homo sapiens
tccatttgctcttc

SEQ ID NO: 6409814 - DNA, 19 bp, Homo sapiens
tccatttgctgattgtctg

SEQ ID NO: 6409815 - DNA, 12 bp, Homo sapiens
tccatttggaaa

SEQ ID NO: 6409816 - DNA, 20 bp, Homo sapiens
tccatttggaaatctttaaa

SEQ ID NO: 6409817 - DNA, 21 bp, Homo sapiens
tccatttggaatcatatggga

SEQ ID NO: 6409818 - DNA, 16 bp, Homo sapiens
tccatttggaattaca

SEQ ID NO: 6409819 - DNA, 17 bp, Homo sapiens
tccatttggaattacaa

SEQ ID NO: 6409820 - DNA, 12 bp, Homo sapiens
taggccctggtc

SEQ ID NO: 6409821 - DNA, 14 bp, Homo sapiens
taggccctggtctg

SEQ ID NO: 6409822 - DNA, 19 bp, Homo sapiens
taggcccttgtcctgccag

SEQ ID NO: 6409823 - DNA, 20 bp, Homo sapiens
taggcccttgtcctgccagc

SEQ ID NO: 6409824 - DNA, 21 bp, Homo sapiens
taggcccttgtcctgccagct

SEQ ID NO: 6409825 - DNA, 23 bp, Homo sapiens
taggcccttgtcctgccagctgc

SEQ ID NO: 6409826 - DNA, 17 bp, Homo sapiens
taggccgagctgtggac

SEQ ID NO: 6409827 - DNA, 16 bp, Homo sapiens
taggccggccagctcc

SEQ ID NO: 6409828 - DNA, 17 bp, Homo sapiens
taggccggccagctccc

SEQ ID NO: 6409829 - DNA, 22 bp, Homo sapiens
taggcctactggggatcagagt

SEQ ID NO: 6409830 - DNA, 22 bp, Homo sapiens
taggcctagtacaatcttggga

SEQ ID NO: 6409831 - DNA, 16 bp, Homo sapiens
taggcctcagtgtcct

SEQ ID NO: 6409832 - DNA, 18 bp, Homo sapiens
taggcctgaaatgacatt

SEQ ID NO: 6409833 - DNA, 21 bp, Homo sapiens
taggcctgagttagctgttta

SEQ ID NO: 6409834 - DNA, 21 bp, Homo sapiens
taggcctgccgctttgatgga

SEQ ID NO: 6409835 - DNA, 20 bp, Homo sapiens
taggcctggagttgggctgg

SEQ ID NO: 6409836 - DNA, 13 bp, Homo sapiens
taggcctggggct

SEQ ID NO: 6409837 - DNA, 13 bp, Homo sapiens
taggcctgggtgc

SEQ ID NO: 6409838 - DNA, 15 bp, Homo sapiens
taggcctgtcccttg

SEQ ID NO: 6409839 - DNA, 19 bp, Homo sapiens
taggcctgtcccttgcctc

SEQ ID NO: 6409840 - DNA, 21 bp, Homo sapiens
taggcctgtcccttgcctctg

SEQ ID NO: 6409841 - DNA, 22 bp, Homo sapiens
taggcctgtgaggtaactggga

SEQ ID NO: 6409842 - DNA, 19 bp, Homo sapiens
taggccttaacacactggc

SEQ ID NO: 6409843 - DNA, 19 bp, Homo sapiens
taggccttcttgtgatctt

SEQ ID NO: 6409844 - DNA, 13 bp, Homo sapiens
taggcctttcctg

SEQ ID NO: 6409845 - DNA, 18 bp, Homo sapiens
taggccttttaacatttt

SEQ ID NO: 6409846 - DNA, 14 bp, Homo sapiens
taggcgaaagtaat

SEQ ID NO: 6409847 - DNA, 13 bp, Homo sapiens
taggcgatcacaa

SEQ ID NO: 6409848 - DNA, 20 bp, Homo sapiens
taggcggcgatttttgtatg

SEQ ID NO: 6409849 - DNA, 21 bp, Homo sapiens
taggcgggcggtcaggggttc

SEQ ID NO: 6409850 - DNA, 18 bp, Homo sapiens
taggcggtcatgtgtgca

SEQ ID NO: 6409851 - DNA, 22 bp, Homo sapiens
taggctaatcaatacccttggc

SEQ ID NO: 6409852 - DNA, 13 bp, Homo sapiens
taggctaatgtca

SEQ ID NO: 6409853 - DNA, 17 bp, Homo sapiens
taggctacccttgccaa

SEQ ID NO: 6409854 - DNA, 20 bp, Homo sapiens
taggctactgtaatgctgcc

SEQ ID NO: 6409855 - DNA, 21 bp, Homo sapiens
taggctagagacagatgctgg

SEQ ID NO: 6409856 - DNA, 23 bp, Homo sapiens
taggctaggacgttggcctcagg

SEQ ID NO: 6409857 - DNA, 16 bp, Homo sapiens
taggctatgccatgtg

SEQ ID NO: 6409858 - DNA, 17 bp, Homo sapiens
taggctattaaaaaagt

SEQ ID NO: 6409859 - DNA, 13 bp, Homo sapiens
taggctattataa

SEQ ID NO: 6409860 - DNA, 19 bp, Homo sapiens
taggctattataatataga

SEQ ID NO: 6409861 - DNA, 14 bp, Homo sapiens
taggctattcacaa

SEQ ID NO: 6409862 - DNA, 15 bp, Homo sapiens
taggctattcacaac

SEQ ID NO: 6409863 - DNA, 16 bp, Homo sapiens
taggctatttgtaaat

SEQ ID NO: 6409864 - DNA, 20 bp, Homo sapiens
taggctattttctaaagact

SEQ ID NO: 6409865 - DNA, 14 bp, Homo sapiens
taggctccctgagg

SEQ ID NO: 6409866 - DNA, 15 bp, Homo sapiens
taggctccttcctgt

SEQ ID NO: 6409867 - DNA, 22 bp, Homo sapiens
taggctccttcctgtgggtggg

SEQ ID NO: 6409868 - DNA, 20 bp, Homo sapiens
taggctctgcacagatggat

SEQ ID NO: 6409869 - DNA, 12 bp, Homo sapiens
taggctctgcct

SEQ ID NO: 6409870 - DNA, 17 bp, Homo sapiens
taggctctgcctgacag

SEQ ID NO: 6409871 - DNA, 19 bp, Homo sapiens
taggctcttaagcagcatg

SEQ ID NO: 6409872 - DNA, 17 bp, Homo sapiens
taggctgagatgcacca

SEQ ID NO: 6409873 - DNA, 21 bp, Homo sapiens
taggctgcaaaattaaatcta

SEQ ID NO: 6409874 - DNA, 22 bp, Homo sapiens
taggctgcccaatctgagcaaa

SEQ ID NO: 6409875 - DNA, 23 bp, Homo sapiens
taggctgccccgggtccccagct

SEQ ID NO: 6409876 - DNA, 16 bp, Homo sapiens
taggctgctgccctgc

SEQ ID NO: 6409877 - DNA, 15 bp, Homo sapiens
taggctgctgggaga

SEQ ID NO: 6409878 - DNA, 15 bp, Homo sapiens
taggctggaatgttc

SEQ ID NO: 6409879 - DNA, 12 bp, Homo sapiens
taggctggagaa

SEQ ID NO: 6409880 - DNA, 19 bp, Homo sapiens
taggctggagaagctcacc

SEQ ID NO: 6409881 - DNA, 21 bp, Homo sapiens
taggctggagaagctcaccca

SEQ ID NO: 6409882 - DNA, 19 bp, Homo sapiens
taggctggagcccagggag

SEQ ID NO: 6409883 - DNA, 20 bp, Homo sapiens
taggctggagttagggactg

SEQ ID NO: 6409884 - DNA, 21 bp, Homo sapiens
taggctggcaagataaacact

SEQ ID NO: 6409885 - DNA, 13 bp, Homo sapiens
taggctggggaca

SEQ ID NO: 6409886 - DNA, 17 bp, Homo sapiens
taggctgggtgcccaca

SEQ ID NO: 6409887 - DNA, 18 bp, Homo sapiens
taggctgggtgcccacag

SEQ ID NO: 6409888 - DNA, 12 bp, Homo sapiens
taggctgtattt

SEQ ID NO: 6409889 - DNA, 16 bp, Homo sapiens
taggctgtattttctt

SEQ ID NO: 6409890 - DNA, 18 bp, Homo sapiens
taggctgtctgtgccatg

SEQ ID NO: 6409891 - DNA, 19 bp, Homo sapiens
taggctgtggggtctggct

SEQ ID NO: 6409892 - DNA, 20 bp, Homo sapiens
taggctgtggggtgggctgg

SEQ ID NO: 6409893 - DNA, 20 bp, Homo sapiens
taggctgttccctttgcctt

SEQ ID NO: 6409894 - DNA, 13 bp, Homo sapiens
taggctgttcctt

SEQ ID NO: 6409895 - DNA, 21 bp, Homo sapiens
taggcttaagagagagagcct

SEQ ID NO: 6409896 - DNA, 17 bp, Homo sapiens
taggcttatcaaaatct

SEQ ID NO: 6409897 - DNA, 20 bp, Homo sapiens
taggcttctatgtccaacag

SEQ ID NO: 6409898 - DNA, 14 bp, Homo sapiens
taggcttctgtaat

SEQ ID NO: 6409899 - DNA, 14 bp, Homo sapiens
taggctttacttag

SEQ ID NO: 6409900 - DNA, 20 bp, Homo sapiens
taggctttatttataaaata

SEQ ID NO: 6409901 - DNA, 21 bp, Homo sapiens
taggctttatttataaaataa

SEQ ID NO: 6409902 - DNA, 19 bp, Homo sapiens
taggcttttaccattagca

SEQ ID NO: 6409903 - DNA, 19 bp, Homo sapiens
tagggaaaacacggccctc

SEQ ID NO: 6409904 - DNA, 23 bp, Homo sapiens
tagggaaaacacggccctcctgg

SEQ ID NO: 6409905 - DNA, 16 bp, Homo sapiens
tagggaaaacattcca

SEQ ID NO: 6409906 - DNA, 19 bp, Homo sapiens
tagggaaaatagggtcctt

SEQ ID NO: 6409907 - DNA, 23 bp, Homo sapiens
tagggaaaccttggagaggagag

SEQ ID NO: 6409908 - DNA, 14 bp, Homo sapiens
tagggaacaatttg

SEQ ID NO: 6409909 - DNA, 20 bp, Homo sapiens
tagggaagaaaactatcctg

SEQ ID NO: 6409910 - DNA, 14 bp, Homo sapiens
tagggaagagaaac

SEQ ID NO: 6409911 - DNA, 13 bp, Homo sapiens
tagggaagataat

SEQ ID NO: 6409912 - DNA, 19 bp, Homo sapiens
tagggaagctggcctgaga

SEQ ID NO: 6409913 - DNA, 21 bp, Homo sapiens
tagggaaggatacaaaagcat

SEQ ID NO: 6409914 - DNA, 15 bp, Homo sapiens
tagggaattttcatt

SEQ ID NO: 6409915 - DNA, 22 bp, Homo sapiens
tagggacaatacagaacccatt

SEQ ID NO: 6409916 - DNA, 19 bp, Homo sapiens
tagggacatttccaagctg

SEQ ID NO: 6409917 - DNA, 15 bp, Homo sapiens
tagggaccaacggga

SEQ ID NO: 6409918 - DNA, 21 bp, Homo sapiens
tagggaccaacgggagcgagt

SEQ ID NO: 6409919 - DNA, 15 bp, Homo sapiens
tagggaccagaacca

SEQ ID NO: 6409920 - DNA, 14 bp, Homo sapiens
tagggacccctcct

SEQ ID NO: 6409921 - DNA, 16 bp, Homo sapiens
tagggacctggggaag

SEQ ID NO: 6409922 - DNA, 19 bp, Homo sapiens
tagggactacccatagaca

SEQ ID NO: 6409923 - DNA, 18 bp, Homo sapiens
tagggactatcaggtaat

SEQ ID NO: 6409924 - DNA, 14 bp, Homo sapiens
tagggactgaccag

SEQ ID NO: 6409925 - DNA, 20 bp, Homo sapiens
tagggactgtcctagccagg

SEQ ID NO: 6409926 - DNA, 21 bp, Homo sapiens
tagggactgtcctagccaggt

SEQ ID NO: 6409927 - DNA, 13 bp, Homo sapiens
tagggacttaaaa

SEQ ID NO: 6409928 - DNA, 16 bp, Homo sapiens
tagggagaaatgttgt

SEQ ID NO: 6409929 - DNA, 14 bp, Homo sapiens
tagggagagaagat

SEQ ID NO: 6409930 - DNA, 15 bp, Homo sapiens
tagggagagaagata

SEQ ID NO: 6409931 - DNA, 12 bp, Homo sapiens
tagggagagaga

SEQ ID NO: 6409932 - DNA, 15 bp, Homo sapiens
tagggagagagaagc

SEQ ID NO: 6409933 - DNA, 17 bp, Homo sapiens
tagggagagagaagcag

SEQ ID NO: 6409934 - DNA, 18 bp, Homo sapiens
tagggagagagaagcagg

SEQ ID NO: 6409935 - DNA, 20 bp, Homo sapiens
tagggagagagaagcaggca

SEQ ID NO: 6409936 - DNA, 21 bp, Homo sapiens
tagggagagggaagagggaga

SEQ ID NO: 6409937 - DNA, 24 bp, Homo sapiens
tagggagagggaagagggagacca

SEQ ID NO: 6409938 - DNA, 13 bp, Homo sapiens
tagggagatattt

SEQ ID NO: 6409939 - DNA, 19 bp, Homo sapiens
tagggagatgagttgcagt

SEQ ID NO: 6409940 - DNA, 17 bp, Homo sapiens
tagggagccatttgaga

SEQ ID NO: 6409941 - DNA, 13 bp, Homo sapiens
tagggaggaccac

SEQ ID NO: 6409942 - DNA, 16 bp, Homo sapiens
tagggaggcagcctcc

SEQ ID NO: 6409943 - DNA, 18 bp, Homo sapiens
tagggagggcggcagggg

SEQ ID NO: 6409944 - DNA, 23 bp, Homo sapiens
tagggagtatgctggaggcagag

SEQ ID NO: 6409945 - DNA, 17 bp, Homo sapiens
tagggatagtcaccttt

SEQ ID NO: 6409946 - DNA, 20 bp, Homo sapiens
tagggatagtcaccttttaa

SEQ ID NO: 6409947 - DNA, 21 bp, Homo sapiens
tagggatagtcaccttttaaa

SEQ ID NO: 6409948 - DNA, 16 bp, Homo sapiens
tagggatataaaaaca

SEQ ID NO: 6409949 - DNA, 17 bp, Homo sapiens
tagggatataaaaacag

SEQ ID NO: 6409950 - DNA, 18 bp, Homo sapiens
tagggatataaaaacaga

SEQ ID NO: 6409951 - DNA, 18 bp, Homo sapiens
tagggatctggggaagga

SEQ ID NO: 6409952 - DNA, 19 bp, Homo sapiens
tagggatctggggaaggac

SEQ ID NO: 6409953 - DNA, 23 bp, Homo sapiens
tagggatctggggaaggaccaac

SEQ ID NO: 6409954 - DNA, 21 bp, Homo sapiens
tagggatgcggatcctgctgg

SEQ ID NO: 6409955 - DNA, 19 bp, Homo sapiens
tagggatggggctgtgggg

SEQ ID NO: 6409956 - DNA, 16 bp, Homo sapiens
tagggattcaggctgc

SEQ ID NO: 6409957 - DNA, 14 bp, Homo sapiens
tagggcaagaggat

SEQ ID NO: 6409958 - DNA, 19 bp, Homo sapiens
tagggcaagggtgcctcag

SEQ ID NO: 6409959 - DNA, 21 bp, Homo sapiens
tagggcaagggtgcctcagga

SEQ ID NO: 6409960 - DNA, 15 bp, Homo sapiens
tagggcaccaggggt

SEQ ID NO: 6409961 - DNA, 14 bp, Homo sapiens
tagggcactgggct

SEQ ID NO: 6409962 - DNA, 19 bp, Homo sapiens
tagggcagagtatgttctt

SEQ ID NO: 6409963 - DNA, 11 bp, Homo sapiens
tagggcagctt

SEQ ID NO: 6409964 - DNA, 15 bp, Homo sapiens
tagggcagcttgccc

SEQ ID NO: 6409965 - DNA, 19 bp, Homo sapiens
tagggcagtaacattgggt

SEQ ID NO: 6409966 - DNA, 19 bp, Homo sapiens
tagggcataatgatgatgg

SEQ ID NO: 6409967 - DNA, 22 bp, Homo sapiens
tagggccagctcacaagcccag

SEQ ID NO: 6409968 - DNA, 17 bp, Homo sapiens
tagggcctcagtctgga

SEQ ID NO: 6409969 - DNA, 21 bp, Homo sapiens
tagggcctcggaggctcctcc

SEQ ID NO: 6409970 - DNA, 22 bp, Homo sapiens
tagggcctcggaggctcctccc

SEQ ID NO: 6409971 - DNA, 13 bp, Homo sapiens
tagggccttggtt

SEQ ID NO: 6409972 - DNA, 14 bp, Homo sapiens
tagggctaaatgtt

SEQ ID NO: 6409973 - DNA, 23 bp, Homo sapiens
tagggctacaaaacctgatgtta

SEQ ID NO: 6409974 - DNA, 14 bp, Homo sapiens
tagggctcagaggg

SEQ ID NO: 6409975 - DNA, 17 bp, Homo sapiens
tagggctctaatttcct

SEQ ID NO: 6409976 - DNA, 15 bp, Homo sapiens
tagggctgaggggcc

SEQ ID NO: 6409977 - DNA, 23 bp, Homo sapiens
tagggctgataatacacacagtt

SEQ ID NO: 6409978 - DNA, 17 bp, Homo sapiens
tagggctgctgcttctg

SEQ ID NO: 6409979 - DNA, 16 bp, Homo sapiens
tagggctgcttttctt

SEQ ID NO: 6409980 - DNA, 14 bp, Homo sapiens
tagggctggaccta

SEQ ID NO: 6409981 - DNA, 23 bp, Homo sapiens
tagggctggactctggcacccag

SEQ ID NO: 6409982 - DNA, 14 bp, Homo sapiens
tagggctgggaaac

SEQ ID NO: 6409983 - DNA, 12 bp, Homo sapiens
tagggctgggga

SEQ ID NO: 6409984 - DNA, 11 bp, Homo sapiens
tagggctgggt

SEQ ID NO: 6409985 - DNA, 20 bp, Homo sapiens
tagggctgtagacttacttt

SEQ ID NO: 6409986 - DNA, 22 bp, Homo sapiens
tagggctgttgctagggagagg

SEQ ID NO: 6409987 - DNA, 14 bp, Homo sapiens
tagggcttagtgtt

SEQ ID NO: 6409988 - DNA, 22 bp, Homo sapiens
tagggcttttattttttaagtt

SEQ ID NO: 6409989 - DNA, 16 bp, Homo sapiens
taggggaacagaccag

SEQ ID NO: 6409990 - DNA, 12 bp, Homo sapiens
taggggaagggg

SEQ ID NO: 6409991 - DNA, 15 bp, Homo sapiens
taggggaagggggtg

SEQ ID NO: 6409992 - DNA, 18 bp, Homo sapiens
taggggagagatctccaa

SEQ ID NO: 6409993 - DNA, 21 bp, Homo sapiens
taggggagccacatttacata

SEQ ID NO: 6409994 - DNA, 23 bp, Homo sapiens
taggggaggggggagccagaggc

SEQ ID NO: 6409995 - DNA, 11 bp, Homo sapiens
taggggagggt

SEQ ID NO: 6409996 - DNA, 16 bp, Homo sapiens
taggggagggtggggc

SEQ ID NO: 6409997 - DNA, 17 bp, Homo sapiens
taggggagggtggggca

SEQ ID NO: 6409998 - DNA, 20 bp, Homo sapiens
tccatttggattttaaacaa

SEQ ID NO: 6409999 - DNA, 22 bp, Homo sapiens
tccatttggcagaactgctggg

SEQ ID NO: 6410000 - DNA, 13 bp, Homo sapiens
tccatttgtaatt

SEQ ID NO: 6410001 - DNA, 17 bp, Homo sapiens
tccatttgttatctggg

SEQ ID NO: 6410002 - DNA, 14 bp, Homo sapiens
tccatttgttcctg

SEQ ID NO: 6410003 - DNA, 15 bp, Homo sapiens
tccatttgttcctgc

SEQ ID NO: 6410004 - DNA, 16 bp, Homo sapiens
tccatttgttcctgct

SEQ ID NO: 6410005 - DNA, 17 bp, Homo sapiens
tccattttaacaaacaa

SEQ ID NO: 6410006 - DNA, 16 bp, Homo sapiens
tccattttacacagca

SEQ ID NO: 6410007 - DNA, 13 bp, Homo sapiens
tccattttatgca

SEQ ID NO: 6410008 - DNA, 21 bp, Homo sapiens
tccattttcccccactactgc

SEQ ID NO: 6410009 - DNA, 19 bp, Homo sapiens
tccattttcctacaggcag

SEQ ID NO: 6410010 - DNA, 14 bp, Homo sapiens
tccattttctaaac

SEQ ID NO: 6410011 - DNA, 15 bp, Homo sapiens
tccattttcttctct

SEQ ID NO: 6410012 - DNA, 14 bp, Homo sapiens
tccattttggaaaa

SEQ ID NO: 6410013 - DNA, 19 bp, Homo sapiens
tccattttgtgaagccctg

SEQ ID NO: 6410014 - DNA, 20 bp, Homo sapiens
tccattttgtgaagccctgt

SEQ ID NO: 6410015 - DNA, 22 bp, Homo sapiens
tccatttttacaagttatagta

SEQ ID NO: 6410016 - DNA, 22 bp, Homo sapiens
tccatttttactaaagcagtgt

SEQ ID NO: 6410017 - DNA, 15 bp, Homo sapiens
tccatttttcccagg

SEQ ID NO: 6410018 - DNA, 15 bp, Homo sapiens
tccatttttcctctg

SEQ ID NO: 6410019 - DNA, 23 bp, Homo sapiens
tccatttttctcccaagaaacct

SEQ ID NO: 6410020 - DNA, 15 bp, Homo sapiens
tccatttttgattta

SEQ ID NO: 6410021 - DNA, 20 bp, Homo sapiens
tccattttttaaatgttcat

SEQ ID NO: 6410022 - DNA, 18 bp, Homo sapiens
tcccaaaaaccccagtgt

SEQ ID NO: 6410023 - DNA, 21 bp, Homo sapiens
tcccaaaaagatgctttaatt

SEQ ID NO: 6410024 - DNA, 23 bp, Homo sapiens
tcccaaaacaatctatttaaaaa

SEQ ID NO: 6410025 - DNA, 12 bp, Homo sapiens
tcccaaaagaat

SEQ ID NO: 6410026 - DNA, 12 bp, Homo sapiens
tcccaaaagcta

SEQ ID NO: 6410027 - DNA, 22 bp, Homo sapiens
tcccaaaatcccctcagcctct

SEQ ID NO: 6410028 - DNA, 23 bp, Homo sapiens
tcccaaaatcccctcagcctctt

SEQ ID NO: 6410029 - DNA, 21 bp, Homo sapiens
tcccaaaatggtgggattaca

SEQ ID NO: 6410030 - DNA, 22 bp, Homo sapiens
tcccaaaattgttttgagcttt

SEQ ID NO: 6410031 - DNA, 20 bp, Homo sapiens
tcccaaacagagggccacac

SEQ ID NO: 6410032 - DNA, 21 bp, Homo sapiens
tcccaaacccagtctcctctc

SEQ ID NO: 6410033 - DNA, 22 bp, Homo sapiens
tcccaaacccagtctcctctcc

SEQ ID NO: 6410034 - DNA, 24 bp, Homo sapiens
tcccaaacgccctttcctcctcag

SEQ ID NO: 6410035 - DNA, 15 bp, Homo sapiens
tcccaaacgcctccc

SEQ ID NO: 6410036 - DNA, 18 bp, Homo sapiens
tcccaaactcccaggacc

SEQ ID NO: 6410037 - DNA, 12 bp, Homo sapiens
tcccaaactgac

SEQ ID NO: 6410038 - DNA, 13 bp, Homo sapiens
tcccaaactgaca

SEQ ID NO: 6410039 - DNA, 14 bp, Homo sapiens
tcccaaactgacaa

SEQ ID NO: 6410040 - DNA, 16 bp, Homo sapiens
tcccaaactgacaatt

SEQ ID NO: 6410041 - DNA, 17 bp, Homo sapiens
tcccaaacttcggaaac

SEQ ID NO: 6410042 - DNA, 17 bp, Homo sapiens
tcccaaactttaaaatg

SEQ ID NO: 6410043 - DNA, 19 bp, Homo sapiens
tcccaaactttaaaatgcg

SEQ ID NO: 6410044 - DNA, 14 bp, Homo sapiens
tcccaaagcaagca

SEQ ID NO: 6410045 - DNA, 18 bp, Homo sapiens
tcccaaagcaagcacctg

SEQ ID NO: 6410046 - DNA, 20 bp, Homo sapiens
tcccaaagcaagcacctggg

SEQ ID NO: 6410047 - DNA, 17 bp, Homo sapiens
tcccaaagcagtgcatg

SEQ ID NO: 6410048 - DNA, 22 bp, Homo sapiens
tcccaaagccttgtgtctacag

SEQ ID NO: 6410049 - DNA, 22 bp, Homo sapiens
tcccaaaggactccacccatcc

SEQ ID NO: 6410050 - DNA, 22 bp, Homo sapiens
tcccaaaggatgagaatgtgac

SEQ ID NO: 6410051 - DNA, 15 bp, Homo sapiens
tcccaaagtcctctg

SEQ ID NO: 6410052 - DNA, 23 bp, Homo sapiens
tcccaaagtgaactctcaaatcc

SEQ ID NO: 6410053 - DNA, 20 bp, Homo sapiens
tcccaaagtgctaggattac

SEQ ID NO: 6410054 - DNA, 14 bp, Homo sapiens
tcccaaagtgctgg

SEQ ID NO: 6410055 - DNA, 16 bp, Homo sapiens
tcccaaagtgctggga

SEQ ID NO: 6410056 - DNA, 21 bp, Homo sapiens
tcccaaagtgctgggaattac

SEQ ID NO: 6410057 - DNA, 21 bp, Homo sapiens
tcccaaagtgctgggattaca

SEQ ID NO: 6410058 - DNA, 21 bp, Homo sapiens
tcccaaagtgttaggattaca

SEQ ID NO: 6410059 - DNA, 13 bp, Homo sapiens
tcccaaataaatt

SEQ ID NO: 6410060 - DNA, 21 bp, Homo sapiens
tcccaaataaatttataacaa

SEQ ID NO: 6410061 - DNA, 22 bp, Homo sapiens
tcccaaatatgcccctccccag

SEQ ID NO: 6410062 - DNA, 23 bp, Homo sapiens
tcccaaatatgcccctccccagt

SEQ ID NO: 6410063 - DNA, 20 bp, Homo sapiens
tcccaaatcctatttaaaga

SEQ ID NO: 6410064 - DNA, 21 bp, Homo sapiens
tcccaaatcctgtctgaaaag

SEQ ID NO: 6410065 - DNA, 15 bp, Homo sapiens
tcccaaatgcagctt

SEQ ID NO: 6410066 - DNA, 18 bp, Homo sapiens
tcccaaattccctggacc

SEQ ID NO: 6410067 - DNA, 16 bp, Homo sapiens
tcccaaatttcatacc

SEQ ID NO: 6410068 - DNA, 19 bp, Homo sapiens
tcccaacaaacattgatgc

SEQ ID NO: 6410069 - DNA, 14 bp, Homo sapiens
tcccaacaacatga

SEQ ID NO: 6410070 - DNA, 21 bp, Homo sapiens
tcccaacactcttggggacca

SEQ ID NO: 6410071 - DNA, 14 bp, Homo sapiens
tcccaacactgcca

SEQ ID NO: 6410072 - DNA, 16 bp, Homo sapiens
tcccaacactgccagc

SEQ ID NO: 6410073 - DNA, 17 bp, Homo sapiens
tcccaacagaggcctcc

SEQ ID NO: 6410074 - DNA, 17 bp, Homo sapiens
tcccaacagccatgccc

SEQ ID NO: 6410075 - DNA, 13 bp, Homo sapiens
tcccaacagccca

SEQ ID NO: 6410076 - DNA, 22 bp, Homo sapiens
tcccaacagccttagctgccag

SEQ ID NO: 6410077 - DNA, 19 bp, Homo sapiens
tcccaacaggaggacaatt

SEQ ID NO: 6410078 - DNA, 12 bp, Homo sapiens
tcccaacatggg

SEQ ID NO: 6410079 - DNA, 19 bp, Homo sapiens
tcccaacatggtcctagca

SEQ ID NO: 6410080 - DNA, 14 bp, Homo sapiens
tcccaacattctgc

SEQ ID NO: 6410081 - DNA, 17 bp, Homo sapiens
tcccaaccaaccagcag

SEQ ID NO: 6410082 - DNA, 18 bp, Homo sapiens
tcccaaccaaccagcagg

SEQ ID NO: 6410083 - DNA, 23 bp, Homo sapiens
tcccaaccagtgccaaggacctc

SEQ ID NO: 6410084 - DNA, 21 bp, Homo sapiens
tcccaacccaggattcaacat

SEQ ID NO: 6410085 - DNA, 21 bp, Homo sapiens
tcccaacccccagcccccacc

SEQ ID NO: 6410086 - DNA, 14 bp, Homo sapiens
tcccaacccccctc

SEQ ID NO: 6410087 - DNA, 17 bp, Homo sapiens
tcccaacccccctcctg

SEQ ID NO: 6410088 - DNA, 18 bp, Homo sapiens
tcccaacccccctcctgc

SEQ ID NO: 6410089 - DNA, 20 bp, Homo sapiens
tcccaacccccctcctgctc

SEQ ID NO: 6410090 - DNA, 21 bp, Homo sapiens
tcccaacccccctcctgctcc

SEQ ID NO: 6410091 - DNA, 17 bp, Homo sapiens
tcccaaccctgcccagc

SEQ ID NO: 6410092 - DNA, 21 bp, Homo sapiens
tcccaacctcaatgccctgcc

SEQ ID NO: 6410093 - DNA, 20 bp, Homo sapiens
tcccaacctcccctggtcct

SEQ ID NO: 6410094 - DNA, 23 bp, Homo sapiens
tcccaacctcccctggtcctgca

SEQ ID NO: 6410095 - DNA, 18 bp, Homo sapiens
tcccaacctcctgtgggc

SEQ ID NO: 6410096 - DNA, 20 bp, Homo sapiens
tcccaacctctttttcctcc

SEQ ID NO: 6410097 - DNA, 22 bp, Homo sapiens
tcccaacctctttttcctcctg

SEQ ID NO: 6410098 - DNA, 21 bp, Homo sapiens
tcccaacgagcctcctcaggg

SEQ ID NO: 6410099 - DNA, 22 bp, Homo sapiens
tcccaacgagcctcctcagggg

SEQ ID NO: 6410100 - DNA, 20 bp, Homo sapiens
tcccaacgtgcaaagccaag

SEQ ID NO: 6410101 - DNA, 17 bp, Homo sapiens
tcccaactataaaacta

SEQ ID NO: 6410102 - DNA, 15 bp, Homo sapiens
tcccaactcacccca

SEQ ID NO: 6410103 - DNA, 21 bp, Homo sapiens
tcccaactcaccccagcccca

SEQ ID NO: 6410104 - DNA, 20 bp, Homo sapiens
tcccaactcactgtgctcct

SEQ ID NO: 6410105 - DNA, 15 bp, Homo sapiens
tcccaactcagcctg

SEQ ID NO: 6410106 - DNA, 23 bp, Homo sapiens
tcccaactcagcctgttccttcc

SEQ ID NO: 6410107 - DNA, 17 bp, Homo sapiens
tcccaactcctataatt

SEQ ID NO: 6410108 - DNA, 16 bp, Homo sapiens
tcccaactcgatgggc

SEQ ID NO: 6410109 - DNA, 15 bp, Homo sapiens
tcccaactctagctg

SEQ ID NO: 6410110 - DNA, 14 bp, Homo sapiens
tcccaactgctctg

SEQ ID NO: 6410111 - DNA, 16 bp, Homo sapiens
tcccaactgctctgcc

SEQ ID NO: 6410112 - DNA, 18 bp, Homo sapiens
tcccaacttccctgttct

SEQ ID NO: 6410113 - DNA, 14 bp, Homo sapiens
tcccaacttgcctt

SEQ ID NO: 6410114 - DNA, 16 bp, Homo sapiens
tcccaactttggaaaa

SEQ ID NO: 6410115 - DNA, 13 bp, Homo sapiens
tcccaagaaaatc

SEQ ID NO: 6410116 - DNA, 19 bp, Homo sapiens
tcccaagaacagcaggccc

SEQ ID NO: 6410117 - DNA, 21 bp, Homo sapiens
tcccaagaacagcaggcccac

SEQ ID NO: 6410118 - DNA, 23 bp, Homo sapiens
tcccaagaacagcaggcccacct

SEQ ID NO: 6410119 - DNA, 20 bp, Homo sapiens
tcccaagaagagagaacttt

SEQ ID NO: 6410120 - DNA, 22 bp, Homo sapiens
tcccaagacctcatctgcctgc

SEQ ID NO: 6410121 - DNA, 17 bp, Homo sapiens
tcccaagagggctttat

SEQ ID NO: 6410122 - DNA, 23 bp, Homo sapiens
tcccaagagggctttattacacc

SEQ ID NO: 6410123 - DNA, 14 bp, Homo sapiens
tcccaagatgcctg

SEQ ID NO: 6410124 - DNA, 15 bp, Homo sapiens
tcccaagatgcctga

SEQ ID NO: 6410125 - DNA, 14 bp, Homo sapiens
tcccaagatgttga

SEQ ID NO: 6410126 - DNA, 23 bp, Homo sapiens
tcccaagatgttgatttttactg

SEQ ID NO: 6410127 - DNA, 20 bp, Homo sapiens
tcccaagcacctgggattac

SEQ ID NO: 6410128 - DNA, 21 bp, Homo sapiens
tcccaagcacctgggattaca

SEQ ID NO: 6410129 - DNA, 23 bp, Homo sapiens
tcccaagcagctgaagggtgact

SEQ ID NO: 6410130 - DNA, 17 bp, Homo sapiens
tcccaagctagactgtg

SEQ ID NO: 6410131 - DNA, 21 bp, Homo sapiens
tcccaagctagactgtgtctg

SEQ ID NO: 6410132 - DNA, 18 bp, Homo sapiens
tcccaagctcagagcagc

SEQ ID NO: 6410133 - DNA, 16 bp, Homo sapiens
tcccaagctcagaggc

SEQ ID NO: 6410134 - DNA, 15 bp, Homo sapiens
tcccaagctcccaag

SEQ ID NO: 6410135 - DNA, 13 bp, Homo sapiens
tcccaagctctgc

SEQ ID NO: 6410136 - DNA, 14 bp, Homo sapiens
tcccaagctctgct

SEQ ID NO: 6410137 - DNA, 17 bp, Homo sapiens
tcccaagctgattttat

SEQ ID NO: 6410138 - DNA, 12 bp, Homo sapiens
tcccaagctgga

SEQ ID NO: 6410139 - DNA, 16 bp, Homo sapiens
tcccaagctggctggg

SEQ ID NO: 6410140 - DNA, 13 bp, Homo sapiens
tcccaagctgggc

SEQ ID NO: 6410141 - DNA, 14 bp, Homo sapiens
tcccaagctgggcc

SEQ ID NO: 6410142 - DNA, 20 bp, Homo sapiens
tcccaagctgtatgtacttc

SEQ ID NO: 6410143 - DNA, 15 bp, Homo sapiens
tcccaagctgtgctg

SEQ ID NO: 6410144 - DNA, 16 bp, Homo sapiens
tcccaagctgtgctgg

SEQ ID NO: 6410145 - DNA, 17 bp, Homo sapiens
tcccaagctgtgctggg

SEQ ID NO: 6410146 - DNA, 12 bp, Homo sapiens
tcccaaggaaag

SEQ ID NO: 6410147 - DNA, 20 bp, Homo sapiens
tcccaaggaagctccttcct

SEQ ID NO: 6410148 - DNA, 12 bp, Homo sapiens
tcccaaggacat

SEQ ID NO: 6410149 - DNA, 21 bp, Homo sapiens
tcccaaggacttccacatttt

SEQ ID NO: 6410150 - DNA, 14 bp, Homo sapiens
tcccaaggagccat

SEQ ID NO: 6410151 - DNA, 23 bp, Homo sapiens
tcccaaggagctgatttccaggc

SEQ ID NO: 6410152 - DNA, 23 bp, Homo sapiens
tcccaaggagggggcctcattgt

SEQ ID NO: 6410153 - DNA, 20 bp, Homo sapiens
tcccaaggcattctcccagc

SEQ ID NO: 6410154 - DNA, 22 bp, Homo sapiens
tcccaaggcattctcccagctc

SEQ ID NO: 6410155 - DNA, 15 bp, Homo sapiens
tcccaaggcgtgcag

SEQ ID NO: 6410156 - DNA, 19 bp, Homo sapiens
tcccaaggctgccagacat

SEQ ID NO: 6410157 - DNA, 20 bp, Homo sapiens
tcccaaggctgccagacatg

SEQ ID NO: 6410158 - DNA, 13 bp, Homo sapiens
tcccaagggacag

SEQ ID NO: 6410159 - DNA, 20 bp, Homo sapiens
tcccaagggaggcccatgtg

SEQ ID NO: 6410160 - DNA, 18 bp, Homo sapiens
tcccaaggtcctctcagt

SEQ ID NO: 6410161 - DNA, 17 bp, Homo sapiens
tcccaaggttggagccc

SEQ ID NO: 6410162 - DNA, 21 bp, Homo sapiens
tcccaaggttggagcccaggg

SEQ ID NO: 6410163 - DNA, 23 bp, Homo sapiens
tcccaaggttggagcccagggca

SEQ ID NO: 6410164 - DNA, 20 bp, Homo sapiens
tcccaagtaactgggattac

SEQ ID NO: 6410165 - DNA, 18 bp, Homo sapiens
tcccaagtaagaggctgg

SEQ ID NO: 6410166 - DNA, 20 bp, Homo sapiens
tcccaagtaccctgagatac

SEQ ID NO: 6410167 - DNA, 20 bp, Homo sapiens
tcccaagtagctgagactac

SEQ ID NO: 6410168 - DNA, 21 bp, Homo sapiens
tcccaagtagctgggactgca

SEQ ID NO: 6410169 - DNA, 20 bp, Homo sapiens
tcccaagtagctgggattac

SEQ ID NO: 6410170 - DNA, 20 bp, Homo sapiens
tcccaagtaggtgggattac

SEQ ID NO: 6410171 - DNA, 14 bp, Homo sapiens
tcccaagtcaaaca

SEQ ID NO: 6410172 - DNA, 17 bp, Homo sapiens
tcccaagtcagacagat

SEQ ID NO: 6410173 - DNA, 22 bp, Homo sapiens
tcccaagtcctcgccccccgcc

SEQ ID NO: 6410174 - DNA, 17 bp, Homo sapiens
taggggatggtccagga

SEQ ID NO: 6410175 - DNA, 18 bp, Homo sapiens
taggggatggtccaggat

SEQ ID NO: 6410176 - DNA, 23 bp, Homo sapiens
taggggcaaaaatttgacattgt

SEQ ID NO: 6410177 - DNA, 17 bp, Homo sapiens
taggggcagggaggcaa

SEQ ID NO: 6410178 - DNA, 11 bp, Homo sapiens
taggggcaggt

SEQ ID NO: 6410179 - DNA, 14 bp, Homo sapiens
taggggccacctcc

SEQ ID NO: 6410180 - DNA, 16 bp, Homo sapiens
taggggccacctcctc

SEQ ID NO: 6410181 - DNA, 17 bp, Homo sapiens
taggggccacctcctcc

SEQ ID NO: 6410182 - DNA, 19 bp, Homo sapiens
taggggccacctcctcccc

SEQ ID NO: 6410183 - DNA, 21 bp, Homo sapiens
taggggccacctcctccccct

SEQ ID NO: 6410184 - DNA, 23 bp, Homo sapiens
taggggcgggggcggaggaggac

SEQ ID NO: 6410185 - DNA, 14 bp, Homo sapiens
taggggctgggaac

SEQ ID NO: 6410186 - DNA, 12 bp, Homo sapiens
taggggcttggt

SEQ ID NO: 6410187 - DNA, 22 bp, Homo sapiens
tagggggaaatgacctttttac

SEQ ID NO: 6410188 - DNA, 12 bp, Homo sapiens
tagggggcaggg

SEQ ID NO: 6410189 - DNA, 22 bp, Homo sapiens
tagggggccttgcggaagccat

SEQ ID NO: 6410190 - DNA, 16 bp, Homo sapiens
tagggggctggaggag

SEQ ID NO: 6410191 - DNA, 15 bp, Homo sapiens
tagggggctttctgg

SEQ ID NO: 6410192 - DNA, 14 bp, Homo sapiens
tagggggtccctcc

SEQ ID NO: 6410193 - DNA, 23 bp, Homo sapiens
taggggtaatatattgctgctgg

SEQ ID NO: 6410194 - DNA, 14 bp, Homo sapiens
taggggtagctggt

SEQ ID NO: 6410195 - DNA, 16 bp, Homo sapiens
taggggtagggagcct

SEQ ID NO: 6410196 - DNA, 21 bp, Homo sapiens
taggggtccacgggaagcctc

SEQ ID NO: 6410197 - DNA, 22 bp, Homo sapiens
taggggtcctcttagtccacaa

SEQ ID NO: 6410198 - DNA, 13 bp, Homo sapiens
taggggtcctggg

SEQ ID NO: 6410199 - DNA, 22 bp, Homo sapiens
taggggtctgtcttttaaactc

SEQ ID NO: 6410200 - DNA, 14 bp, Homo sapiens
taggggtgaaggag

SEQ ID NO: 6410201 - DNA, 20 bp, Homo sapiens
taggggtgcgctcacctgca

SEQ ID NO: 6410202 - DNA, 18 bp, Homo sapiens
taggggttgaagaaaaca

SEQ ID NO: 6410203 - DNA, 14 bp, Homo sapiens
tagggtaaaaaaag

SEQ ID NO: 6410204 - DNA, 13 bp, Homo sapiens
tagggtaagaaga

SEQ ID NO: 6410205 - DNA, 17 bp, Homo sapiens
tagggtaagaagtttgt

SEQ ID NO: 6410206 - DNA, 23 bp, Homo sapiens
tagggtaagaagtttgtgtcttt

SEQ ID NO: 6410207 - DNA, 18 bp, Homo sapiens
tagggtacagcccaggcg

SEQ ID NO: 6410208 - DNA, 19 bp, Homo sapiens
tagggtacatggtgctggg

SEQ ID NO: 6410209 - DNA, 16 bp, Homo sapiens
tagggtacatttataa

SEQ ID NO: 6410210 - DNA, 18 bp, Homo sapiens
tagggtacatttataatt

SEQ ID NO: 6410211 - DNA, 15 bp, Homo sapiens
tagggtatattttcc

SEQ ID NO: 6410212 - DNA, 14 bp, Homo sapiens
tagggtcagccatt

SEQ ID NO: 6410213 - DNA, 13 bp, Homo sapiens
tagggtcaggcgg

SEQ ID NO: 6410214 - DNA, 23 bp, Homo sapiens
tagggtcaggcggggtgctgtgg

SEQ ID NO: 6410215 - DNA, 20 bp, Homo sapiens
tagggtccctgaacgccctg

SEQ ID NO: 6410216 - DNA, 20 bp, Homo sapiens
tagggtcctcaggcagtggc

SEQ ID NO: 6410217 - DNA, 13 bp, Homo sapiens
tagggtcctgggg

SEQ ID NO: 6410218 - DNA, 13 bp, Homo sapiens
tagggtccttgaa

SEQ ID NO: 6410219 - DNA, 20 bp, Homo sapiens
tagggtccttgaaacagaaa

SEQ ID NO: 6410220 - DNA, 16 bp, Homo sapiens
tagggtcttgggggtc

SEQ ID NO: 6410221 - DNA, 22 bp, Homo sapiens
tagggtgaaccacttcattctg

SEQ ID NO: 6410222 - DNA, 13 bp, Homo sapiens
tagggtgcagcca

SEQ ID NO: 6410223 - DNA, 13 bp, Homo sapiens
tagggtggacaga

SEQ ID NO: 6410224 - DNA, 17 bp, Homo sapiens
tagggtggacagaagct

SEQ ID NO: 6410225 - DNA, 20 bp, Homo sapiens
tagggtggcactgggagggg

SEQ ID NO: 6410226 - DNA, 12 bp, Homo sapiens
tagggtggccct

SEQ ID NO: 6410227 - DNA, 16 bp, Homo sapiens
tagggtggctttaatt

SEQ ID NO: 6410228 - DNA, 21 bp, Homo sapiens
tagggtgtgtgttcaccttca

SEQ ID NO: 6410229 - DNA, 17 bp, Homo sapiens
tagggttataataatgt

SEQ ID NO: 6410230 - DNA, 17 bp, Homo sapiens
tagggttatatttggga

SEQ ID NO: 6410231 - DNA, 18 bp, Homo sapiens
tagggttgccagtcctgc

SEQ ID NO: 6410232 - DNA, 19 bp, Homo sapiens
tagggttggttcctttcca

SEQ ID NO: 6410233 - DNA, 23 bp, Homo sapiens
tagggtttgtttgctgcttttga

SEQ ID NO: 6410234 - DNA, 15 bp, Homo sapiens
tagggttttggcctg

SEQ ID NO: 6410235 - DNA, 17 bp, Homo sapiens
tagggttttttttaatg

SEQ ID NO: 6410236 - DNA, 21 bp, Homo sapiens
tagggttttttttaatgtgaa

SEQ ID NO: 6410237 - DNA, 12 bp, Homo sapiens
taggtaaagagg

SEQ ID NO: 6410238 - DNA, 22 bp, Homo sapiens
taggtaaatttttaggcaaaga

SEQ ID NO: 6410239 - DNA, 13 bp, Homo sapiens
taggtaacacatt

SEQ ID NO: 6410240 - DNA, 13 bp, Homo sapiens
taggtaagctgtg

SEQ ID NO: 6410241 - DNA, 12 bp, Homo sapiens
taggtaagggcc

SEQ ID NO: 6410242 - DNA, 16 bp, Homo sapiens
taggtaaggttttcaa

SEQ ID NO: 6410243 - DNA, 15 bp, Homo sapiens
taggtaagttggctc

SEQ ID NO: 6410244 - DNA, 20 bp, Homo sapiens
taggtaatcaatgaatattg

SEQ ID NO: 6410245 - DNA, 16 bp, Homo sapiens
taggtaatgttttgta

SEQ ID NO: 6410246 - DNA, 13 bp, Homo sapiens
taggtacttttgg

SEQ ID NO: 6410247 - DNA, 18 bp, Homo sapiens
taggtagaaaaagggtca

SEQ ID NO: 6410248 - DNA, 14 bp, Homo sapiens
taggtagaaactat

SEQ ID NO: 6410249 - DNA, 22 bp, Homo sapiens
taggtagagtcattcatatttg

SEQ ID NO: 6410250 - DNA, 15 bp, Homo sapiens
taggtagagtctgag

SEQ ID NO: 6410251 - DNA, 13 bp, Homo sapiens
taggtagatccag

SEQ ID NO: 6410252 - DNA, 18 bp, Homo sapiens
taggtagcaacaacagaa

SEQ ID NO: 6410253 - DNA, 21 bp, Homo sapiens
taggtagtggggaccaagttc

SEQ ID NO: 6410254 - DNA, 19 bp, Homo sapiens
taggtagtttggatatttt

SEQ ID NO: 6410255 - DNA, 18 bp, Homo sapiens
taggtataaaaaataagt

SEQ ID NO: 6410256 - DNA, 13 bp, Homo sapiens
taggtatacaaaa

SEQ ID NO: 6410257 - DNA, 15 bp, Homo sapiens
taggtatgaagtata

SEQ ID NO: 6410258 - DNA, 18 bp, Homo sapiens
taggtatgtctgtgccat

SEQ ID NO: 6410259 - DNA, 18 bp, Homo sapiens
taggtatgtttgtaactt

SEQ ID NO: 6410260 - DNA, 17 bp, Homo sapiens
taggtattaaagatgtg

SEQ ID NO: 6410261 - DNA, 18 bp, Homo sapiens
taggtattaaagatgtgt

SEQ ID NO: 6410262 - DNA, 16 bp, Homo sapiens
taggtattagtgtttg

SEQ ID NO: 6410263 - DNA, 18 bp, Homo sapiens
taggtattgtctactctg

SEQ ID NO: 6410264 - DNA, 19 bp, Homo sapiens
taggtattgtctactctga

SEQ ID NO: 6410265 - DNA, 17 bp, Homo sapiens
taggtatttaagactga

SEQ ID NO: 6410266 - DNA, 18 bp, Homo sapiens
taggtcaagaagaagatg

SEQ ID NO: 6410267 - DNA, 15 bp, Homo sapiens
taggtcaagtaataa

SEQ ID NO: 6410268 - DNA, 16 bp, Homo sapiens
taggtcaatgaaatat

SEQ ID NO: 6410269 - DNA, 20 bp, Homo sapiens
taggtcacattacattaaca

SEQ ID NO: 6410270 - DNA, 17 bp, Homo sapiens
taggtcacgttggccct

SEQ ID NO: 6410271 - DNA, 17 bp, Homo sapiens
taggtcactctccagca

SEQ ID NO: 6410272 - DNA, 12 bp, Homo sapiens
taggtcactggc

SEQ ID NO: 6410273 - DNA, 13 bp, Homo sapiens
taggtcagatgga

SEQ ID NO: 6410274 - DNA, 20 bp, Homo sapiens
taggtcaggagttgtgtcta

SEQ ID NO: 6410275 - DNA, 22 bp, Homo sapiens
taggtcagtacccacctgagct

SEQ ID NO: 6410276 - DNA, 17 bp, Homo sapiens
taggtcagtagactgtg

SEQ ID NO: 6410277 - DNA, 15 bp, Homo sapiens
taggtcagtctaaca

SEQ ID NO: 6410278 - DNA, 14 bp, Homo sapiens
taggtcataaagca

SEQ ID NO: 6410279 - DNA, 15 bp, Homo sapiens
taggtcataaagcat

SEQ ID NO: 6410280 - DNA, 20 bp, Homo sapiens
taggtcattcttttgccaca

SEQ ID NO: 6410281 - DNA, 15 bp, Homo sapiens
taggtcattgcacct

SEQ ID NO: 6410282 - DNA, 20 bp, Homo sapiens
taggtcattgcacctatctc

SEQ ID NO: 6410283 - DNA, 16 bp, Homo sapiens
taggtcatttgtagat

SEQ ID NO: 6410284 - DNA, 21 bp, Homo sapiens
taggtcccagaatggaaaaaa

SEQ ID NO: 6410285 - DNA, 16 bp, Homo sapiens
taggtcccccaagcat

SEQ ID NO: 6410286 - DNA, 12 bp, Homo sapiens
taggtcctcact

SEQ ID NO: 6410287 - DNA, 15 bp, Homo sapiens
taggtcctggcttct

SEQ ID NO: 6410288 - DNA, 22 bp, Homo sapiens
taggtcgccagtgaaatagaac

SEQ ID NO: 6410289 - DNA, 17 bp, Homo sapiens
taggtcgcgctcttgca

SEQ ID NO: 6410290 - DNA, 16 bp, Homo sapiens
taggtctcatctcttc

SEQ ID NO: 6410291 - DNA, 20 bp, Homo sapiens
taggtctcatgcccactccc

SEQ ID NO: 6410292 - DNA, 20 bp, Homo sapiens
taggtctccacccctcaagc

SEQ ID NO: 6410293 - DNA, 21 bp, Homo sapiens
taggtctcctcagggtggggg

SEQ ID NO: 6410294 - DNA, 19 bp, Homo sapiens
taggtctcggactaagcct

SEQ ID NO: 6410295 - DNA, 12 bp, Homo sapiens
taggtctgaaat

SEQ ID NO: 6410296 - DNA, 18 bp, Homo sapiens
taggtctgaaatttttct

SEQ ID NO: 6410297 - DNA, 16 bp, Homo sapiens
taggtctgcacacata

SEQ ID NO: 6410298 - DNA, 19 bp, Homo sapiens
taggtctgcacacataaca

SEQ ID NO: 6410299 - DNA, 21 bp, Homo sapiens
taggtctggaaggtcacgctg

SEQ ID NO: 6410300 - DNA, 16 bp, Homo sapiens
taggtcttattgaaat

SEQ ID NO: 6410301 - DNA, 15 bp, Homo sapiens
taggtcttcctgtgg

SEQ ID NO: 6410302 - DNA, 19 bp, Homo sapiens
taggtctttctctcagtga

SEQ ID NO: 6410303 - DNA, 14 bp, Homo sapiens
taggtctttgtaag

SEQ ID NO: 6410304 - DNA, 23 bp, Homo sapiens
taggtgaaaacagcccaggtcct

SEQ ID NO: 6410305 - DNA, 14 bp, Homo sapiens
taggtgaagggatg

SEQ ID NO: 6410306 - DNA, 19 bp, Homo sapiens
taggtgaagggatggggga

SEQ ID NO: 6410307 - DNA, 21 bp, Homo sapiens
taggtgaagggatgggggaag

SEQ ID NO: 6410308 - DNA, 15 bp, Homo sapiens
taggtgagaaaaaaa

SEQ ID NO: 6410309 - DNA, 13 bp, Homo sapiens
taggtgagcctgg

SEQ ID NO: 6410310 - DNA, 22 bp, Homo sapiens
taggtgagctatagtgaagaat

SEQ ID NO: 6410311 - DNA, 19 bp, Homo sapiens
taggtgagtcacactcaga

SEQ ID NO: 6410312 - DNA, 16 bp, Homo sapiens
taggtgatccatgtaa

SEQ ID NO: 6410313 - DNA, 16 bp, Homo sapiens
taggtgatgggcagat

SEQ ID NO: 6410314 - DNA, 22 bp, Homo sapiens
taggtgatgtttgctcttgttt

SEQ ID NO: 6410315 - DNA, 12 bp, Homo sapiens
taggtgattcta

SEQ ID NO: 6410316 - DNA, 15 bp, Homo sapiens
taggtgccaggctgt

SEQ ID NO: 6410317 - DNA, 20 bp, Homo sapiens
taggtgctacaaaaacacag

SEQ ID NO: 6410318 - DNA, 16 bp, Homo sapiens
taggtgctggatgctt

SEQ ID NO: 6410319 - DNA, 12 bp, Homo sapiens
taggtgctggca

SEQ ID NO: 6410320 - DNA, 16 bp, Homo sapiens
taggtggcaaggctgt

SEQ ID NO: 6410321 - DNA, 13 bp, Homo sapiens
taggtgggagaga

SEQ ID NO: 6410322 - DNA, 19 bp, Homo sapiens
taggtgggccagcccctcc

SEQ ID NO: 6410323 - DNA, 17 bp, Homo sapiens
taggtgggtaggagccc

SEQ ID NO: 6410324 - DNA, 23 bp, Homo sapiens
taggtgggtaggagcccttctct

SEQ ID NO: 6410325 - DNA, 22 bp, Homo sapiens
taggtgggtcaactccaaggca

SEQ ID NO: 6410326 - DNA, 18 bp, Homo sapiens
taggtgtaaatgagaaga

SEQ ID NO: 6410327 - DNA, 16 bp, Homo sapiens
taggtgtcatttccat

SEQ ID NO: 6410328 - DNA, 13 bp, Homo sapiens
taggtgtccccaa

SEQ ID NO: 6410329 - DNA, 14 bp, Homo sapiens
taggtgtccccaac

SEQ ID NO: 6410330 - DNA, 22 bp, Homo sapiens
taggtgtctgccttcacaaatg

SEQ ID NO: 6410331 - DNA, 14 bp, Homo sapiens
taggtgtgccaaac

SEQ ID NO: 6410332 - DNA, 17 bp, Homo sapiens
taggtgtgggggaagca

SEQ ID NO: 6410333 - DNA, 13 bp, Homo sapiens
taggttaaaaaaa

SEQ ID NO: 6410334 - DNA, 14 bp, Homo sapiens
taggttaaagctaa

SEQ ID NO: 6410335 - DNA, 18 bp, Homo sapiens
taggttaaagctaaactg

SEQ ID NO: 6410336 - DNA, 19 bp, Homo sapiens
taggttaataggaggacag

SEQ ID NO: 6410337 - DNA, 18 bp, Homo sapiens
taggttatacaataaccc

SEQ ID NO: 6410338 - DNA, 22 bp, Homo sapiens
taggttattttgatgtaaagat

SEQ ID NO: 6410339 - DNA, 17 bp, Homo sapiens
taggttattttgctttg

SEQ ID NO: 6410340 - DNA, 20 bp, Homo sapiens
taggttccctgttcttcctc

SEQ ID NO: 6410341 - DNA, 12 bp, Homo sapiens
taggttctaaaa

SEQ ID NO: 6410342 - DNA, 16 bp, Homo sapiens
taggttctaaagttct

SEQ ID NO: 6410343 - DNA, 22 bp, Homo sapiens
taggttctaaagttctaagatt

SEQ ID NO: 6410344 - DNA, 17 bp, Homo sapiens
taggttctgctttctga

SEQ ID NO: 6410345 - DNA, 12 bp, Homo sapiens
taggttcttctt

SEQ ID NO: 6410346 - DNA, 18 bp, Homo sapiens
taggttctttgctgcatt

SEQ ID NO: 6410347 - DNA, 17 bp, Homo sapiens
taggttgacattcagaa

SEQ ID NO: 6410348 - DNA, 13 bp, Homo sapiens
taggttgcacact

SEQ ID NO: 6410349 - DNA, 19 bp, Homo sapiens
taggttgcacactttggta

SEQ ID NO: 6410350 - DNA, 20 bp, Homo sapiens
taggttgccaataatacact

SEQ ID NO: 6410351 - DNA, 24 bp, Homo sapiens
taggttggaagctagctcccctcc

SEQ ID NO: 6410352 - DNA, 16 bp, Homo sapiens
taggttggacagcccc

SEQ ID NO: 6410353 - DNA, 15 bp, Homo sapiens
taggttggactggaa

SEQ ID NO: 6410354 - DNA, 21 bp, Homo sapiens
tcccaagtcctgctcctttct

SEQ ID NO: 6410355 - DNA, 17 bp, Homo sapiens
tcccaagtctccagaga

SEQ ID NO: 6410356 - DNA, 18 bp, Homo sapiens
tcccaagtctccagagag

SEQ ID NO: 6410357 - DNA, 17 bp, Homo sapiens
tcccaagtgagtctctc

SEQ ID NO: 6410358 - DNA, 13 bp, Homo sapiens
tcccaagtgccaa

SEQ ID NO: 6410359 - DNA, 18 bp, Homo sapiens
tcccaagtggtgcctaaa

SEQ ID NO: 6410360 - DNA, 19 bp, Homo sapiens
tcccaagtttccatagcaa

SEQ ID NO: 6410361 - DNA, 21 bp, Homo sapiens
tcccaagtttccatagcaaca

SEQ ID NO: 6410362 - DNA, 23 bp, Homo sapiens
tcccaagttttaggacaaacagc

SEQ ID NO: 6410363 - DNA, 14 bp, Homo sapiens
tcccaataaaagtg

SEQ ID NO: 6410364 - DNA, 14 bp, Homo sapiens
tcccaatacaaaga

SEQ ID NO: 6410365 - DNA, 21 bp, Homo sapiens
tcccaatacaggcatgaacca

SEQ ID NO: 6410366 - DNA, 18 bp, Homo sapiens
tcccaatagcactttcat

SEQ ID NO: 6410367 - DNA, 17 bp, Homo sapiens
tcccaataggcagactg

SEQ ID NO: 6410368 - DNA, 18 bp, Homo sapiens
tcccaatcaaagaattac

SEQ ID NO: 6410369 - DNA, 13 bp, Homo sapiens
tcccaatcagcac

SEQ ID NO: 6410370 - DNA, 14 bp, Homo sapiens
tcccaatcagcttt

SEQ ID NO: 6410371 - DNA, 18 bp, Homo sapiens
tcccaatctcaatacagc

SEQ ID NO: 6410372 - DNA, 21 bp, Homo sapiens
tcccaatctctacccctttct

SEQ ID NO: 6410373 - DNA, 19 bp, Homo sapiens
tcccaatctttctatataa

SEQ ID NO: 6410374 - DNA, 20 bp, Homo sapiens
tcccaatctttctatataaa

SEQ ID NO: 6410375 - DNA, 17 bp, Homo sapiens
tcccaattaaaatacta

SEQ ID NO: 6410376 - DNA, 14 bp, Homo sapiens
tcccaattaggaag

SEQ ID NO: 6410377 - DNA, 15 bp, Homo sapiens
tcccaattaggaagt

SEQ ID NO: 6410378 - DNA, 19 bp, Homo sapiens
tcccaattaggaagtgtaa

SEQ ID NO: 6410379 - DNA, 20 bp, Homo sapiens
tcccaattaggaagtgtaac

SEQ ID NO: 6410380 - DNA, 15 bp, Homo sapiens
tcccaattcatttca

SEQ ID NO: 6410381 - DNA, 16 bp, Homo sapiens
tcccaattcggggcct

SEQ ID NO: 6410382 - DNA, 17 bp, Homo sapiens
tcccaattcggggcctg

SEQ ID NO: 6410383 - DNA, 20 bp, Homo sapiens
tcccaattcggggcctgctg

SEQ ID NO: 6410384 - DNA, 21 bp, Homo sapiens
tcccaatttaagagtcctgag

SEQ ID NO: 6410385 - DNA, 19 bp, Homo sapiens
tcccacaaaagacagaccc

SEQ ID NO: 6410386 - DNA, 12 bp, Homo sapiens
tcccacaaaata

SEQ ID NO: 6410387 - DNA, 13 bp, Homo sapiens
tcccacaaaatat

SEQ ID NO: 6410388 - DNA, 19 bp, Homo sapiens
tcccacaaaatatttctaa

SEQ ID NO: 6410389 - DNA, 14 bp, Homo sapiens
tcccacaaaggaga

SEQ ID NO: 6410390 - DNA, 22 bp, Homo sapiens
tcccacaactactagtgtgact

SEQ ID NO: 6410391 - DNA, 14 bp, Homo sapiens
tcccacaagcctct

SEQ ID NO: 6410392 - DNA, 17 bp, Homo sapiens
tcccacaagcctgcctc

SEQ ID NO: 6410393 - DNA, 16 bp, Homo sapiens
tcccacaagtggtggt

SEQ ID NO: 6410394 - DNA, 17 bp, Homo sapiens
tcccacaatggctggga

SEQ ID NO: 6410395 - DNA, 20 bp, Homo sapiens
tcccacaattggccagggca

SEQ ID NO: 6410396 - DNA, 17 bp, Homo sapiens
tcccacacccaaagctg

SEQ ID NO: 6410397 - DNA, 15 bp, Homo sapiens
tcccacacccaccct

SEQ ID NO: 6410398 - DNA, 20 bp, Homo sapiens
tcccacacccacctctgcca

SEQ ID NO: 6410399 - DNA, 13 bp, Homo sapiens
tcccacaccccaa

SEQ ID NO: 6410400 - DNA, 15 bp, Homo sapiens
tcccacacctccaca

SEQ ID NO: 6410401 - DNA, 16 bp, Homo sapiens
tcccacacctgcctgc

SEQ ID NO: 6410402 - DNA, 23 bp, Homo sapiens
tcccacactgaaaccaaaacata

SEQ ID NO: 6410403 - DNA, 14 bp, Homo sapiens
tcccacactgaaat

SEQ ID NO: 6410404 - DNA, 23 bp, Homo sapiens
tcccacactgtgcagacccagtc

SEQ ID NO: 6410405 - DNA, 17 bp, Homo sapiens
tcccacacttgctgggg

SEQ ID NO: 6410406 - DNA, 17 bp, Homo sapiens
tcccacacttgtgccag

SEQ ID NO: 6410407 - DNA, 17 bp, Homo sapiens
tcccacagacctgcagt

SEQ ID NO: 6410408 - DNA, 18 bp, Homo sapiens
tcccacagcagccccagg

SEQ ID NO: 6410409 - DNA, 20 bp, Homo sapiens
tcccacagcagccccaggag

SEQ ID NO: 6410410 - DNA, 22 bp, Homo sapiens
tcccacagcagccccaggagaa

SEQ ID NO: 6410411 - DNA, 16 bp, Homo sapiens
tcccacagccacgtgt

SEQ ID NO: 6410412 - DNA, 16 bp, Homo sapiens
tcccacagccccttgc

SEQ ID NO: 6410413 - DNA, 15 bp, Homo sapiens
tcccacagcctcctt

SEQ ID NO: 6410414 - DNA, 17 bp, Homo sapiens
tcccacaggacatttct

SEQ ID NO: 6410415 - DNA, 18 bp, Homo sapiens
tcccacaggacatttctc

SEQ ID NO: 6410416 - DNA, 12 bp, Homo sapiens
tcccacaggagg

SEQ ID NO: 6410417 - DNA, 14 bp, Homo sapiens
tcccacaggcagct

SEQ ID NO: 6410418 - DNA, 17 bp, Homo sapiens
tcccacaggcccttcct

SEQ ID NO: 6410419 - DNA, 11 bp, Homo sapiens
tcccacaggga

SEQ ID NO: 6410420 - DNA, 20 bp, Homo sapiens
tcccacagggaaatgtgtat

SEQ ID NO: 6410421 - DNA, 20 bp, Homo sapiens
tcccacaggtcttcactgcc

SEQ ID NO: 6410422 - DNA, 23 bp, Homo sapiens
tcccacaggtcttcactgcccag

SEQ ID NO: 6410423 - DNA, 16 bp, Homo sapiens
tcccacagtgctggga

SEQ ID NO: 6410424 - DNA, 17 bp, Homo sapiens
tcccacatcccactgga

SEQ ID NO: 6410425 - DNA, 13 bp, Homo sapiens
tcccacatccccc

SEQ ID NO: 6410426 - DNA, 15 bp, Homo sapiens
tcccacatccctggg

SEQ ID NO: 6410427 - DNA, 17 bp, Homo sapiens
tcccacatccctgggcc

SEQ ID NO: 6410428 - DNA, 18 bp, Homo sapiens
tcccacatccctgggcct

SEQ ID NO: 6410429 - DNA, 23 bp, Homo sapiens
tcccacatgaggccatctcagga

SEQ ID NO: 6410430 - DNA, 22 bp, Homo sapiens
tcccacatggccatcttctttc

SEQ ID NO: 6410431 - DNA, 18 bp, Homo sapiens
tcccacattagcttgtta

SEQ ID NO: 6410432 - DNA, 14 bp, Homo sapiens
tcccacatttccat

SEQ ID NO: 6410433 - DNA, 16 bp, Homo sapiens
tcccacattttagaat

SEQ ID NO: 6410434 - DNA, 14 bp, Homo sapiens
tcccaccaacaaaa

SEQ ID NO: 6410435 - DNA, 18 bp, Homo sapiens
tcccaccaactctctctg

SEQ ID NO: 6410436 - DNA, 19 bp, Homo sapiens
tcccaccaactctctctgc

SEQ ID NO: 6410437 - DNA, 15 bp, Homo sapiens
tcccaccaactctgc

SEQ ID NO: 6410438 - DNA, 17 bp, Homo sapiens
tcccaccaactctgcac

SEQ ID NO: 6410439 - DNA, 20 bp, Homo sapiens
tcccaccaactctgcactcc

SEQ ID NO: 6410440 - DNA, 23 bp, Homo sapiens
tcccaccaactctgcactccatg

SEQ ID NO: 6410441 - DNA, 18 bp, Homo sapiens
tcccaccaaggtcttcag

SEQ ID NO: 6410442 - DNA, 17 bp, Homo sapiens
tcccaccaatcctcacc

SEQ ID NO: 6410443 - DNA, 18 bp, Homo sapiens
tcccaccaccctcccacc

SEQ ID NO: 6410444 - DNA, 22 bp, Homo sapiens
tcccaccaccctcccaccatgc

SEQ ID NO: 6410445 - DNA, 17 bp, Homo sapiens
tcccaccaggctgctca

SEQ ID NO: 6410446 - DNA, 23 bp, Homo sapiens
tcccaccataatccctgtcttct

SEQ ID NO: 6410447 - DNA, 19 bp, Homo sapiens
tcccaccatgcgctgctca

SEQ ID NO: 6410448 - DNA, 19 bp, Homo sapiens
tcccaccattcctgccttt

SEQ ID NO: 6410449 - DNA, 16 bp, Homo sapiens
tcccacccaacagctc

SEQ ID NO: 6410450 - DNA, 20 bp, Homo sapiens
tcccacccaacagctcagag

SEQ ID NO: 6410451 - DNA, 18 bp, Homo sapiens
tcccacccaacttcccct

SEQ ID NO: 6410452 - DNA, 21 bp, Homo sapiens
tcccacccaagccctcctttg

SEQ ID NO: 6410453 - DNA, 14 bp, Homo sapiens
tcccacccaaggag

SEQ ID NO: 6410454 - DNA, 16 bp, Homo sapiens
tcccacccaaggagaa

SEQ ID NO: 6410455 - DNA, 19 bp, Homo sapiens
tcccacccaattcaaaaca

SEQ ID NO: 6410456 - DNA, 20 bp, Homo sapiens
tcccacccacaagaactcct

SEQ ID NO: 6410457 - DNA, 18 bp, Homo sapiens
tcccacccacagccatag

SEQ ID NO: 6410458 - DNA, 18 bp, Homo sapiens
tcccacccacatgtgaca

SEQ ID NO: 6410459 - DNA, 11 bp, Homo sapiens
tcccacccacc

SEQ ID NO: 6410460 - DNA, 20 bp, Homo sapiens
tcccacccaggaaaggagga

SEQ ID NO: 6410461 - DNA, 20 bp, Homo sapiens
tcccaccccacacacgccag

SEQ ID NO: 6410462 - DNA, 14 bp, Homo sapiens
tcccaccccactcc

SEQ ID NO: 6410463 - DNA, 19 bp, Homo sapiens
tcccaccccactccagccc

SEQ ID NO: 6410464 - DNA, 20 bp, Homo sapiens
tcccaccccactccagccct

SEQ ID NO: 6410465 - DNA, 21 bp, Homo sapiens
tcccaccccactccagccctg

SEQ ID NO: 6410466 - DNA, 14 bp, Homo sapiens
tcccaccccagaaa

SEQ ID NO: 6410467 - DNA, 16 bp, Homo sapiens
tcccaccccagaaatc

SEQ ID NO: 6410468 - DNA, 20 bp, Homo sapiens
tcccacccccaacccccaga

SEQ ID NO: 6410469 - DNA, 23 bp, Homo sapiens
tcccacccccacccccagctcaa

SEQ ID NO: 6410470 - DNA, 22 bp, Homo sapiens
tcccacccccacttcatgccca

SEQ ID NO: 6410471 - DNA, 12 bp, Homo sapiens
tcccacccccag

SEQ ID NO: 6410472 - DNA, 20 bp, Homo sapiens
tcccacccccagcagctcac

SEQ ID NO: 6410473 - DNA, 15 bp, Homo sapiens
tcccacccccagccc

SEQ ID NO: 6410474 - DNA, 23 bp, Homo sapiens
tcccacccccagccccgactcca

SEQ ID NO: 6410475 - DNA, 14 bp, Homo sapiens
tcccacccccaggc

SEQ ID NO: 6410476 - DNA, 12 bp, Homo sapiens
tcccaccccctc

SEQ ID NO: 6410477 - DNA, 14 bp, Homo sapiens
tcccaccccctccc

SEQ ID NO: 6410478 - DNA, 20 bp, Homo sapiens
tcccaccccctccccgggca

SEQ ID NO: 6410479 - DNA, 21 bp, Homo sapiens
tcccaccccctccccgggcag

SEQ ID NO: 6410480 - DNA, 23 bp, Homo sapiens
tcccaccccctccccgggcagca

SEQ ID NO: 6410481 - DNA, 18 bp, Homo sapiens
tcccaccccggcctccac

SEQ ID NO: 6410482 - DNA, 18 bp, Homo sapiens
tcccacccctacacacac

SEQ ID NO: 6410483 - DNA, 21 bp, Homo sapiens
tcccacccctacacacacact

SEQ ID NO: 6410484 - DNA, 15 bp, Homo sapiens
tcccacccctagcca

SEQ ID NO: 6410485 - DNA, 16 bp, Homo sapiens
tcccacccctagccac

SEQ ID NO: 6410486 - DNA, 19 bp, Homo sapiens
tcccacccctagccaccag

SEQ ID NO: 6410487 - DNA, 24 bp, Homo sapiens
tcccacccctagccaccagtgtcc

SEQ ID NO: 6410488 - DNA, 14 bp, Homo sapiens
tcccacccctccat

SEQ ID NO: 6410489 - DNA, 13 bp, Homo sapiens
tcccacccctccc

SEQ ID NO: 6410490 - DNA, 23 bp, Homo sapiens
tcccaccccttcataccgcctcg

SEQ ID NO: 6410491 - DNA, 13 bp, Homo sapiens
tcccaccccttgg

SEQ ID NO: 6410492 - DNA, 16 bp, Homo sapiens
tcccacccgatgctgc

SEQ ID NO: 6410493 - DNA, 17 bp, Homo sapiens
tcccacccgatgctgct

SEQ ID NO: 6410494 - DNA, 18 bp, Homo sapiens
tcccacccggacaggtgg

SEQ ID NO: 6410495 - DNA, 19 bp, Homo sapiens
tcccacccggacaggtggg

SEQ ID NO: 6410496 - DNA, 21 bp, Homo sapiens
tcccacccggacaggtggggc

SEQ ID NO: 6410497 - DNA, 19 bp, Homo sapiens
tcccacccggccacagctg

SEQ ID NO: 6410498 - DNA, 20 bp, Homo sapiens
tcccacccggccacagctgc

SEQ ID NO: 6410499 - DNA, 21 bp, Homo sapiens
tcccacccggccacagctgct

SEQ ID NO: 6410500 - DNA, 14 bp, Homo sapiens
tcccacccgtggtg

SEQ ID NO: 6410501 - DNA, 18 bp, Homo sapiens
tcccaccctacccccttt

SEQ ID NO: 6410502 - DNA, 12 bp, Homo sapiens
tcccaccctccc

SEQ ID NO: 6410503 - DNA, 14 bp, Homo sapiens
tcccaccctcccta

SEQ ID NO: 6410504 - DNA, 14 bp, Homo sapiens
tcccaccctcctgc

SEQ ID NO: 6410505 - DNA, 20 bp, Homo sapiens
tcccaccctcttcccatgtc

SEQ ID NO: 6410506 - DNA, 15 bp, Homo sapiens
tcccaccctcttcct

SEQ ID NO: 6410507 - DNA, 12 bp, Homo sapiens
tcccaccctgta

SEQ ID NO: 6410508 - DNA, 13 bp, Homo sapiens
tcccaccctgttc

SEQ ID NO: 6410509 - DNA, 17 bp, Homo sapiens
tcccaccctttctgcca

SEQ ID NO: 6410510 - DNA, 20 bp, Homo sapiens
tcccaccctttctgccaggg

SEQ ID NO: 6410511 - DNA, 18 bp, Homo sapiens
tcccaccgcagcgtcccc

SEQ ID NO: 6410512 - DNA, 14 bp, Homo sapiens
tcccaccgccccca

SEQ ID NO: 6410513 - DNA, 15 bp, Homo sapiens
tcccaccgcccccac

SEQ ID NO: 6410514 - DNA, 17 bp, Homo sapiens
tcccaccgcccccaccc

SEQ ID NO: 6410515 - DNA, 19 bp, Homo sapiens
tcccaccgcccccacccct

SEQ ID NO: 6410516 - DNA, 15 bp, Homo sapiens
tcccaccgctgcctc

SEQ ID NO: 6410517 - DNA, 20 bp, Homo sapiens
tcccaccggttgcttctggg

SEQ ID NO: 6410518 - DNA, 14 bp, Homo sapiens
tcccacctagccca

SEQ ID NO: 6410519 - DNA, 17 bp, Homo sapiens
tcccacctagtgcccca

SEQ ID NO: 6410520 - DNA, 21 bp, Homo sapiens
tcccacctagtgccccagact

SEQ ID NO: 6410521 - DNA, 22 bp, Homo sapiens
tcccacctcaaatgggtctggg

SEQ ID NO: 6410522 - DNA, 12 bp, Homo sapiens
tcccacctccag

SEQ ID NO: 6410523 - DNA, 13 bp, Homo sapiens
tcccacctccagc

SEQ ID NO: 6410524 - DNA, 17 bp, Homo sapiens
tcccacctccagcccac

SEQ ID NO: 6410525 - DNA, 17 bp, Homo sapiens
tcccacctccagcccgg

SEQ ID NO: 6410526 - DNA, 15 bp, Homo sapiens
tcccacctccatccc

SEQ ID NO: 6410527 - DNA, 16 bp, Homo sapiens
tcccacctccctgccc

SEQ ID NO: 6410528 - DNA, 13 bp, Homo sapiens
tcccacctccctt

SEQ ID NO: 6410529 - DNA, 16 bp, Homo sapiens
tcccacctccttcctc

SEQ ID NO: 6410530 - DNA, 19 bp, Homo sapiens
tcccacctccttcctccta

SEQ ID NO: 6410531 - DNA, 23 bp, Homo sapiens
tcccacctccttcctcctaccac

SEQ ID NO: 6410532 - DNA, 20 bp, Homo sapiens
tcccacctctccttttgagg

SEQ ID NO: 6410533 - DNA, 18 bp, Homo sapiens
tcccacctctctcactcc

SEQ ID NO: 6410534 - DNA, 18 bp, Homo sapiens
tcccacctctctccccaa

SEQ ID NO: 6410535 - DNA, 13 bp, Homo sapiens
tcccacctctgtg

SEQ ID NO: 6410536 - DNA, 22 bp, Homo sapiens
tcccacctcttctcttcctgta

SEQ ID NO: 6410537 - DNA, 12 bp, Homo sapiens
tcccacctcttt

SEQ ID NO: 6410538 - DNA, 18 bp, Homo sapiens
tcccacctgaatttgtat

SEQ ID NO: 6410539 - DNA, 19 bp, Homo sapiens
tcccacctgacacaccagg

SEQ ID NO: 6410540 - DNA, 23 bp, Homo sapiens
tcccacctgacacaccaggcgct

SEQ ID NO: 6410541 - DNA, 12 bp, Homo sapiens
tcccacctggct

SEQ ID NO: 6410542 - DNA, 14 bp, Homo sapiens
tcccacctggctct

SEQ ID NO: 6410543 - DNA, 13 bp, Homo sapiens
tcccaccttgacc

SEQ ID NO: 6410544 - DNA, 17 bp, Homo sapiens
tcccaccttggcctccc

SEQ ID NO: 6410545 - DNA, 13 bp, Homo sapiens
tcccaccttggct

SEQ ID NO: 6410546 - DNA, 18 bp, Homo sapiens
tcccaccttggctgcagg

SEQ ID NO: 6410547 - DNA, 16 bp, Homo sapiens
tcccaccttgtcgctg

SEQ ID NO: 6410548 - DNA, 20 bp, Homo sapiens
tcccacctttcgggccatgt

SEQ ID NO: 6410549 - DNA, 18 bp, Homo sapiens
tcccacgaatttgctggg

SEQ ID NO: 6410550 - DNA, 19 bp, Homo sapiens
tcccacgacataagctggt

SEQ ID NO: 6410551 - DNA, 20 bp, Homo sapiens
tcccacgcactccatgagca

SEQ ID NO: 6410552 - DNA, 14 bp, Homo sapiens
tcccacgccaggcc

SEQ ID NO: 6410553 - DNA, 18 bp, Homo sapiens
tcccacgccaggccagca

SEQ ID NO: 6410554 - DNA, 23 bp, Homo sapiens
tcccacgctgggacacagaccgg

SEQ ID NO: 6410555 - DNA, 18 bp, Homo sapiens
tcccacggccactgcagt

SEQ ID NO: 6410556 - DNA, 19 bp, Homo sapiens
tcccacggctctgtgcccg

SEQ ID NO: 6410557 - DNA, 19 bp, Homo sapiens
tcccacggggaccactggg

SEQ ID NO: 6410558 - DNA, 21 bp, Homo sapiens
tcccacggggaccactgggcc

SEQ ID NO: 6410559 - DNA, 18 bp, Homo sapiens
tcccacgtctaactggaa

SEQ ID NO: 6410560 - DNA, 19 bp, Homo sapiens
tcccacgtctggccaggca

SEQ ID NO: 6410561 - DNA, 21 bp, Homo sapiens
tcccacgtcttcttgctgcag

SEQ ID NO: 6410562 - DNA, 23 bp, Homo sapiens
tcccacgtcttcttgctgcagcc

SEQ ID NO: 6410563 - DNA, 13 bp, Homo sapiens
tcccacgtgcaca

SEQ ID NO: 6410564 - DNA, 18 bp, Homo sapiens
tcccacgtgtcttccact

SEQ ID NO: 6410565 - DNA, 22 bp, Homo sapiens
tcccacgttctgttaatttagt

SEQ ID NO: 6410566 - DNA, 16 bp, Homo sapiens
tcccactacatctggg

SEQ ID NO: 6410567 - DNA, 20 bp, Homo sapiens
tcccactatgcctgatgtga

SEQ ID NO: 6410568 - DNA, 16 bp, Homo sapiens
tcccactatggtggga

SEQ ID NO: 6410569 - DNA, 19 bp, Homo sapiens
tcccactatttattactga

SEQ ID NO: 6410570 - DNA, 18 bp, Homo sapiens
tcccactcaagccaagca

SEQ ID NO: 6410571 - DNA, 14 bp, Homo sapiens
tcccactcaccagc

SEQ ID NO: 6410572 - DNA, 15 bp, Homo sapiens
tcccactcaccccgg

SEQ ID NO: 6410573 - DNA, 22 bp, Homo sapiens
tcccactcagaactctccaggg

SEQ ID NO: 6410574 - DNA, 16 bp, Homo sapiens
tcccactcagcagtga

SEQ ID NO: 6410575 - DNA, 13 bp, Homo sapiens
tcccactcccatg

SEQ ID NO: 6410576 - DNA, 15 bp, Homo sapiens
tcccactcccatggc

SEQ ID NO: 6410577 - DNA, 16 bp, Homo sapiens
tcccactcccatggct

SEQ ID NO: 6410578 - DNA, 23 bp, Homo sapiens
tcccactcccggcctaggcacct

SEQ ID NO: 6410579 - DNA, 13 bp, Homo sapiens
tcccactcctaat

SEQ ID NO: 6410580 - DNA, 23 bp, Homo sapiens
tcccactcctaatcaagagtctc

SEQ ID NO: 6410581 - DNA, 14 bp, Homo sapiens
tcccactcctagga

SEQ ID NO: 6410582 - DNA, 13 bp, Homo sapiens
tcccactcctgct

SEQ ID NO: 6410583 - DNA, 14 bp, Homo sapiens
tcccactcctgctg

SEQ ID NO: 6410584 - DNA, 16 bp, Homo sapiens
tcccactcctgctgca

SEQ ID NO: 6410585 - DNA, 22 bp, Homo sapiens
tcccactcctgctgcacaggcc

SEQ ID NO: 6410586 - DNA, 22 bp, Homo sapiens
tcccactctgggcaaagcccct

SEQ ID NO: 6410587 - DNA, 14 bp, Homo sapiens
tcccactctttgaa

SEQ ID NO: 6410588 - DNA, 14 bp, Homo sapiens
tcccactgaaggat

SEQ ID NO: 6410589 - DNA, 22 bp, Homo sapiens
tcccactgaaggattaatgaaa

SEQ ID NO: 6410590 - DNA, 21 bp, Homo sapiens
tcccactgatatcacgggccc

SEQ ID NO: 6410591 - DNA, 16 bp, Homo sapiens
tcccactgcaccccct

SEQ ID NO: 6410592 - DNA, 18 bp, Homo sapiens
tcccactgcactccagcc

SEQ ID NO: 6410593 - DNA, 16 bp, Homo sapiens
tcccactgcctcaggt

SEQ ID NO: 6410594 - DNA, 18 bp, Homo sapiens
tcccactgcctcaggttc

SEQ ID NO: 6410595 - DNA, 23 bp, Homo sapiens
tcccactggctcctcccagcaca

SEQ ID NO: 6410596 - DNA, 21 bp, Homo sapiens
tcccactgggactcccagcag

SEQ ID NO: 6410597 - DNA, 23 bp, Homo sapiens
tcccactgggactcccagcagag

SEQ ID NO: 6410598 - DNA, 12 bp, Homo sapiens
tcccactgtcct

SEQ ID NO: 6410599 - DNA, 13 bp, Homo sapiens
tcccactgtcctt

SEQ ID NO: 6410600 - DNA, 17 bp, Homo sapiens
tcccactgtcctttctc

SEQ ID NO: 6410601 - DNA, 20 bp, Homo sapiens
tcccactgtcctttctccag

SEQ ID NO: 6410602 - DNA, 16 bp, Homo sapiens
tcccacttagccgcac

SEQ ID NO: 6410603 - DNA, 15 bp, Homo sapiens
tcccacttcacagct

SEQ ID NO: 6410604 - DNA, 21 bp, Homo sapiens
tcccacttcctcctacctggg

SEQ ID NO: 6410605 - DNA, 17 bp, Homo sapiens
tcccacttggaggcctt

SEQ ID NO: 6410606 - DNA, 12 bp, Homo sapiens
tcccacttgtca

SEQ ID NO: 6410607 - DNA, 15 bp, Homo sapiens
tcccactttctgttc

SEQ ID NO: 6410608 - DNA, 17 bp, Homo sapiens
tcccactttctgttcct

SEQ ID NO: 6410609 - DNA, 16 bp, Homo sapiens
tcccacttttgccaga

SEQ ID NO: 6410610 - DNA, 19 bp, Homo sapiens
tcccagaaaaactggctct

SEQ ID NO: 6410611 - DNA, 22 bp, Homo sapiens
tcccagaaaaccagtctgtgtt

SEQ ID NO: 6410612 - DNA, 22 bp, Homo sapiens
tcccagaaacatctctggccca

SEQ ID NO: 6410613 - DNA, 19 bp, Homo sapiens
tcccagaacacactccatc

SEQ ID NO: 6410614 - DNA, 20 bp, Homo sapiens
tcccagaacacactccatca

SEQ ID NO: 6410615 - DNA, 18 bp, Homo sapiens
tcccagaaccacactgtt

SEQ ID NO: 6410616 - DNA, 14 bp, Homo sapiens
tcccagaacctcta

SEQ ID NO: 6410617 - DNA, 21 bp, Homo sapiens
tcccagaacctctaagtgctg

SEQ ID NO: 6410618 - DNA, 23 bp, Homo sapiens
tcccagaacctctaagtgctgct

SEQ ID NO: 6410619 - DNA, 20 bp, Homo sapiens
tcccagaactattctggggg

SEQ ID NO: 6410620 - DNA, 13 bp, Homo sapiens
tcccagaagatga

SEQ ID NO: 6410621 - DNA, 19 bp, Homo sapiens
tcccagaaggctgggtcca

SEQ ID NO: 6410622 - DNA, 13 bp, Homo sapiens
tcccagaagggag

SEQ ID NO: 6410623 - DNA, 14 bp, Homo sapiens
tcccagaagggagt

SEQ ID NO: 6410624 - DNA, 21 bp, Homo sapiens
tcccagaagtccacaggacgc

SEQ ID NO: 6410625 - DNA, 18 bp, Homo sapiens
tcccagaatcaaagcaat

SEQ ID NO: 6410626 - DNA, 19 bp, Homo sapiens
tcccagaatcccagccggc

SEQ ID NO: 6410627 - DNA, 15 bp, Homo sapiens
tcccagaatgctggg

SEQ ID NO: 6410628 - DNA, 19 bp, Homo sapiens
tcccagaattgtatctcat

SEQ ID NO: 6410629 - DNA, 14 bp, Homo sapiens
tcccagacagctgg

SEQ ID NO: 6410630 - DNA, 15 bp, Homo sapiens
tcccagacagctgga

SEQ ID NO: 6410631 - DNA, 17 bp, Homo sapiens
tcccagacaggccctcc

SEQ ID NO: 6410632 - DNA, 15 bp, Homo sapiens
tcccagaccacctcc

SEQ ID NO: 6410633 - DNA, 17 bp, Homo sapiens
tcccagacccagggcag

SEQ ID NO: 6410634 - DNA, 19 bp, Homo sapiens
tcccagacccagggcagtg

SEQ ID NO: 6410635 - DNA, 14 bp, Homo sapiens
tcccagacccattc

SEQ ID NO: 6410636 - DNA, 16 bp, Homo sapiens
tcccagacccccttgc

SEQ ID NO: 6410637 - DNA, 17 bp, Homo sapiens
tcccagaccccgacacc

SEQ ID NO: 6410638 - DNA, 22 bp, Homo sapiens
tcccagacctgcctcttccccc

SEQ ID NO: 6410639 - DNA, 23 bp, Homo sapiens
tcccagactaaaggatccagaga

SEQ ID NO: 6410640 - DNA, 20 bp, Homo sapiens
tcccagactactattttctt

SEQ ID NO: 6410641 - DNA, 19 bp, Homo sapiens
tcccagacttgtttcctgt

SEQ ID NO: 6410642 - DNA, 23 bp, Homo sapiens
tcccagagaacaatcactattct

SEQ ID NO: 6410643 - DNA, 24 bp, Homo sapiens
tcccagagaacaatcactattctt

SEQ ID NO: 6410644 - DNA, 18 bp, Homo sapiens
tcccagagaagctcattt

SEQ ID NO: 6410645 - DNA, 20 bp, Homo sapiens
tcccagagacaggaaaatcc

SEQ ID NO: 6410646 - DNA, 14 bp, Homo sapiens
tcccagagaccctg

SEQ ID NO: 6410647 - DNA, 15 bp, Homo sapiens
tcccagagacctcat

SEQ ID NO: 6410648 - DNA, 16 bp, Homo sapiens
tcccagagaccttctg

SEQ ID NO: 6410649 - DNA, 9 bp, Homo sapiens
tcccagagc

SEQ ID NO: 6410650 - DNA, 23 bp, Homo sapiens
tcccagagcacaagaaggccagc

SEQ ID NO: 6410651 - DNA, 13 bp, Homo sapiens
tcccagagcacct

SEQ ID NO: 6410652 - DNA, 11 bp, Homo sapiens
tcccagagcag

SEQ ID NO: 6410653 - DNA, 21 bp, Homo sapiens
tcccagagcaggaggcccctg

SEQ ID NO: 6410654 - DNA, 14 bp, Homo sapiens
tcccagagcccgct

SEQ ID NO: 6410655 - DNA, 23 bp, Homo sapiens
tcccagagccctggaccttgggc

SEQ ID NO: 6410656 - DNA, 20 bp, Homo sapiens
tcccagagctccctctgccc

SEQ ID NO: 6410657 - DNA, 18 bp, Homo sapiens
tcccagagctgcacaggg

SEQ ID NO: 6410658 - DNA, 19 bp, Homo sapiens
tcccagagctggtggaccc

SEQ ID NO: 6410659 - DNA, 16 bp, Homo sapiens
tcccagaggagcagct

SEQ ID NO: 6410660 - DNA, 21 bp, Homo sapiens
tcccagaggagccaccagttc

SEQ ID NO: 6410661 - DNA, 11 bp, Homo sapiens
tcccagaggcc

SEQ ID NO: 6410662 - DNA, 12 bp, Homo sapiens
tcccagaggccg

SEQ ID NO: 6410663 - DNA, 20 bp, Homo sapiens
tcccagaggccgctgcccct

SEQ ID NO: 6410664 - DNA, 21 bp, Homo sapiens
tcccagaggccgctgcccctg

SEQ ID NO: 6410665 - DNA, 23 bp, Homo sapiens
tcccagaggccgctgcccctgag

SEQ ID NO: 6410666 - DNA, 16 bp, Homo sapiens
tcccagaggctcctgg

SEQ ID NO: 6410667 - DNA, 17 bp, Homo sapiens
tcccagaggctcctgga

SEQ ID NO: 6410668 - DNA, 20 bp, Homo sapiens
tcccagaggctcctggagcc

SEQ ID NO: 6410669 - DNA, 16 bp, Homo sapiens
tcccagaggctgcccc

SEQ ID NO: 6410670 - DNA, 17 bp, Homo sapiens
tcccagaggctgcccca

SEQ ID NO: 6410671 - DNA, 12 bp, Homo sapiens
tcccagagggag

SEQ ID NO: 6410672 - DNA, 13 bp, Homo sapiens
tcccagagggagc

SEQ ID NO: 6410673 - DNA, 17 bp, Homo sapiens
tcccagagggagcaggc

SEQ ID NO: 6410674 - DNA, 16 bp, Homo sapiens
tcccagaggggcctgc

SEQ ID NO: 6410675 - DNA, 21 bp, Homo sapiens
tcccagagggtttccatgggg

SEQ ID NO: 6410676 - DNA, 13 bp, Homo sapiens
tcccagaggtcca

SEQ ID NO: 6410677 - DNA, 17 bp, Homo sapiens
tcccagaggtccagccc

SEQ ID NO: 6410678 - DNA, 21 bp, Homo sapiens
tcccagaggtgggatcctccc

SEQ ID NO: 6410679 - DNA, 23 bp, Homo sapiens
tcccagaggttatctgcctggcc

SEQ ID NO: 6410680 - DNA, 14 bp, Homo sapiens
tcccagagtcagag

SEQ ID NO: 6410681 - DNA, 21 bp, Homo sapiens
tcccagagtcagaggagaaga

SEQ ID NO: 6410682 - DNA, 18 bp, Homo sapiens
tcccagatagtcccagca

SEQ ID NO: 6410683 - DNA, 22 bp, Homo sapiens
tcccagatcaagcctgcctcaa

SEQ ID NO: 6410684 - DNA, 11 bp, Homo sapiens
tcccagatcca

SEQ ID NO: 6410685 - DNA, 20 bp, Homo sapiens
tcccagatccaggaacacat

SEQ ID NO: 6410686 - DNA, 23 bp, Homo sapiens
tcccagatccaggaacacatgca

SEQ ID NO: 6410687 - DNA, 20 bp, Homo sapiens
tcccagatcgctcccttggc

SEQ ID NO: 6410688 - DNA, 21 bp, Homo sapiens
tcccagatcgctcccttggct

SEQ ID NO: 6410689 - DNA, 19 bp, Homo sapiens
tcccagattggctcacact

SEQ ID NO: 6410690 - DNA, 21 bp, Homo sapiens
tcccagattggctcacactga

SEQ ID NO: 6410691 - DNA, 20 bp, Homo sapiens
tcccagatttcagtcttttc

SEQ ID NO: 6410692 - DNA, 22 bp, Homo sapiens
tcccagcaatcgcatcccggct

SEQ ID NO: 6410693 - DNA, 23 bp, Homo sapiens
tcccagcacatgaaaccttattt

SEQ ID NO: 6410694 - DNA, 19 bp, Homo sapiens
tcccagcacctattgaatt

SEQ ID NO: 6410695 - DNA, 15 bp, Homo sapiens
tcccagcacctgcct

SEQ ID NO: 6410696 - DNA, 22 bp, Homo sapiens
tcccagcactatgctttccttc

SEQ ID NO: 6410697 - DNA, 17 bp, Homo sapiens
tcccagcactccccttg

SEQ ID NO: 6410698 - DNA, 19 bp, Homo sapiens
tcccagcactccccttgcc

SEQ ID NO: 6410699 - DNA, 15 bp, Homo sapiens
tcccagcactgcctc

SEQ ID NO: 6410700 - DNA, 23 bp, Homo sapiens
tcccagcactttgagaggctgag

SEQ ID NO: 6410701 - DNA, 20 bp, Homo sapiens
tcccagcactttgggaagct

SEQ ID NO: 6410702 - DNA, 21 bp, Homo sapiens
tcccagcactttgggaagctg

SEQ ID NO: 6410703 - DNA, 22 bp, Homo sapiens
tcccagcactttgggaggcagg

SEQ ID NO: 6410704 - DNA, 21 bp, Homo sapiens
tcccagcactttgggaggcca

SEQ ID NO: 6410705 - DNA, 23 bp, Homo sapiens
tcccagcactttgggaggccaag

SEQ ID NO: 6410706 - DNA, 22 bp, Homo sapiens
tcccagcacttttggaggccaa

SEQ ID NO: 6410707 - DNA, 20 bp, Homo sapiens
tcccagcagaagagggaggc

SEQ ID NO: 6410708 - DNA, 14 bp, Homo sapiens
aacgaaacatttag

SEQ ID NO: 6410709 - DNA, 15 bp, Homo sapiens
aacgaaactgctcta

SEQ ID NO: 6410710 - DNA, 14 bp, Homo sapiens
aacgaaagaaggca

SEQ ID NO: 6410711 - DNA, 16 bp, Homo sapiens
aacgaacccactgtgc

SEQ ID NO: 6410712 - DNA, 21 bp, Homo sapiens
aacgaaccttggcctgggccg

SEQ ID NO: 6410713 - DNA, 19 bp, Homo sapiens
aacgaagtctttttcattt

SEQ ID NO: 6410714 - DNA, 14 bp, Homo sapiens
aacgaataaagata

SEQ ID NO: 6410715 - DNA, 19 bp, Homo sapiens
aacgaatggtctttgctcc

SEQ ID NO: 6410716 - DNA, 18 bp, Homo sapiens
aacgaatttaaaatgtag

SEQ ID NO: 6410717 - DNA, 18 bp, Homo sapiens
aacgaccgacgcccctcc

SEQ ID NO: 6410718 - DNA, 20 bp, Homo sapiens
aacgaccttacaaatgagga

SEQ ID NO: 6410719 - DNA, 13 bp, Homo sapiens
aacgacttttgtt

SEQ ID NO: 6410720 - DNA, 13 bp, Homo sapiens
aacgagaagtgct

SEQ ID NO: 6410721 - DNA, 15 bp, Homo sapiens
aacgagaagtgcttt

SEQ ID NO: 6410722 - DNA, 12 bp, Homo sapiens
aacgagacacat

SEQ ID NO: 6410723 - DNA, 20 bp, Homo sapiens
aacgagatttgccaaaaact

SEQ ID NO: 6410724 - DNA, 15 bp, Homo sapiens
aacgagcagcccagg

SEQ ID NO: 6410725 - DNA, 21 bp, Homo sapiens
aacgagccttttcacccttct

SEQ ID NO: 6410726 - DNA, 16 bp, Homo sapiens
aacgagtcaatcccct

SEQ ID NO: 6410727 - DNA, 11 bp, Homo sapiens
aacgatatatg

SEQ ID NO: 6410728 - DNA, 22 bp, Homo sapiens
aacgatcacaaatgactttatt

SEQ ID NO: 6410729 - DNA, 17 bp, Homo sapiens
aacgatcagacagatct

SEQ ID NO: 6410730 - DNA, 17 bp, Homo sapiens
aacgatcatatctgtat

SEQ ID NO: 6410731 - DNA, 14 bp, Homo sapiens
aacgattaagtcca

SEQ ID NO: 6410732 - DNA, 17 bp, Homo sapiens
aacgattaagtccaaat

SEQ ID NO: 6410733 - DNA, 14 bp, Homo sapiens
aacgattatagtaa

SEQ ID NO: 6410734 - DNA, 12 bp, Homo sapiens
aacgattcacag

SEQ ID NO: 6410735 - DNA, 13 bp, Homo sapiens
aacgattcacagc

SEQ ID NO: 6410736 - DNA, 18 bp, Homo sapiens
aacgatttaattctcttg

SEQ ID NO: 6410737 - DNA, 13 bp, Homo sapiens
aacgatttagaaa

SEQ ID NO: 6410738 - DNA, 18 bp, Homo sapiens
aacgcaaaaatagctctt

SEQ ID NO: 6410739 - DNA, 18 bp, Homo sapiens
aacgcaaacctctccttc

SEQ ID NO: 6410740 - DNA, 18 bp, Homo sapiens
aacgcaaagggctgaaag

SEQ ID NO: 6410741 - DNA, 13 bp, Homo sapiens
aacgcaattttac

SEQ ID NO: 6410742 - DNA, 16 bp, Homo sapiens
aacgcacaacatgcac

SEQ ID NO: 6410743 - DNA, 12 bp, Homo sapiens
aacgcacaggaa

SEQ ID NO: 6410744 - DNA, 12 bp, Homo sapiens
aacgcaccccac

SEQ ID NO: 6410745 - DNA, 12 bp, Homo sapiens
aacgcacttaca

SEQ ID NO: 6410746 - DNA, 19 bp, Homo sapiens
aacgcactttataaaagca

SEQ ID NO: 6410747 - DNA, 14 bp, Homo sapiens
aacgcagaagaaag

SEQ ID NO: 6410748 - DNA, 16 bp, Homo sapiens
aacgcagaagaggggg

SEQ ID NO: 6410749 - DNA, 15 bp, Homo sapiens
aacgcagacactgag

SEQ ID NO: 6410750 - DNA, 20 bp, Homo sapiens
aacgcaggaggagaaaagaa

SEQ ID NO: 6410751 - DNA, 20 bp, Homo sapiens
aacgcagttgtgtggcccag

SEQ ID NO: 6410752 - DNA, 18 bp, Homo sapiens
aacgcatggagtgtgtat

SEQ ID NO: 6410753 - DNA, 23 bp, Homo sapiens
aacgcatggagtgtgtattgttc

SEQ ID NO: 6410754 - DNA, 17 bp, Homo sapiens
aacgcattaagaggttt

SEQ ID NO: 6410755 - DNA, 13 bp, Homo sapiens
aacgcattgccac

SEQ ID NO: 6410756 - DNA, 15 bp, Homo sapiens
aacgcattgccacgg

SEQ ID NO: 6410757 - DNA, 17 bp, Homo sapiens
aacgccagtctcccagg

SEQ ID NO: 6410758 - DNA, 11 bp, Homo sapiens
aacgcccctcc

SEQ ID NO: 6410759 - DNA, 22 bp, Homo sapiens
aacgcccctccaaacctccagc

SEQ ID NO: 6410760 - DNA, 12 bp, Homo sapiens
aacgcccctgtg

SEQ ID NO: 6410761 - DNA, 13 bp, Homo sapiens
aacgcccctgtgg

SEQ ID NO: 6410762 - DNA, 15 bp, Homo sapiens
aacgcccctgtggcc

SEQ ID NO: 6410763 - DNA, 13 bp, Homo sapiens
aacgccctcaaga

SEQ ID NO: 6410764 - DNA, 17 bp, Homo sapiens
aacgccctcaagaacat

SEQ ID NO: 6410765 - DNA, 17 bp, Homo sapiens
aacgcctcccctgcccc

SEQ ID NO: 6410766 - DNA, 11 bp, Homo sapiens
aacgcctgagc

SEQ ID NO: 6410767 - DNA, 18 bp, Homo sapiens
aacgcctgagcccaggga

SEQ ID NO: 6410768 - DNA, 14 bp, Homo sapiens
aacgcgaaaccaat

SEQ ID NO: 6410769 - DNA, 19 bp, Homo sapiens
aacgcgacttccacaaacc

SEQ ID NO: 6410770 - DNA, 17 bp, Homo sapiens
aacgcgtctgcctgggc

SEQ ID NO: 6410771 - DNA, 16 bp, Homo sapiens
aacgcgtgtgtgcctg

SEQ ID NO: 6410772 - DNA, 17 bp, Homo sapiens
aacgcgttgaaattgta

SEQ ID NO: 6410773 - DNA, 15 bp, Homo sapiens
aacgctacctctctg

SEQ ID NO: 6410774 - DNA, 21 bp, Homo sapiens
aacgctagaagcctaagaact

SEQ ID NO: 6410775 - DNA, 20 bp, Homo sapiens
aacgctctaggtacgatgac

SEQ ID NO: 6410776 - DNA, 23 bp, Homo sapiens
aacgctgaagcggtcagactgga

SEQ ID NO: 6410777 - DNA, 16 bp, Homo sapiens
aacgctgacttgcaga

SEQ ID NO: 6410778 - DNA, 22 bp, Homo sapiens
aacgctgattcctaaggcccag

SEQ ID NO: 6410779 - DNA, 18 bp, Homo sapiens
aacgctgctccatgcaca

SEQ ID NO: 6410780 - DNA, 15 bp, Homo sapiens
aacgctgtgatgctg

SEQ ID NO: 6410781 - DNA, 18 bp, Homo sapiens
aacgctgtgatgctgtgt

SEQ ID NO: 6410782 - DNA, 20 bp, Homo sapiens
aacgctgtgatgctgtgtgc

SEQ ID NO: 6410783 - DNA, 23 bp, Homo sapiens
aacgcttgtagaactcactctgg

SEQ ID NO: 6410784 - DNA, 12 bp, Homo sapiens
aacgctttcccc

SEQ ID NO: 6410785 - DNA, 14 bp, Homo sapiens
aacggaactcttca

SEQ ID NO: 6410786 - DNA, 19 bp, Homo sapiens
aacggaagctgacataatg

SEQ ID NO: 6410787 - DNA, 23 bp, Homo sapiens
aacggaagggttggtgggctggc

SEQ ID NO: 6410788 - DNA, 15 bp, Homo sapiens
aacggactcagtgga

SEQ ID NO: 6410789 - DNA, 19 bp, Homo sapiens
aacggactcagtggacact

SEQ ID NO: 6410790 - DNA, 16 bp, Homo sapiens
aacggaggcagatgga

SEQ ID NO: 6410791 - DNA, 13 bp, Homo sapiens
aacggatcagaaa

SEQ ID NO: 6410792 - DNA, 17 bp, Homo sapiens
aacggatcagaaataca

SEQ ID NO: 6410793 - DNA, 14 bp, Homo sapiens
aacggatgatttct

SEQ ID NO: 6410794 - DNA, 15 bp, Homo sapiens
aacggatgatttcta

SEQ ID NO: 6410795 - DNA, 17 bp, Homo sapiens
aacggattattttttca

SEQ ID NO: 6410796 - DNA, 19 bp, Homo sapiens
aacggattattttttcaga

SEQ ID NO: 6410797 - DNA, 21 bp, Homo sapiens
aacggattattttttcagacc

SEQ ID NO: 6410798 - DNA, 14 bp, Homo sapiens
aacggcaacagcat

SEQ ID NO: 6410799 - DNA, 18 bp, Homo sapiens
aacggcaacgtagcctgg

SEQ ID NO: 6410800 - DNA, 15 bp, Homo sapiens
aacggcccaggccag

SEQ ID NO: 6410801 - DNA, 14 bp, Homo sapiens
aacggccccagctt

SEQ ID NO: 6410802 - DNA, 22 bp, Homo sapiens
aacggcttgctttcctgcatct

SEQ ID NO: 6410803 - DNA, 19 bp, Homo sapiens
aacgggaaagaatataaag

SEQ ID NO: 6410804 - DNA, 16 bp, Homo sapiens
aacgggaacatgcccc

SEQ ID NO: 6410805 - DNA, 19 bp, Homo sapiens
aacgggaacatgccccctg

SEQ ID NO: 6410806 - DNA, 15 bp, Homo sapiens
aacgggcagccacag

SEQ ID NO: 6410807 - DNA, 17 bp, Homo sapiens
aacgggcagccacagga

SEQ ID NO: 6410808 - DNA, 16 bp, Homo sapiens
aacgggcccatggcct

SEQ ID NO: 6410809 - DNA, 13 bp, Homo sapiens
aacgggctccttc

SEQ ID NO: 6410810 - DNA, 12 bp, Homo sapiens
aacggggagaaa

SEQ ID NO: 6410811 - DNA, 20 bp, Homo sapiens
aacggggcagtactcctccc

SEQ ID NO: 6410812 - DNA, 20 bp, Homo sapiens
aacgggggccttctggtttt

SEQ ID NO: 6410813 - DNA, 21 bp, Homo sapiens
aacggggtggacgagggagtg

SEQ ID NO: 6410814 - DNA, 14 bp, Homo sapiens
aacggggtggggag

SEQ ID NO: 6410815 - DNA, 14 bp, Homo sapiens
aacgggtcagtatt

SEQ ID NO: 6410816 - DNA, 16 bp, Homo sapiens
aacgggttctcccatg

SEQ ID NO: 6410817 - DNA, 22 bp, Homo sapiens
aacggtacacagactattgaca

SEQ ID NO: 6410818 - DNA, 17 bp, Homo sapiens
aacggtatcctccctgc

SEQ ID NO: 6410819 - DNA, 16 bp, Homo sapiens
aacggtctggcagggc

SEQ ID NO: 6410820 - DNA, 20 bp, Homo sapiens
aacggtctttatgaattatt

SEQ ID NO: 6410821 - DNA, 15 bp, Homo sapiens
aacggtgcaacagaa

SEQ ID NO: 6410822 - DNA, 14 bp, Homo sapiens
aacggtgctaaaaa

SEQ ID NO: 6410823 - DNA, 13 bp, Homo sapiens
aacggtgctcagg

SEQ ID NO: 6410824 - DNA, 13 bp, Homo sapiens
aacggtgcttgtg

SEQ ID NO: 6410825 - DNA, 14 bp, Homo sapiens
aacggtgcttgtgt

SEQ ID NO: 6410826 - DNA, 14 bp, Homo sapiens
aacggttcagtttc

SEQ ID NO: 6410827 - DNA, 15 bp, Homo sapiens
aacggttcctggtga

SEQ ID NO: 6410828 - DNA, 19 bp, Homo sapiens
aacggtttaattctgtctt

SEQ ID NO: 6410829 - DNA, 23 bp, Homo sapiens
aacggtttttttctttggctgca

SEQ ID NO: 6410830 - DNA, 17 bp, Homo sapiens
aacgtaaccacggaaaa

SEQ ID NO: 6410831 - DNA, 18 bp, Homo sapiens
aacgtaatgattatatga

SEQ ID NO: 6410832 - DNA, 21 bp, Homo sapiens
aacgtacgggaatgtgctttc

SEQ ID NO: 6410833 - DNA, 19 bp, Homo sapiens
aacgtacttaactgtgtga

SEQ ID NO: 6410834 - DNA, 13 bp, Homo sapiens
aacgtagcctggg

SEQ ID NO: 6410835 - DNA, 18 bp, Homo sapiens
aacgtatcacctttccca

SEQ ID NO: 6410836 - DNA, 21 bp, Homo sapiens
aacgtatgcatgtgaagaaag

SEQ ID NO: 6410837 - DNA, 16 bp, Homo sapiens
aacgtatgtgctctta

SEQ ID NO: 6410838 - DNA, 16 bp, Homo sapiens
aacgtattagttgcca

SEQ ID NO: 6410839 - DNA, 23 bp, Homo sapiens
aacgtattagttgccaatatgcc

SEQ ID NO: 6410840 - DNA, 16 bp, Homo sapiens
aacgtatttagccatt

SEQ ID NO: 6410841 - DNA, 16 bp, Homo sapiens
aacgtatttctccaga

SEQ ID NO: 6410842 - DNA, 19 bp, Homo sapiens
aacgtatttctccagaccc

SEQ ID NO: 6410843 - DNA, 20 bp, Homo sapiens
aacgtatttctccagaccca

SEQ ID NO: 6410844 - DNA, 22 bp, Homo sapiens
aacgtatttctccagacccaga

SEQ ID NO: 6410845 - DNA, 16 bp, Homo sapiens
aacgtcacccaaaagc

SEQ ID NO: 6410846 - DNA, 18 bp, Homo sapiens
aacgtcacccaaaagcac

SEQ ID NO: 6410847 - DNA, 15 bp, Homo sapiens
aacgtcatctcaggg

SEQ ID NO: 6410848 - DNA, 12 bp, Homo sapiens
aacgtcattcag

SEQ ID NO: 6410849 - DNA, 13 bp, Homo sapiens
aacgtctcccaga

SEQ ID NO: 6410850 - DNA, 15 bp, Homo sapiens
aacgtgaactaagat

SEQ ID NO: 6410851 - DNA, 22 bp, Homo sapiens
aacgtgagagaaagagagaagc

SEQ ID NO: 6410852 - DNA, 14 bp, Homo sapiens
aacgtgataaatat

SEQ ID NO: 6410853 - DNA, 15 bp, Homo sapiens
aacgtgatacatttg

SEQ ID NO: 6410854 - DNA, 15 bp, Homo sapiens
aacgtgatgatcagc

SEQ ID NO: 6410855 - DNA, 15 bp, Homo sapiens
aacgtgatgtgccac

SEQ ID NO: 6410856 - DNA, 22 bp, Homo sapiens
aacgtgatgttttgaatgtgga

SEQ ID NO: 6410857 - DNA, 19 bp, Homo sapiens
aacgtgatttttaaattaa

SEQ ID NO: 6410858 - DNA, 14 bp, Homo sapiens
aacgtgcaaagcca

SEQ ID NO: 6410859 - DNA, 17 bp, Homo sapiens
aacgtgcagactatgca

SEQ ID NO: 6410860 - DNA, 16 bp, Homo sapiens
aacgtgcattgtgctt

SEQ ID NO: 6410861 - DNA, 17 bp, Homo sapiens
aacgtgctctttgtttt

SEQ ID NO: 6410862 - DNA, 12 bp, Homo sapiens
aacgtgctgact

SEQ ID NO: 6410863 - DNA, 18 bp, Homo sapiens
aacgtgcttctttgtaat

SEQ ID NO: 6410864 - DNA, 19 bp, Homo sapiens
aacgtggattttaaaaaat

SEQ ID NO: 6410865 - DNA, 15 bp, Homo sapiens
aacgtggctctgctg

SEQ ID NO: 6410866 - DNA, 16 bp, Homo sapiens
aacgtggctctgctgg

SEQ ID NO: 6410867 - DNA, 17 bp, Homo sapiens
aacgtggctctgctggc

SEQ ID NO: 6410868 - DNA, 16 bp, Homo sapiens
aacgtggctgcttcaa

SEQ ID NO: 6410869 - DNA, 23 bp, Homo sapiens
aacgtggctgcttcaaggatcct

SEQ ID NO: 6410870 - DNA, 18 bp, Homo sapiens
aacgtgggattcagagaa

SEQ ID NO: 6410871 - DNA, 18 bp, Homo sapiens
aacgtgggcttaaagcag

SEQ ID NO: 6410872 - DNA, 22 bp, Homo sapiens
aacgtggggcagcacagagagg

SEQ ID NO: 6410873 - DNA, 22 bp, Homo sapiens
aacgtgggtatttcctgctaca

SEQ ID NO: 6410874 - DNA, 17 bp, Homo sapiens
aacgtgggttcaatttg

SEQ ID NO: 6410875 - DNA, 13 bp, Homo sapiens
aacgtggtcacct

SEQ ID NO: 6410876 - DNA, 17 bp, Homo sapiens
aacgtgtatagtgccta

SEQ ID NO: 6410877 - DNA, 20 bp, Homo sapiens
aacgtgtatgtttttcagtt

SEQ ID NO: 6410878 - DNA, 17 bp, Homo sapiens
aacgtgtcacacttgtg

SEQ ID NO: 6410879 - DNA, 15 bp, Homo sapiens
aacgtgttaattata

SEQ ID NO: 6410880 - DNA, 19 bp, Homo sapiens
aacgtgttaattataaaca

SEQ ID NO: 6410881 - DNA, 20 bp, Homo sapiens
aacgtgtttaattaaatttc

SEQ ID NO: 6410882 - DNA, 15 bp, Homo sapiens
aacgttaaaagacag

SEQ ID NO: 6410883 - DNA, 16 bp, Homo sapiens
aacgttaaaagacagt

SEQ ID NO: 6410884 - DNA, 18 bp, Homo sapiens
aacgttaagaattgttaa

SEQ ID NO: 6410885 - DNA, 15 bp, Homo sapiens
aacgttcatgttcat

SEQ ID NO: 6410886 - DNA, 17 bp, Homo sapiens
aacgttcatgttcatct

SEQ ID NO: 6410887 - DNA, 15 bp, Homo sapiens
aacgttcgatttcta

SEQ ID NO: 6410888 - DNA, 20 bp, Homo sapiens
aacgttctataaatgaatgt

SEQ ID NO: 6410889 - DNA, 15 bp, Homo sapiens
aacgttctctacctt

SEQ ID NO: 6410890 - DNA, 15 bp, Homo sapiens
taggttgtctaaaaa

SEQ ID NO: 6410891 - DNA, 20 bp, Homo sapiens
taggttgttaccaagtatga

SEQ ID NO: 6410892 - DNA, 22 bp, Homo sapiens
taggttgttaccaagtatgaag

SEQ ID NO: 6410893 - DNA, 15 bp, Homo sapiens
taggtttaacataaa

SEQ ID NO: 6410894 - DNA, 16 bp, Homo sapiens
taggtttaacataaag

SEQ ID NO: 6410895 - DNA, 17 bp, Homo sapiens
taggtttaacataaagg

SEQ ID NO: 6410896 - DNA, 14 bp, Homo sapiens
taggtttcaaagat

SEQ ID NO: 6410897 - DNA, 15 bp, Homo sapiens
taggtttctctccct

SEQ ID NO: 6410898 - DNA, 17 bp, Homo sapiens
taggtttctctgcctcc

SEQ ID NO: 6410899 - DNA, 22 bp, Homo sapiens
taggtttggacaaaatggaata

SEQ ID NO: 6410900 - DNA, 18 bp, Homo sapiens
taggtttgtcaacacaaa

SEQ ID NO: 6410901 - DNA, 21 bp, Homo sapiens
taggtttgtcccagtcagaaa

SEQ ID NO: 6410902 - DNA, 19 bp, Homo sapiens
taggtttgttttttcatgc

SEQ ID NO: 6410903 - DNA, 16 bp, Homo sapiens
taggttttaaatctgc

SEQ ID NO: 6410904 - DNA, 19 bp, Homo sapiens
taggttttaaatctgcttt

SEQ ID NO: 6410905 - DNA, 14 bp, Homo sapiens
taggttttacagat

SEQ ID NO: 6410906 - DNA, 16 bp, Homo sapiens
taggttttgtttgcta

SEQ ID NO: 6410907 - DNA, 21 bp, Homo sapiens
taggtttttccttatttgctt

SEQ ID NO: 6410908 - DNA, 17 bp, Homo sapiens
taggtttttcttgctat

SEQ ID NO: 6410909 - DNA, 13 bp, Homo sapiens
tagtaaaaataaa

SEQ ID NO: 6410910 - DNA, 16 bp, Homo sapiens
tagtaaaaattaaaaa

SEQ ID NO: 6410911 - DNA, 14 bp, Homo sapiens
tagtaaaacacaga

SEQ ID NO: 6410912 - DNA, 21 bp, Homo sapiens
tagtaaaattatctgttctat

SEQ ID NO: 6410913 - DNA, 18 bp, Homo sapiens
tagtaaaatttatttcat

SEQ ID NO: 6410914 - DNA, 21 bp, Homo sapiens
tagtaaacattaagtaaatgc

SEQ ID NO: 6410915 - DNA, 17 bp, Homo sapiens
tagtaaaccaatcctat

SEQ ID NO: 6410916 - DNA, 23 bp, Homo sapiens
tagtaaactattcttaataaaac

SEQ ID NO: 6410917 - DNA, 13 bp, Homo sapiens
tagtaaagaaatg

SEQ ID NO: 6410918 - DNA, 15 bp, Homo sapiens
tagtaaaggaggaat

SEQ ID NO: 6410919 - DNA, 20 bp, Homo sapiens
tagtaaataatgattcaatg

SEQ ID NO: 6410920 - DNA, 21 bp, Homo sapiens
tagtaaataatgattcaatgt

SEQ ID NO: 6410921 - DNA, 16 bp, Homo sapiens
tagtaaataatgcttt

SEQ ID NO: 6410922 - DNA, 13 bp, Homo sapiens
tagtaaatatgtg

SEQ ID NO: 6410923 - DNA, 21 bp, Homo sapiens
tagtaaatattatgattttat

SEQ ID NO: 6410924 - DNA, 16 bp, Homo sapiens
tagtaaatcagaaagt

SEQ ID NO: 6410925 - DNA, 11 bp, Homo sapiens
tagtaaatgtc

SEQ ID NO: 6410926 - DNA, 13 bp, Homo sapiens
tagtaaatgtctt

SEQ ID NO: 6410927 - DNA, 17 bp, Homo sapiens
tagtaaatgtctttgta

SEQ ID NO: 6410928 - DNA, 23 bp, Homo sapiens
tagtaaatgtctttgtaagtcag

SEQ ID NO: 6410929 - DNA, 13 bp, Homo sapiens
tagtaaattttgt

SEQ ID NO: 6410930 - DNA, 23 bp, Homo sapiens
tagtaacaatacatgagaaagat

SEQ ID NO: 6410931 - DNA, 14 bp, Homo sapiens
tagtaacactaata

SEQ ID NO: 6410932 - DNA, 21 bp, Homo sapiens
tagtaacctttaaaaatgtat

SEQ ID NO: 6410933 - DNA, 21 bp, Homo sapiens
tagtaacgtgttactggaaaa

SEQ ID NO: 6410934 - DNA, 14 bp, Homo sapiens
tagtaactttgaaa

SEQ ID NO: 6410935 - DNA, 17 bp, Homo sapiens
tagtaactttttatgta

SEQ ID NO: 6410936 - DNA, 16 bp, Homo sapiens
tagtaagaaaacatca

SEQ ID NO: 6410937 - DNA, 21 bp, Homo sapiens
tagtaagaaatttgcagtttt

SEQ ID NO: 6410938 - DNA, 16 bp, Homo sapiens
tagtaagatgcactga

SEQ ID NO: 6410939 - DNA, 21 bp, Homo sapiens
tagtaagcaccagctgcctct

SEQ ID NO: 6410940 - DNA, 16 bp, Homo sapiens
tagtaagcatagaaac

SEQ ID NO: 6410941 - DNA, 22 bp, Homo sapiens
tagtaagcccctgtgaccctct

SEQ ID NO: 6410942 - DNA, 14 bp, Homo sapiens
tagtaaggctgtgt

SEQ ID NO: 6410943 - DNA, 16 bp, Homo sapiens
tagtaagtatttccat

SEQ ID NO: 6410944 - DNA, 15 bp, Homo sapiens
tagtaagttaatgta

SEQ ID NO: 6410945 - DNA, 16 bp, Homo sapiens
tagtaagttaatgtat

SEQ ID NO: 6410946 - DNA, 20 bp, Homo sapiens
tagtaagtttttcttcatga

SEQ ID NO: 6410947 - DNA, 17 bp, Homo sapiens
tagtaataaaacattag

SEQ ID NO: 6410948 - DNA, 21 bp, Homo sapiens
tagtaataatgtaatactgta

SEQ ID NO: 6410949 - DNA, 15 bp, Homo sapiens
tagtaatacctctaa

SEQ ID NO: 6410950 - DNA, 14 bp, Homo sapiens
tagtaatagagcaa

SEQ ID NO: 6410951 - DNA, 14 bp, Homo sapiens
tagtaatataatac

SEQ ID NO: 6410952 - DNA, 16 bp, Homo sapiens
tagtaatcattgacta

SEQ ID NO: 6410953 - DNA, 14 bp, Homo sapiens
tagtaatctgcatt

SEQ ID NO: 6410954 - DNA, 13 bp, Homo sapiens
tagtaatctgtat

SEQ ID NO: 6410955 - DNA, 21 bp, Homo sapiens
tagtaatgctacgtgtgattt

SEQ ID NO: 6410956 - DNA, 18 bp, Homo sapiens
tagtaatgctctgaccaa

SEQ ID NO: 6410957 - DNA, 16 bp, Homo sapiens
tagtaatgggccaatt

SEQ ID NO: 6410958 - DNA, 19 bp, Homo sapiens
tagtaatgggccaattaaa

SEQ ID NO: 6410959 - DNA, 13 bp, Homo sapiens
tagtaatggtgct

SEQ ID NO: 6410960 - DNA, 15 bp, Homo sapiens
tagtaatgttttata

SEQ ID NO: 6410961 - DNA, 15 bp, Homo sapiens
tagtaattctcaggc

SEQ ID NO: 6410962 - DNA, 17 bp, Homo sapiens
tagtaattgatttgacc

SEQ ID NO: 6410963 - DNA, 22 bp, Homo sapiens
tagtaattgcctagaaatatct

SEQ ID NO: 6410964 - DNA, 23 bp, Homo sapiens
tagtaatttattgtctgtctaca

SEQ ID NO: 6410965 - DNA, 13 bp, Homo sapiens
tagtaatttccta

SEQ ID NO: 6410966 - DNA, 15 bp, Homo sapiens
tagtaatttcctaga

SEQ ID NO: 6410967 - DNA, 13 bp, Homo sapiens
tagtaatttcctt

SEQ ID NO: 6410968 - DNA, 12 bp, Homo sapiens
tagtacaaagtt

SEQ ID NO: 6410969 - DNA, 14 bp, Homo sapiens
tagtacaaagtttc

SEQ ID NO: 6410970 - DNA, 16 bp, Homo sapiens
tagtacaaagtttcaa

SEQ ID NO: 6410971 - DNA, 16 bp, Homo sapiens
tagtacaatcttggga

SEQ ID NO: 6410972 - DNA, 15 bp, Homo sapiens
tagtacaatttcaac

SEQ ID NO: 6410973 - DNA, 23 bp, Homo sapiens
tagtacaggtaaggtgagggaat

SEQ ID NO: 6410974 - DNA, 14 bp, Homo sapiens
tagtaccaaaataa

SEQ ID NO: 6410975 - DNA, 17 bp, Homo sapiens
tagtaccactgcacatc

SEQ ID NO: 6410976 - DNA, 16 bp, Homo sapiens
tagtaccatttataca

SEQ ID NO: 6410977 - DNA, 21 bp, Homo sapiens
tagtacccaaccaaagatgct

SEQ ID NO: 6410978 - DNA, 22 bp, Homo sapiens
tagtacccaaccaaagatgctt

SEQ ID NO: 6410979 - DNA, 14 bp, Homo sapiens
tagtacccacctga

SEQ ID NO: 6410980 - DNA, 17 bp, Homo sapiens
tagtacccacctgagct

SEQ ID NO: 6410981 - DNA, 15 bp, Homo sapiens
tagtaccctgcaggc

SEQ ID NO: 6410982 - DNA, 15 bp, Homo sapiens
tagtacctgaaaagt

SEQ ID NO: 6410983 - DNA, 14 bp, Homo sapiens
tagtaccttcaaat

SEQ ID NO: 6410984 - DNA, 15 bp, Homo sapiens
tagtaccttcaaata

SEQ ID NO: 6410985 - DNA, 16 bp, Homo sapiens
tagtaccttcaaataa

SEQ ID NO: 6410986 - DNA, 20 bp, Homo sapiens
tagtaccttcagatcctacc

SEQ ID NO: 6410987 - DNA, 16 bp, Homo sapiens
tagtacctttgctctt

SEQ ID NO: 6410988 - DNA, 16 bp, Homo sapiens
tagtacgtgtggcttg

SEQ ID NO: 6410989 - DNA, 15 bp, Homo sapiens
tagtactaagcattt

SEQ ID NO: 6410990 - DNA, 23 bp, Homo sapiens
tagtactatatctgttttactgc

SEQ ID NO: 6410991 - DNA, 22 bp, Homo sapiens
tagtactattatggaattactc

SEQ ID NO: 6410992 - DNA, 17 bp, Homo sapiens
tagtactccttaagaac

SEQ ID NO: 6410993 - DNA, 19 bp, Homo sapiens
tagtactccttaagaacac

SEQ ID NO: 6410994 - DNA, 17 bp, Homo sapiens
tagtactgctttactgt

SEQ ID NO: 6410995 - DNA, 18 bp, Homo sapiens
tagtactgctttactgtg

SEQ ID NO: 6410996 - DNA, 15 bp, Homo sapiens
tagtactgtattggc

SEQ ID NO: 6410997 - DNA, 14 bp, Homo sapiens
tagtacttattaca

SEQ ID NO: 6410998 - DNA, 22 bp, Homo sapiens
tagtacttgaaatctaggatta

SEQ ID NO: 6410999 - DNA, 16 bp, Homo sapiens
tagtactttatagaag

SEQ ID NO: 6411000 - DNA, 21 bp, Homo sapiens
tagtacttttataatgaaaag

SEQ ID NO: 6411001 - DNA, 13 bp, Homo sapiens
tagtagaaagaaa

SEQ ID NO: 6411002 - DNA, 22 bp, Homo sapiens
tagtagaaagacatctgcctgt

SEQ ID NO: 6411003 - DNA, 19 bp, Homo sapiens
tagtagaaattttacaata

SEQ ID NO: 6411004 - DNA, 20 bp, Homo sapiens
tagtagaaattttacaatag

SEQ ID NO: 6411005 - DNA, 14 bp, Homo sapiens
tagtagaacaatgt

SEQ ID NO: 6411006 - DNA, 16 bp, Homo sapiens
tagtagaactggatcc

SEQ ID NO: 6411007 - DNA, 11 bp, Homo sapiens
tagtagaagaa

SEQ ID NO: 6411008 - DNA, 16 bp, Homo sapiens
tagtagacatttgtgt

SEQ ID NO: 6411009 - DNA, 12 bp, Homo sapiens
tagtagagacag

SEQ ID NO: 6411010 - DNA, 22 bp, Homo sapiens
tagtagagacagggttttgcca

SEQ ID NO: 6411011 - DNA, 16 bp, Homo sapiens
tagtagagcaaagact

SEQ ID NO: 6411012 - DNA, 17 bp, Homo sapiens
tagtagaggtacacttg

SEQ ID NO: 6411013 - DNA, 13 bp, Homo sapiens
tagtagagtatca

SEQ ID NO: 6411014 - DNA, 23 bp, Homo sapiens
tagtagatgttctactttgttct

SEQ ID NO: 6411015 - DNA, 14 bp, Homo sapiens
tagtagcagaaata

SEQ ID NO: 6411016 - DNA, 20 bp, Homo sapiens
tagtagcagtgattgtctta

SEQ ID NO: 6411017 - DNA, 17 bp, Homo sapiens
tagtagccctttctgtg

SEQ ID NO: 6411018 - DNA, 21 bp, Homo sapiens
tagtagcgttttttaaatgta

SEQ ID NO: 6411019 - DNA, 14 bp, Homo sapiens
tagtagctgataaa

SEQ ID NO: 6411020 - DNA, 14 bp, Homo sapiens
tagtaggatatgcc

SEQ ID NO: 6411021 - DNA, 17 bp, Homo sapiens
tagtaggattaatttat

SEQ ID NO: 6411022 - DNA, 20 bp, Homo sapiens
tagtaggtgagttttcacct

SEQ ID NO: 6411023 - DNA, 21 bp, Homo sapiens
tagtagtaaaattagaaaaaa

SEQ ID NO: 6411024 - DNA, 17 bp, Homo sapiens
tagtagttgatgaccaa

SEQ ID NO: 6411025 - DNA, 16 bp, Homo sapiens
tagtagtttttacaaa

SEQ ID NO: 6411026 - DNA, 16 bp, Homo sapiens
tagtataagcttttca

SEQ ID NO: 6411027 - DNA, 17 bp, Homo sapiens
tagtataatgtatgaat

SEQ ID NO: 6411028 - DNA, 22 bp, Homo sapiens
tagtataatgtatgaattttgt

SEQ ID NO: 6411029 - DNA, 18 bp, Homo sapiens
tagtatagaaaatggaaa

SEQ ID NO: 6411030 - DNA, 15 bp, Homo sapiens
tagtatagaagtctg

SEQ ID NO: 6411031 - DNA, 21 bp, Homo sapiens
tagtatagaagtctggaaaaa

SEQ ID NO: 6411032 - DNA, 15 bp, Homo sapiens
tagtatagaatgaac

SEQ ID NO: 6411033 - DNA, 14 bp, Homo sapiens
tagtatagacaata

SEQ ID NO: 6411034 - DNA, 19 bp, Homo sapiens
tagtataggtctcaatatt

SEQ ID NO: 6411035 - DNA, 16 bp, Homo sapiens
tagtatagtagaaaga

SEQ ID NO: 6411036 - DNA, 20 bp, Homo sapiens
tagtatatgaaatattttga

SEQ ID NO: 6411037 - DNA, 17 bp, Homo sapiens
tagtatattaaaaatgg

SEQ ID NO: 6411038 - DNA, 16 bp, Homo sapiens
tagtatatttatactc

SEQ ID NO: 6411039 - DNA, 14 bp, Homo sapiens
tagtatcaaatatt

SEQ ID NO: 6411040 - DNA, 21 bp, Homo sapiens
tagtatcaaatattagatgtg

SEQ ID NO: 6411041 - DNA, 22 bp, Homo sapiens
tagtatcactgctttttcctta

SEQ ID NO: 6411042 - DNA, 13 bp, Homo sapiens
tagtatcagtgtt

SEQ ID NO: 6411043 - DNA, 19 bp, Homo sapiens
tagtatcagtgttttaaat

SEQ ID NO: 6411044 - DNA, 18 bp, Homo sapiens
tagtatcatcagatagca

SEQ ID NO: 6411045 - DNA, 13 bp, Homo sapiens
tagtatcatttta

SEQ ID NO: 6411046 - DNA, 15 bp, Homo sapiens
tagtatcattttagg

SEQ ID NO: 6411047 - DNA, 22 bp, Homo sapiens
tagtatccacaggatattaaac

SEQ ID NO: 6411048 - DNA, 13 bp, Homo sapiens
tagtatcctccag

SEQ ID NO: 6411049 - DNA, 14 bp, Homo sapiens
tagtatcctccagg

SEQ ID NO: 6411050 - DNA, 15 bp, Homo sapiens
tagtatcctccaggt

SEQ ID NO: 6411051 - DNA, 16 bp, Homo sapiens
tagtatcctccaggtt

SEQ ID NO: 6411052 - DNA, 19 bp, Homo sapiens
tagtatcctccaggttttt

SEQ ID NO: 6411053 - DNA, 21 bp, Homo sapiens
tagtatcctccaggtttttca

SEQ ID NO: 6411054 - DNA, 14 bp, Homo sapiens
tagtatctaacatg

SEQ ID NO: 6411055 - DNA, 19 bp, Homo sapiens
tagtatctagcaatcacaa

SEQ ID NO: 6411056 - DNA, 16 bp, Homo sapiens
tagtatctatatgact

SEQ ID NO: 6411057 - DNA, 14 bp, Homo sapiens
tagtatcttttaaa

SEQ ID NO: 6411058 - DNA, 13 bp, Homo sapiens
tagtatgaaatta

SEQ ID NO: 6411059 - DNA, 19 bp, Homo sapiens
tagtatgacgctgatacat

SEQ ID NO: 6411060 - DNA, 15 bp, Homo sapiens
tagtatgaggcattt

SEQ ID NO: 6411061 - DNA, 21 bp, Homo sapiens
tagtatgctctgagtagcttt

SEQ ID NO: 6411062 - DNA, 20 bp, Homo sapiens
tagtatggcctgacagctct

SEQ ID NO: 6411063 - DNA, 13 bp, Homo sapiens
tagtatgggaaaa

SEQ ID NO: 6411064 - DNA, 22 bp, Homo sapiens
tagtatgggaaaaaaactgaag

SEQ ID NO: 6411065 - DNA, 11 bp, Homo sapiens
tagtatgtctg

SEQ ID NO: 6411066 - DNA, 23 bp, Homo sapiens
tagtatgtgacttttctgattaa

SEQ ID NO: 6411067 - DNA, 19 bp, Homo sapiens
tagtattaaaagttgcatt

SEQ ID NO: 6411068 - DNA, 12 bp, Homo sapiens
tagtattaacta

SEQ ID NO: 6411069 - DNA, 15 bp, Homo sapiens
tagtattacaccacc

SEQ ID NO: 6411070 - DNA, 15 bp, Homo sapiens
aacgttgaccccttt

SEQ ID NO: 6411071 - DNA, 19 bp, Homo sapiens
aacgttgacccctttcccc

SEQ ID NO: 6411072 - DNA, 20 bp, Homo sapiens
aacgttgacccctttccccc

SEQ ID NO: 6411073 - DNA, 13 bp, Homo sapiens
aacgttggacttt

SEQ ID NO: 6411074 - DNA, 21 bp, Homo sapiens
aacgtttcagtaataaaacat

SEQ ID NO: 6411075 - DNA, 15 bp, Homo sapiens
aacgttttaataatt

SEQ ID NO: 6411076 - DNA, 16 bp, Homo sapiens
aacgttttccttgtga

SEQ ID NO: 6411077 - DNA, 21 bp, Homo sapiens
aacgttttctaattgcttatt

SEQ ID NO: 6411078 - DNA, 17 bp, Homo sapiens
aacgttttctactttga

SEQ ID NO: 6411079 - DNA, 20 bp, Homo sapiens
aacgttttctactttgaaat

SEQ ID NO: 6411080 - DNA, 14 bp, Homo sapiens
aacgttttcttaaa

SEQ ID NO: 6411081 - DNA, 13 bp, Homo sapiens
aacgttttcttct

SEQ ID NO: 6411082 - DNA, 19 bp, Homo sapiens
aacgttttcttctttccct

SEQ ID NO: 6411083 - DNA, 21 bp, Homo sapiens
aacgttttcttctttccctgg

SEQ ID NO: 6411084 - DNA, 17 bp, Homo sapiens
aacgtttttcctgttct

SEQ ID NO: 6411085 - DNA, 23 bp, Homo sapiens
aacgtttttcctttaaaaaaatt

SEQ ID NO: 6411086 - DNA, 19 bp, Homo sapiens
aactaaaaaaatttttgac

SEQ ID NO: 6411087 - DNA, 21 bp, Homo sapiens
aactaaaaagagactgtgcca

SEQ ID NO: 6411088 - DNA, 21 bp, Homo sapiens
aactaaaaatatatctgttgg

SEQ ID NO: 6411089 - DNA, 20 bp, Homo sapiens
aactaaaaatttacaagaga

SEQ ID NO: 6411090 - DNA, 20 bp, Homo sapiens
aactaaaacaaagccacttt

SEQ ID NO: 6411091 - DNA, 22 bp, Homo sapiens
aactaaaacccctaggtcattt

SEQ ID NO: 6411092 - DNA, 16 bp, Homo sapiens
aactaaaatagtttaa

SEQ ID NO: 6411093 - DNA, 12 bp, Homo sapiens
aactaaaatgta

SEQ ID NO: 6411094 - DNA, 13 bp, Homo sapiens
aactaaaatgtat

SEQ ID NO: 6411095 - DNA, 20 bp, Homo sapiens
aactaaaattcaacaaatga

SEQ ID NO: 6411096 - DNA, 15 bp, Homo sapiens
aactaaaatttgaag

SEQ ID NO: 6411097 - DNA, 16 bp, Homo sapiens
aactaaactcatttat

SEQ ID NO: 6411098 - DNA, 16 bp, Homo sapiens
aactaaactctctttg

SEQ ID NO: 6411099 - DNA, 15 bp, Homo sapiens
aactaaactttacta

SEQ ID NO: 6411100 - DNA, 13 bp, Homo sapiens
aactaaactttca

SEQ ID NO: 6411101 - DNA, 15 bp, Homo sapiens
aactaaactttcaca

SEQ ID NO: 6411102 - DNA, 12 bp, Homo sapiens
aactaaagaaga

SEQ ID NO: 6411103 - DNA, 14 bp, Homo sapiens
aactaaagaagagg

SEQ ID NO: 6411104 - DNA, 12 bp, Homo sapiens
aactaaagaata

SEQ ID NO: 6411105 - DNA, 15 bp, Homo sapiens
aactaaagagctgca

SEQ ID NO: 6411106 - DNA, 16 bp, Homo sapiens
aactaaagcaatagaa

SEQ ID NO: 6411107 - DNA, 22 bp, Homo sapiens
aactaaaggaaacaaagcaata

SEQ ID NO: 6411108 - DNA, 22 bp, Homo sapiens
aactaaaggacttgatgtacat

SEQ ID NO: 6411109 - DNA, 20 bp, Homo sapiens
aactaaagtgctgcactcaa

SEQ ID NO: 6411110 - DNA, 23 bp, Homo sapiens
aactaaagtgtgctttataaaaa

SEQ ID NO: 6411111 - DNA, 13 bp, Homo sapiens
aactaaataatga

SEQ ID NO: 6411112 - DNA, 17 bp, Homo sapiens
aactaaatagcatgtat

SEQ ID NO: 6411113 - DNA, 22 bp, Homo sapiens
aactaaatatgcaatatatgtt

SEQ ID NO: 6411114 - DNA, 19 bp, Homo sapiens
aactaaatgagattatatg

SEQ ID NO: 6411115 - DNA, 17 bp, Homo sapiens
aactaaatttgatactt

SEQ ID NO: 6411116 - DNA, 19 bp, Homo sapiens
aactaaatttgatacttat

SEQ ID NO: 6411117 - DNA, 16 bp, Homo sapiens
aactaaattttaaagc

SEQ ID NO: 6411118 - DNA, 18 bp, Homo sapiens
aactaaatttttcataga

SEQ ID NO: 6411119 - DNA, 20 bp, Homo sapiens
aactaacaagattaaatatc

SEQ ID NO: 6411120 - DNA, 16 bp, Homo sapiens
aactaacactatttta

SEQ ID NO: 6411121 - DNA, 18 bp, Homo sapiens
aactaacaggcttagtga

SEQ ID NO: 6411122 - DNA, 22 bp, Homo sapiens
aactaacaggcttagtgatgta

SEQ ID NO: 6411123 - DNA, 14 bp, Homo sapiens
aactaacatgtcct

SEQ ID NO: 6411124 - DNA, 13 bp, Homo sapiens
aactaactaaaac

SEQ ID NO: 6411125 - DNA, 14 bp, Homo sapiens
aactaagactcccg

SEQ ID NO: 6411126 - DNA, 12 bp, Homo sapiens
aactaagagaaa

SEQ ID NO: 6411127 - DNA, 17 bp, Homo sapiens
aactaagagaaactgtg

SEQ ID NO: 6411128 - DNA, 14 bp, Homo sapiens
aactaagatctgtt

SEQ ID NO: 6411129 - DNA, 20 bp, Homo sapiens
aactaagatctgttaaaaaa

SEQ ID NO: 6411130 - DNA, 16 bp, Homo sapiens
aactaagattctttta

SEQ ID NO: 6411131 - DNA, 22 bp, Homo sapiens
aactaagattcttttaaattag

SEQ ID NO: 6411132 - DNA, 16 bp, Homo sapiens
aactaagcacattatg

SEQ ID NO: 6411133 - DNA, 17 bp, Homo sapiens
aactaagcacattatgt

SEQ ID NO: 6411134 - DNA, 18 bp, Homo sapiens
aactaagcacattatgtt

SEQ ID NO: 6411135 - DNA, 12 bp, Homo sapiens
aactaagcattg

SEQ ID NO: 6411136 - DNA, 13 bp, Homo sapiens
aactaagccctcg

SEQ ID NO: 6411137 - DNA, 13 bp, Homo sapiens
aactaaggacaaa

SEQ ID NO: 6411138 - DNA, 15 bp, Homo sapiens
aactaaggacaaatt

SEQ ID NO: 6411139 - DNA, 15 bp, Homo sapiens
aactaaggatttttc

SEQ ID NO: 6411140 - DNA, 15 bp, Homo sapiens
aactaaggcatttga

SEQ ID NO: 6411141 - DNA, 17 bp, Homo sapiens
aactaaggcatttgatt

SEQ ID NO: 6411142 - DNA, 16 bp, Homo sapiens
aactaaggcttttatt

SEQ ID NO: 6411143 - DNA, 21 bp, Homo sapiens
aactaaggcttttatttctgt

SEQ ID NO: 6411144 - DNA, 17 bp, Homo sapiens
aactaagttaataataa

SEQ ID NO: 6411145 - DNA, 17 bp, Homo sapiens
aactaagttattgctgc

SEQ ID NO: 6411146 - DNA, 19 bp, Homo sapiens
aactaagttattgctgcat

SEQ ID NO: 6411147 - DNA, 16 bp, Homo sapiens
aactaagttattgtta

SEQ ID NO: 6411148 - DNA, 21 bp, Homo sapiens
aactaagttttgtgtgtatat

SEQ ID NO: 6411149 - DNA, 23 bp, Homo sapiens
aactaagttttttacttccacag

SEQ ID NO: 6411150 - DNA, 11 bp, Homo sapiens
aactaataaaa

SEQ ID NO: 6411151 - DNA, 20 bp, Homo sapiens
aactaataaaatattttctg

SEQ ID NO: 6411152 - DNA, 19 bp, Homo sapiens
aactaatacgtgccagata

SEQ ID NO: 6411153 - DNA, 21 bp, Homo sapiens
aactaatatttgtctgtgtgc

SEQ ID NO: 6411154 - DNA, 14 bp, Homo sapiens
aactaatcaagagt

SEQ ID NO: 6411155 - DNA, 16 bp, Homo sapiens
aactaatcaagagtga

SEQ ID NO: 6411156 - DNA, 16 bp, Homo sapiens
aactaattaaactgat

SEQ ID NO: 6411157 - DNA, 16 bp, Homo sapiens
aactaattcaataaaa

SEQ ID NO: 6411158 - DNA, 15 bp, Homo sapiens
aactaatttaaacca

SEQ ID NO: 6411159 - DNA, 16 bp, Homo sapiens
aactaatttaaaccag

SEQ ID NO: 6411160 - DNA, 17 bp, Homo sapiens
aactaatttaaaccagc

SEQ ID NO: 6411161 - DNA, 23 bp, Homo sapiens
aactaatttgaatgtggttactt

SEQ ID NO: 6411162 - DNA, 14 bp, Homo sapiens
aactaatttttgta

SEQ ID NO: 6411163 - DNA, 20 bp, Homo sapiens
aactacaaacgtttgacaaa

SEQ ID NO: 6411164 - DNA, 18 bp, Homo sapiens
aactacaaagctttgcta

SEQ ID NO: 6411165 - DNA, 16 bp, Homo sapiens
aactacaaaggtttaa

SEQ ID NO: 6411166 - DNA, 20 bp, Homo sapiens
aactacaaaggtttaaatga

SEQ ID NO: 6411167 - DNA, 12 bp, Homo sapiens
aactacaaagta

SEQ ID NO: 6411168 - DNA, 18 bp, Homo sapiens
aactacaaagtaaaatga

SEQ ID NO: 6411169 - DNA, 14 bp, Homo sapiens
aactacaatgatgg

SEQ ID NO: 6411170 - DNA, 19 bp, Homo sapiens
aactacactaataaatgcc

SEQ ID NO: 6411171 - DNA, 14 bp, Homo sapiens
aactacagaatatt

SEQ ID NO: 6411172 - DNA, 22 bp, Homo sapiens
aactacagacctgctttttgaa

SEQ ID NO: 6411173 - DNA, 14 bp, Homo sapiens
aactacagatcttt

SEQ ID NO: 6411174 - DNA, 14 bp, Homo sapiens
aactacatctgcct

SEQ ID NO: 6411175 - DNA, 17 bp, Homo sapiens
aactacatgaacacaaa

SEQ ID NO: 6411176 - DNA, 22 bp, Homo sapiens
aactacatgagaacaaacagat

SEQ ID NO: 6411177 - DNA, 15 bp, Homo sapiens
aactacatgtaaaat

SEQ ID NO: 6411178 - DNA, 16 bp, Homo sapiens
aactacattttaacat

SEQ ID NO: 6411179 - DNA, 13 bp, Homo sapiens
aactaccaaaatg

SEQ ID NO: 6411180 - DNA, 16 bp, Homo sapiens
aactaccaaaatgaag

SEQ ID NO: 6411181 - DNA, 17 bp, Homo sapiens
aactaccacattctgtc

SEQ ID NO: 6411182 - DNA, 20 bp, Homo sapiens
aactaccaccctcgctgcca

SEQ ID NO: 6411183 - DNA, 21 bp, Homo sapiens
aactaccactttttttaacca

SEQ ID NO: 6411184 - DNA, 19 bp, Homo sapiens
aactaccaggaataatgat

SEQ ID NO: 6411185 - DNA, 13 bp, Homo sapiens
aactaccaggtgg

SEQ ID NO: 6411186 - DNA, 22 bp, Homo sapiens
aactaccaggtgtgcctggaag

SEQ ID NO: 6411187 - DNA, 18 bp, Homo sapiens
aactaccagtgggcatgt

SEQ ID NO: 6411188 - DNA, 20 bp, Homo sapiens
aactaccagtgggcatgtat

SEQ ID NO: 6411189 - DNA, 22 bp, Homo sapiens
aactacccatgcaattaaaagg

SEQ ID NO: 6411190 - DNA, 16 bp, Homo sapiens
aactacctaaaataaa

SEQ ID NO: 6411191 - DNA, 18 bp, Homo sapiens
aactacctatattccttg

SEQ ID NO: 6411192 - DNA, 22 bp, Homo sapiens
aactacctatccttacatttca

SEQ ID NO: 6411193 - DNA, 20 bp, Homo sapiens
aactacctcaaaacactttc

SEQ ID NO: 6411194 - DNA, 16 bp, Homo sapiens
aactacctcctcactt

SEQ ID NO: 6411195 - DNA, 21 bp, Homo sapiens
aactacctgtatttaaaaata

SEQ ID NO: 6411196 - DNA, 19 bp, Homo sapiens
aactacgcttgctcatttt

SEQ ID NO: 6411197 - DNA, 18 bp, Homo sapiens
aactactaaagtgcctac

SEQ ID NO: 6411198 - DNA, 21 bp, Homo sapiens
aactactaatctcaatttaag

SEQ ID NO: 6411199 - DNA, 23 bp, Homo sapiens
aactactactggtgatgcctaat

SEQ ID NO: 6411200 - DNA, 20 bp, Homo sapiens
aactactagctacaaaaaat

SEQ ID NO: 6411201 - DNA, 18 bp, Homo sapiens
aactactagtgtgactcc

SEQ ID NO: 6411202 - DNA, 19 bp, Homo sapiens
aactactccggagacaggg

SEQ ID NO: 6411203 - DNA, 15 bp, Homo sapiens
aactactgaataaat

SEQ ID NO: 6411204 - DNA, 17 bp, Homo sapiens
aactactgaataaatca

SEQ ID NO: 6411205 - DNA, 18 bp, Homo sapiens
aactactgaataatgcta

SEQ ID NO: 6411206 - DNA, 16 bp, Homo sapiens
aactactgacgaaaga

SEQ ID NO: 6411207 - DNA, 14 bp, Homo sapiens
aactactgattgaa

SEQ ID NO: 6411208 - DNA, 17 bp, Homo sapiens
aactactgcaaaaagta

SEQ ID NO: 6411209 - DNA, 23 bp, Homo sapiens
aactactgcaaaaagtacatagt

SEQ ID NO: 6411210 - DNA, 17 bp, Homo sapiens
aactactgctatttttt

SEQ ID NO: 6411211 - DNA, 13 bp, Homo sapiens
aactactgtacat

SEQ ID NO: 6411212 - DNA, 15 bp, Homo sapiens
aactactgtacattt

SEQ ID NO: 6411213 - DNA, 13 bp, Homo sapiens
aactactgtactt

SEQ ID NO: 6411214 - DNA, 14 bp, Homo sapiens
aactactgtgttat

SEQ ID NO: 6411215 - DNA, 16 bp, Homo sapiens
aactactgttaacact

SEQ ID NO: 6411216 - DNA, 22 bp, Homo sapiens
aactacttcattttctcaaagg

SEQ ID NO: 6411217 - DNA, 15 bp, Homo sapiens
aactactttataact

SEQ ID NO: 6411218 - DNA, 21 bp, Homo sapiens
aactacttttctaaaatctaa

SEQ ID NO: 6411219 - DNA, 17 bp, Homo sapiens
aactactttttatactc

SEQ ID NO: 6411220 - DNA, 18 bp, Homo sapiens
aactactttttatactcc

SEQ ID NO: 6411221 - DNA, 16 bp, Homo sapiens
aactagaaatctgcca

SEQ ID NO: 6411222 - DNA, 16 bp, Homo sapiens
aactagaacctggagg

SEQ ID NO: 6411223 - DNA, 17 bp, Homo sapiens
aactagaactgaatttt

SEQ ID NO: 6411224 - DNA, 20 bp, Homo sapiens
aactagaaggcttctctcca

SEQ ID NO: 6411225 - DNA, 12 bp, Homo sapiens
aactagaattag

SEQ ID NO: 6411226 - DNA, 13 bp, Homo sapiens
aactagaattagt

SEQ ID NO: 6411227 - DNA, 14 bp, Homo sapiens
aactagaattagta

SEQ ID NO: 6411228 - DNA, 17 bp, Homo sapiens
aactagaatttattcaa

SEQ ID NO: 6411229 - DNA, 19 bp, Homo sapiens
aactagaatttattcaatt

SEQ ID NO: 6411230 - DNA, 22 bp, Homo sapiens
aactagaatttattcaattcct

SEQ ID NO: 6411231 - DNA, 15 bp, Homo sapiens
aactagaatttgatt

SEQ ID NO: 6411232 - DNA, 20 bp, Homo sapiens
aactagacaccaaagttcta

SEQ ID NO: 6411233 - DNA, 20 bp, Homo sapiens
aactagactcccaagctgga

SEQ ID NO: 6411234 - DNA, 16 bp, Homo sapiens
aactagactttccttt

SEQ ID NO: 6411235 - DNA, 13 bp, Homo sapiens
aactagagaaggg

SEQ ID NO: 6411236 - DNA, 16 bp, Homo sapiens
aactagagactctgtg

SEQ ID NO: 6411237 - DNA, 22 bp, Homo sapiens
aactagataacttaaataattt

SEQ ID NO: 6411238 - DNA, 17 bp, Homo sapiens
aactagatctcctattt

SEQ ID NO: 6411239 - DNA, 23 bp, Homo sapiens
aactagatctcctatttttcaga

SEQ ID NO: 6411240 - DNA, 17 bp, Homo sapiens
aactagattgactattt

SEQ ID NO: 6411241 - DNA, 17 bp, Homo sapiens
aactagatttgtccttt

SEQ ID NO: 6411242 - DNA, 14 bp, Homo sapiens
aactagcaccaggg

SEQ ID NO: 6411243 - DNA, 14 bp, Homo sapiens
aactagcatatctg

SEQ ID NO: 6411244 - DNA, 15 bp, Homo sapiens
aactagcattgtaaa

SEQ ID NO: 6411245 - DNA, 18 bp, Homo sapiens
aactagccaaaccaggac

SEQ ID NO: 6411246 - DNA, 12 bp, Homo sapiens
aactagctggaa

SEQ ID NO: 6411247 - DNA, 23 bp, Homo sapiens
aactagctggaattttttattct

SEQ ID NO: 6411248 - DNA, 15 bp, Homo sapiens
aactagctgggacta

SEQ ID NO: 6411249 - DNA, 19 bp, Homo sapiens
tcccagcagagcccaccag

SEQ ID NO: 6411250 - DNA, 19 bp, Homo sapiens
tcccagcagcagagaacca

SEQ ID NO: 6411251 - DNA, 15 bp, Homo sapiens
tcccagcagccagcc

SEQ ID NO: 6411252 - DNA, 16 bp, Homo sapiens
tcccagcagctgggcc

SEQ ID NO: 6411253 - DNA, 22 bp, Homo sapiens
tcccagcagctgggccggccag

SEQ ID NO: 6411254 - DNA, 17 bp, Homo sapiens
tcccagcatccctggag

SEQ ID NO: 6411255 - DNA, 19 bp, Homo sapiens
tcccagcatccctggagca

SEQ ID NO: 6411256 - DNA, 17 bp, Homo sapiens
tcccagcatcgcactct

SEQ ID NO: 6411257 - DNA, 20 bp, Homo sapiens
tcccagcatgctgagattac

SEQ ID NO: 6411258 - DNA, 12 bp, Homo sapiens
tcccagccacca

SEQ ID NO: 6411259 - DNA, 17 bp, Homo sapiens
tcccagccaccaccact

SEQ ID NO: 6411260 - DNA, 22 bp, Homo sapiens
tcccagccaccaccactgtccc

SEQ ID NO: 6411261 - DNA, 20 bp, Homo sapiens
tcccagccaccccgggctct

SEQ ID NO: 6411262 - DNA, 24 bp, Homo sapiens
tcccagccaccccgggctctctgc

SEQ ID NO: 6411263 - DNA, 22 bp, Homo sapiens
tcccagccacccggatctccag

SEQ ID NO: 6411264 - DNA, 11 bp, Homo sapiens
tcccagccacg

SEQ ID NO: 6411265 - DNA, 17 bp, Homo sapiens
tcccagccacgcagggc

SEQ ID NO: 6411266 - DNA, 17 bp, Homo sapiens
tcccagccagcagttca

SEQ ID NO: 6411267 - DNA, 19 bp, Homo sapiens
tcccagccagcccgccgcc

SEQ ID NO: 6411268 - DNA, 13 bp, Homo sapiens
tcccagccatgcc

SEQ ID NO: 6411269 - DNA, 15 bp, Homo sapiens
tcccagccatgccca

SEQ ID NO: 6411270 - DNA, 23 bp, Homo sapiens
tcccagcccaaattctcctctct

SEQ ID NO: 6411271 - DNA, 18 bp, Homo sapiens
tcccagcccaatccaggt

SEQ ID NO: 6411272 - DNA, 14 bp, Homo sapiens
tcccagcccattgc

SEQ ID NO: 6411273 - DNA, 16 bp, Homo sapiens
tcccagcccattgctg

SEQ ID NO: 6411274 - DNA, 18 bp, Homo sapiens
tcccagcccattgctgcc

SEQ ID NO: 6411275 - DNA, 12 bp, Homo sapiens
tcccagccccaa

SEQ ID NO: 6411276 - DNA, 16 bp, Homo sapiens
tcccagccccaggcct

SEQ ID NO: 6411277 - DNA, 17 bp, Homo sapiens
tcccagccccaggcctg

SEQ ID NO: 6411278 - DNA, 20 bp, Homo sapiens
tcccagccccaggcctggcc

SEQ ID NO: 6411279 - DNA, 21 bp, Homo sapiens
tcccagccccaggcctggcct

SEQ ID NO: 6411280 - DNA, 23 bp, Homo sapiens
tcccagccccaggcctggcctcg

SEQ ID NO: 6411281 - DNA, 14 bp, Homo sapiens
tcccagccccaggg

SEQ ID NO: 6411282 - DNA, 15 bp, Homo sapiens
tcccagccccagggg

SEQ ID NO: 6411283 - DNA, 16 bp, Homo sapiens
tcccagccccctgacc

SEQ ID NO: 6411284 - DNA, 18 bp, Homo sapiens
tcccagccccctgaccac

SEQ ID NO: 6411285 - DNA, 22 bp, Homo sapiens
tcccagccccggcaagccacag

SEQ ID NO: 6411286 - DNA, 20 bp, Homo sapiens
tcccagcccctcctccctca

SEQ ID NO: 6411287 - DNA, 21 bp, Homo sapiens
tcccagcccctcctccctcag

SEQ ID NO: 6411288 - DNA, 23 bp, Homo sapiens
tcccagcccctcctccctcagac

SEQ ID NO: 6411289 - DNA, 22 bp, Homo sapiens
tcccagcccctcctccctcagg

SEQ ID NO: 6411290 - DNA, 13 bp, Homo sapiens
tcccagcccctgc

SEQ ID NO: 6411291 - DNA, 14 bp, Homo sapiens
tcccagcccctgca

SEQ ID NO: 6411292 - DNA, 15 bp, Homo sapiens
tcccagccctatgga

SEQ ID NO: 6411293 - DNA, 16 bp, Homo sapiens
tcccagccctatggat

SEQ ID NO: 6411294 - DNA, 16 bp, Homo sapiens
tcccagccctgccagg

SEQ ID NO: 6411295 - DNA, 17 bp, Homo sapiens
tcccagccctgccagga

SEQ ID NO: 6411296 - DNA, 18 bp, Homo sapiens
tcccagccctgccaggag

SEQ ID NO: 6411297 - DNA, 13 bp, Homo sapiens
tcccagccctggg

SEQ ID NO: 6411298 - DNA, 17 bp, Homo sapiens
tcccagccctttccagg

SEQ ID NO: 6411299 - DNA, 17 bp, Homo sapiens
tcccagccgtggtcaac

SEQ ID NO: 6411300 - DNA, 16 bp, Homo sapiens
tcccagcctaagggag

SEQ ID NO: 6411301 - DNA, 12 bp, Homo sapiens
tcccagcctcag

SEQ ID NO: 6411302 - DNA, 18 bp, Homo sapiens
tcccagcctcagaagcct

SEQ ID NO: 6411303 - DNA, 23 bp, Homo sapiens
tcccagcctcagaagccttcttg

SEQ ID NO: 6411304 - DNA, 13 bp, Homo sapiens
tcccagcctctgg

SEQ ID NO: 6411305 - DNA, 17 bp, Homo sapiens
tcccagcctctggggca

SEQ ID NO: 6411306 - DNA, 17 bp, Homo sapiens
tcccagcctcttccatt

SEQ ID NO: 6411307 - DNA, 13 bp, Homo sapiens
tcccagcctgctg

SEQ ID NO: 6411308 - DNA, 14 bp, Homo sapiens
tcccagcctgctga

SEQ ID NO: 6411309 - DNA, 18 bp, Homo sapiens
tcccagcctgctgagagc

SEQ ID NO: 6411310 - DNA, 22 bp, Homo sapiens
tcccagcctgctgagagccccc

SEQ ID NO: 6411311 - DNA, 23 bp, Homo sapiens
tcccagcctggccaccagcttcc

SEQ ID NO: 6411312 - DNA, 16 bp, Homo sapiens
tcccagcctggcctgt

SEQ ID NO: 6411313 - DNA, 23 bp, Homo sapiens
tcccagcctggcctgtggctgcc

SEQ ID NO: 6411314 - DNA, 22 bp, Homo sapiens
tcccagcctgggctcctctgca

SEQ ID NO: 6411315 - DNA, 24 bp, Homo sapiens
tcccagcctggggctccctctctg

SEQ ID NO: 6411316 - DNA, 21 bp, Homo sapiens
tcccagcctgggggccagtgg

SEQ ID NO: 6411317 - DNA, 18 bp, Homo sapiens
tcccagcgagccacagga

SEQ ID NO: 6411318 - DNA, 22 bp, Homo sapiens
tcccagcgcatggcgccccggg

SEQ ID NO: 6411319 - DNA, 15 bp, Homo sapiens
tcccagcgctgctgg

SEQ ID NO: 6411320 - DNA, 15 bp, Homo sapiens
tcccagcgctggctc

SEQ ID NO: 6411321 - DNA, 18 bp, Homo sapiens
tcccagcggcctcagggt

SEQ ID NO: 6411322 - DNA, 19 bp, Homo sapiens
tcccagcggcctcagggtc

SEQ ID NO: 6411323 - DNA, 20 bp, Homo sapiens
tcccagcggcctcagggtct

SEQ ID NO: 6411324 - DNA, 19 bp, Homo sapiens
tcccagcggctggtgcagg

SEQ ID NO: 6411325 - DNA, 23 bp, Homo sapiens
tcccagcggctggtgcagggcct

SEQ ID NO: 6411326 - DNA, 17 bp, Homo sapiens
tcccagcggttcctgtg

SEQ ID NO: 6411327 - DNA, 14 bp, Homo sapiens
tcccagcgtgtgta

SEQ ID NO: 6411328 - DNA, 19 bp, Homo sapiens
tcccagctaaagaggtggg

SEQ ID NO: 6411329 - DNA, 22 bp, Homo sapiens
tcccagctacacctgaggctga

SEQ ID NO: 6411330 - DNA, 13 bp, Homo sapiens
tcccagctactca

SEQ ID NO: 6411331 - DNA, 16 bp, Homo sapiens
tcccagctactcagaa

SEQ ID NO: 6411332 - DNA, 23 bp, Homo sapiens
tcccagctactcagaagcctgag

SEQ ID NO: 6411333 - DNA, 16 bp, Homo sapiens
tcccagctactcagga

SEQ ID NO: 6411334 - DNA, 20 bp, Homo sapiens
tcccagctactcaggaggct

SEQ ID NO: 6411335 - DNA, 22 bp, Homo sapiens
tcccagctactcgggaggctga

SEQ ID NO: 6411336 - DNA, 16 bp, Homo sapiens
tcccagctacttggga

SEQ ID NO: 6411337 - DNA, 17 bp, Homo sapiens
tcccagctacttgggaa

SEQ ID NO: 6411338 - DNA, 21 bp, Homo sapiens
tcccagctacttgggagcctg

SEQ ID NO: 6411339 - DNA, 22 bp, Homo sapiens
tcccagctagactgtaagccct

SEQ ID NO: 6411340 - DNA, 23 bp, Homo sapiens
tcccagctattcaggaggctgag

SEQ ID NO: 6411341 - DNA, 18 bp, Homo sapiens
tcccagctcactgcagcc

SEQ ID NO: 6411342 - DNA, 10 bp, Homo sapiens
tcccagctcc

SEQ ID NO: 6411343 - DNA, 12 bp, Homo sapiens
tcccagctcccc

SEQ ID NO: 6411344 - DNA, 20 bp, Homo sapiens
tcccagctccccccgcccac

SEQ ID NO: 6411345 - DNA, 21 bp, Homo sapiens
tcccagctcccctcttttgta

SEQ ID NO: 6411346 - DNA, 22 bp, Homo sapiens
tcccagctcctttctcctgtga

SEQ ID NO: 6411347 - DNA, 23 bp, Homo sapiens
tcccagctctacattctgctctg

SEQ ID NO: 6411348 - DNA, 21 bp, Homo sapiens
tcccagctctccctctggccc

SEQ ID NO: 6411349 - DNA, 22 bp, Homo sapiens
tcccagctctccctctggccct

SEQ ID NO: 6411350 - DNA, 23 bp, Homo sapiens
tcccagctctccctctggccctg

SEQ ID NO: 6411351 - DNA, 16 bp, Homo sapiens
tcccagctctctctcc

SEQ ID NO: 6411352 - DNA, 19 bp, Homo sapiens
tcccagctctctctcctgg

SEQ ID NO: 6411353 - DNA, 20 bp, Homo sapiens
tcccagctctctctcctgga

SEQ ID NO: 6411354 - DNA, 11 bp, Homo sapiens
tcccagctctg

SEQ ID NO: 6411355 - DNA, 19 bp, Homo sapiens
tcccagctgaaggcagtgg

SEQ ID NO: 6411356 - DNA, 24 bp, Homo sapiens
tcccagctgacagtcctctccacc

SEQ ID NO: 6411357 - DNA, 18 bp, Homo sapiens
tcccagctgccatgtttc

SEQ ID NO: 6411358 - DNA, 16 bp, Homo sapiens
tcccagctgcccctcc

SEQ ID NO: 6411359 - DNA, 19 bp, Homo sapiens
tcccagctgcccctccctg

SEQ ID NO: 6411360 - DNA, 12 bp, Homo sapiens
tcccagctgcct

SEQ ID NO: 6411361 - DNA, 13 bp, Homo sapiens
tcccagctgctga

SEQ ID NO: 6411362 - DNA, 12 bp, Homo sapiens
tcccagctgctt

SEQ ID NO: 6411363 - DNA, 15 bp, Homo sapiens
tcccagctggcagcg

SEQ ID NO: 6411364 - DNA, 16 bp, Homo sapiens
tcccagctggcagcgc

SEQ ID NO: 6411365 - DNA, 22 bp, Homo sapiens
tcccagctggcagcgcctcccg

SEQ ID NO: 6411366 - DNA, 20 bp, Homo sapiens
tcccagctgtgctctggaca

SEQ ID NO: 6411367 - DNA, 22 bp, Homo sapiens
tcccagctgtgctctggacagg

SEQ ID NO: 6411368 - DNA, 23 bp, Homo sapiens
tcccagctgtgctctggacaggc

SEQ ID NO: 6411369 - DNA, 14 bp, Homo sapiens
tcccagctgtgctg

SEQ ID NO: 6411370 - DNA, 20 bp, Homo sapiens
tcccagcttaaatcctagca

SEQ ID NO: 6411371 - DNA, 13 bp, Homo sapiens
tcccagcttcccg

SEQ ID NO: 6411372 - DNA, 18 bp, Homo sapiens
tcccagcttgtaggagct

SEQ ID NO: 6411373 - DNA, 22 bp, Homo sapiens
tcccagctttaaaaagaaaaaa

SEQ ID NO: 6411374 - DNA, 19 bp, Homo sapiens
tcccagctttctgtgtgca

SEQ ID NO: 6411375 - DNA, 23 bp, Homo sapiens
tcccaggaaccgaacatatcatt

SEQ ID NO: 6411376 - DNA, 11 bp, Homo sapiens
tcccaggaact

SEQ ID NO: 6411377 - DNA, 17 bp, Homo sapiens
tcccaggaagcagggag

SEQ ID NO: 6411378 - DNA, 23 bp, Homo sapiens
tcccaggaagccggtgcctgggt

SEQ ID NO: 6411379 - DNA, 14 bp, Homo sapiens
tcccaggacaggaa

SEQ ID NO: 6411380 - DNA, 15 bp, Homo sapiens
tcccaggacaggaaa

SEQ ID NO: 6411381 - DNA, 17 bp, Homo sapiens
tcccaggaccacaggct

SEQ ID NO: 6411382 - DNA, 24 bp, Homo sapiens
tcccaggaccacaggctcaggcag

SEQ ID NO: 6411383 - DNA, 12 bp, Homo sapiens
tcccaggaccct

SEQ ID NO: 6411384 - DNA, 15 bp, Homo sapiens
tcccaggaccctcca

SEQ ID NO: 6411385 - DNA, 14 bp, Homo sapiens
tcccaggaccctga

SEQ ID NO: 6411386 - DNA, 16 bp, Homo sapiens
tcccaggaccctgaag

SEQ ID NO: 6411387 - DNA, 19 bp, Homo sapiens
tcccaggaccctggaccca

SEQ ID NO: 6411388 - DNA, 18 bp, Homo sapiens
tcccaggaccctgggtca

SEQ ID NO: 6411389 - DNA, 22 bp, Homo sapiens
tcccaggacctcggatgaccat

SEQ ID NO: 6411390 - DNA, 18 bp, Homo sapiens
tcccaggacctgagcctg

SEQ ID NO: 6411391 - DNA, 22 bp, Homo sapiens
tcccaggacgcagggagaccct

SEQ ID NO: 6411392 - DNA, 18 bp, Homo sapiens
tcccaggactcaccctcc

SEQ ID NO: 6411393 - DNA, 14 bp, Homo sapiens
tcccaggagaaaga

SEQ ID NO: 6411394 - DNA, 15 bp, Homo sapiens
tcccaggagacagtt

SEQ ID NO: 6411395 - DNA, 16 bp, Homo sapiens
tcccaggagacagttc

SEQ ID NO: 6411396 - DNA, 18 bp, Homo sapiens
tcccaggagcaaatgctg

SEQ ID NO: 6411397 - DNA, 17 bp, Homo sapiens
tcccaggagggctttgt

SEQ ID NO: 6411398 - DNA, 17 bp, Homo sapiens
tcccaggaggtgcagtg

SEQ ID NO: 6411399 - DNA, 19 bp, Homo sapiens
tcccaggagttctgctcat

SEQ ID NO: 6411400 - DNA, 24 bp, Homo sapiens
tcccaggatgagcatcccaggatc

SEQ ID NO: 6411401 - DNA, 18 bp, Homo sapiens
tcccaggatggtcccagc

SEQ ID NO: 6411402 - DNA, 20 bp, Homo sapiens
tcccaggcaaataaaattcc

SEQ ID NO: 6411403 - DNA, 13 bp, Homo sapiens
tcccaggcaaggc

SEQ ID NO: 6411404 - DNA, 16 bp, Homo sapiens
tcccaggcaaggctgt

SEQ ID NO: 6411405 - DNA, 19 bp, Homo sapiens
tcccaggcaaggctgtgga

SEQ ID NO: 6411406 - DNA, 23 bp, Homo sapiens
tcccaggcagcacagtgtgtgaa

SEQ ID NO: 6411407 - DNA, 15 bp, Homo sapiens
tcccaggcagcgcca

SEQ ID NO: 6411408 - DNA, 12 bp, Homo sapiens
tcccaggcaggg

SEQ ID NO: 6411409 - DNA, 15 bp, Homo sapiens
tcccaggcagggaga

SEQ ID NO: 6411410 - DNA, 22 bp, Homo sapiens
tcccaggcatgcagctgcctgg

SEQ ID NO: 6411411 - DNA, 19 bp, Homo sapiens
tcccaggcattccccagga

SEQ ID NO: 6411412 - DNA, 20 bp, Homo sapiens
tcccaggcattccccaggag

SEQ ID NO: 6411413 - DNA, 18 bp, Homo sapiens
tcccaggccacctcagtc

SEQ ID NO: 6411414 - DNA, 15 bp, Homo sapiens
tcccaggccagcgag

SEQ ID NO: 6411415 - DNA, 16 bp, Homo sapiens
tcccaggccagcgagg

SEQ ID NO: 6411416 - DNA, 19 bp, Homo sapiens
tcccaggccagggctgggt

SEQ ID NO: 6411417 - DNA, 19 bp, Homo sapiens
tcccaggcccactgtgcct

SEQ ID NO: 6411418 - DNA, 17 bp, Homo sapiens
tcccaggccccaggcct

SEQ ID NO: 6411419 - DNA, 17 bp, Homo sapiens
tcccaggccccagggga

SEQ ID NO: 6411420 - DNA, 18 bp, Homo sapiens
tcccaggccccatgacct

SEQ ID NO: 6411421 - DNA, 21 bp, Homo sapiens
tcccaggccccatgacctcca

SEQ ID NO: 6411422 - DNA, 22 bp, Homo sapiens
tcccaggccccatgacctccag

SEQ ID NO: 6411423 - DNA, 18 bp, Homo sapiens
tcccaggccccctgcatc

SEQ ID NO: 6411424 - DNA, 17 bp, Homo sapiens
tcccaggcccctggagg

SEQ ID NO: 6411425 - DNA, 22 bp, Homo sapiens
tcccaggcccctggaggctgcc

SEQ ID NO: 6411426 - DNA, 13 bp, Homo sapiens
tcccaggcccttt

SEQ ID NO: 6411427 - DNA, 16 bp, Homo sapiens
tcccaggccctttggc

SEQ ID NO: 6411428 - DNA, 18 bp, Homo sapiens
tcccaggccctttggctt

SEQ ID NO: 6411429 - DNA, 20 bp, Homo sapiens
tcccaggccgcaccatttct

SEQ ID NO: 6411430 - DNA, 17 bp, Homo sapiens
tcccaggccgcatggcc

SEQ ID NO: 6411431 - DNA, 11 bp, Homo sapiens
tcccaggcctc

SEQ ID NO: 6411432 - DNA, 14 bp, Homo sapiens
tcccaggcctctgc

SEQ ID NO: 6411433 - DNA, 21 bp, Homo sapiens
tcccaggcgccccttccccct

SEQ ID NO: 6411434 - DNA, 12 bp, Homo sapiens
tcccaggctgcc

SEQ ID NO: 6411435 - DNA, 13 bp, Homo sapiens
tcccaggctgccg

SEQ ID NO: 6411436 - DNA, 22 bp, Homo sapiens
tcccaggctggagagcactgcc

SEQ ID NO: 6411437 - DNA, 19 bp, Homo sapiens
tcccaggctggagtgcagt

SEQ ID NO: 6411438 - DNA, 20 bp, Homo sapiens
tcccaggctggagtgcagtg

SEQ ID NO: 6411439 - DNA, 15 bp, Homo sapiens
tcccaggctggggct

SEQ ID NO: 6411440 - DNA, 20 bp, Homo sapiens
tcccagggaaggacttggag

SEQ ID NO: 6411441 - DNA, 20 bp, Homo sapiens
tcccagggacaagggaagga

SEQ ID NO: 6411442 - DNA, 13 bp, Homo sapiens
tcccagggaccag

SEQ ID NO: 6411443 - DNA, 17 bp, Homo sapiens
tcccagggagaaaccca

SEQ ID NO: 6411444 - DNA, 19 bp, Homo sapiens
tcccagggagcaagggcag

SEQ ID NO: 6411445 - DNA, 18 bp, Homo sapiens
tcccagggcacccaggca

SEQ ID NO: 6411446 - DNA, 23 bp, Homo sapiens
tcccagggccagggccctgcaga

SEQ ID NO: 6411447 - DNA, 17 bp, Homo sapiens
tcccagggccctcccag

SEQ ID NO: 6411448 - DNA, 13 bp, Homo sapiens
tcccagggccgct

SEQ ID NO: 6411449 - DNA, 17 bp, Homo sapiens
tcccagggctacacaga

SEQ ID NO: 6411450 - DNA, 18 bp, Homo sapiens
tcccagggctacacagac

SEQ ID NO: 6411451 - DNA, 20 bp, Homo sapiens
tcccagggctacacagaccc

SEQ ID NO: 6411452 - DNA, 18 bp, Homo sapiens
tcccagggctctctggac

SEQ ID NO: 6411453 - DNA, 17 bp, Homo sapiens
tcccagggctctgcagg

SEQ ID NO: 6411454 - DNA, 12 bp, Homo sapiens
tcccagggctgg

SEQ ID NO: 6411455 - DNA, 13 bp, Homo sapiens
tcccagggctggc

SEQ ID NO: 6411456 - DNA, 14 bp, Homo sapiens
tcccagggctggct

SEQ ID NO: 6411457 - DNA, 16 bp, Homo sapiens
tcccagggctggctct

SEQ ID NO: 6411458 - DNA, 17 bp, Homo sapiens
tcccagggctggctctg

SEQ ID NO: 6411459 - DNA, 18 bp, Homo sapiens
tcccaggggaccacacct

SEQ ID NO: 6411460 - DNA, 17 bp, Homo sapiens
tcccaggggcagccaca

SEQ ID NO: 6411461 - DNA, 22 bp, Homo sapiens
tcccaggggcagccacaccact

SEQ ID NO: 6411462 - DNA, 18 bp, Homo sapiens
tcccaggggctccctccg

SEQ ID NO: 6411463 - DNA, 17 bp, Homo sapiens
tcccaggggtctccctg

SEQ ID NO: 6411464 - DNA, 20 bp, Homo sapiens
tcccaggggtctccctggct

SEQ ID NO: 6411465 - DNA, 21 bp, Homo sapiens
tcccaggggtctccctggctc

SEQ ID NO: 6411466 - DNA, 18 bp, Homo sapiens
tcccagggtagcccgcct

SEQ ID NO: 6411467 - DNA, 21 bp, Homo sapiens
tcccagggtagcccgcctgcc

SEQ ID NO: 6411468 - DNA, 17 bp, Homo sapiens
tcccagggtcccacccc

SEQ ID NO: 6411469 - DNA, 21 bp, Homo sapiens
tcccagggtcccacccccaac

SEQ ID NO: 6411470 - DNA, 18 bp, Homo sapiens
tcccaggtaagcaggagg

SEQ ID NO: 6411471 - DNA, 18 bp, Homo sapiens
tcccaggtaatttaaatt

SEQ ID NO: 6411472 - DNA, 20 bp, Homo sapiens
tcccaggtataaaacctaaa

SEQ ID NO: 6411473 - DNA, 19 bp, Homo sapiens
tcccaggtcgcccacctgt

SEQ ID NO: 6411474 - DNA, 17 bp, Homo sapiens
tcccaggtcgggcagtg

SEQ ID NO: 6411475 - DNA, 15 bp, Homo sapiens
tcccaggtgagaatt

SEQ ID NO: 6411476 - DNA, 19 bp, Homo sapiens
tcccaggttggcctggtgg

SEQ ID NO: 6411477 - DNA, 23 bp, Homo sapiens
tcccaggttggctctgccagtcc

SEQ ID NO: 6411478 - DNA, 18 bp, Homo sapiens
tcccaggtttagtgaaaa

SEQ ID NO: 6411479 - DNA, 19 bp, Homo sapiens
tcccaggtttcttctctgg

SEQ ID NO: 6411480 - DNA, 15 bp, Homo sapiens
tcccagtactttgga

SEQ ID NO: 6411481 - DNA, 21 bp, Homo sapiens
tcccagtaggcttttaccatt

SEQ ID NO: 6411482 - DNA, 16 bp, Homo sapiens
tcccagtatgttttaa

SEQ ID NO: 6411483 - DNA, 14 bp, Homo sapiens
tcccagtattttta

SEQ ID NO: 6411484 - DNA, 13 bp, Homo sapiens
tcccagtcagaaa

SEQ ID NO: 6411485 - DNA, 22 bp, Homo sapiens
tcccagtcagaaataaaatttg

SEQ ID NO: 6411486 - DNA, 23 bp, Homo sapiens
tcccagtccatttccaaatgtgg

SEQ ID NO: 6411487 - DNA, 16 bp, Homo sapiens
tcccagtcccagcctc

SEQ ID NO: 6411488 - DNA, 17 bp, Homo sapiens
tcccagtcccagcctct

SEQ ID NO: 6411489 - DNA, 16 bp, Homo sapiens
tcccagtccctcgccg

SEQ ID NO: 6411490 - DNA, 17 bp, Homo sapiens
tcccagtccggtgcctt

SEQ ID NO: 6411491 - DNA, 16 bp, Homo sapiens
tcccagtctcatctcc

SEQ ID NO: 6411492 - DNA, 13 bp, Homo sapiens
tcccagtctctgt

SEQ ID NO: 6411493 - DNA, 17 bp, Homo sapiens
tcccagtctgatattca

SEQ ID NO: 6411494 - DNA, 20 bp, Homo sapiens
tcccagtgaactcctgccag

SEQ ID NO: 6411495 - DNA, 22 bp, Homo sapiens
tcccagtgaactcctgccaggc

SEQ ID NO: 6411496 - DNA, 16 bp, Homo sapiens
tcccagtgaactcggc

SEQ ID NO: 6411497 - DNA, 18 bp, Homo sapiens
tcccagtgaatccctggg

SEQ ID NO: 6411498 - DNA, 21 bp, Homo sapiens
tcccagtgaatccctgggagc

SEQ ID NO: 6411499 - DNA, 14 bp, Homo sapiens
tcccagtgacaaca

SEQ ID NO: 6411500 - DNA, 15 bp, Homo sapiens
tcccagtgacacttc

SEQ ID NO: 6411501 - DNA, 22 bp, Homo sapiens
tcccagtgacacttcagagagc

SEQ ID NO: 6411502 - DNA, 19 bp, Homo sapiens
tcccagtgagcctctgcgc

SEQ ID NO: 6411503 - DNA, 17 bp, Homo sapiens
tcccagtgatctgttca

SEQ ID NO: 6411504 - DNA, 19 bp, Homo sapiens
tcccagtgccgagaaggaa

SEQ ID NO: 6411505 - DNA, 22 bp, Homo sapiens
tcccagtgctcaccagccctgc

SEQ ID NO: 6411506 - DNA, 19 bp, Homo sapiens
tcccagtggcctcaaccct

SEQ ID NO: 6411507 - DNA, 18 bp, Homo sapiens
tcccagtgggagcttccc

SEQ ID NO: 6411508 - DNA, 15 bp, Homo sapiens
tcccagtgggaggcg

SEQ ID NO: 6411509 - DNA, 14 bp, Homo sapiens
tcccagtgggaggg

SEQ ID NO: 6411510 - DNA, 17 bp, Homo sapiens
tcccagtgggaggggca

SEQ ID NO: 6411511 - DNA, 14 bp, Homo sapiens
tcccagtgggctgt

SEQ ID NO: 6411512 - DNA, 12 bp, Homo sapiens
tcccagtgtctg

SEQ ID NO: 6411513 - DNA, 19 bp, Homo sapiens
tcccagtgtgagaccccaa

SEQ ID NO: 6411514 - DNA, 11 bp, Homo sapiens
tcccagtgtgt

SEQ ID NO: 6411515 - DNA, 23 bp, Homo sapiens
tcccagtgtgtgtttaacattca

SEQ ID NO: 6411516 - DNA, 14 bp, Homo sapiens
tcccagttaaagat

SEQ ID NO: 6411517 - DNA, 15 bp, Homo sapiens
tcccagttaagtgaa

SEQ ID NO: 6411518 - DNA, 15 bp, Homo sapiens
tcccagttcaggagt

SEQ ID NO: 6411519 - DNA, 14 bp, Homo sapiens
tcccagttcatgtt

SEQ ID NO: 6411520 - DNA, 21 bp, Homo sapiens
tcccagttctacaagcatatt

SEQ ID NO: 6411521 - DNA, 17 bp, Homo sapiens
tcccagttctctaggga

SEQ ID NO: 6411522 - DNA, 20 bp, Homo sapiens
tcccagttcttcctgcaacc

SEQ ID NO: 6411523 - DNA, 16 bp, Homo sapiens
tcccagttgctgtcac

SEQ ID NO: 6411524 - DNA, 20 bp, Homo sapiens
tcccagttgctgtcacaaag

SEQ ID NO: 6411525 - DNA, 22 bp, Homo sapiens
tcccagttggagctccagcctg

SEQ ID NO: 6411526 - DNA, 18 bp, Homo sapiens
tcccagtttcccactctg

SEQ ID NO: 6411527 - DNA, 21 bp, Homo sapiens
tcccagtttctgctgttgact

SEQ ID NO: 6411528 - DNA, 13 bp, Homo sapiens
tcccataaataaa

SEQ ID NO: 6411529 - DNA, 22 bp, Homo sapiens
tcccataacccctagtcatcgt

SEQ ID NO: 6411530 - DNA, 18 bp, Homo sapiens
tcccataaccgctgattc

SEQ ID NO: 6411531 - DNA, 14 bp, Homo sapiens
tcccataagctaag

SEQ ID NO: 6411532 - DNA, 22 bp, Homo sapiens
tcccataataaagcaatctgat

SEQ ID NO: 6411533 - DNA, 22 bp, Homo sapiens
tcccataattttcttcatgcaa

SEQ ID NO: 6411534 - DNA, 18 bp, Homo sapiens
tcccatagatactctctt

SEQ ID NO: 6411535 - DNA, 19 bp, Homo sapiens
tcccatagatactctcttc

SEQ ID NO: 6411536 - DNA, 21 bp, Homo sapiens
tcccatagatactctcttctt

SEQ ID NO: 6411537 - DNA, 19 bp, Homo sapiens
tcccatagcgctggctcag

SEQ ID NO: 6411538 - DNA, 13 bp, Homo sapiens
tcccatagctggg

SEQ ID NO: 6411539 - DNA, 15 bp, Homo sapiens
tcccataggcccagt

SEQ ID NO: 6411540 - DNA, 20 bp, Homo sapiens
tcccatagtgctgggattca

SEQ ID NO: 6411541 - DNA, 21 bp, Homo sapiens
tcccatagtggggcctgggag

SEQ ID NO: 6411542 - DNA, 20 bp, Homo sapiens
tcccatatcaaaagacacag

SEQ ID NO: 6411543 - DNA, 18 bp, Homo sapiens
tcccatatcctgcctcag

SEQ ID NO: 6411544 - DNA, 15 bp, Homo sapiens
tcccatatcttgcct

SEQ ID NO: 6411545 - DNA, 16 bp, Homo sapiens
tcccatatgcctgggc

SEQ ID NO: 6411546 - DNA, 16 bp, Homo sapiens
tcccatcaccccttcc

SEQ ID NO: 6411547 - DNA, 23 bp, Homo sapiens
tcccatcacgtgtactggctcct

SEQ ID NO: 6411548 - DNA, 22 bp, Homo sapiens
tcccatcactgctgtccctcct

SEQ ID NO: 6411549 - DNA, 14 bp, Homo sapiens
tcccatcactggag

SEQ ID NO: 6411550 - DNA, 18 bp, Homo sapiens
tcccatcaggctgttatt

SEQ ID NO: 6411551 - DNA, 20 bp, Homo sapiens
tcccatcaggctgttattat

SEQ ID NO: 6411552 - DNA, 14 bp, Homo sapiens
tcccatcagggaag

SEQ ID NO: 6411553 - DNA, 19 bp, Homo sapiens
tcccatcaggtcaccgcga

SEQ ID NO: 6411554 - DNA, 15 bp, Homo sapiens
tcccatcatcctttg

SEQ ID NO: 6411555 - DNA, 23 bp, Homo sapiens
tcccatcattacccttccctgca

SEQ ID NO: 6411556 - DNA, 18 bp, Homo sapiens
tcccatcccactgctccc

SEQ ID NO: 6411557 - DNA, 13 bp, Homo sapiens
tcccatcccatcc

SEQ ID NO: 6411558 - DNA, 16 bp, Homo sapiens
tcccatcccatcccat

SEQ ID NO: 6411559 - DNA, 14 bp, Homo sapiens
tcccatccccaggt

SEQ ID NO: 6411560 - DNA, 16 bp, Homo sapiens
tcccatccccctgccc

SEQ ID NO: 6411561 - DNA, 17 bp, Homo sapiens
tcccatccccctgccct

SEQ ID NO: 6411562 - DNA, 19 bp, Homo sapiens
tcccatccccctgccctcg

SEQ ID NO: 6411563 - DNA, 13 bp, Homo sapiens
tcccatcccctca

SEQ ID NO: 6411564 - DNA, 22 bp, Homo sapiens
tcccatcccctcaacaccctgc

SEQ ID NO: 6411565 - DNA, 15 bp, Homo sapiens
tcccatcccgctctt

SEQ ID NO: 6411566 - DNA, 18 bp, Homo sapiens
tcccatcccgctcttttc

SEQ ID NO: 6411567 - DNA, 19 bp, Homo sapiens
tcccatcccgctcttttcc

SEQ ID NO: 6411568 - DNA, 14 bp, Homo sapiens
tcccatccctgcgt

SEQ ID NO: 6411569 - DNA, 19 bp, Homo sapiens
tcccatcccttcaacccca

SEQ ID NO: 6411570 - DNA, 17 bp, Homo sapiens
tcccatcctccagccct

SEQ ID NO: 6411571 - DNA, 21 bp, Homo sapiens
tcccatcctgatcccagaccc

SEQ ID NO: 6411572 - DNA, 14 bp, Homo sapiens
tcccatcctgtgtg

SEQ ID NO: 6411573 - DNA, 16 bp, Homo sapiens
tcccatccttccctca

SEQ ID NO: 6411574 - DNA, 14 bp, Homo sapiens
tcccatcggaagtt

SEQ ID NO: 6411575 - DNA, 14 bp, Homo sapiens
tcccatctccaggg

SEQ ID NO: 6411576 - DNA, 18 bp, Homo sapiens
tcccatctcctgatttct

SEQ ID NO: 6411577 - DNA, 22 bp, Homo sapiens
tcccatctcctgatttctctga

SEQ ID NO: 6411578 - DNA, 23 bp, Homo sapiens
tcccatctcctgatttctctgaa

SEQ ID NO: 6411579 - DNA, 20 bp, Homo sapiens
tcccatctccttacctctgg

SEQ ID NO: 6411580 - DNA, 17 bp, Homo sapiens
tcccatctccttccccc

SEQ ID NO: 6411581 - DNA, 19 bp, Homo sapiens
tcccatctccttcccccag

SEQ ID NO: 6411582 - DNA, 22 bp, Homo sapiens
tcccatctccttcccccagccc

SEQ ID NO: 6411583 - DNA, 15 bp, Homo sapiens
tcccatctctcccac

SEQ ID NO: 6411584 - DNA, 22 bp, Homo sapiens
tcccatctctcccacttcctcc

SEQ ID NO: 6411585 - DNA, 16 bp, Homo sapiens
tcccatctcttccttg

SEQ ID NO: 6411586 - DNA, 14 bp, Homo sapiens
tcccatctgcattt

SEQ ID NO: 6411587 - DNA, 16 bp, Homo sapiens
tcccatctgccctccc

SEQ ID NO: 6411588 - DNA, 15 bp, Homo sapiens
tcccatctgctcctc

SEQ ID NO: 6411589 - DNA, 13 bp, Homo sapiens
tcccatctggctc

SEQ ID NO: 6411590 - DNA, 18 bp, Homo sapiens
tcccatctggctttttct

SEQ ID NO: 6411591 - DNA, 17 bp, Homo sapiens
tcccatctgtggttttc

SEQ ID NO: 6411592 - DNA, 21 bp, Homo sapiens
tcccatcttaactctttgcct

SEQ ID NO: 6411593 - DNA, 11 bp, Homo sapiens
tcccatgaagc

SEQ ID NO: 6411594 - DNA, 16 bp, Homo sapiens
tcccatgaagcctttt

SEQ ID NO: 6411595 - DNA, 21 bp, Homo sapiens
tcccatgaagccttttgaaag

SEQ ID NO: 6411596 - DNA, 16 bp, Homo sapiens
tcccatgacccacccc

SEQ ID NO: 6411597 - DNA, 18 bp, Homo sapiens
tcccatgacccacccctg

SEQ ID NO: 6411598 - DNA, 20 bp, Homo sapiens
tcccatgacccacccctgtg

SEQ ID NO: 6411599 - DNA, 21 bp, Homo sapiens
tcccatgacccacccctgtgc

SEQ ID NO: 6411600 - DNA, 19 bp, Homo sapiens
tcccatgacccaggctggg

SEQ ID NO: 6411601 - DNA, 23 bp, Homo sapiens
tcccatgactgcacccagctcca

SEQ ID NO: 6411602 - DNA, 21 bp, Homo sapiens
tcccatgagactgccctgccc

SEQ ID NO: 6411603 - DNA, 23 bp, Homo sapiens
tagtattaccaccctttcacaag

SEQ ID NO: 6411604 - DNA, 22 bp, Homo sapiens
tagtattatcttgttcaggaaa

SEQ ID NO: 6411605 - DNA, 14 bp, Homo sapiens
tagtattcaggcac

SEQ ID NO: 6411606 - DNA, 23 bp, Homo sapiens
tagtattcaggcactgagaatga

SEQ ID NO: 6411607 - DNA, 14 bp, Homo sapiens
tagtattccaatca

SEQ ID NO: 6411608 - DNA, 18 bp, Homo sapiens
tagtattcctcattctgc

SEQ ID NO: 6411609 - DNA, 14 bp, Homo sapiens
tagtattctttatt

SEQ ID NO: 6411610 - DNA, 16 bp, Homo sapiens
tagtattgcaaagtca

SEQ ID NO: 6411611 - DNA, 21 bp, Homo sapiens
tagtattgttgtccttttcat

SEQ ID NO: 6411612 - DNA, 22 bp, Homo sapiens
tagtattgttgtccttttcata

SEQ ID NO: 6411613 - DNA, 23 bp, Homo sapiens
tagtatttaactacatctgcctc

SEQ ID NO: 6411614 - DNA, 14 bp, Homo sapiens
tagtatttaattgt

SEQ ID NO: 6411615 - DNA, 20 bp, Homo sapiens
tagtatttataatataaatc

SEQ ID NO: 6411616 - DNA, 16 bp, Homo sapiens
tagtatttatttaatg

SEQ ID NO: 6411617 - DNA, 19 bp, Homo sapiens
tagtatttctatgaaatat

SEQ ID NO: 6411618 - DNA, 19 bp, Homo sapiens
tagtatttctcctttgcaa

SEQ ID NO: 6411619 - DNA, 20 bp, Homo sapiens
tagtatttctcctttgcaat

SEQ ID NO: 6411620 - DNA, 13 bp, Homo sapiens
tagtatttgaatt

SEQ ID NO: 6411621 - DNA, 18 bp, Homo sapiens
tagtatttgaattaaaac

SEQ ID NO: 6411622 - DNA, 18 bp, Homo sapiens
tagtatttgtatcctggc

SEQ ID NO: 6411623 - DNA, 13 bp, Homo sapiens
tagtattttaaaa

SEQ ID NO: 6411624 - DNA, 13 bp, Homo sapiens
tagtattttctaa

SEQ ID NO: 6411625 - DNA, 14 bp, Homo sapiens
tagtattttctaaa

SEQ ID NO: 6411626 - DNA, 18 bp, Homo sapiens
tagtattttttacatttt

SEQ ID NO: 6411627 - DNA, 23 bp, Homo sapiens
tagtattttttacattttacaca

SEQ ID NO: 6411628 - DNA, 16 bp, Homo sapiens
tagtcaaaaattaaat

SEQ ID NO: 6411629 - DNA, 22 bp, Homo sapiens
tagtcaaaactatttttgtaaa

SEQ ID NO: 6411630 - DNA, 17 bp, Homo sapiens
tagtcaaacaaaaaaga

SEQ ID NO: 6411631 - DNA, 22 bp, Homo sapiens
tagtcaaacaaaaaagaaaagt

SEQ ID NO: 6411632 - DNA, 18 bp, Homo sapiens
tagtcaaaccataaactt

SEQ ID NO: 6411633 - DNA, 14 bp, Homo sapiens
tagtcaaatattta

SEQ ID NO: 6411634 - DNA, 15 bp, Homo sapiens
tagtcaactgctgtt

SEQ ID NO: 6411635 - DNA, 13 bp, Homo sapiens
tagtcaagaaaaa

SEQ ID NO: 6411636 - DNA, 23 bp, Homo sapiens
tagtcaaggtgctcaataaatat

SEQ ID NO: 6411637 - DNA, 15 bp, Homo sapiens
tagtcaataagaaaa

SEQ ID NO: 6411638 - DNA, 17 bp, Homo sapiens
tagtcaatcaaacaggg

SEQ ID NO: 6411639 - DNA, 15 bp, Homo sapiens
tagtcaatcaagtct

SEQ ID NO: 6411640 - DNA, 18 bp, Homo sapiens
tagtcaatgacatgaatt

SEQ ID NO: 6411641 - DNA, 19 bp, Homo sapiens
tagtcaatttctacttctg

SEQ ID NO: 6411642 - DNA, 18 bp, Homo sapiens
tagtcacaaaaatggtgg

SEQ ID NO: 6411643 - DNA, 15 bp, Homo sapiens
tagtcaccagagact

SEQ ID NO: 6411644 - DNA, 14 bp, Homo sapiens
tagtcaccttttaa

SEQ ID NO: 6411645 - DNA, 21 bp, Homo sapiens
tagtcaccttttaaatcctgt

SEQ ID NO: 6411646 - DNA, 14 bp, Homo sapiens
tagtcactgagaca

SEQ ID NO: 6411647 - DNA, 17 bp, Homo sapiens
tagtcactgagacagcc

SEQ ID NO: 6411648 - DNA, 18 bp, Homo sapiens
tagtcactggcagcctgc

SEQ ID NO: 6411649 - DNA, 20 bp, Homo sapiens
tagtcagaaatgattcaggg

SEQ ID NO: 6411650 - DNA, 15 bp, Homo sapiens
tagtcagaagcaggt

SEQ ID NO: 6411651 - DNA, 19 bp, Homo sapiens
tagtcagactgacactact

SEQ ID NO: 6411652 - DNA, 14 bp, Homo sapiens
tagtcagatggatg

SEQ ID NO: 6411653 - DNA, 13 bp, Homo sapiens
tagtcagcgcagt

SEQ ID NO: 6411654 - DNA, 15 bp, Homo sapiens
tagtcagctgccttt

SEQ ID NO: 6411655 - DNA, 21 bp, Homo sapiens
tagtcaggtgcctcaagagaa

SEQ ID NO: 6411656 - DNA, 23 bp, Homo sapiens
tagtcagtgtcgtttatattgta

SEQ ID NO: 6411657 - DNA, 15 bp, Homo sapiens
tagtcataaaatagt

SEQ ID NO: 6411658 - DNA, 16 bp, Homo sapiens
tagtcataactagatt

SEQ ID NO: 6411659 - DNA, 16 bp, Homo sapiens
tagtcatatgtgaaga

SEQ ID NO: 6411660 - DNA, 22 bp, Homo sapiens
tagtcatatttttgtaaatatg

SEQ ID NO: 6411661 - DNA, 13 bp, Homo sapiens
tagtcatctccta

SEQ ID NO: 6411662 - DNA, 20 bp, Homo sapiens
tagtcatgctgctagatctt

SEQ ID NO: 6411663 - DNA, 21 bp, Homo sapiens
tagtcatgctgctagatcttt

SEQ ID NO: 6411664 - DNA, 13 bp, Homo sapiens
tagtcatgtgacc

SEQ ID NO: 6411665 - DNA, 21 bp, Homo sapiens
tagtcatgtttctgcagtatt

SEQ ID NO: 6411666 - DNA, 15 bp, Homo sapiens
tagtcattaaaaaca

SEQ ID NO: 6411667 - DNA, 21 bp, Homo sapiens
tagtcattctgcctgccctga

SEQ ID NO: 6411668 - DNA, 15 bp, Homo sapiens
tagtcattcttccct

SEQ ID NO: 6411669 - DNA, 15 bp, Homo sapiens
tagtcattgatagaa

SEQ ID NO: 6411670 - DNA, 13 bp, Homo sapiens
tagtcatttattt

SEQ ID NO: 6411671 - DNA, 13 bp, Homo sapiens
tagtccaaaatta

SEQ ID NO: 6411672 - DNA, 15 bp, Homo sapiens
tagtccaatatttgg

SEQ ID NO: 6411673 - DNA, 16 bp, Homo sapiens
tagtccaatatttggc

SEQ ID NO: 6411674 - DNA, 21 bp, Homo sapiens
tagtccaatcacccccaggac

SEQ ID NO: 6411675 - DNA, 15 bp, Homo sapiens
tagtccaatgaagat

SEQ ID NO: 6411676 - DNA, 20 bp, Homo sapiens
tagtccaatgaagataaatg

SEQ ID NO: 6411677 - DNA, 22 bp, Homo sapiens
tagtccaatgaagataaatgct

SEQ ID NO: 6411678 - DNA, 19 bp, Homo sapiens
tagtccagagaactgacat

SEQ ID NO: 6411679 - DNA, 16 bp, Homo sapiens
tagtccagccttccag

SEQ ID NO: 6411680 - DNA, 23 bp, Homo sapiens
tagtccatggacaatataaactg

SEQ ID NO: 6411681 - DNA, 20 bp, Homo sapiens
tagtcccaccctatggccac

SEQ ID NO: 6411682 - DNA, 23 bp, Homo sapiens
tagtcccaccttggagcatttat

SEQ ID NO: 6411683 - DNA, 15 bp, Homo sapiens
tagtcccagctactc

SEQ ID NO: 6411684 - DNA, 22 bp, Homo sapiens
tagtccccaaggcctctctctg

SEQ ID NO: 6411685 - DNA, 21 bp, Homo sapiens
tagtcccccaactctgagccc

SEQ ID NO: 6411686 - DNA, 22 bp, Homo sapiens
tagtccccccagctctaagcag

SEQ ID NO: 6411687 - DNA, 21 bp, Homo sapiens
tagtccccctgttttctgttt

SEQ ID NO: 6411688 - DNA, 18 bp, Homo sapiens
tagtccctcatgcaaatc

SEQ ID NO: 6411689 - DNA, 16 bp, Homo sapiens
tagtccctgccacgaa

SEQ ID NO: 6411690 - DNA, 14 bp, Homo sapiens
tagtccctgtgttc

SEQ ID NO: 6411691 - DNA, 16 bp, Homo sapiens
tagtcccttcccctcc

SEQ ID NO: 6411692 - DNA, 20 bp, Homo sapiens
tagtcccttcccctccctgg

SEQ ID NO: 6411693 - DNA, 22 bp, Homo sapiens
tagtcccttcccctccctggct

SEQ ID NO: 6411694 - DNA, 17 bp, Homo sapiens
tagtcccttctctcttt

SEQ ID NO: 6411695 - DNA, 21 bp, Homo sapiens
tagtccgcaagttcagggaag

SEQ ID NO: 6411696 - DNA, 17 bp, Homo sapiens
tagtccgtcctggcaca

SEQ ID NO: 6411697 - DNA, 22 bp, Homo sapiens
tagtccgtgctgacagctgctc

SEQ ID NO: 6411698 - DNA, 23 bp, Homo sapiens
tagtcctagctgacgccaataat

SEQ ID NO: 6411699 - DNA, 16 bp, Homo sapiens
tagtcctatggaaaaa

SEQ ID NO: 6411700 - DNA, 22 bp, Homo sapiens
tagtcctattctattgcagtta

SEQ ID NO: 6411701 - DNA, 13 bp, Homo sapiens
tagtcctcacctt

SEQ ID NO: 6411702 - DNA, 20 bp, Homo sapiens
tagtcctcaccttctgtttt

SEQ ID NO: 6411703 - DNA, 15 bp, Homo sapiens
tagtcctccaaaaca

SEQ ID NO: 6411704 - DNA, 17 bp, Homo sapiens
tagtcctccaaaacaca

SEQ ID NO: 6411705 - DNA, 14 bp, Homo sapiens
tagtcctcccaagc

SEQ ID NO: 6411706 - DNA, 18 bp, Homo sapiens
tagtcctcccaagctgtg

SEQ ID NO: 6411707 - DNA, 23 bp, Homo sapiens
tagtcctcccaagctgtgctggg

SEQ ID NO: 6411708 - DNA, 16 bp, Homo sapiens
tagtcctggcagctgg

SEQ ID NO: 6411709 - DNA, 13 bp, Homo sapiens
tagtcctgggaga

SEQ ID NO: 6411710 - DNA, 21 bp, Homo sapiens
tagtcctgggagaggacaggg

SEQ ID NO: 6411711 - DNA, 11 bp, Homo sapiens
tagtcctgtga

SEQ ID NO: 6411712 - DNA, 13 bp, Homo sapiens
tagtccttggcat

SEQ ID NO: 6411713 - DNA, 21 bp, Homo sapiens
tagtcctttataagttgcttt

SEQ ID NO: 6411714 - DNA, 17 bp, Homo sapiens
tagtcctttctgccttg

SEQ ID NO: 6411715 - DNA, 13 bp, Homo sapiens
tagtcgggacttg

SEQ ID NO: 6411716 - DNA, 15 bp, Homo sapiens
tagtcgggcatgagt

SEQ ID NO: 6411717 - DNA, 21 bp, Homo sapiens
tagtcgtgagctcttgtgagg

SEQ ID NO: 6411718 - DNA, 17 bp, Homo sapiens
tagtctaacacagttga

SEQ ID NO: 6411719 - DNA, 21 bp, Homo sapiens
tagtctaacacagttgaccct

SEQ ID NO: 6411720 - DNA, 17 bp, Homo sapiens
tagtctaaccaaatgca

SEQ ID NO: 6411721 - DNA, 17 bp, Homo sapiens
tagtctaagactatata

SEQ ID NO: 6411722 - DNA, 20 bp, Homo sapiens
tagtctactcttaagccatc

SEQ ID NO: 6411723 - DNA, 18 bp, Homo sapiens
tagtctagatggctcctc

SEQ ID NO: 6411724 - DNA, 20 bp, Homo sapiens
tagtctagatggctcctctc

SEQ ID NO: 6411725 - DNA, 16 bp, Homo sapiens
tagtctagtgtagtat

SEQ ID NO: 6411726 - DNA, 17 bp, Homo sapiens
tagtctatgtgattctg

SEQ ID NO: 6411727 - DNA, 15 bp, Homo sapiens
tagtctcagtgaaga

SEQ ID NO: 6411728 - DNA, 19 bp, Homo sapiens
tagtctcagtttgtgtgtc

SEQ ID NO: 6411729 - DNA, 16 bp, Homo sapiens
tagtctccctgtgtca

SEQ ID NO: 6411730 - DNA, 13 bp, Homo sapiens
tagtctcctttga

SEQ ID NO: 6411731 - DNA, 20 bp, Homo sapiens
tagtctcctttgcactgagg

SEQ ID NO: 6411732 - DNA, 21 bp, Homo sapiens
tagtctcctttgcactgaggg

SEQ ID NO: 6411733 - DNA, 22 bp, Homo sapiens
tagtctcctttgcactgagggc

SEQ ID NO: 6411734 - DNA, 17 bp, Homo sapiens
tagtctcgctaaagtta

SEQ ID NO: 6411735 - DNA, 13 bp, Homo sapiens
tagtctctgattt

SEQ ID NO: 6411736 - DNA, 19 bp, Homo sapiens
tagtctctgccctcataga

SEQ ID NO: 6411737 - DNA, 18 bp, Homo sapiens
tagtctctgggtttacaa

SEQ ID NO: 6411738 - DNA, 17 bp, Homo sapiens
tagtctctgttcttcat

SEQ ID NO: 6411739 - DNA, 12 bp, Homo sapiens
tagtctctttat

SEQ ID NO: 6411740 - DNA, 17 bp, Homo sapiens
tagtctgaaactggctt

SEQ ID NO: 6411741 - DNA, 21 bp, Homo sapiens
tagtctgaagtgaagtacaga

SEQ ID NO: 6411742 - DNA, 11 bp, Homo sapiens
tagtctggaaa

SEQ ID NO: 6411743 - DNA, 21 bp, Homo sapiens
tagtctggaactgctgctgac

SEQ ID NO: 6411744 - DNA, 22 bp, Homo sapiens
tagtctgggtcagacccatctc

SEQ ID NO: 6411745 - DNA, 23 bp, Homo sapiens
tagtctggtgttctgagtacttg

SEQ ID NO: 6411746 - DNA, 12 bp, Homo sapiens
tagtctggtttc

SEQ ID NO: 6411747 - DNA, 15 bp, Homo sapiens
tagtctgtacttcag

SEQ ID NO: 6411748 - DNA, 13 bp, Homo sapiens
tagtctgtcatcc

SEQ ID NO: 6411749 - DNA, 22 bp, Homo sapiens
tagtctgtgtaactttaaacat

SEQ ID NO: 6411750 - DNA, 18 bp, Homo sapiens
tagtctgtgtgcacaatg

SEQ ID NO: 6411751 - DNA, 17 bp, Homo sapiens
tagtctgtgtgctgtgg

SEQ ID NO: 6411752 - DNA, 23 bp, Homo sapiens
tagtctgtgtgggactgtacaca

SEQ ID NO: 6411753 - DNA, 19 bp, Homo sapiens
tagtctgtttcattactgc

SEQ ID NO: 6411754 - DNA, 20 bp, Homo sapiens
tagtcttatgaatagacata

SEQ ID NO: 6411755 - DNA, 23 bp, Homo sapiens
tagtcttatgaatagacataaat

SEQ ID NO: 6411756 - DNA, 14 bp, Homo sapiens
tagtcttatgtaaa

SEQ ID NO: 6411757 - DNA, 17 bp, Homo sapiens
tagtcttatgtaaagta

SEQ ID NO: 6411758 - DNA, 17 bp, Homo sapiens
tagtcttcaagcagatt

SEQ ID NO: 6411759 - DNA, 22 bp, Homo sapiens
tagtcttcagtttcattttcct

SEQ ID NO: 6411760 - DNA, 14 bp, Homo sapiens
tagtcttctcatag

SEQ ID NO: 6411761 - DNA, 22 bp, Homo sapiens
tagtcttgaaatgaaagggaaa

SEQ ID NO: 6411762 - DNA, 15 bp, Homo sapiens
tagtcttgacctctc

SEQ ID NO: 6411763 - DNA, 17 bp, Homo sapiens
tagtcttggctaaggaa

SEQ ID NO: 6411764 - DNA, 17 bp, Homo sapiens
tagtcttgtctcagatt

SEQ ID NO: 6411765 - DNA, 21 bp, Homo sapiens
tagtcttgtcttagctctgga

SEQ ID NO: 6411766 - DNA, 14 bp, Homo sapiens
tagtctttagaact

SEQ ID NO: 6411767 - DNA, 12 bp, Homo sapiens
tagtctttcaca

SEQ ID NO: 6411768 - DNA, 17 bp, Homo sapiens
tagtctttgtttacatg

SEQ ID NO: 6411769 - DNA, 15 bp, Homo sapiens
tagtcttttactcct

SEQ ID NO: 6411770 - DNA, 15 bp, Homo sapiens
tagtcttttgcatgt

SEQ ID NO: 6411771 - DNA, 19 bp, Homo sapiens
tagtcttttgcatgtcgca

SEQ ID NO: 6411772 - DNA, 12 bp, Homo sapiens
tagtcttttgct

SEQ ID NO: 6411773 - DNA, 14 bp, Homo sapiens
tagtcttttgcttt

SEQ ID NO: 6411774 - DNA, 16 bp, Homo sapiens
tagtcttttgcttttg

SEQ ID NO: 6411775 - DNA, 19 bp, Homo sapiens
tagtcttttgtaatatcaa

SEQ ID NO: 6411776 - DNA, 21 bp, Homo sapiens
tagtctttttttccttccttt

SEQ ID NO: 6411777 - DNA, 19 bp, Homo sapiens
tagtgaaaaactgctgtaa

SEQ ID NO: 6411778 - DNA, 23 bp, Homo sapiens
tagtgaaaaatctagtatttgta

SEQ ID NO: 6411779 - DNA, 18 bp, Homo sapiens
tagtgaaaattttattga

SEQ ID NO: 6411780 - DNA, 14 bp, Homo sapiens
tagtgaaacagctt

SEQ ID NO: 6411781 - DNA, 17 bp, Homo sapiens
tcccatgagcctcagca

SEQ ID NO: 6411782 - DNA, 18 bp, Homo sapiens
tcccatgagcctcagcat

SEQ ID NO: 6411783 - DNA, 19 bp, Homo sapiens
tcccatgagcctcagcatc

SEQ ID NO: 6411784 - DNA, 19 bp, Homo sapiens
tcccatgagggagatgcca

SEQ ID NO: 6411785 - DNA, 23 bp, Homo sapiens
tcccatgagggagatgccatgag

SEQ ID NO: 6411786 - DNA, 15 bp, Homo sapiens
tcccatgatccctgt

SEQ ID NO: 6411787 - DNA, 16 bp, Homo sapiens
tcccatgatccctgtg

SEQ ID NO: 6411788 - DNA, 13 bp, Homo sapiens
tcccatgatttca

SEQ ID NO: 6411789 - DNA, 14 bp, Homo sapiens
tcccatgatttcat

SEQ ID NO: 6411790 - DNA, 21 bp, Homo sapiens
tcccatgcacaactctccaaa

SEQ ID NO: 6411791 - DNA, 23 bp, Homo sapiens
tcccatgcacacaaacacctcct

SEQ ID NO: 6411792 - DNA, 15 bp, Homo sapiens
tcccatgcaggccct

SEQ ID NO: 6411793 - DNA, 21 bp, Homo sapiens
tcccatgccggtacacagcca

SEQ ID NO: 6411794 - DNA, 15 bp, Homo sapiens
tcccatgcctggtcc

SEQ ID NO: 6411795 - DNA, 19 bp, Homo sapiens
tcccatgcctggtcccaag

SEQ ID NO: 6411796 - DNA, 14 bp, Homo sapiens
tcccatgctccacc

SEQ ID NO: 6411797 - DNA, 16 bp, Homo sapiens
tcccatgctgaattat

SEQ ID NO: 6411798 - DNA, 17 bp, Homo sapiens
tcccatgctgaattatt

SEQ ID NO: 6411799 - DNA, 15 bp, Homo sapiens
tcccatggacactcc

SEQ ID NO: 6411800 - DNA, 15 bp, Homo sapiens
tcccatggcccagca

SEQ ID NO: 6411801 - DNA, 17 bp, Homo sapiens
tcccatggcccagcagc

SEQ ID NO: 6411802 - DNA, 15 bp, Homo sapiens
tcccatggctctggg

SEQ ID NO: 6411803 - DNA, 18 bp, Homo sapiens
tcccatggctgaagctgg

SEQ ID NO: 6411804 - DNA, 19 bp, Homo sapiens
tcccatggctgaagctgga

SEQ ID NO: 6411805 - DNA, 22 bp, Homo sapiens
tcccatggctgaagctggagca

SEQ ID NO: 6411806 - DNA, 17 bp, Homo sapiens
tcccatggctttgtgct

SEQ ID NO: 6411807 - DNA, 21 bp, Homo sapiens
tcccatggctttgtgctgctg

SEQ ID NO: 6411808 - DNA, 19 bp, Homo sapiens
tcccatgggctctggcccc

SEQ ID NO: 6411809 - DNA, 21 bp, Homo sapiens
tcccatggggaaaccctggag

SEQ ID NO: 6411810 - DNA, 14 bp, Homo sapiens
tcccatggggaggg

SEQ ID NO: 6411811 - DNA, 21 bp, Homo sapiens
tcccatgggggcacttgagtt

SEQ ID NO: 6411812 - DNA, 20 bp, Homo sapiens
tcccatggtagactgtgaca

SEQ ID NO: 6411813 - DNA, 15 bp, Homo sapiens
tcccatggtggcctc

SEQ ID NO: 6411814 - DNA, 15 bp, Homo sapiens
tcccatgtaacagaa

SEQ ID NO: 6411815 - DNA, 21 bp, Homo sapiens
tcccatgtagccccctggcct

SEQ ID NO: 6411816 - DNA, 16 bp, Homo sapiens
tcccatgtatttgtta

SEQ ID NO: 6411817 - DNA, 22 bp, Homo sapiens
tcccatgtatttgttatatata

SEQ ID NO: 6411818 - DNA, 19 bp, Homo sapiens
tcccatgtgagtccctgtg

SEQ ID NO: 6411819 - DNA, 10 bp, Homo sapiens
tcccatgtgg

SEQ ID NO: 6411820 - DNA, 17 bp, Homo sapiens
tcccatgtgtgatgctg

SEQ ID NO: 6411821 - DNA, 22 bp, Homo sapiens
tcccatgtgtgatgctgacacc

SEQ ID NO: 6411822 - DNA, 14 bp, Homo sapiens
tcccatgttcaagc

SEQ ID NO: 6411823 - DNA, 20 bp, Homo sapiens
tcccatgttgcatgcctatg

SEQ ID NO: 6411824 - DNA, 12 bp, Homo sapiens
tcccattaaaaa

SEQ ID NO: 6411825 - DNA, 22 bp, Homo sapiens
tcccattactcaaaatgcagga

SEQ ID NO: 6411826 - DNA, 23 bp, Homo sapiens
tcccattaggacaatcagtcccc

SEQ ID NO: 6411827 - DNA, 21 bp, Homo sapiens
tcccattattatttctgttct

SEQ ID NO: 6411828 - DNA, 13 bp, Homo sapiens
tcccattattcaa

SEQ ID NO: 6411829 - DNA, 19 bp, Homo sapiens
tcccattattcaaagttgc

SEQ ID NO: 6411830 - DNA, 16 bp, Homo sapiens
tcccattcaagattcc

SEQ ID NO: 6411831 - DNA, 19 bp, Homo sapiens
tcccattcactcttccaga

SEQ ID NO: 6411832 - DNA, 18 bp, Homo sapiens
tcccattcacttctgcat

SEQ ID NO: 6411833 - DNA, 19 bp, Homo sapiens
tcccattcacttctgcatt

SEQ ID NO: 6411834 - DNA, 21 bp, Homo sapiens
tcccattcatattaagacagt

SEQ ID NO: 6411835 - DNA, 11 bp, Homo sapiens
tcccattccag

SEQ ID NO: 6411836 - DNA, 13 bp, Homo sapiens
tcccattccaggc

SEQ ID NO: 6411837 - DNA, 19 bp, Homo sapiens
tcccattcccccagtgcgg

SEQ ID NO: 6411838 - DNA, 15 bp, Homo sapiens
tcccattccccttaa

SEQ ID NO: 6411839 - DNA, 21 bp, Homo sapiens
tcccattcctccactctgtat

SEQ ID NO: 6411840 - DNA, 15 bp, Homo sapiens
tcccattcctccctc

SEQ ID NO: 6411841 - DNA, 13 bp, Homo sapiens
tcccattcctgaa

SEQ ID NO: 6411842 - DNA, 14 bp, Homo sapiens
tcccattcctgaag

SEQ ID NO: 6411843 - DNA, 20 bp, Homo sapiens
tcccattctagatcctgcac

SEQ ID NO: 6411844 - DNA, 15 bp, Homo sapiens
tcccattctgcccca

SEQ ID NO: 6411845 - DNA, 20 bp, Homo sapiens
tcccattgaaaatgtaagta

SEQ ID NO: 6411846 - DNA, 22 bp, Homo sapiens
tcccattgcatcacctctgtaa

SEQ ID NO: 6411847 - DNA, 13 bp, Homo sapiens
tcccattgcccag

SEQ ID NO: 6411848 - DNA, 16 bp, Homo sapiens
tcccattggatgcatt

SEQ ID NO: 6411849 - DNA, 20 bp, Homo sapiens
tcccattggatgcatttcta

SEQ ID NO: 6411850 - DNA, 14 bp, Homo sapiens
tcccattggctttc

SEQ ID NO: 6411851 - DNA, 14 bp, Homo sapiens
tcccattgtattta

SEQ ID NO: 6411852 - DNA, 22 bp, Homo sapiens
tcccattgtatttaaaacattt

SEQ ID NO: 6411853 - DNA, 16 bp, Homo sapiens
tcccattgtccctctg

SEQ ID NO: 6411854 - DNA, 18 bp, Homo sapiens
tcccattgtccctctgcc

SEQ ID NO: 6411855 - DNA, 19 bp, Homo sapiens
tcccattgtgcagaaaagc

SEQ ID NO: 6411856 - DNA, 17 bp, Homo sapiens
tcccatttactcttgag

SEQ ID NO: 6411857 - DNA, 15 bp, Homo sapiens
tcccatttagtgtga

SEQ ID NO: 6411858 - DNA, 18 bp, Homo sapiens
tcccatttagtgtgaata

SEQ ID NO: 6411859 - DNA, 20 bp, Homo sapiens
tcccatttagtgtgaatatt

SEQ ID NO: 6411860 - DNA, 17 bp, Homo sapiens
tcccatttatctaaata

SEQ ID NO: 6411861 - DNA, 21 bp, Homo sapiens
tcccatttattattttaatat

SEQ ID NO: 6411862 - DNA, 14 bp, Homo sapiens
tcccatttcaggaa

SEQ ID NO: 6411863 - DNA, 15 bp, Homo sapiens
tcccatttcctgatc

SEQ ID NO: 6411864 - DNA, 23 bp, Homo sapiens
tcccatttccttgtctaaagatc

SEQ ID NO: 6411865 - DNA, 24 bp, Homo sapiens
tcccatttctaaaggcctcttcct

SEQ ID NO: 6411866 - DNA, 14 bp, Homo sapiens
tcccatttctactc

SEQ ID NO: 6411867 - DNA, 15 bp, Homo sapiens
tcccatttctgttgc

SEQ ID NO: 6411868 - DNA, 23 bp, Homo sapiens
tcccatttctgttgctggagggg

SEQ ID NO: 6411869 - DNA, 18 bp, Homo sapiens
tcccatttcttgctagct

SEQ ID NO: 6411870 - DNA, 12 bp, Homo sapiens
tcccatttgtaa

SEQ ID NO: 6411871 - DNA, 19 bp, Homo sapiens
tcccatttgtaatgtatct

SEQ ID NO: 6411872 - DNA, 17 bp, Homo sapiens
tcccatttgtgtttcag

SEQ ID NO: 6411873 - DNA, 14 bp, Homo sapiens
tcccattttagaaa

SEQ ID NO: 6411874 - DNA, 19 bp, Homo sapiens
tcccattttagaaaatcag

SEQ ID NO: 6411875 - DNA, 18 bp, Homo sapiens
tcccattttagatgttta

SEQ ID NO: 6411876 - DNA, 22 bp, Homo sapiens
tcccattttcagactgctttaa

SEQ ID NO: 6411877 - DNA, 17 bp, Homo sapiens
tcccattttcatcctga

SEQ ID NO: 6411878 - DNA, 16 bp, Homo sapiens
tcccattttccccttc

SEQ ID NO: 6411879 - DNA, 18 bp, Homo sapiens
tcccattttggaagtttt

SEQ ID NO: 6411880 - DNA, 14 bp, Homo sapiens
tccccaaaaattga

SEQ ID NO: 6411881 - DNA, 21 bp, Homo sapiens
tccccaaaacaaagtctttgg

SEQ ID NO: 6411882 - DNA, 14 bp, Homo sapiens
tccccaaaagaaac

SEQ ID NO: 6411883 - DNA, 22 bp, Homo sapiens
tccccaaaagaaaccatgacaa

SEQ ID NO: 6411884 - DNA, 17 bp, Homo sapiens
tccccaaacccatcaga

SEQ ID NO: 6411885 - DNA, 18 bp, Homo sapiens
tccccaaacccatcagac

SEQ ID NO: 6411886 - DNA, 15 bp, Homo sapiens
tccccaaactgtgcc

SEQ ID NO: 6411887 - DNA, 22 bp, Homo sapiens
tccccaaactgtgccctgcctt

SEQ ID NO: 6411888 - DNA, 23 bp, Homo sapiens
tccccaaactgtgccctgccttc

SEQ ID NO: 6411889 - DNA, 22 bp, Homo sapiens
tccccaaagccactggaaggag

SEQ ID NO: 6411890 - DNA, 22 bp, Homo sapiens
tccccaaaggaaccgcccagtg

SEQ ID NO: 6411891 - DNA, 21 bp, Homo sapiens
tccccaaaggtccgcaccctg

SEQ ID NO: 6411892 - DNA, 10 bp, Homo sapiens
tccccaaagt

SEQ ID NO: 6411893 - DNA, 18 bp, Homo sapiens
tccccaaatcaatacact

SEQ ID NO: 6411894 - DNA, 23 bp, Homo sapiens
tccccaaatcaatacactagttg

SEQ ID NO: 6411895 - DNA, 22 bp, Homo sapiens
tccccaacaattggagggtctt

SEQ ID NO: 6411896 - DNA, 16 bp, Homo sapiens
tccccaacacctgcct

SEQ ID NO: 6411897 - DNA, 21 bp, Homo sapiens
tccccaacacctgcctctgac

SEQ ID NO: 6411898 - DNA, 20 bp, Homo sapiens
tccccaacagcgcccaaagg

SEQ ID NO: 6411899 - DNA, 21 bp, Homo sapiens
tccccaacagtgtgaagttag

SEQ ID NO: 6411900 - DNA, 16 bp, Homo sapiens
tccccaacatggatgt

SEQ ID NO: 6411901 - DNA, 18 bp, Homo sapiens
tccccaacatgtaataag

SEQ ID NO: 6411902 - DNA, 16 bp, Homo sapiens
tccccaaccacagaga

SEQ ID NO: 6411903 - DNA, 17 bp, Homo sapiens
tccccaaccacagagaa

SEQ ID NO: 6411904 - DNA, 23 bp, Homo sapiens
tccccaacccccattctcatctg

SEQ ID NO: 6411905 - DNA, 23 bp, Homo sapiens
tccccaaccccctgtaaggttcc

SEQ ID NO: 6411906 - DNA, 13 bp, Homo sapiens
tccccaacccctc

SEQ ID NO: 6411907 - DNA, 22 bp, Homo sapiens
tccccaacccctctccaggcct

SEQ ID NO: 6411908 - DNA, 23 bp, Homo sapiens
tccccaacccgtgcccctgggat

SEQ ID NO: 6411909 - DNA, 20 bp, Homo sapiens
tccccaaccctaggttccct

SEQ ID NO: 6411910 - DNA, 22 bp, Homo sapiens
tccccaaccctaggttccctgt

SEQ ID NO: 6411911 - DNA, 17 bp, Homo sapiens
tccccaaccctgcccct

SEQ ID NO: 6411912 - DNA, 20 bp, Homo sapiens
tccccaacggggtggggagg

SEQ ID NO: 6411913 - DNA, 21 bp, Homo sapiens
tccccaacggggtggggaggg

SEQ ID NO: 6411914 - DNA, 16 bp, Homo sapiens
tccccaacgtcccctc

SEQ ID NO: 6411915 - DNA, 20 bp, Homo sapiens
tccccaacgtcccctccgcc

SEQ ID NO: 6411916 - DNA, 23 bp, Homo sapiens
tccccaacgtcccctccgccgtg

SEQ ID NO: 6411917 - DNA, 11 bp, Homo sapiens
tccccaactcc

SEQ ID NO: 6411918 - DNA, 20 bp, Homo sapiens
tccccaactccttcctcttt

SEQ ID NO: 6411919 - DNA, 22 bp, Homo sapiens
tccccaactccttcctctttgc

SEQ ID NO: 6411920 - DNA, 14 bp, Homo sapiens
tccccaactgacca

SEQ ID NO: 6411921 - DNA, 14 bp, Homo sapiens
tccccaactgctcc

SEQ ID NO: 6411922 - DNA, 22 bp, Homo sapiens
tccccaactgctccagcctctg

SEQ ID NO: 6411923 - DNA, 19 bp, Homo sapiens
tccccaacttccctagtcc

SEQ ID NO: 6411924 - DNA, 15 bp, Homo sapiens
tccccaagactgtca

SEQ ID NO: 6411925 - DNA, 14 bp, Homo sapiens
tccccaagatctgc

SEQ ID NO: 6411926 - DNA, 20 bp, Homo sapiens
tccccaagatctgccagacc

SEQ ID NO: 6411927 - DNA, 23 bp, Homo sapiens
tccccaagattcacacctgactc

SEQ ID NO: 6411928 - DNA, 15 bp, Homo sapiens
tccccaagcccacca

SEQ ID NO: 6411929 - DNA, 15 bp, Homo sapiens
tccccaagcctggca

SEQ ID NO: 6411930 - DNA, 20 bp, Homo sapiens
tccccaagcgcctggctgct

SEQ ID NO: 6411931 - DNA, 14 bp, Homo sapiens
tccccaaggaccca

SEQ ID NO: 6411932 - DNA, 17 bp, Homo sapiens
tccccaaggacccagcc

SEQ ID NO: 6411933 - DNA, 20 bp, Homo sapiens
tccccaaggacccagccctc

SEQ ID NO: 6411934 - DNA, 14 bp, Homo sapiens
tccccaaggcactg

SEQ ID NO: 6411935 - DNA, 20 bp, Homo sapiens
tccccaaggcactgagcgcc

SEQ ID NO: 6411936 - DNA, 13 bp, Homo sapiens
tccccaaggcctc

SEQ ID NO: 6411937 - DNA, 18 bp, Homo sapiens
tccccaaggcctctcacc

SEQ ID NO: 6411938 - DNA, 16 bp, Homo sapiens
tccccaaggcctctct

SEQ ID NO: 6411939 - DNA, 19 bp, Homo sapiens
tccccaaggcctctctctg

SEQ ID NO: 6411940 - DNA, 20 bp, Homo sapiens
tccccaaggcctctctctgc

SEQ ID NO: 6411941 - DNA, 16 bp, Homo sapiens
tccccaagggccctgg

SEQ ID NO: 6411942 - DNA, 23 bp, Homo sapiens
tccccaagtggtttccacatgct

SEQ ID NO: 6411943 - DNA, 15 bp, Homo sapiens
tccccaataaagcct

SEQ ID NO: 6411944 - DNA, 20 bp, Homo sapiens
tccccaataaagccttttaa

SEQ ID NO: 6411945 - DNA, 23 bp, Homo sapiens
tccccaatacctaataaggcatg

SEQ ID NO: 6411946 - DNA, 20 bp, Homo sapiens
tccccaatccatttggcaga

SEQ ID NO: 6411947 - DNA, 14 bp, Homo sapiens
tccccaatgctctc

SEQ ID NO: 6411948 - DNA, 22 bp, Homo sapiens
tccccaattacagggtgactca

SEQ ID NO: 6411949 - DNA, 16 bp, Homo sapiens
tccccacacagggcac

SEQ ID NO: 6411950 - DNA, 17 bp, Homo sapiens
tccccacacagggcact

SEQ ID NO: 6411951 - DNA, 19 bp, Homo sapiens
tccccacaccctggagtgg

SEQ ID NO: 6411952 - DNA, 20 bp, Homo sapiens
tccccacaccttccagggcc

SEQ ID NO: 6411953 - DNA, 13 bp, Homo sapiens
tccccacactcca

SEQ ID NO: 6411954 - DNA, 18 bp, Homo sapiens
tccccacactccactctg

SEQ ID NO: 6411955 - DNA, 22 bp, Homo sapiens
tccccacactccactctgattc

SEQ ID NO: 6411956 - DNA, 12 bp, Homo sapiens
tccccacagaac

SEQ ID NO: 6411957 - DNA, 20 bp, Homo sapiens
tagtgaaacagctttctggg

SEQ ID NO: 6411958 - DNA, 24 bp, Homo sapiens
tagtgaaaccccatctctactgaa

SEQ ID NO: 6411959 - DNA, 13 bp, Homo sapiens
tagtgaaactttt

SEQ ID NO: 6411960 - DNA, 19 bp, Homo sapiens
tagtgaaacttttctagaa

SEQ ID NO: 6411961 - DNA, 21 bp, Homo sapiens
tagtgaaaggaagataaacgt

SEQ ID NO: 6411962 - DNA, 22 bp, Homo sapiens
tagtgaaataaattctgattct

SEQ ID NO: 6411963 - DNA, 16 bp, Homo sapiens
tagtgaaatggctggg

SEQ ID NO: 6411964 - DNA, 23 bp, Homo sapiens
tagtgaaatggctggggccgctg

SEQ ID NO: 6411965 - DNA, 16 bp, Homo sapiens
tagtgaacacagcaga

SEQ ID NO: 6411966 - DNA, 18 bp, Homo sapiens
tagtgaacacagcagacc

SEQ ID NO: 6411967 - DNA, 20 bp, Homo sapiens
tagtgaacacagcagaccta

SEQ ID NO: 6411968 - DNA, 20 bp, Homo sapiens
tagtgaaccaaaaatagaaa

SEQ ID NO: 6411969 - DNA, 13 bp, Homo sapiens
tagtgaagaatag

SEQ ID NO: 6411970 - DNA, 18 bp, Homo sapiens
tagtgaagactccagaaa

SEQ ID NO: 6411971 - DNA, 22 bp, Homo sapiens
tagtgaagtgttaatacatcac

SEQ ID NO: 6411972 - DNA, 18 bp, Homo sapiens
tagtgaatactgctacag

SEQ ID NO: 6411973 - DNA, 13 bp, Homo sapiens
tagtgaatgggaa

SEQ ID NO: 6411974 - DNA, 20 bp, Homo sapiens
tagtgacaaaattggccaga

SEQ ID NO: 6411975 - DNA, 14 bp, Homo sapiens
tagtgacacacact

SEQ ID NO: 6411976 - DNA, 18 bp, Homo sapiens
tagtgacccggaggccac

SEQ ID NO: 6411977 - DNA, 20 bp, Homo sapiens
tagtgacccggaggccacat

SEQ ID NO: 6411978 - DNA, 11 bp, Homo sapiens
tagtgactttt

SEQ ID NO: 6411979 - DNA, 18 bp, Homo sapiens
tagtgagacatcagggag

SEQ ID NO: 6411980 - DNA, 19 bp, Homo sapiens
tagtgagacatcagggagt

SEQ ID NO: 6411981 - DNA, 15 bp, Homo sapiens
tagtgagacccctgt

SEQ ID NO: 6411982 - DNA, 19 bp, Homo sapiens
tagtgagactagacatagt

SEQ ID NO: 6411983 - DNA, 15 bp, Homo sapiens
tagtgagatttaggg

SEQ ID NO: 6411984 - DNA, 18 bp, Homo sapiens
tagtgagcagtgagcaga

SEQ ID NO: 6411985 - DNA, 20 bp, Homo sapiens
tagtgagccactcagtctct

SEQ ID NO: 6411986 - DNA, 15 bp, Homo sapiens
tagtgagcgagtgga

SEQ ID NO: 6411987 - DNA, 21 bp, Homo sapiens
tagtgagcgagtggatgctgt

SEQ ID NO: 6411988 - DNA, 22 bp, Homo sapiens
tagtgagtgtggcttagtaata

SEQ ID NO: 6411989 - DNA, 14 bp, Homo sapiens
tagtgatacactgt

SEQ ID NO: 6411990 - DNA, 18 bp, Homo sapiens
tagtgatacactgtatct

SEQ ID NO: 6411991 - DNA, 22 bp, Homo sapiens
tagtgatacactgtatctaaaa

SEQ ID NO: 6411992 - DNA, 16 bp, Homo sapiens
tagtgatagatgtagt

SEQ ID NO: 6411993 - DNA, 16 bp, Homo sapiens
tagtgatatattttat

SEQ ID NO: 6411994 - DNA, 17 bp, Homo sapiens
tagtgatcaagaagact

SEQ ID NO: 6411995 - DNA, 15 bp, Homo sapiens
tagtgatcctgtcct

SEQ ID NO: 6411996 - DNA, 18 bp, Homo sapiens
tagtgatctgaacagaaa

SEQ ID NO: 6411997 - DNA, 12 bp, Homo sapiens
tagtgatgaaat

SEQ ID NO: 6411998 - DNA, 14 bp, Homo sapiens
tagtgatgaaatta

SEQ ID NO: 6411999 - DNA, 13 bp, Homo sapiens
tagtgatggttcc

SEQ ID NO: 6412000 - DNA, 14 bp, Homo sapiens
tagtgatggttccc

SEQ ID NO: 6412001 - DNA, 19 bp, Homo sapiens
tagtgatgtagaaagatac

SEQ ID NO: 6412002 - DNA, 21 bp, Homo sapiens
tagtgattccatcaaagagaa

SEQ ID NO: 6412003 - DNA, 18 bp, Homo sapiens
tagtgattctgatttcag

SEQ ID NO: 6412004 - DNA, 16 bp, Homo sapiens
tagtgattgtaacaaa

SEQ ID NO: 6412005 - DNA, 16 bp, Homo sapiens
tagtgatttacacagg

SEQ ID NO: 6412006 - DNA, 18 bp, Homo sapiens
tagtgatttacacaggtt

SEQ ID NO: 6412007 - DNA, 22 bp, Homo sapiens
tagtgatttccttaatgaaaaa

SEQ ID NO: 6412008 - DNA, 20 bp, Homo sapiens
tagtgatttttatgccacct

SEQ ID NO: 6412009 - DNA, 16 bp, Homo sapiens
tagtgcaaaaaacata

SEQ ID NO: 6412010 - DNA, 18 bp, Homo sapiens
tagtgcaaaaactgtaaa

SEQ ID NO: 6412011 - DNA, 12 bp, Homo sapiens
tagtgcaaaatg

SEQ ID NO: 6412012 - DNA, 18 bp, Homo sapiens
tagtgcaacatctctgaa

SEQ ID NO: 6412013 - DNA, 19 bp, Homo sapiens
tagtgcaagctttaacaga

SEQ ID NO: 6412014 - DNA, 14 bp, Homo sapiens
tagtgcaatatatt

SEQ ID NO: 6412015 - DNA, 17 bp, Homo sapiens
tagtgcaatatattttg

SEQ ID NO: 6412016 - DNA, 19 bp, Homo sapiens
tagtgcaatatattttgta

SEQ ID NO: 6412017 - DNA, 23 bp, Homo sapiens
tagtgcaattccaagaaaatatc

SEQ ID NO: 6412018 - DNA, 12 bp, Homo sapiens
tagtgcagctga

SEQ ID NO: 6412019 - DNA, 15 bp, Homo sapiens
tagtgcagctgaaat

SEQ ID NO: 6412020 - DNA, 20 bp, Homo sapiens
tagtgcagctgaaattgaaa

SEQ ID NO: 6412021 - DNA, 13 bp, Homo sapiens
tagtgcagctgat

SEQ ID NO: 6412022 - DNA, 17 bp, Homo sapiens
tagtgcagctgatttta

SEQ ID NO: 6412023 - DNA, 19 bp, Homo sapiens
tagtgcagctgattttaac

SEQ ID NO: 6412024 - DNA, 22 bp, Homo sapiens
tagtgcagtcaccctgtggcaa

SEQ ID NO: 6412025 - DNA, 13 bp, Homo sapiens
tagtgcatgtcac

SEQ ID NO: 6412026 - DNA, 14 bp, Homo sapiens
tagtgcatgtcaca

SEQ ID NO: 6412027 - DNA, 18 bp, Homo sapiens
tagtgcatttcaaggaat

SEQ ID NO: 6412028 - DNA, 19 bp, Homo sapiens
tagtgcatttttaaacttg

SEQ ID NO: 6412029 - DNA, 23 bp, Homo sapiens
tagtgcatttttaaacttgaaat

SEQ ID NO: 6412030 - DNA, 20 bp, Homo sapiens
tagtgccaaaaggccccttc

SEQ ID NO: 6412031 - DNA, 23 bp, Homo sapiens
tagtgccaaaaggccccttccca

SEQ ID NO: 6412032 - DNA, 20 bp, Homo sapiens
tagtgccaagtttttcagaa

SEQ ID NO: 6412033 - DNA, 13 bp, Homo sapiens
tagtgccaccaca

SEQ ID NO: 6412034 - DNA, 22 bp, Homo sapiens
tagtgccacttaatgtatgtta

SEQ ID NO: 6412035 - DNA, 15 bp, Homo sapiens
tagtgccatggccag

SEQ ID NO: 6412036 - DNA, 16 bp, Homo sapiens
tagtgccatggccagg

SEQ ID NO: 6412037 - DNA, 22 bp, Homo sapiens
tagtgccccctctaacccccag

SEQ ID NO: 6412038 - DNA, 20 bp, Homo sapiens
tagtgccctctttagccaga

SEQ ID NO: 6412039 - DNA, 19 bp, Homo sapiens
tagtgccctgccccctggc

SEQ ID NO: 6412040 - DNA, 20 bp, Homo sapiens
tagtgcctaaagtgctgcag

SEQ ID NO: 6412041 - DNA, 16 bp, Homo sapiens
tagtgcctcagcgctg

SEQ ID NO: 6412042 - DNA, 22 bp, Homo sapiens
tagtgcctcagcgctgcccaca

SEQ ID NO: 6412043 - DNA, 22 bp, Homo sapiens
tagtgcctgagagtatttaggc

SEQ ID NO: 6412044 - DNA, 24 bp, Homo sapiens
tagtgcctgtgatcgtgtgttgcc

SEQ ID NO: 6412045 - DNA, 23 bp, Homo sapiens
tagtgccttgattttaattcagg

SEQ ID NO: 6412046 - DNA, 15 bp, Homo sapiens
tagtgccttgcccac

SEQ ID NO: 6412047 - DNA, 16 bp, Homo sapiens
tagtgccttgcccaca

SEQ ID NO: 6412048 - DNA, 21 bp, Homo sapiens
tagtgcgatgtttcaggaggc

SEQ ID NO: 6412049 - DNA, 19 bp, Homo sapiens
tagtgcggacaagttttaa

SEQ ID NO: 6412050 - DNA, 15 bp, Homo sapiens
tagtgctaacatgaa

SEQ ID NO: 6412051 - DNA, 13 bp, Homo sapiens
tagtgctaagtgt

SEQ ID NO: 6412052 - DNA, 14 bp, Homo sapiens
tagtgctacagatg

SEQ ID NO: 6412053 - DNA, 22 bp, Homo sapiens
tagtgctatatatataaatatt

SEQ ID NO: 6412054 - DNA, 18 bp, Homo sapiens
tagtgctattctgtgttg

SEQ ID NO: 6412055 - DNA, 19 bp, Homo sapiens
tagtgctcgctttctatgt

SEQ ID NO: 6412056 - DNA, 17 bp, Homo sapiens
tagtgctgaagcttatt

SEQ ID NO: 6412057 - DNA, 18 bp, Homo sapiens
tagtgctgaagcttatta

SEQ ID NO: 6412058 - DNA, 19 bp, Homo sapiens
tagtgctgaagcttattaa

SEQ ID NO: 6412059 - DNA, 22 bp, Homo sapiens
tagtgctgctgtgtgctttttt

SEQ ID NO: 6412060 - DNA, 16 bp, Homo sapiens
tagtgctgtttaagct

SEQ ID NO: 6412061 - DNA, 22 bp, Homo sapiens
tagtgcttcagagtttgtgtgt

SEQ ID NO: 6412062 - DNA, 14 bp, Homo sapiens
tagtgcttcttgta

SEQ ID NO: 6412063 - DNA, 19 bp, Homo sapiens
tagtgcttttaaaaatttt

SEQ ID NO: 6412064 - DNA, 13 bp, Homo sapiens
tagtggaaaaaca

SEQ ID NO: 6412065 - DNA, 14 bp, Homo sapiens
tagtggaaaaacac

SEQ ID NO: 6412066 - DNA, 23 bp, Homo sapiens
tagtggaaagtgatttgtaatat

SEQ ID NO: 6412067 - DNA, 23 bp, Homo sapiens
tagtggaaatgagcgaaatcatg

SEQ ID NO: 6412068 - DNA, 19 bp, Homo sapiens
tagtggaagagcagcctga

SEQ ID NO: 6412069 - DNA, 19 bp, Homo sapiens
tagtggacttgttttaatt

SEQ ID NO: 6412070 - DNA, 23 bp, Homo sapiens
tagtggatgactgttgatgaagt

SEQ ID NO: 6412071 - DNA, 18 bp, Homo sapiens
tagtggatggaaggggct

SEQ ID NO: 6412072 - DNA, 19 bp, Homo sapiens
tagtggatggacagatgga

SEQ ID NO: 6412073 - DNA, 22 bp, Homo sapiens
tagtggatggacagatggacca

SEQ ID NO: 6412074 - DNA, 19 bp, Homo sapiens
tagtggccatcatttctgg

SEQ ID NO: 6412075 - DNA, 20 bp, Homo sapiens
tagtggcttaaaacaacact

SEQ ID NO: 6412076 - DNA, 18 bp, Homo sapiens
tagtggcttcagcccctg

SEQ ID NO: 6412077 - DNA, 18 bp, Homo sapiens
tagtgggcaccccactgc

SEQ ID NO: 6412078 - DNA, 20 bp, Homo sapiens
tagtgggccctctctctggg

SEQ ID NO: 6412079 - DNA, 20 bp, Homo sapiens
tagtggggaggggcctggcc

SEQ ID NO: 6412080 - DNA, 16 bp, Homo sapiens
tagtggggcctgggag

SEQ ID NO: 6412081 - DNA, 17 bp, Homo sapiens
tagtggggcctgggagg

SEQ ID NO: 6412082 - DNA, 20 bp, Homo sapiens
tagtggggtctccctctcct

SEQ ID NO: 6412083 - DNA, 22 bp, Homo sapiens
tagtggggtctccctctcctgc

SEQ ID NO: 6412084 - DNA, 11 bp, Homo sapiens
tagtgggtgag

SEQ ID NO: 6412085 - DNA, 14 bp, Homo sapiens
tagtggtagtatct

SEQ ID NO: 6412086 - DNA, 15 bp, Homo sapiens
tagtggtagtatctc

SEQ ID NO: 6412087 - DNA, 14 bp, Homo sapiens
tagtggtcataaaa

SEQ ID NO: 6412088 - DNA, 16 bp, Homo sapiens
tagtggtctttgtaag

SEQ ID NO: 6412089 - DNA, 19 bp, Homo sapiens
tagtggtctttgtaagagt

SEQ ID NO: 6412090 - DNA, 15 bp, Homo sapiens
tagtggtgagcatgt

SEQ ID NO: 6412091 - DNA, 13 bp, Homo sapiens
tagtggtggctct

SEQ ID NO: 6412092 - DNA, 18 bp, Homo sapiens
tagtggttaacagagcta

SEQ ID NO: 6412093 - DNA, 19 bp, Homo sapiens
tagtggttaacagagctaa

SEQ ID NO: 6412094 - DNA, 18 bp, Homo sapiens
tagtggttcttggaaaaa

SEQ ID NO: 6412095 - DNA, 20 bp, Homo sapiens
tagtggtttatcagcaaaaa

SEQ ID NO: 6412096 - DNA, 14 bp, Homo sapiens
tagtggtttgcttt

SEQ ID NO: 6412097 - DNA, 19 bp, Homo sapiens
tagtggttttaggatactt

SEQ ID NO: 6412098 - DNA, 13 bp, Homo sapiens
tagtgtaaaattg

SEQ ID NO: 6412099 - DNA, 15 bp, Homo sapiens
tagtgtaaacaaata

SEQ ID NO: 6412100 - DNA, 23 bp, Homo sapiens
tagtgtaacttgcttaaatttct

SEQ ID NO: 6412101 - DNA, 15 bp, Homo sapiens
tagtgtacattacca

SEQ ID NO: 6412102 - DNA, 18 bp, Homo sapiens
tagtgtacatttctataa

SEQ ID NO: 6412103 - DNA, 23 bp, Homo sapiens
tagtgtacatttctataaataga

SEQ ID NO: 6412104 - DNA, 15 bp, Homo sapiens
tagtgtaccaagtgc

SEQ ID NO: 6412105 - DNA, 21 bp, Homo sapiens
tagtgtacctcctctcagtgt

SEQ ID NO: 6412106 - DNA, 22 bp, Homo sapiens
tagtgtacctcctctcagtgtt

SEQ ID NO: 6412107 - DNA, 21 bp, Homo sapiens
tagtgtagattccatttactg

SEQ ID NO: 6412108 - DNA, 14 bp, Homo sapiens
tagtgtaggcttta

SEQ ID NO: 6412109 - DNA, 15 bp, Homo sapiens
tagtgtaggctttac

SEQ ID NO: 6412110 - DNA, 18 bp, Homo sapiens
tagtgtaggctttactta

SEQ ID NO: 6412111 - DNA, 14 bp, Homo sapiens
tagtgtataaaaac

SEQ ID NO: 6412112 - DNA, 22 bp, Homo sapiens
tagtgtataccacctgtacata

SEQ ID NO: 6412113 - DNA, 15 bp, Homo sapiens
tagtgtatactctgt

SEQ ID NO: 6412114 - DNA, 15 bp, Homo sapiens
tagtgtatatgtgat

SEQ ID NO: 6412115 - DNA, 14 bp, Homo sapiens
tagtgtattaatca

SEQ ID NO: 6412116 - DNA, 20 bp, Homo sapiens
tagtgtattaatctctgtgt

SEQ ID NO: 6412117 - DNA, 15 bp, Homo sapiens
tagtgtcacctttct

SEQ ID NO: 6412118 - DNA, 17 bp, Homo sapiens
tagtgtcacttacctag

SEQ ID NO: 6412119 - DNA, 21 bp, Homo sapiens
tagtgtcataaagattataat

SEQ ID NO: 6412120 - DNA, 20 bp, Homo sapiens
tagtgtcattcatatgagtt

SEQ ID NO: 6412121 - DNA, 23 bp, Homo sapiens
tagtgtccaggctggtctgaaac

SEQ ID NO: 6412122 - DNA, 13 bp, Homo sapiens
tagtgtcccccct

SEQ ID NO: 6412123 - DNA, 16 bp, Homo sapiens
tagtgtccccccttga

SEQ ID NO: 6412124 - DNA, 19 bp, Homo sapiens
tagtgtctctaagttatga

SEQ ID NO: 6412125 - DNA, 20 bp, Homo sapiens
tagtgtctctatttatgaga

SEQ ID NO: 6412126 - DNA, 19 bp, Homo sapiens
tagtgtctggatcagtaaa

SEQ ID NO: 6412127 - DNA, 13 bp, Homo sapiens
tagtgtctgtcca

SEQ ID NO: 6412128 - DNA, 11 bp, Homo sapiens
tagtgtgaaat

SEQ ID NO: 6412129 - DNA, 15 bp, Homo sapiens
tagtgtgaagttgat

SEQ ID NO: 6412130 - DNA, 22 bp, Homo sapiens
tagtgtgaatattaattagttt

SEQ ID NO: 6412131 - DNA, 17 bp, Homo sapiens
tagtgtgctcggacaca

SEQ ID NO: 6412132 - DNA, 15 bp, Homo sapiens
tagtgtgctgctgtt

SEQ ID NO: 6412133 - DNA, 18 bp, Homo sapiens
tagtgtggaaattaagaa

SEQ ID NO: 6412134 - DNA, 13 bp, Homo sapiens
tccccacagaact

SEQ ID NO: 6412135 - DNA, 13 bp, Homo sapiens
tccccacagactg

SEQ ID NO: 6412136 - DNA, 13 bp, Homo sapiens
tccccacagcctc

SEQ ID NO: 6412137 - DNA, 18 bp, Homo sapiens
tccccacagcgtccctgg

SEQ ID NO: 6412138 - DNA, 19 bp, Homo sapiens
tccccacagcgtccctggc

SEQ ID NO: 6412139 - DNA, 20 bp, Homo sapiens
tccccacagcgtccctggcg

SEQ ID NO: 6412140 - DNA, 18 bp, Homo sapiens
tccccacaggagccctgc

SEQ ID NO: 6412141 - DNA, 17 bp, Homo sapiens
tccccaccagagctgcc

SEQ ID NO: 6412142 - DNA, 20 bp, Homo sapiens
tccccaccagatgctgaaaa

SEQ ID NO: 6412143 - DNA, 13 bp, Homo sapiens
tccccaccagctc

SEQ ID NO: 6412144 - DNA, 21 bp, Homo sapiens
tccccaccagtgaatgaaagt

SEQ ID NO: 6412145 - DNA, 14 bp, Homo sapiens
tccccaccatctgc

SEQ ID NO: 6412146 - DNA, 15 bp, Homo sapiens
tccccaccatctgct

SEQ ID NO: 6412147 - DNA, 23 bp, Homo sapiens
tccccaccatctgctgtcttttc

SEQ ID NO: 6412148 - DNA, 13 bp, Homo sapiens
tccccacccacca

SEQ ID NO: 6412149 - DNA, 23 bp, Homo sapiens
tccccacccaccaaatgcctctg

SEQ ID NO: 6412150 - DNA, 23 bp, Homo sapiens
tccccacccaccaaccctcaggg

SEQ ID NO: 6412151 - DNA, 14 bp, Homo sapiens
tccccacccaccac

SEQ ID NO: 6412152 - DNA, 16 bp, Homo sapiens
tccccacccaccaccg

SEQ ID NO: 6412153 - DNA, 15 bp, Homo sapiens
tccccacccacccca

SEQ ID NO: 6412154 - DNA, 17 bp, Homo sapiens
tccccaccccaaccact

SEQ ID NO: 6412155 - DNA, 13 bp, Homo sapiens
tccccaccccacc

SEQ ID NO: 6412156 - DNA, 12 bp, Homo sapiens
tccccaccccat

SEQ ID NO: 6412157 - DNA, 17 bp, Homo sapiens
tccccacccccgctggg

SEQ ID NO: 6412158 - DNA, 19 bp, Homo sapiens
tccccacccccgctggggg

SEQ ID NO: 6412159 - DNA, 15 bp, Homo sapiens
tccccacccctaccc

SEQ ID NO: 6412160 - DNA, 21 bp, Homo sapiens
tccccacccctacccctggct

SEQ ID NO: 6412161 - DNA, 15 bp, Homo sapiens
tccccacccctgcct

SEQ ID NO: 6412162 - DNA, 17 bp, Homo sapiens
tccccacccctgccttt

SEQ ID NO: 6412163 - DNA, 19 bp, Homo sapiens
tccccacccctgcctttgt

SEQ ID NO: 6412164 - DNA, 18 bp, Homo sapiens
tccccacccgcctgcaga

SEQ ID NO: 6412165 - DNA, 18 bp, Homo sapiens
tccccaccctcccctctc

SEQ ID NO: 6412166 - DNA, 21 bp, Homo sapiens
tccccaccctcccctctcctg

SEQ ID NO: 6412167 - DNA, 19 bp, Homo sapiens
tccccaccctcctcttgga

SEQ ID NO: 6412168 - DNA, 15 bp, Homo sapiens
tccccaccctcctgg

SEQ ID NO: 6412169 - DNA, 11 bp, Homo sapiens
tccccaccctg

SEQ ID NO: 6412170 - DNA, 12 bp, Homo sapiens
tccccaccctga

SEQ ID NO: 6412171 - DNA, 16 bp, Homo sapiens
tccccaccctgtccca

SEQ ID NO: 6412172 - DNA, 19 bp, Homo sapiens
tccccaccctgtcccaggc

SEQ ID NO: 6412173 - DNA, 20 bp, Homo sapiens
tccccacccttgagaaggtg

SEQ ID NO: 6412174 - DNA, 17 bp, Homo sapiens
tccccaccgcagacagg

SEQ ID NO: 6412175 - DNA, 18 bp, Homo sapiens
tccccaccgcagacagga

SEQ ID NO: 6412176 - DNA, 18 bp, Homo sapiens
tccccaccgccctgcctc

SEQ ID NO: 6412177 - DNA, 21 bp, Homo sapiens
tccccaccgccctgcctcttc

SEQ ID NO: 6412178 - DNA, 17 bp, Homo sapiens
tccccacctacccagct

SEQ ID NO: 6412179 - DNA, 14 bp, Homo sapiens
tccccacctccagg

SEQ ID NO: 6412180 - DNA, 17 bp, Homo sapiens
tccccacctccaggctt

SEQ ID NO: 6412181 - DNA, 18 bp, Homo sapiens
tccccacctcttccttcc

SEQ ID NO: 6412182 - DNA, 22 bp, Homo sapiens
tccccacctgcactccatccag

SEQ ID NO: 6412183 - DNA, 13 bp, Homo sapiens
tccccacctgctc

SEQ ID NO: 6412184 - DNA, 20 bp, Homo sapiens
tccccacctggacacacact

SEQ ID NO: 6412185 - DNA, 13 bp, Homo sapiens
tccccacctggga

SEQ ID NO: 6412186 - DNA, 16 bp, Homo sapiens
tccccacctgtagctg

SEQ ID NO: 6412187 - DNA, 18 bp, Homo sapiens
tccccaccttcaattcct

SEQ ID NO: 6412188 - DNA, 20 bp, Homo sapiens
tccccaccttcaattcctgg

SEQ ID NO: 6412189 - DNA, 16 bp, Homo sapiens
tccccaccttccccag

SEQ ID NO: 6412190 - DNA, 20 bp, Homo sapiens
tccccaccttcttcagccac

SEQ ID NO: 6412191 - DNA, 15 bp, Homo sapiens
tccccaccttcttgg

SEQ ID NO: 6412192 - DNA, 22 bp, Homo sapiens
tccccacgacccctgcctcgag

SEQ ID NO: 6412193 - DNA, 15 bp, Homo sapiens
tccccacgagggctg

SEQ ID NO: 6412194 - DNA, 16 bp, Homo sapiens
tccccacgagggctgg

SEQ ID NO: 6412195 - DNA, 17 bp, Homo sapiens
tccccacgagggctggc

SEQ ID NO: 6412196 - DNA, 20 bp, Homo sapiens
tccccacgaggggacccatg

SEQ ID NO: 6412197 - DNA, 18 bp, Homo sapiens
tccccacgagtcacctgc

SEQ ID NO: 6412198 - DNA, 23 bp, Homo sapiens
tccccacgagtcacctgcaagcc

SEQ ID NO: 6412199 - DNA, 19 bp, Homo sapiens
tccccacgatgatatctat

SEQ ID NO: 6412200 - DNA, 18 bp, Homo sapiens
tccccacggccgctccag

SEQ ID NO: 6412201 - DNA, 21 bp, Homo sapiens
tccccacgggaaactcaagga

SEQ ID NO: 6412202 - DNA, 19 bp, Homo sapiens
tccccactaggttcttttc

SEQ ID NO: 6412203 - DNA, 21 bp, Homo sapiens
tccccactaggttcttttcca

SEQ ID NO: 6412204 - DNA, 14 bp, Homo sapiens
tccccactccaccc

SEQ ID NO: 6412205 - DNA, 13 bp, Homo sapiens
tccccactccagc

SEQ ID NO: 6412206 - DNA, 16 bp, Homo sapiens
tccccactccagcaga

SEQ ID NO: 6412207 - DNA, 17 bp, Homo sapiens
tccccactccagcagat

SEQ ID NO: 6412208 - DNA, 18 bp, Homo sapiens
tccccactcccccaccca

SEQ ID NO: 6412209 - DNA, 22 bp, Homo sapiens
tccccactcccccacccatggg

SEQ ID NO: 6412210 - DNA, 12 bp, Homo sapiens
tccccactcccg

SEQ ID NO: 6412211 - DNA, 23 bp, Homo sapiens
tccccactcccgaaagcctttcc

SEQ ID NO: 6412212 - DNA, 12 bp, Homo sapiens
tccccactccct

SEQ ID NO: 6412213 - DNA, 13 bp, Homo sapiens
tccccactccctt

SEQ ID NO: 6412214 - DNA, 20 bp, Homo sapiens
tccccactcctctcccacag

SEQ ID NO: 6412215 - DNA, 16 bp, Homo sapiens
tccccactctgctccc

SEQ ID NO: 6412216 - DNA, 16 bp, Homo sapiens
tccccactctgctctg

SEQ ID NO: 6412217 - DNA, 20 bp, Homo sapiens
tccccactctgctctgatgc

SEQ ID NO: 6412218 - DNA, 14 bp, Homo sapiens
tccccactgaagaa

SEQ ID NO: 6412219 - DNA, 11 bp, Homo sapiens
tccccactgcc

SEQ ID NO: 6412220 - DNA, 18 bp, Homo sapiens
tccccactgcctgcccac

SEQ ID NO: 6412221 - DNA, 17 bp, Homo sapiens
tccccactgctgagctg

SEQ ID NO: 6412222 - DNA, 13 bp, Homo sapiens
tccccacttcact

SEQ ID NO: 6412223 - DNA, 18 bp, Homo sapiens
tccccacttctgtgccac

SEQ ID NO: 6412224 - DNA, 22 bp, Homo sapiens
tccccacttgagaattaccctt

SEQ ID NO: 6412225 - DNA, 19 bp, Homo sapiens
tccccacttgtccgctggg

SEQ ID NO: 6412226 - DNA, 17 bp, Homo sapiens
tccccagaactctgcct

SEQ ID NO: 6412227 - DNA, 18 bp, Homo sapiens
tccccagaactggctggg

SEQ ID NO: 6412228 - DNA, 13 bp, Homo sapiens
tccccagacacat

SEQ ID NO: 6412229 - DNA, 21 bp, Homo sapiens
tccccagacagggctccagcc

SEQ ID NO: 6412230 - DNA, 23 bp, Homo sapiens
tccccagacagggctccagcctg

SEQ ID NO: 6412231 - DNA, 15 bp, Homo sapiens
tccccagaccaaccc

SEQ ID NO: 6412232 - DNA, 22 bp, Homo sapiens
tccccagaccaaccctgggacc

SEQ ID NO: 6412233 - DNA, 18 bp, Homo sapiens
tccccagaccagtagtga

SEQ ID NO: 6412234 - DNA, 22 bp, Homo sapiens
tccccagaccagtagtgaccaa

SEQ ID NO: 6412235 - DNA, 12 bp, Homo sapiens
tccccagaccca

SEQ ID NO: 6412236 - DNA, 14 bp, Homo sapiens
tccccagacccaga

SEQ ID NO: 6412237 - DNA, 18 bp, Homo sapiens
tccccagacccagaggtc

SEQ ID NO: 6412238 - DNA, 19 bp, Homo sapiens
tccccagacccagaggtcc

SEQ ID NO: 6412239 - DNA, 20 bp, Homo sapiens
tccccagacccttcttgcct

SEQ ID NO: 6412240 - DNA, 13 bp, Homo sapiens
tccccagacctga

SEQ ID NO: 6412241 - DNA, 15 bp, Homo sapiens
tccccagactcagct

SEQ ID NO: 6412242 - DNA, 16 bp, Homo sapiens
tccccagactcagctc

SEQ ID NO: 6412243 - DNA, 20 bp, Homo sapiens
tccccagactcagctggaag

SEQ ID NO: 6412244 - DNA, 12 bp, Homo sapiens
tccccagactct

SEQ ID NO: 6412245 - DNA, 15 bp, Homo sapiens
tccccagactctgcc

SEQ ID NO: 6412246 - DNA, 16 bp, Homo sapiens
tccccagactctgcct

SEQ ID NO: 6412247 - DNA, 18 bp, Homo sapiens
tccccagactctgcctag

SEQ ID NO: 6412248 - DNA, 23 bp, Homo sapiens
tccccagacttctctttcttatt

SEQ ID NO: 6412249 - DNA, 15 bp, Homo sapiens
tccccagacttgttg

SEQ ID NO: 6412250 - DNA, 23 bp, Homo sapiens
tccccagagaaaggggagcccac

SEQ ID NO: 6412251 - DNA, 15 bp, Homo sapiens
tccccagagagcagg

SEQ ID NO: 6412252 - DNA, 16 bp, Homo sapiens
tccccagagagcaggc

SEQ ID NO: 6412253 - DNA, 22 bp, Homo sapiens
tccccagagatggctccttggg

SEQ ID NO: 6412254 - DNA, 21 bp, Homo sapiens
tccccagagcactgggttgca

SEQ ID NO: 6412255 - DNA, 15 bp, Homo sapiens
tccccagagcccagc

SEQ ID NO: 6412256 - DNA, 22 bp, Homo sapiens
tccccagagcccagctcttgct

SEQ ID NO: 6412257 - DNA, 15 bp, Homo sapiens
tccccagagctcccc

SEQ ID NO: 6412258 - DNA, 15 bp, Homo sapiens
tccccagagctgcct

SEQ ID NO: 6412259 - DNA, 21 bp, Homo sapiens
tccccagagctgcctgctctg

SEQ ID NO: 6412260 - DNA, 17 bp, Homo sapiens
tccccagagctgtgcca

SEQ ID NO: 6412261 - DNA, 14 bp, Homo sapiens
tccccagaggctcc

SEQ ID NO: 6412262 - DNA, 16 bp, Homo sapiens
tccccagaggctccca

SEQ ID NO: 6412263 - DNA, 22 bp, Homo sapiens
tccccagagttcttgcaccctc

SEQ ID NO: 6412264 - DNA, 18 bp, Homo sapiens
tccccagatatttatgta

SEQ ID NO: 6412265 - DNA, 18 bp, Homo sapiens
tccccagatctgtcctgg

SEQ ID NO: 6412266 - DNA, 20 bp, Homo sapiens
tccccagatctgtcctgggg

SEQ ID NO: 6412267 - DNA, 13 bp, Homo sapiens
tccccagattgca

SEQ ID NO: 6412268 - DNA, 15 bp, Homo sapiens
tccccagcaactctg

SEQ ID NO: 6412269 - DNA, 22 bp, Homo sapiens
tccccagcaagtgagagctggg

SEQ ID NO: 6412270 - DNA, 10 bp, Homo sapiens
tccccagcag

SEQ ID NO: 6412271 - DNA, 23 bp, Homo sapiens
tccccagcagggtcttttcatct

SEQ ID NO: 6412272 - DNA, 18 bp, Homo sapiens
tccccagcatcactcccc

SEQ ID NO: 6412273 - DNA, 19 bp, Homo sapiens
tccccagcatcactcccca

SEQ ID NO: 6412274 - DNA, 21 bp, Homo sapiens
tccccagcatgcaccacgggc

SEQ ID NO: 6412275 - DNA, 20 bp, Homo sapiens
tccccagcattccagcccct

SEQ ID NO: 6412276 - DNA, 19 bp, Homo sapiens
tccccagccagcccttccc

SEQ ID NO: 6412277 - DNA, 20 bp, Homo sapiens
tccccagccagcctggctgg

SEQ ID NO: 6412278 - DNA, 12 bp, Homo sapiens
tccccagccagg

SEQ ID NO: 6412279 - DNA, 22 bp, Homo sapiens
tccccagcccacctgctcccag

SEQ ID NO: 6412280 - DNA, 23 bp, Homo sapiens
tccccagcccacctgctcccagg

SEQ ID NO: 6412281 - DNA, 16 bp, Homo sapiens
tccccagcccagagac

SEQ ID NO: 6412282 - DNA, 14 bp, Homo sapiens
tccccagcccagga

SEQ ID NO: 6412283 - DNA, 11 bp, Homo sapiens
tccccagcccc

SEQ ID NO: 6412284 - DNA, 22 bp, Homo sapiens
tccccagccccctcccaccgct

SEQ ID NO: 6412285 - DNA, 20 bp, Homo sapiens
tccccagccccctggcccct

SEQ ID NO: 6412286 - DNA, 22 bp, Homo sapiens
tccccagccccctggcccctcc

SEQ ID NO: 6412287 - DNA, 16 bp, Homo sapiens
tccccagcccctagcc

SEQ ID NO: 6412288 - DNA, 20 bp, Homo sapiens
tccccagcccctagcccagg

SEQ ID NO: 6412289 - DNA, 21 bp, Homo sapiens
tccccagcccctagcccagga

SEQ ID NO: 6412290 - DNA, 18 bp, Homo sapiens
tccccagcccctcctccc

SEQ ID NO: 6412291 - DNA, 20 bp, Homo sapiens
tccccagcccctcctccctc

SEQ ID NO: 6412292 - DNA, 18 bp, Homo sapiens
tccccagccctgggcttg

SEQ ID NO: 6412293 - DNA, 14 bp, Homo sapiens
tccccagcctacct

SEQ ID NO: 6412294 - DNA, 18 bp, Homo sapiens
tccccagcctctcctcct

SEQ ID NO: 6412295 - DNA, 16 bp, Homo sapiens
tccccagcctctcttc

SEQ ID NO: 6412296 - DNA, 17 bp, Homo sapiens
tccccagcctgcgcctg

SEQ ID NO: 6412297 - DNA, 19 bp, Homo sapiens
tccccagcctgcgcctgct

SEQ ID NO: 6412298 - DNA, 17 bp, Homo sapiens
tccccagcctgggccca

SEQ ID NO: 6412299 - DNA, 22 bp, Homo sapiens
tccccagctcacccctggagga

SEQ ID NO: 6412300 - DNA, 12 bp, Homo sapiens
tccccagctcca

SEQ ID NO: 6412301 - DNA, 22 bp, Homo sapiens
tccccagctccatactctgtcc

SEQ ID NO: 6412302 - DNA, 15 bp, Homo sapiens
tccccagctccccag

SEQ ID NO: 6412303 - DNA, 16 bp, Homo sapiens
tccccagctccccagg

SEQ ID NO: 6412304 - DNA, 20 bp, Homo sapiens
tccccagctccccaggactc

SEQ ID NO: 6412305 - DNA, 19 bp, Homo sapiens
tccccagctcccccaggca

SEQ ID NO: 6412306 - DNA, 22 bp, Homo sapiens
tccccagctcttctcttcctag

SEQ ID NO: 6412307 - DNA, 19 bp, Homo sapiens
tccccagctttctcctctg

SEQ ID NO: 6412308 - DNA, 14 bp, Homo sapiens
tccccaggactcac

SEQ ID NO: 6412309 - DNA, 18 bp, Homo sapiens
tccccaggactcaccctc

SEQ ID NO: 6412310 - DNA, 19 bp, Homo sapiens
tccccaggactcaccctca

SEQ ID NO: 6412311 - DNA, 21 bp, Homo sapiens
tccccaggagagaccttctct

SEQ ID NO: 6412312 - DNA, 22 bp, Homo sapiens
tagtgtgggaggctcctgttag

SEQ ID NO: 6412313 - DNA, 19 bp, Homo sapiens
tagtgtggtatttgctgtc

SEQ ID NO: 6412314 - DNA, 16 bp, Homo sapiens
tagtgtggtgtgtttg

SEQ ID NO: 6412315 - DNA, 18 bp, Homo sapiens
tagtgtggttttctgttt

SEQ ID NO: 6412316 - DNA, 13 bp, Homo sapiens
tagtgtgtaaaat

SEQ ID NO: 6412317 - DNA, 13 bp, Homo sapiens
tagtgtgtcagag

SEQ ID NO: 6412318 - DNA, 13 bp, Homo sapiens
tagtgtgtccatg

SEQ ID NO: 6412319 - DNA, 18 bp, Homo sapiens
tagtgtgtgcttacagta

SEQ ID NO: 6412320 - DNA, 20 bp, Homo sapiens
tagtgtgtgtgcagagtcca

SEQ ID NO: 6412321 - DNA, 23 bp, Homo sapiens
tagtgtgtgtgcagagtccattt

SEQ ID NO: 6412322 - DNA, 14 bp, Homo sapiens
tagtgtgtgtgcat

SEQ ID NO: 6412323 - DNA, 15 bp, Homo sapiens
tagtgtgtgtgcatg

SEQ ID NO: 6412324 - DNA, 19 bp, Homo sapiens
tagtgtgtgtgcatgtgtg

SEQ ID NO: 6412325 - DNA, 19 bp, Homo sapiens
tagtgtgttctgattagaa

SEQ ID NO: 6412326 - DNA, 18 bp, Homo sapiens
tagtgtgttgtctgtgca

SEQ ID NO: 6412327 - DNA, 20 bp, Homo sapiens
tagtgtgttgtgctttcaag

SEQ ID NO: 6412328 - DNA, 16 bp, Homo sapiens
tagtgtgttttcataa

SEQ ID NO: 6412329 - DNA, 15 bp, Homo sapiens
tagtgttaatcaatt

SEQ ID NO: 6412330 - DNA, 23 bp, Homo sapiens
tagtgttaatcaatttaaaccca

SEQ ID NO: 6412331 - DNA, 18 bp, Homo sapiens
tagtgttaatgactcttt

SEQ ID NO: 6412332 - DNA, 23 bp, Homo sapiens
tagtgttagttataaatagcctt

SEQ ID NO: 6412333 - DNA, 15 bp, Homo sapiens
tagtgttatatgaac

SEQ ID NO: 6412334 - DNA, 16 bp, Homo sapiens
tagtgttatatgaaca

SEQ ID NO: 6412335 - DNA, 17 bp, Homo sapiens
tagtgttatatgaacat

SEQ ID NO: 6412336 - DNA, 22 bp, Homo sapiens
tagtgttatatgaacatacaaa

SEQ ID NO: 6412337 - DNA, 20 bp, Homo sapiens
tagtgttcaaaacaaaatga

SEQ ID NO: 6412338 - DNA, 20 bp, Homo sapiens
tagtgttcacaaactgtgaa

SEQ ID NO: 6412339 - DNA, 16 bp, Homo sapiens
tagtgttcagaaaaaa

SEQ ID NO: 6412340 - DNA, 15 bp, Homo sapiens
tagtgttctgctcct

SEQ ID NO: 6412341 - DNA, 18 bp, Homo sapiens
tagtgttctgctcctgct

SEQ ID NO: 6412342 - DNA, 23 bp, Homo sapiens
tagtgttctgctcctgcttttct

SEQ ID NO: 6412343 - DNA, 14 bp, Homo sapiens
tagtgttctgtatt

SEQ ID NO: 6412344 - DNA, 12 bp, Homo sapiens
tagtgttctgtt

SEQ ID NO: 6412345 - DNA, 13 bp, Homo sapiens
tagtgttgaggag

SEQ ID NO: 6412346 - DNA, 15 bp, Homo sapiens
tagtgttgaggaggg

SEQ ID NO: 6412347 - DNA, 12 bp, Homo sapiens
tagtgttggaga

SEQ ID NO: 6412348 - DNA, 14 bp, Homo sapiens
tagtgtttaactgg

SEQ ID NO: 6412349 - DNA, 22 bp, Homo sapiens
tagtgtttagcattaaaaataa

SEQ ID NO: 6412350 - DNA, 20 bp, Homo sapiens
tagtgtttcgttaagcagta

SEQ ID NO: 6412351 - DNA, 15 bp, Homo sapiens
tagtgtttctgtgca

SEQ ID NO: 6412352 - DNA, 13 bp, Homo sapiens
tagtgtttggaat

SEQ ID NO: 6412353 - DNA, 19 bp, Homo sapiens
tagtgtttggaattttctg

SEQ ID NO: 6412354 - DNA, 18 bp, Homo sapiens
tagtgtttggacagctga

SEQ ID NO: 6412355 - DNA, 21 bp, Homo sapiens
tagtgttttcaattttaaaca

SEQ ID NO: 6412356 - DNA, 16 bp, Homo sapiens
tagtgttttcattctg

SEQ ID NO: 6412357 - DNA, 23 bp, Homo sapiens
tagttaaaactcatcacataaag

SEQ ID NO: 6412358 - DNA, 11 bp, Homo sapiens
tagttaaaatc

SEQ ID NO: 6412359 - DNA, 13 bp, Homo sapiens
tagttaaactgag

SEQ ID NO: 6412360 - DNA, 15 bp, Homo sapiens
tagttaaactgagag

SEQ ID NO: 6412361 - DNA, 22 bp, Homo sapiens
tagttaaactgagagtaattca

SEQ ID NO: 6412362 - DNA, 19 bp, Homo sapiens
tagttaaatagctatattt

SEQ ID NO: 6412363 - DNA, 15 bp, Homo sapiens
tagttaaatttctgg

SEQ ID NO: 6412364 - DNA, 19 bp, Homo sapiens
tagttaaatttctggacct

SEQ ID NO: 6412365 - DNA, 22 bp, Homo sapiens
tagttaaccaatcgcaaagcaa

SEQ ID NO: 6412366 - DNA, 21 bp, Homo sapiens
tagttaagacatgatttcctt

SEQ ID NO: 6412367 - DNA, 18 bp, Homo sapiens
tagttaagcatgacttta

SEQ ID NO: 6412368 - DNA, 18 bp, Homo sapiens
tagttaaggtgtgcaaag

SEQ ID NO: 6412369 - DNA, 20 bp, Homo sapiens
tagttaaggtgtgcaaagat

SEQ ID NO: 6412370 - DNA, 23 bp, Homo sapiens
tagttaatattgtgaagaaaaat

SEQ ID NO: 6412371 - DNA, 14 bp, Homo sapiens
tagttaatctataa

SEQ ID NO: 6412372 - DNA, 13 bp, Homo sapiens
tagttaattctgt

SEQ ID NO: 6412373 - DNA, 13 bp, Homo sapiens
tagttaatttatt

SEQ ID NO: 6412374 - DNA, 15 bp, Homo sapiens
tagttacatgaatta

SEQ ID NO: 6412375 - DNA, 13 bp, Homo sapiens
tagttacatttat

SEQ ID NO: 6412376 - DNA, 15 bp, Homo sapiens
tagttacatttatgt

SEQ ID NO: 6412377 - DNA, 13 bp, Homo sapiens
tagttacccaccc

SEQ ID NO: 6412378 - DNA, 16 bp, Homo sapiens
tagttacctactgagt

SEQ ID NO: 6412379 - DNA, 14 bp, Homo sapiens
tagttaccttatag

SEQ ID NO: 6412380 - DNA, 23 bp, Homo sapiens
tagttaccttatagttactgtgt

SEQ ID NO: 6412381 - DNA, 17 bp, Homo sapiens
tagttactaaaattatg

SEQ ID NO: 6412382 - DNA, 15 bp, Homo sapiens
tagttactgtgtaaa

SEQ ID NO: 6412383 - DNA, 21 bp, Homo sapiens
tagttactgtgtaaactcatc

SEQ ID NO: 6412384 - DNA, 19 bp, Homo sapiens
tagttactgtgtaattagt

SEQ ID NO: 6412385 - DNA, 16 bp, Homo sapiens
tagttagcatgcgcgc

SEQ ID NO: 6412386 - DNA, 22 bp, Homo sapiens
tagttagccaatatttttctta

SEQ ID NO: 6412387 - DNA, 22 bp, Homo sapiens
tagttagctaataaaaagcttt

SEQ ID NO: 6412388 - DNA, 22 bp, Homo sapiens
tagttagctgctttaaatctat

SEQ ID NO: 6412389 - DNA, 22 bp, Homo sapiens
tagttaggaaataaaacctttc

SEQ ID NO: 6412390 - DNA, 21 bp, Homo sapiens
tagttaggatgctcagttgct

SEQ ID NO: 6412391 - DNA, 21 bp, Homo sapiens
tagttaggtgtgccaaactac

SEQ ID NO: 6412392 - DNA, 23 bp, Homo sapiens
tagttagtgattatatttcaccc

SEQ ID NO: 6412393 - DNA, 14 bp, Homo sapiens
tagttagtttggaa

SEQ ID NO: 6412394 - DNA, 13 bp, Homo sapiens
tagttataaaaat

SEQ ID NO: 6412395 - DNA, 18 bp, Homo sapiens
tagttataaaaggcttta

SEQ ID NO: 6412396 - DNA, 14 bp, Homo sapiens
tagttatatatatg

SEQ ID NO: 6412397 - DNA, 15 bp, Homo sapiens
tagttatatatatgt

SEQ ID NO: 6412398 - DNA, 20 bp, Homo sapiens
tagttatatttgctgatact

SEQ ID NO: 6412399 - DNA, 14 bp, Homo sapiens
tagttatattttct

SEQ ID NO: 6412400 - DNA, 17 bp, Homo sapiens
tagttatattttctatt

SEQ ID NO: 6412401 - DNA, 12 bp, Homo sapiens
tagttatcatgt

SEQ ID NO: 6412402 - DNA, 15 bp, Homo sapiens
tagttatgtaaataa

SEQ ID NO: 6412403 - DNA, 19 bp, Homo sapiens
tagttatgtaaataattct

SEQ ID NO: 6412404 - DNA, 20 bp, Homo sapiens
tagttatgtaaataattctt

SEQ ID NO: 6412405 - DNA, 21 bp, Homo sapiens
tagttattaaatgtttcaaaa

SEQ ID NO: 6412406 - DNA, 13 bp, Homo sapiens
tagttattattta

SEQ ID NO: 6412407 - DNA, 15 bp, Homo sapiens
tagttattctctaag

SEQ ID NO: 6412408 - DNA, 15 bp, Homo sapiens
tagttattgttttat

SEQ ID NO: 6412409 - DNA, 21 bp, Homo sapiens
tagttattgttttatgttcta

SEQ ID NO: 6412410 - DNA, 17 bp, Homo sapiens
tagttatttacttgaaa

SEQ ID NO: 6412411 - DNA, 15 bp, Homo sapiens
tagttatttctgcct

SEQ ID NO: 6412412 - DNA, 13 bp, Homo sapiens
tagttatttgtat

SEQ ID NO: 6412413 - DNA, 12 bp, Homo sapiens
tagttattttaa

SEQ ID NO: 6412414 - DNA, 13 bp, Homo sapiens
tagttattttgca

SEQ ID NO: 6412415 - DNA, 16 bp, Homo sapiens
tagttatttttctctt

SEQ ID NO: 6412416 - DNA, 19 bp, Homo sapiens
tagttcaaaacaaccactt

SEQ ID NO: 6412417 - DNA, 14 bp, Homo sapiens
tagttcaagaaatg

SEQ ID NO: 6412418 - DNA, 23 bp, Homo sapiens
tagttcaatctggattcatattt

SEQ ID NO: 6412419 - DNA, 15 bp, Homo sapiens
tagttcaatttcatg

SEQ ID NO: 6412420 - DNA, 16 bp, Homo sapiens
tagttcaatttcatgt

SEQ ID NO: 6412421 - DNA, 22 bp, Homo sapiens
tagttcactccatttggtcctt

SEQ ID NO: 6412422 - DNA, 15 bp, Homo sapiens
tagttcagacacttt

SEQ ID NO: 6412423 - DNA, 14 bp, Homo sapiens
tagttcagcaaaac

SEQ ID NO: 6412424 - DNA, 15 bp, Homo sapiens
tagttcagtagctta

SEQ ID NO: 6412425 - DNA, 22 bp, Homo sapiens
tagttcatagttggaaatattt

SEQ ID NO: 6412426 - DNA, 16 bp, Homo sapiens
tagttcatgtaaataa

SEQ ID NO: 6412427 - DNA, 21 bp, Homo sapiens
tagttcatgtaaataatacat

SEQ ID NO: 6412428 - DNA, 17 bp, Homo sapiens
tagttcatgtctgctat

SEQ ID NO: 6412429 - DNA, 22 bp, Homo sapiens
tagttcattgtaaatgaacata

SEQ ID NO: 6412430 - DNA, 13 bp, Homo sapiens
tagttccacacag

SEQ ID NO: 6412431 - DNA, 15 bp, Homo sapiens
tagttcccctgttta

SEQ ID NO: 6412432 - DNA, 18 bp, Homo sapiens
tagttccctctgctcagc

SEQ ID NO: 6412433 - DNA, 20 bp, Homo sapiens
tagttccctctgctcagcca

SEQ ID NO: 6412434 - DNA, 12 bp, Homo sapiens
tagttccctttg

SEQ ID NO: 6412435 - DNA, 15 bp, Homo sapiens
tagttccctttgcca

SEQ ID NO: 6412436 - DNA, 16 bp, Homo sapiens
tagttcctaagaagct

SEQ ID NO: 6412437 - DNA, 21 bp, Homo sapiens
tagttcctaagaagcttctaa

SEQ ID NO: 6412438 - DNA, 12 bp, Homo sapiens
tagttcctgcta

SEQ ID NO: 6412439 - DNA, 16 bp, Homo sapiens
tagttccttgccttaa

SEQ ID NO: 6412440 - DNA, 13 bp, Homo sapiens
tagttctaaaatt

SEQ ID NO: 6412441 - DNA, 13 bp, Homo sapiens
tagttctagaaaa

SEQ ID NO: 6412442 - DNA, 16 bp, Homo sapiens
tagttctagaaaaaca

SEQ ID NO: 6412443 - DNA, 16 bp, Homo sapiens
tagttctaggcactgt

SEQ ID NO: 6412444 - DNA, 22 bp, Homo sapiens
tagttctagtgcagctgaaatt

SEQ ID NO: 6412445 - DNA, 22 bp, Homo sapiens
tagttctatcaggaaaacaaat

SEQ ID NO: 6412446 - DNA, 22 bp, Homo sapiens
tagttctatccttttgcctgca

SEQ ID NO: 6412447 - DNA, 16 bp, Homo sapiens
tagttctatttctatc

SEQ ID NO: 6412448 - DNA, 20 bp, Homo sapiens
tagttctatttctatcccaa

SEQ ID NO: 6412449 - DNA, 15 bp, Homo sapiens
tagttctcagcttgc

SEQ ID NO: 6412450 - DNA, 17 bp, Homo sapiens
tagttctctagggtctg

SEQ ID NO: 6412451 - DNA, 15 bp, Homo sapiens
tagttctgactttga

SEQ ID NO: 6412452 - DNA, 19 bp, Homo sapiens
tagttctgactttgaattt

SEQ ID NO: 6412453 - DNA, 18 bp, Homo sapiens
tagttctgagctgccagt

SEQ ID NO: 6412454 - DNA, 12 bp, Homo sapiens
tagttctgcaat

SEQ ID NO: 6412455 - DNA, 13 bp, Homo sapiens
tagttctgccagg

SEQ ID NO: 6412456 - DNA, 14 bp, Homo sapiens
tagttctgccagga

SEQ ID NO: 6412457 - DNA, 15 bp, Homo sapiens
tagttctgctgccct

SEQ ID NO: 6412458 - DNA, 18 bp, Homo sapiens
tagttctgtaataaaact

SEQ ID NO: 6412459 - DNA, 19 bp, Homo sapiens
tagttctgtaataaaactg

SEQ ID NO: 6412460 - DNA, 16 bp, Homo sapiens
tagttctgtagaaatg

SEQ ID NO: 6412461 - DNA, 14 bp, Homo sapiens
tagttctgtatttg

SEQ ID NO: 6412462 - DNA, 11 bp, Homo sapiens
tagttctgtga

SEQ ID NO: 6412463 - DNA, 16 bp, Homo sapiens
tagttctgtgtacttt

SEQ ID NO: 6412464 - DNA, 18 bp, Homo sapiens
tagttctgtgtacttttt

SEQ ID NO: 6412465 - DNA, 22 bp, Homo sapiens
tagttctgtttggtgtgtccca

SEQ ID NO: 6412466 - DNA, 18 bp, Homo sapiens
tagttcttgaattgttat

SEQ ID NO: 6412467 - DNA, 15 bp, Homo sapiens
tagttctttggaaat

SEQ ID NO: 6412468 - DNA, 17 bp, Homo sapiens
tagttctttgttcctgc

SEQ ID NO: 6412469 - DNA, 16 bp, Homo sapiens
tagttgaaaaaagaag

SEQ ID NO: 6412470 - DNA, 20 bp, Homo sapiens
tagttgaaaggcctcaagaa

SEQ ID NO: 6412471 - DNA, 17 bp, Homo sapiens
tagttgaaagtaaaaaa

SEQ ID NO: 6412472 - DNA, 20 bp, Homo sapiens
tagttgaacaagatttccct

SEQ ID NO: 6412473 - DNA, 14 bp, Homo sapiens
tagttgaactgata

SEQ ID NO: 6412474 - DNA, 17 bp, Homo sapiens
tagttgaatacttgaac

SEQ ID NO: 6412475 - DNA, 19 bp, Homo sapiens
tagttgaatacttgaacca

SEQ ID NO: 6412476 - DNA, 20 bp, Homo sapiens
tagttgaatacttgaaccat

SEQ ID NO: 6412477 - DNA, 21 bp, Homo sapiens
tagttgaatacttgaaccata

SEQ ID NO: 6412478 - DNA, 15 bp, Homo sapiens
tagttgaattccaag

SEQ ID NO: 6412479 - DNA, 17 bp, Homo sapiens
tagttgacaacctagaa

SEQ ID NO: 6412480 - DNA, 20 bp, Homo sapiens
tagttgacttcaaatgtgta

SEQ ID NO: 6412481 - DNA, 17 bp, Homo sapiens
tagttgagccagcagac

SEQ ID NO: 6412482 - DNA, 22 bp, Homo sapiens
tagttgagccagcagacattgt

SEQ ID NO: 6412483 - DNA, 23 bp, Homo sapiens
tagttgagccagcagacattgtc

SEQ ID NO: 6412484 - DNA, 23 bp, Homo sapiens
tagttgaggccgaggataaagaa

SEQ ID NO: 6412485 - DNA, 19 bp, Homo sapiens
tagttgagtcttcacattt

SEQ ID NO: 6412486 - DNA, 22 bp, Homo sapiens
tagttgagtcttcacatttaga

SEQ ID NO: 6412487 - DNA, 23 bp, Homo sapiens
tagttgagttggaacaacatgtt

SEQ ID NO: 6412488 - DNA, 20 bp, Homo sapiens
tagttgcaactttgtataaa

SEQ ID NO: 6412489 - DNA, 14 bp, Homo sapiens
tagttgcaattgaa

SEQ ID NO: 6412490 - DNA, 17 bp, Homo sapiens
tagttgcactaactgct

SEQ ID NO: 6412491 - DNA, 23 bp, Homo sapiens
tccccaggagagaccttctctta

SEQ ID NO: 6412492 - DNA, 12 bp, Homo sapiens
tccccaggagca

SEQ ID NO: 6412493 - DNA, 16 bp, Homo sapiens
tccccaggagctcagg

SEQ ID NO: 6412494 - DNA, 17 bp, Homo sapiens
tccccaggagctctctg

SEQ ID NO: 6412495 - DNA, 13 bp, Homo sapiens
tccccaggaggcc

SEQ ID NO: 6412496 - DNA, 14 bp, Homo sapiens
tccccaggaggcca

SEQ ID NO: 6412497 - DNA, 16 bp, Homo sapiens
tccccaggaggccagc

SEQ ID NO: 6412498 - DNA, 17 bp, Homo sapiens
tccccaggaggccagcc

SEQ ID NO: 6412499 - DNA, 23 bp, Homo sapiens
tccccaggaggccagccttgacc

SEQ ID NO: 6412500 - DNA, 17 bp, Homo sapiens
tccccaggaggcctggg

SEQ ID NO: 6412501 - DNA, 15 bp, Homo sapiens
tccccaggcatttgc

SEQ ID NO: 6412502 - DNA, 14 bp, Homo sapiens
tccccaggccaccc

SEQ ID NO: 6412503 - DNA, 12 bp, Homo sapiens
tccccaggccag

SEQ ID NO: 6412504 - DNA, 14 bp, Homo sapiens
tccccaggccaggc

SEQ ID NO: 6412505 - DNA, 14 bp, Homo sapiens
tccccaggcccacc

SEQ ID NO: 6412506 - DNA, 17 bp, Homo sapiens
tccccaggcccagccct

SEQ ID NO: 6412507 - DNA, 18 bp, Homo sapiens
tccccaggcccagccctc

SEQ ID NO: 6412508 - DNA, 13 bp, Homo sapiens
tccccaggcccca

SEQ ID NO: 6412509 - DNA, 19 bp, Homo sapiens
tccccaggccgtggctgcc

SEQ ID NO: 6412510 - DNA, 12 bp, Homo sapiens
tccccaggcctc

SEQ ID NO: 6412511 - DNA, 22 bp, Homo sapiens
tccccaggcctccagcctctcc

SEQ ID NO: 6412512 - DNA, 23 bp, Homo sapiens
tccccaggctgcccactctgggg

SEQ ID NO: 6412513 - DNA, 19 bp, Homo sapiens
tccccagggaagcagcagc

SEQ ID NO: 6412514 - DNA, 17 bp, Homo sapiens
tccccagggagctctgg

SEQ ID NO: 6412515 - DNA, 20 bp, Homo sapiens
tccccagggagctctgggga

SEQ ID NO: 6412516 - DNA, 12 bp, Homo sapiens
tccccagggcac

SEQ ID NO: 6412517 - DNA, 11 bp, Homo sapiens
tccccagggct

SEQ ID NO: 6412518 - DNA, 10 bp, Homo sapiens
tccccagggg

SEQ ID NO: 6412519 - DNA, 15 bp, Homo sapiens
tccccaggggagttg

SEQ ID NO: 6412520 - DNA, 23 bp, Homo sapiens
tccccaggggcatgactgtcgcc

SEQ ID NO: 6412521 - DNA, 17 bp, Homo sapiens
tccccaggggtcccagc

SEQ ID NO: 6412522 - DNA, 18 bp, Homo sapiens
tccccaggggtcccagcc

SEQ ID NO: 6412523 - DNA, 20 bp, Homo sapiens
tccccaggggtcccagccac

SEQ ID NO: 6412524 - DNA, 17 bp, Homo sapiens
tccccagggtgtctcta

SEQ ID NO: 6412525 - DNA, 22 bp, Homo sapiens
tccccagggtgtctctatgaaa

SEQ ID NO: 6412526 - DNA, 17 bp, Homo sapiens
tccccagggttctgtat

SEQ ID NO: 6412527 - DNA, 16 bp, Homo sapiens
tccccaggtccagctc

SEQ ID NO: 6412528 - DNA, 19 bp, Homo sapiens
tccccaggtcctgtctctg

SEQ ID NO: 6412529 - DNA, 16 bp, Homo sapiens
tccccaggtctctcca

SEQ ID NO: 6412530 - DNA, 19 bp, Homo sapiens
tccccaggtggaggtgcca

SEQ ID NO: 6412531 - DNA, 22 bp, Homo sapiens
tccccaggtggaggtgccagga

SEQ ID NO: 6412532 - DNA, 18 bp, Homo sapiens
tccccaggtggctgaccc

SEQ ID NO: 6412533 - DNA, 20 bp, Homo sapiens
tccccaggtggctgacccag

SEQ ID NO: 6412534 - DNA, 11 bp, Homo sapiens
tccccaggtgt

SEQ ID NO: 6412535 - DNA, 14 bp, Homo sapiens
tccccaggtgtgtg

SEQ ID NO: 6412536 - DNA, 15 bp, Homo sapiens
tccccagtccccagc

SEQ ID NO: 6412537 - DNA, 17 bp, Homo sapiens
tccccagtccccagccc

SEQ ID NO: 6412538 - DNA, 22 bp, Homo sapiens
tccccagtctacgttctccagc

SEQ ID NO: 6412539 - DNA, 22 bp, Homo sapiens
tccccagtctctcttaaagttg

SEQ ID NO: 6412540 - DNA, 14 bp, Homo sapiens
tccccagtgactcc

SEQ ID NO: 6412541 - DNA, 16 bp, Homo sapiens
tccccagtgactccag

SEQ ID NO: 6412542 - DNA, 17 bp, Homo sapiens
tccccagtgactccagg

SEQ ID NO: 6412543 - DNA, 16 bp, Homo sapiens
tccccagtgccagctg

SEQ ID NO: 6412544 - DNA, 17 bp, Homo sapiens
tccccagtgccagctgg

SEQ ID NO: 6412545 - DNA, 15 bp, Homo sapiens
tccccagtgcctgcc

SEQ ID NO: 6412546 - DNA, 16 bp, Homo sapiens
tccccagtgcctgcca

SEQ ID NO: 6412547 - DNA, 18 bp, Homo sapiens
tccccagtgctcctggcc

SEQ ID NO: 6412548 - DNA, 12 bp, Homo sapiens
tccccagtgtgg

SEQ ID NO: 6412549 - DNA, 18 bp, Homo sapiens
tccccagttccacagcag

SEQ ID NO: 6412550 - DNA, 20 bp, Homo sapiens
tccccagttccacagcagtg

SEQ ID NO: 6412551 - DNA, 23 bp, Homo sapiens
tccccagttcgcctggagccctc

SEQ ID NO: 6412552 - DNA, 21 bp, Homo sapiens
tccccagttggggctgcgacc

SEQ ID NO: 6412553 - DNA, 18 bp, Homo sapiens
tccccataagacaaacac

SEQ ID NO: 6412554 - DNA, 11 bp, Homo sapiens
tccccatacac

SEQ ID NO: 6412555 - DNA, 17 bp, Homo sapiens
tccccatactctgtctc

SEQ ID NO: 6412556 - DNA, 18 bp, Homo sapiens
tccccatactctgtctcc

SEQ ID NO: 6412557 - DNA, 16 bp, Homo sapiens
tccccatacttcctgg

SEQ ID NO: 6412558 - DNA, 18 bp, Homo sapiens
tccccatacttcctggga

SEQ ID NO: 6412559 - DNA, 19 bp, Homo sapiens
tccccatacttcctgggat

SEQ ID NO: 6412560 - DNA, 18 bp, Homo sapiens
tccccatatttgtgttca

SEQ ID NO: 6412561 - DNA, 18 bp, Homo sapiens
tccccatcacggagggtc

SEQ ID NO: 6412562 - DNA, 15 bp, Homo sapiens
tccccatcagctccc

SEQ ID NO: 6412563 - DNA, 17 bp, Homo sapiens
tccccatcagctcccaa

SEQ ID NO: 6412564 - DNA, 21 bp, Homo sapiens
tccccatcatccacgccaagt

SEQ ID NO: 6412565 - DNA, 18 bp, Homo sapiens
tccccatcatctgtggaa

SEQ ID NO: 6412566 - DNA, 14 bp, Homo sapiens
tccccatccccacc

SEQ ID NO: 6412567 - DNA, 16 bp, Homo sapiens
tccccatccccagctg

SEQ ID NO: 6412568 - DNA, 17 bp, Homo sapiens
tccccatccctgtcatt

SEQ ID NO: 6412569 - DNA, 15 bp, Homo sapiens
tccccatcctccaga

SEQ ID NO: 6412570 - DNA, 15 bp, Homo sapiens
tccccatcctccagc

SEQ ID NO: 6412571 - DNA, 20 bp, Homo sapiens
tccccatcgccagctgatga

SEQ ID NO: 6412572 - DNA, 16 bp, Homo sapiens
tccccatcggccctgt

SEQ ID NO: 6412573 - DNA, 17 bp, Homo sapiens
tccccatcggccctgtc

SEQ ID NO: 6412574 - DNA, 20 bp, Homo sapiens
tccccatcggccctgtcccc

SEQ ID NO: 6412575 - DNA, 19 bp, Homo sapiens
tccccatctccctgcctgg

SEQ ID NO: 6412576 - DNA, 14 bp, Homo sapiens
tccccatctctgtc

SEQ ID NO: 6412577 - DNA, 19 bp, Homo sapiens
tccccatctctgtctgggg

SEQ ID NO: 6412578 - DNA, 20 bp, Homo sapiens
tccccatctctgtctggggc

SEQ ID NO: 6412579 - DNA, 21 bp, Homo sapiens
tccccatctctgtctggggct

SEQ ID NO: 6412580 - DNA, 18 bp, Homo sapiens
tccccatctgccacaggc

SEQ ID NO: 6412581 - DNA, 15 bp, Homo sapiens
tccccatctgtcggc

SEQ ID NO: 6412582 - DNA, 17 bp, Homo sapiens
tccccatctgtcggcct

SEQ ID NO: 6412583 - DNA, 13 bp, Homo sapiens
tccccatctgtgt

SEQ ID NO: 6412584 - DNA, 14 bp, Homo sapiens
tccccatctgtgtt

SEQ ID NO: 6412585 - DNA, 19 bp, Homo sapiens
tccccatcttctaaaccca

SEQ ID NO: 6412586 - DNA, 19 bp, Homo sapiens
tccccatgaaccctgccct

SEQ ID NO: 6412587 - DNA, 22 bp, Homo sapiens
tccccatgcatgggaaagtgca

SEQ ID NO: 6412588 - DNA, 22 bp, Homo sapiens
tccccatgccacgttccacagt

SEQ ID NO: 6412589 - DNA, 16 bp, Homo sapiens
tccccatgcctgtggc

SEQ ID NO: 6412590 - DNA, 15 bp, Homo sapiens
tccccatgctgggct

SEQ ID NO: 6412591 - DNA, 20 bp, Homo sapiens
tccccatggaacagccctgc

SEQ ID NO: 6412592 - DNA, 13 bp, Homo sapiens
tccccatggagcc

SEQ ID NO: 6412593 - DNA, 23 bp, Homo sapiens
tccccatggcatgggggcctcag

SEQ ID NO: 6412594 - DNA, 22 bp, Homo sapiens
tccccatggcttgttctctgga

SEQ ID NO: 6412595 - DNA, 23 bp, Homo sapiens
tccccatggcttgttctctggaa

SEQ ID NO: 6412596 - DNA, 11 bp, Homo sapiens
tccccatggga

SEQ ID NO: 6412597 - DNA, 19 bp, Homo sapiens
tccccatgggctcccactg

SEQ ID NO: 6412598 - DNA, 20 bp, Homo sapiens
tccccatggtgcagtgaaga

SEQ ID NO: 6412599 - DNA, 20 bp, Homo sapiens
tccccatgtgcctgcaccag

SEQ ID NO: 6412600 - DNA, 19 bp, Homo sapiens
tccccattcagacacttca

SEQ ID NO: 6412601 - DNA, 13 bp, Homo sapiens
tccccattctata

SEQ ID NO: 6412602 - DNA, 14 bp, Homo sapiens
tccccattcttcct

SEQ ID NO: 6412603 - DNA, 19 bp, Homo sapiens
tccccatttaggtttctga

SEQ ID NO: 6412604 - DNA, 16 bp, Homo sapiens
tccccatttcccatct

SEQ ID NO: 6412605 - DNA, 18 bp, Homo sapiens
tccccatttcccatctgc

SEQ ID NO: 6412606 - DNA, 16 bp, Homo sapiens
tccccatttcctcttc

SEQ ID NO: 6412607 - DNA, 19 bp, Homo sapiens
tccccatttcctcttcctt

SEQ ID NO: 6412608 - DNA, 23 bp, Homo sapiens
tccccatttcctcttccttctct

SEQ ID NO: 6412609 - DNA, 15 bp, Homo sapiens
tccccatttcctgta

SEQ ID NO: 6412610 - DNA, 22 bp, Homo sapiens
tccccatttcctgtacaatcat

SEQ ID NO: 6412611 - DNA, 19 bp, Homo sapiens
tccccatttctgcctcgct

SEQ ID NO: 6412612 - DNA, 14 bp, Homo sapiens
tccccattttctgg

SEQ ID NO: 6412613 - DNA, 16 bp, Homo sapiens
tcccccaaacagactc

SEQ ID NO: 6412614 - DNA, 23 bp, Homo sapiens
tcccccaaacatctggcatggct

SEQ ID NO: 6412615 - DNA, 20 bp, Homo sapiens
tcccccaaaccctgcttctg

SEQ ID NO: 6412616 - DNA, 11 bp, Homo sapiens
tcccccaaagg

SEQ ID NO: 6412617 - DNA, 22 bp, Homo sapiens
tcccccaaaggcatcccagcct

SEQ ID NO: 6412618 - DNA, 16 bp, Homo sapiens
tcccccaacacctgct

SEQ ID NO: 6412619 - DNA, 16 bp, Homo sapiens
tcccccaacactgagc

SEQ ID NO: 6412620 - DNA, 22 bp, Homo sapiens
tcccccaacatataaaataatg

SEQ ID NO: 6412621 - DNA, 21 bp, Homo sapiens
tcccccaaccaaggaaggagc

SEQ ID NO: 6412622 - DNA, 13 bp, Homo sapiens
tcccccaacccac

SEQ ID NO: 6412623 - DNA, 15 bp, Homo sapiens
tcccccaacccacct

SEQ ID NO: 6412624 - DNA, 14 bp, Homo sapiens
tcccccaaccccca

SEQ ID NO: 6412625 - DNA, 21 bp, Homo sapiens
tcccccaacccccaccccaca

SEQ ID NO: 6412626 - DNA, 21 bp, Homo sapiens
tcccccaactctgagcccatg

SEQ ID NO: 6412627 - DNA, 14 bp, Homo sapiens
tcccccaatgacct

SEQ ID NO: 6412628 - DNA, 13 bp, Homo sapiens
tcccccaccactc

SEQ ID NO: 6412629 - DNA, 19 bp, Homo sapiens
tcccccaccactcaggcca

SEQ ID NO: 6412630 - DNA, 15 bp, Homo sapiens
tcccccaccagctgc

SEQ ID NO: 6412631 - DNA, 14 bp, Homo sapiens
tcccccacccacct

SEQ ID NO: 6412632 - DNA, 15 bp, Homo sapiens
tcccccacccacctc

SEQ ID NO: 6412633 - DNA, 19 bp, Homo sapiens
tcccccacccacctcctgc

SEQ ID NO: 6412634 - DNA, 16 bp, Homo sapiens
tcccccaccccagaag

SEQ ID NO: 6412635 - DNA, 17 bp, Homo sapiens
tcccccaccccagaaga

SEQ ID NO: 6412636 - DNA, 17 bp, Homo sapiens
tcccccaccccagagtt

SEQ ID NO: 6412637 - DNA, 23 bp, Homo sapiens
tcccccacccccaaagacctgcc

SEQ ID NO: 6412638 - DNA, 19 bp, Homo sapiens
tcccccaccccctccccgc

SEQ ID NO: 6412639 - DNA, 12 bp, Homo sapiens
tcccccacccct

SEQ ID NO: 6412640 - DNA, 12 bp, Homo sapiens
tcccccaccctg

SEQ ID NO: 6412641 - DNA, 15 bp, Homo sapiens
tcccccaccctgggt

SEQ ID NO: 6412642 - DNA, 13 bp, Homo sapiens
tcccccaccctgt

SEQ ID NO: 6412643 - DNA, 15 bp, Homo sapiens
tcccccaccctgtgc

SEQ ID NO: 6412644 - DNA, 17 bp, Homo sapiens
tcccccaccgcccactc

SEQ ID NO: 6412645 - DNA, 23 bp, Homo sapiens
tcccccaccggtccagctggcct

SEQ ID NO: 6412646 - DNA, 15 bp, Homo sapiens
tcccccacctgacaa

SEQ ID NO: 6412647 - DNA, 15 bp, Homo sapiens
tcccccacgcctcca

SEQ ID NO: 6412648 - DNA, 23 bp, Homo sapiens
tcccccacgtctctctgcctgct

SEQ ID NO: 6412649 - DNA, 23 bp, Homo sapiens
tcccccacgtggactctgtgctc

SEQ ID NO: 6412650 - DNA, 18 bp, Homo sapiens
tcccccactactgcagca

SEQ ID NO: 6412651 - DNA, 14 bp, Homo sapiens
tcccccactctctc

SEQ ID NO: 6412652 - DNA, 15 bp, Homo sapiens
tcccccactgccaca

SEQ ID NO: 6412653 - DNA, 20 bp, Homo sapiens
tcccccactgccacaccctc

SEQ ID NO: 6412654 - DNA, 12 bp, Homo sapiens
tcccccactgct

SEQ ID NO: 6412655 - DNA, 19 bp, Homo sapiens
tcccccactgctaaggctg

SEQ ID NO: 6412656 - DNA, 22 bp, Homo sapiens
tcccccactgctaaggctgctg

SEQ ID NO: 6412657 - DNA, 12 bp, Homo sapiens
tcccccacttca

SEQ ID NO: 6412658 - DNA, 14 bp, Homo sapiens
tcccccacttggga

SEQ ID NO: 6412659 - DNA, 20 bp, Homo sapiens
tcccccagagtgctgtcggg

SEQ ID NO: 6412660 - DNA, 21 bp, Homo sapiens
tcccccagcaaagcccccaga

SEQ ID NO: 6412661 - DNA, 13 bp, Homo sapiens
tcccccagcaagc

SEQ ID NO: 6412662 - DNA, 16 bp, Homo sapiens
tcccccagcaaggcag

SEQ ID NO: 6412663 - DNA, 14 bp, Homo sapiens
tcccccagcagaac

SEQ ID NO: 6412664 - DNA, 20 bp, Homo sapiens
tcccccagcagaaccagcct

SEQ ID NO: 6412665 - DNA, 21 bp, Homo sapiens
tcccccagcagaaccagcctc

SEQ ID NO: 6412666 - DNA, 22 bp, Homo sapiens
tcccccagcagaaccagcctca

SEQ ID NO: 6412667 - DNA, 19 bp, Homo sapiens
tcccccagccaaactgtct

SEQ ID NO: 6412668 - DNA, 23 bp, Homo sapiens
tcccccagccatgccagctggcc

SEQ ID NO: 6412669 - DNA, 12 bp, Homo sapiens
tcccccagccca

SEQ ID NO: 6412670 - DNA, 18 bp, Homo sapiens
tagttgcagactcagttt

SEQ ID NO: 6412671 - DNA, 13 bp, Homo sapiens
tagttgcagccca

SEQ ID NO: 6412672 - DNA, 20 bp, Homo sapiens
tagttgcatagcagtatatg

SEQ ID NO: 6412673 - DNA, 21 bp, Homo sapiens
tagttgccaaatctggctcct

SEQ ID NO: 6412674 - DNA, 19 bp, Homo sapiens
tagttgccaacagttgtat

SEQ ID NO: 6412675 - DNA, 16 bp, Homo sapiens
tagttgccaatctaaa

SEQ ID NO: 6412676 - DNA, 17 bp, Homo sapiens
tagttgcgttacaccct

SEQ ID NO: 6412677 - DNA, 13 bp, Homo sapiens
tagttgctatttt

SEQ ID NO: 6412678 - DNA, 17 bp, Homo sapiens
tagttgctccaactgaa

SEQ ID NO: 6412679 - DNA, 15 bp, Homo sapiens
tagttgctccgcctc

SEQ ID NO: 6412680 - DNA, 17 bp, Homo sapiens
tagttgcttttgaagga

SEQ ID NO: 6412681 - DNA, 21 bp, Homo sapiens
tagttgcttttgaaggaatac

SEQ ID NO: 6412682 - DNA, 11 bp, Homo sapiens
tagttggaatg

SEQ ID NO: 6412683 - DNA, 22 bp, Homo sapiens
tagttggaatgactgaaagaag

SEQ ID NO: 6412684 - DNA, 15 bp, Homo sapiens
tagttgggatgccaa

SEQ ID NO: 6412685 - DNA, 19 bp, Homo sapiens
tagttgggattacaggtga

SEQ ID NO: 6412686 - DNA, 15 bp, Homo sapiens
tagttggtgagaaac

SEQ ID NO: 6412687 - DNA, 15 bp, Homo sapiens
tagttggtgctgatg

SEQ ID NO: 6412688 - DNA, 15 bp, Homo sapiens
tagttggtgttcaaa

SEQ ID NO: 6412689 - DNA, 13 bp, Homo sapiens
tagttggttccta

SEQ ID NO: 6412690 - DNA, 13 bp, Homo sapiens
tagttgtaaagat

SEQ ID NO: 6412691 - DNA, 14 bp, Homo sapiens
tagttgtaaagata

SEQ ID NO: 6412692 - DNA, 15 bp, Homo sapiens
tagttgtaatgtgta

SEQ ID NO: 6412693 - DNA, 22 bp, Homo sapiens
tagttgtagaagaaaatttaat

SEQ ID NO: 6412694 - DNA, 13 bp, Homo sapiens
tagttgtattttg

SEQ ID NO: 6412695 - DNA, 16 bp, Homo sapiens
tagttgtcagaatatg

SEQ ID NO: 6412696 - DNA, 16 bp, Homo sapiens
tagttgtccagagata

SEQ ID NO: 6412697 - DNA, 23 bp, Homo sapiens
tagttgtccagagataaaaatca

SEQ ID NO: 6412698 - DNA, 17 bp, Homo sapiens
tagttgtctctcttcag

SEQ ID NO: 6412699 - DNA, 16 bp, Homo sapiens
tagttgtctgaattga

SEQ ID NO: 6412700 - DNA, 18 bp, Homo sapiens
tagttgtctgaattgaga

SEQ ID NO: 6412701 - DNA, 19 bp, Homo sapiens
tagttgtctgaattgagaa

SEQ ID NO: 6412702 - DNA, 21 bp, Homo sapiens
tagttgtctgaattgagaaaa

SEQ ID NO: 6412703 - DNA, 13 bp, Homo sapiens
tagttgtctttct

SEQ ID NO: 6412704 - DNA, 14 bp, Homo sapiens
tagttgtctttctt

SEQ ID NO: 6412705 - DNA, 13 bp, Homo sapiens
tagttgtgctttt

SEQ ID NO: 6412706 - DNA, 20 bp, Homo sapiens
tagttgtggaaagataataa

SEQ ID NO: 6412707 - DNA, 21 bp, Homo sapiens
tagttgtgggcaacacatgca

SEQ ID NO: 6412708 - DNA, 17 bp, Homo sapiens
tagttgtgggtgggaga

SEQ ID NO: 6412709 - DNA, 18 bp, Homo sapiens
tagttgttggtctgtagc

SEQ ID NO: 6412710 - DNA, 16 bp, Homo sapiens
tagttgttttaagtac

SEQ ID NO: 6412711 - DNA, 23 bp, Homo sapiens
tagtttaaacccaagaagggcac

SEQ ID NO: 6412712 - DNA, 22 bp, Homo sapiens
tagtttaaccatatgcccacat

SEQ ID NO: 6412713 - DNA, 18 bp, Homo sapiens
tagtttaagacttagtta

SEQ ID NO: 6412714 - DNA, 21 bp, Homo sapiens
tagtttaataccccattacca

SEQ ID NO: 6412715 - DNA, 23 bp, Homo sapiens
tagtttaattaactatgtgatgt

SEQ ID NO: 6412716 - DNA, 11 bp, Homo sapiens
tagtttacaat

SEQ ID NO: 6412717 - DNA, 18 bp, Homo sapiens
tagtttaccacttgcctt

SEQ ID NO: 6412718 - DNA, 22 bp, Homo sapiens
tagtttacctcatccatgcact

SEQ ID NO: 6412719 - DNA, 22 bp, Homo sapiens
tagtttacctgaataaatggta

SEQ ID NO: 6412720 - DNA, 15 bp, Homo sapiens
tagtttactatttta

SEQ ID NO: 6412721 - DNA, 16 bp, Homo sapiens
tagtttactgagaatg

SEQ ID NO: 6412722 - DNA, 19 bp, Homo sapiens
tagtttactggataaattt

SEQ ID NO: 6412723 - DNA, 11 bp, Homo sapiens
tagtttactgt

SEQ ID NO: 6412724 - DNA, 16 bp, Homo sapiens
tagtttacttcacttt

SEQ ID NO: 6412725 - DNA, 18 bp, Homo sapiens
tagtttaggagaaaccag

SEQ ID NO: 6412726 - DNA, 22 bp, Homo sapiens
tagtttagtgtggttttctgtt

SEQ ID NO: 6412727 - DNA, 21 bp, Homo sapiens
tagtttatattactctcattc

SEQ ID NO: 6412728 - DNA, 12 bp, Homo sapiens
tagtttatctta

SEQ ID NO: 6412729 - DNA, 20 bp, Homo sapiens
tagtttatgatgcaaatctg

SEQ ID NO: 6412730 - DNA, 22 bp, Homo sapiens
tagtttattattattaaagtct

SEQ ID NO: 6412731 - DNA, 18 bp, Homo sapiens
tagtttattggaagtgtt

SEQ ID NO: 6412732 - DNA, 12 bp, Homo sapiens
tagtttatttct

SEQ ID NO: 6412733 - DNA, 14 bp, Homo sapiens
tagtttattttgtt

SEQ ID NO: 6412734 - DNA, 17 bp, Homo sapiens
tagtttcaaatctgtaa

SEQ ID NO: 6412735 - DNA, 16 bp, Homo sapiens
tagtttcacgtaaata

SEQ ID NO: 6412736 - DNA, 17 bp, Homo sapiens
tagtttcagaagtactg

SEQ ID NO: 6412737 - DNA, 20 bp, Homo sapiens
tagtttcatataaagtatca

SEQ ID NO: 6412738 - DNA, 15 bp, Homo sapiens
tagtttcatttacaa

SEQ ID NO: 6412739 - DNA, 18 bp, Homo sapiens
tagtttccaagaaatttt

SEQ ID NO: 6412740 - DNA, 17 bp, Homo sapiens
tagtttccctggtgccc

SEQ ID NO: 6412741 - DNA, 16 bp, Homo sapiens
tagtttcctgccttca

SEQ ID NO: 6412742 - DNA, 13 bp, Homo sapiens
tagtttctccaag

SEQ ID NO: 6412743 - DNA, 19 bp, Homo sapiens
tagtttctccaagtacttt

SEQ ID NO: 6412744 - DNA, 22 bp, Homo sapiens
tagtttctccaagtacttttgt

SEQ ID NO: 6412745 - DNA, 13 bp, Homo sapiens
tagtttctgaggc

SEQ ID NO: 6412746 - DNA, 16 bp, Homo sapiens
tagtttctgttctgtg

SEQ ID NO: 6412747 - DNA, 12 bp, Homo sapiens
tagtttctttat

SEQ ID NO: 6412748 - DNA, 20 bp, Homo sapiens
tagtttgaaagttgtacatg

SEQ ID NO: 6412749 - DNA, 23 bp, Homo sapiens
tagtttgaaagttgtacatgata

SEQ ID NO: 6412750 - DNA, 22 bp, Homo sapiens
tagtttgaacagatatgttttt

SEQ ID NO: 6412751 - DNA, 16 bp, Homo sapiens
tagtttgaattcagta

SEQ ID NO: 6412752 - DNA, 14 bp, Homo sapiens
tagtttgaggaaat

SEQ ID NO: 6412753 - DNA, 16 bp, Homo sapiens
tagtttgattaaattc

SEQ ID NO: 6412754 - DNA, 11 bp, Homo sapiens
tagtttgcatt

SEQ ID NO: 6412755 - DNA, 14 bp, Homo sapiens
tagtttgcattcca

SEQ ID NO: 6412756 - DNA, 21 bp, Homo sapiens
tagtttgcattccagcgtctg

SEQ ID NO: 6412757 - DNA, 17 bp, Homo sapiens
tagtttgcattcctgat

SEQ ID NO: 6412758 - DNA, 17 bp, Homo sapiens
tagtttgcatttaagaa

SEQ ID NO: 6412759 - DNA, 13 bp, Homo sapiens
tagtttgcccaga

SEQ ID NO: 6412760 - DNA, 15 bp, Homo sapiens
tagtttgcccagagt

SEQ ID NO: 6412761 - DNA, 17 bp, Homo sapiens
tagtttggaaataaaaa

SEQ ID NO: 6412762 - DNA, 18 bp, Homo sapiens
tagtttggcacatgcagg

SEQ ID NO: 6412763 - DNA, 18 bp, Homo sapiens
tagtttggggcaaaaatc

SEQ ID NO: 6412764 - DNA, 13 bp, Homo sapiens
tagtttggttcac

SEQ ID NO: 6412765 - DNA, 19 bp, Homo sapiens
tagtttgtaccatttatga

SEQ ID NO: 6412766 - DNA, 18 bp, Homo sapiens
tagtttgtactcagtgga

SEQ ID NO: 6412767 - DNA, 12 bp, Homo sapiens
tagtttgtctat

SEQ ID NO: 6412768 - DNA, 18 bp, Homo sapiens
tagtttgtctattttaaa

SEQ ID NO: 6412769 - DNA, 19 bp, Homo sapiens
tagtttgttaattgattaa

SEQ ID NO: 6412770 - DNA, 13 bp, Homo sapiens
tagtttgtttctg

SEQ ID NO: 6412771 - DNA, 20 bp, Homo sapiens
tagtttgttttctttttctg

SEQ ID NO: 6412772 - DNA, 20 bp, Homo sapiens
tagttttaacagaaccagag

SEQ ID NO: 6412773 - DNA, 22 bp, Homo sapiens
tagttttacactaggaaacgtg

SEQ ID NO: 6412774 - DNA, 12 bp, Homo sapiens
tagttttacatt

SEQ ID NO: 6412775 - DNA, 13 bp, Homo sapiens
tagttttacatta

SEQ ID NO: 6412776 - DNA, 16 bp, Homo sapiens
tagttttactttgaac

SEQ ID NO: 6412777 - DNA, 14 bp, Homo sapiens
tagttttactttta

SEQ ID NO: 6412778 - DNA, 15 bp, Homo sapiens
tagttttagacctca

SEQ ID NO: 6412779 - DNA, 16 bp, Homo sapiens
tagttttatatgcttc

SEQ ID NO: 6412780 - DNA, 17 bp, Homo sapiens
tagttttatcacatgta

SEQ ID NO: 6412781 - DNA, 13 bp, Homo sapiens
tagttttatctta

SEQ ID NO: 6412782 - DNA, 20 bp, Homo sapiens
tagttttatggcatgattta

SEQ ID NO: 6412783 - DNA, 14 bp, Homo sapiens
tagttttatttata

SEQ ID NO: 6412784 - DNA, 15 bp, Homo sapiens
tagttttatttatat

SEQ ID NO: 6412785 - DNA, 23 bp, Homo sapiens
tagttttattttctaaagtactg

SEQ ID NO: 6412786 - DNA, 23 bp, Homo sapiens
tagttttcatacacagcctgggc

SEQ ID NO: 6412787 - DNA, 13 bp, Homo sapiens
tagttttctaaat

SEQ ID NO: 6412788 - DNA, 14 bp, Homo sapiens
tagttttctaaatg

SEQ ID NO: 6412789 - DNA, 16 bp, Homo sapiens
tagttttctaaatgtt

SEQ ID NO: 6412790 - DNA, 18 bp, Homo sapiens
tagttttctagatgacat

SEQ ID NO: 6412791 - DNA, 13 bp, Homo sapiens
tagttttcttgtt

SEQ ID NO: 6412792 - DNA, 18 bp, Homo sapiens
tagttttctttgtaaagg

SEQ ID NO: 6412793 - DNA, 21 bp, Homo sapiens
tagttttgagtgtatacatgt

SEQ ID NO: 6412794 - DNA, 12 bp, Homo sapiens
tagttttgcata

SEQ ID NO: 6412795 - DNA, 22 bp, Homo sapiens
tagttttgggaggggatggcag

SEQ ID NO: 6412796 - DNA, 22 bp, Homo sapiens
tagttttggttatttctaaacc

SEQ ID NO: 6412797 - DNA, 22 bp, Homo sapiens
tagttttgtaaaaactgaagaa

SEQ ID NO: 6412798 - DNA, 18 bp, Homo sapiens
tagttttgtgatgcattt

SEQ ID NO: 6412799 - DNA, 16 bp, Homo sapiens
tagttttgttccaaca

SEQ ID NO: 6412800 - DNA, 21 bp, Homo sapiens
tagtttttaaaatttatttgc

SEQ ID NO: 6412801 - DNA, 16 bp, Homo sapiens
tagtttttaattaaaa

SEQ ID NO: 6412802 - DNA, 14 bp, Homo sapiens
tagtttttatatta

SEQ ID NO: 6412803 - DNA, 19 bp, Homo sapiens
tagtttttattaaactcat

SEQ ID NO: 6412804 - DNA, 15 bp, Homo sapiens
tagtttttctgtcat

SEQ ID NO: 6412805 - DNA, 23 bp, Homo sapiens
tagtttttgatcaagaatgcaat

SEQ ID NO: 6412806 - DNA, 20 bp, Homo sapiens
tagtttttgcagggttttat

SEQ ID NO: 6412807 - DNA, 10 bp, Homo sapiens
tagtttttgt

SEQ ID NO: 6412808 - DNA, 17 bp, Homo sapiens
tagttttttcttttaac

SEQ ID NO: 6412809 - DNA, 21 bp, Homo sapiens
tagtttttttttaatctaaat

SEQ ID NO: 6412810 - DNA, 22 bp, Homo sapiens
tataaaaaaaagttgtttataa

SEQ ID NO: 6412811 - DNA, 16 bp, Homo sapiens
tataaaaaaaatgaaa

SEQ ID NO: 6412812 - DNA, 17 bp, Homo sapiens
tataaaaaaaatgaaat

SEQ ID NO: 6412813 - DNA, 22 bp, Homo sapiens
tataaaaaaattgtaaatgttt

SEQ ID NO: 6412814 - DNA, 19 bp, Homo sapiens
tataaaaaactcacaggtg

SEQ ID NO: 6412815 - DNA, 21 bp, Homo sapiens
tataaaaaagaaaacttgtgt

SEQ ID NO: 6412816 - DNA, 14 bp, Homo sapiens
tataaaaaataagt

SEQ ID NO: 6412817 - DNA, 15 bp, Homo sapiens
tataaaaaatatatg

SEQ ID NO: 6412818 - DNA, 17 bp, Homo sapiens
tataaaaaatatatgta

SEQ ID NO: 6412819 - DNA, 14 bp, Homo sapiens
tataaaaaatatgt

SEQ ID NO: 6412820 - DNA, 15 bp, Homo sapiens
tataaaaaatatgta

SEQ ID NO: 6412821 - DNA, 12 bp, Homo sapiens
tataaaaaatgg

SEQ ID NO: 6412822 - DNA, 21 bp, Homo sapiens
tataaaaaatggttcagaatt

SEQ ID NO: 6412823 - DNA, 20 bp, Homo sapiens
tataaaaaattaacttagtt

SEQ ID NO: 6412824 - DNA, 12 bp, Homo sapiens
tataaaaacaaa

SEQ ID NO: 6412825 - DNA, 12 bp, Homo sapiens
tataaaaacaac

SEQ ID NO: 6412826 - DNA, 23 bp, Homo sapiens
tataaaaacaacaaatacttcca

SEQ ID NO: 6412827 - DNA, 13 bp, Homo sapiens
tataaaaacactt

SEQ ID NO: 6412828 - DNA, 13 bp, Homo sapiens
tataaaaacattg

SEQ ID NO: 6412829 - DNA, 20 bp, Homo sapiens
tataaaaacattgaaatatt

SEQ ID NO: 6412830 - DNA, 14 bp, Homo sapiens
tataaaaacatttt

SEQ ID NO: 6412831 - DNA, 20 bp, Homo sapiens
tataaaaaccccaaactgtt

SEQ ID NO: 6412832 - DNA, 21 bp, Homo sapiens
tataaaaacccctaaaaacaa

SEQ ID NO: 6412833 - DNA, 13 bp, Homo sapiens
tataaaaaggaaa

SEQ ID NO: 6412834 - DNA, 14 bp, Homo sapiens
tataaaaaggaaat

SEQ ID NO: 6412835 - DNA, 16 bp, Homo sapiens
tataaaaatataaatt

SEQ ID NO: 6412836 - DNA, 22 bp, Homo sapiens
tataaaaatataaattgtacat

SEQ ID NO: 6412837 - DNA, 13 bp, Homo sapiens
tataaaaatatat

SEQ ID NO: 6412838 - DNA, 19 bp, Homo sapiens
tataaaaatatatgttgaa

SEQ ID NO: 6412839 - DNA, 16 bp, Homo sapiens
tataaaaattatcaaa

SEQ ID NO: 6412840 - DNA, 19 bp, Homo sapiens
tataaaacaaaacaaacaa

SEQ ID NO: 6412841 - DNA, 23 bp, Homo sapiens
tataaaacagccctatttcttga

SEQ ID NO: 6412842 - DNA, 14 bp, Homo sapiens
tataaaacagtcat

SEQ ID NO: 6412843 - DNA, 13 bp, Homo sapiens
tataaaactcagt

SEQ ID NO: 6412844 - DNA, 21 bp, Homo sapiens
tataaaactcagttaaaatgt

SEQ ID NO: 6412845 - DNA, 17 bp, Homo sapiens
tataaaactgaaataaa

SEQ ID NO: 6412846 - DNA, 12 bp, Homo sapiens
tataaaacttct

SEQ ID NO: 6412847 - DNA, 13 bp, Homo sapiens
tataaaagatata

SEQ ID NO: 6412848 - DNA, 16 bp, Homo sapiens
tataaaagcaaaagag

SEQ ID NO: 6412849 - DNA, 17 bp, Homo sapiens
tataaaagcaaaagaga

SEQ ID NO: 6412850 - DNA, 14 bp, Homo sapiens
tcccccagcccaat

SEQ ID NO: 6412851 - DNA, 16 bp, Homo sapiens
tcccccagcccaataa

SEQ ID NO: 6412852 - DNA, 17 bp, Homo sapiens
tcccccagcccaataaa

SEQ ID NO: 6412853 - DNA, 20 bp, Homo sapiens
tcccccagcccaataaaggt

SEQ ID NO: 6412854 - DNA, 15 bp, Homo sapiens
tcccccagccccatc

SEQ ID NO: 6412855 - DNA, 17 bp, Homo sapiens
tcccccagccccatcct

SEQ ID NO: 6412856 - DNA, 21 bp, Homo sapiens
tcccccagccccatcctctgt

SEQ ID NO: 6412857 - DNA, 13 bp, Homo sapiens
tcccccagccctg

SEQ ID NO: 6412858 - DNA, 14 bp, Homo sapiens
tcccccagccctgt

SEQ ID NO: 6412859 - DNA, 15 bp, Homo sapiens
tcccccagccctgtg

SEQ ID NO: 6412860 - DNA, 12 bp, Homo sapiens
tcccccaggacc

SEQ ID NO: 6412861 - DNA, 16 bp, Homo sapiens
tcccccaggaccctga

SEQ ID NO: 6412862 - DNA, 12 bp, Homo sapiens
tcccccaggagg

SEQ ID NO: 6412863 - DNA, 17 bp, Homo sapiens
tcccccaggaggcagct

SEQ ID NO: 6412864 - DNA, 12 bp, Homo sapiens
tcccccaggcct

SEQ ID NO: 6412865 - DNA, 14 bp, Homo sapiens
tcccccaggcctga

SEQ ID NO: 6412866 - DNA, 17 bp, Homo sapiens
tcccccaggcctgagct

SEQ ID NO: 6412867 - DNA, 21 bp, Homo sapiens
tcccccaggctgcgcctgccc

SEQ ID NO: 6412868 - DNA, 14 bp, Homo sapiens
tcccccaggctgga

SEQ ID NO: 6412869 - DNA, 18 bp, Homo sapiens
tcccccaggctgttctcc

SEQ ID NO: 6412870 - DNA, 20 bp, Homo sapiens
tcccccagggaatcagggac

SEQ ID NO: 6412871 - DNA, 17 bp, Homo sapiens
tcccccagggtcccctg

SEQ ID NO: 6412872 - DNA, 19 bp, Homo sapiens
tcccccaggtgttgtaaca

SEQ ID NO: 6412873 - DNA, 23 bp, Homo sapiens
tcccccagtcattctgggaacat

SEQ ID NO: 6412874 - DNA, 20 bp, Homo sapiens
tcccccataaaatgatcctg

SEQ ID NO: 6412875 - DNA, 18 bp, Homo sapiens
tcccccatagcaccctgc

SEQ ID NO: 6412876 - DNA, 15 bp, Homo sapiens
tcccccatagccacc

SEQ ID NO: 6412877 - DNA, 16 bp, Homo sapiens
tcccccatcatgtggc

SEQ ID NO: 6412878 - DNA, 19 bp, Homo sapiens
tcccccatcccccactgcc

SEQ ID NO: 6412879 - DNA, 20 bp, Homo sapiens
tcccccatcccctttcctcc

SEQ ID NO: 6412880 - DNA, 13 bp, Homo sapiens
tcccccatcccta

SEQ ID NO: 6412881 - DNA, 22 bp, Homo sapiens
tcccccatccctaccactgtgg

SEQ ID NO: 6412882 - DNA, 13 bp, Homo sapiens
tcccccatccttc

SEQ ID NO: 6412883 - DNA, 17 bp, Homo sapiens
tcccccatctcttctgg

SEQ ID NO: 6412884 - DNA, 19 bp, Homo sapiens
tcccccatcttcatcccaa

SEQ ID NO: 6412885 - DNA, 12 bp, Homo sapiens
tcccccatgcca

SEQ ID NO: 6412886 - DNA, 19 bp, Homo sapiens
tcccccatgccaccaccca

SEQ ID NO: 6412887 - DNA, 14 bp, Homo sapiens
tcccccatgggctg

SEQ ID NO: 6412888 - DNA, 15 bp, Homo sapiens
tcccccatgtgcctg

SEQ ID NO: 6412889 - DNA, 18 bp, Homo sapiens
tcccccattccctccatt

SEQ ID NO: 6412890 - DNA, 17 bp, Homo sapiens
tccccccacaagtgccc

SEQ ID NO: 6412891 - DNA, 22 bp, Homo sapiens
tccccccacaagtgccctccag

SEQ ID NO: 6412892 - DNA, 18 bp, Homo sapiens
tccccccaccccccagca

SEQ ID NO: 6412893 - DNA, 13 bp, Homo sapiens
tccccccacccct

SEQ ID NO: 6412894 - DNA, 21 bp, Homo sapiens
tccccccactctccccacact

SEQ ID NO: 6412895 - DNA, 19 bp, Homo sapiens
tccccccactgcaggcccc

SEQ ID NO: 6412896 - DNA, 12 bp, Homo sapiens
tccccccagact

SEQ ID NO: 6412897 - DNA, 13 bp, Homo sapiens
tccccccagactc

SEQ ID NO: 6412898 - DNA, 15 bp, Homo sapiens
tccccccagcccctc

SEQ ID NO: 6412899 - DNA, 13 bp, Homo sapiens
tccccccagtggg

SEQ ID NO: 6412900 - DNA, 23 bp, Homo sapiens
tccccccagtgggatgggacagg

SEQ ID NO: 6412901 - DNA, 22 bp, Homo sapiens
tccccccatcccagggtcccac

SEQ ID NO: 6412902 - DNA, 18 bp, Homo sapiens
tcccccccatgcactgtg

SEQ ID NO: 6412903 - DNA, 18 bp, Homo sapiens
tccccccccaacctttcc

SEQ ID NO: 6412904 - DNA, 14 bp, Homo sapiens
tccccccccaggcc

SEQ ID NO: 6412905 - DNA, 21 bp, Homo sapiens
tccccccccaggccctcccac

SEQ ID NO: 6412906 - DNA, 23 bp, Homo sapiens
tccccccccaggccctcccacca

SEQ ID NO: 6412907 - DNA, 19 bp, Homo sapiens
tccccccgagtctccggga

SEQ ID NO: 6412908 - DNA, 13 bp, Homo sapiens
tccccccgcccac

SEQ ID NO: 6412909 - DNA, 19 bp, Homo sapiens
tccccccgcccacccacgc

SEQ ID NO: 6412910 - DNA, 22 bp, Homo sapiens
tccccccgcctctgtctggagc

SEQ ID NO: 6412911 - DNA, 13 bp, Homo sapiens
tcccccctccctg

SEQ ID NO: 6412912 - DNA, 19 bp, Homo sapiens
tcccccctcctctgaaaca

SEQ ID NO: 6412913 - DNA, 14 bp, Homo sapiens
tcccccctctcctc

SEQ ID NO: 6412914 - DNA, 18 bp, Homo sapiens
tcccccctctcctcccag

SEQ ID NO: 6412915 - DNA, 12 bp, Homo sapiens
tcccccctgagt

SEQ ID NO: 6412916 - DNA, 12 bp, Homo sapiens
tcccccctgtgg

SEQ ID NO: 6412917 - DNA, 21 bp, Homo sapiens
tcccccgaccaatccccagcc

SEQ ID NO: 6412918 - DNA, 23 bp, Homo sapiens
tcccccgaccaatccccagccta

SEQ ID NO: 6412919 - DNA, 15 bp, Homo sapiens
tcccccgactgcctg

SEQ ID NO: 6412920 - DNA, 21 bp, Homo sapiens
tcccccgactgcctgtctcca

SEQ ID NO: 6412921 - DNA, 21 bp, Homo sapiens
tcccccgagctcttggccttt

SEQ ID NO: 6412922 - DNA, 22 bp, Homo sapiens
tcccccgcagtccccagccctt

SEQ ID NO: 6412923 - DNA, 15 bp, Homo sapiens
tcccccgccagcccc

SEQ ID NO: 6412924 - DNA, 15 bp, Homo sapiens
tcccccgcccaaggc

SEQ ID NO: 6412925 - DNA, 15 bp, Homo sapiens
tcccccgccctgccc

SEQ ID NO: 6412926 - DNA, 14 bp, Homo sapiens
tcccccgccgcgcc

SEQ ID NO: 6412927 - DNA, 19 bp, Homo sapiens
tcccccgccgcttttctcc

SEQ ID NO: 6412928 - DNA, 17 bp, Homo sapiens
tcccccgctggcagcca

SEQ ID NO: 6412929 - DNA, 17 bp, Homo sapiens
tcccccggcacctccct

SEQ ID NO: 6412930 - DNA, 19 bp, Homo sapiens
tcccccggctgggcctcct

SEQ ID NO: 6412931 - DNA, 15 bp, Homo sapiens
tcccccgtggtgcct

SEQ ID NO: 6412932 - DNA, 21 bp, Homo sapiens
tcccccgtggtgcctgcacac

SEQ ID NO: 6412933 - DNA, 16 bp, Homo sapiens
tcccccgtttctcctt

SEQ ID NO: 6412934 - DNA, 15 bp, Homo sapiens
tccccctaaacacac

SEQ ID NO: 6412935 - DNA, 21 bp, Homo sapiens
tccccctacagatcctccgcg

SEQ ID NO: 6412936 - DNA, 19 bp, Homo sapiens
tccccctaccgcatggcag

SEQ ID NO: 6412937 - DNA, 23 bp, Homo sapiens
tccccctaccgcatggcagctgg

SEQ ID NO: 6412938 - DNA, 14 bp, Homo sapiens
tccccctagccatt

SEQ ID NO: 6412939 - DNA, 16 bp, Homo sapiens
tccccctagccatttt

SEQ ID NO: 6412940 - DNA, 17 bp, Homo sapiens
tccccctatccttggca

SEQ ID NO: 6412941 - DNA, 22 bp, Homo sapiens
tccccctatttattgactttga

SEQ ID NO: 6412942 - DNA, 12 bp, Homo sapiens
tccccctcagct

SEQ ID NO: 6412943 - DNA, 14 bp, Homo sapiens
tccccctccagtgc

SEQ ID NO: 6412944 - DNA, 23 bp, Homo sapiens
tccccctccagtgcttggctgcc

SEQ ID NO: 6412945 - DNA, 13 bp, Homo sapiens
tccccctccccag

SEQ ID NO: 6412946 - DNA, 17 bp, Homo sapiens
tccccctccccctcctg

SEQ ID NO: 6412947 - DNA, 20 bp, Homo sapiens
tccccctcccccttctccca

SEQ ID NO: 6412948 - DNA, 20 bp, Homo sapiens
tccccctccccggcatcatt

SEQ ID NO: 6412949 - DNA, 10 bp, Homo sapiens
tccccctcct

SEQ ID NO: 6412950 - DNA, 20 bp, Homo sapiens
tccccctcctccagggaagg

SEQ ID NO: 6412951 - DNA, 16 bp, Homo sapiens
tccccctcctccgggg

SEQ ID NO: 6412952 - DNA, 15 bp, Homo sapiens
tccccctcctgctgt

SEQ ID NO: 6412953 - DNA, 19 bp, Homo sapiens
tccccctccttcccagctg

SEQ ID NO: 6412954 - DNA, 11 bp, Homo sapiens
tccccctctgc

SEQ ID NO: 6412955 - DNA, 13 bp, Homo sapiens
tccccctctgctt

SEQ ID NO: 6412956 - DNA, 14 bp, Homo sapiens
tccccctctgtctt

SEQ ID NO: 6412957 - DNA, 17 bp, Homo sapiens
tccccctcttcttctga

SEQ ID NO: 6412958 - DNA, 12 bp, Homo sapiens
tccccctgcaac

SEQ ID NO: 6412959 - DNA, 14 bp, Homo sapiens
tccccctgcagccg

SEQ ID NO: 6412960 - DNA, 13 bp, Homo sapiens
tccccctgcagct

SEQ ID NO: 6412961 - DNA, 12 bp, Homo sapiens
tccccctgccag

SEQ ID NO: 6412962 - DNA, 13 bp, Homo sapiens
tccccctgccaga

SEQ ID NO: 6412963 - DNA, 16 bp, Homo sapiens
tccccctgccagaggc

SEQ ID NO: 6412964 - DNA, 19 bp, Homo sapiens
tccccctgccagaggcctg

SEQ ID NO: 6412965 - DNA, 23 bp, Homo sapiens
tccccctgccagaggcctggtgc

SEQ ID NO: 6412966 - DNA, 13 bp, Homo sapiens
tccccctgccagc

SEQ ID NO: 6412967 - DNA, 23 bp, Homo sapiens
tccccctgccctcgtggccagcc

SEQ ID NO: 6412968 - DNA, 14 bp, Homo sapiens
tccccctgccctgt

SEQ ID NO: 6412969 - DNA, 20 bp, Homo sapiens
tccccctgccctgtgccgca

SEQ ID NO: 6412970 - DNA, 22 bp, Homo sapiens
tccccctgctccatgggcacct

SEQ ID NO: 6412971 - DNA, 20 bp, Homo sapiens
tccccctgcttctcagcccc

SEQ ID NO: 6412972 - DNA, 16 bp, Homo sapiens
tccccctggacggggc

SEQ ID NO: 6412973 - DNA, 17 bp, Homo sapiens
tccccctggcactggtt

SEQ ID NO: 6412974 - DNA, 12 bp, Homo sapiens
tccccctgggct

SEQ ID NO: 6412975 - DNA, 20 bp, Homo sapiens
tccccctgggctctgcccca

SEQ ID NO: 6412976 - DNA, 20 bp, Homo sapiens
tccccctggggcttctcctg

SEQ ID NO: 6412977 - DNA, 21 bp, Homo sapiens
tccccctggggcttctcctga

SEQ ID NO: 6412978 - DNA, 13 bp, Homo sapiens
tccccctgtggaa

SEQ ID NO: 6412979 - DNA, 21 bp, Homo sapiens
tccccctgtttcagaggctca

SEQ ID NO: 6412980 - DNA, 17 bp, Homo sapiens
tccccctgttttctgtt

SEQ ID NO: 6412981 - DNA, 19 bp, Homo sapiens
tcccccttaaacttccaaa

SEQ ID NO: 6412982 - DNA, 18 bp, Homo sapiens
tcccccttaagccaacaa

SEQ ID NO: 6412983 - DNA, 15 bp, Homo sapiens
tcccccttagaatgt

SEQ ID NO: 6412984 - DNA, 14 bp, Homo sapiens
tcccccttcacaaa

SEQ ID NO: 6412985 - DNA, 18 bp, Homo sapiens
tcccccttcagctcctga

SEQ ID NO: 6412986 - DNA, 15 bp, Homo sapiens
tcccccttcatccat

SEQ ID NO: 6412987 - DNA, 11 bp, Homo sapiens
tcccccttccc

SEQ ID NO: 6412988 - DNA, 16 bp, Homo sapiens
tcccccttcccgcctt

SEQ ID NO: 6412989 - DNA, 19 bp, Homo sapiens
tcccccttcccgccttcca

SEQ ID NO: 6412990 - DNA, 19 bp, Homo sapiens
tcccccttcccttggaggg

SEQ ID NO: 6412991 - DNA, 20 bp, Homo sapiens
tcccccttcccttggaggga

SEQ ID NO: 6412992 - DNA, 16 bp, Homo sapiens
tcccccttcgtggagc

SEQ ID NO: 6412993 - DNA, 17 bp, Homo sapiens
tcccccttcgtggagct

SEQ ID NO: 6412994 - DNA, 12 bp, Homo sapiens
tcccccttctcc

SEQ ID NO: 6412995 - DNA, 19 bp, Homo sapiens
tcccccttcttcctcccct

SEQ ID NO: 6412996 - DNA, 22 bp, Homo sapiens
tcccccttgatcgacttcttgg

SEQ ID NO: 6412997 - DNA, 13 bp, Homo sapiens
tcccccttgccac

SEQ ID NO: 6412998 - DNA, 14 bp, Homo sapiens
tcccccttgccacc

SEQ ID NO: 6412999 - DNA, 17 bp, Homo sapiens
tcccccttgtcttcccc

SEQ ID NO: 6413000 - DNA, 19 bp, Homo sapiens
tccccctttcacactggat

SEQ ID NO: 6413001 - DNA, 14 bp, Homo sapiens
tccccctttctctg

SEQ ID NO: 6413002 - DNA, 19 bp, Homo sapiens
tccccctttctctgcctgg

SEQ ID NO: 6413003 - DNA, 16 bp, Homo sapiens
tccccctttcttcctc

SEQ ID NO: 6413004 - DNA, 14 bp, Homo sapiens
tccccctttggggt

SEQ ID NO: 6413005 - DNA, 15 bp, Homo sapiens
tccccctttggggta

SEQ ID NO: 6413006 - DNA, 23 bp, Homo sapiens
tccccctttggggtagaccttga

SEQ ID NO: 6413007 - DNA, 19 bp, Homo sapiens
tcccccttttctgcatttt

SEQ ID NO: 6413008 - DNA, 21 bp, Homo sapiens
tcccccttttttgtcccccaa

SEQ ID NO: 6413009 - DNA, 15 bp, Homo sapiens
tccccgacagtggct

SEQ ID NO: 6413010 - DNA, 17 bp, Homo sapiens
tccccgaggagctgggc

SEQ ID NO: 6413011 - DNA, 13 bp, Homo sapiens
tccccgaggctgc

SEQ ID NO: 6413012 - DNA, 13 bp, Homo sapiens
tccccgagggcgg

SEQ ID NO: 6413013 - DNA, 22 bp, Homo sapiens
tccccgaggttgtggggaggct

SEQ ID NO: 6413014 - DNA, 23 bp, Homo sapiens
tccccgaggttgtggggaggctg

SEQ ID NO: 6413015 - DNA, 22 bp, Homo sapiens
tccccgagtcagggcgacttcc

SEQ ID NO: 6413016 - DNA, 13 bp, Homo sapiens
tccccgagtcctc

SEQ ID NO: 6413017 - DNA, 17 bp, Homo sapiens
tccccgagtgactctgg

SEQ ID NO: 6413018 - DNA, 18 bp, Homo sapiens
tccccgagtttccccaga

SEQ ID NO: 6413019 - DNA, 23 bp, Homo sapiens
tccccgataccatgctgtaagga

SEQ ID NO: 6413020 - DNA, 17 bp, Homo sapiens
tccccgatgctgacctc

SEQ ID NO: 6413021 - DNA, 20 bp, Homo sapiens
tccccgatgtcccctgcggg

SEQ ID NO: 6413022 - DNA, 24 bp, Homo sapiens
tccccgatgtgagccgcctcggag

SEQ ID NO: 6413023 - DNA, 17 bp, Homo sapiens
tccccgcaacccacagc

SEQ ID NO: 6413024 - DNA, 18 bp, Homo sapiens
tccccgcaacccacagct

SEQ ID NO: 6413025 - DNA, 19 bp, Homo sapiens
tccccgcagcccgcctgcc

SEQ ID NO: 6413026 - DNA, 20 bp, Homo sapiens
tccccgcagcccgcctgccg

SEQ ID NO: 6413027 - DNA, 15 bp, Homo sapiens
tccccgcagccctct

SEQ ID NO: 6413028 - DNA, 20 bp, Homo sapiens
tccccgcagccctctccacc

SEQ ID NO: 6413029 - DNA, 18 bp, Homo sapiens
tccccgcagccctggcag

SEQ ID NO: 6413030 - DNA, 12 bp, Homo sapiens
tataaaagccca

SEQ ID NO: 6413031 - DNA, 12 bp, Homo sapiens
tataaaagcctg

SEQ ID NO: 6413032 - DNA, 17 bp, Homo sapiens
tataaaagcctgtttaa

SEQ ID NO: 6413033 - DNA, 20 bp, Homo sapiens
tataaaaggcaaatgtgtac

SEQ ID NO: 6413034 - DNA, 15 bp, Homo sapiens
tataaaaggttgcca

SEQ ID NO: 6413035 - DNA, 19 bp, Homo sapiens
tataaaagtttaaagaaga

SEQ ID NO: 6413036 - DNA, 14 bp, Homo sapiens
tataaaataaacac

SEQ ID NO: 6413037 - DNA, 14 bp, Homo sapiens
tataaaataaactt

SEQ ID NO: 6413038 - DNA, 17 bp, Homo sapiens
tataaaataaagcaaat

SEQ ID NO: 6413039 - DNA, 19 bp, Homo sapiens
tataaaataaatatatata

SEQ ID NO: 6413040 - DNA, 12 bp, Homo sapiens
tataaaataact

SEQ ID NO: 6413041 - DNA, 22 bp, Homo sapiens
tataaaataatttttatatttg

SEQ ID NO: 6413042 - DNA, 13 bp, Homo sapiens
tataaaatacacg

SEQ ID NO: 6413043 - DNA, 14 bp, Homo sapiens
tataaaatacacgt

SEQ ID NO: 6413044 - DNA, 23 bp, Homo sapiens
tataaaatacacgtgtatatgag

SEQ ID NO: 6413045 - DNA, 12 bp, Homo sapiens
tataaaatacag

SEQ ID NO: 6413046 - DNA, 13 bp, Homo sapiens
tataaaatacata

SEQ ID NO: 6413047 - DNA, 15 bp, Homo sapiens
tataaaatacatagt

SEQ ID NO: 6413048 - DNA, 12 bp, Homo sapiens
tataaaatagac

SEQ ID NO: 6413049 - DNA, 14 bp, Homo sapiens
tataaaatatctat

SEQ ID NO: 6413050 - DNA, 21 bp, Homo sapiens
tataaaatatgaagacataaa

SEQ ID NO: 6413051 - DNA, 23 bp, Homo sapiens
tataaaatatgaagacataaacc

SEQ ID NO: 6413052 - DNA, 15 bp, Homo sapiens
tataaaatattttca

SEQ ID NO: 6413053 - DNA, 22 bp, Homo sapiens
tataaaatccaaaatgaatgca

SEQ ID NO: 6413054 - DNA, 21 bp, Homo sapiens
tataaaatcctgtgcaataga

SEQ ID NO: 6413055 - DNA, 19 bp, Homo sapiens
tataaaatctgaattttgc

SEQ ID NO: 6413056 - DNA, 12 bp, Homo sapiens
tataaaatgaaa

SEQ ID NO: 6413057 - DNA, 14 bp, Homo sapiens
tataaaatgaaaga

SEQ ID NO: 6413058 - DNA, 17 bp, Homo sapiens
tataaaatgaaagattt

SEQ ID NO: 6413059 - DNA, 19 bp, Homo sapiens
tataaaatgcaaaataaat

SEQ ID NO: 6413060 - DNA, 22 bp, Homo sapiens
tataaaatgcagtaacattcta

SEQ ID NO: 6413061 - DNA, 17 bp, Homo sapiens
tataaaatgctgatatt

SEQ ID NO: 6413062 - DNA, 15 bp, Homo sapiens
tataaaatggacaca

SEQ ID NO: 6413063 - DNA, 20 bp, Homo sapiens
tataaaatggcaacaaactg

SEQ ID NO: 6413064 - DNA, 22 bp, Homo sapiens
tataaaatggcaacaaactgca

SEQ ID NO: 6413065 - DNA, 17 bp, Homo sapiens
tataaaatgggaagact

SEQ ID NO: 6413066 - DNA, 18 bp, Homo sapiens
tataaaatgtatcaacac

SEQ ID NO: 6413067 - DNA, 18 bp, Homo sapiens
tataaaatgtattcaagc

SEQ ID NO: 6413068 - DNA, 19 bp, Homo sapiens
tataaaatgtattcaagca

SEQ ID NO: 6413069 - DNA, 21 bp, Homo sapiens
tataaaatgtgcagatgcaat

SEQ ID NO: 6413070 - DNA, 15 bp, Homo sapiens
tataaaatgtttcaa

SEQ ID NO: 6413071 - DNA, 16 bp, Homo sapiens
tataaaattaaagaaa

SEQ ID NO: 6413072 - DNA, 16 bp, Homo sapiens
tataaaattatgaaaa

SEQ ID NO: 6413073 - DNA, 22 bp, Homo sapiens
tataaaattgaaaacactaaca

SEQ ID NO: 6413074 - DNA, 23 bp, Homo sapiens
tataaacaaacaaacaaaaattg

SEQ ID NO: 6413075 - DNA, 18 bp, Homo sapiens
tataaacaaagattcatg

SEQ ID NO: 6413076 - DNA, 15 bp, Homo sapiens
tataaacaagaaaaa

SEQ ID NO: 6413077 - DNA, 20 bp, Homo sapiens
tataaacaagaaaaataaag

SEQ ID NO: 6413078 - DNA, 22 bp, Homo sapiens
tataaacaagaatgaaggtttt

SEQ ID NO: 6413079 - DNA, 20 bp, Homo sapiens
tataaacaataaaaacaact

SEQ ID NO: 6413080 - DNA, 11 bp, Homo sapiens
tataaacacag

SEQ ID NO: 6413081 - DNA, 14 bp, Homo sapiens
tataaacactatat

SEQ ID NO: 6413082 - DNA, 19 bp, Homo sapiens
tataaacactgtattgtaa

SEQ ID NO: 6413083 - DNA, 16 bp, Homo sapiens
tataaacagaaatgga

SEQ ID NO: 6413084 - DNA, 18 bp, Homo sapiens
tataaacagaaatggaaa

SEQ ID NO: 6413085 - DNA, 14 bp, Homo sapiens
tataaacagcaact

SEQ ID NO: 6413086 - DNA, 23 bp, Homo sapiens
tataaacagcagggtttgagcac

SEQ ID NO: 6413087 - DNA, 20 bp, Homo sapiens
tataaacatatacagaaaaa

SEQ ID NO: 6413088 - DNA, 17 bp, Homo sapiens
tataaacatcacacaca

SEQ ID NO: 6413089 - DNA, 18 bp, Homo sapiens
tataaacatcacacacac

SEQ ID NO: 6413090 - DNA, 13 bp, Homo sapiens
tataaacatgaag

SEQ ID NO: 6413091 - DNA, 23 bp, Homo sapiens
tataaacattaaaagaagactgg

SEQ ID NO: 6413092 - DNA, 18 bp, Homo sapiens
tataaacattaaatgtct

SEQ ID NO: 6413093 - DNA, 17 bp, Homo sapiens
tataaaccaatcttaaa

SEQ ID NO: 6413094 - DNA, 20 bp, Homo sapiens
tataaaccataaaataaata

SEQ ID NO: 6413095 - DNA, 15 bp, Homo sapiens
tataaacctgacctc

SEQ ID NO: 6413096 - DNA, 17 bp, Homo sapiens
tataaaccttaaatgaa

SEQ ID NO: 6413097 - DNA, 23 bp, Homo sapiens
tataaaccttgtcaataaaaata

SEQ ID NO: 6413098 - DNA, 18 bp, Homo sapiens
tataaacgatatatgtaa

SEQ ID NO: 6413099 - DNA, 19 bp, Homo sapiens
tataaacgatatatgtaaa

SEQ ID NO: 6413100 - DNA, 20 bp, Homo sapiens
tataaacgatatatgtaaat

SEQ ID NO: 6413101 - DNA, 20 bp, Homo sapiens
tataaactaaagttgtacct

SEQ ID NO: 6413102 - DNA, 17 bp, Homo sapiens
tataaactaggtaaaat

SEQ ID NO: 6413103 - DNA, 22 bp, Homo sapiens
tataaactatatataatgtata

SEQ ID NO: 6413104 - DNA, 20 bp, Homo sapiens
tataaactgaaaaatgtcag

SEQ ID NO: 6413105 - DNA, 11 bp, Homo sapiens
tataaactgag

SEQ ID NO: 6413106 - DNA, 12 bp, Homo sapiens
tataaactgtga

SEQ ID NO: 6413107 - DNA, 16 bp, Homo sapiens
tataaacttaaagcta

SEQ ID NO: 6413108 - DNA, 23 bp, Homo sapiens
tataaacttagtgcggacaagtt

SEQ ID NO: 6413109 - DNA, 14 bp, Homo sapiens
tataaacttgtgta

SEQ ID NO: 6413110 - DNA, 17 bp, Homo sapiens
tataaactttacatatt

SEQ ID NO: 6413111 - DNA, 13 bp, Homo sapiens
tataaactttacc

SEQ ID NO: 6413112 - DNA, 15 bp, Homo sapiens
tataaactttacctt

SEQ ID NO: 6413113 - DNA, 20 bp, Homo sapiens
tataaagaaacggtatgact

SEQ ID NO: 6413114 - DNA, 19 bp, Homo sapiens
tataaagaaacttttgaaa

SEQ ID NO: 6413115 - DNA, 20 bp, Homo sapiens
tataaagaaacttttgaaaa

SEQ ID NO: 6413116 - DNA, 16 bp, Homo sapiens
tataaagaaagattgt

SEQ ID NO: 6413117 - DNA, 22 bp, Homo sapiens
tataaagaaagattgtaaacta

SEQ ID NO: 6413118 - DNA, 22 bp, Homo sapiens
tataaagaacaaggtagttttt

SEQ ID NO: 6413119 - DNA, 19 bp, Homo sapiens
tataaagaagaacttgcat

SEQ ID NO: 6413120 - DNA, 12 bp, Homo sapiens
tataaagaatag

SEQ ID NO: 6413121 - DNA, 15 bp, Homo sapiens
tataaagaatatata

SEQ ID NO: 6413122 - DNA, 16 bp, Homo sapiens
tataaagacaacaaaa

SEQ ID NO: 6413123 - DNA, 17 bp, Homo sapiens
tataaagacaacaaaag

SEQ ID NO: 6413124 - DNA, 19 bp, Homo sapiens
tataaagacaacaaaagaa

SEQ ID NO: 6413125 - DNA, 22 bp, Homo sapiens
tataaagacaacaaaagaaatc

SEQ ID NO: 6413126 - DNA, 18 bp, Homo sapiens
tataaagacaagtatgaa

SEQ ID NO: 6413127 - DNA, 17 bp, Homo sapiens
tataaagacgttttata

SEQ ID NO: 6413128 - DNA, 15 bp, Homo sapiens
tataaagagaaaatt

SEQ ID NO: 6413129 - DNA, 17 bp, Homo sapiens
tataaagagaaaattga

SEQ ID NO: 6413130 - DNA, 11 bp, Homo sapiens
tataaagatat

SEQ ID NO: 6413131 - DNA, 16 bp, Homo sapiens
tataaagattaacact

SEQ ID NO: 6413132 - DNA, 16 bp, Homo sapiens
tataaagattgtactt

SEQ ID NO: 6413133 - DNA, 17 bp, Homo sapiens
tataaagattgtactta

SEQ ID NO: 6413134 - DNA, 17 bp, Homo sapiens
tataaagcaaattactc

SEQ ID NO: 6413135 - DNA, 15 bp, Homo sapiens
tataaagcatctaaa

SEQ ID NO: 6413136 - DNA, 19 bp, Homo sapiens
tataaagcattactctttt

SEQ ID NO: 6413137 - DNA, 15 bp, Homo sapiens
tataaagccaagaat

SEQ ID NO: 6413138 - DNA, 21 bp, Homo sapiens
tataaagcgatatacagatga

SEQ ID NO: 6413139 - DNA, 21 bp, Homo sapiens
tataaagctacaatattctct

SEQ ID NO: 6413140 - DNA, 18 bp, Homo sapiens
tataaagctgttattctt

SEQ ID NO: 6413141 - DNA, 19 bp, Homo sapiens
tataaagctgttcttgaaa

SEQ ID NO: 6413142 - DNA, 21 bp, Homo sapiens
tataaaggaaaaaagagaagt

SEQ ID NO: 6413143 - DNA, 16 bp, Homo sapiens
tataaaggaccctgtt

SEQ ID NO: 6413144 - DNA, 21 bp, Homo sapiens
tataaagggggagggaaatag

SEQ ID NO: 6413145 - DNA, 16 bp, Homo sapiens
tataaagtagtcctgt

SEQ ID NO: 6413146 - DNA, 18 bp, Homo sapiens
tataaagtatagagagaa

SEQ ID NO: 6413147 - DNA, 20 bp, Homo sapiens
tataaagtatagagagaagt

SEQ ID NO: 6413148 - DNA, 21 bp, Homo sapiens
tataaagtatatgttctgatt

SEQ ID NO: 6413149 - DNA, 14 bp, Homo sapiens
tataaagtattttt

SEQ ID NO: 6413150 - DNA, 19 bp, Homo sapiens
tataaagtctaagcaagat

SEQ ID NO: 6413151 - DNA, 13 bp, Homo sapiens
tataaagtgcttg

SEQ ID NO: 6413152 - DNA, 22 bp, Homo sapiens
tataaagttggttcacttcaaa

SEQ ID NO: 6413153 - DNA, 21 bp, Homo sapiens
tataaagtttatcagatattt

SEQ ID NO: 6413154 - DNA, 21 bp, Homo sapiens
tataaataaaatcatgtagtt

SEQ ID NO: 6413155 - DNA, 13 bp, Homo sapiens
tataaataaagca

SEQ ID NO: 6413156 - DNA, 17 bp, Homo sapiens
tataaataaagcaaata

SEQ ID NO: 6413157 - DNA, 18 bp, Homo sapiens
tataaataaatatatata

SEQ ID NO: 6413158 - DNA, 16 bp, Homo sapiens
tataaataaatgccaa

SEQ ID NO: 6413159 - DNA, 20 bp, Homo sapiens
tataaataaatgtttctagt

SEQ ID NO: 6413160 - DNA, 12 bp, Homo sapiens
tataaataataa

SEQ ID NO: 6413161 - DNA, 13 bp, Homo sapiens
tataaataataaa

SEQ ID NO: 6413162 - DNA, 13 bp, Homo sapiens
tataaataataat

SEQ ID NO: 6413163 - DNA, 18 bp, Homo sapiens
tataaataatcacacaca

SEQ ID NO: 6413164 - DNA, 22 bp, Homo sapiens
tataaatacacttcctgcttaa

SEQ ID NO: 6413165 - DNA, 14 bp, Homo sapiens
tataaatacatata

SEQ ID NO: 6413166 - DNA, 20 bp, Homo sapiens
tataaatactatagttatat

SEQ ID NO: 6413167 - DNA, 16 bp, Homo sapiens
tataaatagatttagt

SEQ ID NO: 6413168 - DNA, 20 bp, Homo sapiens
tataaatagctgaaaactaa

SEQ ID NO: 6413169 - DNA, 19 bp, Homo sapiens
tataaataggagaggatga

SEQ ID NO: 6413170 - DNA, 16 bp, Homo sapiens
tataaatagtattcca

SEQ ID NO: 6413171 - DNA, 17 bp, Homo sapiens
tataaatataagccttt

SEQ ID NO: 6413172 - DNA, 14 bp, Homo sapiens
tataaatatacagt

SEQ ID NO: 6413173 - DNA, 13 bp, Homo sapiens
tataaatatacat

SEQ ID NO: 6413174 - DNA, 14 bp, Homo sapiens
tataaatatatata

SEQ ID NO: 6413175 - DNA, 19 bp, Homo sapiens
tataaatatatataaatat

SEQ ID NO: 6413176 - DNA, 21 bp, Homo sapiens
tataaatatatataaatatat

SEQ ID NO: 6413177 - DNA, 22 bp, Homo sapiens
tataaatatatataaatatata

SEQ ID NO: 6413178 - DNA, 19 bp, Homo sapiens
tataaatatatatttttca

SEQ ID NO: 6413179 - DNA, 20 bp, Homo sapiens
tataaatatatatttttcaa

SEQ ID NO: 6413180 - DNA, 21 bp, Homo sapiens
tataaatatatatttttcaaa

SEQ ID NO: 6413181 - DNA, 23 bp, Homo sapiens
tataaatatatatttttcaacca

SEQ ID NO: 6413182 - DNA, 16 bp, Homo sapiens
tataaatatattgtat

SEQ ID NO: 6413183 - DNA, 21 bp, Homo sapiens
tataaatatcagtattctgac

SEQ ID NO: 6413184 - DNA, 23 bp, Homo sapiens
tataaatatcagtattctgacat

SEQ ID NO: 6413185 - DNA, 15 bp, Homo sapiens
tataaatatcatgca

SEQ ID NO: 6413186 - DNA, 15 bp, Homo sapiens
tataaatatcattgt

SEQ ID NO: 6413187 - DNA, 17 bp, Homo sapiens
tataaatatgaaatgat

SEQ ID NO: 6413188 - DNA, 12 bp, Homo sapiens
tataaatatgtg

SEQ ID NO: 6413189 - DNA, 20 bp, Homo sapiens
tataaatattaggcataaat

SEQ ID NO: 6413190 - DNA, 21 bp, Homo sapiens
tataaatcatattgatgaaaa

SEQ ID NO: 6413191 - DNA, 14 bp, Homo sapiens
tataaatccagtga

SEQ ID NO: 6413192 - DNA, 18 bp, Homo sapiens
tataaatcgcttttgata

SEQ ID NO: 6413193 - DNA, 22 bp, Homo sapiens
tataaatctggggaagaggttt

SEQ ID NO: 6413194 - DNA, 19 bp, Homo sapiens
tataaatgaaatttgcaaa

SEQ ID NO: 6413195 - DNA, 20 bp, Homo sapiens
tataaatgaaatttgcaaaa

SEQ ID NO: 6413196 - DNA, 14 bp, Homo sapiens
tataaatgaagatg

SEQ ID NO: 6413197 - DNA, 23 bp, Homo sapiens
tataaatgaagtattatctgtaa

SEQ ID NO: 6413198 - DNA, 15 bp, Homo sapiens
tataaatgaatgaaa

SEQ ID NO: 6413199 - DNA, 20 bp, Homo sapiens
tataaatgaatgaaatataa

SEQ ID NO: 6413200 - DNA, 15 bp, Homo sapiens
tataaatgaatgtgc

SEQ ID NO: 6413201 - DNA, 17 bp, Homo sapiens
tataaatgacaaagtgt

SEQ ID NO: 6413202 - DNA, 21 bp, Homo sapiens
tataaatgacaaagtgttgaa

SEQ ID NO: 6413203 - DNA, 19 bp, Homo sapiens
tataaatgacagatctcaa

SEQ ID NO: 6413204 - DNA, 20 bp, Homo sapiens
tataaatgacagatctcaat

SEQ ID NO: 6413205 - DNA, 12 bp, Homo sapiens
tataaatgagca

SEQ ID NO: 6413206 - DNA, 17 bp, Homo sapiens
tataaatgatatcaaag

SEQ ID NO: 6413207 - DNA, 17 bp, Homo sapiens
tataaatgatgattgaa

SEQ ID NO: 6413208 - DNA, 17 bp, Homo sapiens
tccccgcagtcgtccca

SEQ ID NO: 6413209 - DNA, 18 bp, Homo sapiens
tccccgcattccaggctc

SEQ ID NO: 6413210 - DNA, 13 bp, Homo sapiens
tccccgccccctg

SEQ ID NO: 6413211 - DNA, 16 bp, Homo sapiens
tccccgccccctgaaa

SEQ ID NO: 6413212 - DNA, 17 bp, Homo sapiens
tccccgccccctgaaac

SEQ ID NO: 6413213 - DNA, 15 bp, Homo sapiens
tccccgcccgccctc

SEQ ID NO: 6413214 - DNA, 18 bp, Homo sapiens
tccccgcccgccctcctc

SEQ ID NO: 6413215 - DNA, 19 bp, Homo sapiens
tccccgcccgccctcctct

SEQ ID NO: 6413216 - DNA, 15 bp, Homo sapiens
tccccgccctttttt

SEQ ID NO: 6413217 - DNA, 16 bp, Homo sapiens
tccccgccgggcagtg

SEQ ID NO: 6413218 - DNA, 13 bp, Homo sapiens
tccccgcctcctc

SEQ ID NO: 6413219 - DNA, 14 bp, Homo sapiens
tccccgcctcctcc

SEQ ID NO: 6413220 - DNA, 21 bp, Homo sapiens
tccccgcctcctcccactggg

SEQ ID NO: 6413221 - DNA, 17 bp, Homo sapiens
tccccgcctcctccctg

SEQ ID NO: 6413222 - DNA, 22 bp, Homo sapiens
tccccgcctgcagtcttctggg

SEQ ID NO: 6413223 - DNA, 16 bp, Homo sapiens
tccccgcctggccagg

SEQ ID NO: 6413224 - DNA, 17 bp, Homo sapiens
tccccgcctggccagga

SEQ ID NO: 6413225 - DNA, 18 bp, Homo sapiens
tccccgcctggccaggag

SEQ ID NO: 6413226 - DNA, 13 bp, Homo sapiens
tccccgcctgtcc

SEQ ID NO: 6413227 - DNA, 19 bp, Homo sapiens
tccccgcctgtcctgcctc

SEQ ID NO: 6413228 - DNA, 22 bp, Homo sapiens
tccccgccttccgccccttccc

SEQ ID NO: 6413229 - DNA, 14 bp, Homo sapiens
tccccgcgccccag

SEQ ID NO: 6413230 - DNA, 16 bp, Homo sapiens
tccccgcgccccagtc

SEQ ID NO: 6413231 - DNA, 19 bp, Homo sapiens
tccccgcgccccagtcact

SEQ ID NO: 6413232 - DNA, 20 bp, Homo sapiens
tccccgcgccccagtcactt

SEQ ID NO: 6413233 - DNA, 22 bp, Homo sapiens
tccccgcgccccagtcacttcc

SEQ ID NO: 6413234 - DNA, 19 bp, Homo sapiens
tccccgcgcgttccttcgc

SEQ ID NO: 6413235 - DNA, 22 bp, Homo sapiens
tccccgcggttcatacgcatcc

SEQ ID NO: 6413236 - DNA, 13 bp, Homo sapiens
tccccgctcaggg

SEQ ID NO: 6413237 - DNA, 22 bp, Homo sapiens
tccccgctgccctttggccaac

SEQ ID NO: 6413238 - DNA, 14 bp, Homo sapiens
tccccgctggctca

SEQ ID NO: 6413239 - DNA, 13 bp, Homo sapiens
tccccgctggctg

SEQ ID NO: 6413240 - DNA, 15 bp, Homo sapiens
tccccgctggctggg

SEQ ID NO: 6413241 - DNA, 17 bp, Homo sapiens
tccccggacaagcccag

SEQ ID NO: 6413242 - DNA, 18 bp, Homo sapiens
tccccggacaagcccagg

SEQ ID NO: 6413243 - DNA, 19 bp, Homo sapiens
tccccggacaagcccagga

SEQ ID NO: 6413244 - DNA, 17 bp, Homo sapiens
tccccggacgctggctc

SEQ ID NO: 6413245 - DNA, 18 bp, Homo sapiens
tccccggacgctggctcg

SEQ ID NO: 6413246 - DNA, 16 bp, Homo sapiens
tccccggactcaagcc

SEQ ID NO: 6413247 - DNA, 19 bp, Homo sapiens
tccccggcaccctctggcc

SEQ ID NO: 6413248 - DNA, 14 bp, Homo sapiens
tccccggcccctgc

SEQ ID NO: 6413249 - DNA, 22 bp, Homo sapiens
tccccggcggggtgcctgctgt

SEQ ID NO: 6413250 - DNA, 23 bp, Homo sapiens
tccccggcggtgccgcgctccga

SEQ ID NO: 6413251 - DNA, 14 bp, Homo sapiens
tccccggctgcttc

SEQ ID NO: 6413252 - DNA, 21 bp, Homo sapiens
tccccgggaccgcgctagggc

SEQ ID NO: 6413253 - DNA, 20 bp, Homo sapiens
tccccgggcagcagagagag

SEQ ID NO: 6413254 - DNA, 21 bp, Homo sapiens
tccccgggcatctttggggag

SEQ ID NO: 6413255 - DNA, 13 bp, Homo sapiens
tccccggggccca

SEQ ID NO: 6413256 - DNA, 22 bp, Homo sapiens
tccccggttgctggtcaggtcc

SEQ ID NO: 6413257 - DNA, 15 bp, Homo sapiens
tccccgtagccactc

SEQ ID NO: 6413258 - DNA, 12 bp, Homo sapiens
tccccgtcccct

SEQ ID NO: 6413259 - DNA, 16 bp, Homo sapiens
tccccgtcccctgcag

SEQ ID NO: 6413260 - DNA, 21 bp, Homo sapiens
tccccgtcccctgcagcctgg

SEQ ID NO: 6413261 - DNA, 17 bp, Homo sapiens
tccccgtccctgtcccc

SEQ ID NO: 6413262 - DNA, 23 bp, Homo sapiens
tccccgtctctgccctgggctcc

SEQ ID NO: 6413263 - DNA, 21 bp, Homo sapiens
tccccgtctgaccaagggctg

SEQ ID NO: 6413264 - DNA, 16 bp, Homo sapiens
tccccgtgttgggtgg

SEQ ID NO: 6413265 - DNA, 15 bp, Homo sapiens
tccccgttcctgaca

SEQ ID NO: 6413266 - DNA, 17 bp, Homo sapiens
tccccgttcctgacatc

SEQ ID NO: 6413267 - DNA, 16 bp, Homo sapiens
tcccctaaagccaggc

SEQ ID NO: 6413268 - DNA, 22 bp, Homo sapiens
tcccctaaagccaggctcagga

SEQ ID NO: 6413269 - DNA, 21 bp, Homo sapiens
tcccctaacccccagtcctca

SEQ ID NO: 6413270 - DNA, 23 bp, Homo sapiens
tcccctaaccctactttgcttcc

SEQ ID NO: 6413271 - DNA, 16 bp, Homo sapiens
tcccctaatcttttct

SEQ ID NO: 6413272 - DNA, 14 bp, Homo sapiens
tcccctacagaatt

SEQ ID NO: 6413273 - DNA, 17 bp, Homo sapiens
tcccctaccactgtctt

SEQ ID NO: 6413274 - DNA, 15 bp, Homo sapiens
tcccctactacactt

SEQ ID NO: 6413275 - DNA, 15 bp, Homo sapiens
tcccctactccctct

SEQ ID NO: 6413276 - DNA, 17 bp, Homo sapiens
tcccctactctgcccct

SEQ ID NO: 6413277 - DNA, 19 bp, Homo sapiens
tcccctacttctcagtccc

SEQ ID NO: 6413278 - DNA, 17 bp, Homo sapiens
tcccctagagccctctc

SEQ ID NO: 6413279 - DNA, 19 bp, Homo sapiens
tcccctagagccctctcct

SEQ ID NO: 6413280 - DNA, 13 bp, Homo sapiens
tcccctagatcca

SEQ ID NO: 6413281 - DNA, 17 bp, Homo sapiens
tcccctagtaagtgcct

SEQ ID NO: 6413282 - DNA, 18 bp, Homo sapiens
tcccctagtaagtgcctt

SEQ ID NO: 6413283 - DNA, 21 bp, Homo sapiens
tcccctagtaagtgccttcca

SEQ ID NO: 6413284 - DNA, 17 bp, Homo sapiens
tcccctatccacccagc

SEQ ID NO: 6413285 - DNA, 18 bp, Homo sapiens
tcccctatccacccagcc

SEQ ID NO: 6413286 - DNA, 14 bp, Homo sapiens
tcccctatcctccc

SEQ ID NO: 6413287 - DNA, 16 bp, Homo sapiens
tcccctatcctcccct

SEQ ID NO: 6413288 - DNA, 15 bp, Homo sapiens
tcccctatgctggta

SEQ ID NO: 6413289 - DNA, 16 bp, Homo sapiens
tcccctatgctggtag

SEQ ID NO: 6413290 - DNA, 18 bp, Homo sapiens
tcccctcaaagtctgcaa

SEQ ID NO: 6413291 - DNA, 21 bp, Homo sapiens
tcccctcaaagtctgcaactt

SEQ ID NO: 6413292 - DNA, 21 bp, Homo sapiens
tcccctcaacaccctgcttct

SEQ ID NO: 6413293 - DNA, 22 bp, Homo sapiens
tcccctcaacaccctgcttctc

SEQ ID NO: 6413294 - DNA, 13 bp, Homo sapiens
tcccctcaagccc

SEQ ID NO: 6413295 - DNA, 22 bp, Homo sapiens
tcccctcacacacaccccccca

SEQ ID NO: 6413296 - DNA, 23 bp, Homo sapiens
tcccctcacagactcttccacca

SEQ ID NO: 6413297 - DNA, 14 bp, Homo sapiens
tcccctcacagcct

SEQ ID NO: 6413298 - DNA, 17 bp, Homo sapiens
tcccctcacagcctctg

SEQ ID NO: 6413299 - DNA, 15 bp, Homo sapiens
tcccctcacatcctc

SEQ ID NO: 6413300 - DNA, 17 bp, Homo sapiens
tcccctcacatcctcct

SEQ ID NO: 6413301 - DNA, 19 bp, Homo sapiens
tcccctcacatcctcctgc

SEQ ID NO: 6413302 - DNA, 20 bp, Homo sapiens
tcccctcacatcctcctgcc

SEQ ID NO: 6413303 - DNA, 22 bp, Homo sapiens
tcccctcacatcctcctgccca

SEQ ID NO: 6413304 - DNA, 14 bp, Homo sapiens
tcccctcacccaaa

SEQ ID NO: 6413305 - DNA, 20 bp, Homo sapiens
tcccctcacccgctgcccag

SEQ ID NO: 6413306 - DNA, 22 bp, Homo sapiens
tcccctcacgtgaccagccccg

SEQ ID NO: 6413307 - DNA, 21 bp, Homo sapiens
tcccctcactctgtcagccag

SEQ ID NO: 6413308 - DNA, 19 bp, Homo sapiens
tcccctcactgatggacaa

SEQ ID NO: 6413309 - DNA, 12 bp, Homo sapiens
tcccctcactgg

SEQ ID NO: 6413310 - DNA, 18 bp, Homo sapiens
tcccctcagaaggtctgt

SEQ ID NO: 6413311 - DNA, 17 bp, Homo sapiens
tcccctcagagcccatg

SEQ ID NO: 6413312 - DNA, 21 bp, Homo sapiens
tcccctcagccacacccaggc

SEQ ID NO: 6413313 - DNA, 13 bp, Homo sapiens
tcccctcagcctc

SEQ ID NO: 6413314 - DNA, 15 bp, Homo sapiens
tcccctcagcctcct

SEQ ID NO: 6413315 - DNA, 17 bp, Homo sapiens
tcccctcagcctcttct

SEQ ID NO: 6413316 - DNA, 17 bp, Homo sapiens
tcccctcagcctgccca

SEQ ID NO: 6413317 - DNA, 15 bp, Homo sapiens
tcccctcagcgcagg

SEQ ID NO: 6413318 - DNA, 21 bp, Homo sapiens
tcccctcagcgcaggctgcag

SEQ ID NO: 6413319 - DNA, 16 bp, Homo sapiens
tcccctcaggactgca

SEQ ID NO: 6413320 - DNA, 22 bp, Homo sapiens
tcccctcatggagaaacatcct

SEQ ID NO: 6413321 - DNA, 22 bp, Homo sapiens
tcccctcattgcatttattgca

SEQ ID NO: 6413322 - DNA, 12 bp, Homo sapiens
tcccctccaacc

SEQ ID NO: 6413323 - DNA, 22 bp, Homo sapiens
tcccctccaacctggggggcag

SEQ ID NO: 6413324 - DNA, 16 bp, Homo sapiens
tcccctccaaggtatg

SEQ ID NO: 6413325 - DNA, 13 bp, Homo sapiens
tcccctccacagc

SEQ ID NO: 6413326 - DNA, 20 bp, Homo sapiens
tcccctccacatcccagcag

SEQ ID NO: 6413327 - DNA, 15 bp, Homo sapiens
tcccctccactgtca

SEQ ID NO: 6413328 - DNA, 12 bp, Homo sapiens
tcccctccagcc

SEQ ID NO: 6413329 - DNA, 15 bp, Homo sapiens
tcccctccaggaggg

SEQ ID NO: 6413330 - DNA, 14 bp, Homo sapiens
tcccctccaggagt

SEQ ID NO: 6413331 - DNA, 16 bp, Homo sapiens
tcccctccatccccat

SEQ ID NO: 6413332 - DNA, 22 bp, Homo sapiens
tcccctccatccccatcggccc

SEQ ID NO: 6413333 - DNA, 16 bp, Homo sapiens
tcccctccatccctgg

SEQ ID NO: 6413334 - DNA, 20 bp, Homo sapiens
tcccctcccaatcctctctc

SEQ ID NO: 6413335 - DNA, 19 bp, Homo sapiens
tcccctcccacctctcctt

SEQ ID NO: 6413336 - DNA, 14 bp, Homo sapiens
tcccctcccagccc

SEQ ID NO: 6413337 - DNA, 14 bp, Homo sapiens
tcccctcccaggga

SEQ ID NO: 6413338 - DNA, 17 bp, Homo sapiens
tcccctcccagggagca

SEQ ID NO: 6413339 - DNA, 11 bp, Homo sapiens
tcccctcccca

SEQ ID NO: 6413340 - DNA, 14 bp, Homo sapiens
tcccctccccagct

SEQ ID NO: 6413341 - DNA, 12 bp, Homo sapiens
tcccctccccat

SEQ ID NO: 6413342 - DNA, 14 bp, Homo sapiens
tcccctccccatct

SEQ ID NO: 6413343 - DNA, 15 bp, Homo sapiens
tcccctccccatctg

SEQ ID NO: 6413344 - DNA, 16 bp, Homo sapiens
tcccctccccatctgt

SEQ ID NO: 6413345 - DNA, 18 bp, Homo sapiens
tcccctccccatctgtgt

SEQ ID NO: 6413346 - DNA, 20 bp, Homo sapiens
tcccctccccatctgtgttc

SEQ ID NO: 6413347 - DNA, 20 bp, Homo sapiens
tcccctcccccactcctcta

SEQ ID NO: 6413348 - DNA, 21 bp, Homo sapiens
tcccctccccgccccctgaaa

SEQ ID NO: 6413349 - DNA, 22 bp, Homo sapiens
tcccctccccgccccctgaaac

SEQ ID NO: 6413350 - DNA, 15 bp, Homo sapiens
tcccctcccctgctg

SEQ ID NO: 6413351 - DNA, 20 bp, Homo sapiens
tcccctcccgtcttcctcct

SEQ ID NO: 6413352 - DNA, 16 bp, Homo sapiens
tcccctccctcccaca

SEQ ID NO: 6413353 - DNA, 14 bp, Homo sapiens
tcccctccctcctc

SEQ ID NO: 6413354 - DNA, 13 bp, Homo sapiens
tcccctccctcgt

SEQ ID NO: 6413355 - DNA, 16 bp, Homo sapiens
tcccctccctcgtggg

SEQ ID NO: 6413356 - DNA, 14 bp, Homo sapiens
tcccctccctcttc

SEQ ID NO: 6413357 - DNA, 15 bp, Homo sapiens
tcccctccctcttcc

SEQ ID NO: 6413358 - DNA, 13 bp, Homo sapiens
tcccctccctgcc

SEQ ID NO: 6413359 - DNA, 14 bp, Homo sapiens
tcccctccctgcct

SEQ ID NO: 6413360 - DNA, 13 bp, Homo sapiens
tcccctccctggc

SEQ ID NO: 6413361 - DNA, 15 bp, Homo sapiens
tcccctccctggctc

SEQ ID NO: 6413362 - DNA, 21 bp, Homo sapiens
tcccctccctggctcccatga

SEQ ID NO: 6413363 - DNA, 14 bp, Homo sapiens
tcccctccctgggt

SEQ ID NO: 6413364 - DNA, 13 bp, Homo sapiens
tcccctccctgtc

SEQ ID NO: 6413365 - DNA, 13 bp, Homo sapiens
tcccctccctttt

SEQ ID NO: 6413366 - DNA, 20 bp, Homo sapiens
tcccctccgccaggcgagat

SEQ ID NO: 6413367 - DNA, 16 bp, Homo sapiens
tcccctccggactggt

SEQ ID NO: 6413368 - DNA, 17 bp, Homo sapiens
tcccctccggactggtg

SEQ ID NO: 6413369 - DNA, 19 bp, Homo sapiens
tcccctccggactggtgcc

SEQ ID NO: 6413370 - DNA, 20 bp, Homo sapiens
tcccctccggactggtgccc

SEQ ID NO: 6413371 - DNA, 14 bp, Homo sapiens
tcccctcctacccc

SEQ ID NO: 6413372 - DNA, 20 bp, Homo sapiens
tcccctcctacccctcccag

SEQ ID NO: 6413373 - DNA, 14 bp, Homo sapiens
tcccctcctcactc

SEQ ID NO: 6413374 - DNA, 13 bp, Homo sapiens
tcccctcctctcc

SEQ ID NO: 6413375 - DNA, 16 bp, Homo sapiens
tcccctcctctcccct

SEQ ID NO: 6413376 - DNA, 18 bp, Homo sapiens
tcccctcctctcccctac

SEQ ID NO: 6413377 - DNA, 19 bp, Homo sapiens
tcccctcctctcctgccca

SEQ ID NO: 6413378 - DNA, 24 bp, Homo sapiens
tcccctcctctgcttgccatccct

SEQ ID NO: 6413379 - DNA, 14 bp, Homo sapiens
tcccctcctcttcc

SEQ ID NO: 6413380 - DNA, 15 bp, Homo sapiens
tcccctcctcttccc

SEQ ID NO: 6413381 - DNA, 15 bp, Homo sapiens
tcccctcctgctggg

SEQ ID NO: 6413382 - DNA, 16 bp, Homo sapiens
tcccctcctgctgggc

SEQ ID NO: 6413383 - DNA, 15 bp, Homo sapiens
tcccctccttccagc

SEQ ID NO: 6413384 - DNA, 15 bp, Homo sapiens
tcccctccttcccaa

SEQ ID NO: 6413385 - DNA, 14 bp, Homo sapiens
tcccctccttccct

SEQ ID NO: 6413386 - DNA, 12 bp, Homo sapiens
tcccctccttgc

SEQ ID NO: 6413387 - DNA, 13 bp, Homo sapiens
tcccctccttggc

SEQ ID NO: 6413388 - DNA, 18 bp, Homo sapiens
tataaatgcaaataacaa

SEQ ID NO: 6413389 - DNA, 15 bp, Homo sapiens
tataaatgcaatatt

SEQ ID NO: 6413390 - DNA, 17 bp, Homo sapiens
tataaatgcactgtaat

SEQ ID NO: 6413391 - DNA, 12 bp, Homo sapiens
tataaatgcatg

SEQ ID NO: 6413392 - DNA, 16 bp, Homo sapiens
tataaatgcatgattt

SEQ ID NO: 6413393 - DNA, 15 bp, Homo sapiens
tataaatgccagagc

SEQ ID NO: 6413394 - DNA, 16 bp, Homo sapiens
tataaatgccagagcc

SEQ ID NO: 6413395 - DNA, 17 bp, Homo sapiens
tataaatgccagagcca

SEQ ID NO: 6413396 - DNA, 14 bp, Homo sapiens
tataaatgctattt

SEQ ID NO: 6413397 - DNA, 15 bp, Homo sapiens
tataaatgggaacat

SEQ ID NO: 6413398 - DNA, 13 bp, Homo sapiens
tataaatggtgag

SEQ ID NO: 6413399 - DNA, 15 bp, Homo sapiens
tataaatggtgagaa

SEQ ID NO: 6413400 - DNA, 18 bp, Homo sapiens
tataaatggtgagaatta

SEQ ID NO: 6413401 - DNA, 16 bp, Homo sapiens
tataaatgtaaaaatg

SEQ ID NO: 6413402 - DNA, 18 bp, Homo sapiens
tataaatgtaaaaatgaa

SEQ ID NO: 6413403 - DNA, 23 bp, Homo sapiens
tataaatgtacatttccaaatga

SEQ ID NO: 6413404 - DNA, 22 bp, Homo sapiens
tataaatgtactacatttgcat

SEQ ID NO: 6413405 - DNA, 11 bp, Homo sapiens
tataaatgtct

SEQ ID NO: 6413406 - DNA, 18 bp, Homo sapiens
tataaatgtctattatta

SEQ ID NO: 6413407 - DNA, 22 bp, Homo sapiens
tataaatgtctattattatgaa

SEQ ID NO: 6413408 - DNA, 23 bp, Homo sapiens
tataaatgtctttaatgcaatat

SEQ ID NO: 6413409 - DNA, 15 bp, Homo sapiens
tataaatgtgatatg

SEQ ID NO: 6413410 - DNA, 13 bp, Homo sapiens
tataaatgtgtgt

SEQ ID NO: 6413411 - DNA, 17 bp, Homo sapiens
tataaatgtttatattg

SEQ ID NO: 6413412 - DNA, 19 bp, Homo sapiens
tataaatgtttatattgtt

SEQ ID NO: 6413413 - DNA, 22 bp, Homo sapiens
tataaatgtttcatgaagaaaa

SEQ ID NO: 6413414 - DNA, 16 bp, Homo sapiens
tataaatgtttggaaa

SEQ ID NO: 6413415 - DNA, 13 bp, Homo sapiens
tataaattaaata

SEQ ID NO: 6413416 - DNA, 20 bp, Homo sapiens
tataaattaaataaactgtt

SEQ ID NO: 6413417 - DNA, 20 bp, Homo sapiens
tataaattaaatatatgtat

SEQ ID NO: 6413418 - DNA, 22 bp, Homo sapiens
tataaattaaatatatgtatgt

SEQ ID NO: 6413419 - DNA, 16 bp, Homo sapiens
tataaattaagacttt

SEQ ID NO: 6413420 - DNA, 13 bp, Homo sapiens
tataaattaatac

SEQ ID NO: 6413421 - DNA, 16 bp, Homo sapiens
tataaattaatacaga

SEQ ID NO: 6413422 - DNA, 15 bp, Homo sapiens
tataaattaattgtg

SEQ ID NO: 6413423 - DNA, 15 bp, Homo sapiens
tataaattacatgca

SEQ ID NO: 6413424 - DNA, 23 bp, Homo sapiens
tataaattacatgcatgagcacc

SEQ ID NO: 6413425 - DNA, 14 bp, Homo sapiens
tataaattataatg

SEQ ID NO: 6413426 - DNA, 15 bp, Homo sapiens
tataaattatattcc

SEQ ID NO: 6413427 - DNA, 15 bp, Homo sapiens
tataaattatctgaa

SEQ ID NO: 6413428 - DNA, 20 bp, Homo sapiens
tataaattcctctttgcttt

SEQ ID NO: 6413429 - DNA, 21 bp, Homo sapiens
tataaattcctctttgctttg

SEQ ID NO: 6413430 - DNA, 18 bp, Homo sapiens
tataaattctactaagtt

SEQ ID NO: 6413431 - DNA, 22 bp, Homo sapiens
tataaattctactaagttattt

SEQ ID NO: 6413432 - DNA, 11 bp, Homo sapiens
tataaattctg

SEQ ID NO: 6413433 - DNA, 24 bp, Homo sapiens
tataaattctgttagctgctcact

SEQ ID NO: 6413434 - DNA, 21 bp, Homo sapiens
tataaattgtacattttgtaa

SEQ ID NO: 6413435 - DNA, 17 bp, Homo sapiens
tataaattgtcttaatg

SEQ ID NO: 6413436 - DNA, 20 bp, Homo sapiens
tataaattgtcttaatggat

SEQ ID NO: 6413437 - DNA, 17 bp, Homo sapiens
tataaattgtgtattta

SEQ ID NO: 6413438 - DNA, 17 bp, Homo sapiens
tataaatttaagcaaac

SEQ ID NO: 6413439 - DNA, 15 bp, Homo sapiens
tataaatttatttac

SEQ ID NO: 6413440 - DNA, 17 bp, Homo sapiens
tataaattttgtacatt

SEQ ID NO: 6413441 - DNA, 22 bp, Homo sapiens
tataaatttttaagagaaagaa

SEQ ID NO: 6413442 - DNA, 19 bp, Homo sapiens
tataaatttttaagtgtca

SEQ ID NO: 6413443 - DNA, 15 bp, Homo sapiens
tataaattttttgaa

SEQ ID NO: 6413444 - DNA, 17 bp, Homo sapiens
tataaattttttttgtt

SEQ ID NO: 6413445 - DNA, 22 bp, Homo sapiens
tataacaaaaaaagaaaagaga

SEQ ID NO: 6413446 - DNA, 15 bp, Homo sapiens
tataacaaactatgt

SEQ ID NO: 6413447 - DNA, 19 bp, Homo sapiens
tataacaacaacaacaaaa

SEQ ID NO: 6413448 - DNA, 21 bp, Homo sapiens
tataacaacactaatacacta

SEQ ID NO: 6413449 - DNA, 16 bp, Homo sapiens
tataacaacgtctttt

SEQ ID NO: 6413450 - DNA, 20 bp, Homo sapiens
tataacaacgtctttttgtt

SEQ ID NO: 6413451 - DNA, 17 bp, Homo sapiens
tataacaactatttact

SEQ ID NO: 6413452 - DNA, 18 bp, Homo sapiens
tataacaagccaaacatt

SEQ ID NO: 6413453 - DNA, 19 bp, Homo sapiens
tataacaaggttcttctaa

SEQ ID NO: 6413454 - DNA, 13 bp, Homo sapiens
tataacaagtata

SEQ ID NO: 6413455 - DNA, 21 bp, Homo sapiens
tataacaatatatgatatata

SEQ ID NO: 6413456 - DNA, 14 bp, Homo sapiens
tataacaatcactg

SEQ ID NO: 6413457 - DNA, 14 bp, Homo sapiens
tataacaattaaaa

SEQ ID NO: 6413458 - DNA, 14 bp, Homo sapiens
tataacaattgatt

SEQ ID NO: 6413459 - DNA, 16 bp, Homo sapiens
tataacagatacattt

SEQ ID NO: 6413460 - DNA, 12 bp, Homo sapiens
tataacagcaag

SEQ ID NO: 6413461 - DNA, 18 bp, Homo sapiens
tataacagcaaggaaaca

SEQ ID NO: 6413462 - DNA, 21 bp, Homo sapiens
tataacaggttattttagttt

SEQ ID NO: 6413463 - DNA, 18 bp, Homo sapiens
tataacagttataaagaa

SEQ ID NO: 6413464 - DNA, 19 bp, Homo sapiens
tataacagttataaagaaa

SEQ ID NO: 6413465 - DNA, 15 bp, Homo sapiens
tataacataaaagca

SEQ ID NO: 6413466 - DNA, 17 bp, Homo sapiens
tataacatgaaagtcaa

SEQ ID NO: 6413467 - DNA, 15 bp, Homo sapiens
tataacatgcaaaca

SEQ ID NO: 6413468 - DNA, 13 bp, Homo sapiens
tataacatgtaaa

SEQ ID NO: 6413469 - DNA, 13 bp, Homo sapiens
tataacattatat

SEQ ID NO: 6413470 - DNA, 14 bp, Homo sapiens
tataacattctgac

SEQ ID NO: 6413471 - DNA, 23 bp, Homo sapiens
tataacatttgctgaatatgcaa

SEQ ID NO: 6413472 - DNA, 23 bp, Homo sapiens
tataaccaaagcaattaaatgat

SEQ ID NO: 6413473 - DNA, 16 bp, Homo sapiens
tataaccagacacata

SEQ ID NO: 6413474 - DNA, 20 bp, Homo sapiens
tataaccagtgttgtggatt

SEQ ID NO: 6413475 - DNA, 22 bp, Homo sapiens
tataaccagtgttgtggattta

SEQ ID NO: 6413476 - DNA, 20 bp, Homo sapiens
tataaccatggttttcctga

SEQ ID NO: 6413477 - DNA, 13 bp, Homo sapiens
tataaccattaca

SEQ ID NO: 6413478 - DNA, 13 bp, Homo sapiens
tataaccccacct

SEQ ID NO: 6413479 - DNA, 23 bp, Homo sapiens
tataaccccaccttgccaagctt

SEQ ID NO: 6413480 - DNA, 15 bp, Homo sapiens
tataaccccagcctg

SEQ ID NO: 6413481 - DNA, 17 bp, Homo sapiens
tataacctagttaaaga

SEQ ID NO: 6413482 - DNA, 20 bp, Homo sapiens
tataacctagttaaagaaag

SEQ ID NO: 6413483 - DNA, 22 bp, Homo sapiens
tataacctgatgccataaatac

SEQ ID NO: 6413484 - DNA, 20 bp, Homo sapiens
tataacctggcaaaatcttg

SEQ ID NO: 6413485 - DNA, 20 bp, Homo sapiens
tataacggtttaattctgtc

SEQ ID NO: 6413486 - DNA, 20 bp, Homo sapiens
tataacgtgttcaatatttt

SEQ ID NO: 6413487 - DNA, 18 bp, Homo sapiens
tataactacatattgaat

SEQ ID NO: 6413488 - DNA, 15 bp, Homo sapiens
tataactacattaaa

SEQ ID NO: 6413489 - DNA, 22 bp, Homo sapiens
tataactcaaggataccttctt

SEQ ID NO: 6413490 - DNA, 18 bp, Homo sapiens
tataactcatcataaaat

SEQ ID NO: 6413491 - DNA, 19 bp, Homo sapiens
tataactcatcataaaata

SEQ ID NO: 6413492 - DNA, 11 bp, Homo sapiens
tataactcatg

SEQ ID NO: 6413493 - DNA, 15 bp, Homo sapiens
tataactcatttgtt

SEQ ID NO: 6413494 - DNA, 13 bp, Homo sapiens
tataactctttga

SEQ ID NO: 6413495 - DNA, 23 bp, Homo sapiens
tataactgagttatattggaatt

SEQ ID NO: 6413496 - DNA, 14 bp, Homo sapiens
tataactgtcttgt

SEQ ID NO: 6413497 - DNA, 15 bp, Homo sapiens
tataactgtcttgtt

SEQ ID NO: 6413498 - DNA, 21 bp, Homo sapiens
tataactgtcttgtttcagtg

SEQ ID NO: 6413499 - DNA, 12 bp, Homo sapiens
tataactgtgat

SEQ ID NO: 6413500 - DNA, 18 bp, Homo sapiens
tataactgtgatgaaata

SEQ ID NO: 6413501 - DNA, 17 bp, Homo sapiens
tataactgttgttgata

SEQ ID NO: 6413502 - DNA, 22 bp, Homo sapiens
tataacttaaaaaaatgacaga

SEQ ID NO: 6413503 - DNA, 17 bp, Homo sapiens
tataacttatattgtaa

SEQ ID NO: 6413504 - DNA, 19 bp, Homo sapiens
tataacttatattgtaaga

SEQ ID NO: 6413505 - DNA, 15 bp, Homo sapiens
tataacttattagca

SEQ ID NO: 6413506 - DNA, 16 bp, Homo sapiens
tataacttcaaatttt

SEQ ID NO: 6413507 - DNA, 15 bp, Homo sapiens
tataacttcttaaaa

SEQ ID NO: 6413508 - DNA, 19 bp, Homo sapiens
tataacttcttcctgctgg

SEQ ID NO: 6413509 - DNA, 13 bp, Homo sapiens
tataacttgaaaa

SEQ ID NO: 6413510 - DNA, 19 bp, Homo sapiens
tataacttgtctaaataag

SEQ ID NO: 6413511 - DNA, 16 bp, Homo sapiens
tataactttaacttct

SEQ ID NO: 6413512 - DNA, 13 bp, Homo sapiens
tataactttagaa

SEQ ID NO: 6413513 - DNA, 16 bp, Homo sapiens
tataactttagaaata

SEQ ID NO: 6413514 - DNA, 12 bp, Homo sapiens
tataacttttta

SEQ ID NO: 6413515 - DNA, 13 bp, Homo sapiens
tataagaaaacta

SEQ ID NO: 6413516 - DNA, 14 bp, Homo sapiens
tataagaaagacat

SEQ ID NO: 6413517 - DNA, 21 bp, Homo sapiens
tataagaaagacatctttctc

SEQ ID NO: 6413518 - DNA, 14 bp, Homo sapiens
tataagaaatttta

SEQ ID NO: 6413519 - DNA, 14 bp, Homo sapiens
tataagaacttgat

SEQ ID NO: 6413520 - DNA, 14 bp, Homo sapiens
tataagaagcaatc

SEQ ID NO: 6413521 - DNA, 21 bp, Homo sapiens
tataagaagcaatctttgaaa

SEQ ID NO: 6413522 - DNA, 22 bp, Homo sapiens
tataagaagcaatctttgaaat

SEQ ID NO: 6413523 - DNA, 13 bp, Homo sapiens
tataagaaggaaa

SEQ ID NO: 6413524 - DNA, 16 bp, Homo sapiens
tataagaataaaatgt

SEQ ID NO: 6413525 - DNA, 19 bp, Homo sapiens
tataagaataaaatgttga

SEQ ID NO: 6413526 - DNA, 15 bp, Homo sapiens
tataagaatcatagt

SEQ ID NO: 6413527 - DNA, 21 bp, Homo sapiens
tataagaatgagcctgtccaa

SEQ ID NO: 6413528 - DNA, 16 bp, Homo sapiens
tataagacaagtctga

SEQ ID NO: 6413529 - DNA, 13 bp, Homo sapiens
tataagacattaa

SEQ ID NO: 6413530 - DNA, 20 bp, Homo sapiens
tataagagacaaagtttgga

SEQ ID NO: 6413531 - DNA, 22 bp, Homo sapiens
tataagagacaaagtttggaag

SEQ ID NO: 6413532 - DNA, 22 bp, Homo sapiens
tataagagcttccaattttcct

SEQ ID NO: 6413533 - DNA, 22 bp, Homo sapiens
tataagatcactgaagaaagag

SEQ ID NO: 6413534 - DNA, 18 bp, Homo sapiens
tataagatcctagatcct

SEQ ID NO: 6413535 - DNA, 14 bp, Homo sapiens
tataagatttttga

SEQ ID NO: 6413536 - DNA, 16 bp, Homo sapiens
tataagcaaaatgaaa

SEQ ID NO: 6413537 - DNA, 19 bp, Homo sapiens
tataagcaaattgcttttt

SEQ ID NO: 6413538 - DNA, 15 bp, Homo sapiens
tataagcaaatttca

SEQ ID NO: 6413539 - DNA, 22 bp, Homo sapiens
tataagcaaatttcaaaagaca

SEQ ID NO: 6413540 - DNA, 23 bp, Homo sapiens
tataagcaaatttcaaaagacat

SEQ ID NO: 6413541 - DNA, 15 bp, Homo sapiens
tataagcaagacagt

SEQ ID NO: 6413542 - DNA, 23 bp, Homo sapiens
tataagcacagacaattctaatg

SEQ ID NO: 6413543 - DNA, 15 bp, Homo sapiens
tataagcatcattat

SEQ ID NO: 6413544 - DNA, 21 bp, Homo sapiens
tataagcatcattatttatgt

SEQ ID NO: 6413545 - DNA, 11 bp, Homo sapiens
tataagcattg

SEQ ID NO: 6413546 - DNA, 18 bp, Homo sapiens
tataagccaaaattaagg

SEQ ID NO: 6413547 - DNA, 19 bp, Homo sapiens
tataagccaaaattaaggt

SEQ ID NO: 6413548 - DNA, 22 bp, Homo sapiens
tataagccaaaattaaggtgtt

SEQ ID NO: 6413549 - DNA, 22 bp, Homo sapiens
tataagccaaagctatatgttg

SEQ ID NO: 6413550 - DNA, 16 bp, Homo sapiens
tataagcccactgtta

SEQ ID NO: 6413551 - DNA, 15 bp, Homo sapiens
tataagccctgcata

SEQ ID NO: 6413552 - DNA, 18 bp, Homo sapiens
tataagccctgcataatg

SEQ ID NO: 6413553 - DNA, 18 bp, Homo sapiens
tataagctgtaatatcat

SEQ ID NO: 6413554 - DNA, 15 bp, Homo sapiens
tataagcttaaatag

SEQ ID NO: 6413555 - DNA, 22 bp, Homo sapiens
tataaggaaagcaataaatgaa

SEQ ID NO: 6413556 - DNA, 14 bp, Homo sapiens
tataaggactgcat

SEQ ID NO: 6413557 - DNA, 15 bp, Homo sapiens
tataaggactgcatg

SEQ ID NO: 6413558 - DNA, 23 bp, Homo sapiens
tataaggagagttcaagcctgtg

SEQ ID NO: 6413559 - DNA, 17 bp, Homo sapiens
tataaggatcttttgta

SEQ ID NO: 6413560 - DNA, 16 bp, Homo sapiens
tataaggcagccttga

SEQ ID NO: 6413561 - DNA, 24 bp, Homo sapiens
tataaggcattctgtataaatgca

SEQ ID NO: 6413562 - DNA, 21 bp, Homo sapiens
tataagggaagtagttatcat

SEQ ID NO: 6413563 - DNA, 21 bp, Homo sapiens
tataagggagtaggctgtatt

SEQ ID NO: 6413564 - DNA, 22 bp, Homo sapiens
tataagggcaaattggagaaaa

SEQ ID NO: 6413565 - DNA, 13 bp, Homo sapiens
tataagggccctg

SEQ ID NO: 6413566 - DNA, 20 bp, Homo sapiens
tataagggccctgccctgta

SEQ ID NO: 6413567 - DNA, 13 bp, Homo sapiens
tcccctccttgtc

SEQ ID NO: 6413568 - DNA, 14 bp, Homo sapiens
tcccctcctttacc

SEQ ID NO: 6413569 - DNA, 15 bp, Homo sapiens
tcccctcctttgtct

SEQ ID NO: 6413570 - DNA, 16 bp, Homo sapiens
tcccctcctttgtctt

SEQ ID NO: 6413571 - DNA, 17 bp, Homo sapiens
tcccctcgcccatcagt

SEQ ID NO: 6413572 - DNA, 18 bp, Homo sapiens
tcccctcgctgtcctgct

SEQ ID NO: 6413573 - DNA, 19 bp, Homo sapiens
tcccctcgcttcataggca

SEQ ID NO: 6413574 - DNA, 22 bp, Homo sapiens
tcccctcgcttcataggcagag

SEQ ID NO: 6413575 - DNA, 20 bp, Homo sapiens
tcccctcgtcccatccagct

SEQ ID NO: 6413576 - DNA, 16 bp, Homo sapiens
tcccctcgtgtcagct

SEQ ID NO: 6413577 - DNA, 17 bp, Homo sapiens
tcccctctatttagcat

SEQ ID NO: 6413578 - DNA, 13 bp, Homo sapiens
tcccctctcagaa

SEQ ID NO: 6413579 - DNA, 14 bp, Homo sapiens
tcccctctcagaac

SEQ ID NO: 6413580 - DNA, 15 bp, Homo sapiens
tcccctctcagaaca

SEQ ID NO: 6413581 - DNA, 13 bp, Homo sapiens
tcccctctcagga

SEQ ID NO: 6413582 - DNA, 14 bp, Homo sapiens
tcccctctcaggag

SEQ ID NO: 6413583 - DNA, 18 bp, Homo sapiens
tcccctctcatacataaa

SEQ ID NO: 6413584 - DNA, 18 bp, Homo sapiens
tcccctctcatccccctg

SEQ ID NO: 6413585 - DNA, 17 bp, Homo sapiens
tcccctctcccagggat

SEQ ID NO: 6413586 - DNA, 13 bp, Homo sapiens
tcccctctcccct

SEQ ID NO: 6413587 - DNA, 16 bp, Homo sapiens
tcccctctccccttgg

SEQ ID NO: 6413588 - DNA, 17 bp, Homo sapiens
tcccctctccctgggga

SEQ ID NO: 6413589 - DNA, 14 bp, Homo sapiens
tcccctctcctcca

SEQ ID NO: 6413590 - DNA, 15 bp, Homo sapiens
tcccctctcctccgc

SEQ ID NO: 6413591 - DNA, 17 bp, Homo sapiens
tcccctctcctccgcca

SEQ ID NO: 6413592 - DNA, 20 bp, Homo sapiens
tcccctctcctgcatccctc

SEQ ID NO: 6413593 - DNA, 15 bp, Homo sapiens
tcccctctccttcct

SEQ ID NO: 6413594 - DNA, 19 bp, Homo sapiens
tcccctctcgccccatccc

SEQ ID NO: 6413595 - DNA, 23 bp, Homo sapiens
tcccctctcgccccatccctgct

SEQ ID NO: 6413596 - DNA, 14 bp, Homo sapiens
tcccctctctctgg

SEQ ID NO: 6413597 - DNA, 11 bp, Homo sapiens
tcccctctctg

SEQ ID NO: 6413598 - DNA, 17 bp, Homo sapiens
tcccctctctgcccctg

SEQ ID NO: 6413599 - DNA, 18 bp, Homo sapiens
tcccctctctgtggctcc

SEQ ID NO: 6413600 - DNA, 20 bp, Homo sapiens
tcccctctctgtggctccaa

SEQ ID NO: 6413601 - DNA, 17 bp, Homo sapiens
tcccctctcttgcaccc

SEQ ID NO: 6413602 - DNA, 15 bp, Homo sapiens
tcccctctgaaagtt

SEQ ID NO: 6413603 - DNA, 23 bp, Homo sapiens
tcccctctgcaaccccccagctc

SEQ ID NO: 6413604 - DNA, 20 bp, Homo sapiens
tcccctctgccccaccctca

SEQ ID NO: 6413605 - DNA, 21 bp, Homo sapiens
tcccctctgccggtcccccat

SEQ ID NO: 6413606 - DNA, 15 bp, Homo sapiens
tcccctctgctgctg

SEQ ID NO: 6413607 - DNA, 15 bp, Homo sapiens
tcccctctgctggcc

SEQ ID NO: 6413608 - DNA, 13 bp, Homo sapiens
tcccctctgcttc

SEQ ID NO: 6413609 - DNA, 14 bp, Homo sapiens
tcccctctggaatc

SEQ ID NO: 6413610 - DNA, 14 bp, Homo sapiens
tcccctctggaggg

SEQ ID NO: 6413611 - DNA, 18 bp, Homo sapiens
tcccctctggcttgacag

SEQ ID NO: 6413612 - DNA, 10 bp, Homo sapiens
tcccctctgt

SEQ ID NO: 6413613 - DNA, 14 bp, Homo sapiens
tcccctctgtgctt

SEQ ID NO: 6413614 - DNA, 15 bp, Homo sapiens
tcccctctgtgcttc

SEQ ID NO: 6413615 - DNA, 21 bp, Homo sapiens
tcccctctgtgtcctctcccc

SEQ ID NO: 6413616 - DNA, 23 bp, Homo sapiens
tcccctcttccctgtcttcccca

SEQ ID NO: 6413617 - DNA, 18 bp, Homo sapiens
tcccctcttcccttcaac

SEQ ID NO: 6413618 - DNA, 13 bp, Homo sapiens
tcccctcttcctc

SEQ ID NO: 6413619 - DNA, 15 bp, Homo sapiens
tcccctcttcctctt

SEQ ID NO: 6413620 - DNA, 13 bp, Homo sapiens
tcccctcttctga

SEQ ID NO: 6413621 - DNA, 21 bp, Homo sapiens
tcccctcttgccccaaccccc

SEQ ID NO: 6413622 - DNA, 12 bp, Homo sapiens
tcccctgaagac

SEQ ID NO: 6413623 - DNA, 15 bp, Homo sapiens
tcccctgacagggcc

SEQ ID NO: 6413624 - DNA, 20 bp, Homo sapiens
tcccctgacctcacctttgc

SEQ ID NO: 6413625 - DNA, 17 bp, Homo sapiens
tcccctgacctgtccag

SEQ ID NO: 6413626 - DNA, 22 bp, Homo sapiens
tcccctgagaccacccccaaac

SEQ ID NO: 6413627 - DNA, 15 bp, Homo sapiens
tcccctgagaggttt

SEQ ID NO: 6413628 - DNA, 19 bp, Homo sapiens
tcccctgagagtttcctca

SEQ ID NO: 6413629 - DNA, 12 bp, Homo sapiens
tcccctgaggct

SEQ ID NO: 6413630 - DNA, 23 bp, Homo sapiens
tcccctgaggctggcatcctggc

SEQ ID NO: 6413631 - DNA, 14 bp, Homo sapiens
tcccctgcacctgg

SEQ ID NO: 6413632 - DNA, 21 bp, Homo sapiens
tcccctgcacctggcctgggc

SEQ ID NO: 6413633 - DNA, 17 bp, Homo sapiens
tcccctgcactaggcag

SEQ ID NO: 6413634 - DNA, 14 bp, Homo sapiens
tcccctgcagcctg

SEQ ID NO: 6413635 - DNA, 17 bp, Homo sapiens
tcccctgcagcctgggt

SEQ ID NO: 6413636 - DNA, 20 bp, Homo sapiens
tcccctgcaggctgagtgca

SEQ ID NO: 6413637 - DNA, 17 bp, Homo sapiens
tcccctgcatggctgag

SEQ ID NO: 6413638 - DNA, 13 bp, Homo sapiens
tcccctgccacca

SEQ ID NO: 6413639 - DNA, 14 bp, Homo sapiens
tcccctgccaccag

SEQ ID NO: 6413640 - DNA, 21 bp, Homo sapiens
tcccctgccaccgactgccca

SEQ ID NO: 6413641 - DNA, 15 bp, Homo sapiens
tcccctgccagggca

SEQ ID NO: 6413642 - DNA, 20 bp, Homo sapiens
tcccctgccagggcagggcc

SEQ ID NO: 6413643 - DNA, 15 bp, Homo sapiens
tcccctgccagggct

SEQ ID NO: 6413644 - DNA, 16 bp, Homo sapiens
tcccctgccagggctc

SEQ ID NO: 6413645 - DNA, 16 bp, Homo sapiens
tcccctgcccagcctg

SEQ ID NO: 6413646 - DNA, 16 bp, Homo sapiens
tcccctgcccccagga

SEQ ID NO: 6413647 - DNA, 19 bp, Homo sapiens
tcccctgccccctgcagga

SEQ ID NO: 6413648 - DNA, 14 bp, Homo sapiens
tcccctgccccgtc

SEQ ID NO: 6413649 - DNA, 16 bp, Homo sapiens
tcccctgcccctgccc

SEQ ID NO: 6413650 - DNA, 22 bp, Homo sapiens
tcccctgcccctttacggacac

SEQ ID NO: 6413651 - DNA, 16 bp, Homo sapiens
tcccctgcccgcccca

SEQ ID NO: 6413652 - DNA, 13 bp, Homo sapiens
tcccctgcccggt

SEQ ID NO: 6413653 - DNA, 16 bp, Homo sapiens
tcccctgccctgctgc

SEQ ID NO: 6413654 - DNA, 17 bp, Homo sapiens
tcccctgccctggtcca

SEQ ID NO: 6413655 - DNA, 16 bp, Homo sapiens
tcccctgccgcctccc

SEQ ID NO: 6413656 - DNA, 17 bp, Homo sapiens
tcccctgccgcctcccg

SEQ ID NO: 6413657 - DNA, 19 bp, Homo sapiens
tcccctgccgcctcccggg

SEQ ID NO: 6413658 - DNA, 11 bp, Homo sapiens
tcccctgcctc

SEQ ID NO: 6413659 - DNA, 19 bp, Homo sapiens
tcccctgcctcctactcca

SEQ ID NO: 6413660 - DNA, 12 bp, Homo sapiens
tcccctgcctct

SEQ ID NO: 6413661 - DNA, 16 bp, Homo sapiens
tcccctgccttaacct

SEQ ID NO: 6413662 - DNA, 20 bp, Homo sapiens
tcccctgccttaacctggga

SEQ ID NO: 6413663 - DNA, 15 bp, Homo sapiens
tcccctgccttgctg

SEQ ID NO: 6413664 - DNA, 15 bp, Homo sapiens
tcccctgcgcaggcc

SEQ ID NO: 6413665 - DNA, 20 bp, Homo sapiens
tcccctgcgccctccctccc

SEQ ID NO: 6413666 - DNA, 16 bp, Homo sapiens
tcccctgcgctttgaa

SEQ ID NO: 6413667 - DNA, 15 bp, Homo sapiens
tcccctgctcccagg

SEQ ID NO: 6413668 - DNA, 13 bp, Homo sapiens
tcccctgctcctg

SEQ ID NO: 6413669 - DNA, 15 bp, Homo sapiens
tcccctgctgcaggg

SEQ ID NO: 6413670 - DNA, 17 bp, Homo sapiens
tcccctgctgcaggggc

SEQ ID NO: 6413671 - DNA, 14 bp, Homo sapiens
tcccctgctgggtg

SEQ ID NO: 6413672 - DNA, 21 bp, Homo sapiens
tcccctgctgggtgtggcgca

SEQ ID NO: 6413673 - DNA, 15 bp, Homo sapiens
tcccctggaaaccca

SEQ ID NO: 6413674 - DNA, 22 bp, Homo sapiens
tcccctggaagcagtgcccagg

SEQ ID NO: 6413675 - DNA, 22 bp, Homo sapiens
tcccctggacagaggcggggct

SEQ ID NO: 6413676 - DNA, 15 bp, Homo sapiens
tcccctggactggga

SEQ ID NO: 6413677 - DNA, 16 bp, Homo sapiens
tcccctggactgggag

SEQ ID NO: 6413678 - DNA, 17 bp, Homo sapiens
tcccctggactgggagg

SEQ ID NO: 6413679 - DNA, 12 bp, Homo sapiens
tcccctggagcc

SEQ ID NO: 6413680 - DNA, 15 bp, Homo sapiens
tcccctggagccagc

SEQ ID NO: 6413681 - DNA, 20 bp, Homo sapiens
tcccctggagccagcagggc

SEQ ID NO: 6413682 - DNA, 19 bp, Homo sapiens
tcccctggagggggaatgg

SEQ ID NO: 6413683 - DNA, 16 bp, Homo sapiens
tcccctggagtgtgtc

SEQ ID NO: 6413684 - DNA, 22 bp, Homo sapiens
tcccctggagtgtgtcagagcc

SEQ ID NO: 6413685 - DNA, 15 bp, Homo sapiens
tcccctggcactggc

SEQ ID NO: 6413686 - DNA, 15 bp, Homo sapiens
tcccctggcagtgct

SEQ ID NO: 6413687 - DNA, 23 bp, Homo sapiens
tcccctggcccttccttcaccca

SEQ ID NO: 6413688 - DNA, 20 bp, Homo sapiens
tcccctggctggctcctagg

SEQ ID NO: 6413689 - DNA, 12 bp, Homo sapiens
tcccctgggact

SEQ ID NO: 6413690 - DNA, 19 bp, Homo sapiens
tcccctgggatgctgaccc

SEQ ID NO: 6413691 - DNA, 23 bp, Homo sapiens
tcccctgggatgctgacccagga

SEQ ID NO: 6413692 - DNA, 16 bp, Homo sapiens
tcccctgggccaccct

SEQ ID NO: 6413693 - DNA, 19 bp, Homo sapiens
tcccctgggccacccttca

SEQ ID NO: 6413694 - DNA, 14 bp, Homo sapiens
tcccctgggcctgg

SEQ ID NO: 6413695 - DNA, 15 bp, Homo sapiens
tcccctgggcctgga

SEQ ID NO: 6413696 - DNA, 11 bp, Homo sapiens
tcccctgggga

SEQ ID NO: 6413697 - DNA, 20 bp, Homo sapiens
tcccctggggtgcaggcgcc

SEQ ID NO: 6413698 - DNA, 16 bp, Homo sapiens
tcccctggtcctgcac

SEQ ID NO: 6413699 - DNA, 16 bp, Homo sapiens
tcccctggtgcccctc

SEQ ID NO: 6413700 - DNA, 22 bp, Homo sapiens
tcccctgtcagtttcccctctc

SEQ ID NO: 6413701 - DNA, 12 bp, Homo sapiens
tcccctgtccca

SEQ ID NO: 6413702 - DNA, 23 bp, Homo sapiens
tcccctgtccccgcactgggctt

SEQ ID NO: 6413703 - DNA, 15 bp, Homo sapiens
tcccctgtcccctgg

SEQ ID NO: 6413704 - DNA, 19 bp, Homo sapiens
tcccctgtcccctggggct

SEQ ID NO: 6413705 - DNA, 20 bp, Homo sapiens
tcccctgtcccctggggctg

SEQ ID NO: 6413706 - DNA, 17 bp, Homo sapiens
tcccctgtcctgtgaat

SEQ ID NO: 6413707 - DNA, 18 bp, Homo sapiens
tcccctgtctctaaggag

SEQ ID NO: 6413708 - DNA, 19 bp, Homo sapiens
tcccctgtcttcacctgcc

SEQ ID NO: 6413709 - DNA, 21 bp, Homo sapiens
tcccctgtcttcacctgccac

SEQ ID NO: 6413710 - DNA, 15 bp, Homo sapiens
tcccctgtcttctct

SEQ ID NO: 6413711 - DNA, 21 bp, Homo sapiens
tcccctgtgactcctcccttc

SEQ ID NO: 6413712 - DNA, 17 bp, Homo sapiens
tcccctgtgccagccca

SEQ ID NO: 6413713 - DNA, 20 bp, Homo sapiens
tcccctgtgccagcccagag

SEQ ID NO: 6413714 - DNA, 17 bp, Homo sapiens
tcccctgtgccctgcac

SEQ ID NO: 6413715 - DNA, 17 bp, Homo sapiens
tcccctgtggtcttgga

SEQ ID NO: 6413716 - DNA, 22 bp, Homo sapiens
tcccctgtggtgatgtgcctgt

SEQ ID NO: 6413717 - DNA, 17 bp, Homo sapiens
tcccctgtggtttgtta

SEQ ID NO: 6413718 - DNA, 18 bp, Homo sapiens
tcccctgtggtttgttat

SEQ ID NO: 6413719 - DNA, 18 bp, Homo sapiens
tcccctgtgtagagcctg

SEQ ID NO: 6413720 - DNA, 16 bp, Homo sapiens
tcccctgtttgcatga

SEQ ID NO: 6413721 - DNA, 20 bp, Homo sapiens
tcccctgtttgtttctgaaa

SEQ ID NO: 6413722 - DNA, 18 bp, Homo sapiens
tccccttatcctccctgt

SEQ ID NO: 6413723 - DNA, 13 bp, Homo sapiens
tccccttcatcct

SEQ ID NO: 6413724 - DNA, 22 bp, Homo sapiens
tccccttccaactatgtccaga

SEQ ID NO: 6413725 - DNA, 15 bp, Homo sapiens
tccccttcccaaccc

SEQ ID NO: 6413726 - DNA, 14 bp, Homo sapiens
tccccttcccagac

SEQ ID NO: 6413727 - DNA, 15 bp, Homo sapiens
tccccttcccagacc

SEQ ID NO: 6413728 - DNA, 13 bp, Homo sapiens
tccccttccccca

SEQ ID NO: 6413729 - DNA, 19 bp, Homo sapiens
tccccttccccgtcccctg

SEQ ID NO: 6413730 - DNA, 23 bp, Homo sapiens
tccccttccccgtcccctgcagc

SEQ ID NO: 6413731 - DNA, 12 bp, Homo sapiens
tccccttcccct

SEQ ID NO: 6413732 - DNA, 14 bp, Homo sapiens
tccccttcccctcc

SEQ ID NO: 6413733 - DNA, 16 bp, Homo sapiens
tccccttcccctcccc

SEQ ID NO: 6413734 - DNA, 15 bp, Homo sapiens
tccccttcccctgct

SEQ ID NO: 6413735 - DNA, 18 bp, Homo sapiens
tccccttcccgtgacctg

SEQ ID NO: 6413736 - DNA, 13 bp, Homo sapiens
tccccttccctgg

SEQ ID NO: 6413737 - DNA, 14 bp, Homo sapiens
tccccttccctggg

SEQ ID NO: 6413738 - DNA, 18 bp, Homo sapiens
tccccttccctggggagc

SEQ ID NO: 6413739 - DNA, 12 bp, Homo sapiens
tccccttccctt

SEQ ID NO: 6413740 - DNA, 13 bp, Homo sapiens
tccccttccctta

SEQ ID NO: 6413741 - DNA, 21 bp, Homo sapiens
tccccttcctaaatatccaaa

SEQ ID NO: 6413742 - DNA, 22 bp, Homo sapiens
tccccttcctaattccacagct

SEQ ID NO: 6413743 - DNA, 16 bp, Homo sapiens
tccccttcctaccacc

SEQ ID NO: 6413744 - DNA, 19 bp, Homo sapiens
tccccttcctaccacccgg

SEQ ID NO: 6413745 - DNA, 16 bp, Homo sapiens
tccccttcctgcaccc

SEQ ID NO: 6413746 - DNA, 12 bp, Homo sapiens
tccccttcctgg

SEQ ID NO: 6413747 - DNA, 21 bp, Homo sapiens
tccccttcctggacacactct

SEQ ID NO: 6413748 - DNA, 14 bp, Homo sapiens
tataaggtcataga

SEQ ID NO: 6413749 - DNA, 15 bp, Homo sapiens
tataaggtgcctcag

SEQ ID NO: 6413750 - DNA, 21 bp, Homo sapiens
tataaggtgctctctttctgt

SEQ ID NO: 6413751 - DNA, 20 bp, Homo sapiens
tataaggtgttttctgtgta

SEQ ID NO: 6413752 - DNA, 23 bp, Homo sapiens
tataaggttgggttagcaatatt

SEQ ID NO: 6413753 - DNA, 18 bp, Homo sapiens
tataagtaaatatattat

SEQ ID NO: 6413754 - DNA, 22 bp, Homo sapiens
tataagtaacttgtcaaggaat

SEQ ID NO: 6413755 - DNA, 18 bp, Homo sapiens
tataagtaagaaaatatt

SEQ ID NO: 6413756 - DNA, 15 bp, Homo sapiens
tataagtacttggtc

SEQ ID NO: 6413757 - DNA, 17 bp, Homo sapiens
tataagtagatttgtag

SEQ ID NO: 6413758 - DNA, 16 bp, Homo sapiens
tataagtagtaaatca

SEQ ID NO: 6413759 - DNA, 20 bp, Homo sapiens
tataagtagttggtttgtat

SEQ ID NO: 6413760 - DNA, 19 bp, Homo sapiens
tataagtcaagcacatgta

SEQ ID NO: 6413761 - DNA, 20 bp, Homo sapiens
tataagtcttggtaacaaat

SEQ ID NO: 6413762 - DNA, 22 bp, Homo sapiens
tataagtgagatggtatgaaat

SEQ ID NO: 6413763 - DNA, 19 bp, Homo sapiens
tataagtgattgctggttt

SEQ ID NO: 6413764 - DNA, 21 bp, Homo sapiens
tataagtgcacacagaaatat

SEQ ID NO: 6413765 - DNA, 13 bp, Homo sapiens
tataagtgctgta

SEQ ID NO: 6413766 - DNA, 17 bp, Homo sapiens
tataagtgctgtataaa

SEQ ID NO: 6413767 - DNA, 19 bp, Homo sapiens
tataagtgctgtataaaat

SEQ ID NO: 6413768 - DNA, 21 bp, Homo sapiens
tataagtgctgtataaaatca

SEQ ID NO: 6413769 - DNA, 16 bp, Homo sapiens
tataagtgcttcacag

SEQ ID NO: 6413770 - DNA, 19 bp, Homo sapiens
tataagtggaggcacttta

SEQ ID NO: 6413771 - DNA, 21 bp, Homo sapiens
tataagtggtgcttagaaaat

SEQ ID NO: 6413772 - DNA, 13 bp, Homo sapiens
tataagtgtacat

SEQ ID NO: 6413773 - DNA, 14 bp, Homo sapiens
tataagtgtacata

SEQ ID NO: 6413774 - DNA, 17 bp, Homo sapiens
tataagtgtgtgttttt

SEQ ID NO: 6413775 - DNA, 23 bp, Homo sapiens
tataagtgtgtgtttttcataaa

SEQ ID NO: 6413776 - DNA, 22 bp, Homo sapiens
tataagtgttcagtgttgacat

SEQ ID NO: 6413777 - DNA, 18 bp, Homo sapiens
tataagttaaagagacaa

SEQ ID NO: 6413778 - DNA, 12 bp, Homo sapiens
tataagttgacc

SEQ ID NO: 6413779 - DNA, 15 bp, Homo sapiens
tataagttgtaccaa

SEQ ID NO: 6413780 - DNA, 22 bp, Homo sapiens
tataagttgtaccaaaacatcc

SEQ ID NO: 6413781 - DNA, 12 bp, Homo sapiens
tataataaaaga

SEQ ID NO: 6413782 - DNA, 13 bp, Homo sapiens
tataataaaagaa

SEQ ID NO: 6413783 - DNA, 14 bp, Homo sapiens
tataataaaagtgc

SEQ ID NO: 6413784 - DNA, 14 bp, Homo sapiens
tataataaaatttc

SEQ ID NO: 6413785 - DNA, 20 bp, Homo sapiens
tataataaactcttaagaga

SEQ ID NO: 6413786 - DNA, 15 bp, Homo sapiens
tataataaactgttt

SEQ ID NO: 6413787 - DNA, 16 bp, Homo sapiens
tataataaactgttta

SEQ ID NO: 6413788 - DNA, 22 bp, Homo sapiens
tataataaagaaaacctttcta

SEQ ID NO: 6413789 - DNA, 19 bp, Homo sapiens
tataataaaggactgtaat

SEQ ID NO: 6413790 - DNA, 18 bp, Homo sapiens
tataataaaggtcacata

SEQ ID NO: 6413791 - DNA, 19 bp, Homo sapiens
tataataaataaacttcaa

SEQ ID NO: 6413792 - DNA, 14 bp, Homo sapiens
tataataaatggga

SEQ ID NO: 6413793 - DNA, 13 bp, Homo sapiens
tataataaatgta

SEQ ID NO: 6413794 - DNA, 16 bp, Homo sapiens
tataataaatgtacat

SEQ ID NO: 6413795 - DNA, 17 bp, Homo sapiens
tataataactgaactgt

SEQ ID NO: 6413796 - DNA, 17 bp, Homo sapiens
tataataagcaaaaaga

SEQ ID NO: 6413797 - DNA, 20 bp, Homo sapiens
tataataattacttaatgtg

SEQ ID NO: 6413798 - DNA, 13 bp, Homo sapiens
tataataattgaa

SEQ ID NO: 6413799 - DNA, 20 bp, Homo sapiens
tataatacagaatcttgttt

SEQ ID NO: 6413800 - DNA, 17 bp, Homo sapiens
tataatacattacatgt

SEQ ID NO: 6413801 - DNA, 16 bp, Homo sapiens
tataatactaaagtgt

SEQ ID NO: 6413802 - DNA, 16 bp, Homo sapiens
tataatactactactg

SEQ ID NO: 6413803 - DNA, 17 bp, Homo sapiens
tataatactctgttgta

SEQ ID NO: 6413804 - DNA, 15 bp, Homo sapiens
tataatactgtattt

SEQ ID NO: 6413805 - DNA, 22 bp, Homo sapiens
tataatacttaaaaatatgtga

SEQ ID NO: 6413806 - DNA, 15 bp, Homo sapiens
tataatactttgtat

SEQ ID NO: 6413807 - DNA, 19 bp, Homo sapiens
tataatactttgtatacaa

SEQ ID NO: 6413808 - DNA, 17 bp, Homo sapiens
tataatagcaacttttg

SEQ ID NO: 6413809 - DNA, 22 bp, Homo sapiens
tataatataaaaaattttaaaa

SEQ ID NO: 6413810 - DNA, 17 bp, Homo sapiens
tataatatactaaacca

SEQ ID NO: 6413811 - DNA, 17 bp, Homo sapiens
tataatatactatattt

SEQ ID NO: 6413812 - DNA, 13 bp, Homo sapiens
tataatatatgtt

SEQ ID NO: 6413813 - DNA, 19 bp, Homo sapiens
tataatattcatacaacaa

SEQ ID NO: 6413814 - DNA, 21 bp, Homo sapiens
tataatatttcttaatttgga

SEQ ID NO: 6413815 - DNA, 18 bp, Homo sapiens
tataatatttgaagcagc

SEQ ID NO: 6413816 - DNA, 23 bp, Homo sapiens
tataatatttgaagcagctctgc

SEQ ID NO: 6413817 - DNA, 22 bp, Homo sapiens
tataatatttttaattaaataa

SEQ ID NO: 6413818 - DNA, 14 bp, Homo sapiens
tataatcaaatgat

SEQ ID NO: 6413819 - DNA, 19 bp, Homo sapiens
tataatcaaatgatttcat

SEQ ID NO: 6413820 - DNA, 16 bp, Homo sapiens
tataatcaccagggcc

SEQ ID NO: 6413821 - DNA, 18 bp, Homo sapiens
tataatcagggaaactaa

SEQ ID NO: 6413822 - DNA, 15 bp, Homo sapiens
tataatcatgctcat

SEQ ID NO: 6413823 - DNA, 18 bp, Homo sapiens
tataatcatgctcatgta

SEQ ID NO: 6413824 - DNA, 23 bp, Homo sapiens
tataatcatgctcatgtatattt

SEQ ID NO: 6413825 - DNA, 15 bp, Homo sapiens
tataatcattagttt

SEQ ID NO: 6413826 - DNA, 23 bp, Homo sapiens
tataatcattattacttttgctg

SEQ ID NO: 6413827 - DNA, 15 bp, Homo sapiens
tataatccctttaca

SEQ ID NO: 6413828 - DNA, 14 bp, Homo sapiens
tataatctatttac

SEQ ID NO: 6413829 - DNA, 13 bp, Homo sapiens
tataatctcaaag

SEQ ID NO: 6413830 - DNA, 18 bp, Homo sapiens
tataatctcctctgctca

SEQ ID NO: 6413831 - DNA, 19 bp, Homo sapiens
tataatctcctctgctcat

SEQ ID NO: 6413832 - DNA, 15 bp, Homo sapiens
tataatctgaagata

SEQ ID NO: 6413833 - DNA, 22 bp, Homo sapiens
tataatcttgtagacacttact

SEQ ID NO: 6413834 - DNA, 17 bp, Homo sapiens
tataatgaacaaaatta

SEQ ID NO: 6413835 - DNA, 14 bp, Homo sapiens
tataatgaagcttt

SEQ ID NO: 6413836 - DNA, 15 bp, Homo sapiens
tataatgaataaatc

SEQ ID NO: 6413837 - DNA, 20 bp, Homo sapiens
tataatgaatgaaacatttt

SEQ ID NO: 6413838 - DNA, 18 bp, Homo sapiens
tataatgaatgagagaat

SEQ ID NO: 6413839 - DNA, 15 bp, Homo sapiens
tataatgacttttaa

SEQ ID NO: 6413840 - DNA, 17 bp, Homo sapiens
tataatgagtttcatta

SEQ ID NO: 6413841 - DNA, 13 bp, Homo sapiens
tataatgattatt

SEQ ID NO: 6413842 - DNA, 20 bp, Homo sapiens
tataatgccagaatataatg

SEQ ID NO: 6413843 - DNA, 15 bp, Homo sapiens
tataatgctggagcg

SEQ ID NO: 6413844 - DNA, 16 bp, Homo sapiens
tataatgctttctgag

SEQ ID NO: 6413845 - DNA, 19 bp, Homo sapiens
tataatggacagattaata

SEQ ID NO: 6413846 - DNA, 18 bp, Homo sapiens
tataatggcctcttaaaa

SEQ ID NO: 6413847 - DNA, 17 bp, Homo sapiens
tataatggctctgggct

SEQ ID NO: 6413848 - DNA, 16 bp, Homo sapiens
tataatgggaagtgta

SEQ ID NO: 6413849 - DNA, 16 bp, Homo sapiens
tataatggtaatagaa

SEQ ID NO: 6413850 - DNA, 19 bp, Homo sapiens
tataatggtaatagaatag

SEQ ID NO: 6413851 - DNA, 12 bp, Homo sapiens
tataatggttgg

SEQ ID NO: 6413852 - DNA, 16 bp, Homo sapiens
tataatggtttactgc

SEQ ID NO: 6413853 - DNA, 18 bp, Homo sapiens
tataatggtttactgctg

SEQ ID NO: 6413854 - DNA, 16 bp, Homo sapiens
tataatggtttcaaag

SEQ ID NO: 6413855 - DNA, 17 bp, Homo sapiens
tataatggtttcaaaga

SEQ ID NO: 6413856 - DNA, 23 bp, Homo sapiens
tataatggtttcaaagattcaaa

SEQ ID NO: 6413857 - DNA, 22 bp, Homo sapiens
tataatgtatgaattttgtaag

SEQ ID NO: 6413858 - DNA, 15 bp, Homo sapiens
tataatgtattcata

SEQ ID NO: 6413859 - DNA, 20 bp, Homo sapiens
tataatgtattcatatttgt

SEQ ID NO: 6413860 - DNA, 12 bp, Homo sapiens
tataatgtattt

SEQ ID NO: 6413861 - DNA, 19 bp, Homo sapiens
tataatgtatttgaaaatt

SEQ ID NO: 6413862 - DNA, 21 bp, Homo sapiens
tataatgtattttcagctcaa

SEQ ID NO: 6413863 - DNA, 15 bp, Homo sapiens
tataatgtcaaatga

SEQ ID NO: 6413864 - DNA, 15 bp, Homo sapiens
tataatgtgaaatgt

SEQ ID NO: 6413865 - DNA, 16 bp, Homo sapiens
tataatgtgaaatgta

SEQ ID NO: 6413866 - DNA, 14 bp, Homo sapiens
tataatgtgcttta

SEQ ID NO: 6413867 - DNA, 22 bp, Homo sapiens
tataatgtggatttcctatttt

SEQ ID NO: 6413868 - DNA, 12 bp, Homo sapiens
tataatgtgtgt

SEQ ID NO: 6413869 - DNA, 13 bp, Homo sapiens
tataatgtgtgta

SEQ ID NO: 6413870 - DNA, 20 bp, Homo sapiens
tataatgtgtgtatgtgtat

SEQ ID NO: 6413871 - DNA, 16 bp, Homo sapiens
tataatgttagtagaa

SEQ ID NO: 6413872 - DNA, 15 bp, Homo sapiens
tataatgttattcat

SEQ ID NO: 6413873 - DNA, 13 bp, Homo sapiens
tataatgtttaaa

SEQ ID NO: 6413874 - DNA, 17 bp, Homo sapiens
tataatgtttattaaat

SEQ ID NO: 6413875 - DNA, 18 bp, Homo sapiens
tataatgtttattaaatg

SEQ ID NO: 6413876 - DNA, 20 bp, Homo sapiens
tataatgtttattaaatgct

SEQ ID NO: 6413877 - DNA, 12 bp, Homo sapiens
tataattaaaga

SEQ ID NO: 6413878 - DNA, 23 bp, Homo sapiens
tataattaaagaaaattgccaaa

SEQ ID NO: 6413879 - DNA, 16 bp, Homo sapiens
tataattaacatgtta

SEQ ID NO: 6413880 - DNA, 18 bp, Homo sapiens
tataattaacatgttaaa

SEQ ID NO: 6413881 - DNA, 19 bp, Homo sapiens
tataattaacatgttaaac

SEQ ID NO: 6413882 - DNA, 19 bp, Homo sapiens
tataattaacttaactgaa

SEQ ID NO: 6413883 - DNA, 13 bp, Homo sapiens
tataattatatgt

SEQ ID NO: 6413884 - DNA, 17 bp, Homo sapiens
tataattatgttattga

SEQ ID NO: 6413885 - DNA, 22 bp, Homo sapiens
tataattatgttattgaaaaaa

SEQ ID NO: 6413886 - DNA, 23 bp, Homo sapiens
tataattatttttatctgaagct

SEQ ID NO: 6413887 - DNA, 15 bp, Homo sapiens
tataattcacattgt

SEQ ID NO: 6413888 - DNA, 13 bp, Homo sapiens
tataattcagtat

SEQ ID NO: 6413889 - DNA, 21 bp, Homo sapiens
tataattcctatatcctgtga

SEQ ID NO: 6413890 - DNA, 23 bp, Homo sapiens
tataattcctgtttttattatta

SEQ ID NO: 6413891 - DNA, 16 bp, Homo sapiens
tataattccttaaaat

SEQ ID NO: 6413892 - DNA, 14 bp, Homo sapiens
tataattctattga

SEQ ID NO: 6413893 - DNA, 16 bp, Homo sapiens
tataattctcattaaa

SEQ ID NO: 6413894 - DNA, 12 bp, Homo sapiens
tataattctgga

SEQ ID NO: 6413895 - DNA, 16 bp, Homo sapiens
tataattctgtaaatg

SEQ ID NO: 6413896 - DNA, 23 bp, Homo sapiens
tataattgaattggtttttccca

SEQ ID NO: 6413897 - DNA, 17 bp, Homo sapiens
tataattggatttccta

SEQ ID NO: 6413898 - DNA, 22 bp, Homo sapiens
tataattggatttcctaatact

SEQ ID NO: 6413899 - DNA, 13 bp, Homo sapiens
tataattgtacaa

SEQ ID NO: 6413900 - DNA, 14 bp, Homo sapiens
tataattgtcatga

SEQ ID NO: 6413901 - DNA, 14 bp, Homo sapiens
tataattgttgcat

SEQ ID NO: 6413902 - DNA, 15 bp, Homo sapiens
tataattgtttttta

SEQ ID NO: 6413903 - DNA, 18 bp, Homo sapiens
tataattgttttttatct

SEQ ID NO: 6413904 - DNA, 13 bp, Homo sapiens
tataatttaaatg

SEQ ID NO: 6413905 - DNA, 16 bp, Homo sapiens
tataatttaaatgata

SEQ ID NO: 6413906 - DNA, 13 bp, Homo sapiens
tataatttaacag

SEQ ID NO: 6413907 - DNA, 18 bp, Homo sapiens
tataatttaataaaaagg

SEQ ID NO: 6413908 - DNA, 19 bp, Homo sapiens
tataatttaataaaaagga

SEQ ID NO: 6413909 - DNA, 22 bp, Homo sapiens
tataatttaataaaaaggaata

SEQ ID NO: 6413910 - DNA, 15 bp, Homo sapiens
tataatttaatgtaa

SEQ ID NO: 6413911 - DNA, 18 bp, Homo sapiens
tataatttaatgtaaata

SEQ ID NO: 6413912 - DNA, 14 bp, Homo sapiens
tataatttacctaa

SEQ ID NO: 6413913 - DNA, 17 bp, Homo sapiens
tataatttataagcatt

SEQ ID NO: 6413914 - DNA, 18 bp, Homo sapiens
tataatttataagcattg

SEQ ID NO: 6413915 - DNA, 14 bp, Homo sapiens
tataatttcaagga

SEQ ID NO: 6413916 - DNA, 13 bp, Homo sapiens
tataatttcctca

SEQ ID NO: 6413917 - DNA, 14 bp, Homo sapiens
tataatttcctcac

SEQ ID NO: 6413918 - DNA, 20 bp, Homo sapiens
tataatttcgagatttgtag

SEQ ID NO: 6413919 - DNA, 20 bp, Homo sapiens
tataatttgagtgtatatat

SEQ ID NO: 6413920 - DNA, 23 bp, Homo sapiens
tataatttgccagacagagatca

SEQ ID NO: 6413921 - DNA, 16 bp, Homo sapiens
tataattttaaagtaa

SEQ ID NO: 6413922 - DNA, 16 bp, Homo sapiens
tataattttacaaagt

SEQ ID NO: 6413923 - DNA, 12 bp, Homo sapiens
tataattttatc

SEQ ID NO: 6413924 - DNA, 18 bp, Homo sapiens
tataattttattgctgga

SEQ ID NO: 6413925 - DNA, 13 bp, Homo sapiens
tataattttcact

SEQ ID NO: 6413926 - DNA, 23 bp, Homo sapiens
tataattttccagtataaaacaa

SEQ ID NO: 6413927 - DNA, 13 bp, Homo sapiens
tccccttcctggc

SEQ ID NO: 6413928 - DNA, 12 bp, Homo sapiens
tccccttcctgt

SEQ ID NO: 6413929 - DNA, 16 bp, Homo sapiens
tccccttcctgttctt

SEQ ID NO: 6413930 - DNA, 11 bp, Homo sapiens
tccccttcctt

SEQ ID NO: 6413931 - DNA, 22 bp, Homo sapiens
tccccttcgcgtatttcaggat

SEQ ID NO: 6413932 - DNA, 16 bp, Homo sapiens
tccccttctctcatct

SEQ ID NO: 6413933 - DNA, 16 bp, Homo sapiens
tccccttctctgcctc

SEQ ID NO: 6413934 - DNA, 22 bp, Homo sapiens
tccccttctgtgtttctggagt

SEQ ID NO: 6413935 - DNA, 15 bp, Homo sapiens
tccccttcttcccgc

SEQ ID NO: 6413936 - DNA, 11 bp, Homo sapiens
tccccttcttg

SEQ ID NO: 6413937 - DNA, 15 bp, Homo sapiens
tccccttgagctgag

SEQ ID NO: 6413938 - DNA, 21 bp, Homo sapiens
tccccttgcactggtcatcag

SEQ ID NO: 6413939 - DNA, 16 bp, Homo sapiens
tccccttgcagcctgg

SEQ ID NO: 6413940 - DNA, 14 bp, Homo sapiens
tccccttgccagct

SEQ ID NO: 6413941 - DNA, 22 bp, Homo sapiens
tccccttgccagctgctgagcc

SEQ ID NO: 6413942 - DNA, 13 bp, Homo sapiens
tccccttgcccag

SEQ ID NO: 6413943 - DNA, 15 bp, Homo sapiens
tccccttgcccaggg

SEQ ID NO: 6413944 - DNA, 24 bp, Homo sapiens
tccccttgcccagggctcagcctg

SEQ ID NO: 6413945 - DNA, 15 bp, Homo sapiens
tccccttgcccttcc

SEQ ID NO: 6413946 - DNA, 16 bp, Homo sapiens
tccccttgcccttcct

SEQ ID NO: 6413947 - DNA, 18 bp, Homo sapiens
tccccttgcccttgccct

SEQ ID NO: 6413948 - DNA, 23 bp, Homo sapiens
tccccttgcctgtgccaggtgag

SEQ ID NO: 6413949 - DNA, 16 bp, Homo sapiens
tccccttgccttcccc

SEQ ID NO: 6413950 - DNA, 21 bp, Homo sapiens
tccccttgccttcccctgtct

SEQ ID NO: 6413951 - DNA, 18 bp, Homo sapiens
tccccttggacctccagg

SEQ ID NO: 6413952 - DNA, 16 bp, Homo sapiens
tccccttggcttcctc

SEQ ID NO: 6413953 - DNA, 23 bp, Homo sapiens
tccccttgggatgggcacaggct

SEQ ID NO: 6413954 - DNA, 16 bp, Homo sapiens
tccccttgggcccaca

SEQ ID NO: 6413955 - DNA, 19 bp, Homo sapiens
tccccttgggcccacacct

SEQ ID NO: 6413956 - DNA, 17 bp, Homo sapiens
tccccttgggcggctga

SEQ ID NO: 6413957 - DNA, 22 bp, Homo sapiens
tccccttgggcggctgagagcc

SEQ ID NO: 6413958 - DNA, 16 bp, Homo sapiens
tccccttgtccctggg

SEQ ID NO: 6413959 - DNA, 17 bp, Homo sapiens
tccccttgtccctgggg

SEQ ID NO: 6413960 - DNA, 18 bp, Homo sapiens
tccccttgtccctggggc

SEQ ID NO: 6413961 - DNA, 19 bp, Homo sapiens
tccccttgtccctggggca

SEQ ID NO: 6413962 - DNA, 19 bp, Homo sapiens
tccccttgtgtcagagaca

SEQ ID NO: 6413963 - DNA, 13 bp, Homo sapiens
tccccttgttcta

SEQ ID NO: 6413964 - DNA, 19 bp, Homo sapiens
tcccctttactcagcccag

SEQ ID NO: 6413965 - DNA, 20 bp, Homo sapiens
tcccctttactcagcccagc

SEQ ID NO: 6413966 - DNA, 19 bp, Homo sapiens
tcccctttcaaattgcctt

SEQ ID NO: 6413967 - DNA, 13 bp, Homo sapiens
tcccctttccaat

SEQ ID NO: 6413968 - DNA, 17 bp, Homo sapiens
tcccctttcccatcacc

SEQ ID NO: 6413969 - DNA, 13 bp, Homo sapiens
tcccctttcctgt

SEQ ID NO: 6413970 - DNA, 14 bp, Homo sapiens
tcccctttcctgtc

SEQ ID NO: 6413971 - DNA, 17 bp, Homo sapiens
tcccctttcctgtccca

SEQ ID NO: 6413972 - DNA, 19 bp, Homo sapiens
tcccctttcgcccacagtc

SEQ ID NO: 6413973 - DNA, 13 bp, Homo sapiens
tcccctttctctt

SEQ ID NO: 6413974 - DNA, 15 bp, Homo sapiens
tcccctttctctttc

SEQ ID NO: 6413975 - DNA, 11 bp, Homo sapiens
tcccctttctt

SEQ ID NO: 6413976 - DNA, 20 bp, Homo sapiens
tcccctttgcactgtaatga

SEQ ID NO: 6413977 - DNA, 18 bp, Homo sapiens
tcccctttggttttacta

SEQ ID NO: 6413978 - DNA, 19 bp, Homo sapiens
tccccttttccttcagagt

SEQ ID NO: 6413979 - DNA, 18 bp, Homo sapiens
tccccttttgcctggctg

SEQ ID NO: 6413980 - DNA, 13 bp, Homo sapiens
tcccgaaaaatgt

SEQ ID NO: 6413981 - DNA, 21 bp, Homo sapiens
tcccgaagaatgaacccaaga

SEQ ID NO: 6413982 - DNA, 20 bp, Homo sapiens
tcccgaagaatggagaggaa

SEQ ID NO: 6413983 - DNA, 15 bp, Homo sapiens
tcccgaatcctgagg

SEQ ID NO: 6413984 - DNA, 18 bp, Homo sapiens
tcccgacccagccagctg

SEQ ID NO: 6413985 - DNA, 15 bp, Homo sapiens
tcccgacctcttaga

SEQ ID NO: 6413986 - DNA, 21 bp, Homo sapiens
tcccgagcaaccctctgaaga

SEQ ID NO: 6413987 - DNA, 20 bp, Homo sapiens
tcccgagccccctgtccttc

SEQ ID NO: 6413988 - DNA, 22 bp, Homo sapiens
tcccgaggaactcgcctcagcc

SEQ ID NO: 6413989 - DNA, 15 bp, Homo sapiens
tcccgaggaagcaca

SEQ ID NO: 6413990 - DNA, 20 bp, Homo sapiens
tcccgaggaagcacagcttg

SEQ ID NO: 6413991 - DNA, 23 bp, Homo sapiens
tcccgaggaagggccagagcctg

SEQ ID NO: 6413992 - DNA, 13 bp, Homo sapiens
tcccgaggcagca

SEQ ID NO: 6413993 - DNA, 22 bp, Homo sapiens
tcccgaggcagcaacaggacca

SEQ ID NO: 6413994 - DNA, 18 bp, Homo sapiens
tcccgagggagctgctgg

SEQ ID NO: 6413995 - DNA, 18 bp, Homo sapiens
tcccgagggcgcctgggt

SEQ ID NO: 6413996 - DNA, 19 bp, Homo sapiens
tcccgagggcgcctgggtc

SEQ ID NO: 6413997 - DNA, 18 bp, Homo sapiens
tcccgaggtatggcagag

SEQ ID NO: 6413998 - DNA, 13 bp, Homo sapiens
tcccgaggtcagc

SEQ ID NO: 6413999 - DNA, 15 bp, Homo sapiens
tcccgagtacagtct

SEQ ID NO: 6414000 - DNA, 16 bp, Homo sapiens
tcccgagtacagtctg

SEQ ID NO: 6414001 - DNA, 20 bp, Homo sapiens
tcccgagtagctgagattat

SEQ ID NO: 6414002 - DNA, 15 bp, Homo sapiens
tcccgagtagctggg

SEQ ID NO: 6414003 - DNA, 12 bp, Homo sapiens
tcccgagtctgg

SEQ ID NO: 6414004 - DNA, 14 bp, Homo sapiens
tcccgagtctggga

SEQ ID NO: 6414005 - DNA, 15 bp, Homo sapiens
tcccgagtctgggac

SEQ ID NO: 6414006 - DNA, 18 bp, Homo sapiens
tcccgatacctcagccct

SEQ ID NO: 6414007 - DNA, 20 bp, Homo sapiens
tcccgatgagggaaggagcc

SEQ ID NO: 6414008 - DNA, 22 bp, Homo sapiens
tcccgatgcgtggctcccagca

SEQ ID NO: 6414009 - DNA, 14 bp, Homo sapiens
tcccgcaaggcctc

SEQ ID NO: 6414010 - DNA, 16 bp, Homo sapiens
tcccgcaaggcctctc

SEQ ID NO: 6414011 - DNA, 18 bp, Homo sapiens
tcccgcaaggcctctcag

SEQ ID NO: 6414012 - DNA, 22 bp, Homo sapiens
tcccgcacatggtgtggggggc

SEQ ID NO: 6414013 - DNA, 20 bp, Homo sapiens
tcccgcaccttcctcctccc

SEQ ID NO: 6414014 - DNA, 17 bp, Homo sapiens
tcccgcagcaccagcct

SEQ ID NO: 6414015 - DNA, 22 bp, Homo sapiens
tcccgcagcaccagcctgagcc

SEQ ID NO: 6414016 - DNA, 23 bp, Homo sapiens
tcccgcagcaccagcctgagcca

SEQ ID NO: 6414017 - DNA, 23 bp, Homo sapiens
tcccgcagcgggcgcgggacagg

SEQ ID NO: 6414018 - DNA, 20 bp, Homo sapiens
tcccgcatgctgcctgcctc

SEQ ID NO: 6414019 - DNA, 19 bp, Homo sapiens
tcccgccactcgccttctt

SEQ ID NO: 6414020 - DNA, 22 bp, Homo sapiens
tcccgccaggaggtcctcctct

SEQ ID NO: 6414021 - DNA, 15 bp, Homo sapiens
tcccgccagggagtg

SEQ ID NO: 6414022 - DNA, 15 bp, Homo sapiens
tcccgccagtgcaga

SEQ ID NO: 6414023 - DNA, 14 bp, Homo sapiens
tcccgccccacctc

SEQ ID NO: 6414024 - DNA, 13 bp, Homo sapiens
tcccgccccagcc

SEQ ID NO: 6414025 - DNA, 15 bp, Homo sapiens
tcccgccccagcctc

SEQ ID NO: 6414026 - DNA, 19 bp, Homo sapiens
tcccgccccagcctcctga

SEQ ID NO: 6414027 - DNA, 15 bp, Homo sapiens
tcccgccccagggtc

SEQ ID NO: 6414028 - DNA, 16 bp, Homo sapiens
tcccgccccccacact

SEQ ID NO: 6414029 - DNA, 21 bp, Homo sapiens
tcccgccctccccctgccaga

SEQ ID NO: 6414030 - DNA, 23 bp, Homo sapiens
tcccgccctccccctgccagagg

SEQ ID NO: 6414031 - DNA, 22 bp, Homo sapiens
tcccgcccttccatgtgccttt

SEQ ID NO: 6414032 - DNA, 15 bp, Homo sapiens
tcccgccgccccccc

SEQ ID NO: 6414033 - DNA, 16 bp, Homo sapiens
tcccgccggaggccag

SEQ ID NO: 6414034 - DNA, 13 bp, Homo sapiens
tcccgcctcagcc

SEQ ID NO: 6414035 - DNA, 21 bp, Homo sapiens
tcccgcctcagggccaggccc

SEQ ID NO: 6414036 - DNA, 20 bp, Homo sapiens
tcccgcctcccgccaccctg

SEQ ID NO: 6414037 - DNA, 15 bp, Homo sapiens
tcccgcctccctagt

SEQ ID NO: 6414038 - DNA, 17 bp, Homo sapiens
tcccgcctccctctcag

SEQ ID NO: 6414039 - DNA, 18 bp, Homo sapiens
tcccgcctccctctcaga

SEQ ID NO: 6414040 - DNA, 13 bp, Homo sapiens
tcccgcctcggct

SEQ ID NO: 6414041 - DNA, 23 bp, Homo sapiens
tcccgcctgattggggcctcacc

SEQ ID NO: 6414042 - DNA, 13 bp, Homo sapiens
tcccgccttctcc

SEQ ID NO: 6414043 - DNA, 14 bp, Homo sapiens
tcccgccttctcca

SEQ ID NO: 6414044 - DNA, 19 bp, Homo sapiens
tcccgccttctccaggctt

SEQ ID NO: 6414045 - DNA, 18 bp, Homo sapiens
tcccgcgggcctggacac

SEQ ID NO: 6414046 - DNA, 16 bp, Homo sapiens
tcccgcggtgctgact

SEQ ID NO: 6414047 - DNA, 20 bp, Homo sapiens
tcccgcgtgcaaaggaaagg

SEQ ID NO: 6414048 - DNA, 13 bp, Homo sapiens
tcccgctcagccc

SEQ ID NO: 6414049 - DNA, 20 bp, Homo sapiens
tcccgctcagccctccctgc

SEQ ID NO: 6414050 - DNA, 13 bp, Homo sapiens
tcccgctccccac

SEQ ID NO: 6414051 - DNA, 12 bp, Homo sapiens
tcccgctcctgc

SEQ ID NO: 6414052 - DNA, 12 bp, Homo sapiens
tcccgctgcctc

SEQ ID NO: 6414053 - DNA, 20 bp, Homo sapiens
tcccgctgcctcctgctctc

SEQ ID NO: 6414054 - DNA, 13 bp, Homo sapiens
tcccgctgctgct

SEQ ID NO: 6414055 - DNA, 15 bp, Homo sapiens
tcccgctgctgtgct

SEQ ID NO: 6414056 - DNA, 16 bp, Homo sapiens
tcccgctgctgtgctc

SEQ ID NO: 6414057 - DNA, 15 bp, Homo sapiens
tcccgcttagcctgc

SEQ ID NO: 6414058 - DNA, 17 bp, Homo sapiens
tcccgcttagcctgcct

SEQ ID NO: 6414059 - DNA, 22 bp, Homo sapiens
tcccgcttagcctgcctcaccc

SEQ ID NO: 6414060 - DNA, 23 bp, Homo sapiens
tcccgcttagcgctctggacaga

SEQ ID NO: 6414061 - DNA, 23 bp, Homo sapiens
tcccgcttcctccggctggacct

SEQ ID NO: 6414062 - DNA, 20 bp, Homo sapiens
tcccgcttcctggcctccct

SEQ ID NO: 6414063 - DNA, 16 bp, Homo sapiens
tcccgcttgctctcct

SEQ ID NO: 6414064 - DNA, 22 bp, Homo sapiens
tcccggagcgcacctgcttccc

SEQ ID NO: 6414065 - DNA, 18 bp, Homo sapiens
tcccggaggttgggtggg

SEQ ID NO: 6414066 - DNA, 20 bp, Homo sapiens
tcccggcaaccagatttcag

SEQ ID NO: 6414067 - DNA, 15 bp, Homo sapiens
tcccggccagctctg

SEQ ID NO: 6414068 - DNA, 18 bp, Homo sapiens
tcccggccagctctggag

SEQ ID NO: 6414069 - DNA, 19 bp, Homo sapiens
tcccggcccccggccaagg

SEQ ID NO: 6414070 - DNA, 20 bp, Homo sapiens
tcccggcccccggccaagga

SEQ ID NO: 6414071 - DNA, 16 bp, Homo sapiens
tcccggccggccctgg

SEQ ID NO: 6414072 - DNA, 13 bp, Homo sapiens
tcccggcctcttc

SEQ ID NO: 6414073 - DNA, 20 bp, Homo sapiens
tcccggcctcttccacccat

SEQ ID NO: 6414074 - DNA, 18 bp, Homo sapiens
tcccggctccagagcagg

SEQ ID NO: 6414075 - DNA, 20 bp, Homo sapiens
tcccggctccagagcaggaa

SEQ ID NO: 6414076 - DNA, 19 bp, Homo sapiens
tcccggctctgaggctgcc

SEQ ID NO: 6414077 - DNA, 13 bp, Homo sapiens
tcccggctgccct

SEQ ID NO: 6414078 - DNA, 15 bp, Homo sapiens
tcccggctgcccttt

SEQ ID NO: 6414079 - DNA, 12 bp, Homo sapiens
tcccggctgcct

SEQ ID NO: 6414080 - DNA, 14 bp, Homo sapiens
tcccggctgcctgc

SEQ ID NO: 6414081 - DNA, 21 bp, Homo sapiens
tcccggctgggtgggcctggc

SEQ ID NO: 6414082 - DNA, 16 bp, Homo sapiens
tcccggctttggtgcg

SEQ ID NO: 6414083 - DNA, 16 bp, Homo sapiens
tcccgggaagcatcct

SEQ ID NO: 6414084 - DNA, 20 bp, Homo sapiens
tcccgggaagcatcctcccc

SEQ ID NO: 6414085 - DNA, 21 bp, Homo sapiens
tcccgggactcactggcagcc

SEQ ID NO: 6414086 - DNA, 22 bp, Homo sapiens
tcccgggactcactggcagccc

SEQ ID NO: 6414087 - DNA, 13 bp, Homo sapiens
tcccgggagctgg

SEQ ID NO: 6414088 - DNA, 18 bp, Homo sapiens
tcccgggagctgggccct

SEQ ID NO: 6414089 - DNA, 21 bp, Homo sapiens
tcccgggagctgggccctgcc

SEQ ID NO: 6414090 - DNA, 22 bp, Homo sapiens
tcccgggcactgtcatgcccag

SEQ ID NO: 6414091 - DNA, 14 bp, Homo sapiens
tcccgggccacgcc

SEQ ID NO: 6414092 - DNA, 22 bp, Homo sapiens
tcccgggccacgccccagcccg

SEQ ID NO: 6414093 - DNA, 16 bp, Homo sapiens
tcccgggccagggctg

SEQ ID NO: 6414094 - DNA, 21 bp, Homo sapiens
tcccgggccagggctgcccct

SEQ ID NO: 6414095 - DNA, 17 bp, Homo sapiens
tcccgggccctcagccc

SEQ ID NO: 6414096 - DNA, 15 bp, Homo sapiens
tcccgggccctccct

SEQ ID NO: 6414097 - DNA, 17 bp, Homo sapiens
tcccgggccctcctggg

SEQ ID NO: 6414098 - DNA, 16 bp, Homo sapiens
tcccggggcagggcag

SEQ ID NO: 6414099 - DNA, 21 bp, Homo sapiens
tcccggggcagggcagccgtc

SEQ ID NO: 6414100 - DNA, 21 bp, Homo sapiens
tcccggggccagcacttccat

SEQ ID NO: 6414101 - DNA, 14 bp, Homo sapiens
tcccggggcccagg

SEQ ID NO: 6414102 - DNA, 15 bp, Homo sapiens
tcccggggcccagga

SEQ ID NO: 6414103 - DNA, 23 bp, Homo sapiens
tcccggggcccaggactctggct

SEQ ID NO: 6414104 - DNA, 13 bp, Homo sapiens
tcccggggcctgg

SEQ ID NO: 6414105 - DNA, 16 bp, Homo sapiens
tcccggggccttcctt

SEQ ID NO: 6414106 - DNA, 14 bp, Homo sapiens
tataattttgatag

SEQ ID NO: 6414107 - DNA, 15 bp, Homo sapiens
tataattttgatagt

SEQ ID NO: 6414108 - DNA, 18 bp, Homo sapiens
tataattttggttgtaat

SEQ ID NO: 6414109 - DNA, 19 bp, Homo sapiens
tataattttggttgtaatt

SEQ ID NO: 6414110 - DNA, 19 bp, Homo sapiens
tataattttgtgaagcaaa

SEQ ID NO: 6414111 - DNA, 19 bp, Homo sapiens
tataatttttaaagtatat

SEQ ID NO: 6414112 - DNA, 20 bp, Homo sapiens
tataatttttttattactga

SEQ ID NO: 6414113 - DNA, 18 bp, Homo sapiens
tataatttttttcaatat

SEQ ID NO: 6414114 - DNA, 14 bp, Homo sapiens
tatacaaaataaga

SEQ ID NO: 6414115 - DNA, 21 bp, Homo sapiens
tatacaaaataagaacgagga

SEQ ID NO: 6414116 - DNA, 20 bp, Homo sapiens
tatacaaaataatttaacta

SEQ ID NO: 6414117 - DNA, 14 bp, Homo sapiens
tatacaaagaaact

SEQ ID NO: 6414118 - DNA, 21 bp, Homo sapiens
tatacaaagacagccactttt

SEQ ID NO: 6414119 - DNA, 16 bp, Homo sapiens
tatacaaagccttggt

SEQ ID NO: 6414120 - DNA, 14 bp, Homo sapiens
tatacaaagctgtc

SEQ ID NO: 6414121 - DNA, 12 bp, Homo sapiens
tatacaaatata

SEQ ID NO: 6414122 - DNA, 22 bp, Homo sapiens
tatacaaatgggggcggctgga

SEQ ID NO: 6414123 - DNA, 16 bp, Homo sapiens
tatacaaattaaaaag

SEQ ID NO: 6414124 - DNA, 13 bp, Homo sapiens
tatacaaattaga

SEQ ID NO: 6414125 - DNA, 14 bp, Homo sapiens
tatacaaattagaa

SEQ ID NO: 6414126 - DNA, 16 bp, Homo sapiens
tatacaaattagaaaa

SEQ ID NO: 6414127 - DNA, 18 bp, Homo sapiens
tatacaaattagaaaatg

SEQ ID NO: 6414128 - DNA, 17 bp, Homo sapiens
tatacaaatttaacttt

SEQ ID NO: 6414129 - DNA, 16 bp, Homo sapiens
tatacaacaaaggcaa

SEQ ID NO: 6414130 - DNA, 18 bp, Homo sapiens
tatacaacaccaaaaaat

SEQ ID NO: 6414131 - DNA, 13 bp, Homo sapiens
tatacaacagtgc

SEQ ID NO: 6414132 - DNA, 16 bp, Homo sapiens
tatacaacagtgctaa

SEQ ID NO: 6414133 - DNA, 21 bp, Homo sapiens
tatacaacagtgctaaaaatg

SEQ ID NO: 6414134 - DNA, 19 bp, Homo sapiens
tatacaaccttcatttaaa

SEQ ID NO: 6414135 - DNA, 22 bp, Homo sapiens
tatacaacgattgtatttgtga

SEQ ID NO: 6414136 - DNA, 16 bp, Homo sapiens
tatacaactgcctggg

SEQ ID NO: 6414137 - DNA, 18 bp, Homo sapiens
tatacaactttcatttaa

SEQ ID NO: 6414138 - DNA, 21 bp, Homo sapiens
tatacaactttggaatttgaa

SEQ ID NO: 6414139 - DNA, 17 bp, Homo sapiens
tatacaagataagcttc

SEQ ID NO: 6414140 - DNA, 18 bp, Homo sapiens
tatacaagctacagttgt

SEQ ID NO: 6414141 - DNA, 21 bp, Homo sapiens
tatacaaggatcagattcttg

SEQ ID NO: 6414142 - DNA, 13 bp, Homo sapiens
tatacaaggcaag

SEQ ID NO: 6414143 - DNA, 22 bp, Homo sapiens
tatacaagtgtttctagtaaca

SEQ ID NO: 6414144 - DNA, 15 bp, Homo sapiens
tatacaataacataa

SEQ ID NO: 6414145 - DNA, 22 bp, Homo sapiens
tatacaataacccagttacttt

SEQ ID NO: 6414146 - DNA, 13 bp, Homo sapiens
tatacaataatgg

SEQ ID NO: 6414147 - DNA, 15 bp, Homo sapiens
tatacaataatgtaa

SEQ ID NO: 6414148 - DNA, 22 bp, Homo sapiens
tatacaataatgtaatttagtc

SEQ ID NO: 6414149 - DNA, 19 bp, Homo sapiens
tatacaatgagtaaaatca

SEQ ID NO: 6414150 - DNA, 23 bp, Homo sapiens
tatacaatgagtaaaatcacaga

SEQ ID NO: 6414151 - DNA, 14 bp, Homo sapiens
tatacaatgttctg

SEQ ID NO: 6414152 - DNA, 20 bp, Homo sapiens
tatacaatgttctgttgtaa

SEQ ID NO: 6414153 - DNA, 20 bp, Homo sapiens
tatacaattatgaagattta

SEQ ID NO: 6414154 - DNA, 18 bp, Homo sapiens
tatacaattcagagaata

SEQ ID NO: 6414155 - DNA, 14 bp, Homo sapiens
tatacacaacattt

SEQ ID NO: 6414156 - DNA, 19 bp, Homo sapiens
tatacacaacatttatttc

SEQ ID NO: 6414157 - DNA, 17 bp, Homo sapiens
tatacacaactttgcaa

SEQ ID NO: 6414158 - DNA, 18 bp, Homo sapiens
tatacacaactttgcaaa

SEQ ID NO: 6414159 - DNA, 21 bp, Homo sapiens
tatacacacaaaaattaacaa

SEQ ID NO: 6414160 - DNA, 11 bp, Homo sapiens
tatacacacac

SEQ ID NO: 6414161 - DNA, 15 bp, Homo sapiens
tatacacacacacac

SEQ ID NO: 6414162 - DNA, 12 bp, Homo sapiens
tatacacacagc

SEQ ID NO: 6414163 - DNA, 14 bp, Homo sapiens
tatacacacatata

SEQ ID NO: 6414164 - DNA, 22 bp, Homo sapiens
tatacacacatatacatatata

SEQ ID NO: 6414165 - DNA, 13 bp, Homo sapiens
tatacacatacat

SEQ ID NO: 6414166 - DNA, 19 bp, Homo sapiens
tatacacattagaaatatt

SEQ ID NO: 6414167 - DNA, 21 bp, Homo sapiens
tatacaccatatactgttctt

SEQ ID NO: 6414168 - DNA, 21 bp, Homo sapiens
tatacacccagttctgaataa

SEQ ID NO: 6414169 - DNA, 19 bp, Homo sapiens
tatacacggattattattt

SEQ ID NO: 6414170 - DNA, 14 bp, Homo sapiens
tatacactgtaatg

SEQ ID NO: 6414171 - DNA, 22 bp, Homo sapiens
tatacacttctggctcacagga

SEQ ID NO: 6414172 - DNA, 15 bp, Homo sapiens
tatacactttacatt

SEQ ID NO: 6414173 - DNA, 20 bp, Homo sapiens
tatacagaacagagggccag

SEQ ID NO: 6414174 - DNA, 22 bp, Homo sapiens
tatacagaattgtgtctgcagg

SEQ ID NO: 6414175 - DNA, 15 bp, Homo sapiens
tatacagagtaatta

SEQ ID NO: 6414176 - DNA, 18 bp, Homo sapiens
tatacagatgaaaatttg

SEQ ID NO: 6414177 - DNA, 21 bp, Homo sapiens
tatacagatgaaaatttgaga

SEQ ID NO: 6414178 - DNA, 12 bp, Homo sapiens
tatacagatttt

SEQ ID NO: 6414179 - DNA, 17 bp, Homo sapiens
tatacagattttctaga

SEQ ID NO: 6414180 - DNA, 17 bp, Homo sapiens
tatacagcatgagattg

SEQ ID NO: 6414181 - DNA, 18 bp, Homo sapiens
tatacaggcataaaatag

SEQ ID NO: 6414182 - DNA, 15 bp, Homo sapiens
tatacaggggaatat

SEQ ID NO: 6414183 - DNA, 23 bp, Homo sapiens
tatacaggggaatattttattca

SEQ ID NO: 6414184 - DNA, 16 bp, Homo sapiens
tatacaggtcatatta

SEQ ID NO: 6414185 - DNA, 20 bp, Homo sapiens
tatacaggtggtttttggtt

SEQ ID NO: 6414186 - DNA, 21 bp, Homo sapiens
tatacagtaactttatgtgta

SEQ ID NO: 6414187 - DNA, 20 bp, Homo sapiens
tatacagtagcttgaaattg

SEQ ID NO: 6414188 - DNA, 14 bp, Homo sapiens
tatacagtgatata

SEQ ID NO: 6414189 - DNA, 12 bp, Homo sapiens
tatacagtgcct

SEQ ID NO: 6414190 - DNA, 19 bp, Homo sapiens
tatacagttgaaaacttgt

SEQ ID NO: 6414191 - DNA, 18 bp, Homo sapiens
tatacagtttgacttttt

SEQ ID NO: 6414192 - DNA, 19 bp, Homo sapiens
tatacagttttaaagaatc

SEQ ID NO: 6414193 - DNA, 14 bp, Homo sapiens
tatacataaacaag

SEQ ID NO: 6414194 - DNA, 18 bp, Homo sapiens
tatacataaacagttttg

SEQ ID NO: 6414195 - DNA, 19 bp, Homo sapiens
tatacatacacttgtataa

SEQ ID NO: 6414196 - DNA, 18 bp, Homo sapiens
tatacatacatgtatctg

SEQ ID NO: 6414197 - DNA, 14 bp, Homo sapiens
tatacatacctctc

SEQ ID NO: 6414198 - DNA, 18 bp, Homo sapiens
tatacatacctctctcta

SEQ ID NO: 6414199 - DNA, 20 bp, Homo sapiens
tatacatacgcaattgtata

SEQ ID NO: 6414200 - DNA, 21 bp, Homo sapiens
tatacatactatgaaatatgt

SEQ ID NO: 6414201 - DNA, 16 bp, Homo sapiens
tatacatagcatgaca

SEQ ID NO: 6414202 - DNA, 22 bp, Homo sapiens
tatacatagcatgacatttctt

SEQ ID NO: 6414203 - DNA, 19 bp, Homo sapiens
tatacatagtcacaaaaat

SEQ ID NO: 6414204 - DNA, 18 bp, Homo sapiens
tatacatatacacaaaga

SEQ ID NO: 6414205 - DNA, 12 bp, Homo sapiens
tatacatatata

SEQ ID NO: 6414206 - DNA, 14 bp, Homo sapiens
tatacatatatata

SEQ ID NO: 6414207 - DNA, 19 bp, Homo sapiens
tatacatatatatatataa

SEQ ID NO: 6414208 - DNA, 14 bp, Homo sapiens
tatacatatcagaa

SEQ ID NO: 6414209 - DNA, 16 bp, Homo sapiens
tatacatatcagaaaa

SEQ ID NO: 6414210 - DNA, 21 bp, Homo sapiens
tatacatatgagaatatacct

SEQ ID NO: 6414211 - DNA, 16 bp, Homo sapiens
tatacatatgatcaaa

SEQ ID NO: 6414212 - DNA, 17 bp, Homo sapiens
tatacatatgatcaaat

SEQ ID NO: 6414213 - DNA, 21 bp, Homo sapiens
tatacatatgatcaaatactc

SEQ ID NO: 6414214 - DNA, 13 bp, Homo sapiens
tatacatatgtag

SEQ ID NO: 6414215 - DNA, 16 bp, Homo sapiens
tatacatatgtagact

SEQ ID NO: 6414216 - DNA, 16 bp, Homo sapiens
tatacatattataaat

SEQ ID NO: 6414217 - DNA, 22 bp, Homo sapiens
tatacatattataaataaatgc

SEQ ID NO: 6414218 - DNA, 16 bp, Homo sapiens
tatacatcaatatgta

SEQ ID NO: 6414219 - DNA, 19 bp, Homo sapiens
tatacatcaatttaaaaag

SEQ ID NO: 6414220 - DNA, 13 bp, Homo sapiens
tatacatcacttc

SEQ ID NO: 6414221 - DNA, 21 bp, Homo sapiens
tatacatcctgggtaatgaga

SEQ ID NO: 6414222 - DNA, 12 bp, Homo sapiens
tatacatctagc

SEQ ID NO: 6414223 - DNA, 17 bp, Homo sapiens
tatacatctagcacagc

SEQ ID NO: 6414224 - DNA, 18 bp, Homo sapiens
tatacatctgtgtatttg

SEQ ID NO: 6414225 - DNA, 22 bp, Homo sapiens
tatacatgaagaatagaaacaa

SEQ ID NO: 6414226 - DNA, 17 bp, Homo sapiens
tatacatgacactgaaa

SEQ ID NO: 6414227 - DNA, 22 bp, Homo sapiens
tatacatgacactgaaatgcct

SEQ ID NO: 6414228 - DNA, 14 bp, Homo sapiens
tatacatggaatcg

SEQ ID NO: 6414229 - DNA, 16 bp, Homo sapiens
tatacatgtatagtga

SEQ ID NO: 6414230 - DNA, 18 bp, Homo sapiens
tatacatgtgtacatata

SEQ ID NO: 6414231 - DNA, 22 bp, Homo sapiens
tatacatgtgtacatatatgta

SEQ ID NO: 6414232 - DNA, 13 bp, Homo sapiens
tatacatgtgtgt

SEQ ID NO: 6414233 - DNA, 15 bp, Homo sapiens
tatacatgtgtgtat

SEQ ID NO: 6414234 - DNA, 19 bp, Homo sapiens
tatacatgtgtgtatatat

SEQ ID NO: 6414235 - DNA, 11 bp, Homo sapiens
tatacatgttg

SEQ ID NO: 6414236 - DNA, 16 bp, Homo sapiens
tatacatgtttatgta

SEQ ID NO: 6414237 - DNA, 23 bp, Homo sapiens
tatacatgtttgcagtgttaaga

SEQ ID NO: 6414238 - DNA, 17 bp, Homo sapiens
tatacatgtttttctat

SEQ ID NO: 6414239 - DNA, 15 bp, Homo sapiens
tatacattagacaca

SEQ ID NO: 6414240 - DNA, 17 bp, Homo sapiens
tatacattagacacaca

SEQ ID NO: 6414241 - DNA, 19 bp, Homo sapiens
tatacattagacacacata

SEQ ID NO: 6414242 - DNA, 23 bp, Homo sapiens
tatacattagacacacatataca

SEQ ID NO: 6414243 - DNA, 16 bp, Homo sapiens
tatacattatttctgt

SEQ ID NO: 6414244 - DNA, 17 bp, Homo sapiens
tatacattatttctgta

SEQ ID NO: 6414245 - DNA, 21 bp, Homo sapiens
tatacattatttctgtatata

SEQ ID NO: 6414246 - DNA, 11 bp, Homo sapiens
tatacattcct

SEQ ID NO: 6414247 - DNA, 17 bp, Homo sapiens
tatacattgaattcatt

SEQ ID NO: 6414248 - DNA, 12 bp, Homo sapiens
tatacattgctt

SEQ ID NO: 6414249 - DNA, 14 bp, Homo sapiens
tatacattgtgtga

SEQ ID NO: 6414250 - DNA, 15 bp, Homo sapiens
tatacattgtgtgaa

SEQ ID NO: 6414251 - DNA, 18 bp, Homo sapiens
tatacattgtgtgaaaaa

SEQ ID NO: 6414252 - DNA, 21 bp, Homo sapiens
tatacatttcataaggcctgc

SEQ ID NO: 6414253 - DNA, 14 bp, Homo sapiens
tatacatttgataa

SEQ ID NO: 6414254 - DNA, 19 bp, Homo sapiens
tatacattttataatgatg

SEQ ID NO: 6414255 - DNA, 22 bp, Homo sapiens
tatacattttgttatagaatac

SEQ ID NO: 6414256 - DNA, 22 bp, Homo sapiens
tataccaaaaacaagtctataa

SEQ ID NO: 6414257 - DNA, 15 bp, Homo sapiens
tataccaaaatgttg

SEQ ID NO: 6414258 - DNA, 13 bp, Homo sapiens
tataccaataaag

SEQ ID NO: 6414259 - DNA, 18 bp, Homo sapiens
tataccacattttcttta

SEQ ID NO: 6414260 - DNA, 13 bp, Homo sapiens
tataccagagaag

SEQ ID NO: 6414261 - DNA, 16 bp, Homo sapiens
tataccagagaaggta

SEQ ID NO: 6414262 - DNA, 13 bp, Homo sapiens
tataccagagacc

SEQ ID NO: 6414263 - DNA, 19 bp, Homo sapiens
tataccagagacctgaggc

SEQ ID NO: 6414264 - DNA, 17 bp, Homo sapiens
tataccagcaatatatc

SEQ ID NO: 6414265 - DNA, 13 bp, Homo sapiens
tataccatgagat

SEQ ID NO: 6414266 - DNA, 21 bp, Homo sapiens
tataccatgtgtgctaatata

SEQ ID NO: 6414267 - DNA, 17 bp, Homo sapiens
tataccatttccgtaat

SEQ ID NO: 6414268 - DNA, 14 bp, Homo sapiens
tataccatttcctc

SEQ ID NO: 6414269 - DNA, 14 bp, Homo sapiens
tatacccaaaggaa

SEQ ID NO: 6414270 - DNA, 15 bp, Homo sapiens
tatacccacccagaa

SEQ ID NO: 6414271 - DNA, 23 bp, Homo sapiens
tatacccatgaacttaaaatgaa

SEQ ID NO: 6414272 - DNA, 23 bp, Homo sapiens
tataccccaaattgtgtatatat

SEQ ID NO: 6414273 - DNA, 22 bp, Homo sapiens
tataccccgtgaagcatccagg

SEQ ID NO: 6414274 - DNA, 22 bp, Homo sapiens
tataccccttacttagcatgca

SEQ ID NO: 6414275 - DNA, 19 bp, Homo sapiens
tatacccgtacaacgtgtc

SEQ ID NO: 6414276 - DNA, 18 bp, Homo sapiens
tataccgagacccaccat

SEQ ID NO: 6414277 - DNA, 18 bp, Homo sapiens
tataccgtgccactttcc

SEQ ID NO: 6414278 - DNA, 15 bp, Homo sapiens
tatacctcaaactat

SEQ ID NO: 6414279 - DNA, 21 bp, Homo sapiens
tatacctcaattttcactgtg

SEQ ID NO: 6414280 - DNA, 12 bp, Homo sapiens
tatacctctaac

SEQ ID NO: 6414281 - DNA, 15 bp, Homo sapiens
tatacctcttgaaga

SEQ ID NO: 6414282 - DNA, 12 bp, Homo sapiens
tatacctgattt

SEQ ID NO: 6414283 - DNA, 14 bp, Homo sapiens
tatacctggctttt

SEQ ID NO: 6414284 - DNA, 13 bp, Homo sapiens
tatacctggttta

SEQ ID NO: 6414285 - DNA, 22 bp, Homo sapiens
tcccggggtgcccgtgtggcct

SEQ ID NO: 6414286 - DNA, 15 bp, Homo sapiens
tcccgggtccttggc

SEQ ID NO: 6414287 - DNA, 22 bp, Homo sapiens
tcccgggttcacgccattctcc

SEQ ID NO: 6414288 - DNA, 21 bp, Homo sapiens
tcccgggtttggctgagcctg

SEQ ID NO: 6414289 - DNA, 16 bp, Homo sapiens
tcccggtcctctgcat

SEQ ID NO: 6414290 - DNA, 18 bp, Homo sapiens
tcccggtgacacatccat

SEQ ID NO: 6414291 - DNA, 22 bp, Homo sapiens
tcccggtggtgggatccacgct

SEQ ID NO: 6414292 - DNA, 17 bp, Homo sapiens
tcccggtgtatgcagtg

SEQ ID NO: 6414293 - DNA, 19 bp, Homo sapiens
tcccggttcagacccctgc

SEQ ID NO: 6414294 - DNA, 21 bp, Homo sapiens
tcccggttcagacccctgcct

SEQ ID NO: 6414295 - DNA, 23 bp, Homo sapiens
tcccggttccctccccagctcct

SEQ ID NO: 6414296 - DNA, 16 bp, Homo sapiens
tcccggttcttccagt

SEQ ID NO: 6414297 - DNA, 15 bp, Homo sapiens
tcccgtaaggctgta

SEQ ID NO: 6414298 - DNA, 15 bp, Homo sapiens
tcccgtatcacagtg

SEQ ID NO: 6414299 - DNA, 23 bp, Homo sapiens
tcccgtcagggcccaagtccctg

SEQ ID NO: 6414300 - DNA, 13 bp, Homo sapiens
tcccgtccctccc

SEQ ID NO: 6414301 - DNA, 18 bp, Homo sapiens
tcccgtccgtccgcccgc

SEQ ID NO: 6414302 - DNA, 15 bp, Homo sapiens
tcccgtctcgcctgc

SEQ ID NO: 6414303 - DNA, 14 bp, Homo sapiens
tcccgtcttcctcc

SEQ ID NO: 6414304 - DNA, 22 bp, Homo sapiens
tcccgtgcaaaacatgctacct

SEQ ID NO: 6414305 - DNA, 18 bp, Homo sapiens
tcccgtgcccctttcctt

SEQ ID NO: 6414306 - DNA, 16 bp, Homo sapiens
tcccgtgcctgggaga

SEQ ID NO: 6414307 - DNA, 15 bp, Homo sapiens
tcccgtgctggaaga

SEQ ID NO: 6414308 - DNA, 16 bp, Homo sapiens
tcccgtggaacgtttt

SEQ ID NO: 6414309 - DNA, 12 bp, Homo sapiens
tcccgtggcccc

SEQ ID NO: 6414310 - DNA, 20 bp, Homo sapiens
tcccgtggccccagcctggc

SEQ ID NO: 6414311 - DNA, 24 bp, Homo sapiens
tcccgtggccccagcctggcccag

SEQ ID NO: 6414312 - DNA, 19 bp, Homo sapiens
tcccgtggctttgtgctta

SEQ ID NO: 6414313 - DNA, 21 bp, Homo sapiens
tcccgtgtcgtaacagcagga

SEQ ID NO: 6414314 - DNA, 17 bp, Homo sapiens
tcccgtgtgcctgagcg

SEQ ID NO: 6414315 - DNA, 14 bp, Homo sapiens
tcccgtgtgtattt

SEQ ID NO: 6414316 - DNA, 18 bp, Homo sapiens
tcccgtgtgtggttggaa

SEQ ID NO: 6414317 - DNA, 15 bp, Homo sapiens
tcccgtgttctcctt

SEQ ID NO: 6414318 - DNA, 14 bp, Homo sapiens
tcccgtgttgcttc

SEQ ID NO: 6414319 - DNA, 14 bp, Homo sapiens
tcccgttgcagagg

SEQ ID NO: 6414320 - DNA, 15 bp, Homo sapiens
tcccgtttccctcca

SEQ ID NO: 6414321 - DNA, 16 bp, Homo sapiens
tcccgtttccctccag

SEQ ID NO: 6414322 - DNA, 15 bp, Homo sapiens
tccctaaaataaaaa

SEQ ID NO: 6414323 - DNA, 19 bp, Homo sapiens
tccctaaaataaaaaccag

SEQ ID NO: 6414324 - DNA, 23 bp, Homo sapiens
tccctaaaatggcgaacatgtgt

SEQ ID NO: 6414325 - DNA, 13 bp, Homo sapiens
tccctaaaatgta

SEQ ID NO: 6414326 - DNA, 21 bp, Homo sapiens
tccctaaaatgtagaaattct

SEQ ID NO: 6414327 - DNA, 22 bp, Homo sapiens
tccctaaaatgtagaaattcta

SEQ ID NO: 6414328 - DNA, 15 bp, Homo sapiens
tccctaaacatagtg

SEQ ID NO: 6414329 - DNA, 22 bp, Homo sapiens
tccctaaacatagtggtatttt

SEQ ID NO: 6414330 - DNA, 15 bp, Homo sapiens
tccctaaactgcagc

SEQ ID NO: 6414331 - DNA, 18 bp, Homo sapiens
tccctaaagaaaaaaaat

SEQ ID NO: 6414332 - DNA, 14 bp, Homo sapiens
tccctaaagacaag

SEQ ID NO: 6414333 - DNA, 16 bp, Homo sapiens
tccctaaagccctctt

SEQ ID NO: 6414334 - DNA, 17 bp, Homo sapiens
tccctaacatcatgcat

SEQ ID NO: 6414335 - DNA, 18 bp, Homo sapiens
tccctaaccctacaaaga

SEQ ID NO: 6414336 - DNA, 15 bp, Homo sapiens
tccctaagaattccc

SEQ ID NO: 6414337 - DNA, 11 bp, Homo sapiens
tccctaagcca

SEQ ID NO: 6414338 - DNA, 17 bp, Homo sapiens
tccctaagccagcctgg

SEQ ID NO: 6414339 - DNA, 15 bp, Homo sapiens
tccctaaggaatctg

SEQ ID NO: 6414340 - DNA, 11 bp, Homo sapiens
tccctaataaa

SEQ ID NO: 6414341 - DNA, 14 bp, Homo sapiens
tccctaataaagct

SEQ ID NO: 6414342 - DNA, 15 bp, Homo sapiens
tccctaataaagctg

SEQ ID NO: 6414343 - DNA, 22 bp, Homo sapiens
tccctaatagctttttaaaaaa

SEQ ID NO: 6414344 - DNA, 23 bp, Homo sapiens
tccctaatggtattgggcagttg

SEQ ID NO: 6414345 - DNA, 18 bp, Homo sapiens
tccctaatgtgtttcttt

SEQ ID NO: 6414346 - DNA, 19 bp, Homo sapiens
tccctaattctcttcgctg

SEQ ID NO: 6414347 - DNA, 20 bp, Homo sapiens
tccctaattctgccttaaat

SEQ ID NO: 6414348 - DNA, 20 bp, Homo sapiens
tccctaatttatcttcatgt

SEQ ID NO: 6414349 - DNA, 18 bp, Homo sapiens
tccctaatttatgtgcta

SEQ ID NO: 6414350 - DNA, 16 bp, Homo sapiens
tccctacacacacaca

SEQ ID NO: 6414351 - DNA, 13 bp, Homo sapiens
tccctacactgat

SEQ ID NO: 6414352 - DNA, 15 bp, Homo sapiens
tccctacagcctagg

SEQ ID NO: 6414353 - DNA, 16 bp, Homo sapiens
tccctacattaaacat

SEQ ID NO: 6414354 - DNA, 18 bp, Homo sapiens
tccctacattccccagag

SEQ ID NO: 6414355 - DNA, 20 bp, Homo sapiens
tccctacattccccagagtg

SEQ ID NO: 6414356 - DNA, 13 bp, Homo sapiens
tccctaccacctc

SEQ ID NO: 6414357 - DNA, 24 bp, Homo sapiens
tccctaccactgagcccttgcaca

SEQ ID NO: 6414358 - DNA, 14 bp, Homo sapiens
tccctaccactgtg

SEQ ID NO: 6414359 - DNA, 22 bp, Homo sapiens
tccctacccaatgtctcccaca

SEQ ID NO: 6414360 - DNA, 19 bp, Homo sapiens
tccctacccacagggcctg

SEQ ID NO: 6414361 - DNA, 12 bp, Homo sapiens
tccctacccact

SEQ ID NO: 6414362 - DNA, 21 bp, Homo sapiens
tccctaccccagggccctggc

SEQ ID NO: 6414363 - DNA, 16 bp, Homo sapiens
tccctaccccatttgt

SEQ ID NO: 6414364 - DNA, 19 bp, Homo sapiens
tccctaccctcttctcagc

SEQ ID NO: 6414365 - DNA, 14 bp, Homo sapiens
tccctaccctgcaa

SEQ ID NO: 6414366 - DNA, 16 bp, Homo sapiens
tccctacccttcctgc

SEQ ID NO: 6414367 - DNA, 22 bp, Homo sapiens
tccctacccttcctgccaagcc

SEQ ID NO: 6414368 - DNA, 23 bp, Homo sapiens
tccctaccgagtctcttctccac

SEQ ID NO: 6414369 - DNA, 11 bp, Homo sapiens
tccctacctca

SEQ ID NO: 6414370 - DNA, 14 bp, Homo sapiens
tccctacctccctc

SEQ ID NO: 6414371 - DNA, 17 bp, Homo sapiens
tccctacctccctcctc

SEQ ID NO: 6414372 - DNA, 20 bp, Homo sapiens
tccctacctccctcctcagg

SEQ ID NO: 6414373 - DNA, 14 bp, Homo sapiens
tccctacctgcttc

SEQ ID NO: 6414374 - DNA, 15 bp, Homo sapiens
tccctaccttgcctc

SEQ ID NO: 6414375 - DNA, 18 bp, Homo sapiens
tccctaccttgcctcctt

SEQ ID NO: 6414376 - DNA, 20 bp, Homo sapiens
tccctaccttgcctcctttt

SEQ ID NO: 6414377 - DNA, 20 bp, Homo sapiens
tccctactaacatcccaata

SEQ ID NO: 6414378 - DNA, 18 bp, Homo sapiens
tccctactgaagcccttg

SEQ ID NO: 6414379 - DNA, 20 bp, Homo sapiens
tccctacttagacccagtca

SEQ ID NO: 6414380 - DNA, 14 bp, Homo sapiens
tccctactttctct

SEQ ID NO: 6414381 - DNA, 15 bp, Homo sapiens
tccctacttttcaag

SEQ ID NO: 6414382 - DNA, 22 bp, Homo sapiens
tccctagaaaacaatgcaaaac

SEQ ID NO: 6414383 - DNA, 22 bp, Homo sapiens
tccctagaagagcacagagccc

SEQ ID NO: 6414384 - DNA, 14 bp, Homo sapiens
tccctagactctgt

SEQ ID NO: 6414385 - DNA, 13 bp, Homo sapiens
tccctagactgca

SEQ ID NO: 6414386 - DNA, 15 bp, Homo sapiens
tccctagagagaata

SEQ ID NO: 6414387 - DNA, 19 bp, Homo sapiens
tccctagaggcaaacattt

SEQ ID NO: 6414388 - DNA, 17 bp, Homo sapiens
tccctagcagcccaccc

SEQ ID NO: 6414389 - DNA, 24 bp, Homo sapiens
tccctagcaggaacttctagctca

SEQ ID NO: 6414390 - DNA, 13 bp, Homo sapiens
tccctagcagtga

SEQ ID NO: 6414391 - DNA, 15 bp, Homo sapiens
tccctagcagtgaac

SEQ ID NO: 6414392 - DNA, 16 bp, Homo sapiens
tccctagcagtgaact

SEQ ID NO: 6414393 - DNA, 11 bp, Homo sapiens
tccctagccca

SEQ ID NO: 6414394 - DNA, 15 bp, Homo sapiens
tccctagcccttcca

SEQ ID NO: 6414395 - DNA, 16 bp, Homo sapiens
tccctagcccttccag

SEQ ID NO: 6414396 - DNA, 22 bp, Homo sapiens
tccctagcccttccagcctggg

SEQ ID NO: 6414397 - DNA, 23 bp, Homo sapiens
tccctagcccttccagcctggga

SEQ ID NO: 6414398 - DNA, 22 bp, Homo sapiens
tccctagctcacactcatccac

SEQ ID NO: 6414399 - DNA, 15 bp, Homo sapiens
tccctagctcttccc

SEQ ID NO: 6414400 - DNA, 20 bp, Homo sapiens
tccctagctgaggatgacag

SEQ ID NO: 6414401 - DNA, 18 bp, Homo sapiens
tccctagctgtgacctct

SEQ ID NO: 6414402 - DNA, 22 bp, Homo sapiens
tccctagctttagaccctgggt

SEQ ID NO: 6414403 - DNA, 17 bp, Homo sapiens
tccctaggagagtttac

SEQ ID NO: 6414404 - DNA, 20 bp, Homo sapiens
tccctaggagagtttactga

SEQ ID NO: 6414405 - DNA, 17 bp, Homo sapiens
tccctaggagggaagga

SEQ ID NO: 6414406 - DNA, 21 bp, Homo sapiens
tccctaggatcccgtcttcca

SEQ ID NO: 6414407 - DNA, 23 bp, Homo sapiens
tccctaggcctgagttagctgtt

SEQ ID NO: 6414408 - DNA, 20 bp, Homo sapiens
tccctagggctctccaagca

SEQ ID NO: 6414409 - DNA, 14 bp, Homo sapiens
tccctagggctggg

SEQ ID NO: 6414410 - DNA, 15 bp, Homo sapiens
tccctagggctgggt

SEQ ID NO: 6414411 - DNA, 15 bp, Homo sapiens
tccctagtagctggg

SEQ ID NO: 6414412 - DNA, 17 bp, Homo sapiens
tccctagtctattcatt

SEQ ID NO: 6414413 - DNA, 22 bp, Homo sapiens
tccctagtctattcattatatt

SEQ ID NO: 6414414 - DNA, 18 bp, Homo sapiens
tccctagtcttcaagcag

SEQ ID NO: 6414415 - DNA, 20 bp, Homo sapiens
tccctagtgacccggaggcc

SEQ ID NO: 6414416 - DNA, 18 bp, Homo sapiens
tccctagttacccaccct

SEQ ID NO: 6414417 - DNA, 17 bp, Homo sapiens
tccctagttagcatcca

SEQ ID NO: 6414418 - DNA, 21 bp, Homo sapiens
tccctagttagcatccaggct

SEQ ID NO: 6414419 - DNA, 20 bp, Homo sapiens
tccctataataaaggctgag

SEQ ID NO: 6414420 - DNA, 22 bp, Homo sapiens
tccctatacactagacaaaact

SEQ ID NO: 6414421 - DNA, 15 bp, Homo sapiens
tccctataccgagac

SEQ ID NO: 6414422 - DNA, 20 bp, Homo sapiens
tccctataccgagacccacc

SEQ ID NO: 6414423 - DNA, 15 bp, Homo sapiens
tccctatactgcttg

SEQ ID NO: 6414424 - DNA, 21 bp, Homo sapiens
tccctataggaacagcccagc

SEQ ID NO: 6414425 - DNA, 16 bp, Homo sapiens
tccctatatcagggcc

SEQ ID NO: 6414426 - DNA, 15 bp, Homo sapiens
tccctatcaaaacat

SEQ ID NO: 6414427 - DNA, 17 bp, Homo sapiens
tccctatcaaaacatat

SEQ ID NO: 6414428 - DNA, 16 bp, Homo sapiens
tccctatcaagcacta

SEQ ID NO: 6414429 - DNA, 20 bp, Homo sapiens
tccctatcactgaagctttt

SEQ ID NO: 6414430 - DNA, 23 bp, Homo sapiens
tccctatctccttcccaccccta

SEQ ID NO: 6414431 - DNA, 16 bp, Homo sapiens
tccctatcttgtgaag

SEQ ID NO: 6414432 - DNA, 18 bp, Homo sapiens
tccctatggagaggcttc

SEQ ID NO: 6414433 - DNA, 16 bp, Homo sapiens
tccctatgtcccagcc

SEQ ID NO: 6414434 - DNA, 18 bp, Homo sapiens
tccctattagagaagaga

SEQ ID NO: 6414435 - DNA, 22 bp, Homo sapiens
tccctattctgccatgggagag

SEQ ID NO: 6414436 - DNA, 23 bp, Homo sapiens
tccctatttgtgaattctgggat

SEQ ID NO: 6414437 - DNA, 22 bp, Homo sapiens
tccctattttttttctgttata

SEQ ID NO: 6414438 - DNA, 13 bp, Homo sapiens
tccctcaaatgac

SEQ ID NO: 6414439 - DNA, 20 bp, Homo sapiens
tccctcaaatgacccaaaga

SEQ ID NO: 6414440 - DNA, 22 bp, Homo sapiens
tccctcaacaaggtatacctca

SEQ ID NO: 6414441 - DNA, 19 bp, Homo sapiens
tccctcaacctcatcctct

SEQ ID NO: 6414442 - DNA, 18 bp, Homo sapiens
tccctcaactgaaggggt

SEQ ID NO: 6414443 - DNA, 23 bp, Homo sapiens
tccctcaactgagggccagggac

SEQ ID NO: 6414444 - DNA, 13 bp, Homo sapiens
tccctcaattaca

SEQ ID NO: 6414445 - DNA, 16 bp, Homo sapiens
tccctcaattccccct

SEQ ID NO: 6414446 - DNA, 21 bp, Homo sapiens
tccctcacaagcgctcccagc

SEQ ID NO: 6414447 - DNA, 13 bp, Homo sapiens
tccctcacaagtg

SEQ ID NO: 6414448 - DNA, 18 bp, Homo sapiens
tccctcacacctcccttc

SEQ ID NO: 6414449 - DNA, 22 bp, Homo sapiens
tccctcacccactttggcctcc

SEQ ID NO: 6414450 - DNA, 14 bp, Homo sapiens
tccctcacccatcc

SEQ ID NO: 6414451 - DNA, 18 bp, Homo sapiens
tccctcacccatcctaga

SEQ ID NO: 6414452 - DNA, 13 bp, Homo sapiens
tccctcacctgta

SEQ ID NO: 6414453 - DNA, 18 bp, Homo sapiens
tccctcactcgtctcccc

SEQ ID NO: 6414454 - DNA, 21 bp, Homo sapiens
tccctcactcgtctcccccaa

SEQ ID NO: 6414455 - DNA, 15 bp, Homo sapiens
tccctcactctcagg

SEQ ID NO: 6414456 - DNA, 17 bp, Homo sapiens
tccctcactctcaggaa

SEQ ID NO: 6414457 - DNA, 17 bp, Homo sapiens
tccctcactcttcctca

SEQ ID NO: 6414458 - DNA, 20 bp, Homo sapiens
tccctcactgaaggacctga

SEQ ID NO: 6414459 - DNA, 14 bp, Homo sapiens
tccctcactgcctt

SEQ ID NO: 6414460 - DNA, 14 bp, Homo sapiens
tccctcagacccag

SEQ ID NO: 6414461 - DNA, 17 bp, Homo sapiens
tccctcagacccaggag

SEQ ID NO: 6414462 - DNA, 19 bp, Homo sapiens
tccctcagacccaggagtc

SEQ ID NO: 6414463 - DNA, 19 bp, Homo sapiens
tccctcagactcagaggtc

SEQ ID NO: 6414464 - DNA, 22 bp, Homo sapiens
tccctcagactcagaggtccag

SEQ ID NO: 6414465 - DNA, 12 bp, Homo sapiens
tccctcagactg

SEQ ID NO: 6414466 - DNA, 11 bp, Homo sapiens
tccctcagaga

SEQ ID NO: 6414467 - DNA, 21 bp, Homo sapiens
tccctcagatcccagttcctt

SEQ ID NO: 6414468 - DNA, 14 bp, Homo sapiens
tccctcagccccca

SEQ ID NO: 6414469 - DNA, 15 bp, Homo sapiens
tccctcagcccctct

SEQ ID NO: 6414470 - DNA, 17 bp, Homo sapiens
tccctcagcccctcttg

SEQ ID NO: 6414471 - DNA, 14 bp, Homo sapiens
tccctcagccctca

SEQ ID NO: 6414472 - DNA, 16 bp, Homo sapiens
tccctcagcctcccct

SEQ ID NO: 6414473 - DNA, 18 bp, Homo sapiens
tccctcagctctctggga

SEQ ID NO: 6414474 - DNA, 14 bp, Homo sapiens
tccctcaggcccag

SEQ ID NO: 6414475 - DNA, 16 bp, Homo sapiens
tccctcaggcccagga

SEQ ID NO: 6414476 - DNA, 19 bp, Homo sapiens
tccctcaggcccaggagtc

SEQ ID NO: 6414477 - DNA, 21 bp, Homo sapiens
tccctcaggcccaggagtcca

SEQ ID NO: 6414478 - DNA, 16 bp, Homo sapiens
tccctcaggcctatgc

SEQ ID NO: 6414479 - DNA, 19 bp, Homo sapiens
tccctcagggagcgatcca

SEQ ID NO: 6414480 - DNA, 18 bp, Homo sapiens
tccctcaggggcaggtgg

SEQ ID NO: 6414481 - DNA, 20 bp, Homo sapiens
tccctcaggttcctttttca

SEQ ID NO: 6414482 - DNA, 22 bp, Homo sapiens
tccctcaggttctattttctta

SEQ ID NO: 6414483 - DNA, 14 bp, Homo sapiens
tccctcagtctgag

SEQ ID NO: 6414484 - DNA, 14 bp, Homo sapiens
tccctcatcctttc

SEQ ID NO: 6414485 - DNA, 13 bp, Homo sapiens
tccctcatctctc

SEQ ID NO: 6414486 - DNA, 16 bp, Homo sapiens
tccctcatctgtccct

SEQ ID NO: 6414487 - DNA, 19 bp, Homo sapiens
tccctcattcatcttgcaa

SEQ ID NO: 6414488 - DNA, 23 bp, Homo sapiens
tccctcattccaccttcccatgc

SEQ ID NO: 6414489 - DNA, 23 bp, Homo sapiens
tccctcatttcattatttttcaa

SEQ ID NO: 6414490 - DNA, 20 bp, Homo sapiens
tccctccaagaggctggaaa

SEQ ID NO: 6414491 - DNA, 15 bp, Homo sapiens
tccctccaagcctgg

SEQ ID NO: 6414492 - DNA, 18 bp, Homo sapiens
tccctccaagcctggcac

SEQ ID NO: 6414493 - DNA, 23 bp, Homo sapiens
tccctccaagcctggcacccacc

SEQ ID NO: 6414494 - DNA, 13 bp, Homo sapiens
tccctccaaggtc

SEQ ID NO: 6414495 - DNA, 17 bp, Homo sapiens
tccctccaattccccct

SEQ ID NO: 6414496 - DNA, 18 bp, Homo sapiens
tccctccaattccccctt

SEQ ID NO: 6414497 - DNA, 14 bp, Homo sapiens
tccctccaccagcc

SEQ ID NO: 6414498 - DNA, 15 bp, Homo sapiens
tccctccaccagcct

SEQ ID NO: 6414499 - DNA, 17 bp, Homo sapiens
tccctccaccagcctgc

SEQ ID NO: 6414500 - DNA, 18 bp, Homo sapiens
tccctccaccagcctgct

SEQ ID NO: 6414501 - DNA, 19 bp, Homo sapiens
tccctccaccagcctgctg

SEQ ID NO: 6414502 - DNA, 22 bp, Homo sapiens
tccctccaccagcctgctgaca

SEQ ID NO: 6414503 - DNA, 11 bp, Homo sapiens
tccctccaccc

SEQ ID NO: 6414504 - DNA, 13 bp, Homo sapiens
tccctccacccca

SEQ ID NO: 6414505 - DNA, 21 bp, Homo sapiens
tccctccaccccacagaacct

SEQ ID NO: 6414506 - DNA, 15 bp, Homo sapiens
tccctccaccccagg

SEQ ID NO: 6414507 - DNA, 20 bp, Homo sapiens
tccctccaccccagtccccg

SEQ ID NO: 6414508 - DNA, 16 bp, Homo sapiens
tccctccacccccatg

SEQ ID NO: 6414509 - DNA, 19 bp, Homo sapiens
tccctccacctccctgcaa

SEQ ID NO: 6414510 - DNA, 23 bp, Homo sapiens
tccctccacctccctgcaataaa

SEQ ID NO: 6414511 - DNA, 22 bp, Homo sapiens
tccctccacgcttagggtctgt

SEQ ID NO: 6414512 - DNA, 19 bp, Homo sapiens
tccctccacgttcacccct

SEQ ID NO: 6414513 - DNA, 17 bp, Homo sapiens
tccctccactccatccc

SEQ ID NO: 6414514 - DNA, 16 bp, Homo sapiens
tccctccactcctctc

SEQ ID NO: 6414515 - DNA, 21 bp, Homo sapiens
tccctccagcaaagctcccgc

SEQ ID NO: 6414516 - DNA, 13 bp, Homo sapiens
tccctccagcaca

SEQ ID NO: 6414517 - DNA, 13 bp, Homo sapiens
tccctccagctgc

SEQ ID NO: 6414518 - DNA, 16 bp, Homo sapiens
tccctccagctgcgac

SEQ ID NO: 6414519 - DNA, 14 bp, Homo sapiens
tccctccagctgga

SEQ ID NO: 6414520 - DNA, 15 bp, Homo sapiens
tccctccaggcccat

SEQ ID NO: 6414521 - DNA, 22 bp, Homo sapiens
tccctccagggaatccgcctgc

SEQ ID NO: 6414522 - DNA, 13 bp, Homo sapiens
tccctccatacct

SEQ ID NO: 6414523 - DNA, 19 bp, Homo sapiens
tccctccatccggctcctg

SEQ ID NO: 6414524 - DNA, 18 bp, Homo sapiens
tccctccatggcaggaag

SEQ ID NO: 6414525 - DNA, 21 bp, Homo sapiens
tccctcccaacagagctgggc

SEQ ID NO: 6414526 - DNA, 23 bp, Homo sapiens
tccctcccacactcgccatctcc

SEQ ID NO: 6414527 - DNA, 17 bp, Homo sapiens
tccctcccacacttccc

SEQ ID NO: 6414528 - DNA, 12 bp, Homo sapiens
tccctcccaccc

SEQ ID NO: 6414529 - DNA, 14 bp, Homo sapiens
tccctcccacctct

SEQ ID NO: 6414530 - DNA, 16 bp, Homo sapiens
tccctcccacctctgt

SEQ ID NO: 6414531 - DNA, 19 bp, Homo sapiens
tccctcccacctctgtgac

SEQ ID NO: 6414532 - DNA, 14 bp, Homo sapiens
tccctcccactccc

SEQ ID NO: 6414533 - DNA, 23 bp, Homo sapiens
tccctcccagaaaaactggctct

SEQ ID NO: 6414534 - DNA, 22 bp, Homo sapiens
tccctcccagaggagccaccag

SEQ ID NO: 6414535 - DNA, 15 bp, Homo sapiens
tccctcccagatcca

SEQ ID NO: 6414536 - DNA, 22 bp, Homo sapiens
tccctcccatttgcagaccagg

SEQ ID NO: 6414537 - DNA, 23 bp, Homo sapiens
tccctccccaaacccatcagaca

SEQ ID NO: 6414538 - DNA, 22 bp, Homo sapiens
tccctccccacagtcctcacag

SEQ ID NO: 6414539 - DNA, 19 bp, Homo sapiens
tccctccccacccaagaga

SEQ ID NO: 6414540 - DNA, 11 bp, Homo sapiens
tccctccccag

SEQ ID NO: 6414541 - DNA, 22 bp, Homo sapiens
tccctccccagatctgtcctgg

SEQ ID NO: 6414542 - DNA, 16 bp, Homo sapiens
tccctccccagtgttt

SEQ ID NO: 6414543 - DNA, 17 bp, Homo sapiens
tccctcccccagagccc

SEQ ID NO: 6414544 - DNA, 18 bp, Homo sapiens
tccctcccccagagcccc

SEQ ID NO: 6414545 - DNA, 14 bp, Homo sapiens
tccctcccccagcc

SEQ ID NO: 6414546 - DNA, 17 bp, Homo sapiens
tccctcccccagccacc

SEQ ID NO: 6414547 - DNA, 12 bp, Homo sapiens
tccctccccccc

SEQ ID NO: 6414548 - DNA, 21 bp, Homo sapiens
tccctcccccccatgcactgt

SEQ ID NO: 6414549 - DNA, 21 bp, Homo sapiens
tccctcccccggggtctccac

SEQ ID NO: 6414550 - DNA, 23 bp, Homo sapiens
tccctcccccggggtctccacct

SEQ ID NO: 6414551 - DNA, 23 bp, Homo sapiens
tccctccccctagcaaggtccag

SEQ ID NO: 6414552 - DNA, 15 bp, Homo sapiens
tccctccccctagtc

SEQ ID NO: 6414553 - DNA, 12 bp, Homo sapiens
tccctccccctc

SEQ ID NO: 6414554 - DNA, 15 bp, Homo sapiens
tccctccccgctgcc

SEQ ID NO: 6414555 - DNA, 23 bp, Homo sapiens
tccctccccgctgccctttggcc

SEQ ID NO: 6414556 - DNA, 14 bp, Homo sapiens
tccctcccctgccc

SEQ ID NO: 6414557 - DNA, 17 bp, Homo sapiens
tccctcccctgccctgg

SEQ ID NO: 6414558 - DNA, 14 bp, Homo sapiens
tccctcccctgctc

SEQ ID NO: 6414559 - DNA, 16 bp, Homo sapiens
tccctcccctgctcag

SEQ ID NO: 6414560 - DNA, 15 bp, Homo sapiens
tccctccccttctct

SEQ ID NO: 6414561 - DNA, 22 bp, Homo sapiens
tccctcccggcatgggaaagcc

SEQ ID NO: 6414562 - DNA, 14 bp, Homo sapiens
tccctcccggctgc

SEQ ID NO: 6414563 - DNA, 20 bp, Homo sapiens
tccctcccggctgcccccat

SEQ ID NO: 6414564 - DNA, 21 bp, Homo sapiens
tccctcccgtagtctcctggg

SEQ ID NO: 6414565 - DNA, 22 bp, Homo sapiens
tccctcccgtagtctcctgggt

SEQ ID NO: 6414566 - DNA, 17 bp, Homo sapiens
tccctcccgtgtgtggt

SEQ ID NO: 6414567 - DNA, 16 bp, Homo sapiens
tccctccctagccctt

SEQ ID NO: 6414568 - DNA, 14 bp, Homo sapiens
tccctccctcactg

SEQ ID NO: 6414569 - DNA, 13 bp, Homo sapiens
tccctccctccac

SEQ ID NO: 6414570 - DNA, 15 bp, Homo sapiens
tccctccctccacct

SEQ ID NO: 6414571 - DNA, 16 bp, Homo sapiens
tccctccctccacctc

SEQ ID NO: 6414572 - DNA, 14 bp, Homo sapiens
tccctccctcctgg

SEQ ID NO: 6414573 - DNA, 18 bp, Homo sapiens
tccctccctgcagggtag

SEQ ID NO: 6414574 - DNA, 12 bp, Homo sapiens
tccctccctgcc

SEQ ID NO: 6414575 - DNA, 16 bp, Homo sapiens
tccctccctgctgtca

SEQ ID NO: 6414576 - DNA, 13 bp, Homo sapiens
tccctcccttcct

SEQ ID NO: 6414577 - DNA, 22 bp, Homo sapiens
tccctcccttgctgaacacaca

SEQ ID NO: 6414578 - DNA, 15 bp, Homo sapiens
tccctccgactccag

SEQ ID NO: 6414579 - DNA, 16 bp, Homo sapiens
tccctccgagcttggg

SEQ ID NO: 6414580 - DNA, 18 bp, Homo sapiens
tccctccgatccttcctc

SEQ ID NO: 6414581 - DNA, 19 bp, Homo sapiens
tccctccgatccttcctcc

SEQ ID NO: 6414582 - DNA, 19 bp, Homo sapiens
tccctccgcccccaggtag

SEQ ID NO: 6414583 - DNA, 13 bp, Homo sapiens
tccctccgcctcc

SEQ ID NO: 6414584 - DNA, 16 bp, Homo sapiens
tccctccgcctcccat

SEQ ID NO: 6414585 - DNA, 22 bp, Homo sapiens
tccctccgccttctcccacatg

SEQ ID NO: 6414586 - DNA, 19 bp, Homo sapiens
tccctccggcttgacctgt

SEQ ID NO: 6414587 - DNA, 13 bp, Homo sapiens
tccctcctagctc

SEQ ID NO: 6414588 - DNA, 18 bp, Homo sapiens
tccctcctcacactccag

SEQ ID NO: 6414589 - DNA, 21 bp, Homo sapiens
tccctcctccaggcctgcctc

SEQ ID NO: 6414590 - DNA, 20 bp, Homo sapiens
tccctcctcccatgtcactg

SEQ ID NO: 6414591 - DNA, 15 bp, Homo sapiens
tccctcctcccccac

SEQ ID NO: 6414592 - DNA, 15 bp, Homo sapiens
tccctcctctcacct

SEQ ID NO: 6414593 - DNA, 15 bp, Homo sapiens
tccctcctctgtccc

SEQ ID NO: 6414594 - DNA, 16 bp, Homo sapiens
tccctcctgacaaata

SEQ ID NO: 6414595 - DNA, 17 bp, Homo sapiens
tccctcctgacaaatat

SEQ ID NO: 6414596 - DNA, 19 bp, Homo sapiens
tccctcctgcccaggactg

SEQ ID NO: 6414597 - DNA, 22 bp, Homo sapiens
tccctcctgcccgccacacaga

SEQ ID NO: 6414598 - DNA, 14 bp, Homo sapiens
tccctcctgctttg

SEQ ID NO: 6414599 - DNA, 18 bp, Homo sapiens
tccctcctggagcatccc

SEQ ID NO: 6414600 - DNA, 14 bp, Homo sapiens
tccctcctggagct

SEQ ID NO: 6414601 - DNA, 14 bp, Homo sapiens
tccctcctggccag

SEQ ID NO: 6414602 - DNA, 13 bp, Homo sapiens
tccctcctggctc

SEQ ID NO: 6414603 - DNA, 22 bp, Homo sapiens
tccctcctggctcacagccacc

SEQ ID NO: 6414604 - DNA, 23 bp, Homo sapiens
tccctcctggctcacagccacca

SEQ ID NO: 6414605 - DNA, 12 bp, Homo sapiens
tccctcctggga

SEQ ID NO: 6414606 - DNA, 19 bp, Homo sapiens
tccctcctgggaatgaagc

SEQ ID NO: 6414607 - DNA, 15 bp, Homo sapiens
tccctcctggtcctg

SEQ ID NO: 6414608 - DNA, 23 bp, Homo sapiens
tccctcctggtcctggacacctc

SEQ ID NO: 6414609 - DNA, 20 bp, Homo sapiens
tccctcctggtgtcacccca

SEQ ID NO: 6414610 - DNA, 21 bp, Homo sapiens
tccctcctggtgtcaccccag

SEQ ID NO: 6414611 - DNA, 14 bp, Homo sapiens
tccctcctgtctct

SEQ ID NO: 6414612 - DNA, 18 bp, Homo sapiens
tccctcctgtgccccagc

SEQ ID NO: 6414613 - DNA, 22 bp, Homo sapiens
tccctcctgtgccccagctgcc

SEQ ID NO: 6414614 - DNA, 17 bp, Homo sapiens
tccctcctgttgtgaaa

SEQ ID NO: 6414615 - DNA, 13 bp, Homo sapiens
tccctccttcatg

SEQ ID NO: 6414616 - DNA, 14 bp, Homo sapiens
tccctccttcatga

SEQ ID NO: 6414617 - DNA, 19 bp, Homo sapiens
tccctccttgagcaccagc

SEQ ID NO: 6414618 - DNA, 12 bp, Homo sapiens
tccctccttggt

SEQ ID NO: 6414619 - DNA, 12 bp, Homo sapiens
tccctcctttcc

SEQ ID NO: 6414620 - DNA, 15 bp, Homo sapiens
tccctccttttaaaa

SEQ ID NO: 6414621 - DNA, 17 bp, Homo sapiens
tccctcgaacccacact

SEQ ID NO: 6414622 - DNA, 21 bp, Homo sapiens
tccctcgacagcgcccctgct

SEQ ID NO: 6414623 - DNA, 22 bp, Homo sapiens
tccctcgacagcgcccctgctg

SEQ ID NO: 6414624 - DNA, 23 bp, Homo sapiens
tccctcgacagcgcccctgctgt

SEQ ID NO: 6414625 - DNA, 23 bp, Homo sapiens
tccctcgcatccgcctctgagcc

SEQ ID NO: 6414626 - DNA, 17 bp, Homo sapiens
tccctcgccctgtgagg

SEQ ID NO: 6414627 - DNA, 19 bp, Homo sapiens
tccctcgccgtccctccca

SEQ ID NO: 6414628 - DNA, 16 bp, Homo sapiens
tccctcgctgtatgat

SEQ ID NO: 6414629 - DNA, 14 bp, Homo sapiens
tccctcggaagccg

SEQ ID NO: 6414630 - DNA, 24 bp, Homo sapiens
tccctcggaagccgtctgactcca

SEQ ID NO: 6414631 - DNA, 15 bp, Homo sapiens
tccctcggccccacc

SEQ ID NO: 6414632 - DNA, 17 bp, Homo sapiens
tccctcggccccaccca

SEQ ID NO: 6414633 - DNA, 18 bp, Homo sapiens
tccctcgggaagcagcca

SEQ ID NO: 6414634 - DNA, 22 bp, Homo sapiens
tccctcggggaccgttcagtgt

SEQ ID NO: 6414635 - DNA, 22 bp, Homo sapiens
tccctcgggggctcttccccta

SEQ ID NO: 6414636 - DNA, 23 bp, Homo sapiens
tccctcggtcacctgtgctacct

SEQ ID NO: 6414637 - DNA, 12 bp, Homo sapiens
tccctcggtcag

SEQ ID NO: 6414638 - DNA, 17 bp, Homo sapiens
tccctcggtcagcaccg

SEQ ID NO: 6414639 - DNA, 21 bp, Homo sapiens
tccctcgtagttggcaggagc

SEQ ID NO: 6414640 - DNA, 20 bp, Homo sapiens
tccctcgtccacaggggcag

SEQ ID NO: 6414641 - DNA, 14 bp, Homo sapiens
tatacctggtttac

SEQ ID NO: 6414642 - DNA, 15 bp, Homo sapiens
tatacctggtttact

SEQ ID NO: 6414643 - DNA, 16 bp, Homo sapiens
tatacctgtacacaca

SEQ ID NO: 6414644 - DNA, 14 bp, Homo sapiens
tatacctgtgcctc

SEQ ID NO: 6414645 - DNA, 15 bp, Homo sapiens
tatacctgtgcctcg

SEQ ID NO: 6414646 - DNA, 21 bp, Homo sapiens
tatacctgtggtttggtttta

SEQ ID NO: 6414647 - DNA, 23 bp, Homo sapiens
tatacctgtgtttcttgcctcat

SEQ ID NO: 6414648 - DNA, 13 bp, Homo sapiens
tatacctgttgct

SEQ ID NO: 6414649 - DNA, 23 bp, Homo sapiens
tatacctgttgcttaattacaat

SEQ ID NO: 6414650 - DNA, 17 bp, Homo sapiens
tatacctgtttaaattg

SEQ ID NO: 6414651 - DNA, 21 bp, Homo sapiens
tataccttatttatttttgtg

SEQ ID NO: 6414652 - DNA, 22 bp, Homo sapiens
tataccttatttatttttgtgt

SEQ ID NO: 6414653 - DNA, 13 bp, Homo sapiens
tatacctttcctt

SEQ ID NO: 6414654 - DNA, 17 bp, Homo sapiens
tatacgaacaaaacaca

SEQ ID NO: 6414655 - DNA, 22 bp, Homo sapiens
tatacgcacgcacccacaccct

SEQ ID NO: 6414656 - DNA, 17 bp, Homo sapiens
tatacggaaaaaattgt

SEQ ID NO: 6414657 - DNA, 22 bp, Homo sapiens
tatacgtatgcatttttttagt

SEQ ID NO: 6414658 - DNA, 22 bp, Homo sapiens
tatactaaaaaatgtctataga

SEQ ID NO: 6414659 - DNA, 22 bp, Homo sapiens
tatactaaaccaactctaatat

SEQ ID NO: 6414660 - DNA, 20 bp, Homo sapiens
tatactaagagtaaagcaac

SEQ ID NO: 6414661 - DNA, 16 bp, Homo sapiens
tatactaataaaaagg

SEQ ID NO: 6414662 - DNA, 20 bp, Homo sapiens
tatactaataaaaaggttta

SEQ ID NO: 6414663 - DNA, 16 bp, Homo sapiens
tatactatacaacaat

SEQ ID NO: 6414664 - DNA, 15 bp, Homo sapiens
tatactatatgaaaa

SEQ ID NO: 6414665 - DNA, 21 bp, Homo sapiens
tatactatatgaaaagagcaa

SEQ ID NO: 6414666 - DNA, 16 bp, Homo sapiens
tatactatattaactt

SEQ ID NO: 6414667 - DNA, 15 bp, Homo sapiens
tatactatatttttc

SEQ ID NO: 6414668 - DNA, 17 bp, Homo sapiens
tatactatttatataca

SEQ ID NO: 6414669 - DNA, 15 bp, Homo sapiens
tatactcaagtttca

SEQ ID NO: 6414670 - DNA, 15 bp, Homo sapiens
tatactcattagaat

SEQ ID NO: 6414671 - DNA, 14 bp, Homo sapiens
tatactcatttgga

SEQ ID NO: 6414672 - DNA, 23 bp, Homo sapiens
tatactccctgcccttccccctg

SEQ ID NO: 6414673 - DNA, 23 bp, Homo sapiens
tatactcctgtcacctagaacgt

SEQ ID NO: 6414674 - DNA, 12 bp, Homo sapiens
tatactccttaa

SEQ ID NO: 6414675 - DNA, 19 bp, Homo sapiens
tatactccttaaaaatgta

SEQ ID NO: 6414676 - DNA, 21 bp, Homo sapiens
tatactctcaccatttggatc

SEQ ID NO: 6414677 - DNA, 13 bp, Homo sapiens
tatactctcccag

SEQ ID NO: 6414678 - DNA, 15 bp, Homo sapiens
tatactctcttccct

SEQ ID NO: 6414679 - DNA, 19 bp, Homo sapiens
tatactctttctgtatata

SEQ ID NO: 6414680 - DNA, 16 bp, Homo sapiens
tatactgaaccaggcc

SEQ ID NO: 6414681 - DNA, 22 bp, Homo sapiens
tatactgaaggaaaaacacaag

SEQ ID NO: 6414682 - DNA, 16 bp, Homo sapiens
tatactgaagtctttt

SEQ ID NO: 6414683 - DNA, 17 bp, Homo sapiens
tatactgattatgtctt

SEQ ID NO: 6414684 - DNA, 13 bp, Homo sapiens
tatactgcagctt

SEQ ID NO: 6414685 - DNA, 14 bp, Homo sapiens
tatactgcagcttt

SEQ ID NO: 6414686 - DNA, 11 bp, Homo sapiens
tatactgcata

SEQ ID NO: 6414687 - DNA, 13 bp, Homo sapiens
tatactgcatatc

SEQ ID NO: 6414688 - DNA, 23 bp, Homo sapiens
tatactgcttggagctgagcaaa

SEQ ID NO: 6414689 - DNA, 16 bp, Homo sapiens
tatactggaaatgtaa

SEQ ID NO: 6414690 - DNA, 23 bp, Homo sapiens
tatactgggggcaaaatcagaat

SEQ ID NO: 6414691 - DNA, 10 bp, Homo sapiens
tatactgtaa

SEQ ID NO: 6414692 - DNA, 15 bp, Homo sapiens
tatactgtaaaagtt

SEQ ID NO: 6414693 - DNA, 22 bp, Homo sapiens
tatactgtaaagaaagagagaa

SEQ ID NO: 6414694 - DNA, 17 bp, Homo sapiens
tatactgtagcaatata

SEQ ID NO: 6414695 - DNA, 20 bp, Homo sapiens
tatactgtagcaatatattt

SEQ ID NO: 6414696 - DNA, 20 bp, Homo sapiens
tatactgtaggtgttatgta

SEQ ID NO: 6414697 - DNA, 18 bp, Homo sapiens
tatactgtcttgtctcac

SEQ ID NO: 6414698 - DNA, 19 bp, Homo sapiens
tatactgtggcctgcagga

SEQ ID NO: 6414699 - DNA, 21 bp, Homo sapiens
tatactgtggcctgcaggagg

SEQ ID NO: 6414700 - DNA, 14 bp, Homo sapiens
tatactgtgtgtga

SEQ ID NO: 6414701 - DNA, 13 bp, Homo sapiens
tatactgttcttc

SEQ ID NO: 6414702 - DNA, 20 bp, Homo sapiens
tatactgtttgtaatataca

SEQ ID NO: 6414703 - DNA, 18 bp, Homo sapiens
tatacttaaaatgacaaa

SEQ ID NO: 6414704 - DNA, 19 bp, Homo sapiens
tatacttaaaatgacaaag

SEQ ID NO: 6414705 - DNA, 12 bp, Homo sapiens
tatacttaagaa

SEQ ID NO: 6414706 - DNA, 19 bp, Homo sapiens
tatacttaatactgaattt

SEQ ID NO: 6414707 - DNA, 19 bp, Homo sapiens
tatacttagatcctggtaa

SEQ ID NO: 6414708 - DNA, 15 bp, Homo sapiens
tatacttgaacaaaa

SEQ ID NO: 6414709 - DNA, 21 bp, Homo sapiens
tatacttgaacaaaagggtca

SEQ ID NO: 6414710 - DNA, 23 bp, Homo sapiens
tatacttgaacaaaagggtcaga

SEQ ID NO: 6414711 - DNA, 14 bp, Homo sapiens
tatacttgactcta

SEQ ID NO: 6414712 - DNA, 16 bp, Homo sapiens
tatacttgactctaat

SEQ ID NO: 6414713 - DNA, 13 bp, Homo sapiens
tatacttgagtgt

SEQ ID NO: 6414714 - DNA, 22 bp, Homo sapiens
tatacttgtttttgtaaagaaa

SEQ ID NO: 6414715 - DNA, 14 bp, Homo sapiens
tatactttaaataa

SEQ ID NO: 6414716 - DNA, 18 bp, Homo sapiens
tatactttaaataatggt

SEQ ID NO: 6414717 - DNA, 22 bp, Homo sapiens
tatactttactttttccatttg

SEQ ID NO: 6414718 - DNA, 12 bp, Homo sapiens
tatactttagta

SEQ ID NO: 6414719 - DNA, 19 bp, Homo sapiens
tatactttagtagacattt

SEQ ID NO: 6414720 - DNA, 15 bp, Homo sapiens
tatactttagtatga

SEQ ID NO: 6414721 - DNA, 18 bp, Homo sapiens
tatactttatataaggca

SEQ ID NO: 6414722 - DNA, 16 bp, Homo sapiens
tatactttatcaaaga

SEQ ID NO: 6414723 - DNA, 13 bp, Homo sapiens
tatactttattga

SEQ ID NO: 6414724 - DNA, 12 bp, Homo sapiens
tatactttccct

SEQ ID NO: 6414725 - DNA, 17 bp, Homo sapiens
tatactttccctaccct

SEQ ID NO: 6414726 - DNA, 20 bp, Homo sapiens
tatactttccctaccctcta

SEQ ID NO: 6414727 - DNA, 15 bp, Homo sapiens
tatactttgccactg

SEQ ID NO: 6414728 - DNA, 17 bp, Homo sapiens
tatactttgccactgct

SEQ ID NO: 6414729 - DNA, 23 bp, Homo sapiens
tatactttggttggcagcattcc

SEQ ID NO: 6414730 - DNA, 14 bp, Homo sapiens
tatactttgtggac

SEQ ID NO: 6414731 - DNA, 13 bp, Homo sapiens
tatactttgttct

SEQ ID NO: 6414732 - DNA, 16 bp, Homo sapiens
tatactttgttgtttt

SEQ ID NO: 6414733 - DNA, 13 bp, Homo sapiens
tatacttttacaa

SEQ ID NO: 6414734 - DNA, 13 bp, Homo sapiens
tatactttttcat

SEQ ID NO: 6414735 - DNA, 11 bp, Homo sapiens
tatactttttt

SEQ ID NO: 6414736 - DNA, 17 bp, Homo sapiens
tatactttttttgttat

SEQ ID NO: 6414737 - DNA, 22 bp, Homo sapiens
tatactttttttgttatagatt

SEQ ID NO: 6414738 - DNA, 16 bp, Homo sapiens
tatagaaaaaaacatt

SEQ ID NO: 6414739 - DNA, 18 bp, Homo sapiens
tatagaaaaagcacagct

SEQ ID NO: 6414740 - DNA, 23 bp, Homo sapiens
tatagaaaaataaaaatctcttt

SEQ ID NO: 6414741 - DNA, 17 bp, Homo sapiens
tatagaaaacctgactt

SEQ ID NO: 6414742 - DNA, 14 bp, Homo sapiens
tatagaaaataaaa

SEQ ID NO: 6414743 - DNA, 14 bp, Homo sapiens
tatagaaaatggaa

SEQ ID NO: 6414744 - DNA, 13 bp, Homo sapiens
tatagaaagctat

SEQ ID NO: 6414745 - DNA, 13 bp, Homo sapiens
tatagaaagctgt

SEQ ID NO: 6414746 - DNA, 14 bp, Homo sapiens
tatagaaaggagac

SEQ ID NO: 6414747 - DNA, 11 bp, Homo sapiens
tatagaaagtg

SEQ ID NO: 6414748 - DNA, 14 bp, Homo sapiens
tatagaaagtgttc

SEQ ID NO: 6414749 - DNA, 22 bp, Homo sapiens
tatagaaatagaacactgcctc

SEQ ID NO: 6414750 - DNA, 12 bp, Homo sapiens
tatagaaattct

SEQ ID NO: 6414751 - DNA, 21 bp, Homo sapiens
tatagaacctctttgtctaca

SEQ ID NO: 6414752 - DNA, 20 bp, Homo sapiens
tatagaactggattttcaga

SEQ ID NO: 6414753 - DNA, 22 bp, Homo sapiens
tatagaacttcatggatcagat

SEQ ID NO: 6414754 - DNA, 18 bp, Homo sapiens
tatagaagaatgcatgct

SEQ ID NO: 6414755 - DNA, 13 bp, Homo sapiens
tatagaagcgatt

SEQ ID NO: 6414756 - DNA, 22 bp, Homo sapiens
tatagaagtataaagaattgtg

SEQ ID NO: 6414757 - DNA, 13 bp, Homo sapiens
tatagaagtcttc

SEQ ID NO: 6414758 - DNA, 22 bp, Homo sapiens
tatagaagtcttcatgaaatgc

SEQ ID NO: 6414759 - DNA, 23 bp, Homo sapiens
tatagaagtcttcatgaaatgct

SEQ ID NO: 6414760 - DNA, 13 bp, Homo sapiens
tatagaagtttag

SEQ ID NO: 6414761 - DNA, 16 bp, Homo sapiens
tatagaagtttgtcca

SEQ ID NO: 6414762 - DNA, 12 bp, Homo sapiens
tatagaataaac

SEQ ID NO: 6414763 - DNA, 22 bp, Homo sapiens
tatagaataaagcctctgtgct

SEQ ID NO: 6414764 - DNA, 22 bp, Homo sapiens
tatagaataatgtgggaagaaa

SEQ ID NO: 6414765 - DNA, 15 bp, Homo sapiens
tatagaataatttct

SEQ ID NO: 6414766 - DNA, 22 bp, Homo sapiens
tatagaatacttttttctagtt

SEQ ID NO: 6414767 - DNA, 20 bp, Homo sapiens
tatagaataggcactttaaa

SEQ ID NO: 6414768 - DNA, 23 bp, Homo sapiens
tatagaataggcactttaaaaca

SEQ ID NO: 6414769 - DNA, 15 bp, Homo sapiens
tatagaattagcttt

SEQ ID NO: 6414770 - DNA, 16 bp, Homo sapiens
tatagaattgcacata

SEQ ID NO: 6414771 - DNA, 13 bp, Homo sapiens
tatagaattgtag

SEQ ID NO: 6414772 - DNA, 17 bp, Homo sapiens
tatagaatttttaatgt

SEQ ID NO: 6414773 - DNA, 14 bp, Homo sapiens
tatagacacacata

SEQ ID NO: 6414774 - DNA, 20 bp, Homo sapiens
tatagacaggagaagaaaga

SEQ ID NO: 6414775 - DNA, 14 bp, Homo sapiens
tatagacagtgccc

SEQ ID NO: 6414776 - DNA, 17 bp, Homo sapiens
tatagacattctcacat

SEQ ID NO: 6414777 - DNA, 19 bp, Homo sapiens
tatagacattgaggacctc

SEQ ID NO: 6414778 - DNA, 22 bp, Homo sapiens
tatagaccaaagcaaagaaaat

SEQ ID NO: 6414779 - DNA, 18 bp, Homo sapiens
tatagaccaattgaagca

SEQ ID NO: 6414780 - DNA, 18 bp, Homo sapiens
tatagaccccaagcattc

SEQ ID NO: 6414781 - DNA, 20 bp, Homo sapiens
tatagacggtgctcactccc

SEQ ID NO: 6414782 - DNA, 22 bp, Homo sapiens
tatagactgtacattatgaaga

SEQ ID NO: 6414783 - DNA, 23 bp, Homo sapiens
tatagagaaaaactttcattttt

SEQ ID NO: 6414784 - DNA, 22 bp, Homo sapiens
tatagagacaggacagaatgtg

SEQ ID NO: 6414785 - DNA, 18 bp, Homo sapiens
tatagagagggggctctc

SEQ ID NO: 6414786 - DNA, 17 bp, Homo sapiens
tatagagatatgcagaa

SEQ ID NO: 6414787 - DNA, 16 bp, Homo sapiens
tatagagatgcattca

SEQ ID NO: 6414788 - DNA, 21 bp, Homo sapiens
tatagaggctagcttctgctt

SEQ ID NO: 6414789 - DNA, 20 bp, Homo sapiens
tatagagtcattgtaatgtt

SEQ ID NO: 6414790 - DNA, 13 bp, Homo sapiens
tatagagttcata

SEQ ID NO: 6414791 - DNA, 17 bp, Homo sapiens
tatagagttcatagaaa

SEQ ID NO: 6414792 - DNA, 18 bp, Homo sapiens
tatagagttcatagaaat

SEQ ID NO: 6414793 - DNA, 15 bp, Homo sapiens
tatagataaagagat

SEQ ID NO: 6414794 - DNA, 11 bp, Homo sapiens
tatagatacaa

SEQ ID NO: 6414795 - DNA, 18 bp, Homo sapiens
tatagatacaaaaccttg

SEQ ID NO: 6414796 - DNA, 15 bp, Homo sapiens
tatagatagataatg

SEQ ID NO: 6414797 - DNA, 14 bp, Homo sapiens
tatagatataaata

SEQ ID NO: 6414798 - DNA, 16 bp, Homo sapiens
tatagatatatttggc

SEQ ID NO: 6414799 - DNA, 18 bp, Homo sapiens
tatagatcacataacaga

SEQ ID NO: 6414800 - DNA, 14 bp, Homo sapiens
tatagatcctgagc

SEQ ID NO: 6414801 - DNA, 17 bp, Homo sapiens
tatagatgggaatgaag

SEQ ID NO: 6414802 - DNA, 14 bp, Homo sapiens
tatagatgtctgtg

SEQ ID NO: 6414803 - DNA, 20 bp, Homo sapiens
tatagatgtctgtgtataca

SEQ ID NO: 6414804 - DNA, 22 bp, Homo sapiens
tatagatgtctgtgtatacata

SEQ ID NO: 6414805 - DNA, 23 bp, Homo sapiens
tatagatgtctgtgtatacatat

SEQ ID NO: 6414806 - DNA, 20 bp, Homo sapiens
tatagatgttgctaacagca

SEQ ID NO: 6414807 - DNA, 21 bp, Homo sapiens
tatagatgttgctaacagcaa

SEQ ID NO: 6414808 - DNA, 19 bp, Homo sapiens
tatagattagagagtgttg

SEQ ID NO: 6414809 - DNA, 22 bp, Homo sapiens
tatagattagagagtgttgaaa

SEQ ID NO: 6414810 - DNA, 15 bp, Homo sapiens
tatagattataactt

SEQ ID NO: 6414811 - DNA, 16 bp, Homo sapiens
tatagattataacttg

SEQ ID NO: 6414812 - DNA, 13 bp, Homo sapiens
tatagattctaaa

SEQ ID NO: 6414813 - DNA, 14 bp, Homo sapiens
tatagattctaaag

SEQ ID NO: 6414814 - DNA, 20 bp, Homo sapiens
tatagattctttattagtga

SEQ ID NO: 6414815 - DNA, 23 bp, Homo sapiens
tatagattctttattagtgaagt

SEQ ID NO: 6414816 - DNA, 16 bp, Homo sapiens
tatagattgtcttaat

SEQ ID NO: 6414817 - DNA, 12 bp, Homo sapiens
tatagatttagc

SEQ ID NO: 6414818 - DNA, 14 bp, Homo sapiens
tatagatttgacct

SEQ ID NO: 6414819 - DNA, 17 bp, Homo sapiens
tatagatttgtatttta

SEQ ID NO: 6414820 - DNA, 22 bp, Homo sapiens
tccctcgtcttcagctgcattt

SEQ ID NO: 6414821 - DNA, 16 bp, Homo sapiens
tccctctaatgagact

SEQ ID NO: 6414822 - DNA, 17 bp, Homo sapiens
tccctctaatgagactg

SEQ ID NO: 6414823 - DNA, 14 bp, Homo sapiens
tccctctaatttat

SEQ ID NO: 6414824 - DNA, 17 bp, Homo sapiens
tccctctactcttcctg

SEQ ID NO: 6414825 - DNA, 15 bp, Homo sapiens
tccctctactgggag

SEQ ID NO: 6414826 - DNA, 18 bp, Homo sapiens
tccctctactgggagcct

SEQ ID NO: 6414827 - DNA, 22 bp, Homo sapiens
tccctctactgggagcctaccc

SEQ ID NO: 6414828 - DNA, 21 bp, Homo sapiens
tccctctagaggctgcctggg

SEQ ID NO: 6414829 - DNA, 20 bp, Homo sapiens
tccctctaggctctgccttc

SEQ ID NO: 6414830 - DNA, 16 bp, Homo sapiens
tccctctcagaggcct

SEQ ID NO: 6414831 - DNA, 14 bp, Homo sapiens
tccctctcagatac

SEQ ID NO: 6414832 - DNA, 18 bp, Homo sapiens
tccctctcagatacccag

SEQ ID NO: 6414833 - DNA, 22 bp, Homo sapiens
tccctctcaggcatgcctgtgt

SEQ ID NO: 6414834 - DNA, 17 bp, Homo sapiens
tccctctcagtgccttc

SEQ ID NO: 6414835 - DNA, 22 bp, Homo sapiens
tccctctcagtgccttctctca

SEQ ID NO: 6414836 - DNA, 14 bp, Homo sapiens
tccctctcatctca

SEQ ID NO: 6414837 - DNA, 19 bp, Homo sapiens
tccctctcatgtccctcca

SEQ ID NO: 6414838 - DNA, 14 bp, Homo sapiens
tccctctccaagac

SEQ ID NO: 6414839 - DNA, 16 bp, Homo sapiens
tccctctccaagacag

SEQ ID NO: 6414840 - DNA, 22 bp, Homo sapiens
tccctctccaagacagcagcag

SEQ ID NO: 6414841 - DNA, 20 bp, Homo sapiens
tccctctccataaccccacc

SEQ ID NO: 6414842 - DNA, 13 bp, Homo sapiens
tccctctcccagg

SEQ ID NO: 6414843 - DNA, 18 bp, Homo sapiens
tccctctccctctctctg

SEQ ID NO: 6414844 - DNA, 14 bp, Homo sapiens
tccctctcctaact

SEQ ID NO: 6414845 - DNA, 23 bp, Homo sapiens
tccctctcctatgtggcagctgg

SEQ ID NO: 6414846 - DNA, 13 bp, Homo sapiens
tccctctcctccc

SEQ ID NO: 6414847 - DNA, 13 bp, Homo sapiens
tccctctcctctg

SEQ ID NO: 6414848 - DNA, 14 bp, Homo sapiens
tccctctcctctgc

SEQ ID NO: 6414849 - DNA, 16 bp, Homo sapiens
tccctctcctctgccc

SEQ ID NO: 6414850 - DNA, 16 bp, Homo sapiens
tccctctcctgtagcc

SEQ ID NO: 6414851 - DNA, 12 bp, Homo sapiens
tccctctccttc

SEQ ID NO: 6414852 - DNA, 13 bp, Homo sapiens
tccctctccttgc

SEQ ID NO: 6414853 - DNA, 22 bp, Homo sapiens
tccctctcgccctggccagggc

SEQ ID NO: 6414854 - DNA, 20 bp, Homo sapiens
tccctctcgctcccctctgc

SEQ ID NO: 6414855 - DNA, 23 bp, Homo sapiens
tccctctcggaaggctggctggg

SEQ ID NO: 6414856 - DNA, 13 bp, Homo sapiens
tccctctctcagc

SEQ ID NO: 6414857 - DNA, 17 bp, Homo sapiens
tccctctctcagcacag

SEQ ID NO: 6414858 - DNA, 20 bp, Homo sapiens
tccctctctccacacggagc

SEQ ID NO: 6414859 - DNA, 21 bp, Homo sapiens
tccctctctcccatttcagga

SEQ ID NO: 6414860 - DNA, 15 bp, Homo sapiens
tccctctctccctgc

SEQ ID NO: 6414861 - DNA, 16 bp, Homo sapiens
tccctctctccctgcc

SEQ ID NO: 6414862 - DNA, 17 bp, Homo sapiens
tccctctctccctgcct

SEQ ID NO: 6414863 - DNA, 15 bp, Homo sapiens
tccctctctcctgga

SEQ ID NO: 6414864 - DNA, 11 bp, Homo sapiens
tccctctctct

SEQ ID NO: 6414865 - DNA, 13 bp, Homo sapiens
tccctctctctga

SEQ ID NO: 6414866 - DNA, 15 bp, Homo sapiens
tccctctctctgact

SEQ ID NO: 6414867 - DNA, 22 bp, Homo sapiens
tccctctctctgactctcaaat

SEQ ID NO: 6414868 - DNA, 16 bp, Homo sapiens
tccctctctctggaaa

SEQ ID NO: 6414869 - DNA, 18 bp, Homo sapiens
tccctctctcttctgctc

SEQ ID NO: 6414870 - DNA, 13 bp, Homo sapiens
tccctctctgccc

SEQ ID NO: 6414871 - DNA, 16 bp, Homo sapiens
tccctctctgctggac

SEQ ID NO: 6414872 - DNA, 19 bp, Homo sapiens
tccctctcttgaccctgtc

SEQ ID NO: 6414873 - DNA, 13 bp, Homo sapiens
tccctctcttggc

SEQ ID NO: 6414874 - DNA, 16 bp, Homo sapiens
tccctctcttggctat

SEQ ID NO: 6414875 - DNA, 22 bp, Homo sapiens
tccctctgaagagaccttggct

SEQ ID NO: 6414876 - DNA, 23 bp, Homo sapiens
tccctctgaagagaccttggctg

SEQ ID NO: 6414877 - DNA, 14 bp, Homo sapiens
tccctctgacccag

SEQ ID NO: 6414878 - DNA, 18 bp, Homo sapiens
tccctctgacctgcaggc

SEQ ID NO: 6414879 - DNA, 22 bp, Homo sapiens
tccctctgagaattccaaggag

SEQ ID NO: 6414880 - DNA, 16 bp, Homo sapiens
tccctctgcagaatcc

SEQ ID NO: 6414881 - DNA, 16 bp, Homo sapiens
tccctctgcagtctct

SEQ ID NO: 6414882 - DNA, 19 bp, Homo sapiens
tccctctgcattgacctgg

SEQ ID NO: 6414883 - DNA, 20 bp, Homo sapiens
tccctctgcattgacctgga

SEQ ID NO: 6414884 - DNA, 10 bp, Homo sapiens
tccctctgcc

SEQ ID NO: 6414885 - DNA, 13 bp, Homo sapiens
tccctctgcccca

SEQ ID NO: 6414886 - DNA, 19 bp, Homo sapiens
tccctctgccccaagcagc

SEQ ID NO: 6414887 - DNA, 15 bp, Homo sapiens
tccctctgcccctcc

SEQ ID NO: 6414888 - DNA, 13 bp, Homo sapiens
tccctctgccggc

SEQ ID NO: 6414889 - DNA, 11 bp, Homo sapiens
tccctctgcct

SEQ ID NO: 6414890 - DNA, 15 bp, Homo sapiens
tccctctgcctcatc

SEQ ID NO: 6414891 - DNA, 16 bp, Homo sapiens
tccctctgcctcatcc

SEQ ID NO: 6414892 - DNA, 12 bp, Homo sapiens
tccctctgcctg

SEQ ID NO: 6414893 - DNA, 17 bp, Homo sapiens
tccctctgcctgggatg

SEQ ID NO: 6414894 - DNA, 16 bp, Homo sapiens
tccctctgcctgtccc

SEQ ID NO: 6414895 - DNA, 11 bp, Homo sapiens
tccctctgctc

SEQ ID NO: 6414896 - DNA, 18 bp, Homo sapiens
tccctctggagtttcatg

SEQ ID NO: 6414897 - DNA, 16 bp, Homo sapiens
tccctctggccctgcc

SEQ ID NO: 6414898 - DNA, 20 bp, Homo sapiens
tccctctggccctgccttct

SEQ ID NO: 6414899 - DNA, 23 bp, Homo sapiens
tccctctgggcacgcctgctggc

SEQ ID NO: 6414900 - DNA, 23 bp, Homo sapiens
tccctctgggcctgttctcttgg

SEQ ID NO: 6414901 - DNA, 20 bp, Homo sapiens
tccctctgggggctctggcc

SEQ ID NO: 6414902 - DNA, 22 bp, Homo sapiens
tccctctgggggctctggccaa

SEQ ID NO: 6414903 - DNA, 22 bp, Homo sapiens
tccctctggtctactctagaag

SEQ ID NO: 6414904 - DNA, 14 bp, Homo sapiens
tccctctgtaatta

SEQ ID NO: 6414905 - DNA, 17 bp, Homo sapiens
tccctctgtccacttgt

SEQ ID NO: 6414906 - DNA, 12 bp, Homo sapiens
tccctctgtctt

SEQ ID NO: 6414907 - DNA, 16 bp, Homo sapiens
tccctctgtcttttct

SEQ ID NO: 6414908 - DNA, 19 bp, Homo sapiens
tccctctgttaggtccatt

SEQ ID NO: 6414909 - DNA, 12 bp, Homo sapiens
tccctcttcact

SEQ ID NO: 6414910 - DNA, 14 bp, Homo sapiens
tccctcttcccagc

SEQ ID NO: 6414911 - DNA, 15 bp, Homo sapiens
tccctcttccctcag

SEQ ID NO: 6414912 - DNA, 18 bp, Homo sapiens
tccctcttccttccccca

SEQ ID NO: 6414913 - DNA, 21 bp, Homo sapiens
tccctcttccttccctgctgt

SEQ ID NO: 6414914 - DNA, 22 bp, Homo sapiens
tccctcttccttccctgctgtg

SEQ ID NO: 6414915 - DNA, 22 bp, Homo sapiens
tccctcttccttggttccctct

SEQ ID NO: 6414916 - DNA, 14 bp, Homo sapiens
tccctcttctcaag

SEQ ID NO: 6414917 - DNA, 19 bp, Homo sapiens
tccctcttctcaagtgcct

SEQ ID NO: 6414918 - DNA, 18 bp, Homo sapiens
tccctcttctctcctcag

SEQ ID NO: 6414919 - DNA, 19 bp, Homo sapiens
tccctcttctggtttccct

SEQ ID NO: 6414920 - DNA, 17 bp, Homo sapiens
tccctcttggtcttccc

SEQ ID NO: 6414921 - DNA, 16 bp, Homo sapiens
tccctcttgtgctcag

SEQ ID NO: 6414922 - DNA, 19 bp, Homo sapiens
tccctcttgtgggataatg

SEQ ID NO: 6414923 - DNA, 16 bp, Homo sapiens
tccctcttgttttgtt

SEQ ID NO: 6414924 - DNA, 17 bp, Homo sapiens
tccctcttgttttgttt

SEQ ID NO: 6414925 - DNA, 21 bp, Homo sapiens
tccctcttgttttgtttgtct

SEQ ID NO: 6414926 - DNA, 11 bp, Homo sapiens
tccctctttcc

SEQ ID NO: 6414927 - DNA, 18 bp, Homo sapiens
tccctctttccccacctc

SEQ ID NO: 6414928 - DNA, 17 bp, Homo sapiens
tccctctttcctgtgcc

SEQ ID NO: 6414929 - DNA, 16 bp, Homo sapiens
tccctctttctagcct

SEQ ID NO: 6414930 - DNA, 18 bp, Homo sapiens
tccctctttctagcctgg

SEQ ID NO: 6414931 - DNA, 19 bp, Homo sapiens
tccctctttctttcttttg

SEQ ID NO: 6414932 - DNA, 20 bp, Homo sapiens
tccctctttggcagttgcat

SEQ ID NO: 6414933 - DNA, 17 bp, Homo sapiens
tccctgaaaatgttttt

SEQ ID NO: 6414934 - DNA, 22 bp, Homo sapiens
tccctgaaacacgaaacttgtt

SEQ ID NO: 6414935 - DNA, 18 bp, Homo sapiens
tccctgaaacactgcttc

SEQ ID NO: 6414936 - DNA, 18 bp, Homo sapiens
tccctgaaatttctcatt

SEQ ID NO: 6414937 - DNA, 16 bp, Homo sapiens
tccctgaacatctgtg

SEQ ID NO: 6414938 - DNA, 18 bp, Homo sapiens
tccctgaacccctggcca

SEQ ID NO: 6414939 - DNA, 24 bp, Homo sapiens
tccctgaacccctggccagctctg

SEQ ID NO: 6414940 - DNA, 15 bp, Homo sapiens
tccctgaacctcagt

SEQ ID NO: 6414941 - DNA, 16 bp, Homo sapiens
tccctgaaccttcctg

SEQ ID NO: 6414942 - DNA, 22 bp, Homo sapiens
tccctgaaccttcctgtctccc

SEQ ID NO: 6414943 - DNA, 20 bp, Homo sapiens
tccctgaacgttttcttctt

SEQ ID NO: 6414944 - DNA, 16 bp, Homo sapiens
tccctgaagagacagg

SEQ ID NO: 6414945 - DNA, 15 bp, Homo sapiens
tccctgaagccagcc

SEQ ID NO: 6414946 - DNA, 23 bp, Homo sapiens
tccctgaaggccccgcccaggct

SEQ ID NO: 6414947 - DNA, 21 bp, Homo sapiens
tccctgaatcccccttgccac

SEQ ID NO: 6414948 - DNA, 23 bp, Homo sapiens
tccctgaatctgaccacagacac

SEQ ID NO: 6414949 - DNA, 16 bp, Homo sapiens
tccctgacactgcggg

SEQ ID NO: 6414950 - DNA, 22 bp, Homo sapiens
tccctgacactgcggggcttgg

SEQ ID NO: 6414951 - DNA, 16 bp, Homo sapiens
tccctgaccaccctgc

SEQ ID NO: 6414952 - DNA, 24 bp, Homo sapiens
tccctgaccaccctgcctgtggag

SEQ ID NO: 6414953 - DNA, 14 bp, Homo sapiens
tccctgaccccctg

SEQ ID NO: 6414954 - DNA, 14 bp, Homo sapiens
tccctgacccgtct

SEQ ID NO: 6414955 - DNA, 14 bp, Homo sapiens
tccctgaccctgca

SEQ ID NO: 6414956 - DNA, 16 bp, Homo sapiens
tccctgaccctgctcc

SEQ ID NO: 6414957 - DNA, 22 bp, Homo sapiens
tccctgaccctgtatatagccc

SEQ ID NO: 6414958 - DNA, 16 bp, Homo sapiens
tccctgacctccctct

SEQ ID NO: 6414959 - DNA, 18 bp, Homo sapiens
tccctgaccttctccagg

SEQ ID NO: 6414960 - DNA, 21 bp, Homo sapiens
tccctgacgtctgccaccagc

SEQ ID NO: 6414961 - DNA, 14 bp, Homo sapiens
tccctgactcattc

SEQ ID NO: 6414962 - DNA, 16 bp, Homo sapiens
tccctgactcattctg

SEQ ID NO: 6414963 - DNA, 19 bp, Homo sapiens
tccctgactcattctgaag

SEQ ID NO: 6414964 - DNA, 16 bp, Homo sapiens
tccctgactccctgtg

SEQ ID NO: 6414965 - DNA, 18 bp, Homo sapiens
tccctgactctctgtgac

SEQ ID NO: 6414966 - DNA, 20 bp, Homo sapiens
tccctgactctctgtgacct

SEQ ID NO: 6414967 - DNA, 14 bp, Homo sapiens
tccctgactgggag

SEQ ID NO: 6414968 - DNA, 19 bp, Homo sapiens
tccctgacttctcccccgc

SEQ ID NO: 6414969 - DNA, 22 bp, Homo sapiens
tccctgacttctcccccgccct

SEQ ID NO: 6414970 - DNA, 23 bp, Homo sapiens
tccctgacttctcccccgccctg

SEQ ID NO: 6414971 - DNA, 22 bp, Homo sapiens
tccctgagaaacccaccagcct

SEQ ID NO: 6414972 - DNA, 15 bp, Homo sapiens
tccctgagacaggga

SEQ ID NO: 6414973 - DNA, 23 bp, Homo sapiens
tccctgagatgggcttcccaagg

SEQ ID NO: 6414974 - DNA, 11 bp, Homo sapiens
tccctgagcag

SEQ ID NO: 6414975 - DNA, 16 bp, Homo sapiens
tccctgagcaggaaag

SEQ ID NO: 6414976 - DNA, 20 bp, Homo sapiens
tccctgagcagtctacttct

SEQ ID NO: 6414977 - DNA, 11 bp, Homo sapiens
tccctgagcct

SEQ ID NO: 6414978 - DNA, 19 bp, Homo sapiens
tccctgagcctgccccagc

SEQ ID NO: 6414979 - DNA, 12 bp, Homo sapiens
tccctgaggacc

SEQ ID NO: 6414980 - DNA, 20 bp, Homo sapiens
tccctgaggactgatttcag

SEQ ID NO: 6414981 - DNA, 21 bp, Homo sapiens
tccctgaggactgatttcaga

SEQ ID NO: 6414982 - DNA, 22 bp, Homo sapiens
tccctgaggatgggtcagagct

SEQ ID NO: 6414983 - DNA, 23 bp, Homo sapiens
tccctgaggatgggtcagagcta

SEQ ID NO: 6414984 - DNA, 22 bp, Homo sapiens
tccctgaggcaggtccccagac

SEQ ID NO: 6414985 - DNA, 20 bp, Homo sapiens
tccctgaggctggactccag

SEQ ID NO: 6414986 - DNA, 14 bp, Homo sapiens
tccctgagggccct

SEQ ID NO: 6414987 - DNA, 16 bp, Homo sapiens
tccctgagggcccttc

SEQ ID NO: 6414988 - DNA, 19 bp, Homo sapiens
tccctgagggcccttccca

SEQ ID NO: 6414989 - DNA, 14 bp, Homo sapiens
tccctgagggcgga

SEQ ID NO: 6414990 - DNA, 20 bp, Homo sapiens
tccctgagggcggagcgcct

SEQ ID NO: 6414991 - DNA, 18 bp, Homo sapiens
tccctgaggtacctttcc

SEQ ID NO: 6414992 - DNA, 15 bp, Homo sapiens
tccctgagtcaccag

SEQ ID NO: 6414993 - DNA, 17 bp, Homo sapiens
tccctgagtcaccagga

SEQ ID NO: 6414994 - DNA, 14 bp, Homo sapiens
tccctgagtctgga

SEQ ID NO: 6414995 - DNA, 16 bp, Homo sapiens
tccctgagtctggacc

SEQ ID NO: 6414996 - DNA, 19 bp, Homo sapiens
tccctgagttcactctccg

SEQ ID NO: 6414997 - DNA, 21 bp, Homo sapiens
tccctgagttgcaccattctt

SEQ ID NO: 6414998 - DNA, 20 bp, Homo sapiens
tatagcaaaaatgttttcca

SEQ ID NO: 6414999 - DNA, 16 bp, Homo sapiens
tatagcaaaactttta

SEQ ID NO: 6415000 - DNA, 19 bp, Homo sapiens
tatagcaaagatatatatt

SEQ ID NO: 6415001 - DNA, 12 bp, Homo sapiens
tatagcaaagtt

SEQ ID NO: 6415002 - DNA, 14 bp, Homo sapiens
tatagcaactaatg

SEQ ID NO: 6415003 - DNA, 18 bp, Homo sapiens
tatagcaatatcaaaagg

SEQ ID NO: 6415004 - DNA, 23 bp, Homo sapiens
tatagcaatccatgttagttttt

SEQ ID NO: 6415005 - DNA, 19 bp, Homo sapiens
tatagcaatgtaacattaa

SEQ ID NO: 6415006 - DNA, 21 bp, Homo sapiens
tatagcaatgtaacattaatt

SEQ ID NO: 6415007 - DNA, 18 bp, Homo sapiens
tatagcacctttcaacca

SEQ ID NO: 6415008 - DNA, 21 bp, Homo sapiens
tatagcactttgaaatacctc

SEQ ID NO: 6415009 - DNA, 22 bp, Homo sapiens
tatagcactttgaaatacctca

SEQ ID NO: 6415010 - DNA, 20 bp, Homo sapiens
tatagcagagtccttattct

SEQ ID NO: 6415011 - DNA, 18 bp, Homo sapiens
tatagcagcaaaaatata

SEQ ID NO: 6415012 - DNA, 22 bp, Homo sapiens
tatagcagcaaaaatataaaat

SEQ ID NO: 6415013 - DNA, 19 bp, Homo sapiens
tatagcagtgttctctctg

SEQ ID NO: 6415014 - DNA, 15 bp, Homo sapiens
tatagcatcacttaa

SEQ ID NO: 6415015 - DNA, 17 bp, Homo sapiens
tatagcatcttctcatt

SEQ ID NO: 6415016 - DNA, 22 bp, Homo sapiens
tatagcatgaatgtttttagag

SEQ ID NO: 6415017 - DNA, 21 bp, Homo sapiens
tatagcattaataaaactgtg

SEQ ID NO: 6415018 - DNA, 17 bp, Homo sapiens
tatagcattgataatct

SEQ ID NO: 6415019 - DNA, 20 bp, Homo sapiens
tatagcattgataatcttca

SEQ ID NO: 6415020 - DNA, 22 bp, Homo sapiens
tatagcattgataatcttcagg

SEQ ID NO: 6415021 - DNA, 19 bp, Homo sapiens
tatagccaaaaatagctaa

SEQ ID NO: 6415022 - DNA, 18 bp, Homo sapiens
tatagccaactgctaatg

SEQ ID NO: 6415023 - DNA, 19 bp, Homo sapiens
tatagccaactgctaatgc

SEQ ID NO: 6415024 - DNA, 14 bp, Homo sapiens
tatagccatgattt

SEQ ID NO: 6415025 - DNA, 21 bp, Homo sapiens
tatagcccctggtgtgtaaat

SEQ ID NO: 6415026 - DNA, 22 bp, Homo sapiens
tatagccctgccctcccaagtc

SEQ ID NO: 6415027 - DNA, 15 bp, Homo sapiens
tatagccctgtgaag

SEQ ID NO: 6415028 - DNA, 20 bp, Homo sapiens
tatagcctaggtgacagagt

SEQ ID NO: 6415029 - DNA, 19 bp, Homo sapiens
tatagcctatggcagaaaa

SEQ ID NO: 6415030 - DNA, 12 bp, Homo sapiens
tatagcctgcct

SEQ ID NO: 6415031 - DNA, 15 bp, Homo sapiens
tatagcctgcctcag

SEQ ID NO: 6415032 - DNA, 20 bp, Homo sapiens
tatagcctgcctcagtggca

SEQ ID NO: 6415033 - DNA, 15 bp, Homo sapiens
tatagcgcctgtata

SEQ ID NO: 6415034 - DNA, 22 bp, Homo sapiens
tatagcgcctgtataagtagat

SEQ ID NO: 6415035 - DNA, 18 bp, Homo sapiens
tatagctacatgttcttt

SEQ ID NO: 6415036 - DNA, 13 bp, Homo sapiens
tatagctagctat

SEQ ID NO: 6415037 - DNA, 22 bp, Homo sapiens
tatagctaggtgacatatacat

SEQ ID NO: 6415038 - DNA, 16 bp, Homo sapiens
tatagctatcatttct

SEQ ID NO: 6415039 - DNA, 13 bp, Homo sapiens
tatagctcatcac

SEQ ID NO: 6415040 - DNA, 20 bp, Homo sapiens
tatagctcccaaaagaatgg

SEQ ID NO: 6415041 - DNA, 18 bp, Homo sapiens
tatagctctaataagttt

SEQ ID NO: 6415042 - DNA, 20 bp, Homo sapiens
tatagctctaatgtttgcat

SEQ ID NO: 6415043 - DNA, 19 bp, Homo sapiens
tatagctctacacaacatg

SEQ ID NO: 6415044 - DNA, 15 bp, Homo sapiens
tatagctctcatcac

SEQ ID NO: 6415045 - DNA, 17 bp, Homo sapiens
tatagctctcatcacta

SEQ ID NO: 6415046 - DNA, 17 bp, Homo sapiens
tatagctgcttccagtg

SEQ ID NO: 6415047 - DNA, 20 bp, Homo sapiens
tatagctgtattgaatcatg

SEQ ID NO: 6415048 - DNA, 22 bp, Homo sapiens
tatagcttacctgaacaggaat

SEQ ID NO: 6415049 - DNA, 19 bp, Homo sapiens
tatagcttccagattacaa

SEQ ID NO: 6415050 - DNA, 16 bp, Homo sapiens
tataggaacagcccag

SEQ ID NO: 6415051 - DNA, 19 bp, Homo sapiens
tataggaacatatgaaaat

SEQ ID NO: 6415052 - DNA, 14 bp, Homo sapiens
tataggaattgacc

SEQ ID NO: 6415053 - DNA, 19 bp, Homo sapiens
tataggacttaatttagca

SEQ ID NO: 6415054 - DNA, 23 bp, Homo sapiens
tataggagaaagcaaaatacatc

SEQ ID NO: 6415055 - DNA, 17 bp, Homo sapiens
tataggagccccaggca

SEQ ID NO: 6415056 - DNA, 14 bp, Homo sapiens
tataggataaatta

SEQ ID NO: 6415057 - DNA, 22 bp, Homo sapiens
tataggataaattacattaaaa

SEQ ID NO: 6415058 - DNA, 14 bp, Homo sapiens
tataggataagaaa

SEQ ID NO: 6415059 - DNA, 17 bp, Homo sapiens
tataggatagacactgg

SEQ ID NO: 6415060 - DNA, 21 bp, Homo sapiens
tataggatttatttaaaatag

SEQ ID NO: 6415061 - DNA, 15 bp, Homo sapiens
tataggcacctacca

SEQ ID NO: 6415062 - DNA, 17 bp, Homo sapiens
tataggcagcttctaag

SEQ ID NO: 6415063 - DNA, 19 bp, Homo sapiens
tataggcagtagactcatc

SEQ ID NO: 6415064 - DNA, 19 bp, Homo sapiens
tataggcatacctcctatg

SEQ ID NO: 6415065 - DNA, 14 bp, Homo sapiens
tataggccatctgt

SEQ ID NO: 6415066 - DNA, 15 bp, Homo sapiens
tataggccatctgta

SEQ ID NO: 6415067 - DNA, 17 bp, Homo sapiens
tataggccatctgtaaa

SEQ ID NO: 6415068 - DNA, 18 bp, Homo sapiens
tataggccatctgtaaat

SEQ ID NO: 6415069 - DNA, 19 bp, Homo sapiens
tataggccatctgtaaata

SEQ ID NO: 6415070 - DNA, 20 bp, Homo sapiens
tataggctagacttagattc

SEQ ID NO: 6415071 - DNA, 13 bp, Homo sapiens
tataggctatttt

SEQ ID NO: 6415072 - DNA, 15 bp, Homo sapiens
tatagggaattttca

SEQ ID NO: 6415073 - DNA, 21 bp, Homo sapiens
tataggggtcctgggggcagg

SEQ ID NO: 6415074 - DNA, 13 bp, Homo sapiens
tatagggtttgtt

SEQ ID NO: 6415075 - DNA, 17 bp, Homo sapiens
tatagggtttgtttgct

SEQ ID NO: 6415076 - DNA, 15 bp, Homo sapiens
tataggtaacgtgat

SEQ ID NO: 6415077 - DNA, 23 bp, Homo sapiens
tataggtaacgtgattgattcag

SEQ ID NO: 6415078 - DNA, 23 bp, Homo sapiens
tataggtcctgtgttaaacacta

SEQ ID NO: 6415079 - DNA, 16 bp, Homo sapiens
tataggtttattacaa

SEQ ID NO: 6415080 - DNA, 18 bp, Homo sapiens
tataggtttgattcaaca

SEQ ID NO: 6415081 - DNA, 17 bp, Homo sapiens
tataggttttgtttgct

SEQ ID NO: 6415082 - DNA, 20 bp, Homo sapiens
tataggtttttctcatgtat

SEQ ID NO: 6415083 - DNA, 15 bp, Homo sapiens
tatagtaagtgctta

SEQ ID NO: 6415084 - DNA, 12 bp, Homo sapiens
tatagtacatga

SEQ ID NO: 6415085 - DNA, 13 bp, Homo sapiens
tatagtacatgat

SEQ ID NO: 6415086 - DNA, 16 bp, Homo sapiens
tatagtacatgataaa

SEQ ID NO: 6415087 - DNA, 20 bp, Homo sapiens
tatagtaccagaagcaaggt

SEQ ID NO: 6415088 - DNA, 16 bp, Homo sapiens
tatagtactgctttac

SEQ ID NO: 6415089 - DNA, 23 bp, Homo sapiens
tatagtactgctttactgtgtat

SEQ ID NO: 6415090 - DNA, 21 bp, Homo sapiens
tatagtagaaagacatctgcc

SEQ ID NO: 6415091 - DNA, 19 bp, Homo sapiens
tatagtaggggttgaagaa

SEQ ID NO: 6415092 - DNA, 20 bp, Homo sapiens
tatagtaggggttgaagaaa

SEQ ID NO: 6415093 - DNA, 17 bp, Homo sapiens
tatagtagtcaattagt

SEQ ID NO: 6415094 - DNA, 22 bp, Homo sapiens
tatagtagtcaattagtacagt

SEQ ID NO: 6415095 - DNA, 15 bp, Homo sapiens
tatagtatctgtata

SEQ ID NO: 6415096 - DNA, 23 bp, Homo sapiens
tatagtatgatttttacaataat

SEQ ID NO: 6415097 - DNA, 21 bp, Homo sapiens
tatagtatgtgacttttctga

SEQ ID NO: 6415098 - DNA, 16 bp, Homo sapiens
tatagtattaagtgaa

SEQ ID NO: 6415099 - DNA, 17 bp, Homo sapiens
tatagtattaagtgaaa

SEQ ID NO: 6415100 - DNA, 19 bp, Homo sapiens
tatagtattaagtgaaatt

SEQ ID NO: 6415101 - DNA, 18 bp, Homo sapiens
tatagtattagtggaaag

SEQ ID NO: 6415102 - DNA, 20 bp, Homo sapiens
tatagtattcttcttcctga

SEQ ID NO: 6415103 - DNA, 13 bp, Homo sapiens
tatagtatttgaa

SEQ ID NO: 6415104 - DNA, 17 bp, Homo sapiens
tatagtatttgaaaaca

SEQ ID NO: 6415105 - DNA, 20 bp, Homo sapiens
tatagtatttgaaaacagaa

SEQ ID NO: 6415106 - DNA, 19 bp, Homo sapiens
tatagtatttgattcaaaa

SEQ ID NO: 6415107 - DNA, 21 bp, Homo sapiens
tatagtcatttattttaaaaa

SEQ ID NO: 6415108 - DNA, 13 bp, Homo sapiens
tatagtccagctt

SEQ ID NO: 6415109 - DNA, 16 bp, Homo sapiens
tatagtcctatagttt

SEQ ID NO: 6415110 - DNA, 16 bp, Homo sapiens
tatagtctaagactat

SEQ ID NO: 6415111 - DNA, 18 bp, Homo sapiens
tatagtctaagactatat

SEQ ID NO: 6415112 - DNA, 14 bp, Homo sapiens
tatagtctacagtt

SEQ ID NO: 6415113 - DNA, 15 bp, Homo sapiens
tatagtctacagttg

SEQ ID NO: 6415114 - DNA, 13 bp, Homo sapiens
tatagtctattca

SEQ ID NO: 6415115 - DNA, 22 bp, Homo sapiens
tatagtctcaaatcaaatacat

SEQ ID NO: 6415116 - DNA, 14 bp, Homo sapiens
tatagtgaaaaatg

SEQ ID NO: 6415117 - DNA, 13 bp, Homo sapiens
tatagtgaaacat

SEQ ID NO: 6415118 - DNA, 13 bp, Homo sapiens
tatagtgaagtgt

SEQ ID NO: 6415119 - DNA, 22 bp, Homo sapiens
tatagtgaagtgttaatacatc

SEQ ID NO: 6415120 - DNA, 21 bp, Homo sapiens
tatagtgcaatagtgcaacat

SEQ ID NO: 6415121 - DNA, 15 bp, Homo sapiens
tatagtgcaatatat

SEQ ID NO: 6415122 - DNA, 16 bp, Homo sapiens
tatagtgcacaaaatg

SEQ ID NO: 6415123 - DNA, 11 bp, Homo sapiens
tatagtgccta

SEQ ID NO: 6415124 - DNA, 18 bp, Homo sapiens
tatagtgtaataatgtta

SEQ ID NO: 6415125 - DNA, 17 bp, Homo sapiens
tatagtgtagaaaagaa

SEQ ID NO: 6415126 - DNA, 19 bp, Homo sapiens
tatagtgtataccacctgt

SEQ ID NO: 6415127 - DNA, 23 bp, Homo sapiens
tatagtgtataccacctgtacat

SEQ ID NO: 6415128 - DNA, 22 bp, Homo sapiens
tatagtgtccccatgggctccc

SEQ ID NO: 6415129 - DNA, 14 bp, Homo sapiens
tatagtgtgttgtg

SEQ ID NO: 6415130 - DNA, 16 bp, Homo sapiens
tatagtgtgttgtgct

SEQ ID NO: 6415131 - DNA, 16 bp, Homo sapiens
tatagtgttcacaaac

SEQ ID NO: 6415132 - DNA, 20 bp, Homo sapiens
tatagtgttcacaaactgtg

SEQ ID NO: 6415133 - DNA, 17 bp, Homo sapiens
tatagtgttgtgttaca

SEQ ID NO: 6415134 - DNA, 15 bp, Homo sapiens
tatagtgtttaactg

SEQ ID NO: 6415135 - DNA, 12 bp, Homo sapiens
tatagttaaact

SEQ ID NO: 6415136 - DNA, 15 bp, Homo sapiens
tatagttaaactgag

SEQ ID NO: 6415137 - DNA, 16 bp, Homo sapiens
tatagttaaactgaga

SEQ ID NO: 6415138 - DNA, 17 bp, Homo sapiens
tatagttaacacactac

SEQ ID NO: 6415139 - DNA, 19 bp, Homo sapiens
tatagttaatctataacta

SEQ ID NO: 6415140 - DNA, 17 bp, Homo sapiens
tatagttactgtcctgt

SEQ ID NO: 6415141 - DNA, 16 bp, Homo sapiens
tatagttactgtgtaa

SEQ ID NO: 6415142 - DNA, 17 bp, Homo sapiens
tatagttagctttattg

SEQ ID NO: 6415143 - DNA, 16 bp, Homo sapiens
tatagttatatagata

SEQ ID NO: 6415144 - DNA, 16 bp, Homo sapiens
tatagttatatgtaca

SEQ ID NO: 6415145 - DNA, 22 bp, Homo sapiens
tatagttcatagttggaaatat

SEQ ID NO: 6415146 - DNA, 17 bp, Homo sapiens
tatagttccttgcctta

SEQ ID NO: 6415147 - DNA, 12 bp, Homo sapiens
tatagttctaga

SEQ ID NO: 6415148 - DNA, 13 bp, Homo sapiens
tatagttctagac

SEQ ID NO: 6415149 - DNA, 13 bp, Homo sapiens
tatagttgaaagt

SEQ ID NO: 6415150 - DNA, 22 bp, Homo sapiens
tatagttgcttgcctgatataa

SEQ ID NO: 6415151 - DNA, 13 bp, Homo sapiens
tatagttgtattt

SEQ ID NO: 6415152 - DNA, 14 bp, Homo sapiens
tatagttgtatttt

SEQ ID NO: 6415153 - DNA, 16 bp, Homo sapiens
tatagttgtctttctt

SEQ ID NO: 6415154 - DNA, 19 bp, Homo sapiens
tatagttgtctttctttgc

SEQ ID NO: 6415155 - DNA, 22 bp, Homo sapiens
tatagttgtctttctttgctgc

SEQ ID NO: 6415156 - DNA, 21 bp, Homo sapiens
tatagttgtggacatttaaga

SEQ ID NO: 6415157 - DNA, 14 bp, Homo sapiens
tatagtttaaaaca

SEQ ID NO: 6415158 - DNA, 18 bp, Homo sapiens
tatagtttaaaacacatt

SEQ ID NO: 6415159 - DNA, 19 bp, Homo sapiens
tatagtttaaaacacattg

SEQ ID NO: 6415160 - DNA, 17 bp, Homo sapiens
tatagtttatttcccag

SEQ ID NO: 6415161 - DNA, 15 bp, Homo sapiens
tatagtttgggcttc

SEQ ID NO: 6415162 - DNA, 18 bp, Homo sapiens
tatagtttttatattaat

SEQ ID NO: 6415163 - DNA, 13 bp, Homo sapiens
tatagttttttct

SEQ ID NO: 6415164 - DNA, 17 bp, Homo sapiens
tatataaaaaatatatg

SEQ ID NO: 6415165 - DNA, 22 bp, Homo sapiens
tatataaaaaatatatgtaata

SEQ ID NO: 6415166 - DNA, 20 bp, Homo sapiens
tatataaaaagaaaagataa

SEQ ID NO: 6415167 - DNA, 13 bp, Homo sapiens
tatataaaacaaa

SEQ ID NO: 6415168 - DNA, 22 bp, Homo sapiens
tatataaaactaaggcttttat

SEQ ID NO: 6415169 - DNA, 17 bp, Homo sapiens
tatataaaacttaaaaa

SEQ ID NO: 6415170 - DNA, 21 bp, Homo sapiens
tatataaaacttaaaaacaag

SEQ ID NO: 6415171 - DNA, 15 bp, Homo sapiens
tatataaaagaaata

SEQ ID NO: 6415172 - DNA, 19 bp, Homo sapiens
tatataaaagaaatatatc

SEQ ID NO: 6415173 - DNA, 20 bp, Homo sapiens
tatataaaagaaatatatct

SEQ ID NO: 6415174 - DNA, 16 bp, Homo sapiens
tatataaaataaatat

SEQ ID NO: 6415175 - DNA, 22 bp, Homo sapiens
tatataaaataaatatatataa

SEQ ID NO: 6415176 - DNA, 14 bp, Homo sapiens
tccctgatcaagct

SEQ ID NO: 6415177 - DNA, 16 bp, Homo sapiens
tccctgatcccacccc

SEQ ID NO: 6415178 - DNA, 17 bp, Homo sapiens
tccctgatcccaccccc

SEQ ID NO: 6415179 - DNA, 20 bp, Homo sapiens
tccctgatcccagtttctgc

SEQ ID NO: 6415180 - DNA, 14 bp, Homo sapiens
tccctgatcccttc

SEQ ID NO: 6415181 - DNA, 15 bp, Homo sapiens
tccctgatcccttcc

SEQ ID NO: 6415182 - DNA, 16 bp, Homo sapiens
tccctgatggaccctc

SEQ ID NO: 6415183 - DNA, 14 bp, Homo sapiens
tccctgatggcaga

SEQ ID NO: 6415184 - DNA, 21 bp, Homo sapiens
tccctgatggcagaactccca

SEQ ID NO: 6415185 - DNA, 18 bp, Homo sapiens
tccctgatggcctttgga

SEQ ID NO: 6415186 - DNA, 21 bp, Homo sapiens
tccctgatggcctttggaccc

SEQ ID NO: 6415187 - DNA, 19 bp, Homo sapiens
tccctgatgggggacagga

SEQ ID NO: 6415188 - DNA, 19 bp, Homo sapiens
tccctgattaaagtgcctt

SEQ ID NO: 6415189 - DNA, 21 bp, Homo sapiens
tccctgattaaagtgccttca

SEQ ID NO: 6415190 - DNA, 14 bp, Homo sapiens
tccctgattattta

SEQ ID NO: 6415191 - DNA, 16 bp, Homo sapiens
tccctgattatttatc

SEQ ID NO: 6415192 - DNA, 23 bp, Homo sapiens
tccctgattgacctgctccgctg

SEQ ID NO: 6415193 - DNA, 19 bp, Homo sapiens
tccctgcaaaactccaggc

SEQ ID NO: 6415194 - DNA, 18 bp, Homo sapiens
tccctgcacaagccaggg

SEQ ID NO: 6415195 - DNA, 12 bp, Homo sapiens
tccctgcacaca

SEQ ID NO: 6415196 - DNA, 15 bp, Homo sapiens
tccctgcacagcctc

SEQ ID NO: 6415197 - DNA, 23 bp, Homo sapiens
tccctgcacagtgacttctgaga

SEQ ID NO: 6415198 - DNA, 18 bp, Homo sapiens
tccctgcacataaactcc

SEQ ID NO: 6415199 - DNA, 11 bp, Homo sapiens
tccctgcaccg

SEQ ID NO: 6415200 - DNA, 19 bp, Homo sapiens
tccctgcacggcccaaggg

SEQ ID NO: 6415201 - DNA, 20 bp, Homo sapiens
tccctgcactaaagccagcc

SEQ ID NO: 6415202 - DNA, 14 bp, Homo sapiens
tccctgcactgtgc

SEQ ID NO: 6415203 - DNA, 13 bp, Homo sapiens
tccctgcacttca

SEQ ID NO: 6415204 - DNA, 13 bp, Homo sapiens
tccctgcacttgc

SEQ ID NO: 6415205 - DNA, 20 bp, Homo sapiens
tccctgcacttgcagactct

SEQ ID NO: 6415206 - DNA, 20 bp, Homo sapiens
tccctgcagaagccagaagg

SEQ ID NO: 6415207 - DNA, 16 bp, Homo sapiens
tccctgcagatgccac

SEQ ID NO: 6415208 - DNA, 21 bp, Homo sapiens
tccctgcagccaccagacttg

SEQ ID NO: 6415209 - DNA, 13 bp, Homo sapiens
tccctgcagctga

SEQ ID NO: 6415210 - DNA, 21 bp, Homo sapiens
tccctgcagctttgaggctgg

SEQ ID NO: 6415211 - DNA, 10 bp, Homo sapiens
tccctgcagg

SEQ ID NO: 6415212 - DNA, 11 bp, Homo sapiens
tccctgcaggg

SEQ ID NO: 6415213 - DNA, 22 bp, Homo sapiens
tccctgcagggcgcccctggga

SEQ ID NO: 6415214 - DNA, 20 bp, Homo sapiens
tccctgcatatgcttctgat

SEQ ID NO: 6415215 - DNA, 15 bp, Homo sapiens
tccctgcatcctgag

SEQ ID NO: 6415216 - DNA, 16 bp, Homo sapiens
tccctgcatcctgagg

SEQ ID NO: 6415217 - DNA, 17 bp, Homo sapiens
tccctgcatcctgaggc

SEQ ID NO: 6415218 - DNA, 19 bp, Homo sapiens
tccctgcatcctgaggcca

SEQ ID NO: 6415219 - DNA, 20 bp, Homo sapiens
tccctgcatctgaccagcag

SEQ ID NO: 6415220 - DNA, 21 bp, Homo sapiens
tccctgcatggcatcctccag

SEQ ID NO: 6415221 - DNA, 10 bp, Homo sapiens
tccctgccaa

SEQ ID NO: 6415222 - DNA, 15 bp, Homo sapiens
tccctgccaaactga

SEQ ID NO: 6415223 - DNA, 15 bp, Homo sapiens
tccctgccaactcca

SEQ ID NO: 6415224 - DNA, 24 bp, Homo sapiens
tccctgccaactccatgaccaggc

SEQ ID NO: 6415225 - DNA, 19 bp, Homo sapiens
tccctgccaagtctcagaa

SEQ ID NO: 6415226 - DNA, 19 bp, Homo sapiens
tccctgccaatgctccagc

SEQ ID NO: 6415227 - DNA, 21 bp, Homo sapiens
tccctgccacactcagtcccc

SEQ ID NO: 6415228 - DNA, 13 bp, Homo sapiens
tccctgccactgg

SEQ ID NO: 6415229 - DNA, 14 bp, Homo sapiens
tccctgccactggg

SEQ ID NO: 6415230 - DNA, 15 bp, Homo sapiens
tccctgccactgggc

SEQ ID NO: 6415231 - DNA, 19 bp, Homo sapiens
tccctgccactgggctctg

SEQ ID NO: 6415232 - DNA, 18 bp, Homo sapiens
tccctgccagcaccccca

SEQ ID NO: 6415233 - DNA, 17 bp, Homo sapiens
tccctgccatccccctc

SEQ ID NO: 6415234 - DNA, 21 bp, Homo sapiens
tccctgccattttttaagaga

SEQ ID NO: 6415235 - DNA, 11 bp, Homo sapiens
tccctgcccaa

SEQ ID NO: 6415236 - DNA, 19 bp, Homo sapiens
tccctgcccaaactcccct

SEQ ID NO: 6415237 - DNA, 13 bp, Homo sapiens
tccctgcccaggc

SEQ ID NO: 6415238 - DNA, 14 bp, Homo sapiens
tccctgcccatccg

SEQ ID NO: 6415239 - DNA, 13 bp, Homo sapiens
tccctgcccccca

SEQ ID NO: 6415240 - DNA, 18 bp, Homo sapiens
tccctgcccctcccttca

SEQ ID NO: 6415241 - DNA, 20 bp, Homo sapiens
tccctgcccctcccttcaac

SEQ ID NO: 6415242 - DNA, 14 bp, Homo sapiens
tccctgcccctgtc

SEQ ID NO: 6415243 - DNA, 22 bp, Homo sapiens
tccctgcccctgtgcctctgtc

SEQ ID NO: 6415244 - DNA, 16 bp, Homo sapiens
tccctgccctcccctg

SEQ ID NO: 6415245 - DNA, 17 bp, Homo sapiens
tccctgccctcccctgc

SEQ ID NO: 6415246 - DNA, 18 bp, Homo sapiens
tccctgccctcgggtctc

SEQ ID NO: 6415247 - DNA, 17 bp, Homo sapiens
tccctgccctgtcctcc

SEQ ID NO: 6415248 - DNA, 18 bp, Homo sapiens
tccctgccctgtcctcca

SEQ ID NO: 6415249 - DNA, 17 bp, Homo sapiens
tccctgccgaacacaca

SEQ ID NO: 6415250 - DNA, 15 bp, Homo sapiens
tccctgcctaaggaa

SEQ ID NO: 6415251 - DNA, 18 bp, Homo sapiens
tccctgcctaggagctgg

SEQ ID NO: 6415252 - DNA, 20 bp, Homo sapiens
tccctgcctaggagctgggg

SEQ ID NO: 6415253 - DNA, 10 bp, Homo sapiens
tccctgcctc

SEQ ID NO: 6415254 - DNA, 16 bp, Homo sapiens
tccctgcctcacatct

SEQ ID NO: 6415255 - DNA, 19 bp, Homo sapiens
tccctgcctcacatctccc

SEQ ID NO: 6415256 - DNA, 16 bp, Homo sapiens
tccctgcctcactcct

SEQ ID NO: 6415257 - DNA, 18 bp, Homo sapiens
tccctgcctcaggccaag

SEQ ID NO: 6415258 - DNA, 16 bp, Homo sapiens
tccctgcctcaggcct

SEQ ID NO: 6415259 - DNA, 18 bp, Homo sapiens
tccctgcctccacccaca

SEQ ID NO: 6415260 - DNA, 19 bp, Homo sapiens
tccctgcctccagctgtca

SEQ ID NO: 6415261 - DNA, 14 bp, Homo sapiens
tccctgcctcctgc

SEQ ID NO: 6415262 - DNA, 16 bp, Homo sapiens
tccctgcctcctgccg

SEQ ID NO: 6415263 - DNA, 13 bp, Homo sapiens
tccctgcctggag

SEQ ID NO: 6415264 - DNA, 14 bp, Homo sapiens
tccctgcctggagg

SEQ ID NO: 6415265 - DNA, 15 bp, Homo sapiens
tccctgcctggaggc

SEQ ID NO: 6415266 - DNA, 13 bp, Homo sapiens
tccctgcctggcc

SEQ ID NO: 6415267 - DNA, 14 bp, Homo sapiens
tccctgcctggccc

SEQ ID NO: 6415268 - DNA, 16 bp, Homo sapiens
tccctgcctggccctc

SEQ ID NO: 6415269 - DNA, 15 bp, Homo sapiens
tccctgcctggtcac

SEQ ID NO: 6415270 - DNA, 16 bp, Homo sapiens
tccctgcctgtttccc

SEQ ID NO: 6415271 - DNA, 19 bp, Homo sapiens
tccctgccttcactgtgct

SEQ ID NO: 6415272 - DNA, 21 bp, Homo sapiens
tccctgccttgctgacaataa

SEQ ID NO: 6415273 - DNA, 11 bp, Homo sapiens
tccctgccttt

SEQ ID NO: 6415274 - DNA, 19 bp, Homo sapiens
tccctgcctttaaggagaa

SEQ ID NO: 6415275 - DNA, 19 bp, Homo sapiens
tccctgcgagacgcacaca

SEQ ID NO: 6415276 - DNA, 15 bp, Homo sapiens
tccctgcgcctttcc

SEQ ID NO: 6415277 - DNA, 18 bp, Homo sapiens
tccctgcgcgcagctggc

SEQ ID NO: 6415278 - DNA, 16 bp, Homo sapiens
tccctgcgcttcctga

SEQ ID NO: 6415279 - DNA, 21 bp, Homo sapiens
tccctgcggaagccacagggt

SEQ ID NO: 6415280 - DNA, 22 bp, Homo sapiens
tccctgcggaagccacagggtg

SEQ ID NO: 6415281 - DNA, 17 bp, Homo sapiens
tccctgcgtctcctgcc

SEQ ID NO: 6415282 - DNA, 18 bp, Homo sapiens
tccctgctagcacagagg

SEQ ID NO: 6415283 - DNA, 22 bp, Homo sapiens
tccctgctagcacagaggcctg

SEQ ID NO: 6415284 - DNA, 13 bp, Homo sapiens
tccctgctcagct

SEQ ID NO: 6415285 - DNA, 12 bp, Homo sapiens
tccctgctcccc

SEQ ID NO: 6415286 - DNA, 13 bp, Homo sapiens
tccctgctcccct

SEQ ID NO: 6415287 - DNA, 16 bp, Homo sapiens
tccctgctcccctttg

SEQ ID NO: 6415288 - DNA, 12 bp, Homo sapiens
tccctgctcctc

SEQ ID NO: 6415289 - DNA, 18 bp, Homo sapiens
tccctgctcctcatggga

SEQ ID NO: 6415290 - DNA, 21 bp, Homo sapiens
tccctgctctaacacctgcct

SEQ ID NO: 6415291 - DNA, 16 bp, Homo sapiens
tccctgctctctgagt

SEQ ID NO: 6415292 - DNA, 14 bp, Homo sapiens
tccctgctctggtc

SEQ ID NO: 6415293 - DNA, 12 bp, Homo sapiens
tccctgctgaat

SEQ ID NO: 6415294 - DNA, 15 bp, Homo sapiens
tccctgctgaatgcc

SEQ ID NO: 6415295 - DNA, 15 bp, Homo sapiens
tccctgctgccagct

SEQ ID NO: 6415296 - DNA, 16 bp, Homo sapiens
tccctgctgccaggct

SEQ ID NO: 6415297 - DNA, 22 bp, Homo sapiens
tccctgctgccaggctcccact

SEQ ID NO: 6415298 - DNA, 15 bp, Homo sapiens
tccctgctgcgctgc

SEQ ID NO: 6415299 - DNA, 16 bp, Homo sapiens
tccctgctgcgctgct

SEQ ID NO: 6415300 - DNA, 17 bp, Homo sapiens
tccctgctgcgctgctt

SEQ ID NO: 6415301 - DNA, 14 bp, Homo sapiens
tccctgctggggaa

SEQ ID NO: 6415302 - DNA, 20 bp, Homo sapiens
tccctgctgtatcttccaga

SEQ ID NO: 6415303 - DNA, 22 bp, Homo sapiens
tccctgctgtcattgcttcttc

SEQ ID NO: 6415304 - DNA, 14 bp, Homo sapiens
tccctgctgtcccc

SEQ ID NO: 6415305 - DNA, 22 bp, Homo sapiens
tccctgctgtcccctcttgccc

SEQ ID NO: 6415306 - DNA, 20 bp, Homo sapiens
tccctgctgtgccatgctgg

SEQ ID NO: 6415307 - DNA, 22 bp, Homo sapiens
tccctgcttcatatctctccct

SEQ ID NO: 6415308 - DNA, 19 bp, Homo sapiens
tccctgcttgcacacttcc

SEQ ID NO: 6415309 - DNA, 22 bp, Homo sapiens
tccctgcttgcacacttcccca

SEQ ID NO: 6415310 - DNA, 21 bp, Homo sapiens
tccctgcttgcaggaggccaa

SEQ ID NO: 6415311 - DNA, 20 bp, Homo sapiens
tccctgcttgcccgctccca

SEQ ID NO: 6415312 - DNA, 21 bp, Homo sapiens
tccctgcttggcttatgaaaa

SEQ ID NO: 6415313 - DNA, 17 bp, Homo sapiens
tccctgctttgcatctt

SEQ ID NO: 6415314 - DNA, 23 bp, Homo sapiens
tccctgcttttctcccagaaggc

SEQ ID NO: 6415315 - DNA, 20 bp, Homo sapiens
tccctggaaaaggagcttca

SEQ ID NO: 6415316 - DNA, 23 bp, Homo sapiens
tccctggaaaccttccacccagt

SEQ ID NO: 6415317 - DNA, 17 bp, Homo sapiens
tccctggaagctggaag

SEQ ID NO: 6415318 - DNA, 18 bp, Homo sapiens
tccctggaagcttaaagt

SEQ ID NO: 6415319 - DNA, 22 bp, Homo sapiens
tccctggaatgagttgaggcca

SEQ ID NO: 6415320 - DNA, 14 bp, Homo sapiens
tccctggaattcac

SEQ ID NO: 6415321 - DNA, 14 bp, Homo sapiens
tccctggacacagc

SEQ ID NO: 6415322 - DNA, 16 bp, Homo sapiens
tccctggacacagctc

SEQ ID NO: 6415323 - DNA, 21 bp, Homo sapiens
tccctggacacagctcttcat

SEQ ID NO: 6415324 - DNA, 16 bp, Homo sapiens
tccctggacagagcta

SEQ ID NO: 6415325 - DNA, 11 bp, Homo sapiens
tccctggacca

SEQ ID NO: 6415326 - DNA, 18 bp, Homo sapiens
tccctggacgcatgcagg

SEQ ID NO: 6415327 - DNA, 22 bp, Homo sapiens
tccctggacgcatgcagggccc

SEQ ID NO: 6415328 - DNA, 19 bp, Homo sapiens
tccctggagaagcaccagc

SEQ ID NO: 6415329 - DNA, 18 bp, Homo sapiens
tccctggagcaggagccc

SEQ ID NO: 6415330 - DNA, 17 bp, Homo sapiens
tccctggagccagactc

SEQ ID NO: 6415331 - DNA, 12 bp, Homo sapiens
tccctggagccc

SEQ ID NO: 6415332 - DNA, 14 bp, Homo sapiens
tccctggagccctg

SEQ ID NO: 6415333 - DNA, 15 bp, Homo sapiens
tccctggagccctgt

SEQ ID NO: 6415334 - DNA, 21 bp, Homo sapiens
tccctggagcctccactgcct

SEQ ID NO: 6415335 - DNA, 13 bp, Homo sapiens
tccctggagctgt

SEQ ID NO: 6415336 - DNA, 20 bp, Homo sapiens
tccctggaggcacgcaccac

SEQ ID NO: 6415337 - DNA, 22 bp, Homo sapiens
tccctggaggcacgcaccactg

SEQ ID NO: 6415338 - DNA, 22 bp, Homo sapiens
tccctggagggcaagccctgcc

SEQ ID NO: 6415339 - DNA, 19 bp, Homo sapiens
tccctggaggtctctccct

SEQ ID NO: 6415340 - DNA, 16 bp, Homo sapiens
tccctggagtcagttt

SEQ ID NO: 6415341 - DNA, 11 bp, Homo sapiens
tccctggagtg

SEQ ID NO: 6415342 - DNA, 21 bp, Homo sapiens
tccctggatctacctggaggg

SEQ ID NO: 6415343 - DNA, 23 bp, Homo sapiens
tccctggatgtgaagctcacact

SEQ ID NO: 6415344 - DNA, 17 bp, Homo sapiens
tccctggatttttacca

SEQ ID NO: 6415345 - DNA, 20 bp, Homo sapiens
tccctggatttttaccagtc

SEQ ID NO: 6415346 - DNA, 18 bp, Homo sapiens
tccctggcaaggagaata

SEQ ID NO: 6415347 - DNA, 18 bp, Homo sapiens
tccctggcatgtcagagc

SEQ ID NO: 6415348 - DNA, 23 bp, Homo sapiens
tccctggcatgtcagagccaggc

SEQ ID NO: 6415349 - DNA, 18 bp, Homo sapiens
tccctggccacctgccag

SEQ ID NO: 6415350 - DNA, 14 bp, Homo sapiens
tccctggccactga

SEQ ID NO: 6415351 - DNA, 15 bp, Homo sapiens
tccctggccatctct

SEQ ID NO: 6415352 - DNA, 21 bp, Homo sapiens
tccctggccgcttctccccag

SEQ ID NO: 6415353 - DNA, 17 bp, Homo sapiens
tccctggcctcagggct

SEQ ID NO: 6415354 - DNA, 14 bp, Homo sapiens
tccctggcctggct

SEQ ID NO: 6415355 - DNA, 14 bp, Homo sapiens
tccctggcctgttc

SEQ ID NO: 6415356 - DNA, 14 bp, Homo sapiens
tatataaaataact

SEQ ID NO: 6415357 - DNA, 13 bp, Homo sapiens
tatataaaataca

SEQ ID NO: 6415358 - DNA, 17 bp, Homo sapiens
tatataaaatacacgtg

SEQ ID NO: 6415359 - DNA, 23 bp, Homo sapiens
tatataaaatgtgcgaggatcct

SEQ ID NO: 6415360 - DNA, 23 bp, Homo sapiens
tatataaaatgtggccaagaaga

SEQ ID NO: 6415361 - DNA, 16 bp, Homo sapiens
tatataaacaaacaaa

SEQ ID NO: 6415362 - DNA, 11 bp, Homo sapiens
tatataaacat

SEQ ID NO: 6415363 - DNA, 15 bp, Homo sapiens
tatataaacctaaaa

SEQ ID NO: 6415364 - DNA, 21 bp, Homo sapiens
tatataaacgatatatgtaaa

SEQ ID NO: 6415365 - DNA, 12 bp, Homo sapiens
tatataaagaaa

SEQ ID NO: 6415366 - DNA, 14 bp, Homo sapiens
tatataaagaaaat

SEQ ID NO: 6415367 - DNA, 19 bp, Homo sapiens
tatataaagacaacaaaag

SEQ ID NO: 6415368 - DNA, 18 bp, Homo sapiens
tatataaagcacagattt

SEQ ID NO: 6415369 - DNA, 14 bp, Homo sapiens
tatataaaggcaag

SEQ ID NO: 6415370 - DNA, 17 bp, Homo sapiens
tatataaagtatatgtt

SEQ ID NO: 6415371 - DNA, 19 bp, Homo sapiens
tatataaagtattcttttt

SEQ ID NO: 6415372 - DNA, 14 bp, Homo sapiens
tatataaagtattt

SEQ ID NO: 6415373 - DNA, 12 bp, Homo sapiens
tatataaagtta

SEQ ID NO: 6415374 - DNA, 22 bp, Homo sapiens
tatataaagtttttttatttct

SEQ ID NO: 6415375 - DNA, 17 bp, Homo sapiens
tatataaataaagcaaa

SEQ ID NO: 6415376 - DNA, 16 bp, Homo sapiens
tatataaataaatata

SEQ ID NO: 6415377 - DNA, 15 bp, Homo sapiens
tatataaatactata

SEQ ID NO: 6415378 - DNA, 12 bp, Homo sapiens
tatataaatata

SEQ ID NO: 6415379 - DNA, 16 bp, Homo sapiens
tatataaatatatata

SEQ ID NO: 6415380 - DNA, 13 bp, Homo sapiens
tatataaatcatt

SEQ ID NO: 6415381 - DNA, 18 bp, Homo sapiens
tatataaatgtaaaaata

SEQ ID NO: 6415382 - DNA, 14 bp, Homo sapiens
tatataacaaaaaa

SEQ ID NO: 6415383 - DNA, 24 bp, Homo sapiens
tatataaccttcatttttaagact

SEQ ID NO: 6415384 - DNA, 13 bp, Homo sapiens
tatataactcttt

SEQ ID NO: 6415385 - DNA, 14 bp, Homo sapiens
tatataactttttt

SEQ ID NO: 6415386 - DNA, 14 bp, Homo sapiens
tatataagaaagac

SEQ ID NO: 6415387 - DNA, 17 bp, Homo sapiens
tatataagaaagacatc

SEQ ID NO: 6415388 - DNA, 18 bp, Homo sapiens
tatataagactgctgcag

SEQ ID NO: 6415389 - DNA, 19 bp, Homo sapiens
tatataagactgctgcagt

SEQ ID NO: 6415390 - DNA, 12 bp, Homo sapiens
tatataagcttt

SEQ ID NO: 6415391 - DNA, 21 bp, Homo sapiens
tatataaggcattctgtataa

SEQ ID NO: 6415392 - DNA, 18 bp, Homo sapiens
tatataagtattctaaat

SEQ ID NO: 6415393 - DNA, 17 bp, Homo sapiens
tatataagttaaagaga

SEQ ID NO: 6415394 - DNA, 14 bp, Homo sapiens
tatataataaagta

SEQ ID NO: 6415395 - DNA, 14 bp, Homo sapiens
tatataataacttt

SEQ ID NO: 6415396 - DNA, 22 bp, Homo sapiens
tatataataactttattgcata

SEQ ID NO: 6415397 - DNA, 14 bp, Homo sapiens
tatataatactaaa

SEQ ID NO: 6415398 - DNA, 19 bp, Homo sapiens
tatataatactaaagtgtc

SEQ ID NO: 6415399 - DNA, 15 bp, Homo sapiens
tatataatacttaaa

SEQ ID NO: 6415400 - DNA, 12 bp, Homo sapiens
tatataatatct

SEQ ID NO: 6415401 - DNA, 16 bp, Homo sapiens
tatataatcatcaagt

SEQ ID NO: 6415402 - DNA, 20 bp, Homo sapiens
tatataatcatgctcatgta

SEQ ID NO: 6415403 - DNA, 19 bp, Homo sapiens
tatataatggtttcaaaga

SEQ ID NO: 6415404 - DNA, 14 bp, Homo sapiens
tatataatgtatat

SEQ ID NO: 6415405 - DNA, 15 bp, Homo sapiens
tatataatgtatata

SEQ ID NO: 6415406 - DNA, 22 bp, Homo sapiens
tatataattacatatttgcata

SEQ ID NO: 6415407 - DNA, 13 bp, Homo sapiens
tatataattcact

SEQ ID NO: 6415408 - DNA, 14 bp, Homo sapiens
tatataattctgta

SEQ ID NO: 6415409 - DNA, 19 bp, Homo sapiens
tatataatttaatgtaaat

SEQ ID NO: 6415410 - DNA, 14 bp, Homo sapiens
tatataatttactt

SEQ ID NO: 6415411 - DNA, 17 bp, Homo sapiens
tatataatttactttgt

SEQ ID NO: 6415412 - DNA, 18 bp, Homo sapiens
tatatacacacacaaaga

SEQ ID NO: 6415413 - DNA, 15 bp, Homo sapiens
tatatacacacatgt

SEQ ID NO: 6415414 - DNA, 14 bp, Homo sapiens
tatatacacataca

SEQ ID NO: 6415415 - DNA, 18 bp, Homo sapiens
tatatacacatacataca

SEQ ID NO: 6415416 - DNA, 14 bp, Homo sapiens
tatatacacatata

SEQ ID NO: 6415417 - DNA, 18 bp, Homo sapiens
tatatacacatataccta

SEQ ID NO: 6415418 - DNA, 14 bp, Homo sapiens
tatatacagagcct

SEQ ID NO: 6415419 - DNA, 14 bp, Homo sapiens
tatatacagtaact

SEQ ID NO: 6415420 - DNA, 17 bp, Homo sapiens
tatatacagtaacttta

SEQ ID NO: 6415421 - DNA, 23 bp, Homo sapiens
tatatacagtaactttatgtgta

SEQ ID NO: 6415422 - DNA, 19 bp, Homo sapiens
tatatacagttattttgga

SEQ ID NO: 6415423 - DNA, 21 bp, Homo sapiens
tatatacagttattttggata

SEQ ID NO: 6415424 - DNA, 16 bp, Homo sapiens
tatatacatatgtaga

SEQ ID NO: 6415425 - DNA, 19 bp, Homo sapiens
tatatacatattataaata

SEQ ID NO: 6415426 - DNA, 21 bp, Homo sapiens
tatatacatattataaataaa

SEQ ID NO: 6415427 - DNA, 19 bp, Homo sapiens
tatatacatattcaaagta

SEQ ID NO: 6415428 - DNA, 21 bp, Homo sapiens
tatatacatcatacttaactt

SEQ ID NO: 6415429 - DNA, 13 bp, Homo sapiens
tatatacatctct

SEQ ID NO: 6415430 - DNA, 17 bp, Homo sapiens
tatatacatgtatagtg

SEQ ID NO: 6415431 - DNA, 14 bp, Homo sapiens
tatatacatgtgtg

SEQ ID NO: 6415432 - DNA, 17 bp, Homo sapiens
tatatacatgtgtgtat

SEQ ID NO: 6415433 - DNA, 15 bp, Homo sapiens
tatatacattagaca

SEQ ID NO: 6415434 - DNA, 21 bp, Homo sapiens
tatatacatttatgaattaaa

SEQ ID NO: 6415435 - DNA, 16 bp, Homo sapiens
tatataccaaagcaca

SEQ ID NO: 6415436 - DNA, 21 bp, Homo sapiens
tatataccaaagcacatttta

SEQ ID NO: 6415437 - DNA, 22 bp, Homo sapiens
tatatacctggcttttacttta

SEQ ID NO: 6415438 - DNA, 20 bp, Homo sapiens
tatatacgtatgtatataca

SEQ ID NO: 6415439 - DNA, 13 bp, Homo sapiens
tatatactacatg

SEQ ID NO: 6415440 - DNA, 18 bp, Homo sapiens
tatatactatatgaaaag

SEQ ID NO: 6415441 - DNA, 20 bp, Homo sapiens
tatatactcaagagtggtat

SEQ ID NO: 6415442 - DNA, 19 bp, Homo sapiens
tatatactgggttcttgtt

SEQ ID NO: 6415443 - DNA, 12 bp, Homo sapiens
tatatactgtgt

SEQ ID NO: 6415444 - DNA, 17 bp, Homo sapiens
tatatacttaataaaac

SEQ ID NO: 6415445 - DNA, 16 bp, Homo sapiens
tatatactttgccact

SEQ ID NO: 6415446 - DNA, 14 bp, Homo sapiens
tatatacttttaaa

SEQ ID NO: 6415447 - DNA, 17 bp, Homo sapiens
tatatacttttaaatta

SEQ ID NO: 6415448 - DNA, 21 bp, Homo sapiens
tatatagaatgatctattgct

SEQ ID NO: 6415449 - DNA, 18 bp, Homo sapiens
tatatagaattgtagact

SEQ ID NO: 6415450 - DNA, 19 bp, Homo sapiens
tatatagagatgtttttaa

SEQ ID NO: 6415451 - DNA, 22 bp, Homo sapiens
tatatagagattgtacatttat

SEQ ID NO: 6415452 - DNA, 19 bp, Homo sapiens
tatatagatgtcagcaatt

SEQ ID NO: 6415453 - DNA, 20 bp, Homo sapiens
tatatagatgtctgtgtata

SEQ ID NO: 6415454 - DNA, 21 bp, Homo sapiens
tatatagatgtctgtgtatac

SEQ ID NO: 6415455 - DNA, 23 bp, Homo sapiens
tatatagatgtctgtgtatacat

SEQ ID NO: 6415456 - DNA, 13 bp, Homo sapiens
tatatagatgtgc

SEQ ID NO: 6415457 - DNA, 16 bp, Homo sapiens
tatatagatgtgcaag

SEQ ID NO: 6415458 - DNA, 18 bp, Homo sapiens
tatatagcaaaatgattc

SEQ ID NO: 6415459 - DNA, 18 bp, Homo sapiens
tatatagcaaagatatat

SEQ ID NO: 6415460 - DNA, 18 bp, Homo sapiens
tatatagcaagacattat

SEQ ID NO: 6415461 - DNA, 20 bp, Homo sapiens
tatatagcaagacattatat

SEQ ID NO: 6415462 - DNA, 21 bp, Homo sapiens
tatatagcaagtgctatttca

SEQ ID NO: 6415463 - DNA, 18 bp, Homo sapiens
tatatagcagcaaaaata

SEQ ID NO: 6415464 - DNA, 16 bp, Homo sapiens
tatatagcagtaaaaa

SEQ ID NO: 6415465 - DNA, 21 bp, Homo sapiens
tatatagcatctggaagatca

SEQ ID NO: 6415466 - DNA, 18 bp, Homo sapiens
tatatagcatttatggta

SEQ ID NO: 6415467 - DNA, 18 bp, Homo sapiens
tatataggatattgctaa

SEQ ID NO: 6415468 - DNA, 12 bp, Homo sapiens
tatataggtttt

SEQ ID NO: 6415469 - DNA, 21 bp, Homo sapiens
tatataggttttgtttgctat

SEQ ID NO: 6415470 - DNA, 17 bp, Homo sapiens
tatatagtacctttgct

SEQ ID NO: 6415471 - DNA, 18 bp, Homo sapiens
tatatagtatatttatac

SEQ ID NO: 6415472 - DNA, 19 bp, Homo sapiens
tatatagtatatttatact

SEQ ID NO: 6415473 - DNA, 16 bp, Homo sapiens
tatatagtctacagtt

SEQ ID NO: 6415474 - DNA, 10 bp, Homo sapiens
tatatataaa

SEQ ID NO: 6415475 - DNA, 12 bp, Homo sapiens
tatatataaaat

SEQ ID NO: 6415476 - DNA, 19 bp, Homo sapiens
tatatataaaataaatata

SEQ ID NO: 6415477 - DNA, 12 bp, Homo sapiens
tatatataaacc

SEQ ID NO: 6415478 - DNA, 12 bp, Homo sapiens
tatatataaaga

SEQ ID NO: 6415479 - DNA, 14 bp, Homo sapiens
tatatataaagaat

SEQ ID NO: 6415480 - DNA, 13 bp, Homo sapiens
tatatataaatat

SEQ ID NO: 6415481 - DNA, 18 bp, Homo sapiens
tatatataaatatctatt

SEQ ID NO: 6415482 - DNA, 15 bp, Homo sapiens
tatatataaatgtat

SEQ ID NO: 6415483 - DNA, 17 bp, Homo sapiens
tatatataatatgtata

SEQ ID NO: 6415484 - DNA, 19 bp, Homo sapiens
tatatataattctgtacat

SEQ ID NO: 6415485 - DNA, 14 bp, Homo sapiens
tatatatacaatat

SEQ ID NO: 6415486 - DNA, 15 bp, Homo sapiens
tatatatacacatac

SEQ ID NO: 6415487 - DNA, 17 bp, Homo sapiens
tatatatacacatacat

SEQ ID NO: 6415488 - DNA, 11 bp, Homo sapiens
tatatatacat

SEQ ID NO: 6415489 - DNA, 14 bp, Homo sapiens
tatatatacatata

SEQ ID NO: 6415490 - DNA, 14 bp, Homo sapiens
tatatatacatcat

SEQ ID NO: 6415491 - DNA, 12 bp, Homo sapiens
tatatatacatt

SEQ ID NO: 6415492 - DNA, 14 bp, Homo sapiens
tatatatacattag

SEQ ID NO: 6415493 - DNA, 14 bp, Homo sapiens
tatatatactggaa

SEQ ID NO: 6415494 - DNA, 13 bp, Homo sapiens
tatatatagaaaa

SEQ ID NO: 6415495 - DNA, 16 bp, Homo sapiens
tatatatagcagcttt

SEQ ID NO: 6415496 - DNA, 15 bp, Homo sapiens
tatatatagttagat

SEQ ID NO: 6415497 - DNA, 14 bp, Homo sapiens
tatatatataaaat

SEQ ID NO: 6415498 - DNA, 14 bp, Homo sapiens
tatatatataaaca

SEQ ID NO: 6415499 - DNA, 15 bp, Homo sapiens
tatatatatacacac

SEQ ID NO: 6415500 - DNA, 14 bp, Homo sapiens
tatatatatataaa

SEQ ID NO: 6415501 - DNA, 14 bp, Homo sapiens
tatatatatatata

SEQ ID NO: 6415502 - DNA, 15 bp, Homo sapiens
tatatatatatgtac

SEQ ID NO: 6415503 - DNA, 16 bp, Homo sapiens
tatatatatatgtata

SEQ ID NO: 6415504 - DNA, 15 bp, Homo sapiens
tatatatatatgtgt

SEQ ID NO: 6415505 - DNA, 14 bp, Homo sapiens
tatatatatattta

SEQ ID NO: 6415506 - DNA, 13 bp, Homo sapiens
tatatatatcagt

SEQ ID NO: 6415507 - DNA, 13 bp, Homo sapiens
tatatatatctat

SEQ ID NO: 6415508 - DNA, 13 bp, Homo sapiens
tatatatatctgt

SEQ ID NO: 6415509 - DNA, 13 bp, Homo sapiens
tatatatatgcat

SEQ ID NO: 6415510 - DNA, 14 bp, Homo sapiens
tatatatatgtata

SEQ ID NO: 6415511 - DNA, 14 bp, Homo sapiens
tatatatatgtgaa

SEQ ID NO: 6415512 - DNA, 13 bp, Homo sapiens
tatatatcaaata

SEQ ID NO: 6415513 - DNA, 16 bp, Homo sapiens
tatatatcaggtaaaa

SEQ ID NO: 6415514 - DNA, 15 bp, Homo sapiens
tatatatcataaagt

SEQ ID NO: 6415515 - DNA, 12 bp, Homo sapiens
tatatatcctat

SEQ ID NO: 6415516 - DNA, 20 bp, Homo sapiens
tatatatctaagttcacagt

SEQ ID NO: 6415517 - DNA, 20 bp, Homo sapiens
tatatatctgagttgtgcct

SEQ ID NO: 6415518 - DNA, 18 bp, Homo sapiens
tatatatctgataaaatt

SEQ ID NO: 6415519 - DNA, 18 bp, Homo sapiens
tatatatctgctgtccag

SEQ ID NO: 6415520 - DNA, 16 bp, Homo sapiens
tatatatcttttgtaa

SEQ ID NO: 6415521 - DNA, 22 bp, Homo sapiens
tatatatgaaaactatacaaca

SEQ ID NO: 6415522 - DNA, 14 bp, Homo sapiens
tatatatgaagttg

SEQ ID NO: 6415523 - DNA, 19 bp, Homo sapiens
tatatatgaataattatgt

SEQ ID NO: 6415524 - DNA, 16 bp, Homo sapiens
tatatatgaatattac

SEQ ID NO: 6415525 - DNA, 14 bp, Homo sapiens
tatatatgatcatt

SEQ ID NO: 6415526 - DNA, 20 bp, Homo sapiens
tatatatgatcattgaaata

SEQ ID NO: 6415527 - DNA, 17 bp, Homo sapiens
tatatatgatgtggaca

SEQ ID NO: 6415528 - DNA, 14 bp, Homo sapiens
tatatatgccttat

SEQ ID NO: 6415529 - DNA, 15 bp, Homo sapiens
tatatatggatcaga

SEQ ID NO: 6415530 - DNA, 22 bp, Homo sapiens
tatatatggggatggtagtttt

SEQ ID NO: 6415531 - DNA, 19 bp, Homo sapiens
tatatatggtcatatacat

SEQ ID NO: 6415532 - DNA, 14 bp, Homo sapiens
tatatatgtacagt

SEQ ID NO: 6415533 - DNA, 21 bp, Homo sapiens
tatatatgtacagttatacat

SEQ ID NO: 6415534 - DNA, 18 bp, Homo sapiens
tatatatgtagagaaaga

SEQ ID NO: 6415535 - DNA, 18 bp, Homo sapiens
tatatatgtatgtatgtg

SEQ ID NO: 6415536 - DNA, 13 bp, Homo sapiens
tatatatgtcaat

SEQ ID NO: 6415537 - DNA, 12 bp, Homo sapiens
tatatatgtgta

SEQ ID NO: 6415538 - DNA, 21 bp, Homo sapiens
tatatatgtgtatatatacat

SEQ ID NO: 6415539 - DNA, 13 bp, Homo sapiens
tccctggccttga

SEQ ID NO: 6415540 - DNA, 17 bp, Homo sapiens
tccctggccttgagtag

SEQ ID NO: 6415541 - DNA, 16 bp, Homo sapiens
tccctggcctttcata

SEQ ID NO: 6415542 - DNA, 24 bp, Homo sapiens
tccctggcctttcatattttagct

SEQ ID NO: 6415543 - DNA, 19 bp, Homo sapiens
tccctggcggccccaactc

SEQ ID NO: 6415544 - DNA, 22 bp, Homo sapiens
tccctggctacttcccttcctc

SEQ ID NO: 6415545 - DNA, 18 bp, Homo sapiens
tccctggctcactggcag

SEQ ID NO: 6415546 - DNA, 19 bp, Homo sapiens
tccctggctcactggcagg

SEQ ID NO: 6415547 - DNA, 20 bp, Homo sapiens
tccctggctcactggcaggt

SEQ ID NO: 6415548 - DNA, 14 bp, Homo sapiens
tccctggctcaggg

SEQ ID NO: 6415549 - DNA, 14 bp, Homo sapiens
tccctggctcccat

SEQ ID NO: 6415550 - DNA, 17 bp, Homo sapiens
tccctggctccctcctc

SEQ ID NO: 6415551 - DNA, 19 bp, Homo sapiens
tccctggctcctccgtctg

SEQ ID NO: 6415552 - DNA, 20 bp, Homo sapiens
tccctggctctcagaaggta

SEQ ID NO: 6415553 - DNA, 15 bp, Homo sapiens
tccctggctctgcca

SEQ ID NO: 6415554 - DNA, 16 bp, Homo sapiens
tccctggctctgccag

SEQ ID NO: 6415555 - DNA, 14 bp, Homo sapiens
tccctggctgacct

SEQ ID NO: 6415556 - DNA, 19 bp, Homo sapiens
tccctggctgacctgctgt

SEQ ID NO: 6415557 - DNA, 21 bp, Homo sapiens
tccctggctgacctgctgtgg

SEQ ID NO: 6415558 - DNA, 11 bp, Homo sapiens
tccctggctgc

SEQ ID NO: 6415559 - DNA, 14 bp, Homo sapiens
tccctggctgcagc

SEQ ID NO: 6415560 - DNA, 18 bp, Homo sapiens
tccctggctgccctggcc

SEQ ID NO: 6415561 - DNA, 19 bp, Homo sapiens
tccctggctgccctggccc

SEQ ID NO: 6415562 - DNA, 22 bp, Homo sapiens
tccctggctgccctggccctga

SEQ ID NO: 6415563 - DNA, 21 bp, Homo sapiens
tccctggctgtgagcagcctc

SEQ ID NO: 6415564 - DNA, 17 bp, Homo sapiens
tccctggcttccttact

SEQ ID NO: 6415565 - DNA, 15 bp, Homo sapiens
tccctggcttctgtg

SEQ ID NO: 6415566 - DNA, 17 bp, Homo sapiens
tccctggcttctgtggg

SEQ ID NO: 6415567 - DNA, 14 bp, Homo sapiens
tccctggcttgcct

SEQ ID NO: 6415568 - DNA, 19 bp, Homo sapiens
tccctggcttgtaactcca

SEQ ID NO: 6415569 - DNA, 21 bp, Homo sapiens
tccctggcttgtaactccacc

SEQ ID NO: 6415570 - DNA, 22 bp, Homo sapiens
tccctggcttgtaactccacca

SEQ ID NO: 6415571 - DNA, 19 bp, Homo sapiens
tccctgggaactcatcctg

SEQ ID NO: 6415572 - DNA, 23 bp, Homo sapiens
tccctgggacacagacccaggac

SEQ ID NO: 6415573 - DNA, 23 bp, Homo sapiens
tccctgggagggacatgcttagc

SEQ ID NO: 6415574 - DNA, 16 bp, Homo sapiens
tccctgggagggaggt

SEQ ID NO: 6415575 - DNA, 15 bp, Homo sapiens
tccctgggatctggt

SEQ ID NO: 6415576 - DNA, 21 bp, Homo sapiens
tccctgggatggacgctgccg

SEQ ID NO: 6415577 - DNA, 16 bp, Homo sapiens
tccctgggcaccctgc

SEQ ID NO: 6415578 - DNA, 18 bp, Homo sapiens
tccctgggcaccctgcag

SEQ ID NO: 6415579 - DNA, 16 bp, Homo sapiens
tccctgggcagaaagt

SEQ ID NO: 6415580 - DNA, 12 bp, Homo sapiens
tccctgggcatt

SEQ ID NO: 6415581 - DNA, 17 bp, Homo sapiens
tccctgggccagggtct

SEQ ID NO: 6415582 - DNA, 18 bp, Homo sapiens
tccctgggccagggtctg

SEQ ID NO: 6415583 - DNA, 21 bp, Homo sapiens
tccctgggcctcagcctccag

SEQ ID NO: 6415584 - DNA, 16 bp, Homo sapiens
tccctgggcctgctgc

SEQ ID NO: 6415585 - DNA, 20 bp, Homo sapiens
tccctgggcctgctgctgag

SEQ ID NO: 6415586 - DNA, 13 bp, Homo sapiens
tccctgggcctgt

SEQ ID NO: 6415587 - DNA, 17 bp, Homo sapiens
tccctgggcctgtctca

SEQ ID NO: 6415588 - DNA, 13 bp, Homo sapiens
tccctgggccttg

SEQ ID NO: 6415589 - DNA, 16 bp, Homo sapiens
tccctgggccttgggc

SEQ ID NO: 6415590 - DNA, 14 bp, Homo sapiens
tccctgggctaagc

SEQ ID NO: 6415591 - DNA, 22 bp, Homo sapiens
tccctgggctggcatggggagg

SEQ ID NO: 6415592 - DNA, 15 bp, Homo sapiens
tccctgggctgtgct

SEQ ID NO: 6415593 - DNA, 16 bp, Homo sapiens
tccctgggctgtgcta

SEQ ID NO: 6415594 - DNA, 19 bp, Homo sapiens
tccctgggctgtgctacct

SEQ ID NO: 6415595 - DNA, 21 bp, Homo sapiens
tccctggggacggggctcccc

SEQ ID NO: 6415596 - DNA, 21 bp, Homo sapiens
tccctggggagccctcaggct

SEQ ID NO: 6415597 - DNA, 22 bp, Homo sapiens
tccctggggagccctcaggctc

SEQ ID NO: 6415598 - DNA, 17 bp, Homo sapiens
tccctggggaggacccc

SEQ ID NO: 6415599 - DNA, 20 bp, Homo sapiens
tccctggggaggacccctgc

SEQ ID NO: 6415600 - DNA, 22 bp, Homo sapiens
tccctggggaggacccctgccc

SEQ ID NO: 6415601 - DNA, 23 bp, Homo sapiens
tccctggggaggacccctgccct

SEQ ID NO: 6415602 - DNA, 22 bp, Homo sapiens
tccctggggatgtggctggagc

SEQ ID NO: 6415603 - DNA, 14 bp, Homo sapiens
tccctggggcactc

SEQ ID NO: 6415604 - DNA, 19 bp, Homo sapiens
tccctgggggaagccctgg

SEQ ID NO: 6415605 - DNA, 20 bp, Homo sapiens
tccctgggggcatcctgctt

SEQ ID NO: 6415606 - DNA, 22 bp, Homo sapiens
tccctgggggcatcctgcttcc

SEQ ID NO: 6415607 - DNA, 24 bp, Homo sapiens
tccctgggggcatcctgcttcctg

SEQ ID NO: 6415608 - DNA, 21 bp, Homo sapiens
tccctgggggccttgggtgag

SEQ ID NO: 6415609 - DNA, 22 bp, Homo sapiens
tccctgggggccttgggtgagt

SEQ ID NO: 6415610 - DNA, 23 bp, Homo sapiens
tccctgggggcggccagccctcc

SEQ ID NO: 6415611 - DNA, 21 bp, Homo sapiens
tccctgggggtggggctccta

SEQ ID NO: 6415612 - DNA, 19 bp, Homo sapiens
tccctggggtcaccttcta

SEQ ID NO: 6415613 - DNA, 14 bp, Homo sapiens
tccctggggtgggg

SEQ ID NO: 6415614 - DNA, 17 bp, Homo sapiens
tccctggggttctctac

SEQ ID NO: 6415615 - DNA, 18 bp, Homo sapiens
tccctggggtttttttca

SEQ ID NO: 6415616 - DNA, 21 bp, Homo sapiens
tccctggtagtgtagctgtgt

SEQ ID NO: 6415617 - DNA, 11 bp, Homo sapiens
tccctggtcac

SEQ ID NO: 6415618 - DNA, 12 bp, Homo sapiens
tccctggtcacc

SEQ ID NO: 6415619 - DNA, 12 bp, Homo sapiens
tccctggtccct

SEQ ID NO: 6415620 - DNA, 22 bp, Homo sapiens
tccctggtccctcgtccacagg

SEQ ID NO: 6415621 - DNA, 13 bp, Homo sapiens
tccctggtccctt

SEQ ID NO: 6415622 - DNA, 12 bp, Homo sapiens
tccctggtcctt

SEQ ID NO: 6415623 - DNA, 22 bp, Homo sapiens
tccctggtccttcactggcgcc

SEQ ID NO: 6415624 - DNA, 17 bp, Homo sapiens
tccctggtcggagaggg

SEQ ID NO: 6415625 - DNA, 21 bp, Homo sapiens
tccctggtctggctctgctgg

SEQ ID NO: 6415626 - DNA, 21 bp, Homo sapiens
tccctggtgagagggccgggc

SEQ ID NO: 6415627 - DNA, 23 bp, Homo sapiens
tccctggtgcccttccctggagg

SEQ ID NO: 6415628 - DNA, 18 bp, Homo sapiens
tccctggtgcctctgtgc

SEQ ID NO: 6415629 - DNA, 22 bp, Homo sapiens
tccctggtgcctctgtgcacag

SEQ ID NO: 6415630 - DNA, 20 bp, Homo sapiens
tccctggtggctacccaata

SEQ ID NO: 6415631 - DNA, 18 bp, Homo sapiens
tccctggttgcctctctt

SEQ ID NO: 6415632 - DNA, 20 bp, Homo sapiens
tccctgtaaaagagaggggc

SEQ ID NO: 6415633 - DNA, 14 bp, Homo sapiens
tccctgtaacctct

SEQ ID NO: 6415634 - DNA, 22 bp, Homo sapiens
tccctgtaacctcttcagaggc

SEQ ID NO: 6415635 - DNA, 17 bp, Homo sapiens
tccctgtaatgcactcc

SEQ ID NO: 6415636 - DNA, 21 bp, Homo sapiens
tccctgtaatgcactcctgcc

SEQ ID NO: 6415637 - DNA, 15 bp, Homo sapiens
tccctgtagctcagt

SEQ ID NO: 6415638 - DNA, 17 bp, Homo sapiens
tccctgtagctcagtca

SEQ ID NO: 6415639 - DNA, 16 bp, Homo sapiens
tccctgtaggattttt

SEQ ID NO: 6415640 - DNA, 19 bp, Homo sapiens
tccctgtatcaccccctcc

SEQ ID NO: 6415641 - DNA, 18 bp, Homo sapiens
tccctgtatgtctacctc

SEQ ID NO: 6415642 - DNA, 18 bp, Homo sapiens
tccctgtcactcagctga

SEQ ID NO: 6415643 - DNA, 14 bp, Homo sapiens
tccctgtcagaggc

SEQ ID NO: 6415644 - DNA, 15 bp, Homo sapiens
tccctgtcagaggct

SEQ ID NO: 6415645 - DNA, 17 bp, Homo sapiens
tccctgtccatccccag

SEQ ID NO: 6415646 - DNA, 11 bp, Homo sapiens
tccctgtcccc

SEQ ID NO: 6415647 - DNA, 23 bp, Homo sapiens
tccctgtccccaggcccagccct

SEQ ID NO: 6415648 - DNA, 14 bp, Homo sapiens
tccctgtcccccag

SEQ ID NO: 6415649 - DNA, 16 bp, Homo sapiens
tccctgtcccccagca

SEQ ID NO: 6415650 - DNA, 16 bp, Homo sapiens
tccctgtcccctcctc

SEQ ID NO: 6415651 - DNA, 14 bp, Homo sapiens
tccctgtcccctga

SEQ ID NO: 6415652 - DNA, 21 bp, Homo sapiens
tccctgtccctctagtgcctt

SEQ ID NO: 6415653 - DNA, 18 bp, Homo sapiens
tccctgtccctgccccgc

SEQ ID NO: 6415654 - DNA, 12 bp, Homo sapiens
tccctgtccttc

SEQ ID NO: 6415655 - DNA, 15 bp, Homo sapiens
tccctgtccttccct

SEQ ID NO: 6415656 - DNA, 17 bp, Homo sapiens
tccctgtccttccctgt

SEQ ID NO: 6415657 - DNA, 16 bp, Homo sapiens
tccctgtcggcctggt

SEQ ID NO: 6415658 - DNA, 13 bp, Homo sapiens
tccctgtctccag

SEQ ID NO: 6415659 - DNA, 14 bp, Homo sapiens
tccctgtctccagc

SEQ ID NO: 6415660 - DNA, 16 bp, Homo sapiens
tccctgtctccagctg

SEQ ID NO: 6415661 - DNA, 23 bp, Homo sapiens
tccctgtctccagctgcctgggc

SEQ ID NO: 6415662 - DNA, 15 bp, Homo sapiens
tccctgtctcccggc

SEQ ID NO: 6415663 - DNA, 15 bp, Homo sapiens
tccctgtctctgcat

SEQ ID NO: 6415664 - DNA, 19 bp, Homo sapiens
tccctgtctctgcatctga

SEQ ID NO: 6415665 - DNA, 22 bp, Homo sapiens
tccctgtctgtctgtctctctt

SEQ ID NO: 6415666 - DNA, 22 bp, Homo sapiens
tccctgtctgtgtcccagccac

SEQ ID NO: 6415667 - DNA, 19 bp, Homo sapiens
tccctgtcttccccacctt

SEQ ID NO: 6415668 - DNA, 20 bp, Homo sapiens
tccctgtcttctttccatcc

SEQ ID NO: 6415669 - DNA, 18 bp, Homo sapiens
tccctgtgatggccaggc

SEQ ID NO: 6415670 - DNA, 20 bp, Homo sapiens
tccctgtgatggccaggcca

SEQ ID NO: 6415671 - DNA, 20 bp, Homo sapiens
tccctgtgcccccagcctca

SEQ ID NO: 6415672 - DNA, 21 bp, Homo sapiens
tccctgtgcccccagcctcag

SEQ ID NO: 6415673 - DNA, 14 bp, Homo sapiens
tccctgtgcctcct

SEQ ID NO: 6415674 - DNA, 19 bp, Homo sapiens
tccctgtgcctcctccctc

SEQ ID NO: 6415675 - DNA, 21 bp, Homo sapiens
tccctgtggcactcagggagc

SEQ ID NO: 6415676 - DNA, 15 bp, Homo sapiens
tccctgtgggctcac

SEQ ID NO: 6415677 - DNA, 18 bp, Homo sapiens
tccctgtgggctcacacc

SEQ ID NO: 6415678 - DNA, 19 bp, Homo sapiens
tccctgtggggcaggagtg

SEQ ID NO: 6415679 - DNA, 21 bp, Homo sapiens
tccctgtgggggtggccatcc

SEQ ID NO: 6415680 - DNA, 21 bp, Homo sapiens
tccctgtggtaccctggcaga

SEQ ID NO: 6415681 - DNA, 14 bp, Homo sapiens
tccctgtggtctac

SEQ ID NO: 6415682 - DNA, 17 bp, Homo sapiens
tccctgtgtaccctcca

SEQ ID NO: 6415683 - DNA, 20 bp, Homo sapiens
tccctgtgtaccctccatgt

SEQ ID NO: 6415684 - DNA, 20 bp, Homo sapiens
tccctgtgtccacctgtggg

SEQ ID NO: 6415685 - DNA, 13 bp, Homo sapiens
tccctgtgtcttt

SEQ ID NO: 6415686 - DNA, 15 bp, Homo sapiens
tccctgtgtggacca

SEQ ID NO: 6415687 - DNA, 19 bp, Homo sapiens
tccctgtgtgtaggctggg

SEQ ID NO: 6415688 - DNA, 18 bp, Homo sapiens
tccctgtgttaactcagg

SEQ ID NO: 6415689 - DNA, 18 bp, Homo sapiens
tccctgtgttctgggctg

SEQ ID NO: 6415690 - DNA, 20 bp, Homo sapiens
tccctgttatttttctgccc

SEQ ID NO: 6415691 - DNA, 21 bp, Homo sapiens
tccctgttatttttctgccct

SEQ ID NO: 6415692 - DNA, 22 bp, Homo sapiens
tccctgttcacggtgacacagg

SEQ ID NO: 6415693 - DNA, 12 bp, Homo sapiens
tccctgttcatt

SEQ ID NO: 6415694 - DNA, 23 bp, Homo sapiens
tccctgttccccacaggtcctcc

SEQ ID NO: 6415695 - DNA, 18 bp, Homo sapiens
tccctgttctcagctccg

SEQ ID NO: 6415696 - DNA, 17 bp, Homo sapiens
tccctgttctccctttc

SEQ ID NO: 6415697 - DNA, 23 bp, Homo sapiens
tccctgttctggtatttcccctg

SEQ ID NO: 6415698 - DNA, 20 bp, Homo sapiens
tccctgttgacgaagtctct

SEQ ID NO: 6415699 - DNA, 21 bp, Homo sapiens
tccctgttgacgaagtctctt

SEQ ID NO: 6415700 - DNA, 23 bp, Homo sapiens
tccctgtttattccaaatgccat

SEQ ID NO: 6415701 - DNA, 19 bp, Homo sapiens
tccctgtttgaagcctgcc

SEQ ID NO: 6415702 - DNA, 16 bp, Homo sapiens
tccctgttttaaatta

SEQ ID NO: 6415703 - DNA, 14 bp, Homo sapiens
tccctgttttagtt

SEQ ID NO: 6415704 - DNA, 16 bp, Homo sapiens
tccctgttttagtttc

SEQ ID NO: 6415705 - DNA, 18 bp, Homo sapiens
tccctgttttagtttctg

SEQ ID NO: 6415706 - DNA, 16 bp, Homo sapiens
tcccttaacagttgta

SEQ ID NO: 6415707 - DNA, 17 bp, Homo sapiens
tcccttaacagttgtat

SEQ ID NO: 6415708 - DNA, 18 bp, Homo sapiens
tcccttaacttttccttg

SEQ ID NO: 6415709 - DNA, 18 bp, Homo sapiens
tcccttaagaatgagttt

SEQ ID NO: 6415710 - DNA, 19 bp, Homo sapiens
tcccttaagaatgagtttc

SEQ ID NO: 6415711 - DNA, 14 bp, Homo sapiens
tcccttaagcagca

SEQ ID NO: 6415712 - DNA, 22 bp, Homo sapiens
tcccttaagcagcaacagccta

SEQ ID NO: 6415713 - DNA, 22 bp, Homo sapiens
tcccttaatattgaggctgcag

SEQ ID NO: 6415714 - DNA, 14 bp, Homo sapiens
tcccttacccatct

SEQ ID NO: 6415715 - DNA, 13 bp, Homo sapiens
tatatatgtgtgt

SEQ ID NO: 6415716 - DNA, 14 bp, Homo sapiens
tatatatgtgtgtg

SEQ ID NO: 6415717 - DNA, 17 bp, Homo sapiens
tatatatgtgtgtttaa

SEQ ID NO: 6415718 - DNA, 15 bp, Homo sapiens
tatatattaaaattg

SEQ ID NO: 6415719 - DNA, 10 bp, Homo sapiens
tatatattat

SEQ ID NO: 6415720 - DNA, 18 bp, Homo sapiens
tatatattataagttgac

SEQ ID NO: 6415721 - DNA, 18 bp, Homo sapiens
tatatattatatatacat

SEQ ID NO: 6415722 - DNA, 20 bp, Homo sapiens
tatatattatatatacatta

SEQ ID NO: 6415723 - DNA, 16 bp, Homo sapiens
tatatattatatggaa

SEQ ID NO: 6415724 - DNA, 16 bp, Homo sapiens
tatatattatcttata

SEQ ID NO: 6415725 - DNA, 17 bp, Homo sapiens
tatatattatgtgaaga

SEQ ID NO: 6415726 - DNA, 19 bp, Homo sapiens
tatatattatgtgaagaat

SEQ ID NO: 6415727 - DNA, 20 bp, Homo sapiens
tatatattatgtgaagaatt

SEQ ID NO: 6415728 - DNA, 16 bp, Homo sapiens
tatatattattctcat

SEQ ID NO: 6415729 - DNA, 21 bp, Homo sapiens
tatatattattctcatttagt

SEQ ID NO: 6415730 - DNA, 12 bp, Homo sapiens
tatatattcacc

SEQ ID NO: 6415731 - DNA, 22 bp, Homo sapiens
tatatattccttactagaaata

SEQ ID NO: 6415732 - DNA, 13 bp, Homo sapiens
tatatattctcag

SEQ ID NO: 6415733 - DNA, 17 bp, Homo sapiens
tatatattcttataaaa

SEQ ID NO: 6415734 - DNA, 20 bp, Homo sapiens
tatatattcttataaaaatg

SEQ ID NO: 6415735 - DNA, 21 bp, Homo sapiens
tatatattgaaagttgctttt

SEQ ID NO: 6415736 - DNA, 22 bp, Homo sapiens
tatatattgattatatattgtt

SEQ ID NO: 6415737 - DNA, 15 bp, Homo sapiens
tatatattgtaaaga

SEQ ID NO: 6415738 - DNA, 19 bp, Homo sapiens
tatatatttaaaagtgtca

SEQ ID NO: 6415739 - DNA, 14 bp, Homo sapiens
tatatatttaaagg

SEQ ID NO: 6415740 - DNA, 16 bp, Homo sapiens
tatatatttaacatgt

SEQ ID NO: 6415741 - DNA, 13 bp, Homo sapiens
tatatatttataa

SEQ ID NO: 6415742 - DNA, 20 bp, Homo sapiens
tatatatttatcatatttaa

SEQ ID NO: 6415743 - DNA, 20 bp, Homo sapiens
tatatatttattttattcta

SEQ ID NO: 6415744 - DNA, 14 bp, Homo sapiens
tatatatttccaaa

SEQ ID NO: 6415745 - DNA, 15 bp, Homo sapiens
tatatatttccaaat

SEQ ID NO: 6415746 - DNA, 14 bp, Homo sapiens
tatatatttcttaa

SEQ ID NO: 6415747 - DNA, 13 bp, Homo sapiens
tatatatttgaaa

SEQ ID NO: 6415748 - DNA, 20 bp, Homo sapiens
tatatatttgaatatcatta

SEQ ID NO: 6415749 - DNA, 14 bp, Homo sapiens
tatatattttaatt

SEQ ID NO: 6415750 - DNA, 15 bp, Homo sapiens
tatatattttatatg

SEQ ID NO: 6415751 - DNA, 13 bp, Homo sapiens
tatatattttatg

SEQ ID NO: 6415752 - DNA, 14 bp, Homo sapiens
tatatattttgaaa

SEQ ID NO: 6415753 - DNA, 13 bp, Homo sapiens
tatatattttgtg

SEQ ID NO: 6415754 - DNA, 16 bp, Homo sapiens
tatatattttgtgtga

SEQ ID NO: 6415755 - DNA, 17 bp, Homo sapiens
tatatattttgttgttc

SEQ ID NO: 6415756 - DNA, 14 bp, Homo sapiens
tatatatttttcaa

SEQ ID NO: 6415757 - DNA, 15 bp, Homo sapiens
tatatatttttcaaa

SEQ ID NO: 6415758 - DNA, 22 bp, Homo sapiens
tatatatttttcaaatagattt

SEQ ID NO: 6415759 - DNA, 21 bp, Homo sapiens
tatatatttttttctgaaatt

SEQ ID NO: 6415760 - DNA, 16 bp, Homo sapiens
tatatcaaaaaacctt

SEQ ID NO: 6415761 - DNA, 13 bp, Homo sapiens
tatatcaaagcag

SEQ ID NO: 6415762 - DNA, 15 bp, Homo sapiens
tatatcaaatccagg

SEQ ID NO: 6415763 - DNA, 14 bp, Homo sapiens
tatatcaaatgcct

SEQ ID NO: 6415764 - DNA, 22 bp, Homo sapiens
tatatcaagcttaatatgtgct

SEQ ID NO: 6415765 - DNA, 21 bp, Homo sapiens
tatatcaaggatgttctggct

SEQ ID NO: 6415766 - DNA, 19 bp, Homo sapiens
tatatcacagagccactct

SEQ ID NO: 6415767 - DNA, 19 bp, Homo sapiens
tatatcactaaaagcatga

SEQ ID NO: 6415768 - DNA, 21 bp, Homo sapiens
tatatcactaagagctttata

SEQ ID NO: 6415769 - DNA, 12 bp, Homo sapiens
tatatcactcta

SEQ ID NO: 6415770 - DNA, 13 bp, Homo sapiens
tatatcactgtct

SEQ ID NO: 6415771 - DNA, 14 bp, Homo sapiens
tatatcagaatctg

SEQ ID NO: 6415772 - DNA, 16 bp, Homo sapiens
tatatcagaatctgtg

SEQ ID NO: 6415773 - DNA, 21 bp, Homo sapiens
tatatcagactgctttgagaa

SEQ ID NO: 6415774 - DNA, 11 bp, Homo sapiens
tatatcagcct

SEQ ID NO: 6415775 - DNA, 17 bp, Homo sapiens
tatatcagcttttctga

SEQ ID NO: 6415776 - DNA, 21 bp, Homo sapiens
tatatcagcttttctgatggt

SEQ ID NO: 6415777 - DNA, 19 bp, Homo sapiens
tatatcagggtttaacaat

SEQ ID NO: 6415778 - DNA, 19 bp, Homo sapiens
tatatcagtagtgtacatt

SEQ ID NO: 6415779 - DNA, 20 bp, Homo sapiens
tatatcagtcgttttagtgt

SEQ ID NO: 6415780 - DNA, 22 bp, Homo sapiens
tatatcagtcgttttagtgtct

SEQ ID NO: 6415781 - DNA, 14 bp, Homo sapiens
tatatcataactat

SEQ ID NO: 6415782 - DNA, 13 bp, Homo sapiens
tatatcataactt

SEQ ID NO: 6415783 - DNA, 13 bp, Homo sapiens
tatatcatatttc

SEQ ID NO: 6415784 - DNA, 13 bp, Homo sapiens
tatatcatcttta

SEQ ID NO: 6415785 - DNA, 13 bp, Homo sapiens
tatatcattctgg

SEQ ID NO: 6415786 - DNA, 14 bp, Homo sapiens
tatatcattttaaa

SEQ ID NO: 6415787 - DNA, 20 bp, Homo sapiens
tatatcattttaaaatgtct

SEQ ID NO: 6415788 - DNA, 15 bp, Homo sapiens
tatatccaaaattca

SEQ ID NO: 6415789 - DNA, 23 bp, Homo sapiens
tatatccagttcctgctctctgc

SEQ ID NO: 6415790 - DNA, 14 bp, Homo sapiens
tatatccatgtact

SEQ ID NO: 6415791 - DNA, 17 bp, Homo sapiens
tatatccatgtactgta

SEQ ID NO: 6415792 - DNA, 18 bp, Homo sapiens
tatatccatgtactgtag

SEQ ID NO: 6415793 - DNA, 19 bp, Homo sapiens
tatatccatgtactgtagt

SEQ ID NO: 6415794 - DNA, 14 bp, Homo sapiens
tatatcccagaaat

SEQ ID NO: 6415795 - DNA, 17 bp, Homo sapiens
tatatccccactactca

SEQ ID NO: 6415796 - DNA, 18 bp, Homo sapiens
tatatcctccttctcctg

SEQ ID NO: 6415797 - DNA, 23 bp, Homo sapiens
tatatcctctggaaaaggctttc

SEQ ID NO: 6415798 - DNA, 14 bp, Homo sapiens
tatatcctgtgact

SEQ ID NO: 6415799 - DNA, 15 bp, Homo sapiens
tatatcctgtttgta

SEQ ID NO: 6415800 - DNA, 20 bp, Homo sapiens
tatatccttaatattttata

SEQ ID NO: 6415801 - DNA, 17 bp, Homo sapiens
tatatcctttctaacaa

SEQ ID NO: 6415802 - DNA, 20 bp, Homo sapiens
tatatcctttctaacaaaaa

SEQ ID NO: 6415803 - DNA, 19 bp, Homo sapiens
tatatccttttctgtgttt

SEQ ID NO: 6415804 - DNA, 20 bp, Homo sapiens
tatatccttttcttctatgt

SEQ ID NO: 6415805 - DNA, 15 bp, Homo sapiens
tatatctaaatctgt

SEQ ID NO: 6415806 - DNA, 13 bp, Homo sapiens
tatatctaaattg

SEQ ID NO: 6415807 - DNA, 17 bp, Homo sapiens
tatatctaaattgaata

SEQ ID NO: 6415808 - DNA, 21 bp, Homo sapiens
tatatctaagttcacagtgtt

SEQ ID NO: 6415809 - DNA, 14 bp, Homo sapiens
tatatctaatttat

SEQ ID NO: 6415810 - DNA, 19 bp, Homo sapiens
tatatctaatttatacaaa

SEQ ID NO: 6415811 - DNA, 20 bp, Homo sapiens
tatatctaatttatacaaaa

SEQ ID NO: 6415812 - DNA, 22 bp, Homo sapiens
tatatctatatataattctgta

SEQ ID NO: 6415813 - DNA, 17 bp, Homo sapiens
tatatctatatctctaa

SEQ ID NO: 6415814 - DNA, 16 bp, Homo sapiens
tatatctatatgtact

SEQ ID NO: 6415815 - DNA, 13 bp, Homo sapiens
tatatctatctat

SEQ ID NO: 6415816 - DNA, 21 bp, Homo sapiens
tatatctatctatatatacat

SEQ ID NO: 6415817 - DNA, 15 bp, Homo sapiens
tatatctattatgta

SEQ ID NO: 6415818 - DNA, 12 bp, Homo sapiens
tatatctccttt

SEQ ID NO: 6415819 - DNA, 16 bp, Homo sapiens
tatatctcctttgtat

SEQ ID NO: 6415820 - DNA, 15 bp, Homo sapiens
tatatctcttggaaa

SEQ ID NO: 6415821 - DNA, 18 bp, Homo sapiens
tatatctgaaaactggaa

SEQ ID NO: 6415822 - DNA, 21 bp, Homo sapiens
tatatctgaggaattctgtat

SEQ ID NO: 6415823 - DNA, 22 bp, Homo sapiens
tatatctgaggaattctgtata

SEQ ID NO: 6415824 - DNA, 15 bp, Homo sapiens
tatatctgagttgtg

SEQ ID NO: 6415825 - DNA, 15 bp, Homo sapiens
tatatctgataaaat

SEQ ID NO: 6415826 - DNA, 13 bp, Homo sapiens
tatatctgcaaaa

SEQ ID NO: 6415827 - DNA, 13 bp, Homo sapiens
tatatctgctgtc

SEQ ID NO: 6415828 - DNA, 14 bp, Homo sapiens
tatatctggaatga

SEQ ID NO: 6415829 - DNA, 13 bp, Homo sapiens
tatatctggcctc

SEQ ID NO: 6415830 - DNA, 20 bp, Homo sapiens
tatatctgggctggccagtt

SEQ ID NO: 6415831 - DNA, 11 bp, Homo sapiens
tatatctgtat

SEQ ID NO: 6415832 - DNA, 14 bp, Homo sapiens
tatatctgtatata

SEQ ID NO: 6415833 - DNA, 20 bp, Homo sapiens
tatatctgtatgtattagtg

SEQ ID NO: 6415834 - DNA, 16 bp, Homo sapiens
tatatctgtgatttta

SEQ ID NO: 6415835 - DNA, 18 bp, Homo sapiens
tatatctgtggtcttcaa

SEQ ID NO: 6415836 - DNA, 18 bp, Homo sapiens
tatatctgtttgtatatt

SEQ ID NO: 6415837 - DNA, 21 bp, Homo sapiens
tatatctgtttgtatatttgc

SEQ ID NO: 6415838 - DNA, 17 bp, Homo sapiens
tatatctgttttactgc

SEQ ID NO: 6415839 - DNA, 16 bp, Homo sapiens
tatatcttaagaatgt

SEQ ID NO: 6415840 - DNA, 16 bp, Homo sapiens
tatatcttatgttaaa

SEQ ID NO: 6415841 - DNA, 14 bp, Homo sapiens
tatatcttcttata

SEQ ID NO: 6415842 - DNA, 18 bp, Homo sapiens
tatatcttgtttacaata

SEQ ID NO: 6415843 - DNA, 16 bp, Homo sapiens
tatatctttatgcaaa

SEQ ID NO: 6415844 - DNA, 20 bp, Homo sapiens
tatatctttatgcaaaaaca

SEQ ID NO: 6415845 - DNA, 13 bp, Homo sapiens
tatatctttgtaa

SEQ ID NO: 6415846 - DNA, 18 bp, Homo sapiens
tatatctttgtaaattat

SEQ ID NO: 6415847 - DNA, 13 bp, Homo sapiens
tatatgaaaacac

SEQ ID NO: 6415848 - DNA, 12 bp, Homo sapiens
tatatgaaaact

SEQ ID NO: 6415849 - DNA, 19 bp, Homo sapiens
tatatgaacatacaaatgc

SEQ ID NO: 6415850 - DNA, 19 bp, Homo sapiens
tatatgaagcaagctgtgt

SEQ ID NO: 6415851 - DNA, 17 bp, Homo sapiens
tatatgaagcagaatga

SEQ ID NO: 6415852 - DNA, 20 bp, Homo sapiens
tatatgaataattatgttta

SEQ ID NO: 6415853 - DNA, 13 bp, Homo sapiens
tatatgaatatta

SEQ ID NO: 6415854 - DNA, 15 bp, Homo sapiens
tatatgaatgctatt

SEQ ID NO: 6415855 - DNA, 20 bp, Homo sapiens
tatatgacttcttgttcatg

SEQ ID NO: 6415856 - DNA, 15 bp, Homo sapiens
tatatgagaagaata

SEQ ID NO: 6415857 - DNA, 20 bp, Homo sapiens
tatatgagaagaatagccta

SEQ ID NO: 6415858 - DNA, 20 bp, Homo sapiens
tatatgagagaatcacacaa

SEQ ID NO: 6415859 - DNA, 18 bp, Homo sapiens
tatatgaggatgtatgtg

SEQ ID NO: 6415860 - DNA, 18 bp, Homo sapiens
tatatgagtagatactct

SEQ ID NO: 6415861 - DNA, 14 bp, Homo sapiens
tatatgatatgcat

SEQ ID NO: 6415862 - DNA, 21 bp, Homo sapiens
tatatgatatgcatgtagcat

SEQ ID NO: 6415863 - DNA, 14 bp, Homo sapiens
tatatgatcattga

SEQ ID NO: 6415864 - DNA, 22 bp, Homo sapiens
tatatgatcctgaaaaaatgat

SEQ ID NO: 6415865 - DNA, 17 bp, Homo sapiens
tatatgatgaaattctt

SEQ ID NO: 6415866 - DNA, 13 bp, Homo sapiens
tatatgatggggg

SEQ ID NO: 6415867 - DNA, 23 bp, Homo sapiens
tatatgatgtggacatatgtata

SEQ ID NO: 6415868 - DNA, 12 bp, Homo sapiens
tatatgattgta

SEQ ID NO: 6415869 - DNA, 21 bp, Homo sapiens
tatatgattgtataatgtgat

SEQ ID NO: 6415870 - DNA, 14 bp, Homo sapiens
tatatgatttagca

SEQ ID NO: 6415871 - DNA, 17 bp, Homo sapiens
tatatgatttttatcca

SEQ ID NO: 6415872 - DNA, 15 bp, Homo sapiens
tatatgcacacatat

SEQ ID NO: 6415873 - DNA, 21 bp, Homo sapiens
tatatgcacttataattttcc

SEQ ID NO: 6415874 - DNA, 18 bp, Homo sapiens
tatatgcagtctctttat

SEQ ID NO: 6415875 - DNA, 14 bp, Homo sapiens
tatatgcataaaca

SEQ ID NO: 6415876 - DNA, 19 bp, Homo sapiens
tatatgcatatatatatgt

SEQ ID NO: 6415877 - DNA, 22 bp, Homo sapiens
tatatgcatatatatatgtgtg

SEQ ID NO: 6415878 - DNA, 19 bp, Homo sapiens
tatatgcatgcacaggaag

SEQ ID NO: 6415879 - DNA, 18 bp, Homo sapiens
tatatgccgtataaaaga

SEQ ID NO: 6415880 - DNA, 20 bp, Homo sapiens
tatatgcctatatttataaa

SEQ ID NO: 6415881 - DNA, 16 bp, Homo sapiens
tatatgcctgattcat

SEQ ID NO: 6415882 - DNA, 16 bp, Homo sapiens
tatatgccttactatt

SEQ ID NO: 6415883 - DNA, 18 bp, Homo sapiens
tatatgccttactattgt

SEQ ID NO: 6415884 - DNA, 14 bp, Homo sapiens
tatatgctactttt

SEQ ID NO: 6415885 - DNA, 18 bp, Homo sapiens
tatatgctatttctatat

SEQ ID NO: 6415886 - DNA, 12 bp, Homo sapiens
tatatgctgtat

SEQ ID NO: 6415887 - DNA, 23 bp, Homo sapiens
tatatgctgtatttctttgtaga

SEQ ID NO: 6415888 - DNA, 16 bp, Homo sapiens
tatatgcttactgata

SEQ ID NO: 6415889 - DNA, 15 bp, Homo sapiens
tatatgcttactgtg

SEQ ID NO: 6415890 - DNA, 16 bp, Homo sapiens
tatatgcttttttgca

SEQ ID NO: 6415891 - DNA, 23 bp, Homo sapiens
tatatgcttttttgcaataagga

SEQ ID NO: 6415892 - DNA, 19 bp, Homo sapiens
tatatggaaatatatatta

SEQ ID NO: 6415893 - DNA, 22 bp, Homo sapiens
tatatggaaatatatattatac

SEQ ID NO: 6415894 - DNA, 18 bp, Homo sapiens
tatatggaaggttcctgt

SEQ ID NO: 6415895 - DNA, 18 bp, Homo sapiens
tatatggacaaaacaaga

SEQ ID NO: 6415896 - DNA, 18 bp, Homo sapiens
tcccttacccatcttgct

SEQ ID NO: 6415897 - DNA, 17 bp, Homo sapiens
tcccttaccctcctctg

SEQ ID NO: 6415898 - DNA, 18 bp, Homo sapiens
tcccttaccctcctctgc

SEQ ID NO: 6415899 - DNA, 19 bp, Homo sapiens
tcccttaccctcctctgct

SEQ ID NO: 6415900 - DNA, 13 bp, Homo sapiens
tcccttacctcaa

SEQ ID NO: 6415901 - DNA, 17 bp, Homo sapiens
tcccttacgtgagtcct

SEQ ID NO: 6415902 - DNA, 15 bp, Homo sapiens
tcccttactttgctg

SEQ ID NO: 6415903 - DNA, 16 bp, Homo sapiens
tcccttagaagagagc

SEQ ID NO: 6415904 - DNA, 17 bp, Homo sapiens
tcccttagcctctccca

SEQ ID NO: 6415905 - DNA, 23 bp, Homo sapiens
tcccttaggcattatttaatgtt

SEQ ID NO: 6415906 - DNA, 16 bp, Homo sapiens
tcccttagtgactctt

SEQ ID NO: 6415907 - DNA, 20 bp, Homo sapiens
tcccttatgtccaccacttc

SEQ ID NO: 6415908 - DNA, 19 bp, Homo sapiens
tcccttatttttatttatt

SEQ ID NO: 6415909 - DNA, 18 bp, Homo sapiens
tcccttcaaccccacttc

SEQ ID NO: 6415910 - DNA, 20 bp, Homo sapiens
tcccttcaaccccacttcct

SEQ ID NO: 6415911 - DNA, 21 bp, Homo sapiens
tcccttcaagagtcctgaaga

SEQ ID NO: 6415912 - DNA, 17 bp, Homo sapiens
tcccttcacagtcccag

SEQ ID NO: 6415913 - DNA, 14 bp, Homo sapiens
tcccttcacatagt

SEQ ID NO: 6415914 - DNA, 19 bp, Homo sapiens
tcccttcacatagttttta

SEQ ID NO: 6415915 - DNA, 21 bp, Homo sapiens
tcccttcactcaagcttggct

SEQ ID NO: 6415916 - DNA, 20 bp, Homo sapiens
tcccttcagcaacttatttt

SEQ ID NO: 6415917 - DNA, 19 bp, Homo sapiens
tcccttcagcccccagccc

SEQ ID NO: 6415918 - DNA, 21 bp, Homo sapiens
tcccttcagcccccagcccct

SEQ ID NO: 6415919 - DNA, 22 bp, Homo sapiens
tcccttcagggattccctgtcc

SEQ ID NO: 6415920 - DNA, 16 bp, Homo sapiens
tcccttcagtaccctc

SEQ ID NO: 6415921 - DNA, 20 bp, Homo sapiens
tcccttcagtaccctctcag

SEQ ID NO: 6415922 - DNA, 21 bp, Homo sapiens
tcccttcagtaccctctcagc

SEQ ID NO: 6415923 - DNA, 18 bp, Homo sapiens
tcccttcatcccagggta

SEQ ID NO: 6415924 - DNA, 18 bp, Homo sapiens
tcccttcatctccaggga

SEQ ID NO: 6415925 - DNA, 19 bp, Homo sapiens
tcccttcatttaaactaaa

SEQ ID NO: 6415926 - DNA, 13 bp, Homo sapiens
tcccttccaaaga

SEQ ID NO: 6415927 - DNA, 16 bp, Homo sapiens
tcccttccacaccccc

SEQ ID NO: 6415928 - DNA, 18 bp, Homo sapiens
tcccttccacacccccac

SEQ ID NO: 6415929 - DNA, 14 bp, Homo sapiens
tcccttccacctgc

SEQ ID NO: 6415930 - DNA, 19 bp, Homo sapiens
tcccttccacctgctctgc

SEQ ID NO: 6415931 - DNA, 18 bp, Homo sapiens
tcccttccactgcctctg

SEQ ID NO: 6415932 - DNA, 20 bp, Homo sapiens
tcccttccactgcctctgcc

SEQ ID NO: 6415933 - DNA, 21 bp, Homo sapiens
tcccttccagatggtcatcca

SEQ ID NO: 6415934 - DNA, 22 bp, Homo sapiens
tcccttccagtttattccagag

SEQ ID NO: 6415935 - DNA, 16 bp, Homo sapiens
tcccttccatctcttc

SEQ ID NO: 6415936 - DNA, 17 bp, Homo sapiens
tcccttccatctcttcc

SEQ ID NO: 6415937 - DNA, 20 bp, Homo sapiens
tcccttccatctcttccttt

SEQ ID NO: 6415938 - DNA, 18 bp, Homo sapiens
tcccttccatgccccagg

SEQ ID NO: 6415939 - DNA, 13 bp, Homo sapiens
tcccttcccacat

SEQ ID NO: 6415940 - DNA, 16 bp, Homo sapiens
tcccttcccacatgcc

SEQ ID NO: 6415941 - DNA, 17 bp, Homo sapiens
tcccttcccacatgcct

SEQ ID NO: 6415942 - DNA, 20 bp, Homo sapiens
tcccttcccacatgcctgcg

SEQ ID NO: 6415943 - DNA, 15 bp, Homo sapiens
tcccttcccagacca

SEQ ID NO: 6415944 - DNA, 19 bp, Homo sapiens
tcccttcccagaccaggaa

SEQ ID NO: 6415945 - DNA, 15 bp, Homo sapiens
tcccttcccagtggg

SEQ ID NO: 6415946 - DNA, 16 bp, Homo sapiens
tcccttcccataagct

SEQ ID NO: 6415947 - DNA, 17 bp, Homo sapiens
tcccttcccattggcct

SEQ ID NO: 6415948 - DNA, 13 bp, Homo sapiens
tcccttccccctg

SEQ ID NO: 6415949 - DNA, 12 bp, Homo sapiens
tcccttcccctc

SEQ ID NO: 6415950 - DNA, 15 bp, Homo sapiens
tcccttcccctgcct

SEQ ID NO: 6415951 - DNA, 16 bp, Homo sapiens
tcccttcccctgcctg

SEQ ID NO: 6415952 - DNA, 17 bp, Homo sapiens
tcccttcccctgcctgg

SEQ ID NO: 6415953 - DNA, 16 bp, Homo sapiens
tcccttccctccctga

SEQ ID NO: 6415954 - DNA, 14 bp, Homo sapiens
tcccttccctcctc

SEQ ID NO: 6415955 - DNA, 15 bp, Homo sapiens
tcccttccctcctcc

SEQ ID NO: 6415956 - DNA, 16 bp, Homo sapiens
tcccttccctcctccc

SEQ ID NO: 6415957 - DNA, 21 bp, Homo sapiens
tcccttccgaccctctgggaa

SEQ ID NO: 6415958 - DNA, 14 bp, Homo sapiens
tcccttcctattct

SEQ ID NO: 6415959 - DNA, 17 bp, Homo sapiens
tcccttcctattctcct

SEQ ID NO: 6415960 - DNA, 20 bp, Homo sapiens
tcccttcctattctcctgcc

SEQ ID NO: 6415961 - DNA, 23 bp, Homo sapiens
tcccttcctattctcctgccatg

SEQ ID NO: 6415962 - DNA, 14 bp, Homo sapiens
tcccttcctcaccc

SEQ ID NO: 6415963 - DNA, 20 bp, Homo sapiens
tcccttcctccgctcccctt

SEQ ID NO: 6415964 - DNA, 18 bp, Homo sapiens
tcccttcctcctctcctg

SEQ ID NO: 6415965 - DNA, 22 bp, Homo sapiens
tcccttcctcggtggctctggg

SEQ ID NO: 6415966 - DNA, 16 bp, Homo sapiens
tcccttcctctctcct

SEQ ID NO: 6415967 - DNA, 13 bp, Homo sapiens
tcccttcctctga

SEQ ID NO: 6415968 - DNA, 13 bp, Homo sapiens
tcccttcctcttc

SEQ ID NO: 6415969 - DNA, 15 bp, Homo sapiens
tcccttcctctttcc

SEQ ID NO: 6415970 - DNA, 15 bp, Homo sapiens
tcccttcctggaaac

SEQ ID NO: 6415971 - DNA, 22 bp, Homo sapiens
tcccttcctggaaacagcatga

SEQ ID NO: 6415972 - DNA, 14 bp, Homo sapiens
tcccttcctggcct

SEQ ID NO: 6415973 - DNA, 11 bp, Homo sapiens
tcccttcctgt

SEQ ID NO: 6415974 - DNA, 15 bp, Homo sapiens
tcccttcctgtcctg

SEQ ID NO: 6415975 - DNA, 14 bp, Homo sapiens
tcccttcctgttcc

SEQ ID NO: 6415976 - DNA, 22 bp, Homo sapiens
tcccttcctgttccctcctggt

SEQ ID NO: 6415977 - DNA, 23 bp, Homo sapiens
tcccttcctgttccctcctggtc

SEQ ID NO: 6415978 - DNA, 19 bp, Homo sapiens
tcccttccttcctctcctg

SEQ ID NO: 6415979 - DNA, 16 bp, Homo sapiens
tcccttccttgggcag

SEQ ID NO: 6415980 - DNA, 18 bp, Homo sapiens
tcccttccttttccctgc

SEQ ID NO: 6415981 - DNA, 17 bp, Homo sapiens
tcccttcgacagcattt

SEQ ID NO: 6415982 - DNA, 17 bp, Homo sapiens
tcccttcgagtccagga

SEQ ID NO: 6415983 - DNA, 14 bp, Homo sapiens
tcccttcgctctgc

SEQ ID NO: 6415984 - DNA, 15 bp, Homo sapiens
tcccttcggccaaac

SEQ ID NO: 6415985 - DNA, 20 bp, Homo sapiens
tcccttctacctgccactca

SEQ ID NO: 6415986 - DNA, 19 bp, Homo sapiens
tcccttctactgcttctac

SEQ ID NO: 6415987 - DNA, 20 bp, Homo sapiens
tcccttctatatcctcaagg

SEQ ID NO: 6415988 - DNA, 14 bp, Homo sapiens
tcccttctatgcag

SEQ ID NO: 6415989 - DNA, 19 bp, Homo sapiens
tcccttctcagaaaacttc

SEQ ID NO: 6415990 - DNA, 16 bp, Homo sapiens
tcccttctccccagcc

SEQ ID NO: 6415991 - DNA, 19 bp, Homo sapiens
tcccttctccccagccaga

SEQ ID NO: 6415992 - DNA, 13 bp, Homo sapiens
tcccttctccccc

SEQ ID NO: 6415993 - DNA, 20 bp, Homo sapiens
tcccttctcccccttgtctt

SEQ ID NO: 6415994 - DNA, 23 bp, Homo sapiens
tcccttctcccccttgtcttccc

SEQ ID NO: 6415995 - DNA, 14 bp, Homo sapiens
tcccttctccctgg

SEQ ID NO: 6415996 - DNA, 15 bp, Homo sapiens
tcccttctccctgga

SEQ ID NO: 6415997 - DNA, 13 bp, Homo sapiens
tcccttctccttc

SEQ ID NO: 6415998 - DNA, 21 bp, Homo sapiens
tcccttctccttgataacagc

SEQ ID NO: 6415999 - DNA, 17 bp, Homo sapiens
tcccttctctctttcta

SEQ ID NO: 6416000 - DNA, 15 bp, Homo sapiens
tcccttctctggtct

SEQ ID NO: 6416001 - DNA, 23 bp, Homo sapiens
tcccttctctgtagggaactctg

SEQ ID NO: 6416002 - DNA, 15 bp, Homo sapiens
tcccttctcttgggg

SEQ ID NO: 6416003 - DNA, 17 bp, Homo sapiens
tcccttctgagtctcca

SEQ ID NO: 6416004 - DNA, 13 bp, Homo sapiens
tcccttcttgcat

SEQ ID NO: 6416005 - DNA, 14 bp, Homo sapiens
tcccttctttcctt

SEQ ID NO: 6416006 - DNA, 16 bp, Homo sapiens
tcccttctttccttcc

SEQ ID NO: 6416007 - DNA, 20 bp, Homo sapiens
tcccttctttgcacttttga

SEQ ID NO: 6416008 - DNA, 22 bp, Homo sapiens
tcccttctttttccctttcctt

SEQ ID NO: 6416009 - DNA, 20 bp, Homo sapiens
tcccttgaagttgtggagga

SEQ ID NO: 6416010 - DNA, 15 bp, Homo sapiens
tcccttgaattgtgt

SEQ ID NO: 6416011 - DNA, 13 bp, Homo sapiens
tcccttgaccatt

SEQ ID NO: 6416012 - DNA, 19 bp, Homo sapiens
tcccttgaccattggctgc

SEQ ID NO: 6416013 - DNA, 17 bp, Homo sapiens
tcccttgacctttccag

SEQ ID NO: 6416014 - DNA, 20 bp, Homo sapiens
tcccttgagaattccctgtg

SEQ ID NO: 6416015 - DNA, 13 bp, Homo sapiens
tcccttgagacct

SEQ ID NO: 6416016 - DNA, 16 bp, Homo sapiens
tcccttgagacctcag

SEQ ID NO: 6416017 - DNA, 17 bp, Homo sapiens
tcccttgagacctcagc

SEQ ID NO: 6416018 - DNA, 22 bp, Homo sapiens
tcccttgagatgagtttctggg

SEQ ID NO: 6416019 - DNA, 20 bp, Homo sapiens
tcccttgagtaggccctgct

SEQ ID NO: 6416020 - DNA, 15 bp, Homo sapiens
tcccttgatgcacag

SEQ ID NO: 6416021 - DNA, 22 bp, Homo sapiens
tcccttgatgcacagagaagct

SEQ ID NO: 6416022 - DNA, 16 bp, Homo sapiens
tcccttgattcaaata

SEQ ID NO: 6416023 - DNA, 21 bp, Homo sapiens
tcccttgcaggggtcccccct

SEQ ID NO: 6416024 - DNA, 15 bp, Homo sapiens
tcccttgccccaggc

SEQ ID NO: 6416025 - DNA, 17 bp, Homo sapiens
tcccttgccccaggcca

SEQ ID NO: 6416026 - DNA, 18 bp, Homo sapiens
tcccttgcccccctggcc

SEQ ID NO: 6416027 - DNA, 20 bp, Homo sapiens
tcccttgccctccctttctc

SEQ ID NO: 6416028 - DNA, 20 bp, Homo sapiens
tcccttgcctcaatgccagt

SEQ ID NO: 6416029 - DNA, 14 bp, Homo sapiens
tcccttgcctctgc

SEQ ID NO: 6416030 - DNA, 18 bp, Homo sapiens
tcccttgccttcctcagc

SEQ ID NO: 6416031 - DNA, 19 bp, Homo sapiens
tcccttgctcagtgcctcc

SEQ ID NO: 6416032 - DNA, 20 bp, Homo sapiens
tcccttgctcagtgcctcct

SEQ ID NO: 6416033 - DNA, 21 bp, Homo sapiens
tcccttgctcagtgcctcctg

SEQ ID NO: 6416034 - DNA, 18 bp, Homo sapiens
tcccttgctcatgagctc

SEQ ID NO: 6416035 - DNA, 22 bp, Homo sapiens
tcccttgctcatgagctcctga

SEQ ID NO: 6416036 - DNA, 17 bp, Homo sapiens
tcccttgctgaacacac

SEQ ID NO: 6416037 - DNA, 20 bp, Homo sapiens
tcccttgctgaacacacaca

SEQ ID NO: 6416038 - DNA, 15 bp, Homo sapiens
tcccttgctggcccc

SEQ ID NO: 6416039 - DNA, 16 bp, Homo sapiens
tcccttgctggcccca

SEQ ID NO: 6416040 - DNA, 17 bp, Homo sapiens
tcccttgctggccccag

SEQ ID NO: 6416041 - DNA, 15 bp, Homo sapiens
tcccttgcttagcct

SEQ ID NO: 6416042 - DNA, 23 bp, Homo sapiens
tcccttgcttgcctgcagggcca

SEQ ID NO: 6416043 - DNA, 21 bp, Homo sapiens
tcccttgctttgttttaataa

SEQ ID NO: 6416044 - DNA, 18 bp, Homo sapiens
tcccttggaaacctgccc

SEQ ID NO: 6416045 - DNA, 15 bp, Homo sapiens
tcccttggacatttt

SEQ ID NO: 6416046 - DNA, 19 bp, Homo sapiens
tcccttggacattttatgt

SEQ ID NO: 6416047 - DNA, 22 bp, Homo sapiens
tcccttggacattttatgtctt

SEQ ID NO: 6416048 - DNA, 13 bp, Homo sapiens
tcccttggaggga

SEQ ID NO: 6416049 - DNA, 12 bp, Homo sapiens
tcccttggccac

SEQ ID NO: 6416050 - DNA, 16 bp, Homo sapiens
tcccttggccacggcc

SEQ ID NO: 6416051 - DNA, 23 bp, Homo sapiens
tcccttggccacggcctgggagg

SEQ ID NO: 6416052 - DNA, 15 bp, Homo sapiens
tcccttggcccagag

SEQ ID NO: 6416053 - DNA, 16 bp, Homo sapiens
tcccttggctgttaag

SEQ ID NO: 6416054 - DNA, 19 bp, Homo sapiens
tcccttggctttgaggccg

SEQ ID NO: 6416055 - DNA, 21 bp, Homo sapiens
tcccttgggaaggacacagca

SEQ ID NO: 6416056 - DNA, 16 bp, Homo sapiens
tcccttgggcacgtgt

SEQ ID NO: 6416057 - DNA, 22 bp, Homo sapiens
tcccttgggcacgtgtgctggg

SEQ ID NO: 6416058 - DNA, 14 bp, Homo sapiens
tcccttgggctctg

SEQ ID NO: 6416059 - DNA, 21 bp, Homo sapiens
tcccttgggctctgatgaaaa

SEQ ID NO: 6416060 - DNA, 17 bp, Homo sapiens
tcccttgggttctgata

SEQ ID NO: 6416061 - DNA, 23 bp, Homo sapiens
tcccttggtgccctcgcctcctc

SEQ ID NO: 6416062 - DNA, 19 bp, Homo sapiens
tcccttggtggcaagagcc

SEQ ID NO: 6416063 - DNA, 22 bp, Homo sapiens
tcccttggtttagaggaaccca

SEQ ID NO: 6416064 - DNA, 23 bp, Homo sapiens
tcccttgtacctatggctgcctg

SEQ ID NO: 6416065 - DNA, 19 bp, Homo sapiens
tcccttgtatcccctgcag

SEQ ID NO: 6416066 - DNA, 21 bp, Homo sapiens
tcccttgtatcccctgcaggc

SEQ ID NO: 6416067 - DNA, 12 bp, Homo sapiens
tcccttgtattt

SEQ ID NO: 6416068 - DNA, 20 bp, Homo sapiens
tcccttgtgttccttctgtg

SEQ ID NO: 6416069 - DNA, 23 bp, Homo sapiens
tcccttgtgttccttctgtgaag

SEQ ID NO: 6416070 - DNA, 15 bp, Homo sapiens
tcccttgtttttgat

SEQ ID NO: 6416071 - DNA, 16 bp, Homo sapiens
tcccttgtttttgatg

SEQ ID NO: 6416072 - DNA, 13 bp, Homo sapiens
tccctttaaagag

SEQ ID NO: 6416073 - DNA, 14 bp, Homo sapiens
tccctttaaagaga

SEQ ID NO: 6416074 - DNA, 16 bp, Homo sapiens
tatatggataatctga

SEQ ID NO: 6416075 - DNA, 19 bp, Homo sapiens
tatatggatgattcagaaa

SEQ ID NO: 6416076 - DNA, 16 bp, Homo sapiens
tatatggcaagaaagc

SEQ ID NO: 6416077 - DNA, 20 bp, Homo sapiens
tatatggcagagttgtaaat

SEQ ID NO: 6416078 - DNA, 22 bp, Homo sapiens
tatatggcagagttgtaaatat

SEQ ID NO: 6416079 - DNA, 23 bp, Homo sapiens
tatatggcagagttgtaaatata

SEQ ID NO: 6416080 - DNA, 22 bp, Homo sapiens
tatatggcaggagctactgaga

SEQ ID NO: 6416081 - DNA, 20 bp, Homo sapiens
tatatggcgttttgtctgtg

SEQ ID NO: 6416082 - DNA, 22 bp, Homo sapiens
tatatgggggaaaattattttg

SEQ ID NO: 6416083 - DNA, 15 bp, Homo sapiens
tatatggtatatata

SEQ ID NO: 6416084 - DNA, 15 bp, Homo sapiens
tatatggtctaatgt

SEQ ID NO: 6416085 - DNA, 16 bp, Homo sapiens
tatatggtctgtgtgt

SEQ ID NO: 6416086 - DNA, 14 bp, Homo sapiens
tatatgtaaatata

SEQ ID NO: 6416087 - DNA, 16 bp, Homo sapiens
tatatgtaaatataca

SEQ ID NO: 6416088 - DNA, 13 bp, Homo sapiens
tatatgtaaatgt

SEQ ID NO: 6416089 - DNA, 14 bp, Homo sapiens
tatatgtaaatgtg

SEQ ID NO: 6416090 - DNA, 15 bp, Homo sapiens
tatatgtaaatgtgt

SEQ ID NO: 6416091 - DNA, 15 bp, Homo sapiens
tatatgtaacagttt

SEQ ID NO: 6416092 - DNA, 12 bp, Homo sapiens
tatatgtacagt

SEQ ID NO: 6416093 - DNA, 21 bp, Homo sapiens
tatatgtacatacattcatac

SEQ ID NO: 6416094 - DNA, 12 bp, Homo sapiens
tatatgtacatg

SEQ ID NO: 6416095 - DNA, 14 bp, Homo sapiens
tatatgtataatat

SEQ ID NO: 6416096 - DNA, 15 bp, Homo sapiens
tatatgtatataaaa

SEQ ID NO: 6416097 - DNA, 14 bp, Homo sapiens
tatatgtatatcta

SEQ ID NO: 6416098 - DNA, 19 bp, Homo sapiens
tatatgtatatctatatct

SEQ ID NO: 6416099 - DNA, 15 bp, Homo sapiens
tatatgtatatgtat

SEQ ID NO: 6416100 - DNA, 15 bp, Homo sapiens
tatatgtatccagta

SEQ ID NO: 6416101 - DNA, 21 bp, Homo sapiens
tatatgtatggatctatattt

SEQ ID NO: 6416102 - DNA, 14 bp, Homo sapiens
tatatgtatgtagt

SEQ ID NO: 6416103 - DNA, 19 bp, Homo sapiens
tatatgtatgtgtttagaa

SEQ ID NO: 6416104 - DNA, 16 bp, Homo sapiens
tatatgtattatttat

SEQ ID NO: 6416105 - DNA, 20 bp, Homo sapiens
tatatgtattcccttgtatt

SEQ ID NO: 6416106 - DNA, 12 bp, Homo sapiens
tatatgtattta

SEQ ID NO: 6416107 - DNA, 17 bp, Homo sapiens
tatatgtatttaaaaac

SEQ ID NO: 6416108 - DNA, 18 bp, Homo sapiens
tatatgtatttaagatgt

SEQ ID NO: 6416109 - DNA, 16 bp, Homo sapiens
tatatgtatttattgt

SEQ ID NO: 6416110 - DNA, 15 bp, Homo sapiens
tatatgtatttctat

SEQ ID NO: 6416111 - DNA, 12 bp, Homo sapiens
tatatgtcaaag

SEQ ID NO: 6416112 - DNA, 20 bp, Homo sapiens
tatatgtcagacatgaaaac

SEQ ID NO: 6416113 - DNA, 12 bp, Homo sapiens
tatatgtccttg

SEQ ID NO: 6416114 - DNA, 14 bp, Homo sapiens
tatatgtctagata

SEQ ID NO: 6416115 - DNA, 16 bp, Homo sapiens
tatatgtctatataca

SEQ ID NO: 6416116 - DNA, 18 bp, Homo sapiens
tatatgtgaaacattttt

SEQ ID NO: 6416117 - DNA, 18 bp, Homo sapiens
tatatgtgaacatttatc

SEQ ID NO: 6416118 - DNA, 17 bp, Homo sapiens
tatatgtgattttcaaa

SEQ ID NO: 6416119 - DNA, 21 bp, Homo sapiens
tatatgtgattttcaaatatg

SEQ ID NO: 6416120 - DNA, 18 bp, Homo sapiens
tatatgtgcggcttttca

SEQ ID NO: 6416121 - DNA, 16 bp, Homo sapiens
tatatgtgtatacata

SEQ ID NO: 6416122 - DNA, 19 bp, Homo sapiens
tatatgtgtatacatacat

SEQ ID NO: 6416123 - DNA, 19 bp, Homo sapiens
tatatgtgtatatatacat

SEQ ID NO: 6416124 - DNA, 14 bp, Homo sapiens
tatatgtgtatgta

SEQ ID NO: 6416125 - DNA, 13 bp, Homo sapiens
tatatgtgtgtgt

SEQ ID NO: 6416126 - DNA, 14 bp, Homo sapiens
tatatgttctgcaa

SEQ ID NO: 6416127 - DNA, 20 bp, Homo sapiens
tatatgttctgcaagaatta

SEQ ID NO: 6416128 - DNA, 14 bp, Homo sapiens
tatatgttcttcat

SEQ ID NO: 6416129 - DNA, 15 bp, Homo sapiens
tatatgttcttcata

SEQ ID NO: 6416130 - DNA, 18 bp, Homo sapiens
tatatgttcttcataagc

SEQ ID NO: 6416131 - DNA, 23 bp, Homo sapiens
tatatgttgaatgttaacaggta

SEQ ID NO: 6416132 - DNA, 16 bp, Homo sapiens
tatatgtttatacaca

SEQ ID NO: 6416133 - DNA, 17 bp, Homo sapiens
tatatgtttatacacac

SEQ ID NO: 6416134 - DNA, 19 bp, Homo sapiens
tatatgtttatacacacag

SEQ ID NO: 6416135 - DNA, 15 bp, Homo sapiens
tatatgtttgtggaa

SEQ ID NO: 6416136 - DNA, 12 bp, Homo sapiens
tatatgttttaa

SEQ ID NO: 6416137 - DNA, 11 bp, Homo sapiens
tatatgttttg

SEQ ID NO: 6416138 - DNA, 12 bp, Homo sapiens
tatatgttttga

SEQ ID NO: 6416139 - DNA, 18 bp, Homo sapiens
tatatgttttgagaaaaa

SEQ ID NO: 6416140 - DNA, 17 bp, Homo sapiens
tatattaaaaatataaa

SEQ ID NO: 6416141 - DNA, 18 bp, Homo sapiens
tatattaaaaatataaaa

SEQ ID NO: 6416142 - DNA, 21 bp, Homo sapiens
tatattaaaaatataaaactg

SEQ ID NO: 6416143 - DNA, 23 bp, Homo sapiens
tatattaaaaatataaaactgcg

SEQ ID NO: 6416144 - DNA, 14 bp, Homo sapiens
tatattaaaaatgg

SEQ ID NO: 6416145 - DNA, 19 bp, Homo sapiens
tatattaaaaatggtaaaa

SEQ ID NO: 6416146 - DNA, 14 bp, Homo sapiens
tatattaaaatagc

SEQ ID NO: 6416147 - DNA, 16 bp, Homo sapiens
tatattaaaatatgaa

SEQ ID NO: 6416148 - DNA, 15 bp, Homo sapiens
tatattaaaattgat

SEQ ID NO: 6416149 - DNA, 13 bp, Homo sapiens
tatattaaacata

SEQ ID NO: 6416150 - DNA, 22 bp, Homo sapiens
tatattaaagaaaaactttaaa

SEQ ID NO: 6416151 - DNA, 14 bp, Homo sapiens
tatattaaagaagt

SEQ ID NO: 6416152 - DNA, 22 bp, Homo sapiens
tatattaaaggtatacaaataa

SEQ ID NO: 6416153 - DNA, 13 bp, Homo sapiens
tatattaactttt

SEQ ID NO: 6416154 - DNA, 15 bp, Homo sapiens
tatattaacttttat

SEQ ID NO: 6416155 - DNA, 13 bp, Homo sapiens
tatattaagcaga

SEQ ID NO: 6416156 - DNA, 15 bp, Homo sapiens
tatattaatgtactt

SEQ ID NO: 6416157 - DNA, 14 bp, Homo sapiens
tatattaatttgtt

SEQ ID NO: 6416158 - DNA, 21 bp, Homo sapiens
tatattacacatttgtacaga

SEQ ID NO: 6416159 - DNA, 19 bp, Homo sapiens
tatattacctcaaattcct

SEQ ID NO: 6416160 - DNA, 20 bp, Homo sapiens
tatattacggaggaacagat

SEQ ID NO: 6416161 - DNA, 17 bp, Homo sapiens
tatattactgatttaga

SEQ ID NO: 6416162 - DNA, 17 bp, Homo sapiens
tatattacttttgtaaa

SEQ ID NO: 6416163 - DNA, 18 bp, Homo sapiens
tatattagataaccatat

SEQ ID NO: 6416164 - DNA, 16 bp, Homo sapiens
tatattagctgaaaca

SEQ ID NO: 6416165 - DNA, 23 bp, Homo sapiens
tatattaggcctgtgtgtaagct

SEQ ID NO: 6416166 - DNA, 14 bp, Homo sapiens
tatattagttgctt

SEQ ID NO: 6416167 - DNA, 20 bp, Homo sapiens
tatattataaatatatataa

SEQ ID NO: 6416168 - DNA, 18 bp, Homo sapiens
tatattataagttgacct

SEQ ID NO: 6416169 - DNA, 17 bp, Homo sapiens
tatattataataatgtt

SEQ ID NO: 6416170 - DNA, 18 bp, Homo sapiens
tatattatacttgtaatt

SEQ ID NO: 6416171 - DNA, 15 bp, Homo sapiens
tatattatatacata

SEQ ID NO: 6416172 - DNA, 13 bp, Homo sapiens
tatattatatata

SEQ ID NO: 6416173 - DNA, 14 bp, Homo sapiens
tatattatcagaca

SEQ ID NO: 6416174 - DNA, 16 bp, Homo sapiens
tatattatcataagaa

SEQ ID NO: 6416175 - DNA, 18 bp, Homo sapiens
tatattatcataagaatt

SEQ ID NO: 6416176 - DNA, 17 bp, Homo sapiens
tatattatcatatctct

SEQ ID NO: 6416177 - DNA, 17 bp, Homo sapiens
tatattatcttctggtg

SEQ ID NO: 6416178 - DNA, 12 bp, Homo sapiens
tatattatgaaa

SEQ ID NO: 6416179 - DNA, 19 bp, Homo sapiens
tatattatgaaaattaaga

SEQ ID NO: 6416180 - DNA, 19 bp, Homo sapiens
tatattatgtcttcttttg

SEQ ID NO: 6416181 - DNA, 16 bp, Homo sapiens
tatattatgtgaagaa

SEQ ID NO: 6416182 - DNA, 16 bp, Homo sapiens
tatattattacttgta

SEQ ID NO: 6416183 - DNA, 22 bp, Homo sapiens
tatattattgctatatttgcta

SEQ ID NO: 6416184 - DNA, 13 bp, Homo sapiens
tatattattgtaa

SEQ ID NO: 6416185 - DNA, 23 bp, Homo sapiens
tatattattgtaagttgtacaaa

SEQ ID NO: 6416186 - DNA, 20 bp, Homo sapiens
tatattatttagtcaacata

SEQ ID NO: 6416187 - DNA, 23 bp, Homo sapiens
tatattatttctaggaagaattt

SEQ ID NO: 6416188 - DNA, 14 bp, Homo sapiens
tatattatttgcag

SEQ ID NO: 6416189 - DNA, 13 bp, Homo sapiens
tatattatttggc

SEQ ID NO: 6416190 - DNA, 14 bp, Homo sapiens
tatattatttggca

SEQ ID NO: 6416191 - DNA, 22 bp, Homo sapiens
tatattcaaattatgtataaat

SEQ ID NO: 6416192 - DNA, 12 bp, Homo sapiens
tatattcaacca

SEQ ID NO: 6416193 - DNA, 13 bp, Homo sapiens
tatattcaaccat

SEQ ID NO: 6416194 - DNA, 17 bp, Homo sapiens
tatattcagagatgtac

SEQ ID NO: 6416195 - DNA, 23 bp, Homo sapiens
tatattcagagatgtaccatgtt

SEQ ID NO: 6416196 - DNA, 22 bp, Homo sapiens
tatattcaggacttgaaagaaa

SEQ ID NO: 6416197 - DNA, 13 bp, Homo sapiens
tatattcataata

SEQ ID NO: 6416198 - DNA, 23 bp, Homo sapiens
tatattcataatatataaaagaa

SEQ ID NO: 6416199 - DNA, 17 bp, Homo sapiens
tatattcatatacaaac

SEQ ID NO: 6416200 - DNA, 22 bp, Homo sapiens
tatattcatatacaaacatgta

SEQ ID NO: 6416201 - DNA, 19 bp, Homo sapiens
tatattcatcagaatgtta

SEQ ID NO: 6416202 - DNA, 22 bp, Homo sapiens
tatattcatgtaataaatctga

SEQ ID NO: 6416203 - DNA, 23 bp, Homo sapiens
tatattcattcagatataagatt

SEQ ID NO: 6416204 - DNA, 19 bp, Homo sapiens
tatattcattctttttgaa

SEQ ID NO: 6416205 - DNA, 20 bp, Homo sapiens
tatattcattctttttgaaa

SEQ ID NO: 6416206 - DNA, 14 bp, Homo sapiens
tatattccaaggaa

SEQ ID NO: 6416207 - DNA, 18 bp, Homo sapiens
tatattccaggtttaagt

SEQ ID NO: 6416208 - DNA, 21 bp, Homo sapiens
tatattccatatattagcatt

SEQ ID NO: 6416209 - DNA, 19 bp, Homo sapiens
tatattcccctaagatttg

SEQ ID NO: 6416210 - DNA, 19 bp, Homo sapiens
tatattccttttaaagaag

SEQ ID NO: 6416211 - DNA, 23 bp, Homo sapiens
tatattccttttcccaggaaaga

SEQ ID NO: 6416212 - DNA, 13 bp, Homo sapiens
tatattctaaatt

SEQ ID NO: 6416213 - DNA, 22 bp, Homo sapiens
tatattctattccatgtccata

SEQ ID NO: 6416214 - DNA, 17 bp, Homo sapiens
tatattctcagcagagt

SEQ ID NO: 6416215 - DNA, 17 bp, Homo sapiens
tatattctgcagaaaat

SEQ ID NO: 6416216 - DNA, 13 bp, Homo sapiens
tatattctggaaa

SEQ ID NO: 6416217 - DNA, 14 bp, Homo sapiens
tatattctggaaaa

SEQ ID NO: 6416218 - DNA, 22 bp, Homo sapiens
tatattctggaaaaaaaatata

SEQ ID NO: 6416219 - DNA, 22 bp, Homo sapiens
tatattctggccagactcgatg

SEQ ID NO: 6416220 - DNA, 16 bp, Homo sapiens
tatattctttcaaagg

SEQ ID NO: 6416221 - DNA, 14 bp, Homo sapiens
tatattgaaaaaaa

SEQ ID NO: 6416222 - DNA, 12 bp, Homo sapiens
tatattgaaaag

SEQ ID NO: 6416223 - DNA, 16 bp, Homo sapiens
tatattgaaaagaaaa

SEQ ID NO: 6416224 - DNA, 22 bp, Homo sapiens
tatattgaaaagaaaaagaaga

SEQ ID NO: 6416225 - DNA, 13 bp, Homo sapiens
tatattgaacttt

SEQ ID NO: 6416226 - DNA, 20 bp, Homo sapiens
tatattgaagacaatttgat

SEQ ID NO: 6416227 - DNA, 13 bp, Homo sapiens
tatattgaataaa

SEQ ID NO: 6416228 - DNA, 15 bp, Homo sapiens
tatattgaatatatc

SEQ ID NO: 6416229 - DNA, 14 bp, Homo sapiens
tatattgagacaaa

SEQ ID NO: 6416230 - DNA, 15 bp, Homo sapiens
tatattgataaattt

SEQ ID NO: 6416231 - DNA, 23 bp, Homo sapiens
tatattgataaattttaaaattg

SEQ ID NO: 6416232 - DNA, 22 bp, Homo sapiens
tatattgataacagcactgact

SEQ ID NO: 6416233 - DNA, 16 bp, Homo sapiens
tatattgattatagca

SEQ ID NO: 6416234 - DNA, 22 bp, Homo sapiens
tatattgccagtatataagctg

SEQ ID NO: 6416235 - DNA, 12 bp, Homo sapiens
tatattgcctta

SEQ ID NO: 6416236 - DNA, 19 bp, Homo sapiens
tatattggtaacatccttt

SEQ ID NO: 6416237 - DNA, 15 bp, Homo sapiens
tatattggtgtatat

SEQ ID NO: 6416238 - DNA, 18 bp, Homo sapiens
tatattggtgtatattat

SEQ ID NO: 6416239 - DNA, 16 bp, Homo sapiens
tatattgtaaagaagg

SEQ ID NO: 6416240 - DNA, 12 bp, Homo sapiens
tatattgtaaga

SEQ ID NO: 6416241 - DNA, 15 bp, Homo sapiens
tatattgtaagaaat

SEQ ID NO: 6416242 - DNA, 12 bp, Homo sapiens
tatattgtaatt

SEQ ID NO: 6416243 - DNA, 16 bp, Homo sapiens
tatattgtatattctg

SEQ ID NO: 6416244 - DNA, 15 bp, Homo sapiens
tatattgtattaagg

SEQ ID NO: 6416245 - DNA, 16 bp, Homo sapiens
tatattgtctgtaaaa

SEQ ID NO: 6416246 - DNA, 12 bp, Homo sapiens
tatattgtggaa

SEQ ID NO: 6416247 - DNA, 19 bp, Homo sapiens
tatattgtggaataaatcc

SEQ ID NO: 6416248 - DNA, 19 bp, Homo sapiens
tatattgtgtttgtgtatt

SEQ ID NO: 6416249 - DNA, 15 bp, Homo sapiens
tatattgtgttttaa

SEQ ID NO: 6416250 - DNA, 21 bp, Homo sapiens
tatattgttaaatcctttgct

SEQ ID NO: 6416251 - DNA, 15 bp, Homo sapiens
tatattgtttgctaa

SEQ ID NO: 6416252 - DNA, 17 bp, Homo sapiens
tatattgtttttatata

SEQ ID NO: 6416253 - DNA, 20 bp, Homo sapiens
tatattgtttttgtatttat

SEQ ID NO: 6416254 - DNA, 16 bp, Homo sapiens
tatatttaaaaaatta

SEQ ID NO: 6416255 - DNA, 16 bp, Homo sapiens
tccctttaaagagcaa

SEQ ID NO: 6416256 - DNA, 20 bp, Homo sapiens
tccctttacaatgtgaatag

SEQ ID NO: 6416257 - DNA, 21 bp, Homo sapiens
tccctttacagctctcctcca

SEQ ID NO: 6416258 - DNA, 21 bp, Homo sapiens
tccctttaccactgtggtttt

SEQ ID NO: 6416259 - DNA, 22 bp, Homo sapiens
tccctttagaacggttgcccca

SEQ ID NO: 6416260 - DNA, 20 bp, Homo sapiens
tccctttatcatgtgtttct

SEQ ID NO: 6416261 - DNA, 13 bp, Homo sapiens
tccctttatgtat

SEQ ID NO: 6416262 - DNA, 17 bp, Homo sapiens
tccctttatttcacata

SEQ ID NO: 6416263 - DNA, 17 bp, Homo sapiens
tccctttatttctcttc

SEQ ID NO: 6416264 - DNA, 23 bp, Homo sapiens
tccctttcatatgaggggaccca

SEQ ID NO: 6416265 - DNA, 17 bp, Homo sapiens
tccctttcatttgctat

SEQ ID NO: 6416266 - DNA, 22 bp, Homo sapiens
tccctttccaaatgcccagctt

SEQ ID NO: 6416267 - DNA, 22 bp, Homo sapiens
tccctttcccatccataaggtg

SEQ ID NO: 6416268 - DNA, 16 bp, Homo sapiens
tccctttccccagcat

SEQ ID NO: 6416269 - DNA, 21 bp, Homo sapiens
tccctttccccattcagtgac

SEQ ID NO: 6416270 - DNA, 16 bp, Homo sapiens
tccctttccctacctt

SEQ ID NO: 6416271 - DNA, 20 bp, Homo sapiens
tccctttccctgcatccctt

SEQ ID NO: 6416272 - DNA, 13 bp, Homo sapiens
tccctttcctggt

SEQ ID NO: 6416273 - DNA, 14 bp, Homo sapiens
tccctttccttcca

SEQ ID NO: 6416274 - DNA, 13 bp, Homo sapiens
tccctttcctttc

SEQ ID NO: 6416275 - DNA, 14 bp, Homo sapiens
tccctttcctttcc

SEQ ID NO: 6416276 - DNA, 20 bp, Homo sapiens
tccctttctaagcaaccaca

SEQ ID NO: 6416277 - DNA, 15 bp, Homo sapiens
tccctttctcccctg

SEQ ID NO: 6416278 - DNA, 18 bp, Homo sapiens
tccctttctcccctgccc

SEQ ID NO: 6416279 - DNA, 21 bp, Homo sapiens
tccctttctctctcctctctg

SEQ ID NO: 6416280 - DNA, 13 bp, Homo sapiens
tccctttctcttc

SEQ ID NO: 6416281 - DNA, 14 bp, Homo sapiens
tccctttctgcccg

SEQ ID NO: 6416282 - DNA, 21 bp, Homo sapiens
tccctttcttggccagttatc

SEQ ID NO: 6416283 - DNA, 18 bp, Homo sapiens
tccctttcttttcatgcc

SEQ ID NO: 6416284 - DNA, 16 bp, Homo sapiens
tccctttgaagataat

SEQ ID NO: 6416285 - DNA, 16 bp, Homo sapiens
tccctttgacgccatc

SEQ ID NO: 6416286 - DNA, 21 bp, Homo sapiens
tccctttgacgccatcccagc

SEQ ID NO: 6416287 - DNA, 22 bp, Homo sapiens
tccctttgacgccatcccagcc

SEQ ID NO: 6416288 - DNA, 23 bp, Homo sapiens
tccctttgacgccatcccagccc

SEQ ID NO: 6416289 - DNA, 23 bp, Homo sapiens
tccctttgacttcagctgcctga

SEQ ID NO: 6416290 - DNA, 17 bp, Homo sapiens
tccctttgcacctgaga

SEQ ID NO: 6416291 - DNA, 17 bp, Homo sapiens
tccctttgcccagaaag

SEQ ID NO: 6416292 - DNA, 12 bp, Homo sapiens
tccctttgcctt

SEQ ID NO: 6416293 - DNA, 13 bp, Homo sapiens
tccctttgcctta

SEQ ID NO: 6416294 - DNA, 19 bp, Homo sapiens
tccctttgcgtcaggagca

SEQ ID NO: 6416295 - DNA, 11 bp, Homo sapiens
tccctttgctc

SEQ ID NO: 6416296 - DNA, 16 bp, Homo sapiens
tccctttgctccaccc

SEQ ID NO: 6416297 - DNA, 22 bp, Homo sapiens
tccctttgctgctgatgggcat

SEQ ID NO: 6416298 - DNA, 18 bp, Homo sapiens
tccctttgcttgtcttct

SEQ ID NO: 6416299 - DNA, 14 bp, Homo sapiens
tccctttgtctttc

SEQ ID NO: 6416300 - DNA, 14 bp, Homo sapiens
tccctttgttgctg

SEQ ID NO: 6416301 - DNA, 17 bp, Homo sapiens
tccctttgttgctgtct

SEQ ID NO: 6416302 - DNA, 18 bp, Homo sapiens
tcccttttaaacacattt

SEQ ID NO: 6416303 - DNA, 13 bp, Homo sapiens
tcccttttaaaga

SEQ ID NO: 6416304 - DNA, 17 bp, Homo sapiens
tcccttttaatataaaa

SEQ ID NO: 6416305 - DNA, 13 bp, Homo sapiens
tcccttttacata

SEQ ID NO: 6416306 - DNA, 20 bp, Homo sapiens
tcccttttacattctgtgtg

SEQ ID NO: 6416307 - DNA, 20 bp, Homo sapiens
tcccttttataattaatgtt

SEQ ID NO: 6416308 - DNA, 20 bp, Homo sapiens
tcccttttcaccttttcagg

SEQ ID NO: 6416309 - DNA, 13 bp, Homo sapiens
tcccttttcagat

SEQ ID NO: 6416310 - DNA, 15 bp, Homo sapiens
tcccttttccatcat

SEQ ID NO: 6416311 - DNA, 14 bp, Homo sapiens
tcccttttccatga

SEQ ID NO: 6416312 - DNA, 14 bp, Homo sapiens
tcccttttcctgtc

SEQ ID NO: 6416313 - DNA, 21 bp, Homo sapiens
tcccttttcctttctggcccc

SEQ ID NO: 6416314 - DNA, 14 bp, Homo sapiens
tcccttttctcctc

SEQ ID NO: 6416315 - DNA, 14 bp, Homo sapiens
tcccttttcttgac

SEQ ID NO: 6416316 - DNA, 18 bp, Homo sapiens
tcccttttctttcctttt

SEQ ID NO: 6416317 - DNA, 18 bp, Homo sapiens
tcccttttgacacagttg

SEQ ID NO: 6416318 - DNA, 23 bp, Homo sapiens
tcccttttgcggatgggaggggt

SEQ ID NO: 6416319 - DNA, 12 bp, Homo sapiens
tcccttttgcta

SEQ ID NO: 6416320 - DNA, 20 bp, Homo sapiens
tccctttttatatcccattt

SEQ ID NO: 6416321 - DNA, 16 bp, Homo sapiens
tccctttttcataatt

SEQ ID NO: 6416322 - DNA, 16 bp, Homo sapiens
tccctttttccttgtc

SEQ ID NO: 6416323 - DNA, 17 bp, Homo sapiens
tccctttttccttgtcc

SEQ ID NO: 6416324 - DNA, 21 bp, Homo sapiens
tccctttttccttgtccccac

SEQ ID NO: 6416325 - DNA, 17 bp, Homo sapiens
tccctttttgaattgtg

SEQ ID NO: 6416326 - DNA, 21 bp, Homo sapiens
tccctttttgaattgtgtgga

SEQ ID NO: 6416327 - DNA, 17 bp, Homo sapiens
tcccttttttcttcccc

SEQ ID NO: 6416328 - DNA, 17 bp, Homo sapiens
tcccttttttggctgct

SEQ ID NO: 6416329 - DNA, 19 bp, Homo sapiens
tcccttttttggctgctga

SEQ ID NO: 6416330 - DNA, 22 bp, Homo sapiens
tcccttttttggctgctgaagg

SEQ ID NO: 6416331 - DNA, 19 bp, Homo sapiens
tccctttttttacatttca

SEQ ID NO: 6416332 - DNA, 14 bp, Homo sapiens
tccctttttttgtt

SEQ ID NO: 6416333 - DNA, 17 bp, Homo sapiens
tccctttttttgttatt

SEQ ID NO: 6416334 - DNA, 16 bp, Homo sapiens
tcccttttttttttaa

SEQ ID NO: 6416335 - DNA, 20 bp, Homo sapiens
tccgaaaaaaaaatgttcat

SEQ ID NO: 6416336 - DNA, 22 bp, Homo sapiens
tccgaaaaatcctcttcctctg

SEQ ID NO: 6416337 - DNA, 19 bp, Homo sapiens
tccgaaaccaaagaagaaa

SEQ ID NO: 6416338 - DNA, 21 bp, Homo sapiens
tccgaaagggacttggaagct

SEQ ID NO: 6416339 - DNA, 22 bp, Homo sapiens
tccgaaagggacttggaagctc

SEQ ID NO: 6416340 - DNA, 17 bp, Homo sapiens
tccgaaatgctgtcttt

SEQ ID NO: 6416341 - DNA, 16 bp, Homo sapiens
tccgaacctcctctgt

SEQ ID NO: 6416342 - DNA, 19 bp, Homo sapiens
tccgaacctcctctgtgaa

SEQ ID NO: 6416343 - DNA, 23 bp, Homo sapiens
tccgaacgctgctccatgcacag

SEQ ID NO: 6416344 - DNA, 20 bp, Homo sapiens
tccgaactgttcaagtgtcc

SEQ ID NO: 6416345 - DNA, 23 bp, Homo sapiens
tccgaactgttcaagtgtcccca

SEQ ID NO: 6416346 - DNA, 14 bp, Homo sapiens
tccgaagaaaagaa

SEQ ID NO: 6416347 - DNA, 16 bp, Homo sapiens
tccgaagaaaagatat

SEQ ID NO: 6416348 - DNA, 21 bp, Homo sapiens
tccgaagaaaagatatgtatt

SEQ ID NO: 6416349 - DNA, 21 bp, Homo sapiens
tccgaaggtgtctctggtctt

SEQ ID NO: 6416350 - DNA, 23 bp, Homo sapiens
tccgaagtctctgattagttgac

SEQ ID NO: 6416351 - DNA, 19 bp, Homo sapiens
tccgaatctctttcccttc

SEQ ID NO: 6416352 - DNA, 23 bp, Homo sapiens
tccgacaaccgatgctccagcca

SEQ ID NO: 6416353 - DNA, 19 bp, Homo sapiens
tccgacaagccttcagcca

SEQ ID NO: 6416354 - DNA, 17 bp, Homo sapiens
tccgacagccccctctg

SEQ ID NO: 6416355 - DNA, 20 bp, Homo sapiens
tccgacagccccctctgccg

SEQ ID NO: 6416356 - DNA, 22 bp, Homo sapiens
tccgacagtcaagacggatcca

SEQ ID NO: 6416357 - DNA, 17 bp, Homo sapiens
tccgaccctcatggccc

SEQ ID NO: 6416358 - DNA, 13 bp, Homo sapiens
tccgacctctctc

SEQ ID NO: 6416359 - DNA, 14 bp, Homo sapiens
tccgacctctctca

SEQ ID NO: 6416360 - DNA, 17 bp, Homo sapiens
tccgacctctctcagcc

SEQ ID NO: 6416361 - DNA, 19 bp, Homo sapiens
tccgacctctctcagcccc

SEQ ID NO: 6416362 - DNA, 20 bp, Homo sapiens
tccgacctctctcagcccca

SEQ ID NO: 6416363 - DNA, 19 bp, Homo sapiens
tccgacctggcctgtctgt

SEQ ID NO: 6416364 - DNA, 23 bp, Homo sapiens
tccgacgctgcctctcattggca

SEQ ID NO: 6416365 - DNA, 16 bp, Homo sapiens
tccgactcacaccact

SEQ ID NO: 6416366 - DNA, 19 bp, Homo sapiens
tccgactctaagctgtgtg

SEQ ID NO: 6416367 - DNA, 21 bp, Homo sapiens
tccgactctaagctgtgtgca

SEQ ID NO: 6416368 - DNA, 17 bp, Homo sapiens
tccgactcttctgagca

SEQ ID NO: 6416369 - DNA, 19 bp, Homo sapiens
tccgactgcccctgctgtg

SEQ ID NO: 6416370 - DNA, 17 bp, Homo sapiens
tccgacttcccctgggc

SEQ ID NO: 6416371 - DNA, 15 bp, Homo sapiens
tccgacttgtccctc

SEQ ID NO: 6416372 - DNA, 16 bp, Homo sapiens
tccgagacagtccagt

SEQ ID NO: 6416373 - DNA, 14 bp, Homo sapiens
tccgagacccagga

SEQ ID NO: 6416374 - DNA, 22 bp, Homo sapiens
tccgagacccaggagacaaaca

SEQ ID NO: 6416375 - DNA, 15 bp, Homo sapiens
tccgagaggcagcca

SEQ ID NO: 6416376 - DNA, 14 bp, Homo sapiens
tccgagagggagag

SEQ ID NO: 6416377 - DNA, 15 bp, Homo sapiens
tccgagagggagaga

SEQ ID NO: 6416378 - DNA, 20 bp, Homo sapiens
tccgagatccccagggcagc

SEQ ID NO: 6416379 - DNA, 21 bp, Homo sapiens
tccgagattcagactgcttca

SEQ ID NO: 6416380 - DNA, 22 bp, Homo sapiens
tccgagattcagactgcttcat

SEQ ID NO: 6416381 - DNA, 16 bp, Homo sapiens
tccgagccagctctgg

SEQ ID NO: 6416382 - DNA, 17 bp, Homo sapiens
tccgagcccctgtttct

SEQ ID NO: 6416383 - DNA, 19 bp, Homo sapiens
tccgagccggggagtttct

SEQ ID NO: 6416384 - DNA, 21 bp, Homo sapiens
tccgagccggggagtttcttt

SEQ ID NO: 6416385 - DNA, 16 bp, Homo sapiens
tccgagctctggtgct

SEQ ID NO: 6416386 - DNA, 17 bp, Homo sapiens
tccgagctgtaggagag

SEQ ID NO: 6416387 - DNA, 13 bp, Homo sapiens
tccgaggcagggt

SEQ ID NO: 6416388 - DNA, 20 bp, Homo sapiens
tccgaggcctggctctggag

SEQ ID NO: 6416389 - DNA, 15 bp, Homo sapiens
tccgaggctccccgc

SEQ ID NO: 6416390 - DNA, 14 bp, Homo sapiens
tccgagggcggcca

SEQ ID NO: 6416391 - DNA, 17 bp, Homo sapiens
tccgagggcggccaggg

SEQ ID NO: 6416392 - DNA, 19 bp, Homo sapiens
tccgagggcggccagggac

SEQ ID NO: 6416393 - DNA, 15 bp, Homo sapiens
tccgaggggcgggac

SEQ ID NO: 6416394 - DNA, 23 bp, Homo sapiens
tccgaggggcgggacccaggcac

SEQ ID NO: 6416395 - DNA, 22 bp, Homo sapiens
tccgaggggtggaatgccgctg

SEQ ID NO: 6416396 - DNA, 19 bp, Homo sapiens
tccgagtctttctcactgc

SEQ ID NO: 6416397 - DNA, 21 bp, Homo sapiens
tccgagtctttctcactgcct

SEQ ID NO: 6416398 - DNA, 15 bp, Homo sapiens
tccgatgaattctta

SEQ ID NO: 6416399 - DNA, 18 bp, Homo sapiens
tccgatgacagtgctcta

SEQ ID NO: 6416400 - DNA, 20 bp, Homo sapiens
tccgatggatgaatctccca

SEQ ID NO: 6416401 - DNA, 20 bp, Homo sapiens
tccgatggcccgagagctgg

SEQ ID NO: 6416402 - DNA, 21 bp, Homo sapiens
tccgatggcccgagagctggg

SEQ ID NO: 6416403 - DNA, 17 bp, Homo sapiens
tccgatggtatctgggt

SEQ ID NO: 6416404 - DNA, 19 bp, Homo sapiens
tccgcaacccatgccctgg

SEQ ID NO: 6416405 - DNA, 22 bp, Homo sapiens
tccgcaattcatgtagtttctg

SEQ ID NO: 6416406 - DNA, 14 bp, Homo sapiens
tccgcaccagctgc

SEQ ID NO: 6416407 - DNA, 16 bp, Homo sapiens
tccgcaccagctgctc

SEQ ID NO: 6416408 - DNA, 23 bp, Homo sapiens
tccgcaccagctgctctgcccct

SEQ ID NO: 6416409 - DNA, 14 bp, Homo sapiens
tccgcacctgaccg

SEQ ID NO: 6416410 - DNA, 21 bp, Homo sapiens
tccgcacctgaccgctgccca

SEQ ID NO: 6416411 - DNA, 14 bp, Homo sapiens
tccgcactgggcac

SEQ ID NO: 6416412 - DNA, 14 bp, Homo sapiens
tccgcacttggaaa

SEQ ID NO: 6416413 - DNA, 21 bp, Homo sapiens
tccgcagactgcttggccaga

SEQ ID NO: 6416414 - DNA, 22 bp, Homo sapiens
tccgcagactgcttggccagat

SEQ ID NO: 6416415 - DNA, 16 bp, Homo sapiens
tccgcagcccctttcc

SEQ ID NO: 6416416 - DNA, 11 bp, Homo sapiens
tccgcagggcg

SEQ ID NO: 6416417 - DNA, 17 bp, Homo sapiens
tccgcagggcgcccagc

SEQ ID NO: 6416418 - DNA, 14 bp, Homo sapiens
tccgcagtgagaga

SEQ ID NO: 6416419 - DNA, 16 bp, Homo sapiens
tccgcagtgtctccac

SEQ ID NO: 6416420 - DNA, 19 bp, Homo sapiens
tccgcagtgtggccaggct

SEQ ID NO: 6416421 - DNA, 18 bp, Homo sapiens
tccgcagttgtagcagaa

SEQ ID NO: 6416422 - DNA, 15 bp, Homo sapiens
tccgcatcacctcac

SEQ ID NO: 6416423 - DNA, 21 bp, Homo sapiens
tccgccaatctggcccttaca

SEQ ID NO: 6416424 - DNA, 21 bp, Homo sapiens
tccgccacccccgccgtgggg

SEQ ID NO: 6416425 - DNA, 19 bp, Homo sapiens
tccgccacgaggagcttcc

SEQ ID NO: 6416426 - DNA, 18 bp, Homo sapiens
tccgccagaccccgtggc

SEQ ID NO: 6416427 - DNA, 16 bp, Homo sapiens
tccgccagacctcaac

SEQ ID NO: 6416428 - DNA, 13 bp, Homo sapiens
tccgccagccaca

SEQ ID NO: 6416429 - DNA, 14 bp, Homo sapiens
tccgccagccacag

SEQ ID NO: 6416430 - DNA, 20 bp, Homo sapiens
tccgccagccacaggaccac

SEQ ID NO: 6416431 - DNA, 22 bp, Homo sapiens
tccgccagccacaggaccacct

SEQ ID NO: 6416432 - DNA, 20 bp, Homo sapiens
tatatttaaaaaattatgga

SEQ ID NO: 6416433 - DNA, 21 bp, Homo sapiens
tatatttaaaaaattatggaa

SEQ ID NO: 6416434 - DNA, 15 bp, Homo sapiens
tatatttaaaaattg

SEQ ID NO: 6416435 - DNA, 18 bp, Homo sapiens
tatatttaaaaattgttt

SEQ ID NO: 6416436 - DNA, 15 bp, Homo sapiens
tatatttaaaattca

SEQ ID NO: 6416437 - DNA, 11 bp, Homo sapiens
tatatttaaat

SEQ ID NO: 6416438 - DNA, 16 bp, Homo sapiens
tatatttaacatgtgg

SEQ ID NO: 6416439 - DNA, 18 bp, Homo sapiens
tatatttaagtattcaag

SEQ ID NO: 6416440 - DNA, 22 bp, Homo sapiens
tatatttaagtattcaagaaag

SEQ ID NO: 6416441 - DNA, 16 bp, Homo sapiens
tatatttaatatattg

SEQ ID NO: 6416442 - DNA, 14 bp, Homo sapiens
tatatttaatatgt

SEQ ID NO: 6416443 - DNA, 11 bp, Homo sapiens
tatatttaatg

SEQ ID NO: 6416444 - DNA, 22 bp, Homo sapiens
tatatttaatgcattaaacctg

SEQ ID NO: 6416445 - DNA, 15 bp, Homo sapiens
tatatttaattatta

SEQ ID NO: 6416446 - DNA, 13 bp, Homo sapiens
tatatttaattgt

SEQ ID NO: 6416447 - DNA, 15 bp, Homo sapiens
tatatttaattttga

SEQ ID NO: 6416448 - DNA, 19 bp, Homo sapiens
tatatttaatttttacatg

SEQ ID NO: 6416449 - DNA, 12 bp, Homo sapiens
tatatttacaat

SEQ ID NO: 6416450 - DNA, 13 bp, Homo sapiens
tatatttacaata

SEQ ID NO: 6416451 - DNA, 14 bp, Homo sapiens
tatatttacaataa

SEQ ID NO: 6416452 - DNA, 20 bp, Homo sapiens
tatatttacatgctactaaa

SEQ ID NO: 6416453 - DNA, 15 bp, Homo sapiens
tatatttaggaaaac

SEQ ID NO: 6416454 - DNA, 22 bp, Homo sapiens
tatatttaggaaattcaaagca

SEQ ID NO: 6416455 - DNA, 14 bp, Homo sapiens
tatatttagtaact

SEQ ID NO: 6416456 - DNA, 18 bp, Homo sapiens
tatatttataaaccagca

SEQ ID NO: 6416457 - DNA, 23 bp, Homo sapiens
tatatttataactcatcataaaa

SEQ ID NO: 6416458 - DNA, 12 bp, Homo sapiens
tatatttatact

SEQ ID NO: 6416459 - DNA, 13 bp, Homo sapiens
tatatttatactc

SEQ ID NO: 6416460 - DNA, 18 bp, Homo sapiens
tatatttatataattatg

SEQ ID NO: 6416461 - DNA, 20 bp, Homo sapiens
tatatttatatactttttca

SEQ ID NO: 6416462 - DNA, 22 bp, Homo sapiens
tatatttatcaaacttgtgctg

SEQ ID NO: 6416463 - DNA, 13 bp, Homo sapiens
tatatttatcata

SEQ ID NO: 6416464 - DNA, 16 bp, Homo sapiens
tatatttattcataat

SEQ ID NO: 6416465 - DNA, 17 bp, Homo sapiens
tatatttattcataatg

SEQ ID NO: 6416466 - DNA, 19 bp, Homo sapiens
tatatttattcataatgaa

SEQ ID NO: 6416467 - DNA, 21 bp, Homo sapiens
tatatttattgactcttgagt

SEQ ID NO: 6416468 - DNA, 12 bp, Homo sapiens
tatatttatttc

SEQ ID NO: 6416469 - DNA, 19 bp, Homo sapiens
tatatttcacaggctgtaa

SEQ ID NO: 6416470 - DNA, 21 bp, Homo sapiens
tatatttccaaatattctaaa

SEQ ID NO: 6416471 - DNA, 21 bp, Homo sapiens
tatatttcctgtattgcttta

SEQ ID NO: 6416472 - DNA, 18 bp, Homo sapiens
tatatttccttttgtaaa

SEQ ID NO: 6416473 - DNA, 23 bp, Homo sapiens
tatatttctacagagaaaatgaa

SEQ ID NO: 6416474 - DNA, 12 bp, Homo sapiens
tatatttctcat

SEQ ID NO: 6416475 - DNA, 13 bp, Homo sapiens
tatatttctgtgt

SEQ ID NO: 6416476 - DNA, 14 bp, Homo sapiens
tatatttcttcttc

SEQ ID NO: 6416477 - DNA, 18 bp, Homo sapiens
tatatttcttcttctaag

SEQ ID NO: 6416478 - DNA, 12 bp, Homo sapiens
tatatttgaaag

SEQ ID NO: 6416479 - DNA, 13 bp, Homo sapiens
tatatttgaaata

SEQ ID NO: 6416480 - DNA, 18 bp, Homo sapiens
tatatttgaaataaagtt

SEQ ID NO: 6416481 - DNA, 19 bp, Homo sapiens
tatatttgaaataaagttg

SEQ ID NO: 6416482 - DNA, 13 bp, Homo sapiens
tatatttgacatg

SEQ ID NO: 6416483 - DNA, 16 bp, Homo sapiens
tatatttgatttatta

SEQ ID NO: 6416484 - DNA, 20 bp, Homo sapiens
tatatttgatttattaactt

SEQ ID NO: 6416485 - DNA, 13 bp, Homo sapiens
tatatttgcatta

SEQ ID NO: 6416486 - DNA, 17 bp, Homo sapiens
tatatttggaaagagac

SEQ ID NO: 6416487 - DNA, 18 bp, Homo sapiens
tatatttgggagtgactg

SEQ ID NO: 6416488 - DNA, 22 bp, Homo sapiens
tatatttgggcctgctccagac

SEQ ID NO: 6416489 - DNA, 13 bp, Homo sapiens
tatatttgggtta

SEQ ID NO: 6416490 - DNA, 15 bp, Homo sapiens
tatatttgtaaagct

SEQ ID NO: 6416491 - DNA, 22 bp, Homo sapiens
tatatttgtgatagcactttct

SEQ ID NO: 6416492 - DNA, 23 bp, Homo sapiens
tatatttgtgatagcactttcta

SEQ ID NO: 6416493 - DNA, 20 bp, Homo sapiens
tatatttgtgctatagtatt

SEQ ID NO: 6416494 - DNA, 21 bp, Homo sapiens
tatatttgtgctatagtattt

SEQ ID NO: 6416495 - DNA, 22 bp, Homo sapiens
tatatttgtgctatagtatttg

SEQ ID NO: 6416496 - DNA, 21 bp, Homo sapiens
tatatttgtgtattttcctgg

SEQ ID NO: 6416497 - DNA, 13 bp, Homo sapiens
tatatttgtttca

SEQ ID NO: 6416498 - DNA, 14 bp, Homo sapiens
tatattttaaatgt

SEQ ID NO: 6416499 - DNA, 15 bp, Homo sapiens
tatattttagcattt

SEQ ID NO: 6416500 - DNA, 10 bp, Homo sapiens
tatattttat

SEQ ID NO: 6416501 - DNA, 14 bp, Homo sapiens
tatattttatactg

SEQ ID NO: 6416502 - DNA, 14 bp, Homo sapiens
tatattttatcttg

SEQ ID NO: 6416503 - DNA, 11 bp, Homo sapiens
tatattttatg

SEQ ID NO: 6416504 - DNA, 16 bp, Homo sapiens
tatattttatgaacat

SEQ ID NO: 6416505 - DNA, 20 bp, Homo sapiens
tatattttatgaacattgta

SEQ ID NO: 6416506 - DNA, 21 bp, Homo sapiens
tatattttcaattcaaaaatg

SEQ ID NO: 6416507 - DNA, 23 bp, Homo sapiens
tatattttcatgacttttccatg

SEQ ID NO: 6416508 - DNA, 24 bp, Homo sapiens
tatattttcatgacttttccatgt

SEQ ID NO: 6416509 - DNA, 16 bp, Homo sapiens
tatattttcattctcc

SEQ ID NO: 6416510 - DNA, 14 bp, Homo sapiens
tatattttcctata

SEQ ID NO: 6416511 - DNA, 20 bp, Homo sapiens
tatattttcgtatgaaaatg

SEQ ID NO: 6416512 - DNA, 21 bp, Homo sapiens
tatattttctgtatttaatta

SEQ ID NO: 6416513 - DNA, 13 bp, Homo sapiens
tatattttgattt

SEQ ID NO: 6416514 - DNA, 17 bp, Homo sapiens
tatattttgattttaca

SEQ ID NO: 6416515 - DNA, 21 bp, Homo sapiens
tatattttgtatgcaagcagt

SEQ ID NO: 6416516 - DNA, 13 bp, Homo sapiens
tatattttgtcat

SEQ ID NO: 6416517 - DNA, 23 bp, Homo sapiens
tatattttgtgggcttaattgaa

SEQ ID NO: 6416518 - DNA, 19 bp, Homo sapiens
tatattttgtgtgaaattg

SEQ ID NO: 6416519 - DNA, 17 bp, Homo sapiens
tatattttgtttacaaa

SEQ ID NO: 6416520 - DNA, 18 bp, Homo sapiens
tatatttttaaaaaactg

SEQ ID NO: 6416521 - DNA, 18 bp, Homo sapiens
tatatttttaaaaaatga

SEQ ID NO: 6416522 - DNA, 17 bp, Homo sapiens
tatatttttaaagaagg

SEQ ID NO: 6416523 - DNA, 17 bp, Homo sapiens
tatatttttaagataat

SEQ ID NO: 6416524 - DNA, 18 bp, Homo sapiens
tatatttttaatggaaag

SEQ ID NO: 6416525 - DNA, 13 bp, Homo sapiens
tatatttttactg

SEQ ID NO: 6416526 - DNA, 13 bp, Homo sapiens
tatatttttatat

SEQ ID NO: 6416527 - DNA, 18 bp, Homo sapiens
tatatttttatatgtgga

SEQ ID NO: 6416528 - DNA, 19 bp, Homo sapiens
tatatttttatatttacta

SEQ ID NO: 6416529 - DNA, 20 bp, Homo sapiens
tatatttttatatttagtta

SEQ ID NO: 6416530 - DNA, 20 bp, Homo sapiens
tatatttttcaaatagattt

SEQ ID NO: 6416531 - DNA, 13 bp, Homo sapiens
tatatttttcaac

SEQ ID NO: 6416532 - DNA, 18 bp, Homo sapiens
tatatttttcaaccagca

SEQ ID NO: 6416533 - DNA, 21 bp, Homo sapiens
tatatttttcaaccagcattt

SEQ ID NO: 6416534 - DNA, 20 bp, Homo sapiens
tatatttttccctgtttgcc

SEQ ID NO: 6416535 - DNA, 16 bp, Homo sapiens
tatatttttctgagat

SEQ ID NO: 6416536 - DNA, 15 bp, Homo sapiens
tatatttttcttaaa

SEQ ID NO: 6416537 - DNA, 12 bp, Homo sapiens
tatatttttgta

SEQ ID NO: 6416538 - DNA, 16 bp, Homo sapiens
tatatttttgtacata

SEQ ID NO: 6416539 - DNA, 23 bp, Homo sapiens
tatatttttgtatgtcactattt

SEQ ID NO: 6416540 - DNA, 18 bp, Homo sapiens
tatatttttgtctgcagc

SEQ ID NO: 6416541 - DNA, 16 bp, Homo sapiens
tatatttttgtgaatt

SEQ ID NO: 6416542 - DNA, 16 bp, Homo sapiens
tatatttttgtgtttt

SEQ ID NO: 6416543 - DNA, 18 bp, Homo sapiens
tatatttttgtgttttct

SEQ ID NO: 6416544 - DNA, 15 bp, Homo sapiens
tatatttttgtttgt

SEQ ID NO: 6416545 - DNA, 17 bp, Homo sapiens
tatatttttgtttgttt

SEQ ID NO: 6416546 - DNA, 18 bp, Homo sapiens
tatattttttaaaataag

SEQ ID NO: 6416547 - DNA, 22 bp, Homo sapiens
tatattttttaatttgatgaaa

SEQ ID NO: 6416548 - DNA, 15 bp, Homo sapiens
tatattttttgtctg

SEQ ID NO: 6416549 - DNA, 21 bp, Homo sapiens
tatattttttgttaaatgatt

SEQ ID NO: 6416550 - DNA, 18 bp, Homo sapiens
tatatttttttaactgtg

SEQ ID NO: 6416551 - DNA, 20 bp, Homo sapiens
tatatttttttaactgtgat

SEQ ID NO: 6416552 - DNA, 21 bp, Homo sapiens
tatatttttttaactgtgata

SEQ ID NO: 6416553 - DNA, 21 bp, Homo sapiens
tatatttttttttaagctctg

SEQ ID NO: 6416554 - DNA, 21 bp, Homo sapiens
tatcaaaaaaagactcagcca

SEQ ID NO: 6416555 - DNA, 16 bp, Homo sapiens
tatcaaaaaacaagtc

SEQ ID NO: 6416556 - DNA, 13 bp, Homo sapiens
tatcaaaaaacag

SEQ ID NO: 6416557 - DNA, 21 bp, Homo sapiens
tatcaaaaagctaatgtgcag

SEQ ID NO: 6416558 - DNA, 23 bp, Homo sapiens
tatcaaaaaggagctcttcttgt

SEQ ID NO: 6416559 - DNA, 20 bp, Homo sapiens
tatcaaaacatatcaattca

SEQ ID NO: 6416560 - DNA, 12 bp, Homo sapiens
tatcaaaacatc

SEQ ID NO: 6416561 - DNA, 13 bp, Homo sapiens
tatcaaaagaaat

SEQ ID NO: 6416562 - DNA, 15 bp, Homo sapiens
tatcaaaagacagca

SEQ ID NO: 6416563 - DNA, 15 bp, Homo sapiens
tatcaaaaggaagat

SEQ ID NO: 6416564 - DNA, 18 bp, Homo sapiens
tatcaaaataaattgaaa

SEQ ID NO: 6416565 - DNA, 22 bp, Homo sapiens
tatcaaaatgctcttatttcat

SEQ ID NO: 6416566 - DNA, 22 bp, Homo sapiens
tatcaaaatgtagcttttgggg

SEQ ID NO: 6416567 - DNA, 20 bp, Homo sapiens
tatcaaacagccccagtctt

SEQ ID NO: 6416568 - DNA, 18 bp, Homo sapiens
tatcaaacagctcaggct

SEQ ID NO: 6416569 - DNA, 15 bp, Homo sapiens
tatcaaacattaaaa

SEQ ID NO: 6416570 - DNA, 17 bp, Homo sapiens
tatcaaaccctagcctt

SEQ ID NO: 6416571 - DNA, 22 bp, Homo sapiens
tatcaaaccctagccttgcttg

SEQ ID NO: 6416572 - DNA, 13 bp, Homo sapiens
tatcaaactgaag

SEQ ID NO: 6416573 - DNA, 16 bp, Homo sapiens
tatcaaactgaagcca

SEQ ID NO: 6416574 - DNA, 13 bp, Homo sapiens
tatcaaactgctt

SEQ ID NO: 6416575 - DNA, 21 bp, Homo sapiens
tatcaaacttcagctgtactt

SEQ ID NO: 6416576 - DNA, 14 bp, Homo sapiens
tatcaaacttgtgc

SEQ ID NO: 6416577 - DNA, 16 bp, Homo sapiens
tatcaaagaaaaacaa

SEQ ID NO: 6416578 - DNA, 19 bp, Homo sapiens
tatcaaagaagagtcaaca

SEQ ID NO: 6416579 - DNA, 19 bp, Homo sapiens
tatcaaagagaagatgcct

SEQ ID NO: 6416580 - DNA, 14 bp, Homo sapiens
tatcaaaggcagaa

SEQ ID NO: 6416581 - DNA, 21 bp, Homo sapiens
tatcaaataaaaagcatgaga

SEQ ID NO: 6416582 - DNA, 14 bp, Homo sapiens
tatcaaataaaata

SEQ ID NO: 6416583 - DNA, 16 bp, Homo sapiens
tatcaaataaaatatc

SEQ ID NO: 6416584 - DNA, 17 bp, Homo sapiens
tatcaaataaaatatca

SEQ ID NO: 6416585 - DNA, 18 bp, Homo sapiens
tatcaaataaaatatcat

SEQ ID NO: 6416586 - DNA, 14 bp, Homo sapiens
tatcaaataaaatt

SEQ ID NO: 6416587 - DNA, 12 bp, Homo sapiens
tatcaaataata

SEQ ID NO: 6416588 - DNA, 13 bp, Homo sapiens
tatcaaatcattc

SEQ ID NO: 6416589 - DNA, 15 bp, Homo sapiens
tatcaaatctaccac

SEQ ID NO: 6416590 - DNA, 13 bp, Homo sapiens
tatcaaatctgta

SEQ ID NO: 6416591 - DNA, 18 bp, Homo sapiens
tatcaaatgccttcatga

SEQ ID NO: 6416592 - DNA, 11 bp, Homo sapiens
tatcaaatgtt

SEQ ID NO: 6416593 - DNA, 14 bp, Homo sapiens
tatcaaattaattg

SEQ ID NO: 6416594 - DNA, 17 bp, Homo sapiens
tatcaaattaattgtgt

SEQ ID NO: 6416595 - DNA, 19 bp, Homo sapiens
tatcaaattcaataatctt

SEQ ID NO: 6416596 - DNA, 23 bp, Homo sapiens
tatcaacaacaagttgtttcaaa

SEQ ID NO: 6416597 - DNA, 21 bp, Homo sapiens
tatcaacactgttactttcgt

SEQ ID NO: 6416598 - DNA, 21 bp, Homo sapiens
tatcaacatctttttcctccc

SEQ ID NO: 6416599 - DNA, 22 bp, Homo sapiens
tatcaaccattagataaacaca

SEQ ID NO: 6416600 - DNA, 17 bp, Homo sapiens
tatcaacccagaaacac

SEQ ID NO: 6416601 - DNA, 19 bp, Homo sapiens
tatcaaccccagacactgg

SEQ ID NO: 6416602 - DNA, 22 bp, Homo sapiens
tatcaactggggggaccaaata

SEQ ID NO: 6416603 - DNA, 13 bp, Homo sapiens
tatcaactttaat

SEQ ID NO: 6416604 - DNA, 14 bp, Homo sapiens
tatcaagaaatgct

SEQ ID NO: 6416605 - DNA, 21 bp, Homo sapiens
tatcaagaagtcagagaaaac

SEQ ID NO: 6416606 - DNA, 16 bp, Homo sapiens
tatcaagacatagcat

SEQ ID NO: 6416607 - DNA, 20 bp, Homo sapiens
tatcaagagagtaaacagac

SEQ ID NO: 6416608 - DNA, 20 bp, Homo sapiens
tatcaagaggctgagacagg

SEQ ID NO: 6416609 - DNA, 14 bp, Homo sapiens
tatcaagcaacatt

SEQ ID NO: 6416610 - DNA, 18 bp, Homo sapiens
tatcaagcaacattcttg

SEQ ID NO: 6416611 - DNA, 14 bp, Homo sapiens
tatcaagcagagac

SEQ ID NO: 6416612 - DNA, 11 bp, Homo sapiens
tccgccagcct

SEQ ID NO: 6416613 - DNA, 14 bp, Homo sapiens
tccgccagcctcct

SEQ ID NO: 6416614 - DNA, 15 bp, Homo sapiens
tccgccaggcgctgc

SEQ ID NO: 6416615 - DNA, 18 bp, Homo sapiens
tccgccagggcccacacc

SEQ ID NO: 6416616 - DNA, 15 bp, Homo sapiens
tccgccagtgtttct

SEQ ID NO: 6416617 - DNA, 15 bp, Homo sapiens
tccgccatccagggt

SEQ ID NO: 6416618 - DNA, 18 bp, Homo sapiens
tccgccatccagggtctg

SEQ ID NO: 6416619 - DNA, 21 bp, Homo sapiens
tccgccatggggtcggctcct

SEQ ID NO: 6416620 - DNA, 15 bp, Homo sapiens
tccgccattccaagt

SEQ ID NO: 6416621 - DNA, 17 bp, Homo sapiens
tccgcccacctcagcct

SEQ ID NO: 6416622 - DNA, 13 bp, Homo sapiens
tccgcccagcctc

SEQ ID NO: 6416623 - DNA, 14 bp, Homo sapiens
tccgcccagcctct

SEQ ID NO: 6416624 - DNA, 16 bp, Homo sapiens
tccgcccagcctctcc

SEQ ID NO: 6416625 - DNA, 19 bp, Homo sapiens
tccgcccagcctctccccg

SEQ ID NO: 6416626 - DNA, 14 bp, Homo sapiens
tccgccccagacac

SEQ ID NO: 6416627 - DNA, 15 bp, Homo sapiens
tccgcccccagccta

SEQ ID NO: 6416628 - DNA, 16 bp, Homo sapiens
tccgcccccagcctat

SEQ ID NO: 6416629 - DNA, 16 bp, Homo sapiens
tccgcccccaggtagg

SEQ ID NO: 6416630 - DNA, 18 bp, Homo sapiens
tccgcccccgccccacag

SEQ ID NO: 6416631 - DNA, 17 bp, Homo sapiens
tccgccccgtgctcctc

SEQ ID NO: 6416632 - DNA, 15 bp, Homo sapiens
tccgcccctgagccc

SEQ ID NO: 6416633 - DNA, 17 bp, Homo sapiens
tccgcccctgagcccac

SEQ ID NO: 6416634 - DNA, 19 bp, Homo sapiens
tccgcccctgagcccactg

SEQ ID NO: 6416635 - DNA, 21 bp, Homo sapiens
tccgcccctgagcccactgtg

SEQ ID NO: 6416636 - DNA, 14 bp, Homo sapiens
tccgcccctgcctg

SEQ ID NO: 6416637 - DNA, 16 bp, Homo sapiens
tccgcccctgcctgcc

SEQ ID NO: 6416638 - DNA, 19 bp, Homo sapiens
tccgcccctgcctgccatg

SEQ ID NO: 6416639 - DNA, 15 bp, Homo sapiens
tccgcccgcccaccc

SEQ ID NO: 6416640 - DNA, 20 bp, Homo sapiens
tccgcccgcccaccccgctg

SEQ ID NO: 6416641 - DNA, 21 bp, Homo sapiens
tccgcccgcccaccccgctgc

SEQ ID NO: 6416642 - DNA, 22 bp, Homo sapiens
tccgcccgccgccctggacaga

SEQ ID NO: 6416643 - DNA, 16 bp, Homo sapiens
tccgccctgccactca

SEQ ID NO: 6416644 - DNA, 14 bp, Homo sapiens
tccgccctgctcct

SEQ ID NO: 6416645 - DNA, 11 bp, Homo sapiens
tccgccctggg

SEQ ID NO: 6416646 - DNA, 15 bp, Homo sapiens
tccgccctgggctct

SEQ ID NO: 6416647 - DNA, 21 bp, Homo sapiens
tccgcccttagtcccccaact

SEQ ID NO: 6416648 - DNA, 17 bp, Homo sapiens
tccgcctacctcggcct

SEQ ID NO: 6416649 - DNA, 20 bp, Homo sapiens
tccgcctagaggtcccctca

SEQ ID NO: 6416650 - DNA, 21 bp, Homo sapiens
tccgcctagaggtcccctcac

SEQ ID NO: 6416651 - DNA, 15 bp, Homo sapiens
tccgcctcactgggt

SEQ ID NO: 6416652 - DNA, 15 bp, Homo sapiens
tccgcctccacactg

SEQ ID NO: 6416653 - DNA, 16 bp, Homo sapiens
tccgcctccacactga

SEQ ID NO: 6416654 - DNA, 13 bp, Homo sapiens
tccgcctccagga

SEQ ID NO: 6416655 - DNA, 11 bp, Homo sapiens
tccgcctcccc

SEQ ID NO: 6416656 - DNA, 16 bp, Homo sapiens
tccgcctcccccatgg

SEQ ID NO: 6416657 - DNA, 14 bp, Homo sapiens
tccgcctcctgtgt

SEQ ID NO: 6416658 - DNA, 18 bp, Homo sapiens
tccgcctctgagccagga

SEQ ID NO: 6416659 - DNA, 13 bp, Homo sapiens
tccgcctctgtcc

SEQ ID NO: 6416660 - DNA, 18 bp, Homo sapiens
tccgcctgcctctgcctc

SEQ ID NO: 6416661 - DNA, 15 bp, Homo sapiens
tccgcctggcaccca

SEQ ID NO: 6416662 - DNA, 20 bp, Homo sapiens
tccgcctggcacccactccg

SEQ ID NO: 6416663 - DNA, 12 bp, Homo sapiens
tccgcctgggat

SEQ ID NO: 6416664 - DNA, 18 bp, Homo sapiens
tccgcctgtccacagccc

SEQ ID NO: 6416665 - DNA, 17 bp, Homo sapiens
tccgcctgtgtccatct

SEQ ID NO: 6416666 - DNA, 16 bp, Homo sapiens
tccgccttctcccaca

SEQ ID NO: 6416667 - DNA, 21 bp, Homo sapiens
tccgcctttacaagggagaag

SEQ ID NO: 6416668 - DNA, 16 bp, Homo sapiens
tccgccttttagtttt

SEQ ID NO: 6416669 - DNA, 19 bp, Homo sapiens
tccgcgagggctactcagc

SEQ ID NO: 6416670 - DNA, 22 bp, Homo sapiens
tccgcgagggctactcagcagt

SEQ ID NO: 6416671 - DNA, 19 bp, Homo sapiens
tccgcgccctccgacctct

SEQ ID NO: 6416672 - DNA, 14 bp, Homo sapiens
tccgcggagccctt

SEQ ID NO: 6416673 - DNA, 22 bp, Homo sapiens
tccgcgggctgactgggccaca

SEQ ID NO: 6416674 - DNA, 15 bp, Homo sapiens
tccgcgggtcccggc

SEQ ID NO: 6416675 - DNA, 18 bp, Homo sapiens
tccgcgtgtgcctgtgtg

SEQ ID NO: 6416676 - DNA, 22 bp, Homo sapiens
tccgctaagacctccccacccc

SEQ ID NO: 6416677 - DNA, 14 bp, Homo sapiens
tccgctaaggcttc

SEQ ID NO: 6416678 - DNA, 15 bp, Homo sapiens
tccgctaaggcttcc

SEQ ID NO: 6416679 - DNA, 19 bp, Homo sapiens
tccgctaaggcttccggct

SEQ ID NO: 6416680 - DNA, 16 bp, Homo sapiens
tccgctaatctcttct

SEQ ID NO: 6416681 - DNA, 17 bp, Homo sapiens
tccgctcccaccgcccc

SEQ ID NO: 6416682 - DNA, 20 bp, Homo sapiens
tccgctcccctttcccatca

SEQ ID NO: 6416683 - DNA, 12 bp, Homo sapiens
tccgctccctgg

SEQ ID NO: 6416684 - DNA, 21 bp, Homo sapiens
tccgctcctttacctaccacc

SEQ ID NO: 6416685 - DNA, 15 bp, Homo sapiens
tccgctctctcatgt

SEQ ID NO: 6416686 - DNA, 17 bp, Homo sapiens
tccgctctctcatgtgg

SEQ ID NO: 6416687 - DNA, 15 bp, Homo sapiens
tccgctctcttcctg

SEQ ID NO: 6416688 - DNA, 14 bp, Homo sapiens
tccgctctgaggca

SEQ ID NO: 6416689 - DNA, 12 bp, Homo sapiens
tccgctgccacc

SEQ ID NO: 6416690 - DNA, 14 bp, Homo sapiens
tccgctgccaccac

SEQ ID NO: 6416691 - DNA, 19 bp, Homo sapiens
tccgctgccagccttgagc

SEQ ID NO: 6416692 - DNA, 13 bp, Homo sapiens
tccgctgcctgga

SEQ ID NO: 6416693 - DNA, 13 bp, Homo sapiens
tccgctgctcctt

SEQ ID NO: 6416694 - DNA, 14 bp, Homo sapiens
tccgctgctgcttt

SEQ ID NO: 6416695 - DNA, 19 bp, Homo sapiens
tccgctgtctccctcctga

SEQ ID NO: 6416696 - DNA, 15 bp, Homo sapiens
tccgcttctcctgca

SEQ ID NO: 6416697 - DNA, 15 bp, Homo sapiens
tccgcttgccagagg

SEQ ID NO: 6416698 - DNA, 16 bp, Homo sapiens
tccgctttcctggagc

SEQ ID NO: 6416699 - DNA, 17 bp, Homo sapiens
tccgctttcctggagcc

SEQ ID NO: 6416700 - DNA, 16 bp, Homo sapiens
tccgctttctacccag

SEQ ID NO: 6416701 - DNA, 20 bp, Homo sapiens
tccgctttctacccagcgag

SEQ ID NO: 6416702 - DNA, 14 bp, Homo sapiens
tccggaagtaaata

SEQ ID NO: 6416703 - DNA, 22 bp, Homo sapiens
tccggaatcctgtcctcagctt

SEQ ID NO: 6416704 - DNA, 18 bp, Homo sapiens
tccggaatgccacccaca

SEQ ID NO: 6416705 - DNA, 16 bp, Homo sapiens
tccggaattgtattta

SEQ ID NO: 6416706 - DNA, 15 bp, Homo sapiens
tccggacactcctag

SEQ ID NO: 6416707 - DNA, 18 bp, Homo sapiens
tccggacactcctagaga

SEQ ID NO: 6416708 - DNA, 14 bp, Homo sapiens
tccggactggcaga

SEQ ID NO: 6416709 - DNA, 23 bp, Homo sapiens
tccggagcctcatgttctcttcc

SEQ ID NO: 6416710 - DNA, 18 bp, Homo sapiens
tccggagcgaccctggct

SEQ ID NO: 6416711 - DNA, 18 bp, Homo sapiens
tccggagcgccctgcagg

SEQ ID NO: 6416712 - DNA, 21 bp, Homo sapiens
tccggagcgccctgcagggcc

SEQ ID NO: 6416713 - DNA, 22 bp, Homo sapiens
tccggagcgccctgcagggccg

SEQ ID NO: 6416714 - DNA, 18 bp, Homo sapiens
tccggaggactgagcccc

SEQ ID NO: 6416715 - DNA, 15 bp, Homo sapiens
tccggaggagcagcc

SEQ ID NO: 6416716 - DNA, 18 bp, Homo sapiens
tccggaggagcagcctcg

SEQ ID NO: 6416717 - DNA, 19 bp, Homo sapiens
tccggaggagcagcctcga

SEQ ID NO: 6416718 - DNA, 20 bp, Homo sapiens
tccggaggagcagcctcgag

SEQ ID NO: 6416719 - DNA, 20 bp, Homo sapiens
tccggaggggacccagctcc

SEQ ID NO: 6416720 - DNA, 21 bp, Homo sapiens
tccggaggggacccagctcct

SEQ ID NO: 6416721 - DNA, 22 bp, Homo sapiens
tccggaggggacccagctcctc

SEQ ID NO: 6416722 - DNA, 22 bp, Homo sapiens
tccggaggggttgcgggggagc

SEQ ID NO: 6416723 - DNA, 16 bp, Homo sapiens
tccggatcctaagcat

SEQ ID NO: 6416724 - DNA, 22 bp, Homo sapiens
tccggatggaatcacagccaat

SEQ ID NO: 6416725 - DNA, 17 bp, Homo sapiens
tccggattggcttgtgt

SEQ ID NO: 6416726 - DNA, 23 bp, Homo sapiens
tccggattggcttgtgtgtttca

SEQ ID NO: 6416727 - DNA, 21 bp, Homo sapiens
tccggatttctaacagtcctt

SEQ ID NO: 6416728 - DNA, 15 bp, Homo sapiens
tccggcacactgcca

SEQ ID NO: 6416729 - DNA, 16 bp, Homo sapiens
tccggcacactgccaa

SEQ ID NO: 6416730 - DNA, 23 bp, Homo sapiens
tccggcacactgccaaataaaca

SEQ ID NO: 6416731 - DNA, 13 bp, Homo sapiens
tccggcagaggca

SEQ ID NO: 6416732 - DNA, 19 bp, Homo sapiens
tccggcagaggcagggccc

SEQ ID NO: 6416733 - DNA, 13 bp, Homo sapiens
tccggcatggaca

SEQ ID NO: 6416734 - DNA, 22 bp, Homo sapiens
tccggccaggtgcctcctgaca

SEQ ID NO: 6416735 - DNA, 13 bp, Homo sapiens
tccggcccagtgc

SEQ ID NO: 6416736 - DNA, 20 bp, Homo sapiens
tccggcccagtgccactgcc

SEQ ID NO: 6416737 - DNA, 20 bp, Homo sapiens
tccggcccagtgccagctcc

SEQ ID NO: 6416738 - DNA, 21 bp, Homo sapiens
tccggcccagtgccagctcca

SEQ ID NO: 6416739 - DNA, 18 bp, Homo sapiens
tccggcccccagagcgcc

SEQ ID NO: 6416740 - DNA, 19 bp, Homo sapiens
tccggccccgtctctcttg

SEQ ID NO: 6416741 - DNA, 18 bp, Homo sapiens
tccggccctccagagccc

SEQ ID NO: 6416742 - DNA, 21 bp, Homo sapiens
tccggccctcctaccctgcgc

SEQ ID NO: 6416743 - DNA, 15 bp, Homo sapiens
tccggccctgcccca

SEQ ID NO: 6416744 - DNA, 23 bp, Homo sapiens
tccggccctgccccacacaggcc

SEQ ID NO: 6416745 - DNA, 19 bp, Homo sapiens
tccggcctctccagcctca

SEQ ID NO: 6416746 - DNA, 16 bp, Homo sapiens
tccggcctctccctgc

SEQ ID NO: 6416747 - DNA, 17 bp, Homo sapiens
tccggcctctccctgcc

SEQ ID NO: 6416748 - DNA, 14 bp, Homo sapiens
tccggcctctgcct

SEQ ID NO: 6416749 - DNA, 21 bp, Homo sapiens
tccggcctgatgacagagcga

SEQ ID NO: 6416750 - DNA, 13 bp, Homo sapiens
tccggcctgcagc

SEQ ID NO: 6416751 - DNA, 20 bp, Homo sapiens
tccggcctgcagcccagaac

SEQ ID NO: 6416752 - DNA, 13 bp, Homo sapiens
tccggcctggcct

SEQ ID NO: 6416753 - DNA, 13 bp, Homo sapiens
tccggcgccccgc

SEQ ID NO: 6416754 - DNA, 14 bp, Homo sapiens
tccggcgccccgca

SEQ ID NO: 6416755 - DNA, 16 bp, Homo sapiens
tccggcgtcagcctcc

SEQ ID NO: 6416756 - DNA, 21 bp, Homo sapiens
tccggcgtcagcctccagcct

SEQ ID NO: 6416757 - DNA, 22 bp, Homo sapiens
tccggcgtcagcctccagcctc

SEQ ID NO: 6416758 - DNA, 18 bp, Homo sapiens
tccggctaagcaggcgca

SEQ ID NO: 6416759 - DNA, 16 bp, Homo sapiens
tccggctcccagcctc

SEQ ID NO: 6416760 - DNA, 22 bp, Homo sapiens
tccggctcctgtgctttccctg

SEQ ID NO: 6416761 - DNA, 21 bp, Homo sapiens
tccggctgagctgtgccagct

SEQ ID NO: 6416762 - DNA, 24 bp, Homo sapiens
tccggctgagctgtgccagctgct

SEQ ID NO: 6416763 - DNA, 20 bp, Homo sapiens
tccggctgcctagccctccc

SEQ ID NO: 6416764 - DNA, 16 bp, Homo sapiens
tccggctgctcctcca

SEQ ID NO: 6416765 - DNA, 13 bp, Homo sapiens
tccggctgtgctg

SEQ ID NO: 6416766 - DNA, 16 bp, Homo sapiens
tccggctgtgctggga

SEQ ID NO: 6416767 - DNA, 18 bp, Homo sapiens
tccgggaacagtgcatgt

SEQ ID NO: 6416768 - DNA, 17 bp, Homo sapiens
tccgggacgcttccaga

SEQ ID NO: 6416769 - DNA, 20 bp, Homo sapiens
tccgggacgcttccagacca

SEQ ID NO: 6416770 - DNA, 23 bp, Homo sapiens
tccgggacgcttccagaccacct

SEQ ID NO: 6416771 - DNA, 21 bp, Homo sapiens
tccgggacgtggcacctcctc

SEQ ID NO: 6416772 - DNA, 12 bp, Homo sapiens
tccgggagctgg

SEQ ID NO: 6416773 - DNA, 21 bp, Homo sapiens
tccgggagctggtgacagcct

SEQ ID NO: 6416774 - DNA, 12 bp, Homo sapiens
tccgggaggtca

SEQ ID NO: 6416775 - DNA, 20 bp, Homo sapiens
tccgggcaaatgccagggcc

SEQ ID NO: 6416776 - DNA, 21 bp, Homo sapiens
tccgggcaaatgccagggccc

SEQ ID NO: 6416777 - DNA, 18 bp, Homo sapiens
tccgggcagagaccaccg

SEQ ID NO: 6416778 - DNA, 11 bp, Homo sapiens
tccgggcaggg

SEQ ID NO: 6416779 - DNA, 20 bp, Homo sapiens
tccgggccgggcggaagggg

SEQ ID NO: 6416780 - DNA, 18 bp, Homo sapiens
tccgggcctcggcctggc

SEQ ID NO: 6416781 - DNA, 19 bp, Homo sapiens
tccgggcctcggcctggct

SEQ ID NO: 6416782 - DNA, 18 bp, Homo sapiens
tccgggcctttctctggc

SEQ ID NO: 6416783 - DNA, 18 bp, Homo sapiens
tccgggcgtgtgaagaac

SEQ ID NO: 6416784 - DNA, 15 bp, Homo sapiens
tccggggagaaaccc

SEQ ID NO: 6416785 - DNA, 20 bp, Homo sapiens
tccggggagaaacccagaga

SEQ ID NO: 6416786 - DNA, 15 bp, Homo sapiens
tccggggaggagcct

SEQ ID NO: 6416787 - DNA, 15 bp, Homo sapiens
tccggggccagctcc

SEQ ID NO: 6416788 - DNA, 17 bp, Homo sapiens
tccggggctgctggcct

SEQ ID NO: 6416789 - DNA, 18 bp, Homo sapiens
tccggggctgctggcctg

SEQ ID NO: 6416790 - DNA, 16 bp, Homo sapiens
tccggggtctgtgctg

SEQ ID NO: 6416791 - DNA, 18 bp, Homo sapiens
tccggggtggtggacagg

SEQ ID NO: 6416792 - DNA, 18 bp, Homo sapiens
tccggggttcagcctcct

SEQ ID NO: 6416793 - DNA, 14 bp, Homo sapiens
tccgggtcttccta

SEQ ID NO: 6416794 - DNA, 19 bp, Homo sapiens
tccgggtgctcaataaact

SEQ ID NO: 6416795 - DNA, 15 bp, Homo sapiens
tccgggtgtggcctc

SEQ ID NO: 6416796 - DNA, 19 bp, Homo sapiens
tccgggtgtggcctcagcc

SEQ ID NO: 6416797 - DNA, 22 bp, Homo sapiens
tccgggtgtggcctcagccctc

SEQ ID NO: 6416798 - DNA, 22 bp, Homo sapiens
tccgggtttgagatggacacac

SEQ ID NO: 6416799 - DNA, 20 bp, Homo sapiens
tccggtcccctgcctggaac

SEQ ID NO: 6416800 - DNA, 18 bp, Homo sapiens
tccggtcgtgtctctggt

SEQ ID NO: 6416801 - DNA, 17 bp, Homo sapiens
tccggtgccttccaccc

SEQ ID NO: 6416802 - DNA, 22 bp, Homo sapiens
tccggtgccttccaccctgccc

SEQ ID NO: 6416803 - DNA, 18 bp, Homo sapiens
tccggtggaaggccttct

SEQ ID NO: 6416804 - DNA, 18 bp, Homo sapiens
tccggtggcctattccag

SEQ ID NO: 6416805 - DNA, 21 bp, Homo sapiens
tccggtggcctattccaggaa

SEQ ID NO: 6416806 - DNA, 14 bp, Homo sapiens
tccggttgcatact

SEQ ID NO: 6416807 - DNA, 15 bp, Homo sapiens
tccggtttactttaa

SEQ ID NO: 6416808 - DNA, 16 bp, Homo sapiens
tccggtttctttttgc

SEQ ID NO: 6416809 - DNA, 18 bp, Homo sapiens
tccggtttctttttgctc

SEQ ID NO: 6416810 - DNA, 14 bp, Homo sapiens
tccggtttgccatg

SEQ ID NO: 6416811 - DNA, 14 bp, Homo sapiens
tccgtaaatgtctg

SEQ ID NO: 6416812 - DNA, 15 bp, Homo sapiens
tccgtaaatgtctgc

SEQ ID NO: 6416813 - DNA, 20 bp, Homo sapiens
tccgtactcggcttcctgtg

SEQ ID NO: 6416814 - DNA, 21 bp, Homo sapiens
tccgtactcggcttcctgtgg

SEQ ID NO: 6416815 - DNA, 13 bp, Homo sapiens
tccgtagctcccc

SEQ ID NO: 6416816 - DNA, 22 bp, Homo sapiens
tccgtagctcccctggctggct

SEQ ID NO: 6416817 - DNA, 16 bp, Homo sapiens
tccgtagctctgctgc

SEQ ID NO: 6416818 - DNA, 20 bp, Homo sapiens
tccgtagctctgctgctgat

SEQ ID NO: 6416819 - DNA, 18 bp, Homo sapiens
tccgtaggacaagtttta

SEQ ID NO: 6416820 - DNA, 17 bp, Homo sapiens
tccgtagggtctttctt

SEQ ID NO: 6416821 - DNA, 15 bp, Homo sapiens
tccgtagttttgata

SEQ ID NO: 6416822 - DNA, 23 bp, Homo sapiens
tccgtatctccctggagaagcac

SEQ ID NO: 6416823 - DNA, 23 bp, Homo sapiens
tccgtcaaaacagattgtttgca

SEQ ID NO: 6416824 - DNA, 17 bp, Homo sapiens
tccgtcaagctggttgt

SEQ ID NO: 6416825 - DNA, 20 bp, Homo sapiens
tccgtcaccagaattagtcc

SEQ ID NO: 6416826 - DNA, 20 bp, Homo sapiens
tccgtcacccttggtagagt

SEQ ID NO: 6416827 - DNA, 14 bp, Homo sapiens
tccgtcactacctg

SEQ ID NO: 6416828 - DNA, 15 bp, Homo sapiens
tccgtcactacctgg

SEQ ID NO: 6416829 - DNA, 17 bp, Homo sapiens
tccgtcagaaagtgtaa

SEQ ID NO: 6416830 - DNA, 15 bp, Homo sapiens
tccgtcagcttctcc

SEQ ID NO: 6416831 - DNA, 17 bp, Homo sapiens
tccgtcagcttctccca

SEQ ID NO: 6416832 - DNA, 13 bp, Homo sapiens
tccgtcaggagag

SEQ ID NO: 6416833 - DNA, 18 bp, Homo sapiens
tccgtcatccatgccctc

SEQ ID NO: 6416834 - DNA, 17 bp, Homo sapiens
tccgtccacccaggctg

SEQ ID NO: 6416835 - DNA, 18 bp, Homo sapiens
tccgtccacccaggctgc

SEQ ID NO: 6416836 - DNA, 20 bp, Homo sapiens
tccgtccacccttccatcag

SEQ ID NO: 6416837 - DNA, 23 bp, Homo sapiens
tccgtccagagccggcatccttg

SEQ ID NO: 6416838 - DNA, 21 bp, Homo sapiens
tccgtccccagggtgcaggcg

SEQ ID NO: 6416839 - DNA, 17 bp, Homo sapiens
tccgtccggaaatgaag

SEQ ID NO: 6416840 - DNA, 16 bp, Homo sapiens
tccgtccggtgtgtca

SEQ ID NO: 6416841 - DNA, 16 bp, Homo sapiens
tccgtcctgctcgccc

SEQ ID NO: 6416842 - DNA, 13 bp, Homo sapiens
tccgtcctggcac

SEQ ID NO: 6416843 - DNA, 15 bp, Homo sapiens
tccgtcctggcaggg

SEQ ID NO: 6416844 - DNA, 19 bp, Homo sapiens
tccgtcgggcccctgcctg

SEQ ID NO: 6416845 - DNA, 20 bp, Homo sapiens
tccgtctaagtcatgagctg

SEQ ID NO: 6416846 - DNA, 14 bp, Homo sapiens
tccgtctctgtccg

SEQ ID NO: 6416847 - DNA, 15 bp, Homo sapiens
tccgtctctgtcctc

SEQ ID NO: 6416848 - DNA, 14 bp, Homo sapiens
tccgtctgtcctgc

SEQ ID NO: 6416849 - DNA, 15 bp, Homo sapiens
tccgtctgtcctgcg

SEQ ID NO: 6416850 - DNA, 16 bp, Homo sapiens
tccgtctgtcctgcgc

SEQ ID NO: 6416851 - DNA, 16 bp, Homo sapiens
tccgtctgtgtatgtg

SEQ ID NO: 6416852 - DNA, 23 bp, Homo sapiens
tccgtgaaaatgcaagtgtttga

SEQ ID NO: 6416853 - DNA, 15 bp, Homo sapiens
tccgtgaaagttgtg

SEQ ID NO: 6416854 - DNA, 19 bp, Homo sapiens
tccgtgaaagttgtgatct

SEQ ID NO: 6416855 - DNA, 17 bp, Homo sapiens
tccgtgaactctggtgc

SEQ ID NO: 6416856 - DNA, 22 bp, Homo sapiens
tccgtgaactctggtgctcctg

SEQ ID NO: 6416857 - DNA, 22 bp, Homo sapiens
tccgtgaagtcacattccacat

SEQ ID NO: 6416858 - DNA, 17 bp, Homo sapiens
tccgtgaattctcggaa

SEQ ID NO: 6416859 - DNA, 20 bp, Homo sapiens
tccgtgagagtcatctcaaa

SEQ ID NO: 6416860 - DNA, 21 bp, Homo sapiens
tccgtgagcaccaccagggct

SEQ ID NO: 6416861 - DNA, 15 bp, Homo sapiens
tccgtgagcagtgtg

SEQ ID NO: 6416862 - DNA, 12 bp, Homo sapiens
tccgtgagccct

SEQ ID NO: 6416863 - DNA, 14 bp, Homo sapiens
tccgtgagcccttg

SEQ ID NO: 6416864 - DNA, 14 bp, Homo sapiens
tccgtgaggcaggg

SEQ ID NO: 6416865 - DNA, 23 bp, Homo sapiens
tccgtgatccatccatctccagg

SEQ ID NO: 6416866 - DNA, 18 bp, Homo sapiens
tccgtgccccttccctgg

SEQ ID NO: 6416867 - DNA, 17 bp, Homo sapiens
tccgtgccgtgtatttt

SEQ ID NO: 6416868 - DNA, 16 bp, Homo sapiens
tccgtgcctcttttta

SEQ ID NO: 6416869 - DNA, 13 bp, Homo sapiens
tccgtgctgacag

SEQ ID NO: 6416870 - DNA, 13 bp, Homo sapiens
tccgtgctgggct

SEQ ID NO: 6416871 - DNA, 19 bp, Homo sapiens
tccgtggaacattctggat

SEQ ID NO: 6416872 - DNA, 16 bp, Homo sapiens
tccgtggactgcagtc

SEQ ID NO: 6416873 - DNA, 12 bp, Homo sapiens
tccgtggaggag

SEQ ID NO: 6416874 - DNA, 21 bp, Homo sapiens
tccgtggccccgccctcaggc

SEQ ID NO: 6416875 - DNA, 17 bp, Homo sapiens
tccgtgggaccctcagc

SEQ ID NO: 6416876 - DNA, 18 bp, Homo sapiens
tccgtgggaccctcagca

SEQ ID NO: 6416877 - DNA, 17 bp, Homo sapiens
tccgtgggacggtgccc

SEQ ID NO: 6416878 - DNA, 21 bp, Homo sapiens
tccgtgggccgtatctgtcac

SEQ ID NO: 6416879 - DNA, 22 bp, Homo sapiens
tccgtgggtcatcccagcacct

SEQ ID NO: 6416880 - DNA, 16 bp, Homo sapiens
tccgtgggttgctaac

SEQ ID NO: 6416881 - DNA, 21 bp, Homo sapiens
tccgtgggttgctaactgaac

SEQ ID NO: 6416882 - DNA, 21 bp, Homo sapiens
tccgtggtcagagtgccactg

SEQ ID NO: 6416883 - DNA, 19 bp, Homo sapiens
tccgtggttcactttggtc

SEQ ID NO: 6416884 - DNA, 14 bp, Homo sapiens
tccgtggtttctca

SEQ ID NO: 6416885 - DNA, 18 bp, Homo sapiens
tccgtggtttgtactcaa

SEQ ID NO: 6416886 - DNA, 13 bp, Homo sapiens
tccgtgtcctctc

SEQ ID NO: 6416887 - DNA, 22 bp, Homo sapiens
tccgtgtgattgtctttgaatc

SEQ ID NO: 6416888 - DNA, 12 bp, Homo sapiens
tccgtgtgcctc

SEQ ID NO: 6416889 - DNA, 17 bp, Homo sapiens
tccgtgtgcctcctgtg

SEQ ID NO: 6416890 - DNA, 18 bp, Homo sapiens
tccgtgtgcctggggttc

SEQ ID NO: 6416891 - DNA, 21 bp, Homo sapiens
tccgtgtggagcacgtggaga

SEQ ID NO: 6416892 - DNA, 18 bp, Homo sapiens
tccgtgtggagggctgca

SEQ ID NO: 6416893 - DNA, 12 bp, Homo sapiens
tccgtgtgtgtg

SEQ ID NO: 6416894 - DNA, 13 bp, Homo sapiens
tccgtgtgtgtgt

SEQ ID NO: 6416895 - DNA, 13 bp, Homo sapiens
tccgtgtgtttat

SEQ ID NO: 6416896 - DNA, 22 bp, Homo sapiens
tccgtgttgcaggttcatggat

SEQ ID NO: 6416897 - DNA, 22 bp, Homo sapiens
tccgtgtttctctaaggaatta

SEQ ID NO: 6416898 - DNA, 20 bp, Homo sapiens
tccgttaacctttttgtaaa

SEQ ID NO: 6416899 - DNA, 22 bp, Homo sapiens
tccgttaacctttttgtaaata

SEQ ID NO: 6416900 - DNA, 19 bp, Homo sapiens
tccgttagctcctgtggcc

SEQ ID NO: 6416901 - DNA, 12 bp, Homo sapiens
tccgttaggaat

SEQ ID NO: 6416902 - DNA, 16 bp, Homo sapiens
tccgttcacatgtgtg

SEQ ID NO: 6416903 - DNA, 14 bp, Homo sapiens
tccgttcccacctc

SEQ ID NO: 6416904 - DNA, 17 bp, Homo sapiens
tccgttcctcctcagcc

SEQ ID NO: 6416905 - DNA, 13 bp, Homo sapiens
tccgttcctggca

SEQ ID NO: 6416906 - DNA, 14 bp, Homo sapiens
tccgttctgttctg

SEQ ID NO: 6416907 - DNA, 18 bp, Homo sapiens
tccgttggaaagaacatt

SEQ ID NO: 6416908 - DNA, 16 bp, Homo sapiens
tccgtttccttacaca

SEQ ID NO: 6416909 - DNA, 24 bp, Homo sapiens
tccgtttctaccaccgcatcctca

SEQ ID NO: 6416910 - DNA, 19 bp, Homo sapiens
tccgtttcttccccccaga

SEQ ID NO: 6416911 - DNA, 21 bp, Homo sapiens
tccgtttgatttgtcactgct

SEQ ID NO: 6416912 - DNA, 22 bp, Homo sapiens
tcctaaaacaaaagctcatcca

SEQ ID NO: 6416913 - DNA, 15 bp, Homo sapiens
tcctaaaacaaatag

SEQ ID NO: 6416914 - DNA, 23 bp, Homo sapiens
tcctaaaacacccttcagcaatg

SEQ ID NO: 6416915 - DNA, 17 bp, Homo sapiens
tcctaaaacacctggta

SEQ ID NO: 6416916 - DNA, 16 bp, Homo sapiens
tcctaaaactctgcca

SEQ ID NO: 6416917 - DNA, 22 bp, Homo sapiens
tcctaaaactgggattaagaaa

SEQ ID NO: 6416918 - DNA, 14 bp, Homo sapiens
tcctaaaagcaaaa

SEQ ID NO: 6416919 - DNA, 22 bp, Homo sapiens
tcctaaaagcaaaataaaaact

SEQ ID NO: 6416920 - DNA, 13 bp, Homo sapiens
tcctaaaaggccc

SEQ ID NO: 6416921 - DNA, 15 bp, Homo sapiens
tcctaaaaggcccag

SEQ ID NO: 6416922 - DNA, 18 bp, Homo sapiens
tcctaaaaggcccagaga

SEQ ID NO: 6416923 - DNA, 21 bp, Homo sapiens
tcctaaaagttttaacctcag

SEQ ID NO: 6416924 - DNA, 15 bp, Homo sapiens
tcctaaacataattg

SEQ ID NO: 6416925 - DNA, 19 bp, Homo sapiens
tcctaaacccccgctccag

SEQ ID NO: 6416926 - DNA, 22 bp, Homo sapiens
tcctaaacccccgctccagatc

SEQ ID NO: 6416927 - DNA, 23 bp, Homo sapiens
tcctaaaccgtcccctccttccc

SEQ ID NO: 6416928 - DNA, 17 bp, Homo sapiens
tcctaaagaacaaagta

SEQ ID NO: 6416929 - DNA, 17 bp, Homo sapiens
tcctaaagaagacattt

SEQ ID NO: 6416930 - DNA, 18 bp, Homo sapiens
tcctaaagaagacatttt

SEQ ID NO: 6416931 - DNA, 12 bp, Homo sapiens
tcctaaagccaa

SEQ ID NO: 6416932 - DNA, 23 bp, Homo sapiens
tcctaaagccaaagtttctgttg

SEQ ID NO: 6416933 - DNA, 22 bp, Homo sapiens
tcctaaaggtgagggtctcttt

SEQ ID NO: 6416934 - DNA, 13 bp, Homo sapiens
tcctaaagtgaag

SEQ ID NO: 6416935 - DNA, 17 bp, Homo sapiens
tcctaaagtgaagaagc

SEQ ID NO: 6416936 - DNA, 23 bp, Homo sapiens
tcctaaataatatcctgaataac

SEQ ID NO: 6416937 - DNA, 19 bp, Homo sapiens
tcctaaatattttcaagaa

SEQ ID NO: 6416938 - DNA, 18 bp, Homo sapiens
tcctaaattttcctgtcc

SEQ ID NO: 6416939 - DNA, 14 bp, Homo sapiens
tcctaacaggatga

SEQ ID NO: 6416940 - DNA, 16 bp, Homo sapiens
tcctaacaggatgaaa

SEQ ID NO: 6416941 - DNA, 23 bp, Homo sapiens
tcctaacataacactaaatgctg

SEQ ID NO: 6416942 - DNA, 23 bp, Homo sapiens
tcctaacatatatgtatatacac

SEQ ID NO: 6416943 - DNA, 16 bp, Homo sapiens
tcctaaccactaacat

SEQ ID NO: 6416944 - DNA, 23 bp, Homo sapiens
tcctaaccccctaagctccaggt

SEQ ID NO: 6416945 - DNA, 14 bp, Homo sapiens
tcctaaccctgggc

SEQ ID NO: 6416946 - DNA, 22 bp, Homo sapiens
tcctaaccctgggctccctgga

SEQ ID NO: 6416947 - DNA, 15 bp, Homo sapiens
tcctaactagaatta

SEQ ID NO: 6416948 - DNA, 17 bp, Homo sapiens
tcctaactgaagagaca

SEQ ID NO: 6416949 - DNA, 14 bp, Homo sapiens
tcctaactgagaat

SEQ ID NO: 6416950 - DNA, 23 bp, Homo sapiens
tcctaactgttttgtatatgctg

SEQ ID NO: 6416951 - DNA, 24 bp, Homo sapiens
tcctaactttggacctattatcag

SEQ ID NO: 6416952 - DNA, 15 bp, Homo sapiens
tcctaagaaatatgt

SEQ ID NO: 6416953 - DNA, 16 bp, Homo sapiens
tcctaagaagcttcta

SEQ ID NO: 6416954 - DNA, 19 bp, Homo sapiens
tcctaagaagcttctaata

SEQ ID NO: 6416955 - DNA, 16 bp, Homo sapiens
tcctaagacacaaatg

SEQ ID NO: 6416956 - DNA, 12 bp, Homo sapiens
tcctaagacatt

SEQ ID NO: 6416957 - DNA, 19 bp, Homo sapiens
tcctaagacatttttcatt

SEQ ID NO: 6416958 - DNA, 17 bp, Homo sapiens
tcctaagagtgctgggc

SEQ ID NO: 6416959 - DNA, 19 bp, Homo sapiens
tcctaagagtgctgggcat

SEQ ID NO: 6416960 - DNA, 21 bp, Homo sapiens
tcctaagcaactaggccttca

SEQ ID NO: 6416961 - DNA, 14 bp, Homo sapiens
tcctaagcagctgg

SEQ ID NO: 6416962 - DNA, 19 bp, Homo sapiens
tcctaagcagtgcttgtaa

SEQ ID NO: 6416963 - DNA, 14 bp, Homo sapiens
tcctaagcatctaa

SEQ ID NO: 6416964 - DNA, 13 bp, Homo sapiens
tcctaagcctgtg

SEQ ID NO: 6416965 - DNA, 13 bp, Homo sapiens
tcctaagctgcca

SEQ ID NO: 6416966 - DNA, 15 bp, Homo sapiens
tcctaagctgttgga

SEQ ID NO: 6416967 - DNA, 12 bp, Homo sapiens
tcctaaggacac

SEQ ID NO: 6416968 - DNA, 16 bp, Homo sapiens
tcctaaggacacacta

SEQ ID NO: 6416969 - DNA, 13 bp, Homo sapiens
tatcaagcccctg

SEQ ID NO: 6416970 - DNA, 13 bp, Homo sapiens
tatcaagctaata

SEQ ID NO: 6416971 - DNA, 16 bp, Homo sapiens
tatcaaggaaacgttt

SEQ ID NO: 6416972 - DNA, 21 bp, Homo sapiens
tatcaaggaagtcttcaaatt

SEQ ID NO: 6416973 - DNA, 20 bp, Homo sapiens
tatcaaggattttcatgttg

SEQ ID NO: 6416974 - DNA, 15 bp, Homo sapiens
tatcaaggctgcctg

SEQ ID NO: 6416975 - DNA, 21 bp, Homo sapiens
tatcaagtattataccttttt

SEQ ID NO: 6416976 - DNA, 17 bp, Homo sapiens
tatcaagtcccgaggca

SEQ ID NO: 6416977 - DNA, 17 bp, Homo sapiens
tatcaagtgttctaaaa

SEQ ID NO: 6416978 - DNA, 20 bp, Homo sapiens
tatcaataaaattctgtaat

SEQ ID NO: 6416979 - DNA, 19 bp, Homo sapiens
tatcaataaatagaccatt

SEQ ID NO: 6416980 - DNA, 15 bp, Homo sapiens
tatcaatagtcaaga

SEQ ID NO: 6416981 - DNA, 19 bp, Homo sapiens
tatcaatataatgttttta

SEQ ID NO: 6416982 - DNA, 22 bp, Homo sapiens
tatcaatatctaatatatatga

SEQ ID NO: 6416983 - DNA, 19 bp, Homo sapiens
tatcaatatggtgtcttga

SEQ ID NO: 6416984 - DNA, 16 bp, Homo sapiens
tatcaattcaacacat

SEQ ID NO: 6416985 - DNA, 17 bp, Homo sapiens
tatcaattcaacacatt

SEQ ID NO: 6416986 - DNA, 14 bp, Homo sapiens
tatcaattcttgag

SEQ ID NO: 6416987 - DNA, 21 bp, Homo sapiens
tatcaattggcagtgactttg

SEQ ID NO: 6416988 - DNA, 21 bp, Homo sapiens
tatcaatttctaatgtttact

SEQ ID NO: 6416989 - DNA, 20 bp, Homo sapiens
tatcacaaatcttaacttga

SEQ ID NO: 6416990 - DNA, 16 bp, Homo sapiens
tatcacacaaagcaga

SEQ ID NO: 6416991 - DNA, 14 bp, Homo sapiens
tatcacacaatata

SEQ ID NO: 6416992 - DNA, 19 bp, Homo sapiens
tatcacacacattgctgtg

SEQ ID NO: 6416993 - DNA, 11 bp, Homo sapiens
tatcacacact

SEQ ID NO: 6416994 - DNA, 19 bp, Homo sapiens
tatcacacttgcaaatgaa

SEQ ID NO: 6416995 - DNA, 15 bp, Homo sapiens
tatcacagagccact

SEQ ID NO: 6416996 - DNA, 18 bp, Homo sapiens
tatcacagagccactctt

SEQ ID NO: 6416997 - DNA, 12 bp, Homo sapiens
tatcacagtatt

SEQ ID NO: 6416998 - DNA, 16 bp, Homo sapiens
tatcacagtattatct

SEQ ID NO: 6416999 - DNA, 16 bp, Homo sapiens
tatcacataattccag

SEQ ID NO: 6417000 - DNA, 14 bp, Homo sapiens
tatcacatacaatt

SEQ ID NO: 6417001 - DNA, 18 bp, Homo sapiens
tatcacatacaatttgca

SEQ ID NO: 6417002 - DNA, 20 bp, Homo sapiens
tatcacatgtgaaaagctta

SEQ ID NO: 6417003 - DNA, 13 bp, Homo sapiens
tatcacatgttgt

SEQ ID NO: 6417004 - DNA, 18 bp, Homo sapiens
tatcacatgttttctctg

SEQ ID NO: 6417005 - DNA, 23 bp, Homo sapiens
tatcacattacatcatcctcctt

SEQ ID NO: 6417006 - DNA, 13 bp, Homo sapiens
tatcacattattt

SEQ ID NO: 6417007 - DNA, 20 bp, Homo sapiens
tatcacattggagtcactgc

SEQ ID NO: 6417008 - DNA, 23 bp, Homo sapiens
tatcaccaaaaacctattccact

SEQ ID NO: 6417009 - DNA, 15 bp, Homo sapiens
tatcaccacagtaag

SEQ ID NO: 6417010 - DNA, 15 bp, Homo sapiens
tatcaccagctgcct

SEQ ID NO: 6417011 - DNA, 14 bp, Homo sapiens
tatcaccagtctta

SEQ ID NO: 6417012 - DNA, 22 bp, Homo sapiens
tatcaccccctccctacacaca

SEQ ID NO: 6417013 - DNA, 16 bp, Homo sapiens
tatcacccttccctgc

SEQ ID NO: 6417014 - DNA, 15 bp, Homo sapiens
tatcacctcattctg

SEQ ID NO: 6417015 - DNA, 20 bp, Homo sapiens
tatcacctcccctccttgcc

SEQ ID NO: 6417016 - DNA, 16 bp, Homo sapiens
tatcacctctcttcag

SEQ ID NO: 6417017 - DNA, 22 bp, Homo sapiens
tatcacctgaattattaatgaa

SEQ ID NO: 6417018 - DNA, 19 bp, Homo sapiens
tatcacctggcttgtttat

SEQ ID NO: 6417019 - DNA, 22 bp, Homo sapiens
tatcacctgttcatttgaagaa

SEQ ID NO: 6417020 - DNA, 15 bp, Homo sapiens
tatcacgatttgcag

SEQ ID NO: 6417021 - DNA, 15 bp, Homo sapiens
tatcacgggcccgct

SEQ ID NO: 6417022 - DNA, 16 bp, Homo sapiens
tatcacgtctgacaaa

SEQ ID NO: 6417023 - DNA, 16 bp, Homo sapiens
tatcactaaaagcatg

SEQ ID NO: 6417024 - DNA, 21 bp, Homo sapiens
tatcactaaaagcatgaattg

SEQ ID NO: 6417025 - DNA, 16 bp, Homo sapiens
tatcactaaataaaca

SEQ ID NO: 6417026 - DNA, 12 bp, Homo sapiens
tatcactaagaa

SEQ ID NO: 6417027 - DNA, 19 bp, Homo sapiens
tatcactaataaagtctgt

SEQ ID NO: 6417028 - DNA, 12 bp, Homo sapiens
tatcactcactg

SEQ ID NO: 6417029 - DNA, 19 bp, Homo sapiens
tatcactcattaattaacc

SEQ ID NO: 6417030 - DNA, 10 bp, Homo sapiens
tatcactcta

SEQ ID NO: 6417031 - DNA, 18 bp, Homo sapiens
tatcactctaaaaaacat

SEQ ID NO: 6417032 - DNA, 21 bp, Homo sapiens
tatcactctgaccttcacagg

SEQ ID NO: 6417033 - DNA, 19 bp, Homo sapiens
tatcactgcagtcacctct

SEQ ID NO: 6417034 - DNA, 23 bp, Homo sapiens
tatcactgcattatcttgctcat

SEQ ID NO: 6417035 - DNA, 23 bp, Homo sapiens
tatcactgccttcgtttatattt

SEQ ID NO: 6417036 - DNA, 12 bp, Homo sapiens
tatcactgctgc

SEQ ID NO: 6417037 - DNA, 17 bp, Homo sapiens
tatcactggcaatattt

SEQ ID NO: 6417038 - DNA, 21 bp, Homo sapiens
tatcactggcaatatttgttc

SEQ ID NO: 6417039 - DNA, 15 bp, Homo sapiens
tatcactgtctttga

SEQ ID NO: 6417040 - DNA, 20 bp, Homo sapiens
tatcacttaatttgaaatct

SEQ ID NO: 6417041 - DNA, 17 bp, Homo sapiens
tatcacttgccgtgtca

SEQ ID NO: 6417042 - DNA, 13 bp, Homo sapiens
tatcactttgtat

SEQ ID NO: 6417043 - DNA, 16 bp, Homo sapiens
tatcactttttgaact

SEQ ID NO: 6417044 - DNA, 18 bp, Homo sapiens
tatcactttttgaactaa

SEQ ID NO: 6417045 - DNA, 20 bp, Homo sapiens
tatcactttttgaactaaga

SEQ ID NO: 6417046 - DNA, 17 bp, Homo sapiens
tatcagaaaagtagaat

SEQ ID NO: 6417047 - DNA, 19 bp, Homo sapiens
tatcagaaaagtagaatta

SEQ ID NO: 6417048 - DNA, 12 bp, Homo sapiens
tatcagaaacag

SEQ ID NO: 6417049 - DNA, 19 bp, Homo sapiens
tatcagaactcctttctaa

SEQ ID NO: 6417050 - DNA, 13 bp, Homo sapiens
tatcagaagcaag

SEQ ID NO: 6417051 - DNA, 19 bp, Homo sapiens
tatcagaagcaaggaagta

SEQ ID NO: 6417052 - DNA, 18 bp, Homo sapiens
tatcagaagtatatctgt

SEQ ID NO: 6417053 - DNA, 18 bp, Homo sapiens
tatcagaatacttgcact

SEQ ID NO: 6417054 - DNA, 20 bp, Homo sapiens
tatcagaatacttgcactct

SEQ ID NO: 6417055 - DNA, 15 bp, Homo sapiens
tatcagaataggaag

SEQ ID NO: 6417056 - DNA, 22 bp, Homo sapiens
tatcagaatcaaatctgagcct

SEQ ID NO: 6417057 - DNA, 18 bp, Homo sapiens
tatcagacactctggctg

SEQ ID NO: 6417058 - DNA, 19 bp, Homo sapiens
tatcagacactctggctgg

SEQ ID NO: 6417059 - DNA, 20 bp, Homo sapiens
tatcagacactctggctggt

SEQ ID NO: 6417060 - DNA, 18 bp, Homo sapiens
tatcagacgtgctccctc

SEQ ID NO: 6417061 - DNA, 17 bp, Homo sapiens
tatcagactaagccagc

SEQ ID NO: 6417062 - DNA, 21 bp, Homo sapiens
tatcagactcggaatctattt

SEQ ID NO: 6417063 - DNA, 15 bp, Homo sapiens
tatcagagctcttaa

SEQ ID NO: 6417064 - DNA, 22 bp, Homo sapiens
tatcagaggtctatttttacct

SEQ ID NO: 6417065 - DNA, 21 bp, Homo sapiens
tatcagagttgcttttctaat

SEQ ID NO: 6417066 - DNA, 13 bp, Homo sapiens
tatcagatacatc

SEQ ID NO: 6417067 - DNA, 16 bp, Homo sapiens
tatcagatacatcact

SEQ ID NO: 6417068 - DNA, 19 bp, Homo sapiens
tatcagatacatcactgct

SEQ ID NO: 6417069 - DNA, 20 bp, Homo sapiens
tatcagatattttcatattt

SEQ ID NO: 6417070 - DNA, 14 bp, Homo sapiens
tatcagcacgtgtg

SEQ ID NO: 6417071 - DNA, 15 bp, Homo sapiens
tatcagcacgtgtgg

SEQ ID NO: 6417072 - DNA, 16 bp, Homo sapiens
tatcagcactggattg

SEQ ID NO: 6417073 - DNA, 15 bp, Homo sapiens
tatcagccagccttc

SEQ ID NO: 6417074 - DNA, 19 bp, Homo sapiens
tatcagcctgtctcttcca

SEQ ID NO: 6417075 - DNA, 16 bp, Homo sapiens
tatcagccttgctttg

SEQ ID NO: 6417076 - DNA, 16 bp, Homo sapiens
tatcagctacaattgt

SEQ ID NO: 6417077 - DNA, 16 bp, Homo sapiens
tatcagctactgtagt

SEQ ID NO: 6417078 - DNA, 22 bp, Homo sapiens
tatcagctctatgtcaattgat

SEQ ID NO: 6417079 - DNA, 19 bp, Homo sapiens
tatcagctttgataattgt

SEQ ID NO: 6417080 - DNA, 14 bp, Homo sapiens
tatcagcttttctg

SEQ ID NO: 6417081 - DNA, 15 bp, Homo sapiens
tatcaggaatataaa

SEQ ID NO: 6417082 - DNA, 16 bp, Homo sapiens
tatcaggatttcctct

SEQ ID NO: 6417083 - DNA, 14 bp, Homo sapiens
tatcaggcacaggc

SEQ ID NO: 6417084 - DNA, 15 bp, Homo sapiens
tatcaggcacaggca

SEQ ID NO: 6417085 - DNA, 11 bp, Homo sapiens
tatcaggcaga

SEQ ID NO: 6417086 - DNA, 23 bp, Homo sapiens
tatcaggcagaagaatctttctt

SEQ ID NO: 6417087 - DNA, 14 bp, Homo sapiens
tatcagggcacagt

SEQ ID NO: 6417088 - DNA, 20 bp, Homo sapiens
tatcagggcccaaataacag

SEQ ID NO: 6417089 - DNA, 21 bp, Homo sapiens
tatcagggcccaaataacagt

SEQ ID NO: 6417090 - DNA, 13 bp, Homo sapiens
tatcagggcctga

SEQ ID NO: 6417091 - DNA, 23 bp, Homo sapiens
tatcaggggatgtacatctctcc

SEQ ID NO: 6417092 - DNA, 19 bp, Homo sapiens
tatcagggtataaattata

SEQ ID NO: 6417093 - DNA, 22 bp, Homo sapiens
tatcaggtaaaatattttccaa

SEQ ID NO: 6417094 - DNA, 14 bp, Homo sapiens
tatcaggtaataaa

SEQ ID NO: 6417095 - DNA, 14 bp, Homo sapiens
tatcaggtcaggga

SEQ ID NO: 6417096 - DNA, 15 bp, Homo sapiens
tatcaggtctcccac

SEQ ID NO: 6417097 - DNA, 16 bp, Homo sapiens
tatcaggtgcccatcc

SEQ ID NO: 6417098 - DNA, 15 bp, Homo sapiens
tatcagtaaataact

SEQ ID NO: 6417099 - DNA, 15 bp, Homo sapiens
tatcagtaatgctaa

SEQ ID NO: 6417100 - DNA, 23 bp, Homo sapiens
tatcagtaatgctaaatgtgtaa

SEQ ID NO: 6417101 - DNA, 19 bp, Homo sapiens
tatcagtacaattctttgt

SEQ ID NO: 6417102 - DNA, 17 bp, Homo sapiens
tatcagtaccatttgat

SEQ ID NO: 6417103 - DNA, 12 bp, Homo sapiens
tatcagtacctc

SEQ ID NO: 6417104 - DNA, 14 bp, Homo sapiens
tatcagtattctga

SEQ ID NO: 6417105 - DNA, 20 bp, Homo sapiens
tatcagtcatgacagatgaa

SEQ ID NO: 6417106 - DNA, 14 bp, Homo sapiens
tatcagtcatgact

SEQ ID NO: 6417107 - DNA, 14 bp, Homo sapiens
tatcagtctctgag

SEQ ID NO: 6417108 - DNA, 22 bp, Homo sapiens
tatcagtcttgtaccaaggcaa

SEQ ID NO: 6417109 - DNA, 17 bp, Homo sapiens
tatcagtgacagagttc

SEQ ID NO: 6417110 - DNA, 20 bp, Homo sapiens
tatcagtgacagagttcact

SEQ ID NO: 6417111 - DNA, 17 bp, Homo sapiens
tatcagtgacttctgaa

SEQ ID NO: 6417112 - DNA, 23 bp, Homo sapiens
tatcagtgctcgagacacagtga

SEQ ID NO: 6417113 - DNA, 22 bp, Homo sapiens
tatcagtggttcgggggaaata

SEQ ID NO: 6417114 - DNA, 13 bp, Homo sapiens
tatcagtgtgccc

SEQ ID NO: 6417115 - DNA, 15 bp, Homo sapiens
tatcagtgtgccccc

SEQ ID NO: 6417116 - DNA, 16 bp, Homo sapiens
tatcagtgttaaagtg

SEQ ID NO: 6417117 - DNA, 13 bp, Homo sapiens
tatcagtgttctt

SEQ ID NO: 6417118 - DNA, 20 bp, Homo sapiens
tatcagtgttttaaattctg

SEQ ID NO: 6417119 - DNA, 22 bp, Homo sapiens
tatcagttaaaatcacatttta

SEQ ID NO: 6417120 - DNA, 20 bp, Homo sapiens
tatcagttactcagccctgg

SEQ ID NO: 6417121 - DNA, 15 bp, Homo sapiens
tatcagttatccttt

SEQ ID NO: 6417122 - DNA, 14 bp, Homo sapiens
tatcagttgcaata

SEQ ID NO: 6417123 - DNA, 14 bp, Homo sapiens
tatcagttggacag

SEQ ID NO: 6417124 - DNA, 17 bp, Homo sapiens
tatcagtttcatgaaat

SEQ ID NO: 6417125 - DNA, 13 bp, Homo sapiens
tatcagtttgatc

SEQ ID NO: 6417126 - DNA, 13 bp, Homo sapiens
tatcagtttgcta

SEQ ID NO: 6417127 - DNA, 13 bp, Homo sapiens
tatcataaaaata

SEQ ID NO: 6417128 - DNA, 11 bp, Homo sapiens
tatcataaagt

SEQ ID NO: 6417129 - DNA, 13 bp, Homo sapiens
tatcataagaatt

SEQ ID NO: 6417130 - DNA, 16 bp, Homo sapiens
tatcataatatattgt

SEQ ID NO: 6417131 - DNA, 14 bp, Homo sapiens
tatcataatgtaat

SEQ ID NO: 6417132 - DNA, 13 bp, Homo sapiens
tatcataattacc

SEQ ID NO: 6417133 - DNA, 22 bp, Homo sapiens
tatcatacaaatcagttagttt

SEQ ID NO: 6417134 - DNA, 13 bp, Homo sapiens
tatcatacagttt

SEQ ID NO: 6417135 - DNA, 21 bp, Homo sapiens
tatcatactcttctaaaactt

SEQ ID NO: 6417136 - DNA, 15 bp, Homo sapiens
tatcatagaaatgta

SEQ ID NO: 6417137 - DNA, 13 bp, Homo sapiens
tatcatagttaac

SEQ ID NO: 6417138 - DNA, 15 bp, Homo sapiens
tatcatagttaacat

SEQ ID NO: 6417139 - DNA, 16 bp, Homo sapiens
tatcatataaaatttc

SEQ ID NO: 6417140 - DNA, 12 bp, Homo sapiens
tatcatatatgc

SEQ ID NO: 6417141 - DNA, 18 bp, Homo sapiens
tatcatatatgctttttt

SEQ ID NO: 6417142 - DNA, 17 bp, Homo sapiens
tatcatatattaaaaca

SEQ ID NO: 6417143 - DNA, 16 bp, Homo sapiens
tatcatatccttgccc

SEQ ID NO: 6417144 - DNA, 14 bp, Homo sapiens
tatcatattctaaa

SEQ ID NO: 6417145 - DNA, 15 bp, Homo sapiens
tatcatattggtatt

SEQ ID NO: 6417146 - DNA, 22 bp, Homo sapiens
tatcatcaagcaggaattatgt

SEQ ID NO: 6417147 - DNA, 18 bp, Homo sapiens
tatcatcaatgtgacatt

SEQ ID NO: 6417148 - DNA, 23 bp, Homo sapiens
tatcatcagtgtagaacctaatt

SEQ ID NO: 6417149 - DNA, 17 bp, Homo sapiens
tcctaaggacacactaa

SEQ ID NO: 6417150 - DNA, 15 bp, Homo sapiens
tcctaaggccactgt

SEQ ID NO: 6417151 - DNA, 13 bp, Homo sapiens
tcctaaggcccag

SEQ ID NO: 6417152 - DNA, 16 bp, Homo sapiens
tcctaaggcccagctg

SEQ ID NO: 6417153 - DNA, 19 bp, Homo sapiens
tcctaaggcccagctgcca

SEQ ID NO: 6417154 - DNA, 21 bp, Homo sapiens
tcctaaggctccccaccccga

SEQ ID NO: 6417155 - DNA, 16 bp, Homo sapiens
tcctaagggtcgaaag

SEQ ID NO: 6417156 - DNA, 23 bp, Homo sapiens
tcctaaggtccaacaagaatgca

SEQ ID NO: 6417157 - DNA, 21 bp, Homo sapiens
tcctaagtatcaagtatagaa

SEQ ID NO: 6417158 - DNA, 17 bp, Homo sapiens
tcctaagtcccttccta

SEQ ID NO: 6417159 - DNA, 22 bp, Homo sapiens
tcctaagtgggaagtgaagccc

SEQ ID NO: 6417160 - DNA, 23 bp, Homo sapiens
tcctaagtgggaagtgaagcccc

SEQ ID NO: 6417161 - DNA, 18 bp, Homo sapiens
tcctaagtgtcaagtcct

SEQ ID NO: 6417162 - DNA, 18 bp, Homo sapiens
tcctaagttcccttctat

SEQ ID NO: 6417163 - DNA, 13 bp, Homo sapiens
tcctaatagcttt

SEQ ID NO: 6417164 - DNA, 14 bp, Homo sapiens
tcctaatatgatct

SEQ ID NO: 6417165 - DNA, 22 bp, Homo sapiens
tcctaatcaaattctgtctggg

SEQ ID NO: 6417166 - DNA, 23 bp, Homo sapiens
tcctaatcaagagtctctccagc

SEQ ID NO: 6417167 - DNA, 18 bp, Homo sapiens
tcctaatcactcagagca

SEQ ID NO: 6417168 - DNA, 23 bp, Homo sapiens
tcctaatgaaggttttcatttgc

SEQ ID NO: 6417169 - DNA, 22 bp, Homo sapiens
tcctaatgaatgcataaaatgt

SEQ ID NO: 6417170 - DNA, 23 bp, Homo sapiens
tcctaatgatgacttgagccctg

SEQ ID NO: 6417171 - DNA, 16 bp, Homo sapiens
tcctaatgctctgaaa

SEQ ID NO: 6417172 - DNA, 17 bp, Homo sapiens
tcctaatggctattttt

SEQ ID NO: 6417173 - DNA, 23 bp, Homo sapiens
tcctaattcacacaaagactcct

SEQ ID NO: 6417174 - DNA, 15 bp, Homo sapiens
tcctaattccacagc

SEQ ID NO: 6417175 - DNA, 14 bp, Homo sapiens
tcctaattcctgta

SEQ ID NO: 6417176 - DNA, 21 bp, Homo sapiens
tcctaattctatgattaaact

SEQ ID NO: 6417177 - DNA, 12 bp, Homo sapiens
tcctaattttga

SEQ ID NO: 6417178 - DNA, 23 bp, Homo sapiens
tcctacaaaaataaaaggcttcc

SEQ ID NO: 6417179 - DNA, 18 bp, Homo sapiens
tcctacaaagaaaaaaga

SEQ ID NO: 6417180 - DNA, 20 bp, Homo sapiens
tcctacaaagaaaaaagaag

SEQ ID NO: 6417181 - DNA, 23 bp, Homo sapiens
tcctacaaagacgcaaggtgtgc

SEQ ID NO: 6417182 - DNA, 18 bp, Homo sapiens
tcctacaacttaatggaa

SEQ ID NO: 6417183 - DNA, 19 bp, Homo sapiens
tcctacaagagcagcctgt

SEQ ID NO: 6417184 - DNA, 22 bp, Homo sapiens
tcctacaagagcagcctgtggc

SEQ ID NO: 6417185 - DNA, 23 bp, Homo sapiens
tcctacaagagcagcctgtggca

SEQ ID NO: 6417186 - DNA, 18 bp, Homo sapiens
tcctacaagatttagaaa

SEQ ID NO: 6417187 - DNA, 18 bp, Homo sapiens
tcctacaagttaaccagt

SEQ ID NO: 6417188 - DNA, 23 bp, Homo sapiens
tcctacaatatcattttcctggg

SEQ ID NO: 6417189 - DNA, 17 bp, Homo sapiens
tcctacaatattttatt

SEQ ID NO: 6417190 - DNA, 19 bp, Homo sapiens
tcctacaatattttattct

SEQ ID NO: 6417191 - DNA, 15 bp, Homo sapiens
tcctacacataggag

SEQ ID NO: 6417192 - DNA, 19 bp, Homo sapiens
tcctacacttgagagaaaa

SEQ ID NO: 6417193 - DNA, 13 bp, Homo sapiens
tcctacagaaaaa

SEQ ID NO: 6417194 - DNA, 21 bp, Homo sapiens
tcctacagcactactgggtgt

SEQ ID NO: 6417195 - DNA, 13 bp, Homo sapiens
tcctacagcccct

SEQ ID NO: 6417196 - DNA, 14 bp, Homo sapiens
tcctacagcctcag

SEQ ID NO: 6417197 - DNA, 16 bp, Homo sapiens
tcctacaggcagtctc

SEQ ID NO: 6417198 - DNA, 17 bp, Homo sapiens
tcctacaggcagtctct

SEQ ID NO: 6417199 - DNA, 22 bp, Homo sapiens
tcctacaggcagtctctctctt

SEQ ID NO: 6417200 - DNA, 18 bp, Homo sapiens
tcctacaggcgctccagg

SEQ ID NO: 6417201 - DNA, 14 bp, Homo sapiens
tcctacagtacaat

SEQ ID NO: 6417202 - DNA, 20 bp, Homo sapiens
tcctacagtgaaatgagcag

SEQ ID NO: 6417203 - DNA, 16 bp, Homo sapiens
tcctacatccagctcc

SEQ ID NO: 6417204 - DNA, 17 bp, Homo sapiens
tcctacatccagctcct

SEQ ID NO: 6417205 - DNA, 18 bp, Homo sapiens
tcctacattttctttttt

SEQ ID NO: 6417206 - DNA, 12 bp, Homo sapiens
tcctaccaaagt

SEQ ID NO: 6417207 - DNA, 14 bp, Homo sapiens
tcctaccaagtcaa

SEQ ID NO: 6417208 - DNA, 20 bp, Homo sapiens
tcctaccaatagattcccca

SEQ ID NO: 6417209 - DNA, 13 bp, Homo sapiens
tcctaccaatgca

SEQ ID NO: 6417210 - DNA, 20 bp, Homo sapiens
tcctaccaatggattcatgg

SEQ ID NO: 6417211 - DNA, 21 bp, Homo sapiens
tcctaccaatggattcatgga

SEQ ID NO: 6417212 - DNA, 17 bp, Homo sapiens
tcctaccactggacagt

SEQ ID NO: 6417213 - DNA, 14 bp, Homo sapiens
tcctaccagcaaac

SEQ ID NO: 6417214 - DNA, 20 bp, Homo sapiens
tcctaccagcaaacagctga

SEQ ID NO: 6417215 - DNA, 17 bp, Homo sapiens
tcctaccagttgcccta

SEQ ID NO: 6417216 - DNA, 21 bp, Homo sapiens
tcctaccatcagctctgcctt

SEQ ID NO: 6417217 - DNA, 15 bp, Homo sapiens
tcctaccattatggc

SEQ ID NO: 6417218 - DNA, 16 bp, Homo sapiens
tcctacccaaccactc

SEQ ID NO: 6417219 - DNA, 12 bp, Homo sapiens
tcctacccagcg

SEQ ID NO: 6417220 - DNA, 23 bp, Homo sapiens
tcctacccagcgtggcccaggcc

SEQ ID NO: 6417221 - DNA, 15 bp, Homo sapiens
tcctacccatccccg

SEQ ID NO: 6417222 - DNA, 14 bp, Homo sapiens
tcctaccccacctc

SEQ ID NO: 6417223 - DNA, 15 bp, Homo sapiens
tcctaccccctgtgc

SEQ ID NO: 6417224 - DNA, 12 bp, Homo sapiens
tcctacccctcc

SEQ ID NO: 6417225 - DNA, 13 bp, Homo sapiens
tcctacccctccc

SEQ ID NO: 6417226 - DNA, 17 bp, Homo sapiens
tcctacccctcccagct

SEQ ID NO: 6417227 - DNA, 14 bp, Homo sapiens
tcctaccccttcct

SEQ ID NO: 6417228 - DNA, 20 bp, Homo sapiens
tcctaccccttcctgtcctg

SEQ ID NO: 6417229 - DNA, 22 bp, Homo sapiens
tcctacccgcccgcgtccaacc

SEQ ID NO: 6417230 - DNA, 17 bp, Homo sapiens
tcctaccctccttccac

SEQ ID NO: 6417231 - DNA, 17 bp, Homo sapiens
tcctaccctcgggccca

SEQ ID NO: 6417232 - DNA, 21 bp, Homo sapiens
tcctaccctcgggcccacctg

SEQ ID NO: 6417233 - DNA, 16 bp, Homo sapiens
tcctacctatattaca

SEQ ID NO: 6417234 - DNA, 14 bp, Homo sapiens
tcctacctattatc

SEQ ID NO: 6417235 - DNA, 16 bp, Homo sapiens
tcctacctcagcctag

SEQ ID NO: 6417236 - DNA, 22 bp, Homo sapiens
tcctacctctgtgccagggcag

SEQ ID NO: 6417237 - DNA, 23 bp, Homo sapiens
tcctacctctgtgccagggcagc

SEQ ID NO: 6417238 - DNA, 16 bp, Homo sapiens
tcctacctgaaggcag

SEQ ID NO: 6417239 - DNA, 18 bp, Homo sapiens
tcctacctgaaggcaggg

SEQ ID NO: 6417240 - DNA, 14 bp, Homo sapiens
tcctacctgccctg

SEQ ID NO: 6417241 - DNA, 12 bp, Homo sapiens
tcctacctgggg

SEQ ID NO: 6417242 - DNA, 18 bp, Homo sapiens
tcctacctggggactcct

SEQ ID NO: 6417243 - DNA, 20 bp, Homo sapiens
tcctacctggggactcctca

SEQ ID NO: 6417244 - DNA, 15 bp, Homo sapiens
tcctacctgggggca

SEQ ID NO: 6417245 - DNA, 12 bp, Homo sapiens
tcctacctggtc

SEQ ID NO: 6417246 - DNA, 22 bp, Homo sapiens
tcctacctggtcaacccgctgc

SEQ ID NO: 6417247 - DNA, 20 bp, Homo sapiens
tcctaccttggtcctgcctc

SEQ ID NO: 6417248 - DNA, 21 bp, Homo sapiens
tcctaccttggtcctgcctct

SEQ ID NO: 6417249 - DNA, 23 bp, Homo sapiens
tcctacgagtaattgcatttgct

SEQ ID NO: 6417250 - DNA, 17 bp, Homo sapiens
tcctacgctatgtagaa

SEQ ID NO: 6417251 - DNA, 14 bp, Homo sapiens
tcctacggagggac

SEQ ID NO: 6417252 - DNA, 15 bp, Homo sapiens
tcctacgtccaaggt

SEQ ID NO: 6417253 - DNA, 14 bp, Homo sapiens
tcctactaagaagt

SEQ ID NO: 6417254 - DNA, 16 bp, Homo sapiens
tcctactaataaacca

SEQ ID NO: 6417255 - DNA, 15 bp, Homo sapiens
tcctactcaacaaaa

SEQ ID NO: 6417256 - DNA, 20 bp, Homo sapiens
tcctactccgttcctggcat

SEQ ID NO: 6417257 - DNA, 12 bp, Homo sapiens
tcctactcctga

SEQ ID NO: 6417258 - DNA, 12 bp, Homo sapiens
tcctactctgtg

SEQ ID NO: 6417259 - DNA, 20 bp, Homo sapiens
tcctactcttctctctgctc

SEQ ID NO: 6417260 - DNA, 16 bp, Homo sapiens
tcctactgtcctcaga

SEQ ID NO: 6417261 - DNA, 14 bp, Homo sapiens
tcctacttaaacaa

SEQ ID NO: 6417262 - DNA, 22 bp, Homo sapiens
tcctacttaaacaaaaactttc

SEQ ID NO: 6417263 - DNA, 19 bp, Homo sapiens
tcctacttagggaagaaaa

SEQ ID NO: 6417264 - DNA, 20 bp, Homo sapiens
tcctacttagggaagaaaaa

SEQ ID NO: 6417265 - DNA, 23 bp, Homo sapiens
tcctacttagggaagaaaaagca

SEQ ID NO: 6417266 - DNA, 13 bp, Homo sapiens
tcctacttctctg

SEQ ID NO: 6417267 - DNA, 18 bp, Homo sapiens
tcctacttctgactttac

SEQ ID NO: 6417268 - DNA, 19 bp, Homo sapiens
tcctacttctgactttact

SEQ ID NO: 6417269 - DNA, 17 bp, Homo sapiens
tcctacttgcagtacat

SEQ ID NO: 6417270 - DNA, 13 bp, Homo sapiens
tcctactttgaaa

SEQ ID NO: 6417271 - DNA, 14 bp, Homo sapiens
tcctactttgcttc

SEQ ID NO: 6417272 - DNA, 19 bp, Homo sapiens
tcctactttgcttctctcc

SEQ ID NO: 6417273 - DNA, 22 bp, Homo sapiens
tcctagaaaacccttcccgccc

SEQ ID NO: 6417274 - DNA, 15 bp, Homo sapiens
tcctagaaaagtttg

SEQ ID NO: 6417275 - DNA, 18 bp, Homo sapiens
tcctagaaaagtttgttt

SEQ ID NO: 6417276 - DNA, 18 bp, Homo sapiens
tcctagaaccaagcttca

SEQ ID NO: 6417277 - DNA, 20 bp, Homo sapiens
tcctagaaccaagcttcaga

SEQ ID NO: 6417278 - DNA, 23 bp, Homo sapiens
tcctagaaccaagcttcagagcc

SEQ ID NO: 6417279 - DNA, 15 bp, Homo sapiens
tcctagaactccagt

SEQ ID NO: 6417280 - DNA, 21 bp, Homo sapiens
tcctagaactccagtaaaagt

SEQ ID NO: 6417281 - DNA, 21 bp, Homo sapiens
tcctagaactggtgatataaa

SEQ ID NO: 6417282 - DNA, 22 bp, Homo sapiens
tcctagaagagtcaggaaggga

SEQ ID NO: 6417283 - DNA, 21 bp, Homo sapiens
tcctagaagcccctgtcgccc

SEQ ID NO: 6417284 - DNA, 14 bp, Homo sapiens
tcctagaagtctta

SEQ ID NO: 6417285 - DNA, 12 bp, Homo sapiens
tcctagacactc

SEQ ID NO: 6417286 - DNA, 22 bp, Homo sapiens
tcctagactaattaaaatctgg

SEQ ID NO: 6417287 - DNA, 15 bp, Homo sapiens
tcctagactgctcct

SEQ ID NO: 6417288 - DNA, 20 bp, Homo sapiens
tcctagactgctcctgggca

SEQ ID NO: 6417289 - DNA, 15 bp, Homo sapiens
tcctagacttgaaag

SEQ ID NO: 6417290 - DNA, 16 bp, Homo sapiens
tcctagacttgaaagt

SEQ ID NO: 6417291 - DNA, 18 bp, Homo sapiens
tcctagagaacgcagccc

SEQ ID NO: 6417292 - DNA, 23 bp, Homo sapiens
tcctagagaacgcagccctagag

SEQ ID NO: 6417293 - DNA, 19 bp, Homo sapiens
tcctagagaagacaggctg

SEQ ID NO: 6417294 - DNA, 16 bp, Homo sapiens
tcctagagatctatgg

SEQ ID NO: 6417295 - DNA, 18 bp, Homo sapiens
tcctagagcatctgtccc

SEQ ID NO: 6417296 - DNA, 18 bp, Homo sapiens
tcctagagctcctgtccc

SEQ ID NO: 6417297 - DNA, 15 bp, Homo sapiens
tcctagaggacctga

SEQ ID NO: 6417298 - DNA, 18 bp, Homo sapiens
tcctagaggccctttgct

SEQ ID NO: 6417299 - DNA, 20 bp, Homo sapiens
tcctagaggccctttgctgt

SEQ ID NO: 6417300 - DNA, 21 bp, Homo sapiens
tcctagagggaggggcctagg

SEQ ID NO: 6417301 - DNA, 18 bp, Homo sapiens
tcctagaggtagagaaac

SEQ ID NO: 6417302 - DNA, 23 bp, Homo sapiens
tcctagaggtgggcagctgggcc

SEQ ID NO: 6417303 - DNA, 14 bp, Homo sapiens
tcctagagtagagt

SEQ ID NO: 6417304 - DNA, 14 bp, Homo sapiens
tcctagataaaaag

SEQ ID NO: 6417305 - DNA, 15 bp, Homo sapiens
tcctagataaaaaga

SEQ ID NO: 6417306 - DNA, 13 bp, Homo sapiens
tcctagatcctaa

SEQ ID NO: 6417307 - DNA, 23 bp, Homo sapiens
tcctagatcctaagggtcgaaag

SEQ ID NO: 6417308 - DNA, 13 bp, Homo sapiens
tcctagatgctct

SEQ ID NO: 6417309 - DNA, 23 bp, Homo sapiens
tcctagcaagtaagaatggccaa

SEQ ID NO: 6417310 - DNA, 21 bp, Homo sapiens
tcctagcacaaggagtgcccg

SEQ ID NO: 6417311 - DNA, 17 bp, Homo sapiens
tcctagcaccctggaga

SEQ ID NO: 6417312 - DNA, 16 bp, Homo sapiens
tcctagcactgcccca

SEQ ID NO: 6417313 - DNA, 20 bp, Homo sapiens
tcctagcactgccccacatg

SEQ ID NO: 6417314 - DNA, 22 bp, Homo sapiens
tcctagcactgccccacatgca

SEQ ID NO: 6417315 - DNA, 17 bp, Homo sapiens
tcctagcacttgtctca

SEQ ID NO: 6417316 - DNA, 18 bp, Homo sapiens
tcctagcagacactgcct

SEQ ID NO: 6417317 - DNA, 12 bp, Homo sapiens
tcctagcagaga

SEQ ID NO: 6417318 - DNA, 21 bp, Homo sapiens
tcctagcaggagagaggctct

SEQ ID NO: 6417319 - DNA, 15 bp, Homo sapiens
tcctagcccagcaga

SEQ ID NO: 6417320 - DNA, 13 bp, Homo sapiens
tcctagccccacc

SEQ ID NO: 6417321 - DNA, 19 bp, Homo sapiens
tcctagccccacccagagg

SEQ ID NO: 6417322 - DNA, 20 bp, Homo sapiens
tcctagccccacccagaggt

SEQ ID NO: 6417323 - DNA, 14 bp, Homo sapiens
tcctagcccctctc

SEQ ID NO: 6417324 - DNA, 15 bp, Homo sapiens
tcctagcccctctct

SEQ ID NO: 6417325 - DNA, 17 bp, Homo sapiens
tcctagccctcctgagg

SEQ ID NO: 6417326 - DNA, 17 bp, Homo sapiens
tatcatccacattgttt

SEQ ID NO: 6417327 - DNA, 16 bp, Homo sapiens
tatcatctacctagat

SEQ ID NO: 6417328 - DNA, 22 bp, Homo sapiens
tatcatctacctagatttaata

SEQ ID NO: 6417329 - DNA, 13 bp, Homo sapiens
tatcatctccatc

SEQ ID NO: 6417330 - DNA, 14 bp, Homo sapiens
tatcatctgtcatt

SEQ ID NO: 6417331 - DNA, 20 bp, Homo sapiens
tatcatctgtggactgacct

SEQ ID NO: 6417332 - DNA, 14 bp, Homo sapiens
tatcatctttgcca

SEQ ID NO: 6417333 - DNA, 14 bp, Homo sapiens
tatcatgaaagaat

SEQ ID NO: 6417334 - DNA, 11 bp, Homo sapiens
tatcatgaagc

SEQ ID NO: 6417335 - DNA, 21 bp, Homo sapiens
tatcatgaagccttgctgaac

SEQ ID NO: 6417336 - DNA, 22 bp, Homo sapiens
tatcatgaatgtgagtcattat

SEQ ID NO: 6417337 - DNA, 16 bp, Homo sapiens
tatcatgcaaatgctg

SEQ ID NO: 6417338 - DNA, 19 bp, Homo sapiens
tatcatgcgttttatatct

SEQ ID NO: 6417339 - DNA, 12 bp, Homo sapiens
tatcatgctaaa

SEQ ID NO: 6417340 - DNA, 13 bp, Homo sapiens
tatcatgctaaaa

SEQ ID NO: 6417341 - DNA, 20 bp, Homo sapiens
tatcatgctaaaattctata

SEQ ID NO: 6417342 - DNA, 14 bp, Homo sapiens
tatcatggaaatat

SEQ ID NO: 6417343 - DNA, 23 bp, Homo sapiens
tatcatggaaatattatgcaaat

SEQ ID NO: 6417344 - DNA, 17 bp, Homo sapiens
tatcatggaagaaaagg

SEQ ID NO: 6417345 - DNA, 17 bp, Homo sapiens
tatcatggggagtaata

SEQ ID NO: 6417346 - DNA, 13 bp, Homo sapiens
tatcatggtaatg

SEQ ID NO: 6417347 - DNA, 23 bp, Homo sapiens
tatcatggtaatgacagatgcaa

SEQ ID NO: 6417348 - DNA, 17 bp, Homo sapiens
tatcatggtctcagtca

SEQ ID NO: 6417349 - DNA, 16 bp, Homo sapiens
tatcatggtgaaaagc

SEQ ID NO: 6417350 - DNA, 22 bp, Homo sapiens
tatcatgtaaagaaatgtctta

SEQ ID NO: 6417351 - DNA, 15 bp, Homo sapiens
tatcatgtaaatgta

SEQ ID NO: 6417352 - DNA, 13 bp, Homo sapiens
tatcatgtatctc

SEQ ID NO: 6417353 - DNA, 19 bp, Homo sapiens
tatcatgtcgtaggtaaac

SEQ ID NO: 6417354 - DNA, 13 bp, Homo sapiens
tatcatgtgtaat

SEQ ID NO: 6417355 - DNA, 13 bp, Homo sapiens
tatcatgttaacc

SEQ ID NO: 6417356 - DNA, 21 bp, Homo sapiens
tatcatgttagtaatacctct

SEQ ID NO: 6417357 - DNA, 22 bp, Homo sapiens
tatcatgttttataatttgaat

SEQ ID NO: 6417358 - DNA, 12 bp, Homo sapiens
tatcattaaaca

SEQ ID NO: 6417359 - DNA, 18 bp, Homo sapiens
tatcattaaacaaataaa

SEQ ID NO: 6417360 - DNA, 18 bp, Homo sapiens
tatcattaaacatgaatt

SEQ ID NO: 6417361 - DNA, 22 bp, Homo sapiens
tatcattaaacatgaatttaat

SEQ ID NO: 6417362 - DNA, 12 bp, Homo sapiens
tatcattaaagt

SEQ ID NO: 6417363 - DNA, 16 bp, Homo sapiens
tatcattaaattggaa

SEQ ID NO: 6417364 - DNA, 20 bp, Homo sapiens
tatcattacaattttctgta

SEQ ID NO: 6417365 - DNA, 17 bp, Homo sapiens
tatcattatagcatgta

SEQ ID NO: 6417366 - DNA, 14 bp, Homo sapiens
tatcattcaagtgt

SEQ ID NO: 6417367 - DNA, 12 bp, Homo sapiens
tatcattcagca

SEQ ID NO: 6417368 - DNA, 13 bp, Homo sapiens
tatcattcattct

SEQ ID NO: 6417369 - DNA, 21 bp, Homo sapiens
tatcattctgggtgtgttctt

SEQ ID NO: 6417370 - DNA, 15 bp, Homo sapiens
tatcattgaaacatt

SEQ ID NO: 6417371 - DNA, 16 bp, Homo sapiens
tatcattgaaacattt

SEQ ID NO: 6417372 - DNA, 23 bp, Homo sapiens
tatcattgttggtgttaattgaa

SEQ ID NO: 6417373 - DNA, 14 bp, Homo sapiens
tatcatttaataat

SEQ ID NO: 6417374 - DNA, 18 bp, Homo sapiens
tatcatttaataatatac

SEQ ID NO: 6417375 - DNA, 20 bp, Homo sapiens
tatcatttaataatatactt

SEQ ID NO: 6417376 - DNA, 18 bp, Homo sapiens
tatcatttattctgcttc

SEQ ID NO: 6417377 - DNA, 15 bp, Homo sapiens
tatcatttcactgtc

SEQ ID NO: 6417378 - DNA, 16 bp, Homo sapiens
tatcatttcactgtct

SEQ ID NO: 6417379 - DNA, 15 bp, Homo sapiens
tatcatttcataaaa

SEQ ID NO: 6417380 - DNA, 13 bp, Homo sapiens
tatcatttcatgc

SEQ ID NO: 6417381 - DNA, 18 bp, Homo sapiens
tatcatttcatgctttga

SEQ ID NO: 6417382 - DNA, 13 bp, Homo sapiens
tatcatttctaat

SEQ ID NO: 6417383 - DNA, 15 bp, Homo sapiens
tatcatttcttaacc

SEQ ID NO: 6417384 - DNA, 23 bp, Homo sapiens
tatcatttgagtttagggttctg

SEQ ID NO: 6417385 - DNA, 13 bp, Homo sapiens
tatcatttggccg

SEQ ID NO: 6417386 - DNA, 16 bp, Homo sapiens
tatcatttgtgaagaa

SEQ ID NO: 6417387 - DNA, 17 bp, Homo sapiens
tatcatttgtgaagaat

SEQ ID NO: 6417388 - DNA, 19 bp, Homo sapiens
tatcattttaaaaacttta

SEQ ID NO: 6417389 - DNA, 19 bp, Homo sapiens
tatcattttaaaatgtctt

SEQ ID NO: 6417390 - DNA, 21 bp, Homo sapiens
tatcattttaaaatgtcttgg

SEQ ID NO: 6417391 - DNA, 17 bp, Homo sapiens
tatcattttagaagact

SEQ ID NO: 6417392 - DNA, 12 bp, Homo sapiens
tatcattttata

SEQ ID NO: 6417393 - DNA, 15 bp, Homo sapiens
tatcattttatagaa

SEQ ID NO: 6417394 - DNA, 12 bp, Homo sapiens
tatcattttatt

SEQ ID NO: 6417395 - DNA, 15 bp, Homo sapiens
tatcattttattcac

SEQ ID NO: 6417396 - DNA, 16 bp, Homo sapiens
tatcattttccaatta

SEQ ID NO: 6417397 - DNA, 18 bp, Homo sapiens
tatcattttcctgggagt

SEQ ID NO: 6417398 - DNA, 14 bp, Homo sapiens
tatcattttctgca

SEQ ID NO: 6417399 - DNA, 18 bp, Homo sapiens
tatcatttttacactatt

SEQ ID NO: 6417400 - DNA, 22 bp, Homo sapiens
tatcatttttgtacagtttgct

SEQ ID NO: 6417401 - DNA, 20 bp, Homo sapiens
tatcatttttgtataaaaag

SEQ ID NO: 6417402 - DNA, 21 bp, Homo sapiens
tatcatttttgtataaaaagg

SEQ ID NO: 6417403 - DNA, 22 bp, Homo sapiens
tatcatttttgtataaaaagga

SEQ ID NO: 6417404 - DNA, 15 bp, Homo sapiens
tatcattttttcctg

SEQ ID NO: 6417405 - DNA, 19 bp, Homo sapiens
tatccaaaaatagccctgc

SEQ ID NO: 6417406 - DNA, 21 bp, Homo sapiens
tatccaaaatatttaaattta

SEQ ID NO: 6417407 - DNA, 15 bp, Homo sapiens
tatccaaaatgcttg

SEQ ID NO: 6417408 - DNA, 23 bp, Homo sapiens
tatccaaaatgtgtatttcttat

SEQ ID NO: 6417409 - DNA, 15 bp, Homo sapiens
tatccaaagactgta

SEQ ID NO: 6417410 - DNA, 17 bp, Homo sapiens
tatccaaagactgtact

SEQ ID NO: 6417411 - DNA, 15 bp, Homo sapiens
tatccaaataatgaa

SEQ ID NO: 6417412 - DNA, 16 bp, Homo sapiens
tatccaaatcttgaat

SEQ ID NO: 6417413 - DNA, 14 bp, Homo sapiens
tatccaactttttc

SEQ ID NO: 6417414 - DNA, 12 bp, Homo sapiens
tatccaaggaaa

SEQ ID NO: 6417415 - DNA, 23 bp, Homo sapiens
tatccaaggaaacattttatcat

SEQ ID NO: 6417416 - DNA, 19 bp, Homo sapiens
tatccaagtaccaatgctg

SEQ ID NO: 6417417 - DNA, 14 bp, Homo sapiens
tatccaagtgttat

SEQ ID NO: 6417418 - DNA, 13 bp, Homo sapiens
tatccaatcctca

SEQ ID NO: 6417419 - DNA, 14 bp, Homo sapiens
tatccaatctgtga

SEQ ID NO: 6417420 - DNA, 18 bp, Homo sapiens
tatccaattaaaattaag

SEQ ID NO: 6417421 - DNA, 14 bp, Homo sapiens
tatccaattatgtg

SEQ ID NO: 6417422 - DNA, 22 bp, Homo sapiens
tatccaattcagggtccctgga

SEQ ID NO: 6417423 - DNA, 17 bp, Homo sapiens
tatccacaaatgctatt

SEQ ID NO: 6417424 - DNA, 21 bp, Homo sapiens
tatccacagaaacattttcat

SEQ ID NO: 6417425 - DNA, 21 bp, Homo sapiens
tatccacagaacctttgtcaa

SEQ ID NO: 6417426 - DNA, 22 bp, Homo sapiens
tatccacagagagtcccactgc

SEQ ID NO: 6417427 - DNA, 23 bp, Homo sapiens
tatccacagagagtcccactgcc

SEQ ID NO: 6417428 - DNA, 22 bp, Homo sapiens
tatccacataaatgctccttgt

SEQ ID NO: 6417429 - DNA, 23 bp, Homo sapiens
tatccacattgtagcctaatatt

SEQ ID NO: 6417430 - DNA, 15 bp, Homo sapiens
tatccaccacctccc

SEQ ID NO: 6417431 - DNA, 15 bp, Homo sapiens
tatccaccactttaa

SEQ ID NO: 6417432 - DNA, 19 bp, Homo sapiens
tatccacccagcccattct

SEQ ID NO: 6417433 - DNA, 14 bp, Homo sapiens
tatccacctcccta

SEQ ID NO: 6417434 - DNA, 18 bp, Homo sapiens
tatccacgagagcgcagc

SEQ ID NO: 6417435 - DNA, 23 bp, Homo sapiens
tatccactggacactgtgaaata

SEQ ID NO: 6417436 - DNA, 20 bp, Homo sapiens
tatccactgtctatgtacaa

SEQ ID NO: 6417437 - DNA, 20 bp, Homo sapiens
tatccagaaataaaacaact

SEQ ID NO: 6417438 - DNA, 21 bp, Homo sapiens
tatccagaatggaattttgct

SEQ ID NO: 6417439 - DNA, 12 bp, Homo sapiens
tatccagagctg

SEQ ID NO: 6417440 - DNA, 12 bp, Homo sapiens
tatccagaggaa

SEQ ID NO: 6417441 - DNA, 18 bp, Homo sapiens
tatccagaggacccaact

SEQ ID NO: 6417442 - DNA, 19 bp, Homo sapiens
tatccagctagtgccaaat

SEQ ID NO: 6417443 - DNA, 22 bp, Homo sapiens
tatccagctctttattacatag

SEQ ID NO: 6417444 - DNA, 17 bp, Homo sapiens
tatccaggcaccaggac

SEQ ID NO: 6417445 - DNA, 18 bp, Homo sapiens
tatccaggcaccaggact

SEQ ID NO: 6417446 - DNA, 18 bp, Homo sapiens
tatccaggtaatccaaga

SEQ ID NO: 6417447 - DNA, 17 bp, Homo sapiens
tatccaggtcaacagaa

SEQ ID NO: 6417448 - DNA, 21 bp, Homo sapiens
tatccaggtcaacagaatgaa

SEQ ID NO: 6417449 - DNA, 22 bp, Homo sapiens
tatccaggtcaacagaatgaaa

SEQ ID NO: 6417450 - DNA, 20 bp, Homo sapiens
tatccaggtgtgcccctcca

SEQ ID NO: 6417451 - DNA, 15 bp, Homo sapiens
tatccagtcaaagac

SEQ ID NO: 6417452 - DNA, 11 bp, Homo sapiens
tatccagtcta

SEQ ID NO: 6417453 - DNA, 20 bp, Homo sapiens
tatccagtgatgtgctggag

SEQ ID NO: 6417454 - DNA, 15 bp, Homo sapiens
tatccagttcctgct

SEQ ID NO: 6417455 - DNA, 20 bp, Homo sapiens
tatccagttcctgctctctg

SEQ ID NO: 6417456 - DNA, 21 bp, Homo sapiens
tatccagttcctgctctctgc

SEQ ID NO: 6417457 - DNA, 22 bp, Homo sapiens
tatccagttcctgctctctgct

SEQ ID NO: 6417458 - DNA, 17 bp, Homo sapiens
tatccataaaaaaaaat

SEQ ID NO: 6417459 - DNA, 13 bp, Homo sapiens
tatccataaaatt

SEQ ID NO: 6417460 - DNA, 16 bp, Homo sapiens
tatccataaaattgga

SEQ ID NO: 6417461 - DNA, 11 bp, Homo sapiens
tatccataatg

SEQ ID NO: 6417462 - DNA, 22 bp, Homo sapiens
tatccataatgatggatttaac

SEQ ID NO: 6417463 - DNA, 23 bp, Homo sapiens
tatccataatgatggatttaaca

SEQ ID NO: 6417464 - DNA, 17 bp, Homo sapiens
tatccatacagtcaaga

SEQ ID NO: 6417465 - DNA, 20 bp, Homo sapiens
tatccatattacgttgtttc

SEQ ID NO: 6417466 - DNA, 17 bp, Homo sapiens
tatccatattgagtcaa

SEQ ID NO: 6417467 - DNA, 23 bp, Homo sapiens
tatccatcagagatgactctgtc

SEQ ID NO: 6417468 - DNA, 22 bp, Homo sapiens
tatccatgacaggcctgaagat

SEQ ID NO: 6417469 - DNA, 16 bp, Homo sapiens
tatccatgcaccaaac

SEQ ID NO: 6417470 - DNA, 20 bp, Homo sapiens
tatccatgcatgtgcatata

SEQ ID NO: 6417471 - DNA, 19 bp, Homo sapiens
tatccatgggggcagggca

SEQ ID NO: 6417472 - DNA, 20 bp, Homo sapiens
tatccatgggggcagggcat

SEQ ID NO: 6417473 - DNA, 18 bp, Homo sapiens
tatccatgtactgtagtt

SEQ ID NO: 6417474 - DNA, 18 bp, Homo sapiens
tatccattacgtgcattt

SEQ ID NO: 6417475 - DNA, 19 bp, Homo sapiens
tatccattatcatgtgtaa

SEQ ID NO: 6417476 - DNA, 21 bp, Homo sapiens
tatccatttaaactaaccttt

SEQ ID NO: 6417477 - DNA, 22 bp, Homo sapiens
tatccatttaaactaacctttt

SEQ ID NO: 6417478 - DNA, 14 bp, Homo sapiens
tatccatttcttca

SEQ ID NO: 6417479 - DNA, 17 bp, Homo sapiens
tatccatttcttttact

SEQ ID NO: 6417480 - DNA, 15 bp, Homo sapiens
tatccattttacact

SEQ ID NO: 6417481 - DNA, 22 bp, Homo sapiens
tatcccaaagttgttgtaacct

SEQ ID NO: 6417482 - DNA, 18 bp, Homo sapiens
tatcccaagaatgcaaga

SEQ ID NO: 6417483 - DNA, 22 bp, Homo sapiens
tatcccaatcaaagaattacag

SEQ ID NO: 6417484 - DNA, 23 bp, Homo sapiens
tatcccacccaacagctcagaga

SEQ ID NO: 6417485 - DNA, 11 bp, Homo sapiens
tatcccacctc

SEQ ID NO: 6417486 - DNA, 13 bp, Homo sapiens
tatcccacctcca

SEQ ID NO: 6417487 - DNA, 16 bp, Homo sapiens
tatcccacctccagcc

SEQ ID NO: 6417488 - DNA, 23 bp, Homo sapiens
tatcccacctccagcccacagtg

SEQ ID NO: 6417489 - DNA, 21 bp, Homo sapiens
tatcccacggaaaatgccaat

SEQ ID NO: 6417490 - DNA, 19 bp, Homo sapiens
tatcccagcttgctgaggg

SEQ ID NO: 6417491 - DNA, 21 bp, Homo sapiens
tatcccagctttaaaaagaaa

SEQ ID NO: 6417492 - DNA, 16 bp, Homo sapiens
tatcccatcccatccc

SEQ ID NO: 6417493 - DNA, 13 bp, Homo sapiens
tatccccaagctg

SEQ ID NO: 6417494 - DNA, 18 bp, Homo sapiens
tatccccaatcagctcct

SEQ ID NO: 6417495 - DNA, 15 bp, Homo sapiens
tatccccagtgcccg

SEQ ID NO: 6417496 - DNA, 20 bp, Homo sapiens
tatccccatctccctgcctg

SEQ ID NO: 6417497 - DNA, 16 bp, Homo sapiens
tatccccatttctttt

SEQ ID NO: 6417498 - DNA, 14 bp, Homo sapiens
tatcccccccagcc

SEQ ID NO: 6417499 - DNA, 15 bp, Homo sapiens
tatcccccttaaaga

SEQ ID NO: 6417500 - DNA, 16 bp, Homo sapiens
tatcccctcccagtca

SEQ ID NO: 6417501 - DNA, 12 bp, Homo sapiens
tatcccctgcct

SEQ ID NO: 6417502 - DNA, 19 bp, Homo sapiens
tatcccctgcctcctgcca

SEQ ID NO: 6417503 - DNA, 14 bp, Homo sapiens
tatcccctgcgctt

SEQ ID NO: 6417504 - DNA, 20 bp, Homo sapiens
tcctagcccttccctgagtg

SEQ ID NO: 6417505 - DNA, 14 bp, Homo sapiens
tcctagcctgctct

SEQ ID NO: 6417506 - DNA, 16 bp, Homo sapiens
tcctagcctgctctgc

SEQ ID NO: 6417507 - DNA, 19 bp, Homo sapiens
tcctagcctgctctgccac

SEQ ID NO: 6417508 - DNA, 20 bp, Homo sapiens
tcctagcctgctctgccact

SEQ ID NO: 6417509 - DNA, 14 bp, Homo sapiens
tcctagcctgtttc

SEQ ID NO: 6417510 - DNA, 16 bp, Homo sapiens
tcctagcctgtttctt

SEQ ID NO: 6417511 - DNA, 18 bp, Homo sapiens
tcctagccttatcctctg

SEQ ID NO: 6417512 - DNA, 19 bp, Homo sapiens
tcctagccttatcctctga

SEQ ID NO: 6417513 - DNA, 21 bp, Homo sapiens
tcctagccttatcctctgatc

SEQ ID NO: 6417514 - DNA, 15 bp, Homo sapiens
tcctagcgcagccat

SEQ ID NO: 6417515 - DNA, 21 bp, Homo sapiens
tcctagctacttggcaggctg

SEQ ID NO: 6417516 - DNA, 20 bp, Homo sapiens
tcctagctaggagcaggctt

SEQ ID NO: 6417517 - DNA, 14 bp, Homo sapiens
tcctagctcctcct

SEQ ID NO: 6417518 - DNA, 20 bp, Homo sapiens
tcctagctcctcctcctggg

SEQ ID NO: 6417519 - DNA, 21 bp, Homo sapiens
tcctagctcctcctcctgggc

SEQ ID NO: 6417520 - DNA, 12 bp, Homo sapiens
tcctagctctgg

SEQ ID NO: 6417521 - DNA, 14 bp, Homo sapiens
tcctagctgcacag

SEQ ID NO: 6417522 - DNA, 17 bp, Homo sapiens
tcctagctgcacagggc

SEQ ID NO: 6417523 - DNA, 22 bp, Homo sapiens
tcctagctggagaggagccctg

SEQ ID NO: 6417524 - DNA, 20 bp, Homo sapiens
tcctagctggagtgccatgg

SEQ ID NO: 6417525 - DNA, 22 bp, Homo sapiens
tcctagctggagtgccatggct

SEQ ID NO: 6417526 - DNA, 23 bp, Homo sapiens
tcctagctggagtgccatggctg

SEQ ID NO: 6417527 - DNA, 18 bp, Homo sapiens
tcctagctgtcctttttc

SEQ ID NO: 6417528 - DNA, 21 bp, Homo sapiens
tcctagcttatctccctgctt

SEQ ID NO: 6417529 - DNA, 23 bp, Homo sapiens
tcctagcttatctccctgcttca

SEQ ID NO: 6417530 - DNA, 13 bp, Homo sapiens
tcctaggaaccag

SEQ ID NO: 6417531 - DNA, 17 bp, Homo sapiens
tcctaggaaccagccaa

SEQ ID NO: 6417532 - DNA, 13 bp, Homo sapiens
tcctaggacttaa

SEQ ID NO: 6417533 - DNA, 18 bp, Homo sapiens
tcctaggacttaaaatta

SEQ ID NO: 6417534 - DNA, 14 bp, Homo sapiens
tcctaggagaagca

SEQ ID NO: 6417535 - DNA, 14 bp, Homo sapiens
tcctaggagagcca

SEQ ID NO: 6417536 - DNA, 18 bp, Homo sapiens
tcctaggaggaaaattcc

SEQ ID NO: 6417537 - DNA, 20 bp, Homo sapiens
tcctaggaggtaatgaccat

SEQ ID NO: 6417538 - DNA, 20 bp, Homo sapiens
tcctaggcattgcaggacct

SEQ ID NO: 6417539 - DNA, 22 bp, Homo sapiens
tcctaggccacgtccaggtccg

SEQ ID NO: 6417540 - DNA, 17 bp, Homo sapiens
tcctaggcccaggcctg

SEQ ID NO: 6417541 - DNA, 16 bp, Homo sapiens
tcctaggcccttgggg

SEQ ID NO: 6417542 - DNA, 22 bp, Homo sapiens
tcctaggcctcaactcctccca

SEQ ID NO: 6417543 - DNA, 23 bp, Homo sapiens
tcctaggcctcaactcctcccat

SEQ ID NO: 6417544 - DNA, 19 bp, Homo sapiens
tcctaggcgctcagaggcc

SEQ ID NO: 6417545 - DNA, 17 bp, Homo sapiens
tcctaggctccctgagg

SEQ ID NO: 6417546 - DNA, 17 bp, Homo sapiens
tcctaggctcctgggag

SEQ ID NO: 6417547 - DNA, 15 bp, Homo sapiens
tcctaggctggaagg

SEQ ID NO: 6417548 - DNA, 20 bp, Homo sapiens
tcctaggctggaaggaggaa

SEQ ID NO: 6417549 - DNA, 20 bp, Homo sapiens
tcctaggcttaaatgcaata

SEQ ID NO: 6417550 - DNA, 23 bp, Homo sapiens
tcctagggcattgtatctgtctt

SEQ ID NO: 6417551 - DNA, 17 bp, Homo sapiens
tcctagggcctgggttt

SEQ ID NO: 6417552 - DNA, 13 bp, Homo sapiens
tcctaggggaaga

SEQ ID NO: 6417553 - DNA, 22 bp, Homo sapiens
tcctaggggccgagggaaatgc

SEQ ID NO: 6417554 - DNA, 14 bp, Homo sapiens
tcctaggggtgcgc

SEQ ID NO: 6417555 - DNA, 18 bp, Homo sapiens
tcctaggtagggtttaat

SEQ ID NO: 6417556 - DNA, 21 bp, Homo sapiens
tcctaggtcatgcctcctccc

SEQ ID NO: 6417557 - DNA, 16 bp, Homo sapiens
tcctaggtccaagccc

SEQ ID NO: 6417558 - DNA, 15 bp, Homo sapiens
tcctaggtgacccca

SEQ ID NO: 6417559 - DNA, 13 bp, Homo sapiens
tcctaggtgctgg

SEQ ID NO: 6417560 - DNA, 15 bp, Homo sapiens
tcctaggtgctggat

SEQ ID NO: 6417561 - DNA, 20 bp, Homo sapiens
tcctaggttttgagatttag

SEQ ID NO: 6417562 - DNA, 14 bp, Homo sapiens
tcctagtaactctt

SEQ ID NO: 6417563 - DNA, 19 bp, Homo sapiens
tcctagtaagcatctactt

SEQ ID NO: 6417564 - DNA, 21 bp, Homo sapiens
tcctagtaagtcaggacagct

SEQ ID NO: 6417565 - DNA, 22 bp, Homo sapiens
tcctagtcgggcagggcccctg

SEQ ID NO: 6417566 - DNA, 23 bp, Homo sapiens
tcctagtctctatcattaaagtt

SEQ ID NO: 6417567 - DNA, 14 bp, Homo sapiens
tcctagtcttcaca

SEQ ID NO: 6417568 - DNA, 23 bp, Homo sapiens
tcctagtgaaagaggcagcttga

SEQ ID NO: 6417569 - DNA, 13 bp, Homo sapiens
tcctagtgaacct

SEQ ID NO: 6417570 - DNA, 22 bp, Homo sapiens
tcctagtgactggggatgggac

SEQ ID NO: 6417571 - DNA, 21 bp, Homo sapiens
tcctagtggagttttataaat

SEQ ID NO: 6417572 - DNA, 17 bp, Homo sapiens
tcctagtgtctattccc

SEQ ID NO: 6417573 - DNA, 17 bp, Homo sapiens
tcctagtgtctttaaat

SEQ ID NO: 6417574 - DNA, 12 bp, Homo sapiens
tcctagttccac

SEQ ID NO: 6417575 - DNA, 17 bp, Homo sapiens
tcctagttccaccatca

SEQ ID NO: 6417576 - DNA, 19 bp, Homo sapiens
tcctagttccattcttggt

SEQ ID NO: 6417577 - DNA, 16 bp, Homo sapiens
tcctagttctagaaaa

SEQ ID NO: 6417578 - DNA, 18 bp, Homo sapiens
tcctagttctgtagaaat

SEQ ID NO: 6417579 - DNA, 19 bp, Homo sapiens
tcctagttctgtagaaatg

SEQ ID NO: 6417580 - DNA, 23 bp, Homo sapiens
tcctagttctgtagaaatggttg

SEQ ID NO: 6417581 - DNA, 22 bp, Homo sapiens
tcctagttcttaagcatttgcg

SEQ ID NO: 6417582 - DNA, 16 bp, Homo sapiens
tcctagttcttcatcc

SEQ ID NO: 6417583 - DNA, 14 bp, Homo sapiens
tcctagttggtgag

SEQ ID NO: 6417584 - DNA, 20 bp, Homo sapiens
tcctagttttctcctcccag

SEQ ID NO: 6417585 - DNA, 14 bp, Homo sapiens
tcctataaagtgcc

SEQ ID NO: 6417586 - DNA, 19 bp, Homo sapiens
tcctataaagtgcctcgga

SEQ ID NO: 6417587 - DNA, 19 bp, Homo sapiens
tcctataacttcttcctgc

SEQ ID NO: 6417588 - DNA, 22 bp, Homo sapiens
tcctataacttcttcctgctgg

SEQ ID NO: 6417589 - DNA, 20 bp, Homo sapiens
tcctataacttgatgcatgt

SEQ ID NO: 6417590 - DNA, 14 bp, Homo sapiens
tcctataaggagag

SEQ ID NO: 6417591 - DNA, 15 bp, Homo sapiens
tcctataatctgtca

SEQ ID NO: 6417592 - DNA, 16 bp, Homo sapiens
tcctataatctgtcaa

SEQ ID NO: 6417593 - DNA, 17 bp, Homo sapiens
tcctataatctgtcaaa

SEQ ID NO: 6417594 - DNA, 23 bp, Homo sapiens
tcctataccatatgtctgcttct

SEQ ID NO: 6417595 - DNA, 17 bp, Homo sapiens
tcctatacccagcagag

SEQ ID NO: 6417596 - DNA, 18 bp, Homo sapiens
tcctatacccagcagagg

SEQ ID NO: 6417597 - DNA, 18 bp, Homo sapiens
tcctatacgcagcgtgct

SEQ ID NO: 6417598 - DNA, 19 bp, Homo sapiens
tcctatacgcagcgtgctt

SEQ ID NO: 6417599 - DNA, 16 bp, Homo sapiens
tcctatatatttctat

SEQ ID NO: 6417600 - DNA, 20 bp, Homo sapiens
tcctatatatttctattatt

SEQ ID NO: 6417601 - DNA, 18 bp, Homo sapiens
tcctatatcattatttag

SEQ ID NO: 6417602 - DNA, 12 bp, Homo sapiens
tcctatatctgt

SEQ ID NO: 6417603 - DNA, 16 bp, Homo sapiens
tcctatatctgtttgt

SEQ ID NO: 6417604 - DNA, 19 bp, Homo sapiens
tcctatatctgtttgtata

SEQ ID NO: 6417605 - DNA, 23 bp, Homo sapiens
tcctatattgttttcagtgtaca

SEQ ID NO: 6417606 - DNA, 16 bp, Homo sapiens
tcctatcacctcccct

SEQ ID NO: 6417607 - DNA, 17 bp, Homo sapiens
tcctatcacctcccctc

SEQ ID NO: 6417608 - DNA, 19 bp, Homo sapiens
tcctatcacctcccctcct

SEQ ID NO: 6417609 - DNA, 12 bp, Homo sapiens
tcctatcccatc

SEQ ID NO: 6417610 - DNA, 14 bp, Homo sapiens
tcctatcccatccc

SEQ ID NO: 6417611 - DNA, 15 bp, Homo sapiens
tcctatcccatccca

SEQ ID NO: 6417612 - DNA, 22 bp, Homo sapiens
tcctatccttataggcctgtcc

SEQ ID NO: 6417613 - DNA, 22 bp, Homo sapiens
tcctatccttggagagcagctg

SEQ ID NO: 6417614 - DNA, 15 bp, Homo sapiens
tcctatctagcattt

SEQ ID NO: 6417615 - DNA, 19 bp, Homo sapiens
tcctatctcaactctgttt

SEQ ID NO: 6417616 - DNA, 17 bp, Homo sapiens
tcctatctccagcggcc

SEQ ID NO: 6417617 - DNA, 19 bp, Homo sapiens
tcctatctccagcggccct

SEQ ID NO: 6417618 - DNA, 13 bp, Homo sapiens
tcctatctccccc

SEQ ID NO: 6417619 - DNA, 21 bp, Homo sapiens
tcctatctcccccaacccacc

SEQ ID NO: 6417620 - DNA, 13 bp, Homo sapiens
tcctatctccctg

SEQ ID NO: 6417621 - DNA, 15 bp, Homo sapiens
tcctatctccctggc

SEQ ID NO: 6417622 - DNA, 18 bp, Homo sapiens
tcctatctccctggctca

SEQ ID NO: 6417623 - DNA, 20 bp, Homo sapiens
tcctatctccctggctcact

SEQ ID NO: 6417624 - DNA, 19 bp, Homo sapiens
tcctatctgggcttcctgg

SEQ ID NO: 6417625 - DNA, 15 bp, Homo sapiens
tcctatctggggagc

SEQ ID NO: 6417626 - DNA, 20 bp, Homo sapiens
tcctatctggggagctcctg

SEQ ID NO: 6417627 - DNA, 13 bp, Homo sapiens
tcctatctgtgtt

SEQ ID NO: 6417628 - DNA, 14 bp, Homo sapiens
tcctatctgtgttt

SEQ ID NO: 6417629 - DNA, 18 bp, Homo sapiens
tcctatctttcctcccta

SEQ ID NO: 6417630 - DNA, 20 bp, Homo sapiens
tcctatctttcctccctatc

SEQ ID NO: 6417631 - DNA, 18 bp, Homo sapiens
tcctatcttttatttcat

SEQ ID NO: 6417632 - DNA, 15 bp, Homo sapiens
tcctatgaatgcttt

SEQ ID NO: 6417633 - DNA, 16 bp, Homo sapiens
tcctatgagagaagag

SEQ ID NO: 6417634 - DNA, 21 bp, Homo sapiens
tcctatgagagaagagagtat

SEQ ID NO: 6417635 - DNA, 16 bp, Homo sapiens
tcctatgcaataaaat

SEQ ID NO: 6417636 - DNA, 16 bp, Homo sapiens
tcctatgccttcaaat

SEQ ID NO: 6417637 - DNA, 20 bp, Homo sapiens
tcctatgccttcaaatagta

SEQ ID NO: 6417638 - DNA, 17 bp, Homo sapiens
tcctatgcttaataaaa

SEQ ID NO: 6417639 - DNA, 23 bp, Homo sapiens
tcctatgcttaataaaagaacat

SEQ ID NO: 6417640 - DNA, 20 bp, Homo sapiens
tcctatgctttgaaacagaa

SEQ ID NO: 6417641 - DNA, 17 bp, Homo sapiens
tcctatggaaacatttt

SEQ ID NO: 6417642 - DNA, 13 bp, Homo sapiens
tcctatggaaacc

SEQ ID NO: 6417643 - DNA, 12 bp, Homo sapiens
tcctatgtacag

SEQ ID NO: 6417644 - DNA, 18 bp, Homo sapiens
tcctatgtattctgggta

SEQ ID NO: 6417645 - DNA, 18 bp, Homo sapiens
tcctatgtcaatttgtat

SEQ ID NO: 6417646 - DNA, 24 bp, Homo sapiens
tcctatgtcaatttgtatatcatg

SEQ ID NO: 6417647 - DNA, 19 bp, Homo sapiens
tcctatgtttttgttcaaa

SEQ ID NO: 6417648 - DNA, 16 bp, Homo sapiens
tcctattaaaacacag

SEQ ID NO: 6417649 - DNA, 20 bp, Homo sapiens
tcctattaaaacacagcttt

SEQ ID NO: 6417650 - DNA, 19 bp, Homo sapiens
tcctattagtgacttttca

SEQ ID NO: 6417651 - DNA, 17 bp, Homo sapiens
tcctattagtgttatat

SEQ ID NO: 6417652 - DNA, 15 bp, Homo sapiens
tcctattatgtgttc

SEQ ID NO: 6417653 - DNA, 22 bp, Homo sapiens
tcctattcagttcccagaatca

SEQ ID NO: 6417654 - DNA, 15 bp, Homo sapiens
tcctattctataaaa

SEQ ID NO: 6417655 - DNA, 14 bp, Homo sapiens
tcctattctcacca

SEQ ID NO: 6417656 - DNA, 15 bp, Homo sapiens
tcctattctcaccag

SEQ ID NO: 6417657 - DNA, 16 bp, Homo sapiens
tcctattctcaccagg

SEQ ID NO: 6417658 - DNA, 18 bp, Homo sapiens
tcctattctcaccaggaa

SEQ ID NO: 6417659 - DNA, 20 bp, Homo sapiens
tcctattctcaccaggaagg

SEQ ID NO: 6417660 - DNA, 12 bp, Homo sapiens
tcctattctcct

SEQ ID NO: 6417661 - DNA, 13 bp, Homo sapiens
tcctattctcctg

SEQ ID NO: 6417662 - DNA, 17 bp, Homo sapiens
tcctattctcctgccat

SEQ ID NO: 6417663 - DNA, 20 bp, Homo sapiens
tcctattctgatgaatctca

SEQ ID NO: 6417664 - DNA, 21 bp, Homo sapiens
tcctattctttcgaaagaaga

SEQ ID NO: 6417665 - DNA, 18 bp, Homo sapiens
tcctattgtgatttgact

SEQ ID NO: 6417666 - DNA, 21 bp, Homo sapiens
tcctattgtgcaatgtaaata

SEQ ID NO: 6417667 - DNA, 14 bp, Homo sapiens
tcctatttaaagac

SEQ ID NO: 6417668 - DNA, 11 bp, Homo sapiens
tcctatttaag

SEQ ID NO: 6417669 - DNA, 14 bp, Homo sapiens
tcctatttcaatga

SEQ ID NO: 6417670 - DNA, 17 bp, Homo sapiens
tcctatttcaatgagtt

SEQ ID NO: 6417671 - DNA, 20 bp, Homo sapiens
tcctatttcaatgagttatt

SEQ ID NO: 6417672 - DNA, 20 bp, Homo sapiens
tcctatttcagaagtttaaa

SEQ ID NO: 6417673 - DNA, 16 bp, Homo sapiens
tcctatttcagtactt

SEQ ID NO: 6417674 - DNA, 18 bp, Homo sapiens
tcctatttctagggctgg

SEQ ID NO: 6417675 - DNA, 20 bp, Homo sapiens
tcctattttaaaaccatgca

SEQ ID NO: 6417676 - DNA, 23 bp, Homo sapiens
tcctattttcgatgaagttctga

SEQ ID NO: 6417677 - DNA, 21 bp, Homo sapiens
tcctattttctatccccctta

SEQ ID NO: 6417678 - DNA, 14 bp, Homo sapiens
tcctattttcttga

SEQ ID NO: 6417679 - DNA, 19 bp, Homo sapiens
tcctattttgcataataaa

SEQ ID NO: 6417680 - DNA, 24 bp, Homo sapiens
tcctatttttgtagatctccatgc

SEQ ID NO: 6417681 - DNA, 19 bp, Homo sapiens
tatcccgagtctgggacac

SEQ ID NO: 6417682 - DNA, 16 bp, Homo sapiens
tatcccggctgccctt

SEQ ID NO: 6417683 - DNA, 20 bp, Homo sapiens
tatccctactgtaatttgtg

SEQ ID NO: 6417684 - DNA, 15 bp, Homo sapiens
tatccctcacctgta

SEQ ID NO: 6417685 - DNA, 23 bp, Homo sapiens
tatccctcccgtgtgtggttgga

SEQ ID NO: 6417686 - DNA, 19 bp, Homo sapiens
tatccctcctgttgggaga

SEQ ID NO: 6417687 - DNA, 12 bp, Homo sapiens
tatccctctcca

SEQ ID NO: 6417688 - DNA, 24 bp, Homo sapiens
tatccctgatttattctggtgtct

SEQ ID NO: 6417689 - DNA, 11 bp, Homo sapiens
tatccctgccc

SEQ ID NO: 6417690 - DNA, 16 bp, Homo sapiens
tatccctgcccagcct

SEQ ID NO: 6417691 - DNA, 12 bp, Homo sapiens
tatccctggcca

SEQ ID NO: 6417692 - DNA, 13 bp, Homo sapiens
tatccctggccac

SEQ ID NO: 6417693 - DNA, 19 bp, Homo sapiens
tatccctggccacctgcca

SEQ ID NO: 6417694 - DNA, 11 bp, Homo sapiens
tatcccttccg

SEQ ID NO: 6417695 - DNA, 15 bp, Homo sapiens
tatcccttctcagaa

SEQ ID NO: 6417696 - DNA, 22 bp, Homo sapiens
tatcccttcttataccctaaga

SEQ ID NO: 6417697 - DNA, 22 bp, Homo sapiens
tatccctttctctcttgtccaa

SEQ ID NO: 6417698 - DNA, 16 bp, Homo sapiens
tatcccttttcttgac

SEQ ID NO: 6417699 - DNA, 14 bp, Homo sapiens
tatccgaaagtttc

SEQ ID NO: 6417700 - DNA, 15 bp, Homo sapiens
tatccgactctaagc

SEQ ID NO: 6417701 - DNA, 19 bp, Homo sapiens
tatccgactctaagctgtg

SEQ ID NO: 6417702 - DNA, 20 bp, Homo sapiens
tatccgactctaagctgtgt

SEQ ID NO: 6417703 - DNA, 23 bp, Homo sapiens
tatccgactctaagctgtgtgca

SEQ ID NO: 6417704 - DNA, 16 bp, Homo sapiens
tatccggactcctgcc

SEQ ID NO: 6417705 - DNA, 14 bp, Homo sapiens
tatccgggtgctca

SEQ ID NO: 6417706 - DNA, 22 bp, Homo sapiens
tatccgggtgctcaataaactt

SEQ ID NO: 6417707 - DNA, 13 bp, Homo sapiens
tatcctaaaaatc

SEQ ID NO: 6417708 - DNA, 13 bp, Homo sapiens
tatcctaaacttt

SEQ ID NO: 6417709 - DNA, 14 bp, Homo sapiens
tatcctaaacttta

SEQ ID NO: 6417710 - DNA, 22 bp, Homo sapiens
tatcctaataaaaaggtgacca

SEQ ID NO: 6417711 - DNA, 16 bp, Homo sapiens
tatcctaattgtccac

SEQ ID NO: 6417712 - DNA, 18 bp, Homo sapiens
tatcctacatacttcttt

SEQ ID NO: 6417713 - DNA, 14 bp, Homo sapiens
tatcctacttcccc

SEQ ID NO: 6417714 - DNA, 17 bp, Homo sapiens
tatcctacttccccttc

SEQ ID NO: 6417715 - DNA, 16 bp, Homo sapiens
tatcctagaaaattgt

SEQ ID NO: 6417716 - DNA, 17 bp, Homo sapiens
tatcctagcacatgctt

SEQ ID NO: 6417717 - DNA, 19 bp, Homo sapiens
tatcctagcacatgcttca

SEQ ID NO: 6417718 - DNA, 22 bp, Homo sapiens
tatcctagcacatgcttcaata

SEQ ID NO: 6417719 - DNA, 21 bp, Homo sapiens
tatcctagtcttcacaacttt

SEQ ID NO: 6417720 - DNA, 14 bp, Homo sapiens
tatcctagttccat

SEQ ID NO: 6417721 - DNA, 17 bp, Homo sapiens
tatcctagttccattct

SEQ ID NO: 6417722 - DNA, 16 bp, Homo sapiens
tatcctatctctccaa

SEQ ID NO: 6417723 - DNA, 19 bp, Homo sapiens
tatcctatgccttcaaata

SEQ ID NO: 6417724 - DNA, 16 bp, Homo sapiens
tatcctcaagttgtgt

SEQ ID NO: 6417725 - DNA, 13 bp, Homo sapiens
tatcctcacataa

SEQ ID NO: 6417726 - DNA, 13 bp, Homo sapiens
tatcctccaggtt

SEQ ID NO: 6417727 - DNA, 14 bp, Homo sapiens
tatcctccaggttt

SEQ ID NO: 6417728 - DNA, 17 bp, Homo sapiens
tatcctccaggtttttc

SEQ ID NO: 6417729 - DNA, 13 bp, Homo sapiens
tatcctccctgcc

SEQ ID NO: 6417730 - DNA, 20 bp, Homo sapiens
tatcctccctggcagacaca

SEQ ID NO: 6417731 - DNA, 17 bp, Homo sapiens
tatcctccctgtaactt

SEQ ID NO: 6417732 - DNA, 19 bp, Homo sapiens
tatcctcctgcaagagtgg

SEQ ID NO: 6417733 - DNA, 18 bp, Homo sapiens
tatcctcctgttctgaaa

SEQ ID NO: 6417734 - DNA, 16 bp, Homo sapiens
tatcctcgctcccggg

SEQ ID NO: 6417735 - DNA, 20 bp, Homo sapiens
tatcctctccccctcctcca

SEQ ID NO: 6417736 - DNA, 17 bp, Homo sapiens
tatcctctctctcttct

SEQ ID NO: 6417737 - DNA, 14 bp, Homo sapiens
tatcctctgttgat

SEQ ID NO: 6417738 - DNA, 17 bp, Homo sapiens
tatcctctttagagtta

SEQ ID NO: 6417739 - DNA, 12 bp, Homo sapiens
tatcctgaataa

SEQ ID NO: 6417740 - DNA, 16 bp, Homo sapiens
tatcctgattccaaat

SEQ ID NO: 6417741 - DNA, 13 bp, Homo sapiens
tatcctgcaaggg

SEQ ID NO: 6417742 - DNA, 22 bp, Homo sapiens
tatcctgcaagggacaggaagg

SEQ ID NO: 6417743 - DNA, 13 bp, Homo sapiens
tatcctgcaccct

SEQ ID NO: 6417744 - DNA, 10 bp, Homo sapiens
tatcctgccc

SEQ ID NO: 6417745 - DNA, 12 bp, Homo sapiens
tatcctgcctca

SEQ ID NO: 6417746 - DNA, 20 bp, Homo sapiens
tatcctgcctcagcccgcca

SEQ ID NO: 6417747 - DNA, 20 bp, Homo sapiens
tatcctgctagcaggccccc

SEQ ID NO: 6417748 - DNA, 20 bp, Homo sapiens
tatcctgctagctgtagaaa

SEQ ID NO: 6417749 - DNA, 21 bp, Homo sapiens
tatcctggaacaatattttat

SEQ ID NO: 6417750 - DNA, 18 bp, Homo sapiens
tatcctggcaaataatac

SEQ ID NO: 6417751 - DNA, 15 bp, Homo sapiens
tatcctggccctggg

SEQ ID NO: 6417752 - DNA, 16 bp, Homo sapiens
tatcctggccctgggg

SEQ ID NO: 6417753 - DNA, 19 bp, Homo sapiens
tatcctggccttgtacttg

SEQ ID NO: 6417754 - DNA, 22 bp, Homo sapiens
tatcctggccttgtacttgctt

SEQ ID NO: 6417755 - DNA, 21 bp, Homo sapiens
tatcctggctttgcccaacct

SEQ ID NO: 6417756 - DNA, 11 bp, Homo sapiens
tatcctgggac

SEQ ID NO: 6417757 - DNA, 12 bp, Homo sapiens
tatcctgggacc

SEQ ID NO: 6417758 - DNA, 23 bp, Homo sapiens
tatcctgggacctccccagccca

SEQ ID NO: 6417759 - DNA, 10 bp, Homo sapiens
tatcctgggg

SEQ ID NO: 6417760 - DNA, 22 bp, Homo sapiens
tatcctgggggacccaatgtag

SEQ ID NO: 6417761 - DNA, 12 bp, Homo sapiens
tatcctgtattc

SEQ ID NO: 6417762 - DNA, 19 bp, Homo sapiens
tatcctgtgacatgtaaca

SEQ ID NO: 6417763 - DNA, 16 bp, Homo sapiens
tatcctgtgactgtct

SEQ ID NO: 6417764 - DNA, 17 bp, Homo sapiens
tatcctgtgactgtctc

SEQ ID NO: 6417765 - DNA, 23 bp, Homo sapiens
tatcctgtgactgtctcacttaa

SEQ ID NO: 6417766 - DNA, 11 bp, Homo sapiens
tatcctgtgca

SEQ ID NO: 6417767 - DNA, 15 bp, Homo sapiens
tatcctgtgctacag

SEQ ID NO: 6417768 - DNA, 12 bp, Homo sapiens
tatcctgtgtac

SEQ ID NO: 6417769 - DNA, 16 bp, Homo sapiens
tatcctgtgtgtgtct

SEQ ID NO: 6417770 - DNA, 13 bp, Homo sapiens
tatcctgttaaca

SEQ ID NO: 6417771 - DNA, 23 bp, Homo sapiens
tatcctgttaggggaaaatagta

SEQ ID NO: 6417772 - DNA, 14 bp, Homo sapiens
tatcctgttcttcc

SEQ ID NO: 6417773 - DNA, 18 bp, Homo sapiens
tatcctgtttgtattttt

SEQ ID NO: 6417774 - DNA, 23 bp, Homo sapiens
tatcctgtttgtatttttttcca

SEQ ID NO: 6417775 - DNA, 22 bp, Homo sapiens
tatccttaaggcatatactttg

SEQ ID NO: 6417776 - DNA, 16 bp, Homo sapiens
tatccttacaatgtga

SEQ ID NO: 6417777 - DNA, 15 bp, Homo sapiens
tatccttacatttca

SEQ ID NO: 6417778 - DNA, 22 bp, Homo sapiens
tatccttataggcctgtccctt

SEQ ID NO: 6417779 - DNA, 22 bp, Homo sapiens
tatccttatgccacccccgctg

SEQ ID NO: 6417780 - DNA, 23 bp, Homo sapiens
tatccttcacaatttcaatgctt

SEQ ID NO: 6417781 - DNA, 16 bp, Homo sapiens
tatccttcatctttta

SEQ ID NO: 6417782 - DNA, 22 bp, Homo sapiens
tatccttcatcttttaaagaaa

SEQ ID NO: 6417783 - DNA, 16 bp, Homo sapiens
tatccttggagagcag

SEQ ID NO: 6417784 - DNA, 15 bp, Homo sapiens
tatcctttcatcaat

SEQ ID NO: 6417785 - DNA, 14 bp, Homo sapiens
tatcctttggaaca

SEQ ID NO: 6417786 - DNA, 17 bp, Homo sapiens
tatcctttggtcctggt

SEQ ID NO: 6417787 - DNA, 18 bp, Homo sapiens
tatcctttggtcctggtg

SEQ ID NO: 6417788 - DNA, 22 bp, Homo sapiens
tatcctttgtggcaccttttct

SEQ ID NO: 6417789 - DNA, 17 bp, Homo sapiens
tatccttttctgtgttt

SEQ ID NO: 6417790 - DNA, 18 bp, Homo sapiens
tatccttttcttctatgt

SEQ ID NO: 6417791 - DNA, 21 bp, Homo sapiens
tatccttttttcctttcctga

SEQ ID NO: 6417792 - DNA, 15 bp, Homo sapiens
tatcgaaataacaat

SEQ ID NO: 6417793 - DNA, 22 bp, Homo sapiens
tatcgaatatagttctgtgtag

SEQ ID NO: 6417794 - DNA, 12 bp, Homo sapiens
tatcgactttat

SEQ ID NO: 6417795 - DNA, 16 bp, Homo sapiens
tatcgatctcttattt

SEQ ID NO: 6417796 - DNA, 22 bp, Homo sapiens
tatcgatgttttattatttcta

SEQ ID NO: 6417797 - DNA, 15 bp, Homo sapiens
tatcgcaaatcacaa

SEQ ID NO: 6417798 - DNA, 14 bp, Homo sapiens
tatcgctcctattg

SEQ ID NO: 6417799 - DNA, 20 bp, Homo sapiens
tatcgctgacttcatggaat

SEQ ID NO: 6417800 - DNA, 14 bp, Homo sapiens
tatcgctgatgcag

SEQ ID NO: 6417801 - DNA, 15 bp, Homo sapiens
tatcggaagaacatg

SEQ ID NO: 6417802 - DNA, 16 bp, Homo sapiens
tatcggaagaacatga

SEQ ID NO: 6417803 - DNA, 13 bp, Homo sapiens
tatcggcactgta

SEQ ID NO: 6417804 - DNA, 15 bp, Homo sapiens
tatcgggagcagtgt

SEQ ID NO: 6417805 - DNA, 17 bp, Homo sapiens
tatcggggaagccagac

SEQ ID NO: 6417806 - DNA, 16 bp, Homo sapiens
tatcggtataaaggca

SEQ ID NO: 6417807 - DNA, 21 bp, Homo sapiens
tatcgtaaccagccagatcct

SEQ ID NO: 6417808 - DNA, 14 bp, Homo sapiens
tatcgttactggca

SEQ ID NO: 6417809 - DNA, 18 bp, Homo sapiens
tatcgttattataaatgt

SEQ ID NO: 6417810 - DNA, 20 bp, Homo sapiens
tatcgtttttgtattttcat

SEQ ID NO: 6417811 - DNA, 13 bp, Homo sapiens
tatctaaaagtgt

SEQ ID NO: 6417812 - DNA, 23 bp, Homo sapiens
tatctaaactagattagatccaa

SEQ ID NO: 6417813 - DNA, 17 bp, Homo sapiens
tatctaaaggatggaaa

SEQ ID NO: 6417814 - DNA, 21 bp, Homo sapiens
tatctaaatagtattttgtct

SEQ ID NO: 6417815 - DNA, 21 bp, Homo sapiens
tatctaaatgaatgagccaaa

SEQ ID NO: 6417816 - DNA, 12 bp, Homo sapiens
tatctaaatgat

SEQ ID NO: 6417817 - DNA, 14 bp, Homo sapiens
tatctaaattgaat

SEQ ID NO: 6417818 - DNA, 13 bp, Homo sapiens
tatctaactcttc

SEQ ID NO: 6417819 - DNA, 13 bp, Homo sapiens
tatctaagaatac

SEQ ID NO: 6417820 - DNA, 18 bp, Homo sapiens
tatctaagaatacagctt

SEQ ID NO: 6417821 - DNA, 23 bp, Homo sapiens
tatctaagaatacagctttctga

SEQ ID NO: 6417822 - DNA, 22 bp, Homo sapiens
tatctaagttaatttaaagttg

SEQ ID NO: 6417823 - DNA, 15 bp, Homo sapiens
tatctaatacctctg

SEQ ID NO: 6417824 - DNA, 13 bp, Homo sapiens
tatctaatcatga

SEQ ID NO: 6417825 - DNA, 13 bp, Homo sapiens
tatctaatccttt

SEQ ID NO: 6417826 - DNA, 22 bp, Homo sapiens
tatctaatcctttaatgatctg

SEQ ID NO: 6417827 - DNA, 13 bp, Homo sapiens
tatctaatgagtt

SEQ ID NO: 6417828 - DNA, 15 bp, Homo sapiens
tatctaattatttcc

SEQ ID NO: 6417829 - DNA, 15 bp, Homo sapiens
tatctaattctttaa

SEQ ID NO: 6417830 - DNA, 16 bp, Homo sapiens
tatctaattctttaat

SEQ ID NO: 6417831 - DNA, 16 bp, Homo sapiens
tatctaatttatacaa

SEQ ID NO: 6417832 - DNA, 17 bp, Homo sapiens
tatctaatttcattcaa

SEQ ID NO: 6417833 - DNA, 13 bp, Homo sapiens
tatctacaaaaat

SEQ ID NO: 6417834 - DNA, 13 bp, Homo sapiens
tatctacaaagaa

SEQ ID NO: 6417835 - DNA, 16 bp, Homo sapiens
tatctacaatatatat

SEQ ID NO: 6417836 - DNA, 14 bp, Homo sapiens
tatctacattaaaa

SEQ ID NO: 6417837 - DNA, 16 bp, Homo sapiens
tatctacattaaaatg

SEQ ID NO: 6417838 - DNA, 17 bp, Homo sapiens
tatctacattaaaatga

SEQ ID NO: 6417839 - DNA, 22 bp, Homo sapiens
tatctacattaaaatgacaaac

SEQ ID NO: 6417840 - DNA, 15 bp, Homo sapiens
tatctaccaactttc

SEQ ID NO: 6417841 - DNA, 19 bp, Homo sapiens
tatctaccaactttcaaga

SEQ ID NO: 6417842 - DNA, 20 bp, Homo sapiens
tatctaccaactttcaagaa

SEQ ID NO: 6417843 - DNA, 15 bp, Homo sapiens
tatctacctcaaggt

SEQ ID NO: 6417844 - DNA, 20 bp, Homo sapiens
tatctacctcaaggtaacaa

SEQ ID NO: 6417845 - DNA, 16 bp, Homo sapiens
tatctacctgccctct

SEQ ID NO: 6417846 - DNA, 19 bp, Homo sapiens
tatctacctgccctctctc

SEQ ID NO: 6417847 - DNA, 16 bp, Homo sapiens
tatctacctggaaaca

SEQ ID NO: 6417848 - DNA, 20 bp, Homo sapiens
tatctacctgttctgtagct

SEQ ID NO: 6417849 - DNA, 21 bp, Homo sapiens
tatctacctgttctgtagctt

SEQ ID NO: 6417850 - DNA, 22 bp, Homo sapiens
tatctacctgttctgtagcttt

SEQ ID NO: 6417851 - DNA, 13 bp, Homo sapiens
tatctaccttcct

SEQ ID NO: 6417852 - DNA, 19 bp, Homo sapiens
tatctactaagtttccttt

SEQ ID NO: 6417853 - DNA, 13 bp, Homo sapiens
tatctactctcct

SEQ ID NO: 6417854 - DNA, 20 bp, Homo sapiens
tatctactctcctcatctct

SEQ ID NO: 6417855 - DNA, 17 bp, Homo sapiens
tatctactgactatatt

SEQ ID NO: 6417856 - DNA, 16 bp, Homo sapiens
tatctactgactgaaa

SEQ ID NO: 6417857 - DNA, 18 bp, Homo sapiens
tatctactgactgaaatc

SEQ ID NO: 6417858 - DNA, 22 bp, Homo sapiens
tatctacttccaaactaatttt

SEQ ID NO: 6417859 - DNA, 12 bp, Homo sapiens
tatctagaaaga

SEQ ID NO: 6417860 - DNA, 15 bp, Homo sapiens
tatctagaaagaaaa

SEQ ID NO: 6417861 - DNA, 21 bp, Homo sapiens
tatctagcaagaagattctaa

SEQ ID NO: 6417862 - DNA, 14 bp, Homo sapiens
tcctatttttgtga

SEQ ID NO: 6417863 - DNA, 14 bp, Homo sapiens
tcctatttttttaa

SEQ ID NO: 6417864 - DNA, 22 bp, Homo sapiens
tcctatttttttaaaatcacta

SEQ ID NO: 6417865 - DNA, 17 bp, Homo sapiens
tcctcaaaaagcagaag

SEQ ID NO: 6417866 - DNA, 17 bp, Homo sapiens
tcctcaaaactggagtc

SEQ ID NO: 6417867 - DNA, 14 bp, Homo sapiens
tcctcaaacactgc

SEQ ID NO: 6417868 - DNA, 16 bp, Homo sapiens
tcctcaaacactgcag

SEQ ID NO: 6417869 - DNA, 13 bp, Homo sapiens
tcctcaaaccact

SEQ ID NO: 6417870 - DNA, 17 bp, Homo sapiens
tcctcaaaccacttgcc

SEQ ID NO: 6417871 - DNA, 19 bp, Homo sapiens
tcctcaaaccacttgcctg

SEQ ID NO: 6417872 - DNA, 16 bp, Homo sapiens
tcctcaaacccagtct

SEQ ID NO: 6417873 - DNA, 18 bp, Homo sapiens
tcctcaaacgacagagga

SEQ ID NO: 6417874 - DNA, 15 bp, Homo sapiens
tcctcaaagaaagtg

SEQ ID NO: 6417875 - DNA, 18 bp, Homo sapiens
tcctcaaagaaagtgtat

SEQ ID NO: 6417876 - DNA, 22 bp, Homo sapiens
tcctcaaagcacctgaaccact

SEQ ID NO: 6417877 - DNA, 15 bp, Homo sapiens
tcctcaaatacatgc

SEQ ID NO: 6417878 - DNA, 17 bp, Homo sapiens
tcctcaaatacatgcac

SEQ ID NO: 6417879 - DNA, 18 bp, Homo sapiens
tcctcaaatacatgcaca

SEQ ID NO: 6417880 - DNA, 17 bp, Homo sapiens
tcctcaacacccaactg

SEQ ID NO: 6417881 - DNA, 15 bp, Homo sapiens
tcctcaacagtgttt

SEQ ID NO: 6417882 - DNA, 19 bp, Homo sapiens
tcctcaacccctcccctcc

SEQ ID NO: 6417883 - DNA, 13 bp, Homo sapiens
tcctcaaccttga

SEQ ID NO: 6417884 - DNA, 21 bp, Homo sapiens
tcctcaagaagaaagtgttca

SEQ ID NO: 6417885 - DNA, 16 bp, Homo sapiens
tcctcaagactttgat

SEQ ID NO: 6417886 - DNA, 14 bp, Homo sapiens
tcctcaagcctgtg

SEQ ID NO: 6417887 - DNA, 16 bp, Homo sapiens
tcctcaagcctgtggg

SEQ ID NO: 6417888 - DNA, 17 bp, Homo sapiens
tcctcaagcctgtgggc

SEQ ID NO: 6417889 - DNA, 21 bp, Homo sapiens
tcctcaagcctgtgggcagca

SEQ ID NO: 6417890 - DNA, 22 bp, Homo sapiens
tcctcaaggcccagccataaaa

SEQ ID NO: 6417891 - DNA, 14 bp, Homo sapiens
tcctcaagggaagg

SEQ ID NO: 6417892 - DNA, 14 bp, Homo sapiens
tcctcaagggcaga

SEQ ID NO: 6417893 - DNA, 17 bp, Homo sapiens
tcctcaagggcagagaa

SEQ ID NO: 6417894 - DNA, 17 bp, Homo sapiens
tcctcaagttgtgtgct

SEQ ID NO: 6417895 - DNA, 12 bp, Homo sapiens
tcctcaatccag

SEQ ID NO: 6417896 - DNA, 13 bp, Homo sapiens
tcctcaatccagc

SEQ ID NO: 6417897 - DNA, 18 bp, Homo sapiens
tcctcaatggacttcaaa

SEQ ID NO: 6417898 - DNA, 19 bp, Homo sapiens
tcctcaatgggctttcccc

SEQ ID NO: 6417899 - DNA, 20 bp, Homo sapiens
tcctcacaagcctcttctga

SEQ ID NO: 6417900 - DNA, 15 bp, Homo sapiens
tcctcacacacagac

SEQ ID NO: 6417901 - DNA, 19 bp, Homo sapiens
tcctcacacaccctgaggt

SEQ ID NO: 6417902 - DNA, 16 bp, Homo sapiens
tcctcacacccacctg

SEQ ID NO: 6417903 - DNA, 22 bp, Homo sapiens
tcctcacacccacctgctgctg

SEQ ID NO: 6417904 - DNA, 13 bp, Homo sapiens
tcctcacacccct

SEQ ID NO: 6417905 - DNA, 13 bp, Homo sapiens
tcctcacactcca

SEQ ID NO: 6417906 - DNA, 14 bp, Homo sapiens
tcctcacactccag

SEQ ID NO: 6417907 - DNA, 23 bp, Homo sapiens
tcctcacacttactgtaagacat

SEQ ID NO: 6417908 - DNA, 15 bp, Homo sapiens
tcctcacacttttgg

SEQ ID NO: 6417909 - DNA, 12 bp, Homo sapiens
tcctcacagcct

SEQ ID NO: 6417910 - DNA, 16 bp, Homo sapiens
tcctcacagcctctcc

SEQ ID NO: 6417911 - DNA, 19 bp, Homo sapiens
tcctcacagccttggctcc

SEQ ID NO: 6417912 - DNA, 20 bp, Homo sapiens
tcctcacagccttggctcct

SEQ ID NO: 6417913 - DNA, 17 bp, Homo sapiens
tcctcacaggagcagac

SEQ ID NO: 6417914 - DNA, 14 bp, Homo sapiens
tcctcacagtccca

SEQ ID NO: 6417915 - DNA, 19 bp, Homo sapiens
tcctcacagtcccactgtg

SEQ ID NO: 6417916 - DNA, 15 bp, Homo sapiens
tcctcacataaaaaa

SEQ ID NO: 6417917 - DNA, 18 bp, Homo sapiens
tcctcacatacccacaca

SEQ ID NO: 6417918 - DNA, 20 bp, Homo sapiens
tcctcacatctttcacactt

SEQ ID NO: 6417919 - DNA, 19 bp, Homo sapiens
tcctcacatgactgaaggg

SEQ ID NO: 6417920 - DNA, 17 bp, Homo sapiens
tcctcaccaataacttc

SEQ ID NO: 6417921 - DNA, 20 bp, Homo sapiens
tcctcaccaataacttcaga

SEQ ID NO: 6417922 - DNA, 22 bp, Homo sapiens
tcctcaccaataacttcagaga

SEQ ID NO: 6417923 - DNA, 14 bp, Homo sapiens
tcctcaccacatgc

SEQ ID NO: 6417924 - DNA, 22 bp, Homo sapiens
tcctcaccagtcccatgctggc

SEQ ID NO: 6417925 - DNA, 17 bp, Homo sapiens
tcctcacccagatcagg

SEQ ID NO: 6417926 - DNA, 17 bp, Homo sapiens
tcctcaccccagtgcct

SEQ ID NO: 6417927 - DNA, 16 bp, Homo sapiens
tcctcacccccacccc

SEQ ID NO: 6417928 - DNA, 16 bp, Homo sapiens
tcctcacccctgtagg

SEQ ID NO: 6417929 - DNA, 18 bp, Homo sapiens
tcctcacccctgtaggga

SEQ ID NO: 6417930 - DNA, 17 bp, Homo sapiens
tcctcacccctgtcctc

SEQ ID NO: 6417931 - DNA, 22 bp, Homo sapiens
tcctcaccctgatttcttgctt

SEQ ID NO: 6417932 - DNA, 15 bp, Homo sapiens
tcctcaccctgtggg

SEQ ID NO: 6417933 - DNA, 16 bp, Homo sapiens
tcctcaccctgtggga

SEQ ID NO: 6417934 - DNA, 23 bp, Homo sapiens
tcctcaccctgtgggaccgcctg

SEQ ID NO: 6417935 - DNA, 19 bp, Homo sapiens
tcctcacccttcccggccc

SEQ ID NO: 6417936 - DNA, 13 bp, Homo sapiens
tcctcaccgagca

SEQ ID NO: 6417937 - DNA, 21 bp, Homo sapiens
tcctcacctaccctcaaagta

SEQ ID NO: 6417938 - DNA, 16 bp, Homo sapiens
tcctcacctcatgccc

SEQ ID NO: 6417939 - DNA, 20 bp, Homo sapiens
tcctcacctctggactggct

SEQ ID NO: 6417940 - DNA, 23 bp, Homo sapiens
tcctcacctctggactggctaga

SEQ ID NO: 6417941 - DNA, 17 bp, Homo sapiens
tcctcacctgtctaggt

SEQ ID NO: 6417942 - DNA, 18 bp, Homo sapiens
tcctcaccttctgtttta

SEQ ID NO: 6417943 - DNA, 19 bp, Homo sapiens
tcctcaccttttcccgggg

SEQ ID NO: 6417944 - DNA, 22 bp, Homo sapiens
tcctcaccttttcccggggagg

SEQ ID NO: 6417945 - DNA, 22 bp, Homo sapiens
tcctcacgtgcaggacagctct

SEQ ID NO: 6417946 - DNA, 21 bp, Homo sapiens
tcctcactatgacactgagca

SEQ ID NO: 6417947 - DNA, 12 bp, Homo sapiens
tcctcactccca

SEQ ID NO: 6417948 - DNA, 16 bp, Homo sapiens
tcctcactcccagttc

SEQ ID NO: 6417949 - DNA, 21 bp, Homo sapiens
tcctcactcccttcccataag

SEQ ID NO: 6417950 - DNA, 15 bp, Homo sapiens
tcctcactctgtccc

SEQ ID NO: 6417951 - DNA, 22 bp, Homo sapiens
tcctcactgccccaccagccac

SEQ ID NO: 6417952 - DNA, 12 bp, Homo sapiens
tcctcactgcct

SEQ ID NO: 6417953 - DNA, 13 bp, Homo sapiens
tcctcactgctcc

SEQ ID NO: 6417954 - DNA, 15 bp, Homo sapiens
tcctcactgggctca

SEQ ID NO: 6417955 - DNA, 13 bp, Homo sapiens
tcctcactgggtg

SEQ ID NO: 6417956 - DNA, 15 bp, Homo sapiens
tcctcactgggtggg

SEQ ID NO: 6417957 - DNA, 21 bp, Homo sapiens
tcctcacttccatacagctct

SEQ ID NO: 6417958 - DNA, 15 bp, Homo sapiens
tcctcacttctgtct

SEQ ID NO: 6417959 - DNA, 16 bp, Homo sapiens
tcctcacttctgtctc

SEQ ID NO: 6417960 - DNA, 19 bp, Homo sapiens
tcctcacttctgtctcctg

SEQ ID NO: 6417961 - DNA, 13 bp, Homo sapiens
tcctcacttggct

SEQ ID NO: 6417962 - DNA, 22 bp, Homo sapiens
tcctcacttggctgtctgacca

SEQ ID NO: 6417963 - DNA, 19 bp, Homo sapiens
tcctcagaaagtgcagcat

SEQ ID NO: 6417964 - DNA, 17 bp, Homo sapiens
tcctcagaacccacagt

SEQ ID NO: 6417965 - DNA, 17 bp, Homo sapiens
tcctcagaactctttgc

SEQ ID NO: 6417966 - DNA, 21 bp, Homo sapiens
tcctcagaatagtgatgtgtt

SEQ ID NO: 6417967 - DNA, 19 bp, Homo sapiens
tcctcagaccaggtggaat

SEQ ID NO: 6417968 - DNA, 23 bp, Homo sapiens
tcctcagaccaggtggaattact

SEQ ID NO: 6417969 - DNA, 16 bp, Homo sapiens
tcctcagactctaaga

SEQ ID NO: 6417970 - DNA, 21 bp, Homo sapiens
tcctcagactctaagaaagaa

SEQ ID NO: 6417971 - DNA, 14 bp, Homo sapiens
tcctcagagcgcca

SEQ ID NO: 6417972 - DNA, 15 bp, Homo sapiens
tcctcagagcgccag

SEQ ID NO: 6417973 - DNA, 20 bp, Homo sapiens
tcctcagagcgccaggaagc

SEQ ID NO: 6417974 - DNA, 21 bp, Homo sapiens
tcctcagagcgccaggaagcc

SEQ ID NO: 6417975 - DNA, 22 bp, Homo sapiens
tcctcagagcgccaggaagcca

SEQ ID NO: 6417976 - DNA, 19 bp, Homo sapiens
tcctcagaggcgtgctggt

SEQ ID NO: 6417977 - DNA, 13 bp, Homo sapiens
tcctcagaggctg

SEQ ID NO: 6417978 - DNA, 19 bp, Homo sapiens
tcctcagatcatccagaag

SEQ ID NO: 6417979 - DNA, 20 bp, Homo sapiens
tcctcagatcttctgtgggt

SEQ ID NO: 6417980 - DNA, 13 bp, Homo sapiens
tcctcagatgctc

SEQ ID NO: 6417981 - DNA, 20 bp, Homo sapiens
tcctcagattagatgtgcca

SEQ ID NO: 6417982 - DNA, 21 bp, Homo sapiens
tcctcagattagatgtgccaa

SEQ ID NO: 6417983 - DNA, 19 bp, Homo sapiens
tcctcagcaagtgctgagt

SEQ ID NO: 6417984 - DNA, 16 bp, Homo sapiens
tcctcagcaccccact

SEQ ID NO: 6417985 - DNA, 17 bp, Homo sapiens
tcctcagcaccccactc

SEQ ID NO: 6417986 - DNA, 22 bp, Homo sapiens
tcctcagcaccccactcctcag

SEQ ID NO: 6417987 - DNA, 15 bp, Homo sapiens
tcctcagcacggtgc

SEQ ID NO: 6417988 - DNA, 19 bp, Homo sapiens
tcctcagcacggtgcctcc

SEQ ID NO: 6417989 - DNA, 15 bp, Homo sapiens
tcctcagcaggccaa

SEQ ID NO: 6417990 - DNA, 10 bp, Homo sapiens
tcctcagcca

SEQ ID NO: 6417991 - DNA, 12 bp, Homo sapiens
tcctcagccagc

SEQ ID NO: 6417992 - DNA, 13 bp, Homo sapiens
tcctcagccccag

SEQ ID NO: 6417993 - DNA, 16 bp, Homo sapiens
tcctcagccccagggc

SEQ ID NO: 6417994 - DNA, 22 bp, Homo sapiens
tcctcagccccagggccctgct

SEQ ID NO: 6417995 - DNA, 18 bp, Homo sapiens
tcctcagcccccaggcca

SEQ ID NO: 6417996 - DNA, 22 bp, Homo sapiens
tcctcagcccccaggccaggtg

SEQ ID NO: 6417997 - DNA, 13 bp, Homo sapiens
tcctcagccctct

SEQ ID NO: 6417998 - DNA, 15 bp, Homo sapiens
tcctcagccctctct

SEQ ID NO: 6417999 - DNA, 19 bp, Homo sapiens
tcctcagccctctcttgcc

SEQ ID NO: 6418000 - DNA, 20 bp, Homo sapiens
tcctcagccgagaaattggg

SEQ ID NO: 6418001 - DNA, 11 bp, Homo sapiens
tcctcagcctc

SEQ ID NO: 6418002 - DNA, 13 bp, Homo sapiens
tcctcagcctcca

SEQ ID NO: 6418003 - DNA, 18 bp, Homo sapiens
tcctcagcctccaaagtg

SEQ ID NO: 6418004 - DNA, 13 bp, Homo sapiens
tcctcagcctccc

SEQ ID NO: 6418005 - DNA, 22 bp, Homo sapiens
tcctcagcctccctttgccagc

SEQ ID NO: 6418006 - DNA, 12 bp, Homo sapiens
tcctcagcctga

SEQ ID NO: 6418007 - DNA, 14 bp, Homo sapiens
tcctcagcctgaac

SEQ ID NO: 6418008 - DNA, 15 bp, Homo sapiens
tcctcagcctggggt

SEQ ID NO: 6418009 - DNA, 21 bp, Homo sapiens
tcctcagccttgccagagatc

SEQ ID NO: 6418010 - DNA, 19 bp, Homo sapiens
tcctcagcgagaggcagca

SEQ ID NO: 6418011 - DNA, 17 bp, Homo sapiens
tcctcagctcagctggg

SEQ ID NO: 6418012 - DNA, 18 bp, Homo sapiens
tcctcagctcagctgggc

SEQ ID NO: 6418013 - DNA, 15 bp, Homo sapiens
tcctcagctccctgc

SEQ ID NO: 6418014 - DNA, 14 bp, Homo sapiens
tcctcagctctagg

SEQ ID NO: 6418015 - DNA, 16 bp, Homo sapiens
tcctcagctgcatgga

SEQ ID NO: 6418016 - DNA, 20 bp, Homo sapiens
tcctcagctgcatggagcct

SEQ ID NO: 6418017 - DNA, 22 bp, Homo sapiens
tcctcagctgcatggagcctgg

SEQ ID NO: 6418018 - DNA, 23 bp, Homo sapiens
tcctcagctgcatggagcctgga

SEQ ID NO: 6418019 - DNA, 15 bp, Homo sapiens
tcctcagctgccaag

SEQ ID NO: 6418020 - DNA, 14 bp, Homo sapiens
tcctcagcttgggc

SEQ ID NO: 6418021 - DNA, 15 bp, Homo sapiens
tcctcagctttgctt

SEQ ID NO: 6418022 - DNA, 17 bp, Homo sapiens
tcctcaggaacagaaca

SEQ ID NO: 6418023 - DNA, 21 bp, Homo sapiens
tcctcaggaagggggccgcca

SEQ ID NO: 6418024 - DNA, 12 bp, Homo sapiens
tcctcaggacaa

SEQ ID NO: 6418025 - DNA, 13 bp, Homo sapiens
tcctcaggacaag

SEQ ID NO: 6418026 - DNA, 12 bp, Homo sapiens
tcctcaggacca

SEQ ID NO: 6418027 - DNA, 22 bp, Homo sapiens
tcctcaggaccctcagccctgg

SEQ ID NO: 6418028 - DNA, 15 bp, Homo sapiens
tcctcaggagaaggg

SEQ ID NO: 6418029 - DNA, 21 bp, Homo sapiens
tcctcaggagccgaagcccag

SEQ ID NO: 6418030 - DNA, 16 bp, Homo sapiens
tcctcaggcacacagc

SEQ ID NO: 6418031 - DNA, 16 bp, Homo sapiens
tcctcaggcagtggcc

SEQ ID NO: 6418032 - DNA, 18 bp, Homo sapiens
tcctcaggcagtggccca

SEQ ID NO: 6418033 - DNA, 14 bp, Homo sapiens
tcctcaggcccagc

SEQ ID NO: 6418034 - DNA, 18 bp, Homo sapiens
tcctcagggacagagaca

SEQ ID NO: 6418035 - DNA, 22 bp, Homo sapiens
tcctcagggacagagacacctg

SEQ ID NO: 6418036 - DNA, 21 bp, Homo sapiens
tcctcagggagcagggaaggc

SEQ ID NO: 6418037 - DNA, 22 bp, Homo sapiens
tcctcaggggcacagacctctc

SEQ ID NO: 6418038 - DNA, 20 bp, Homo sapiens
tcctcagggggtaggagagc

SEQ ID NO: 6418039 - DNA, 17 bp, Homo sapiens
tcctcagggtgtcctga

SEQ ID NO: 6418040 - DNA, 16 bp, Homo sapiens
tcctcaggtcagctgg

SEQ ID NO: 6418041 - DNA, 23 bp, Homo sapiens
tatctagcaagaagattctaaaa

SEQ ID NO: 6418042 - DNA, 14 bp, Homo sapiens
tatctagccaaaga

SEQ ID NO: 6418043 - DNA, 11 bp, Homo sapiens
tatctagctct

SEQ ID NO: 6418044 - DNA, 15 bp, Homo sapiens
tatctaggcatttca

SEQ ID NO: 6418045 - DNA, 17 bp, Homo sapiens
tatctaggtttatgaca

SEQ ID NO: 6418046 - DNA, 17 bp, Homo sapiens
tatctagtatgaaatta

SEQ ID NO: 6418047 - DNA, 16 bp, Homo sapiens
tatctagtcacataaa

SEQ ID NO: 6418048 - DNA, 20 bp, Homo sapiens
tatctagtgtctaaaacact

SEQ ID NO: 6418049 - DNA, 15 bp, Homo sapiens
tatctagttacatgg

SEQ ID NO: 6418050 - DNA, 18 bp, Homo sapiens
tatctagttctaacagtg

SEQ ID NO: 6418051 - DNA, 18 bp, Homo sapiens
tatctataaaatagatat

SEQ ID NO: 6418052 - DNA, 15 bp, Homo sapiens
tatctatacctgcct

SEQ ID NO: 6418053 - DNA, 16 bp, Homo sapiens
tatctatacctgcctt

SEQ ID NO: 6418054 - DNA, 23 bp, Homo sapiens
tatctatacctgccttttaagtt

SEQ ID NO: 6418055 - DNA, 14 bp, Homo sapiens
tatctatataaaat

SEQ ID NO: 6418056 - DNA, 15 bp, Homo sapiens
tatctatataaaata

SEQ ID NO: 6418057 - DNA, 21 bp, Homo sapiens
tatctatatataattctgtac

SEQ ID NO: 6418058 - DNA, 15 bp, Homo sapiens
tatctatatatgtat

SEQ ID NO: 6418059 - DNA, 15 bp, Homo sapiens
tatctatatatgtgt

SEQ ID NO: 6418060 - DNA, 16 bp, Homo sapiens
tatctatatatgtgta

SEQ ID NO: 6418061 - DNA, 22 bp, Homo sapiens
tatctatatatgtgtatgtacg

SEQ ID NO: 6418062 - DNA, 14 bp, Homo sapiens
tatctatatcatat

SEQ ID NO: 6418063 - DNA, 22 bp, Homo sapiens
tatctatatcatatttctgtgg

SEQ ID NO: 6418064 - DNA, 23 bp, Homo sapiens
tatctatatcatatttctgtgga

SEQ ID NO: 6418065 - DNA, 15 bp, Homo sapiens
tatctatatctctaa

SEQ ID NO: 6418066 - DNA, 17 bp, Homo sapiens
tatctatatctctaaac

SEQ ID NO: 6418067 - DNA, 14 bp, Homo sapiens
tatctatatttttg

SEQ ID NO: 6418068 - DNA, 18 bp, Homo sapiens
tatctatcggaagaacat

SEQ ID NO: 6418069 - DNA, 14 bp, Homo sapiens
tatctatcttccaa

SEQ ID NO: 6418070 - DNA, 22 bp, Homo sapiens
tatctatgaacaacagtagttt

SEQ ID NO: 6418071 - DNA, 19 bp, Homo sapiens
tatctatgactgtgtttaa

SEQ ID NO: 6418072 - DNA, 21 bp, Homo sapiens
tatctatgcaaagcactctct

SEQ ID NO: 6418073 - DNA, 23 bp, Homo sapiens
tatctatgcaaagcactctctgc

SEQ ID NO: 6418074 - DNA, 18 bp, Homo sapiens
tatctatggccctgcaaa

SEQ ID NO: 6418075 - DNA, 23 bp, Homo sapiens
tatctatgttgcatgataaacat

SEQ ID NO: 6418076 - DNA, 13 bp, Homo sapiens
tatctattaatat

SEQ ID NO: 6418077 - DNA, 18 bp, Homo sapiens
tatctattaatatatgta

SEQ ID NO: 6418078 - DNA, 16 bp, Homo sapiens
tatctattctgagaaa

SEQ ID NO: 6418079 - DNA, 23 bp, Homo sapiens
tatctattctgagaaaacaagca

SEQ ID NO: 6418080 - DNA, 19 bp, Homo sapiens
tatctattgtaagataaaa

SEQ ID NO: 6418081 - DNA, 17 bp, Homo sapiens
tatctatttatctgtct

SEQ ID NO: 6418082 - DNA, 18 bp, Homo sapiens
tatctatttgaataaatt

SEQ ID NO: 6418083 - DNA, 14 bp, Homo sapiens
tatctatttgtaca

SEQ ID NO: 6418084 - DNA, 12 bp, Homo sapiens
tatctcaaacaa

SEQ ID NO: 6418085 - DNA, 23 bp, Homo sapiens
tatctcaaacaattgaagtcaat

SEQ ID NO: 6418086 - DNA, 17 bp, Homo sapiens
tatctcaaagtttaaca

SEQ ID NO: 6418087 - DNA, 24 bp, Homo sapiens
tatctcaaatctgctttcatccag

SEQ ID NO: 6418088 - DNA, 18 bp, Homo sapiens
tatctcaacaacatgtca

SEQ ID NO: 6418089 - DNA, 23 bp, Homo sapiens
tatctcaactttggttcctgtga

SEQ ID NO: 6418090 - DNA, 15 bp, Homo sapiens
tatctcaagtaaaac

SEQ ID NO: 6418091 - DNA, 21 bp, Homo sapiens
tatctcaagtaaaacaaatga

SEQ ID NO: 6418092 - DNA, 12 bp, Homo sapiens
tatctcacactc

SEQ ID NO: 6418093 - DNA, 13 bp, Homo sapiens
tatctcacttcca

SEQ ID NO: 6418094 - DNA, 16 bp, Homo sapiens
tatctcacttgtgcca

SEQ ID NO: 6418095 - DNA, 20 bp, Homo sapiens
tatctcactttgtaaataaa

SEQ ID NO: 6418096 - DNA, 18 bp, Homo sapiens
tatctcagatatttgcac

SEQ ID NO: 6418097 - DNA, 15 bp, Homo sapiens
tatctcagccatagg

SEQ ID NO: 6418098 - DNA, 13 bp, Homo sapiens
tatctcagggagg

SEQ ID NO: 6418099 - DNA, 13 bp, Homo sapiens
tatctcatactgt

SEQ ID NO: 6418100 - DNA, 16 bp, Homo sapiens
tatctcatcctttcct

SEQ ID NO: 6418101 - DNA, 18 bp, Homo sapiens
tatctcatcctttcctct

SEQ ID NO: 6418102 - DNA, 14 bp, Homo sapiens
tatctcatttaatt

SEQ ID NO: 6418103 - DNA, 20 bp, Homo sapiens
tatctccagccaatttcaaa

SEQ ID NO: 6418104 - DNA, 22 bp, Homo sapiens
tatctccatggccctgtcccag

SEQ ID NO: 6418105 - DNA, 12 bp, Homo sapiens
tatctcccacaa

SEQ ID NO: 6418106 - DNA, 19 bp, Homo sapiens
tatctcccccaacccacct

SEQ ID NO: 6418107 - DNA, 19 bp, Homo sapiens
tatctcccccactccacta

SEQ ID NO: 6418108 - DNA, 17 bp, Homo sapiens
tatctcccccagcccca

SEQ ID NO: 6418109 - DNA, 23 bp, Homo sapiens
tatctcccgaagtcctctgtggc

SEQ ID NO: 6418110 - DNA, 22 bp, Homo sapiens
tatctccctgcctcctgccggc

SEQ ID NO: 6418111 - DNA, 14 bp, Homo sapiens
tatctccctgcttc

SEQ ID NO: 6418112 - DNA, 15 bp, Homo sapiens
tatctccctgcttca

SEQ ID NO: 6418113 - DNA, 18 bp, Homo sapiens
tatctccctggagaagca

SEQ ID NO: 6418114 - DNA, 16 bp, Homo sapiens
tatctccctggctcac

SEQ ID NO: 6418115 - DNA, 20 bp, Homo sapiens
tatctccctggctcactggc

SEQ ID NO: 6418116 - DNA, 20 bp, Homo sapiens
tatctcctaactttggacct

SEQ ID NO: 6418117 - DNA, 16 bp, Homo sapiens
tatctcctagggctat

SEQ ID NO: 6418118 - DNA, 13 bp, Homo sapiens
tatctcctcctat

SEQ ID NO: 6418119 - DNA, 13 bp, Homo sapiens
tatctcctgacag

SEQ ID NO: 6418120 - DNA, 14 bp, Homo sapiens
tatctcctgacaga

SEQ ID NO: 6418121 - DNA, 12 bp, Homo sapiens
tatctcctggaa

SEQ ID NO: 6418122 - DNA, 14 bp, Homo sapiens
tatctcctggaaca

SEQ ID NO: 6418123 - DNA, 17 bp, Homo sapiens
tatctcctggaacacta

SEQ ID NO: 6418124 - DNA, 23 bp, Homo sapiens
tatctccttcagaagtttgcttc

SEQ ID NO: 6418125 - DNA, 15 bp, Homo sapiens
tatctccttcccacc

SEQ ID NO: 6418126 - DNA, 16 bp, Homo sapiens
tatctccttgtggcct

SEQ ID NO: 6418127 - DNA, 22 bp, Homo sapiens
tatctccttgtggcctatgaaa

SEQ ID NO: 6418128 - DNA, 16 bp, Homo sapiens
tatctcctttaatata

SEQ ID NO: 6418129 - DNA, 15 bp, Homo sapiens
tatctcgaagtcttc

SEQ ID NO: 6418130 - DNA, 22 bp, Homo sapiens
tatctcgaagtcttccatcagc

SEQ ID NO: 6418131 - DNA, 23 bp, Homo sapiens
tatctcgaagtcttccatcagca

SEQ ID NO: 6418132 - DNA, 14 bp, Homo sapiens
tatctcggactttg

SEQ ID NO: 6418133 - DNA, 15 bp, Homo sapiens
tatctcgtaatagct

SEQ ID NO: 6418134 - DNA, 20 bp, Homo sapiens
tatctcgtaatagcttctgt

SEQ ID NO: 6418135 - DNA, 16 bp, Homo sapiens
tatctctaaactgctg

SEQ ID NO: 6418136 - DNA, 18 bp, Homo sapiens
tatctctaataaaaacag

SEQ ID NO: 6418137 - DNA, 22 bp, Homo sapiens
tatctctaggctgttttctcca

SEQ ID NO: 6418138 - DNA, 19 bp, Homo sapiens
tatctctagtccctgtgtt

SEQ ID NO: 6418139 - DNA, 17 bp, Homo sapiens
tatctctatttaatatt

SEQ ID NO: 6418140 - DNA, 16 bp, Homo sapiens
tatctctatttgagaa

SEQ ID NO: 6418141 - DNA, 18 bp, Homo sapiens
tatctctcaagagtgctg

SEQ ID NO: 6418142 - DNA, 16 bp, Homo sapiens
tatctctcccttcttt

SEQ ID NO: 6418143 - DNA, 13 bp, Homo sapiens
tatctctctgtgc

SEQ ID NO: 6418144 - DNA, 23 bp, Homo sapiens
tatctctgaagcatgtttcatgt

SEQ ID NO: 6418145 - DNA, 17 bp, Homo sapiens
tatctctgtgtgcacaa

SEQ ID NO: 6418146 - DNA, 12 bp, Homo sapiens
tatctctgtgtt

SEQ ID NO: 6418147 - DNA, 13 bp, Homo sapiens
tatctcttcctta

SEQ ID NO: 6418148 - DNA, 15 bp, Homo sapiens
tatctcttggaaaat

SEQ ID NO: 6418149 - DNA, 20 bp, Homo sapiens
tatctcttgtgcttttttga

SEQ ID NO: 6418150 - DNA, 12 bp, Homo sapiens
tatctctttcca

SEQ ID NO: 6418151 - DNA, 14 bp, Homo sapiens
tatctgaaaactgg

SEQ ID NO: 6418152 - DNA, 16 bp, Homo sapiens
tatctgaaaatacatt

SEQ ID NO: 6418153 - DNA, 14 bp, Homo sapiens
tatctgaaaatgta

SEQ ID NO: 6418154 - DNA, 15 bp, Homo sapiens
tatctgaaaatgtat

SEQ ID NO: 6418155 - DNA, 20 bp, Homo sapiens
tatctgaaaggccagcagct

SEQ ID NO: 6418156 - DNA, 15 bp, Homo sapiens
tatctgaaatcccaa

SEQ ID NO: 6418157 - DNA, 13 bp, Homo sapiens
tatctgaacacat

SEQ ID NO: 6418158 - DNA, 17 bp, Homo sapiens
tatctgaacatttacta

SEQ ID NO: 6418159 - DNA, 19 bp, Homo sapiens
tatctgaacatttactaca

SEQ ID NO: 6418160 - DNA, 19 bp, Homo sapiens
tatctgaaccaagatgtaa

SEQ ID NO: 6418161 - DNA, 19 bp, Homo sapiens
tatctgaactaattcattt

SEQ ID NO: 6418162 - DNA, 15 bp, Homo sapiens
tatctgaactcacag

SEQ ID NO: 6418163 - DNA, 21 bp, Homo sapiens
tatctgaactcacagactgct

SEQ ID NO: 6418164 - DNA, 23 bp, Homo sapiens
tatctgaactcacagactgctgt

SEQ ID NO: 6418165 - DNA, 16 bp, Homo sapiens
tatctgaactggacta

SEQ ID NO: 6418166 - DNA, 21 bp, Homo sapiens
tatctgaaggagattttcctt

SEQ ID NO: 6418167 - DNA, 18 bp, Homo sapiens
tatctgaagtcagatctg

SEQ ID NO: 6418168 - DNA, 13 bp, Homo sapiens
tatctgaatgttc

SEQ ID NO: 6418169 - DNA, 19 bp, Homo sapiens
tatctgaatttttaaacaa

SEQ ID NO: 6418170 - DNA, 16 bp, Homo sapiens
tatctgagaagtgtat

SEQ ID NO: 6418171 - DNA, 18 bp, Homo sapiens
tatctgagaagtgtatat

SEQ ID NO: 6418172 - DNA, 22 bp, Homo sapiens
tatctgagaagtgtatatagtt

SEQ ID NO: 6418173 - DNA, 13 bp, Homo sapiens
tatctgagaattg

SEQ ID NO: 6418174 - DNA, 17 bp, Homo sapiens
tatctgagaattgcaaa

SEQ ID NO: 6418175 - DNA, 18 bp, Homo sapiens
tatctgagaattgcaaaa

SEQ ID NO: 6418176 - DNA, 22 bp, Homo sapiens
tatctgagaattgcaaaactag

SEQ ID NO: 6418177 - DNA, 16 bp, Homo sapiens
tatctgagcaataact

SEQ ID NO: 6418178 - DNA, 20 bp, Homo sapiens
tatctgagcgtttaaagtac

SEQ ID NO: 6418179 - DNA, 21 bp, Homo sapiens
tatctgagctcttatctatga

SEQ ID NO: 6418180 - DNA, 22 bp, Homo sapiens
tatctgaggaattctgtataga

SEQ ID NO: 6418181 - DNA, 21 bp, Homo sapiens
tatctgaggcacatgtcagca

SEQ ID NO: 6418182 - DNA, 18 bp, Homo sapiens
tatctgagggaggaggcc

SEQ ID NO: 6418183 - DNA, 18 bp, Homo sapiens
tatctgagttgccaagac

SEQ ID NO: 6418184 - DNA, 21 bp, Homo sapiens
tatctgagttgccaagacaaa

SEQ ID NO: 6418185 - DNA, 23 bp, Homo sapiens
tatctgagttgtgcctcatttat

SEQ ID NO: 6418186 - DNA, 15 bp, Homo sapiens
tatctgatatctgtt

SEQ ID NO: 6418187 - DNA, 16 bp, Homo sapiens
tatctgatatgctgag

SEQ ID NO: 6418188 - DNA, 19 bp, Homo sapiens
tatctgatattaaagattt

SEQ ID NO: 6418189 - DNA, 13 bp, Homo sapiens
tatctgatcagaa

SEQ ID NO: 6418190 - DNA, 14 bp, Homo sapiens
tatctgatctgtga

SEQ ID NO: 6418191 - DNA, 17 bp, Homo sapiens
tatctgattcctttaaa

SEQ ID NO: 6418192 - DNA, 20 bp, Homo sapiens
tatctgcaaatagtttcaaa

SEQ ID NO: 6418193 - DNA, 22 bp, Homo sapiens
tatctgcaaatagtttcaaatg

SEQ ID NO: 6418194 - DNA, 23 bp, Homo sapiens
tatctgcaaggattttttaaaaa

SEQ ID NO: 6418195 - DNA, 22 bp, Homo sapiens
tatctgcaagtgaggtgtgtca

SEQ ID NO: 6418196 - DNA, 20 bp, Homo sapiens
tatctgcactctaaactgca

SEQ ID NO: 6418197 - DNA, 14 bp, Homo sapiens
tatctgcagaacat

SEQ ID NO: 6418198 - DNA, 19 bp, Homo sapiens
tatctgcagaatgggccac

SEQ ID NO: 6418199 - DNA, 11 bp, Homo sapiens
tatctgcagcg

SEQ ID NO: 6418200 - DNA, 22 bp, Homo sapiens
tatctgcatgtaaaatcttcag

SEQ ID NO: 6418201 - DNA, 12 bp, Homo sapiens
tatctgcatgtg

SEQ ID NO: 6418202 - DNA, 17 bp, Homo sapiens
tatctgcatgtgtcatg

SEQ ID NO: 6418203 - DNA, 12 bp, Homo sapiens
tatctgcattta

SEQ ID NO: 6418204 - DNA, 18 bp, Homo sapiens
tatctgcatttataaatg

SEQ ID NO: 6418205 - DNA, 23 bp, Homo sapiens
tatctgcatttataaatgtgtgg

SEQ ID NO: 6418206 - DNA, 16 bp, Homo sapiens
tatctgccatgtccat

SEQ ID NO: 6418207 - DNA, 12 bp, Homo sapiens
tatctgcccctc

SEQ ID NO: 6418208 - DNA, 16 bp, Homo sapiens
tatctgcccctccccc

SEQ ID NO: 6418209 - DNA, 14 bp, Homo sapiens
tatctgcctcccct

SEQ ID NO: 6418210 - DNA, 15 bp, Homo sapiens
tatctgcctgacagg

SEQ ID NO: 6418211 - DNA, 23 bp, Homo sapiens
tatctgcctgacaggctgtgact

SEQ ID NO: 6418212 - DNA, 12 bp, Homo sapiens
tatctgcctggc

SEQ ID NO: 6418213 - DNA, 14 bp, Homo sapiens
tatctgcctggcct

SEQ ID NO: 6418214 - DNA, 15 bp, Homo sapiens
tatctgcctggcctg

SEQ ID NO: 6418215 - DNA, 21 bp, Homo sapiens
tatctgcctggcctggctccc

SEQ ID NO: 6418216 - DNA, 18 bp, Homo sapiens
tatctgcctttattgtgt

SEQ ID NO: 6418217 - DNA, 13 bp, Homo sapiens
tatctgctgtcca

SEQ ID NO: 6418218 - DNA, 22 bp, Homo sapiens
tatctgctgtccagacagcctg

SEQ ID NO: 6418219 - DNA, 14 bp, Homo sapiens
tatctgctgttctt

SEQ ID NO: 6418220 - DNA, 19 bp, Homo sapiens
tcctcaggtcagctgggag

SEQ ID NO: 6418221 - DNA, 16 bp, Homo sapiens
tcctcaggtgaataac

SEQ ID NO: 6418222 - DNA, 13 bp, Homo sapiens
tcctcaggtggcc

SEQ ID NO: 6418223 - DNA, 18 bp, Homo sapiens
tcctcaggtggccatgcc

SEQ ID NO: 6418224 - DNA, 22 bp, Homo sapiens
tcctcaggtggccatgcctcag

SEQ ID NO: 6418225 - DNA, 19 bp, Homo sapiens
tcctcagtaaaagtcttct

SEQ ID NO: 6418226 - DNA, 23 bp, Homo sapiens
tcctcagtaaaagtcttctccca

SEQ ID NO: 6418227 - DNA, 22 bp, Homo sapiens
tcctcagtaagtgttagaggga

SEQ ID NO: 6418228 - DNA, 16 bp, Homo sapiens
tcctcagtccatttat

SEQ ID NO: 6418229 - DNA, 18 bp, Homo sapiens
tcctcagtccatttatat

SEQ ID NO: 6418230 - DNA, 17 bp, Homo sapiens
tcctcagtcctggaagc

SEQ ID NO: 6418231 - DNA, 15 bp, Homo sapiens
tcctcagtgatggaa

SEQ ID NO: 6418232 - DNA, 16 bp, Homo sapiens
tcctcagtgatggaat

SEQ ID NO: 6418233 - DNA, 19 bp, Homo sapiens
tcctcagtgatggaatatc

SEQ ID NO: 6418234 - DNA, 22 bp, Homo sapiens
tcctcagtgcaaaatgtcttgt

SEQ ID NO: 6418235 - DNA, 17 bp, Homo sapiens
tcctcagttggaatcat

SEQ ID NO: 6418236 - DNA, 15 bp, Homo sapiens
tcctcagtttatttt

SEQ ID NO: 6418237 - DNA, 17 bp, Homo sapiens
tcctcataaacatttga

SEQ ID NO: 6418238 - DNA, 15 bp, Homo sapiens
tcctcatatggccca

SEQ ID NO: 6418239 - DNA, 23 bp, Homo sapiens
tcctcatcaccatcgtgtttgca

SEQ ID NO: 6418240 - DNA, 21 bp, Homo sapiens
tcctcatcatgaaaactggga

SEQ ID NO: 6418241 - DNA, 20 bp, Homo sapiens
tcctcatcctcagatgctca

SEQ ID NO: 6418242 - DNA, 21 bp, Homo sapiens
tcctcatcctccctgaccctg

SEQ ID NO: 6418243 - DNA, 18 bp, Homo sapiens
tcctcatctatggttcta

SEQ ID NO: 6418244 - DNA, 23 bp, Homo sapiens
tcctcatctctaacagctcagga

SEQ ID NO: 6418245 - DNA, 14 bp, Homo sapiens
tcctcatctctctt

SEQ ID NO: 6418246 - DNA, 16 bp, Homo sapiens
tcctcatctctcttgg

SEQ ID NO: 6418247 - DNA, 18 bp, Homo sapiens
tcctcatctgcctggaaa

SEQ ID NO: 6418248 - DNA, 20 bp, Homo sapiens
tcctcatctgcctggaaagt

SEQ ID NO: 6418249 - DNA, 20 bp, Homo sapiens
tcctcatctgggggagtgga

SEQ ID NO: 6418250 - DNA, 15 bp, Homo sapiens
tcctcatctgggtct

SEQ ID NO: 6418251 - DNA, 13 bp, Homo sapiens
tcctcatctgtgc

SEQ ID NO: 6418252 - DNA, 14 bp, Homo sapiens
tcctcatctgtgcc

SEQ ID NO: 6418253 - DNA, 16 bp, Homo sapiens
tcctcatctgtgcctg

SEQ ID NO: 6418254 - DNA, 19 bp, Homo sapiens
tcctcatctgtgcctgtct

SEQ ID NO: 6418255 - DNA, 21 bp, Homo sapiens
tcctcatctgtgcctgtctgt

SEQ ID NO: 6418256 - DNA, 15 bp, Homo sapiens
tcctcatgaaagcag

SEQ ID NO: 6418257 - DNA, 17 bp, Homo sapiens
tcctcatgaatgtaaat

SEQ ID NO: 6418258 - DNA, 20 bp, Homo sapiens
tcctcatgaatgtaaatttg

SEQ ID NO: 6418259 - DNA, 19 bp, Homo sapiens
tcctcatggcccatcaggg

SEQ ID NO: 6418260 - DNA, 20 bp, Homo sapiens
tcctcatggtgcatataaat

SEQ ID NO: 6418261 - DNA, 19 bp, Homo sapiens
tcctcatgtaacattggtg

SEQ ID NO: 6418262 - DNA, 23 bp, Homo sapiens
tcctcatgtcttctcacaagcca

SEQ ID NO: 6418263 - DNA, 18 bp, Homo sapiens
tcctcattagcattttgc

SEQ ID NO: 6418264 - DNA, 14 bp, Homo sapiens
tcctcattcctgaa

SEQ ID NO: 6418265 - DNA, 17 bp, Homo sapiens
tcctcattgttcagaaa

SEQ ID NO: 6418266 - DNA, 23 bp, Homo sapiens
tcctcattgttggagtgtaaacc

SEQ ID NO: 6418267 - DNA, 20 bp, Homo sapiens
tcctcatttaatatttttca

SEQ ID NO: 6418268 - DNA, 22 bp, Homo sapiens
tcctcatttaatatttttcaaa

SEQ ID NO: 6418269 - DNA, 19 bp, Homo sapiens
tcctcatttcccctcccaa

SEQ ID NO: 6418270 - DNA, 21 bp, Homo sapiens
tcctcatttgcaaacctcaga

SEQ ID NO: 6418271 - DNA, 23 bp, Homo sapiens
tcctcatttggggtagctagagg

SEQ ID NO: 6418272 - DNA, 18 bp, Homo sapiens
tcctcatttgttcattaa

SEQ ID NO: 6418273 - DNA, 12 bp, Homo sapiens
tcctcattttga

SEQ ID NO: 6418274 - DNA, 22 bp, Homo sapiens
tcctcatttttataatgtccct

SEQ ID NO: 6418275 - DNA, 11 bp, Homo sapiens
tcctccaaaac

SEQ ID NO: 6418276 - DNA, 15 bp, Homo sapiens
tcctccaaaacacaa

SEQ ID NO: 6418277 - DNA, 16 bp, Homo sapiens
tcctccaaactcctgc

SEQ ID NO: 6418278 - DNA, 23 bp, Homo sapiens
tcctccaaagactgaaggagcat

SEQ ID NO: 6418279 - DNA, 17 bp, Homo sapiens
tcctccaacaccaagca

SEQ ID NO: 6418280 - DNA, 23 bp, Homo sapiens
tcctccaacgttaaaagacagtg

SEQ ID NO: 6418281 - DNA, 17 bp, Homo sapiens
tcctccaagaatctatc

SEQ ID NO: 6418282 - DNA, 14 bp, Homo sapiens
tcctccaagaattt

SEQ ID NO: 6418283 - DNA, 20 bp, Homo sapiens
tcctccaagacactgtggac

SEQ ID NO: 6418284 - DNA, 21 bp, Homo sapiens
tcctccaagacactgtggact

SEQ ID NO: 6418285 - DNA, 12 bp, Homo sapiens
tcctccaagcca

SEQ ID NO: 6418286 - DNA, 21 bp, Homo sapiens
tcctccaagtgccccctcacc

SEQ ID NO: 6418287 - DNA, 15 bp, Homo sapiens
tcctccaatgtcctg

SEQ ID NO: 6418288 - DNA, 23 bp, Homo sapiens
tcctccaattccacagtctctgg

SEQ ID NO: 6418289 - DNA, 18 bp, Homo sapiens
tcctccacaaggtccccc

SEQ ID NO: 6418290 - DNA, 15 bp, Homo sapiens
tcctccacagagagg

SEQ ID NO: 6418291 - DNA, 18 bp, Homo sapiens
tcctccacagtcccccac

SEQ ID NO: 6418292 - DNA, 23 bp, Homo sapiens
tcctccacagtcccccacccacc

SEQ ID NO: 6418293 - DNA, 18 bp, Homo sapiens
tcctccacagtgctgctt

SEQ ID NO: 6418294 - DNA, 19 bp, Homo sapiens
tcctccacagtgctgcttc

SEQ ID NO: 6418295 - DNA, 13 bp, Homo sapiens
tcctccacatttg

SEQ ID NO: 6418296 - DNA, 16 bp, Homo sapiens
tcctccacatttgttt

SEQ ID NO: 6418297 - DNA, 19 bp, Homo sapiens
tcctccaccacaagagctc

SEQ ID NO: 6418298 - DNA, 20 bp, Homo sapiens
tcctccaccaccgcccgtct

SEQ ID NO: 6418299 - DNA, 15 bp, Homo sapiens
tcctccaccatgcac

SEQ ID NO: 6418300 - DNA, 12 bp, Homo sapiens
tcctccacccca

SEQ ID NO: 6418301 - DNA, 23 bp, Homo sapiens
tcctccaccgccatggcttccaa

SEQ ID NO: 6418302 - DNA, 12 bp, Homo sapiens
tcctccacgcct

SEQ ID NO: 6418303 - DNA, 22 bp, Homo sapiens
tcctccacgttctgctcatcat

SEQ ID NO: 6418304 - DNA, 23 bp, Homo sapiens
tcctccacgttctgctcatcatt

SEQ ID NO: 6418305 - DNA, 17 bp, Homo sapiens
tcctccactcactccag

SEQ ID NO: 6418306 - DNA, 18 bp, Homo sapiens
tcctccactcactccagc

SEQ ID NO: 6418307 - DNA, 16 bp, Homo sapiens
tcctccactccacctc

SEQ ID NO: 6418308 - DNA, 16 bp, Homo sapiens
tcctccactcgaccca

SEQ ID NO: 6418309 - DNA, 15 bp, Homo sapiens
tcctccactttgctg

SEQ ID NO: 6418310 - DNA, 13 bp, Homo sapiens
tcctccagaagcc

SEQ ID NO: 6418311 - DNA, 20 bp, Homo sapiens
tcctccagaagcctccttac

SEQ ID NO: 6418312 - DNA, 13 bp, Homo sapiens
tcctccagacaga

SEQ ID NO: 6418313 - DNA, 13 bp, Homo sapiens
tcctccagaccac

SEQ ID NO: 6418314 - DNA, 16 bp, Homo sapiens
tcctccagaccaccag

SEQ ID NO: 6418315 - DNA, 22 bp, Homo sapiens
tcctccagactcgagagggctg

SEQ ID NO: 6418316 - DNA, 21 bp, Homo sapiens
tcctccagagaaacccaggga

SEQ ID NO: 6418317 - DNA, 21 bp, Homo sapiens
tcctccagagacactgagcca

SEQ ID NO: 6418318 - DNA, 18 bp, Homo sapiens
tcctccagagcctgggcg

SEQ ID NO: 6418319 - DNA, 12 bp, Homo sapiens
tcctccagcagg

SEQ ID NO: 6418320 - DNA, 14 bp, Homo sapiens
tcctccagccaaga

SEQ ID NO: 6418321 - DNA, 14 bp, Homo sapiens
tcctccagcccacc

SEQ ID NO: 6418322 - DNA, 13 bp, Homo sapiens
tcctccagcccct

SEQ ID NO: 6418323 - DNA, 13 bp, Homo sapiens
tcctccagccctg

SEQ ID NO: 6418324 - DNA, 15 bp, Homo sapiens
tcctccagccctgcc

SEQ ID NO: 6418325 - DNA, 16 bp, Homo sapiens
tcctccagccctgggc

SEQ ID NO: 6418326 - DNA, 13 bp, Homo sapiens
tcctccagccctt

SEQ ID NO: 6418327 - DNA, 23 bp, Homo sapiens
tcctccagcctcccctcccctgg

SEQ ID NO: 6418328 - DNA, 16 bp, Homo sapiens
tcctccagctcctgcc

SEQ ID NO: 6418329 - DNA, 21 bp, Homo sapiens
tcctccagctgcaccagagca

SEQ ID NO: 6418330 - DNA, 12 bp, Homo sapiens
tcctccagctgg

SEQ ID NO: 6418331 - DNA, 14 bp, Homo sapiens
tcctccagcttctg

SEQ ID NO: 6418332 - DNA, 23 bp, Homo sapiens
tcctccaggagaaggggcccaag

SEQ ID NO: 6418333 - DNA, 21 bp, Homo sapiens
tcctccaggaggactgttcta

SEQ ID NO: 6418334 - DNA, 20 bp, Homo sapiens
tcctccaggcacgtcccgga

SEQ ID NO: 6418335 - DNA, 19 bp, Homo sapiens
tcctccaggcctgcctccc

SEQ ID NO: 6418336 - DNA, 19 bp, Homo sapiens
tcctccagggctcaacact

SEQ ID NO: 6418337 - DNA, 22 bp, Homo sapiens
tcctccagggtgattttatgat

SEQ ID NO: 6418338 - DNA, 20 bp, Homo sapiens
tcctccagggtggcagcaac

SEQ ID NO: 6418339 - DNA, 21 bp, Homo sapiens
tcctccagggtggcagcaaca

SEQ ID NO: 6418340 - DNA, 13 bp, Homo sapiens
tcctccaggtgca

SEQ ID NO: 6418341 - DNA, 20 bp, Homo sapiens
tcctccaggtgcacaagctc

SEQ ID NO: 6418342 - DNA, 16 bp, Homo sapiens
tcctccaggtttttca

SEQ ID NO: 6418343 - DNA, 18 bp, Homo sapiens
tcctccaggtttttcaat

SEQ ID NO: 6418344 - DNA, 19 bp, Homo sapiens
tcctccaggtttttcaatt

SEQ ID NO: 6418345 - DNA, 20 bp, Homo sapiens
tcctccaggtttttcaatta

SEQ ID NO: 6418346 - DNA, 21 bp, Homo sapiens
tcctccaggtttttcaattaa

SEQ ID NO: 6418347 - DNA, 22 bp, Homo sapiens
tcctccagtgtgggcttgacca

SEQ ID NO: 6418348 - DNA, 14 bp, Homo sapiens
tcctccatcacccc

SEQ ID NO: 6418349 - DNA, 19 bp, Homo sapiens
tcctccatcacccctggtg

SEQ ID NO: 6418350 - DNA, 23 bp, Homo sapiens
tcctccatcacctgaaacactgg

SEQ ID NO: 6418351 - DNA, 12 bp, Homo sapiens
tcctccatccac

SEQ ID NO: 6418352 - DNA, 19 bp, Homo sapiens
tcctccatccatgtgttcc

SEQ ID NO: 6418353 - DNA, 21 bp, Homo sapiens
tcctccatccatgtgttccaa

SEQ ID NO: 6418354 - DNA, 13 bp, Homo sapiens
tcctccatgcctg

SEQ ID NO: 6418355 - DNA, 17 bp, Homo sapiens
tcctccatgcctgacca

SEQ ID NO: 6418356 - DNA, 23 bp, Homo sapiens
tcctccatgggggctcagccagg

SEQ ID NO: 6418357 - DNA, 12 bp, Homo sapiens
tcctccatggtg

SEQ ID NO: 6418358 - DNA, 13 bp, Homo sapiens
tcctccatggtgg

SEQ ID NO: 6418359 - DNA, 20 bp, Homo sapiens
tcctccattgctgttgttgc

SEQ ID NO: 6418360 - DNA, 16 bp, Homo sapiens
tcctccattgtatctt

SEQ ID NO: 6418361 - DNA, 21 bp, Homo sapiens
tcctccatttcaactccagaa

SEQ ID NO: 6418362 - DNA, 13 bp, Homo sapiens
tcctccattttct

SEQ ID NO: 6418363 - DNA, 22 bp, Homo sapiens
tcctcccaaagtccccctcctc

SEQ ID NO: 6418364 - DNA, 22 bp, Homo sapiens
tcctcccaaccaaccagcaggg

SEQ ID NO: 6418365 - DNA, 22 bp, Homo sapiens
tcctcccaactctggccttggt

SEQ ID NO: 6418366 - DNA, 12 bp, Homo sapiens
tcctcccaagct

SEQ ID NO: 6418367 - DNA, 17 bp, Homo sapiens
tcctcccaagctgtgct

SEQ ID NO: 6418368 - DNA, 21 bp, Homo sapiens
tcctcccaaggcattctccca

SEQ ID NO: 6418369 - DNA, 20 bp, Homo sapiens
tcctcccaatttcagactcc

SEQ ID NO: 6418370 - DNA, 13 bp, Homo sapiens
tcctcccacaatc

SEQ ID NO: 6418371 - DNA, 18 bp, Homo sapiens
tcctcccacagacctgca

SEQ ID NO: 6418372 - DNA, 20 bp, Homo sapiens
tcctcccaccaccctcccac

SEQ ID NO: 6418373 - DNA, 22 bp, Homo sapiens
tcctcccaccaccctcccacca

SEQ ID NO: 6418374 - DNA, 24 bp, Homo sapiens
tcctcccaccaccctcccaccatg

SEQ ID NO: 6418375 - DNA, 21 bp, Homo sapiens
tcctcccaccagtggccccca

SEQ ID NO: 6418376 - DNA, 21 bp, Homo sapiens
tcctcccacccggctgcagag

SEQ ID NO: 6418377 - DNA, 16 bp, Homo sapiens
tcctcccactgcccac

SEQ ID NO: 6418378 - DNA, 12 bp, Homo sapiens
tcctcccacttc

SEQ ID NO: 6418379 - DNA, 20 bp, Homo sapiens
tcctcccacttcagcctccc

SEQ ID NO: 6418380 - DNA, 14 bp, Homo sapiens
tcctcccagcacag

SEQ ID NO: 6418381 - DNA, 19 bp, Homo sapiens
tcctcccagcgtgtgtatc

SEQ ID NO: 6418382 - DNA, 11 bp, Homo sapiens
tcctcccagct

SEQ ID NO: 6418383 - DNA, 12 bp, Homo sapiens
tcctcccagctg

SEQ ID NO: 6418384 - DNA, 13 bp, Homo sapiens
tcctcccagctgc

SEQ ID NO: 6418385 - DNA, 21 bp, Homo sapiens
tcctcccagctgtaccggcca

SEQ ID NO: 6418386 - DNA, 11 bp, Homo sapiens
tcctcccagga

SEQ ID NO: 6418387 - DNA, 22 bp, Homo sapiens
tcctcccaggaggtgcttgagg

SEQ ID NO: 6418388 - DNA, 22 bp, Homo sapiens
tcctcccagggcctcctggggg

SEQ ID NO: 6418389 - DNA, 19 bp, Homo sapiens
tcctcccagtgccttctgg

SEQ ID NO: 6418390 - DNA, 15 bp, Homo sapiens
tcctcccatcccctg

SEQ ID NO: 6418391 - DNA, 17 bp, Homo sapiens
tcctcccatctccttcc

SEQ ID NO: 6418392 - DNA, 13 bp, Homo sapiens
tcctcccatggcc

SEQ ID NO: 6418393 - DNA, 18 bp, Homo sapiens
tcctcccatggccttccc

SEQ ID NO: 6418394 - DNA, 20 bp, Homo sapiens
tcctcccatgtcactgcaga

SEQ ID NO: 6418395 - DNA, 17 bp, Homo sapiens
tcctcccattgcccagt

SEQ ID NO: 6418396 - DNA, 17 bp, Homo sapiens
tcctcccattttagaaa

SEQ ID NO: 6418397 - DNA, 23 bp, Homo sapiens
tatctgcttttggttataatgtg

SEQ ID NO: 6418398 - DNA, 19 bp, Homo sapiens
tatctggaacaacttgtag

SEQ ID NO: 6418399 - DNA, 22 bp, Homo sapiens
tatctggaacaacttgtagcag

SEQ ID NO: 6418400 - DNA, 18 bp, Homo sapiens
tatctggacaagccaact

SEQ ID NO: 6418401 - DNA, 14 bp, Homo sapiens
tatctggagcctga

SEQ ID NO: 6418402 - DNA, 18 bp, Homo sapiens
tatctggattcaaattta

SEQ ID NO: 6418403 - DNA, 16 bp, Homo sapiens
tatctggccacactgg

SEQ ID NO: 6418404 - DNA, 19 bp, Homo sapiens
tatctggccatatttacta

SEQ ID NO: 6418405 - DNA, 18 bp, Homo sapiens
tatctggcctaaaatctt

SEQ ID NO: 6418406 - DNA, 15 bp, Homo sapiens
tatctggcctctgct

SEQ ID NO: 6418407 - DNA, 19 bp, Homo sapiens
tatctggcttccctggaag

SEQ ID NO: 6418408 - DNA, 23 bp, Homo sapiens
tatctgggattatggttttgtga

SEQ ID NO: 6418409 - DNA, 18 bp, Homo sapiens
tatctgggctgtgggcaa

SEQ ID NO: 6418410 - DNA, 15 bp, Homo sapiens
tatctgggcttcctg

SEQ ID NO: 6418411 - DNA, 16 bp, Homo sapiens
tatctgggcttcctgg

SEQ ID NO: 6418412 - DNA, 17 bp, Homo sapiens
tatctggggagctcctg

SEQ ID NO: 6418413 - DNA, 16 bp, Homo sapiens
tatctgggttaagtgt

SEQ ID NO: 6418414 - DNA, 20 bp, Homo sapiens
tatctgggttaagtgtttat

SEQ ID NO: 6418415 - DNA, 19 bp, Homo sapiens
tatctggtatatgtcatta

SEQ ID NO: 6418416 - DNA, 11 bp, Homo sapiens
tatctggtatc

SEQ ID NO: 6418417 - DNA, 22 bp, Homo sapiens
tatctggtcaacctcctggaca

SEQ ID NO: 6418418 - DNA, 14 bp, Homo sapiens
tatctggtgcctcc

SEQ ID NO: 6418419 - DNA, 18 bp, Homo sapiens
tatctggtgcctcctcaa

SEQ ID NO: 6418420 - DNA, 18 bp, Homo sapiens
tatctgtaaatttaactg

SEQ ID NO: 6418421 - DNA, 16 bp, Homo sapiens
tatctgtaacactatt

SEQ ID NO: 6418422 - DNA, 21 bp, Homo sapiens
tatctgtaagaggtactaaaa

SEQ ID NO: 6418423 - DNA, 13 bp, Homo sapiens
tatctgtaatgat

SEQ ID NO: 6418424 - DNA, 20 bp, Homo sapiens
tatctgtaattaatattcct

SEQ ID NO: 6418425 - DNA, 19 bp, Homo sapiens
tatctgtactgaaagcaaa

SEQ ID NO: 6418426 - DNA, 21 bp, Homo sapiens
tatctgtagacggctcagtat

SEQ ID NO: 6418427 - DNA, 22 bp, Homo sapiens
tatctgtagctacactgtataa

SEQ ID NO: 6418428 - DNA, 23 bp, Homo sapiens
tatctgtagtgagatagcattgt

SEQ ID NO: 6418429 - DNA, 18 bp, Homo sapiens
tatctgtataagctgtaa

SEQ ID NO: 6418430 - DNA, 20 bp, Homo sapiens
tatctgtataagctgtaata

SEQ ID NO: 6418431 - DNA, 23 bp, Homo sapiens
tatctgtataagctgtaatatca

SEQ ID NO: 6418432 - DNA, 14 bp, Homo sapiens
tatctgtattggca

SEQ ID NO: 6418433 - DNA, 21 bp, Homo sapiens
tatctgtatttattatttgaa

SEQ ID NO: 6418434 - DNA, 22 bp, Homo sapiens
tatctgtattttcatttaacta

SEQ ID NO: 6418435 - DNA, 17 bp, Homo sapiens
tatctgtcacaataaat

SEQ ID NO: 6418436 - DNA, 16 bp, Homo sapiens
tatctgtcacacaagg

SEQ ID NO: 6418437 - DNA, 14 bp, Homo sapiens
tatctgtctacttt

SEQ ID NO: 6418438 - DNA, 20 bp, Homo sapiens
tatctgtctactttctcttg

SEQ ID NO: 6418439 - DNA, 14 bp, Homo sapiens
tatctgtctgagcc

SEQ ID NO: 6418440 - DNA, 22 bp, Homo sapiens
tatctgtctgagccctgccctc

SEQ ID NO: 6418441 - DNA, 12 bp, Homo sapiens
tatctgtcttta

SEQ ID NO: 6418442 - DNA, 16 bp, Homo sapiens
tatctgtctttatgat

SEQ ID NO: 6418443 - DNA, 16 bp, Homo sapiens
tatctgtgaaatatca

SEQ ID NO: 6418444 - DNA, 19 bp, Homo sapiens
tatctgtgaaatgctggca

SEQ ID NO: 6418445 - DNA, 18 bp, Homo sapiens
tatctgtgaggtgctgat

SEQ ID NO: 6418446 - DNA, 15 bp, Homo sapiens
tatctgtgagttctg

SEQ ID NO: 6418447 - DNA, 16 bp, Homo sapiens
tatctgtgatggatgg

SEQ ID NO: 6418448 - DNA, 17 bp, Homo sapiens
tatctgtgcaatggaat

SEQ ID NO: 6418449 - DNA, 17 bp, Homo sapiens
tatctgtgcgtgaaaca

SEQ ID NO: 6418450 - DNA, 20 bp, Homo sapiens
tatctgtgcgtgaaacacac

SEQ ID NO: 6418451 - DNA, 17 bp, Homo sapiens
tatctgtgtgccctagg

SEQ ID NO: 6418452 - DNA, 13 bp, Homo sapiens
tatctgttactcc

SEQ ID NO: 6418453 - DNA, 14 bp, Homo sapiens
tatctgttcacttt

SEQ ID NO: 6418454 - DNA, 16 bp, Homo sapiens
tatctgttcccttcct

SEQ ID NO: 6418455 - DNA, 14 bp, Homo sapiens
tatctgttctatgg

SEQ ID NO: 6418456 - DNA, 15 bp, Homo sapiens
tatctgttctatgga

SEQ ID NO: 6418457 - DNA, 18 bp, Homo sapiens
tatctgttctatggacca

SEQ ID NO: 6418458 - DNA, 12 bp, Homo sapiens
tatctgttcttg

SEQ ID NO: 6418459 - DNA, 20 bp, Homo sapiens
tatctgttctttaatttatt

SEQ ID NO: 6418460 - DNA, 18 bp, Homo sapiens
tatctgtttaaagcatat

SEQ ID NO: 6418461 - DNA, 15 bp, Homo sapiens
tatctgtttgagaaa

SEQ ID NO: 6418462 - DNA, 19 bp, Homo sapiens
tatctgtttgagaaagtca

SEQ ID NO: 6418463 - DNA, 18 bp, Homo sapiens
tatctgtttttaaagcac

SEQ ID NO: 6418464 - DNA, 13 bp, Homo sapiens
tatcttaaaaggg

SEQ ID NO: 6418465 - DNA, 19 bp, Homo sapiens
tatcttaaaatatagaaaa

SEQ ID NO: 6418466 - DNA, 15 bp, Homo sapiens
tatcttaaagcactt

SEQ ID NO: 6418467 - DNA, 16 bp, Homo sapiens
tatcttaaatatgaat

SEQ ID NO: 6418468 - DNA, 14 bp, Homo sapiens
tatcttaacactga

SEQ ID NO: 6418469 - DNA, 17 bp, Homo sapiens
tatcttaagaatgtgct

SEQ ID NO: 6418470 - DNA, 13 bp, Homo sapiens
tatcttaagcagg

SEQ ID NO: 6418471 - DNA, 14 bp, Homo sapiens
tatcttaagcatgt

SEQ ID NO: 6418472 - DNA, 18 bp, Homo sapiens
tatcttaagttctatgaa

SEQ ID NO: 6418473 - DNA, 17 bp, Homo sapiens
tatcttaattctttgtt

SEQ ID NO: 6418474 - DNA, 14 bp, Homo sapiens
tatcttaattgcaa

SEQ ID NO: 6418475 - DNA, 13 bp, Homo sapiens
tatcttaattttg

SEQ ID NO: 6418476 - DNA, 20 bp, Homo sapiens
tatcttaattttggttgtat

SEQ ID NO: 6418477 - DNA, 17 bp, Homo sapiens
tatcttacaactccccc

SEQ ID NO: 6418478 - DNA, 15 bp, Homo sapiens
tatcttacagccaga

SEQ ID NO: 6418479 - DNA, 16 bp, Homo sapiens
tatcttacagccagag

SEQ ID NO: 6418480 - DNA, 17 bp, Homo sapiens
tatcttacctagtgttt

SEQ ID NO: 6418481 - DNA, 20 bp, Homo sapiens
tatcttacctgtaaagtcta

SEQ ID NO: 6418482 - DNA, 23 bp, Homo sapiens
tatcttacgcacgatatctagtg

SEQ ID NO: 6418483 - DNA, 17 bp, Homo sapiens
tatcttactatttcaca

SEQ ID NO: 6418484 - DNA, 14 bp, Homo sapiens
tatcttagttacat

SEQ ID NO: 6418485 - DNA, 18 bp, Homo sapiens
tatcttatactgtacaat

SEQ ID NO: 6418486 - DNA, 14 bp, Homo sapiens
tatcttatcattta

SEQ ID NO: 6418487 - DNA, 21 bp, Homo sapiens
tatcttatttaatttttgcaa

SEQ ID NO: 6418488 - DNA, 12 bp, Homo sapiens
tatcttatttat

SEQ ID NO: 6418489 - DNA, 13 bp, Homo sapiens
tatcttcaaaaat

SEQ ID NO: 6418490 - DNA, 14 bp, Homo sapiens
tatcttcaaaaata

SEQ ID NO: 6418491 - DNA, 21 bp, Homo sapiens
tatcttcaaactttcactttg

SEQ ID NO: 6418492 - DNA, 14 bp, Homo sapiens
tatcttcacatagt

SEQ ID NO: 6418493 - DNA, 16 bp, Homo sapiens
tatcttcacattgtgt

SEQ ID NO: 6418494 - DNA, 22 bp, Homo sapiens
tatcttcaccctcatcctttac

SEQ ID NO: 6418495 - DNA, 13 bp, Homo sapiens
tatcttcagccca

SEQ ID NO: 6418496 - DNA, 18 bp, Homo sapiens
tatcttcagcccaggctt

SEQ ID NO: 6418497 - DNA, 13 bp, Homo sapiens
tatcttcagttta

SEQ ID NO: 6418498 - DNA, 13 bp, Homo sapiens
tatcttccaaatg

SEQ ID NO: 6418499 - DNA, 18 bp, Homo sapiens
tatcttccatatgctctt

SEQ ID NO: 6418500 - DNA, 17 bp, Homo sapiens
tatcttccatatttgga

SEQ ID NO: 6418501 - DNA, 19 bp, Homo sapiens
tatcttcccatttaacatt

SEQ ID NO: 6418502 - DNA, 20 bp, Homo sapiens
tatcttcccatttaacattg

SEQ ID NO: 6418503 - DNA, 23 bp, Homo sapiens
tatcttcccatttaacattgttt

SEQ ID NO: 6418504 - DNA, 15 bp, Homo sapiens
tatcttcctcatcag

SEQ ID NO: 6418505 - DNA, 16 bp, Homo sapiens
tatcttcctttcttgt

SEQ ID NO: 6418506 - DNA, 20 bp, Homo sapiens
tatcttcgttagtaatctgt

SEQ ID NO: 6418507 - DNA, 21 bp, Homo sapiens
tatcttcgttagtaatctgta

SEQ ID NO: 6418508 - DNA, 23 bp, Homo sapiens
tatcttcgttagtaatctgtata

SEQ ID NO: 6418509 - DNA, 17 bp, Homo sapiens
tatcttcgttcttgtta

SEQ ID NO: 6418510 - DNA, 15 bp, Homo sapiens
tatcttctcaagttc

SEQ ID NO: 6418511 - DNA, 20 bp, Homo sapiens
tatcttctcaagttctaaga

SEQ ID NO: 6418512 - DNA, 23 bp, Homo sapiens
tatcttctccattctagatgctt

SEQ ID NO: 6418513 - DNA, 14 bp, Homo sapiens
tatcttctggatta

SEQ ID NO: 6418514 - DNA, 19 bp, Homo sapiens
tatcttctgtttttctcaa

SEQ ID NO: 6418515 - DNA, 17 bp, Homo sapiens
tatcttcttcaaataca

SEQ ID NO: 6418516 - DNA, 13 bp, Homo sapiens
tatcttctttcca

SEQ ID NO: 6418517 - DNA, 20 bp, Homo sapiens
tatcttgaaacttgtgaaat

SEQ ID NO: 6418518 - DNA, 12 bp, Homo sapiens
tatcttgaagaa

SEQ ID NO: 6418519 - DNA, 14 bp, Homo sapiens
tatcttgaatttca

SEQ ID NO: 6418520 - DNA, 22 bp, Homo sapiens
tatcttgaggtggtagtaaaac

SEQ ID NO: 6418521 - DNA, 17 bp, Homo sapiens
tatcttgagtgttatgt

SEQ ID NO: 6418522 - DNA, 18 bp, Homo sapiens
tatcttgattaatgtact

SEQ ID NO: 6418523 - DNA, 19 bp, Homo sapiens
tatcttgattaatgtactt

SEQ ID NO: 6418524 - DNA, 23 bp, Homo sapiens
tatcttgcagtatcggcactgta

SEQ ID NO: 6418525 - DNA, 15 bp, Homo sapiens
tatcttgctctgtaa

SEQ ID NO: 6418526 - DNA, 18 bp, Homo sapiens
tatcttggaaaaatgcgt

SEQ ID NO: 6418527 - DNA, 17 bp, Homo sapiens
tatcttggactgacatt

SEQ ID NO: 6418528 - DNA, 13 bp, Homo sapiens
tatcttggatgag

SEQ ID NO: 6418529 - DNA, 11 bp, Homo sapiens
tatcttggcct

SEQ ID NO: 6418530 - DNA, 13 bp, Homo sapiens
tatcttgggacca

SEQ ID NO: 6418531 - DNA, 21 bp, Homo sapiens
tatcttgggtgtattctctgt

SEQ ID NO: 6418532 - DNA, 15 bp, Homo sapiens
tatcttggtttaact

SEQ ID NO: 6418533 - DNA, 16 bp, Homo sapiens
tatcttgtaaatattg

SEQ ID NO: 6418534 - DNA, 19 bp, Homo sapiens
tatcttgtatggtttgcaa

SEQ ID NO: 6418535 - DNA, 17 bp, Homo sapiens
tatcttgtctctgggct

SEQ ID NO: 6418536 - DNA, 14 bp, Homo sapiens
tatcttgtgtatgg

SEQ ID NO: 6418537 - DNA, 16 bp, Homo sapiens
tatcttgtttacaata

SEQ ID NO: 6418538 - DNA, 14 bp, Homo sapiens
tatcttgtttttcc

SEQ ID NO: 6418539 - DNA, 21 bp, Homo sapiens
tatctttaaagccgtgctctt

SEQ ID NO: 6418540 - DNA, 19 bp, Homo sapiens
tatctttaaatgatgtaca

SEQ ID NO: 6418541 - DNA, 18 bp, Homo sapiens
tatctttaacaattgtct

SEQ ID NO: 6418542 - DNA, 21 bp, Homo sapiens
tatctttaacaattgtcttaa

SEQ ID NO: 6418543 - DNA, 17 bp, Homo sapiens
tatctttagatatttgc

SEQ ID NO: 6418544 - DNA, 19 bp, Homo sapiens
tatctttagatatttgcct

SEQ ID NO: 6418545 - DNA, 16 bp, Homo sapiens
tatctttagttgaatt

SEQ ID NO: 6418546 - DNA, 21 bp, Homo sapiens
tatctttataggcagtagact

SEQ ID NO: 6418547 - DNA, 15 bp, Homo sapiens
tatctttatgcaaaa

SEQ ID NO: 6418548 - DNA, 14 bp, Homo sapiens
tatctttattaatc

SEQ ID NO: 6418549 - DNA, 16 bp, Homo sapiens
tatctttcacctttct

SEQ ID NO: 6418550 - DNA, 21 bp, Homo sapiens
tatctttcaggaaatttttgc

SEQ ID NO: 6418551 - DNA, 12 bp, Homo sapiens
tatctttcagtt

SEQ ID NO: 6418552 - DNA, 12 bp, Homo sapiens
tatctttcctcc

SEQ ID NO: 6418553 - DNA, 14 bp, Homo sapiens
tatctttcctccct

SEQ ID NO: 6418554 - DNA, 16 bp, Homo sapiens
tatctttctaaaactg

SEQ ID NO: 6418555 - DNA, 13 bp, Homo sapiens
tatctttctacag

SEQ ID NO: 6418556 - DNA, 13 bp, Homo sapiens
tatctttctttcc

SEQ ID NO: 6418557 - DNA, 15 bp, Homo sapiens
tatctttctttccat

SEQ ID NO: 6418558 - DNA, 17 bp, Homo sapiens
tatctttctttctctaa

SEQ ID NO: 6418559 - DNA, 23 bp, Homo sapiens
tatctttgaatggtcttctgcca

SEQ ID NO: 6418560 - DNA, 18 bp, Homo sapiens
tatctttgagttcaacct

SEQ ID NO: 6418561 - DNA, 14 bp, Homo sapiens
tatctttgccaccc

SEQ ID NO: 6418562 - DNA, 16 bp, Homo sapiens
tatctttgccaccctc

SEQ ID NO: 6418563 - DNA, 22 bp, Homo sapiens
tatctttggttatcctgtttga

SEQ ID NO: 6418564 - DNA, 17 bp, Homo sapiens
tatctttgtaattattt

SEQ ID NO: 6418565 - DNA, 18 bp, Homo sapiens
tatctttgtattcttcat

SEQ ID NO: 6418566 - DNA, 18 bp, Homo sapiens
tatctttgtgtaatctaa

SEQ ID NO: 6418567 - DNA, 17 bp, Homo sapiens
tatcttttatgtttgaa

SEQ ID NO: 6418568 - DNA, 21 bp, Homo sapiens
tatcttttcatacattttcta

SEQ ID NO: 6418569 - DNA, 19 bp, Homo sapiens
tatcttttccacaaatatg

SEQ ID NO: 6418570 - DNA, 13 bp, Homo sapiens
tatcttttcttta

SEQ ID NO: 6418571 - DNA, 15 bp, Homo sapiens
tatcttttctttaga

SEQ ID NO: 6418572 - DNA, 17 bp, Homo sapiens
tatcttttgtttccttt

SEQ ID NO: 6418573 - DNA, 18 bp, Homo sapiens
tatctttttaaaaactct

SEQ ID NO: 6418574 - DNA, 18 bp, Homo sapiens
tatctttttacctttcat

SEQ ID NO: 6418575 - DNA, 23 bp, Homo sapiens
tatgaaaaaaaaattatttgcct

SEQ ID NO: 6418576 - DNA, 19 bp, Homo sapiens
tatgaaaaaaatatatttt

SEQ ID NO: 6418577 - DNA, 17 bp, Homo sapiens
tcctccccaacctgcaa

SEQ ID NO: 6418578 - DNA, 14 bp, Homo sapiens
tcctccccacactc

SEQ ID NO: 6418579 - DNA, 13 bp, Homo sapiens
tcctccccaccag

SEQ ID NO: 6418580 - DNA, 18 bp, Homo sapiens
tcctccccaccagagctg

SEQ ID NO: 6418581 - DNA, 23 bp, Homo sapiens
tcctccccaccagagctgcctcc

SEQ ID NO: 6418582 - DNA, 14 bp, Homo sapiens
tcctccccaccagt

SEQ ID NO: 6418583 - DNA, 23 bp, Homo sapiens
tcctccccaccagtctcacccac

SEQ ID NO: 6418584 - DNA, 14 bp, Homo sapiens
tcctccccaccctg

SEQ ID NO: 6418585 - DNA, 18 bp, Homo sapiens
tcctccccaccctgtccc

SEQ ID NO: 6418586 - DNA, 23 bp, Homo sapiens
tcctccccaccctgtcccaggca

SEQ ID NO: 6418587 - DNA, 13 bp, Homo sapiens
tcctccccacctg

SEQ ID NO: 6418588 - DNA, 14 bp, Homo sapiens
tcctccccacctgt

SEQ ID NO: 6418589 - DNA, 15 bp, Homo sapiens
tcctccccacctgta

SEQ ID NO: 6418590 - DNA, 10 bp, Homo sapiens
tcctccccag

SEQ ID NO: 6418591 - DNA, 16 bp, Homo sapiens
tcctccccagagctgg

SEQ ID NO: 6418592 - DNA, 18 bp, Homo sapiens
tcctccccagagctggcg

SEQ ID NO: 6418593 - DNA, 16 bp, Homo sapiens
tcctccccagcaggtg

SEQ ID NO: 6418594 - DNA, 20 bp, Homo sapiens
tcctccccagccccctggca

SEQ ID NO: 6418595 - DNA, 20 bp, Homo sapiens
tcctccccaggacttggtct

SEQ ID NO: 6418596 - DNA, 15 bp, Homo sapiens
tcctccccattccta

SEQ ID NO: 6418597 - DNA, 14 bp, Homo sapiens
tcctcccccacccc

SEQ ID NO: 6418598 - DNA, 24 bp, Homo sapiens
tcctcccccaccttcaagcaccct

SEQ ID NO: 6418599 - DNA, 22 bp, Homo sapiens
tcctcccccggctgggcctcct

SEQ ID NO: 6418600 - DNA, 21 bp, Homo sapiens
tcctccccctcctagggggtg

SEQ ID NO: 6418601 - DNA, 17 bp, Homo sapiens
tcctccccctcctccat

SEQ ID NO: 6418602 - DNA, 15 bp, Homo sapiens
tcctccccctgcaac

SEQ ID NO: 6418603 - DNA, 24 bp, Homo sapiens
tcctccccctgccagtgccttacc

SEQ ID NO: 6418604 - DNA, 18 bp, Homo sapiens
tcctccccctgctcccct

SEQ ID NO: 6418605 - DNA, 14 bp, Homo sapiens
tcctccccctgttc

SEQ ID NO: 6418606 - DNA, 22 bp, Homo sapiens
tcctccccctgttctgttgggg

SEQ ID NO: 6418607 - DNA, 12 bp, Homo sapiens
tcctcccccttt

SEQ ID NO: 6418608 - DNA, 17 bp, Homo sapiens
tcctccccctttggggt

SEQ ID NO: 6418609 - DNA, 23 bp, Homo sapiens
tcctccccgatccccgacagtgg

SEQ ID NO: 6418610 - DNA, 20 bp, Homo sapiens
tcctccccgcctcctcccac

SEQ ID NO: 6418611 - DNA, 21 bp, Homo sapiens
tcctccccgctccgtctctgt

SEQ ID NO: 6418612 - DNA, 14 bp, Homo sapiens
tcctcccctactct

SEQ ID NO: 6418613 - DNA, 17 bp, Homo sapiens
tcctcccctattttaag

SEQ ID NO: 6418614 - DNA, 23 bp, Homo sapiens
tcctcccctcacagcctctgacc

SEQ ID NO: 6418615 - DNA, 16 bp, Homo sapiens
tcctcccctcctcctg

SEQ ID NO: 6418616 - DNA, 14 bp, Homo sapiens
tcctcccctctcct

SEQ ID NO: 6418617 - DNA, 17 bp, Homo sapiens
tcctcccctctcttgtc

SEQ ID NO: 6418618 - DNA, 15 bp, Homo sapiens
tcctcccctcttgag

SEQ ID NO: 6418619 - DNA, 10 bp, Homo sapiens
tcctcccctg

SEQ ID NO: 6418620 - DNA, 15 bp, Homo sapiens
tcctcccctgccgcc

SEQ ID NO: 6418621 - DNA, 15 bp, Homo sapiens
tcctcccctggactc

SEQ ID NO: 6418622 - DNA, 14 bp, Homo sapiens
tcctcccctggagg

SEQ ID NO: 6418623 - DNA, 21 bp, Homo sapiens
tcctcccctggcaactgctga

SEQ ID NO: 6418624 - DNA, 10 bp, Homo sapiens
tcctcccctt

SEQ ID NO: 6418625 - DNA, 12 bp, Homo sapiens
tcctccccttcc

SEQ ID NO: 6418626 - DNA, 13 bp, Homo sapiens
tcctccccttccc

SEQ ID NO: 6418627 - DNA, 14 bp, Homo sapiens
tcctccccttcctg

SEQ ID NO: 6418628 - DNA, 16 bp, Homo sapiens
tcctccccttcctgca

SEQ ID NO: 6418629 - DNA, 18 bp, Homo sapiens
tcctccccttcctgcacc

SEQ ID NO: 6418630 - DNA, 14 bp, Homo sapiens
tcctccccttgggc

SEQ ID NO: 6418631 - DNA, 20 bp, Homo sapiens
tcctccccttttaccactcc

SEQ ID NO: 6418632 - DNA, 18 bp, Homo sapiens
tcctcccgccaggagctt

SEQ ID NO: 6418633 - DNA, 19 bp, Homo sapiens
tcctcccgccccagcctcc

SEQ ID NO: 6418634 - DNA, 19 bp, Homo sapiens
tcctcccgccccgcccctc

SEQ ID NO: 6418635 - DNA, 19 bp, Homo sapiens
tcctcccgcccttccatgt

SEQ ID NO: 6418636 - DNA, 18 bp, Homo sapiens
tcctcccggctccctcct

SEQ ID NO: 6418637 - DNA, 19 bp, Homo sapiens
tcctcccggggccttcctt

SEQ ID NO: 6418638 - DNA, 16 bp, Homo sapiens
tcctccctacttccaa

SEQ ID NO: 6418639 - DNA, 12 bp, Homo sapiens
tcctccctagct

SEQ ID NO: 6418640 - DNA, 9 bp, Homo sapiens
tcctccctc

SEQ ID NO: 6418641 - DNA, 18 bp, Homo sapiens
tcctccctcagacccagg

SEQ ID NO: 6418642 - DNA, 16 bp, Homo sapiens
tcctccctcagactca

SEQ ID NO: 6418643 - DNA, 17 bp, Homo sapiens
tcctccctcagactcag

SEQ ID NO: 6418644 - DNA, 14 bp, Homo sapiens
tcctccctcagcct

SEQ ID NO: 6418645 - DNA, 16 bp, Homo sapiens
tcctccctcagcctcc

SEQ ID NO: 6418646 - DNA, 14 bp, Homo sapiens
tcctccctcaggcc

SEQ ID NO: 6418647 - DNA, 15 bp, Homo sapiens
tcctccctcagtgcc

SEQ ID NO: 6418648 - DNA, 14 bp, Homo sapiens
tcctccctccagct

SEQ ID NO: 6418649 - DNA, 17 bp, Homo sapiens
tcctccctccagctgcg

SEQ ID NO: 6418650 - DNA, 14 bp, Homo sapiens
tcctccctcccaag

SEQ ID NO: 6418651 - DNA, 13 bp, Homo sapiens
tcctccctcccag

SEQ ID NO: 6418652 - DNA, 17 bp, Homo sapiens
tcctccctcccagctgc

SEQ ID NO: 6418653 - DNA, 10 bp, Homo sapiens
tcctccctct

SEQ ID NO: 6418654 - DNA, 16 bp, Homo sapiens
tcctccctctgaccca

SEQ ID NO: 6418655 - DNA, 18 bp, Homo sapiens
tcctccctctgaggctgt

SEQ ID NO: 6418656 - DNA, 23 bp, Homo sapiens
tcctccctctgcctcatcctcct

SEQ ID NO: 6418657 - DNA, 17 bp, Homo sapiens
tcctccctgaccctgct

SEQ ID NO: 6418658 - DNA, 21 bp, Homo sapiens
tcctccctgaccctgctccta

SEQ ID NO: 6418659 - DNA, 20 bp, Homo sapiens
tcctccctgacttttctgtg

SEQ ID NO: 6418660 - DNA, 14 bp, Homo sapiens
tcctccctgcatct

SEQ ID NO: 6418661 - DNA, 13 bp, Homo sapiens
tcctccctgccca

SEQ ID NO: 6418662 - DNA, 14 bp, Homo sapiens
tcctccctgccctc

SEQ ID NO: 6418663 - DNA, 13 bp, Homo sapiens
tcctccctgctca

SEQ ID NO: 6418664 - DNA, 15 bp, Homo sapiens
tcctccctgctcagc

SEQ ID NO: 6418665 - DNA, 18 bp, Homo sapiens
tcctccctgctcctcatg

SEQ ID NO: 6418666 - DNA, 19 bp, Homo sapiens
tcctccctgctcctcatgg

SEQ ID NO: 6418667 - DNA, 20 bp, Homo sapiens
tcctccctgctcctcatggg

SEQ ID NO: 6418668 - DNA, 13 bp, Homo sapiens
tcctccctggctg

SEQ ID NO: 6418669 - DNA, 15 bp, Homo sapiens
tcctccctggctgca

SEQ ID NO: 6418670 - DNA, 17 bp, Homo sapiens
tcctccctggctgcagc

SEQ ID NO: 6418671 - DNA, 19 bp, Homo sapiens
tcctccctggctgccctgg

SEQ ID NO: 6418672 - DNA, 12 bp, Homo sapiens
tcctccctgggg

SEQ ID NO: 6418673 - DNA, 13 bp, Homo sapiens
tcctccctggggg

SEQ ID NO: 6418674 - DNA, 20 bp, Homo sapiens
tcctccctgtgcccccagcc

SEQ ID NO: 6418675 - DNA, 20 bp, Homo sapiens
tcctccctgttccccacagg

SEQ ID NO: 6418676 - DNA, 14 bp, Homo sapiens
tcctcccttagctc

SEQ ID NO: 6418677 - DNA, 13 bp, Homo sapiens
tcctcccttctgc

SEQ ID NO: 6418678 - DNA, 17 bp, Homo sapiens
tcctcccttctgctact

SEQ ID NO: 6418679 - DNA, 23 bp, Homo sapiens
tcctcccttgagaattccctgtg

SEQ ID NO: 6418680 - DNA, 21 bp, Homo sapiens
tcctcccttgccccaggccag

SEQ ID NO: 6418681 - DNA, 17 bp, Homo sapiens
tcctccctttttccttg

SEQ ID NO: 6418682 - DNA, 15 bp, Homo sapiens
tcctccgaggccagt

SEQ ID NO: 6418683 - DNA, 16 bp, Homo sapiens
tcctccgcctactgtc

SEQ ID NO: 6418684 - DNA, 20 bp, Homo sapiens
tcctccgcggaggcccctga

SEQ ID NO: 6418685 - DNA, 19 bp, Homo sapiens
tcctccgctcccctttccc

SEQ ID NO: 6418686 - DNA, 22 bp, Homo sapiens
tcctccgctcccctttcccatc

SEQ ID NO: 6418687 - DNA, 15 bp, Homo sapiens
tcctccggagcctca

SEQ ID NO: 6418688 - DNA, 15 bp, Homo sapiens
tcctccggctggacc

SEQ ID NO: 6418689 - DNA, 22 bp, Homo sapiens
tcctccggggctcagccctgag

SEQ ID NO: 6418690 - DNA, 19 bp, Homo sapiens
tcctccgtagggtctttct

SEQ ID NO: 6418691 - DNA, 23 bp, Homo sapiens
tcctccgtagggtctttcttggg

SEQ ID NO: 6418692 - DNA, 15 bp, Homo sapiens
tcctccgtccaccca

SEQ ID NO: 6418693 - DNA, 14 bp, Homo sapiens
tcctccgtccagcc

SEQ ID NO: 6418694 - DNA, 16 bp, Homo sapiens
tcctccgtgagcacca

SEQ ID NO: 6418695 - DNA, 13 bp, Homo sapiens
tcctccgtgggca

SEQ ID NO: 6418696 - DNA, 16 bp, Homo sapiens
tcctccgtgggcagct

SEQ ID NO: 6418697 - DNA, 23 bp, Homo sapiens
tcctccgtgtctcgcgcgactga

SEQ ID NO: 6418698 - DNA, 17 bp, Homo sapiens
tcctcctaaagacctcc

SEQ ID NO: 6418699 - DNA, 23 bp, Homo sapiens
tcctcctacctcagcctcctggg

SEQ ID NO: 6418700 - DNA, 12 bp, Homo sapiens
tcctcctacctg

SEQ ID NO: 6418701 - DNA, 16 bp, Homo sapiens
tcctcctaccttttgt

SEQ ID NO: 6418702 - DNA, 20 bp, Homo sapiens
tcctcctaccttttgtctct

SEQ ID NO: 6418703 - DNA, 16 bp, Homo sapiens
tcctcctagctggagt

SEQ ID NO: 6418704 - DNA, 20 bp, Homo sapiens
tcctcctaggaaaccagctc

SEQ ID NO: 6418705 - DNA, 21 bp, Homo sapiens
tcctcctaggaaaccagctcg

SEQ ID NO: 6418706 - DNA, 19 bp, Homo sapiens
tcctcctaggcgctcagag

SEQ ID NO: 6418707 - DNA, 18 bp, Homo sapiens
tcctcctcacctcatgcc

SEQ ID NO: 6418708 - DNA, 19 bp, Homo sapiens
tcctcctcagctgcatgga

SEQ ID NO: 6418709 - DNA, 20 bp, Homo sapiens
tcctcctcagtcttctcagt

SEQ ID NO: 6418710 - DNA, 17 bp, Homo sapiens
tcctcctcattcagacc

SEQ ID NO: 6418711 - DNA, 12 bp, Homo sapiens
tcctcctccaca

SEQ ID NO: 6418712 - DNA, 11 bp, Homo sapiens
tcctcctccag

SEQ ID NO: 6418713 - DNA, 15 bp, Homo sapiens
tcctcctccagggac

SEQ ID NO: 6418714 - DNA, 17 bp, Homo sapiens
tcctcctccagggacag

SEQ ID NO: 6418715 - DNA, 16 bp, Homo sapiens
tcctcctcccagtgcc

SEQ ID NO: 6418716 - DNA, 15 bp, Homo sapiens
tcctcctccccagct

SEQ ID NO: 6418717 - DNA, 13 bp, Homo sapiens
tcctcctcccctc

SEQ ID NO: 6418718 - DNA, 14 bp, Homo sapiens
tcctcctcccctcc

SEQ ID NO: 6418719 - DNA, 14 bp, Homo sapiens
tcctcctcccctgg

SEQ ID NO: 6418720 - DNA, 13 bp, Homo sapiens
tcctcctccctcc

SEQ ID NO: 6418721 - DNA, 18 bp, Homo sapiens
tcctcctccctgcatctg

SEQ ID NO: 6418722 - DNA, 16 bp, Homo sapiens
tcctcctcctcctcct

SEQ ID NO: 6418723 - DNA, 12 bp, Homo sapiens
tcctcctcctgc

SEQ ID NO: 6418724 - DNA, 18 bp, Homo sapiens
tcctcctccttcctagtt

SEQ ID NO: 6418725 - DNA, 13 bp, Homo sapiens
tcctcctcctttc

SEQ ID NO: 6418726 - DNA, 22 bp, Homo sapiens
tcctcctcggaaccgctcacct

SEQ ID NO: 6418727 - DNA, 19 bp, Homo sapiens
tcctcctctacctctctcc

SEQ ID NO: 6418728 - DNA, 16 bp, Homo sapiens
tcctcctctcaaacct

SEQ ID NO: 6418729 - DNA, 14 bp, Homo sapiens
tcctcctctccatg

SEQ ID NO: 6418730 - DNA, 16 bp, Homo sapiens
tcctcctctccatgca

SEQ ID NO: 6418731 - DNA, 21 bp, Homo sapiens
tcctcctctccatgcaagtgc

SEQ ID NO: 6418732 - DNA, 14 bp, Homo sapiens
tcctcctctcctgg

SEQ ID NO: 6418733 - DNA, 14 bp, Homo sapiens
tcctcctctgactt

SEQ ID NO: 6418734 - DNA, 12 bp, Homo sapiens
tcctcctctgag

SEQ ID NO: 6418735 - DNA, 11 bp, Homo sapiens
tcctcctctgc

SEQ ID NO: 6418736 - DNA, 13 bp, Homo sapiens
tcctcctctgcct

SEQ ID NO: 6418737 - DNA, 14 bp, Homo sapiens
tcctcctctgccta

SEQ ID NO: 6418738 - DNA, 12 bp, Homo sapiens
tcctcctctgtg

SEQ ID NO: 6418739 - DNA, 14 bp, Homo sapiens
tcctcctctgtgaa

SEQ ID NO: 6418740 - DNA, 12 bp, Homo sapiens
tcctcctcttca

SEQ ID NO: 6418741 - DNA, 21 bp, Homo sapiens
tcctcctcttcaccaggtgca

SEQ ID NO: 6418742 - DNA, 16 bp, Homo sapiens
tcctcctctttctctc

SEQ ID NO: 6418743 - DNA, 17 bp, Homo sapiens
tcctcctctttctctcc

SEQ ID NO: 6418744 - DNA, 21 bp, Homo sapiens
tcctcctgaagcctctgccct

SEQ ID NO: 6418745 - DNA, 18 bp, Homo sapiens
tcctcctgaaggaggcgg

SEQ ID NO: 6418746 - DNA, 13 bp, Homo sapiens
tcctcctgacacc

SEQ ID NO: 6418747 - DNA, 22 bp, Homo sapiens
tcctcctgacaccccacttagc

SEQ ID NO: 6418748 - DNA, 16 bp, Homo sapiens
tcctcctgactcttca

SEQ ID NO: 6418749 - DNA, 15 bp, Homo sapiens
tcctcctgagagctg

SEQ ID NO: 6418750 - DNA, 18 bp, Homo sapiens
tcctcctgagagctgttc

SEQ ID NO: 6418751 - DNA, 20 bp, Homo sapiens
tcctcctgcagaccacgccc

SEQ ID NO: 6418752 - DNA, 16 bp, Homo sapiens
tcctcctgccagctct

SEQ ID NO: 6418753 - DNA, 20 bp, Homo sapiens
tcctcctgccagctctgtca

SEQ ID NO: 6418754 - DNA, 21 bp, Homo sapiens
tcctcctgccagctctgtcac

SEQ ID NO: 6418755 - DNA, 20 bp, Homo sapiens
tcctcctgcccagctcctca

SEQ ID NO: 6418756 - DNA, 21 bp, Homo sapiens
tcctcctgcccagctcctcac

SEQ ID NO: 6418757 - DNA, 19 bp, Homo sapiens
tcctcctgcccccacccca

SEQ ID NO: 6418758 - DNA, 20 bp, Homo sapiens
tcctcctgcccccaccccag

SEQ ID NO: 6418759 - DNA, 16 bp, Homo sapiens
tatgaaaaaatgttca

SEQ ID NO: 6418760 - DNA, 15 bp, Homo sapiens
tatgaaaaacatccc

SEQ ID NO: 6418761 - DNA, 21 bp, Homo sapiens
tatgaaaaactcttctacttt

SEQ ID NO: 6418762 - DNA, 15 bp, Homo sapiens
tatgaaaaagaagaa

SEQ ID NO: 6418763 - DNA, 22 bp, Homo sapiens
tatgaaaacaatactaaataaa

SEQ ID NO: 6418764 - DNA, 20 bp, Homo sapiens
tatgaaaacaccactgaaca

SEQ ID NO: 6418765 - DNA, 13 bp, Homo sapiens
tatgaaaacatgg

SEQ ID NO: 6418766 - DNA, 20 bp, Homo sapiens
tatgaaaacatggaacagtg

SEQ ID NO: 6418767 - DNA, 16 bp, Homo sapiens
tatgaaaaccaaattt

SEQ ID NO: 6418768 - DNA, 17 bp, Homo sapiens
tatgaaaaccagtggct

SEQ ID NO: 6418769 - DNA, 23 bp, Homo sapiens
tatgaaaaccgtaaagtgcctta

SEQ ID NO: 6418770 - DNA, 15 bp, Homo sapiens
tatgaaaacttatga

SEQ ID NO: 6418771 - DNA, 14 bp, Homo sapiens
tatgaaaagataac

SEQ ID NO: 6418772 - DNA, 17 bp, Homo sapiens
tatgaaaagcaactgag

SEQ ID NO: 6418773 - DNA, 19 bp, Homo sapiens
tatgaaaagctatcttaaa

SEQ ID NO: 6418774 - DNA, 17 bp, Homo sapiens
tatgaaaatatagacat

SEQ ID NO: 6418775 - DNA, 22 bp, Homo sapiens
tatgaaaatcctatatctgttt

SEQ ID NO: 6418776 - DNA, 19 bp, Homo sapiens
tatgaaaatgagcatcaga

SEQ ID NO: 6418777 - DNA, 15 bp, Homo sapiens
tatgaaaatgagccc

SEQ ID NO: 6418778 - DNA, 17 bp, Homo sapiens
tatgaaaatgagccctg

SEQ ID NO: 6418779 - DNA, 20 bp, Homo sapiens
tatgaaaatgagttgtgaaa

SEQ ID NO: 6418780 - DNA, 20 bp, Homo sapiens
tatgaaacaaatatactcat

SEQ ID NO: 6418781 - DNA, 22 bp, Homo sapiens
tatgaaacaaatatactcattt

SEQ ID NO: 6418782 - DNA, 18 bp, Homo sapiens
tatgaaacaatcttccaa

SEQ ID NO: 6418783 - DNA, 20 bp, Homo sapiens
tatgaaacaatcttccaaag

SEQ ID NO: 6418784 - DNA, 16 bp, Homo sapiens
tatgaaacgaatataa

SEQ ID NO: 6418785 - DNA, 19 bp, Homo sapiens
tatgaaactcatctgtaaa

SEQ ID NO: 6418786 - DNA, 19 bp, Homo sapiens
tatgaaactctacatttaa

SEQ ID NO: 6418787 - DNA, 22 bp, Homo sapiens
tatgaaactctacatttaaaca

SEQ ID NO: 6418788 - DNA, 21 bp, Homo sapiens
tatgaaactggtttataataa

SEQ ID NO: 6418789 - DNA, 19 bp, Homo sapiens
tatgaaacttgtgtaaata

SEQ ID NO: 6418790 - DNA, 22 bp, Homo sapiens
tatgaaagagaaaatgctttct

SEQ ID NO: 6418791 - DNA, 15 bp, Homo sapiens
tatgaaagaggcagc

SEQ ID NO: 6418792 - DNA, 23 bp, Homo sapiens
tatgaaagatggctgtgcctctg

SEQ ID NO: 6418793 - DNA, 17 bp, Homo sapiens
tatgaaagattgtgggg

SEQ ID NO: 6418794 - DNA, 21 bp, Homo sapiens
tatgaaagcaacaactttgtt

SEQ ID NO: 6418795 - DNA, 14 bp, Homo sapiens
tatgaaataaagaa

SEQ ID NO: 6418796 - DNA, 17 bp, Homo sapiens
tatgaaataaattctga

SEQ ID NO: 6418797 - DNA, 14 bp, Homo sapiens
tatgaaataagtaa

SEQ ID NO: 6418798 - DNA, 16 bp, Homo sapiens
tatgaaataagtaaat

SEQ ID NO: 6418799 - DNA, 15 bp, Homo sapiens
tatgaaatataaatt

SEQ ID NO: 6418800 - DNA, 15 bp, Homo sapiens
tatgaaatattttga

SEQ ID NO: 6418801 - DNA, 19 bp, Homo sapiens
tatgaaatcatagtatatg

SEQ ID NO: 6418802 - DNA, 21 bp, Homo sapiens
tatgaaatgataaagatgtca

SEQ ID NO: 6418803 - DNA, 17 bp, Homo sapiens
tatgaaatgccactggg

SEQ ID NO: 6418804 - DNA, 14 bp, Homo sapiens
tatgaaatgccaga

SEQ ID NO: 6418805 - DNA, 17 bp, Homo sapiens
tatgaaatgtgcacttt

SEQ ID NO: 6418806 - DNA, 14 bp, Homo sapiens
tatgaaatgtttca

SEQ ID NO: 6418807 - DNA, 17 bp, Homo sapiens
tatgaaattaacaagaa

SEQ ID NO: 6418808 - DNA, 18 bp, Homo sapiens
tatgaaattccagcaata

SEQ ID NO: 6418809 - DNA, 23 bp, Homo sapiens
tatgaaattccagcaataagaaa

SEQ ID NO: 6418810 - DNA, 20 bp, Homo sapiens
tatgaacaaagaaaaaaata

SEQ ID NO: 6418811 - DNA, 14 bp, Homo sapiens
tatgaacaactcca

SEQ ID NO: 6418812 - DNA, 17 bp, Homo sapiens
tatgaacagaaatattg

SEQ ID NO: 6418813 - DNA, 13 bp, Homo sapiens
tatgaacagctgt

SEQ ID NO: 6418814 - DNA, 21 bp, Homo sapiens
tatgaacagggcccaggcctg

SEQ ID NO: 6418815 - DNA, 17 bp, Homo sapiens
tatgaacatacaaatgc

SEQ ID NO: 6418816 - DNA, 19 bp, Homo sapiens
tatgaacatattgttgaaa

SEQ ID NO: 6418817 - DNA, 10 bp, Homo sapiens
tatgaacatc

SEQ ID NO: 6418818 - DNA, 21 bp, Homo sapiens
tatgaacatggagaggacttt

SEQ ID NO: 6418819 - DNA, 13 bp, Homo sapiens
tatgaacattgta

SEQ ID NO: 6418820 - DNA, 14 bp, Homo sapiens
tatgaacattgtac

SEQ ID NO: 6418821 - DNA, 16 bp, Homo sapiens
tatgaacattgtactg

SEQ ID NO: 6418822 - DNA, 18 bp, Homo sapiens
tatgaacattgtactgtt

SEQ ID NO: 6418823 - DNA, 23 bp, Homo sapiens
tatgaacattgtactgttgcttt

SEQ ID NO: 6418824 - DNA, 23 bp, Homo sapiens
tatgaacccttcctgagctttat

SEQ ID NO: 6418825 - DNA, 19 bp, Homo sapiens
tatgaaccctttgtttctt

SEQ ID NO: 6418826 - DNA, 15 bp, Homo sapiens
tatgaacctattttc

SEQ ID NO: 6418827 - DNA, 21 bp, Homo sapiens
tatgaacctattttcatttgt

SEQ ID NO: 6418828 - DNA, 19 bp, Homo sapiens
tatgaacgcacaacatgca

SEQ ID NO: 6418829 - DNA, 23 bp, Homo sapiens
tatgaactacaggtgtttgactt

SEQ ID NO: 6418830 - DNA, 14 bp, Homo sapiens
tatgaacttaacat

SEQ ID NO: 6418831 - DNA, 20 bp, Homo sapiens
tatgaacttgagatctgtat

SEQ ID NO: 6418832 - DNA, 22 bp, Homo sapiens
tatgaacttgagatctgtataa

SEQ ID NO: 6418833 - DNA, 20 bp, Homo sapiens
tatgaactttatagttgttt

SEQ ID NO: 6418834 - DNA, 21 bp, Homo sapiens
tatgaagaaaaagtacaatga

SEQ ID NO: 6418835 - DNA, 15 bp, Homo sapiens
tatgaagaaaatact

SEQ ID NO: 6418836 - DNA, 16 bp, Homo sapiens
tatgaagaaaatactt

SEQ ID NO: 6418837 - DNA, 22 bp, Homo sapiens
tatgaagaaaatacttaaatgt

SEQ ID NO: 6418838 - DNA, 18 bp, Homo sapiens
tatgaagaatacccagga

SEQ ID NO: 6418839 - DNA, 21 bp, Homo sapiens
tatgaagaatacccaggaaga

SEQ ID NO: 6418840 - DNA, 19 bp, Homo sapiens
tatgaagacagaggcagag

SEQ ID NO: 6418841 - DNA, 18 bp, Homo sapiens
tatgaagagtattaatgt

SEQ ID NO: 6418842 - DNA, 19 bp, Homo sapiens
tatgaagataagtgtattt

SEQ ID NO: 6418843 - DNA, 19 bp, Homo sapiens
tatgaagatgtttttagag

SEQ ID NO: 6418844 - DNA, 17 bp, Homo sapiens
tatgaagcaagctgtgt

SEQ ID NO: 6418845 - DNA, 20 bp, Homo sapiens
tatgaagcaagctgtgttac

SEQ ID NO: 6418846 - DNA, 21 bp, Homo sapiens
tatgaagcaagctgtgttact

SEQ ID NO: 6418847 - DNA, 19 bp, Homo sapiens
tatgaagcagaatgagatg

SEQ ID NO: 6418848 - DNA, 15 bp, Homo sapiens
tatgaagcagattta

SEQ ID NO: 6418849 - DNA, 17 bp, Homo sapiens
tatgaagccaactgaca

SEQ ID NO: 6418850 - DNA, 18 bp, Homo sapiens
tatgaagccaactgacaa

SEQ ID NO: 6418851 - DNA, 20 bp, Homo sapiens
tatgaagccaactgacaaag

SEQ ID NO: 6418852 - DNA, 21 bp, Homo sapiens
tatgaagctacctcaaacttc

SEQ ID NO: 6418853 - DNA, 22 bp, Homo sapiens
tatgaagcttttatgtgaaaca

SEQ ID NO: 6418854 - DNA, 23 bp, Homo sapiens
tatgaagcttttatgtgaaacat

SEQ ID NO: 6418855 - DNA, 21 bp, Homo sapiens
tatgaagggacagctgctggg

SEQ ID NO: 6418856 - DNA, 22 bp, Homo sapiens
tatgaagggccttgagcatctg

SEQ ID NO: 6418857 - DNA, 14 bp, Homo sapiens
tatgaagtaaagaa

SEQ ID NO: 6418858 - DNA, 20 bp, Homo sapiens
tatgaagtaaagaactgcac

SEQ ID NO: 6418859 - DNA, 15 bp, Homo sapiens
tatgaagtactttta

SEQ ID NO: 6418860 - DNA, 16 bp, Homo sapiens
tatgaagtataaatct

SEQ ID NO: 6418861 - DNA, 15 bp, Homo sapiens
tatgaagtatataat

SEQ ID NO: 6418862 - DNA, 16 bp, Homo sapiens
tatgaagtatctaaaa

SEQ ID NO: 6418863 - DNA, 14 bp, Homo sapiens
tatgaagtgtgggg

SEQ ID NO: 6418864 - DNA, 20 bp, Homo sapiens
tatgaagttggcacatttca

SEQ ID NO: 6418865 - DNA, 18 bp, Homo sapiens
tatgaagtttaaaacagt

SEQ ID NO: 6418866 - DNA, 21 bp, Homo sapiens
tatgaagtttaaaacagtatt

SEQ ID NO: 6418867 - DNA, 16 bp, Homo sapiens
tatgaataaaaggctg

SEQ ID NO: 6418868 - DNA, 17 bp, Homo sapiens
tatgaataaagaatgcc

SEQ ID NO: 6418869 - DNA, 18 bp, Homo sapiens
tatgaataagcacttgaa

SEQ ID NO: 6418870 - DNA, 21 bp, Homo sapiens
tatgaataagcacttgaatca

SEQ ID NO: 6418871 - DNA, 15 bp, Homo sapiens
tatgaatacagcagc

SEQ ID NO: 6418872 - DNA, 19 bp, Homo sapiens
tatgaatagacataaattg

SEQ ID NO: 6418873 - DNA, 20 bp, Homo sapiens
tatgaatagacataaattgt

SEQ ID NO: 6418874 - DNA, 23 bp, Homo sapiens
tatgaatagacataaattgtaat

SEQ ID NO: 6418875 - DNA, 15 bp, Homo sapiens
tatgaatatcattga

SEQ ID NO: 6418876 - DNA, 16 bp, Homo sapiens
tatgaatatcattgat

SEQ ID NO: 6418877 - DNA, 18 bp, Homo sapiens
tatgaatatcattgattt

SEQ ID NO: 6418878 - DNA, 20 bp, Homo sapiens
tatgaatatttcattttgag

SEQ ID NO: 6418879 - DNA, 21 bp, Homo sapiens
tatgaatatttcattttgaga

SEQ ID NO: 6418880 - DNA, 13 bp, Homo sapiens
tatgaatcaaata

SEQ ID NO: 6418881 - DNA, 16 bp, Homo sapiens
tatgaatccaacgtgt

SEQ ID NO: 6418882 - DNA, 13 bp, Homo sapiens
tatgaatctataa

SEQ ID NO: 6418883 - DNA, 13 bp, Homo sapiens
tatgaatctatgc

SEQ ID NO: 6418884 - DNA, 12 bp, Homo sapiens
tatgaatctatt

SEQ ID NO: 6418885 - DNA, 21 bp, Homo sapiens
tatgaatctattatactgtat

SEQ ID NO: 6418886 - DNA, 15 bp, Homo sapiens
tatgaatgagaatgt

SEQ ID NO: 6418887 - DNA, 22 bp, Homo sapiens
tatgaatgagaatgtgccatgt

SEQ ID NO: 6418888 - DNA, 18 bp, Homo sapiens
tatgaatgagttttacaa

SEQ ID NO: 6418889 - DNA, 21 bp, Homo sapiens
tatgaatgcccccagctggcc

SEQ ID NO: 6418890 - DNA, 14 bp, Homo sapiens
tatgaatgctattt

SEQ ID NO: 6418891 - DNA, 17 bp, Homo sapiens
tatgaatggtctagaaa

SEQ ID NO: 6418892 - DNA, 20 bp, Homo sapiens
tatgaatggtctagaaacat

SEQ ID NO: 6418893 - DNA, 23 bp, Homo sapiens
tatgaatgtactgcatgttacca

SEQ ID NO: 6418894 - DNA, 15 bp, Homo sapiens
tatgaatgtcacatt

SEQ ID NO: 6418895 - DNA, 14 bp, Homo sapiens
tatgaattgtacag

SEQ ID NO: 6418896 - DNA, 15 bp, Homo sapiens
tatgaattgtacaga

SEQ ID NO: 6418897 - DNA, 22 bp, Homo sapiens
tatgaattgtacagaatatttc

SEQ ID NO: 6418898 - DNA, 17 bp, Homo sapiens
tatgaatttaaatataa

SEQ ID NO: 6418899 - DNA, 21 bp, Homo sapiens
tatgacaaatgaaagagaaaa

SEQ ID NO: 6418900 - DNA, 23 bp, Homo sapiens
tatgacaaatgaaagagaaaata

SEQ ID NO: 6418901 - DNA, 13 bp, Homo sapiens
tatgacaaatgtt

SEQ ID NO: 6418902 - DNA, 16 bp, Homo sapiens
tatgacaaatgtttct

SEQ ID NO: 6418903 - DNA, 17 bp, Homo sapiens
tatgacaaatgtttcta

SEQ ID NO: 6418904 - DNA, 16 bp, Homo sapiens
tatgacaaattcaaga

SEQ ID NO: 6418905 - DNA, 20 bp, Homo sapiens
tatgacaaatttagccaata

SEQ ID NO: 6418906 - DNA, 13 bp, Homo sapiens
tatgacaagcaag

SEQ ID NO: 6418907 - DNA, 17 bp, Homo sapiens
tatgacaatttcaaaat

SEQ ID NO: 6418908 - DNA, 14 bp, Homo sapiens
tatgacacttgtaa

SEQ ID NO: 6418909 - DNA, 23 bp, Homo sapiens
tatgacagaatggctatcaaaag

SEQ ID NO: 6418910 - DNA, 22 bp, Homo sapiens
tatgacagaatttgtgaatata

SEQ ID NO: 6418911 - DNA, 14 bp, Homo sapiens
tatgacagaggagg

SEQ ID NO: 6418912 - DNA, 15 bp, Homo sapiens
tatgacagatatatt

SEQ ID NO: 6418913 - DNA, 14 bp, Homo sapiens
tatgacagtaaaca

SEQ ID NO: 6418914 - DNA, 17 bp, Homo sapiens
tatgacagtaattgtgt

SEQ ID NO: 6418915 - DNA, 20 bp, Homo sapiens
tatgacagtgaattttgcac

SEQ ID NO: 6418916 - DNA, 15 bp, Homo sapiens
tatgacagttatact

SEQ ID NO: 6418917 - DNA, 23 bp, Homo sapiens
tatgacataaaaacaactttata

SEQ ID NO: 6418918 - DNA, 23 bp, Homo sapiens
tatgacataagcaatcattttat

SEQ ID NO: 6418919 - DNA, 22 bp, Homo sapiens
tatgacataggccaaggcccaa

SEQ ID NO: 6418920 - DNA, 16 bp, Homo sapiens
tatgacatgaaaagtt

SEQ ID NO: 6418921 - DNA, 16 bp, Homo sapiens
tatgacatgaaatgaa

SEQ ID NO: 6418922 - DNA, 21 bp, Homo sapiens
tatgacatgccaccctctcca

SEQ ID NO: 6418923 - DNA, 23 bp, Homo sapiens
tatgacatgccaccctctccatg

SEQ ID NO: 6418924 - DNA, 19 bp, Homo sapiens
tatgacattcatgcctggc

SEQ ID NO: 6418925 - DNA, 12 bp, Homo sapiens
tatgacatttaa

SEQ ID NO: 6418926 - DNA, 22 bp, Homo sapiens
tatgacatttaaatgtaactta

SEQ ID NO: 6418927 - DNA, 17 bp, Homo sapiens
tatgacatttcttaaaa

SEQ ID NO: 6418928 - DNA, 14 bp, Homo sapiens
tatgaccacactcc

SEQ ID NO: 6418929 - DNA, 15 bp, Homo sapiens
tatgaccagaagcct

SEQ ID NO: 6418930 - DNA, 16 bp, Homo sapiens
tatgaccagaagcctt

SEQ ID NO: 6418931 - DNA, 19 bp, Homo sapiens
tatgaccagagcaaaaatg

SEQ ID NO: 6418932 - DNA, 21 bp, Homo sapiens
tatgaccagagcaaaaatgta

SEQ ID NO: 6418933 - DNA, 15 bp, Homo sapiens
tatgaccattgaaaa

SEQ ID NO: 6418934 - DNA, 16 bp, Homo sapiens
tatgaccattgaaaaa

SEQ ID NO: 6418935 - DNA, 12 bp, Homo sapiens
tcctcctgccct

SEQ ID NO: 6418936 - DNA, 14 bp, Homo sapiens
tcctcctgccctcc

SEQ ID NO: 6418937 - DNA, 13 bp, Homo sapiens
tcctcctgccctg

SEQ ID NO: 6418938 - DNA, 14 bp, Homo sapiens
tcctcctgcctcag

SEQ ID NO: 6418939 - DNA, 12 bp, Homo sapiens
tcctcctgcctt

SEQ ID NO: 6418940 - DNA, 16 bp, Homo sapiens
tcctcctgctcctcac

SEQ ID NO: 6418941 - DNA, 19 bp, Homo sapiens
tcctcctgctctgcttcct

SEQ ID NO: 6418942 - DNA, 22 bp, Homo sapiens
tcctcctgctctgcttcctcag

SEQ ID NO: 6418943 - DNA, 11 bp, Homo sapiens
tcctcctggaa

SEQ ID NO: 6418944 - DNA, 13 bp, Homo sapiens
tcctcctggacac

SEQ ID NO: 6418945 - DNA, 13 bp, Homo sapiens
tcctcctggaccc

SEQ ID NO: 6418946 - DNA, 14 bp, Homo sapiens
tcctcctggaccca

SEQ ID NO: 6418947 - DNA, 16 bp, Homo sapiens
tcctcctggacccagc

SEQ ID NO: 6418948 - DNA, 13 bp, Homo sapiens
tcctcctggactc

SEQ ID NO: 6418949 - DNA, 20 bp, Homo sapiens
tcctcctggcctgagcgcag

SEQ ID NO: 6418950 - DNA, 12 bp, Homo sapiens
tcctcctgggag

SEQ ID NO: 6418951 - DNA, 15 bp, Homo sapiens
tcctcctgggccctc

SEQ ID NO: 6418952 - DNA, 16 bp, Homo sapiens
tcctcctgggccctct

SEQ ID NO: 6418953 - DNA, 20 bp, Homo sapiens
tcctcctgggccctctctgc

SEQ ID NO: 6418954 - DNA, 22 bp, Homo sapiens
tcctcctgggccctctctgctc

SEQ ID NO: 6418955 - DNA, 12 bp, Homo sapiens
tcctcctggggg

SEQ ID NO: 6418956 - DNA, 18 bp, Homo sapiens
tcctcctgggggctggct

SEQ ID NO: 6418957 - DNA, 19 bp, Homo sapiens
tcctcctgggggctggctc

SEQ ID NO: 6418958 - DNA, 20 bp, Homo sapiens
tcctcctggtgcccacagca

SEQ ID NO: 6418959 - DNA, 13 bp, Homo sapiens
tcctcctggtggg

SEQ ID NO: 6418960 - DNA, 20 bp, Homo sapiens
tcctcctggtgggtccaggg

SEQ ID NO: 6418961 - DNA, 22 bp, Homo sapiens
tcctcctggtgggtccaggggc

SEQ ID NO: 6418962 - DNA, 16 bp, Homo sapiens
tcctcctgtctcctct

SEQ ID NO: 6418963 - DNA, 12 bp, Homo sapiens
tcctcctgtgct

SEQ ID NO: 6418964 - DNA, 13 bp, Homo sapiens
tcctcctgtgcta

SEQ ID NO: 6418965 - DNA, 14 bp, Homo sapiens
tcctcctgtgctat

SEQ ID NO: 6418966 - DNA, 13 bp, Homo sapiens
tcctcctgtgtca

SEQ ID NO: 6418967 - DNA, 22 bp, Homo sapiens
tcctcctgttcatctgtgcacc

SEQ ID NO: 6418968 - DNA, 15 bp, Homo sapiens
tcctcctgttcctgc

SEQ ID NO: 6418969 - DNA, 18 bp, Homo sapiens
tcctcctgttcctgcctt

SEQ ID NO: 6418970 - DNA, 18 bp, Homo sapiens
tcctccttataagcccag

SEQ ID NO: 6418971 - DNA, 10 bp, Homo sapiens
tcctccttcc

SEQ ID NO: 6418972 - DNA, 14 bp, Homo sapiens
tcctccttccaggc

SEQ ID NO: 6418973 - DNA, 16 bp, Homo sapiens
tcctccttccaggccc

SEQ ID NO: 6418974 - DNA, 15 bp, Homo sapiens
tcctccttccatgga

SEQ ID NO: 6418975 - DNA, 13 bp, Homo sapiens
tcctccttcccag

SEQ ID NO: 6418976 - DNA, 18 bp, Homo sapiens
tcctccttcccagggacc

SEQ ID NO: 6418977 - DNA, 22 bp, Homo sapiens
tcctccttccggggaaggattt

SEQ ID NO: 6418978 - DNA, 12 bp, Homo sapiens
tcctccttcctg

SEQ ID NO: 6418979 - DNA, 14 bp, Homo sapiens
tcctccttcctggg

SEQ ID NO: 6418980 - DNA, 13 bp, Homo sapiens
tcctccttcttca

SEQ ID NO: 6418981 - DNA, 24 bp, Homo sapiens
tcctccttgcccagactacagggc

SEQ ID NO: 6418982 - DNA, 17 bp, Homo sapiens
tcctcctttcagttcgt

SEQ ID NO: 6418983 - DNA, 20 bp, Homo sapiens
tcctcctttcccctttctct

SEQ ID NO: 6418984 - DNA, 19 bp, Homo sapiens
tcctcctttcctatttccc

SEQ ID NO: 6418985 - DNA, 17 bp, Homo sapiens
tcctcctttcctcctct

SEQ ID NO: 6418986 - DNA, 16 bp, Homo sapiens
tcctcgaagtcccggc

SEQ ID NO: 6418987 - DNA, 21 bp, Homo sapiens
tcctcgacatcactgttcatg

SEQ ID NO: 6418988 - DNA, 18 bp, Homo sapiens
tcctcgagccctccccca

SEQ ID NO: 6418989 - DNA, 14 bp, Homo sapiens
tcctcgcacacact

SEQ ID NO: 6418990 - DNA, 22 bp, Homo sapiens
tcctcgcacagggcatgcctgg

SEQ ID NO: 6418991 - DNA, 23 bp, Homo sapiens
tcctcgcacagggcatgcctggc

SEQ ID NO: 6418992 - DNA, 22 bp, Homo sapiens
tcctcgccgggccattctgatt

SEQ ID NO: 6418993 - DNA, 14 bp, Homo sapiens
tcctcgcctaggcc

SEQ ID NO: 6418994 - DNA, 15 bp, Homo sapiens
tcctcgcctgacaac

SEQ ID NO: 6418995 - DNA, 24 bp, Homo sapiens
tcctcgcctgacaaccactggtct

SEQ ID NO: 6418996 - DNA, 19 bp, Homo sapiens
tcctcgctcctccttccca

SEQ ID NO: 6418997 - DNA, 22 bp, Homo sapiens
tcctcgctcctccttcccaggg

SEQ ID NO: 6418998 - DNA, 15 bp, Homo sapiens
tcctcgcttctttca

SEQ ID NO: 6418999 - DNA, 17 bp, Homo sapiens
tcctcggacacccaggg

SEQ ID NO: 6419000 - DNA, 16 bp, Homo sapiens
tcctcggagagcagca

SEQ ID NO: 6419001 - DNA, 19 bp, Homo sapiens
tcctcggagagcagcagca

SEQ ID NO: 6419002 - DNA, 21 bp, Homo sapiens
tcctcggagagcagcagcacc

SEQ ID NO: 6419003 - DNA, 14 bp, Homo sapiens
tcctcggccagagc

SEQ ID NO: 6419004 - DNA, 20 bp, Homo sapiens
tcctcggcccatctgtccat

SEQ ID NO: 6419005 - DNA, 13 bp, Homo sapiens
tcctcggccctgt

SEQ ID NO: 6419006 - DNA, 16 bp, Homo sapiens
tcctcggccctgtagc

SEQ ID NO: 6419007 - DNA, 20 bp, Homo sapiens
tcctcggccctgtagccctg

SEQ ID NO: 6419008 - DNA, 21 bp, Homo sapiens
tcctcggccctgtagccctgg

SEQ ID NO: 6419009 - DNA, 22 bp, Homo sapiens
tcctcggccctgtagccctggc

SEQ ID NO: 6419010 - DNA, 20 bp, Homo sapiens
tcctcggctggctgtccacc

SEQ ID NO: 6419011 - DNA, 17 bp, Homo sapiens
tcctcgggcaagggccg

SEQ ID NO: 6419012 - DNA, 18 bp, Homo sapiens
tcctcgggcccctgagcc

SEQ ID NO: 6419013 - DNA, 20 bp, Homo sapiens
tcctcgggcccctgagcctg

SEQ ID NO: 6419014 - DNA, 22 bp, Homo sapiens
tcctcgggcccctgagcctgtg

SEQ ID NO: 6419015 - DNA, 14 bp, Homo sapiens
tcctcgggccctgt

SEQ ID NO: 6419016 - DNA, 15 bp, Homo sapiens
tcctcgggccgaggc

SEQ ID NO: 6419017 - DNA, 18 bp, Homo sapiens
tcctcgggccgaggccca

SEQ ID NO: 6419018 - DNA, 20 bp, Homo sapiens
tcctcgggccgaggcccagc

SEQ ID NO: 6419019 - DNA, 22 bp, Homo sapiens
tcctcggtcgccccgtgtttgc

SEQ ID NO: 6419020 - DNA, 17 bp, Homo sapiens
tcctcggtctcccttcc

SEQ ID NO: 6419021 - DNA, 22 bp, Homo sapiens
tcctcggtggcatttgctgaat

SEQ ID NO: 6419022 - DNA, 13 bp, Homo sapiens
tcctcggtggctc

SEQ ID NO: 6419023 - DNA, 15 bp, Homo sapiens
tcctcggtggctctg

SEQ ID NO: 6419024 - DNA, 18 bp, Homo sapiens
tcctcggtggctctgggg

SEQ ID NO: 6419025 - DNA, 19 bp, Homo sapiens
tcctcggtgggccagagct

SEQ ID NO: 6419026 - DNA, 17 bp, Homo sapiens
tcctcggtgttacttcc

SEQ ID NO: 6419027 - DNA, 22 bp, Homo sapiens
tcctcggtgttacttccctttc

SEQ ID NO: 6419028 - DNA, 18 bp, Homo sapiens
tcctcggtttcccatttg

SEQ ID NO: 6419029 - DNA, 19 bp, Homo sapiens
tcctcggtttcccatttgt

SEQ ID NO: 6419030 - DNA, 23 bp, Homo sapiens
tcctcggtttcccatttgttgct

SEQ ID NO: 6419031 - DNA, 19 bp, Homo sapiens
tcctcgtccatcagggatc

SEQ ID NO: 6419032 - DNA, 15 bp, Homo sapiens
tcctcgtcccctgcc

SEQ ID NO: 6419033 - DNA, 16 bp, Homo sapiens
tcctcgtccggcctgc

SEQ ID NO: 6419034 - DNA, 22 bp, Homo sapiens
tcctcgtgcagagctggggctg

SEQ ID NO: 6419035 - DNA, 15 bp, Homo sapiens
tcctcgtgggtccca

SEQ ID NO: 6419036 - DNA, 20 bp, Homo sapiens
tcctcgtgggtcccagagac

SEQ ID NO: 6419037 - DNA, 21 bp, Homo sapiens
tcctcgttcaaaacattccaa

SEQ ID NO: 6419038 - DNA, 21 bp, Homo sapiens
tcctcgttctccctgggaggc

SEQ ID NO: 6419039 - DNA, 13 bp, Homo sapiens
tcctcgtttgtgt

SEQ ID NO: 6419040 - DNA, 14 bp, Homo sapiens
tcctcgtttgtgtt

SEQ ID NO: 6419041 - DNA, 15 bp, Homo sapiens
tcctctaaacacact

SEQ ID NO: 6419042 - DNA, 21 bp, Homo sapiens
tcctctaaagcagaggcaaca

SEQ ID NO: 6419043 - DNA, 14 bp, Homo sapiens
tcctctaacatttt

SEQ ID NO: 6419044 - DNA, 15 bp, Homo sapiens
tcctctaactcactg

SEQ ID NO: 6419045 - DNA, 14 bp, Homo sapiens
tcctctaatgttgt

SEQ ID NO: 6419046 - DNA, 18 bp, Homo sapiens
tcctctacaccaattaat

SEQ ID NO: 6419047 - DNA, 22 bp, Homo sapiens
tcctctacaccaattaatgtag

SEQ ID NO: 6419048 - DNA, 15 bp, Homo sapiens
tcctctacctctctc

SEQ ID NO: 6419049 - DNA, 19 bp, Homo sapiens
tcctctactaacaatcagc

SEQ ID NO: 6419050 - DNA, 12 bp, Homo sapiens
tcctctactact

SEQ ID NO: 6419051 - DNA, 18 bp, Homo sapiens
tcctctagcccactccct

SEQ ID NO: 6419052 - DNA, 16 bp, Homo sapiens
tcctctagcttttcta

SEQ ID NO: 6419053 - DNA, 14 bp, Homo sapiens
tcctctaggaggtc

SEQ ID NO: 6419054 - DNA, 17 bp, Homo sapiens
tcctctaggaggtctct

SEQ ID NO: 6419055 - DNA, 18 bp, Homo sapiens
tcctctaggggcagcctc

SEQ ID NO: 6419056 - DNA, 16 bp, Homo sapiens
tcctctagtaagatgc

SEQ ID NO: 6419057 - DNA, 16 bp, Homo sapiens
tcctctatacatctct

SEQ ID NO: 6419058 - DNA, 13 bp, Homo sapiens
tcctctatacttt

SEQ ID NO: 6419059 - DNA, 15 bp, Homo sapiens
tcctctatactttgt

SEQ ID NO: 6419060 - DNA, 17 bp, Homo sapiens
tcctctatactttgttc

SEQ ID NO: 6419061 - DNA, 24 bp, Homo sapiens
tcctctatactttgttctgttgtc

SEQ ID NO: 6419062 - DNA, 14 bp, Homo sapiens
tcctctatcttcca

SEQ ID NO: 6419063 - DNA, 18 bp, Homo sapiens
tcctctattaattactgt

SEQ ID NO: 6419064 - DNA, 17 bp, Homo sapiens
tcctctatttaagatat

SEQ ID NO: 6419065 - DNA, 15 bp, Homo sapiens
tcctctatttcttta

SEQ ID NO: 6419066 - DNA, 12 bp, Homo sapiens
tcctctattttg

SEQ ID NO: 6419067 - DNA, 18 bp, Homo sapiens
tcctctcaaacctggcag

SEQ ID NO: 6419068 - DNA, 20 bp, Homo sapiens
tcctctcaaccacctttcag

SEQ ID NO: 6419069 - DNA, 22 bp, Homo sapiens
tcctctcaagctagccagaggg

SEQ ID NO: 6419070 - DNA, 22 bp, Homo sapiens
tcctctcaccccactcctgtca

SEQ ID NO: 6419071 - DNA, 13 bp, Homo sapiens
tcctctcactccc

SEQ ID NO: 6419072 - DNA, 22 bp, Homo sapiens
tcctctcactccccagcctggg

SEQ ID NO: 6419073 - DNA, 16 bp, Homo sapiens
tcctctcactcctgcc

SEQ ID NO: 6419074 - DNA, 14 bp, Homo sapiens
tcctctcagagcct

SEQ ID NO: 6419075 - DNA, 19 bp, Homo sapiens
tcctctcatttccagcttc

SEQ ID NO: 6419076 - DNA, 21 bp, Homo sapiens
tcctctcatttccagcttctc

SEQ ID NO: 6419077 - DNA, 14 bp, Homo sapiens
tcctctccacagga

SEQ ID NO: 6419078 - DNA, 15 bp, Homo sapiens
tcctctccacaggag

SEQ ID NO: 6419079 - DNA, 17 bp, Homo sapiens
tcctctccacaggagcc

SEQ ID NO: 6419080 - DNA, 13 bp, Homo sapiens
tcctctccaccct

SEQ ID NO: 6419081 - DNA, 14 bp, Homo sapiens
tcctctccaccctc

SEQ ID NO: 6419082 - DNA, 15 bp, Homo sapiens
tcctctccaccctcc

SEQ ID NO: 6419083 - DNA, 16 bp, Homo sapiens
tcctctccaccctcct

SEQ ID NO: 6419084 - DNA, 19 bp, Homo sapiens
tcctctccacctagtggct

SEQ ID NO: 6419085 - DNA, 14 bp, Homo sapiens
tcctctccactgcc

SEQ ID NO: 6419086 - DNA, 15 bp, Homo sapiens
tcctctccactgcct

SEQ ID NO: 6419087 - DNA, 15 bp, Homo sapiens
tcctctccactgctg

SEQ ID NO: 6419088 - DNA, 18 bp, Homo sapiens
tcctctccactgctggac

SEQ ID NO: 6419089 - DNA, 20 bp, Homo sapiens
tcctctccactgctggacat

SEQ ID NO: 6419090 - DNA, 12 bp, Homo sapiens
tcctctccaggc

SEQ ID NO: 6419091 - DNA, 16 bp, Homo sapiens
tcctctccatgcaagt

SEQ ID NO: 6419092 - DNA, 22 bp, Homo sapiens
tcctctccatgcaagtgctgtt

SEQ ID NO: 6419093 - DNA, 17 bp, Homo sapiens
tcctctccatgcacagt

SEQ ID NO: 6419094 - DNA, 23 bp, Homo sapiens
tcctctcccacagagtgctggac

SEQ ID NO: 6419095 - DNA, 15 bp, Homo sapiens
tcctctcccatcccc

SEQ ID NO: 6419096 - DNA, 23 bp, Homo sapiens
tcctctcccattgtccctctgcc

SEQ ID NO: 6419097 - DNA, 19 bp, Homo sapiens
tcctctccccaacccttcc

SEQ ID NO: 6419098 - DNA, 15 bp, Homo sapiens
tcctctccccagcaa

SEQ ID NO: 6419099 - DNA, 15 bp, Homo sapiens
tcctctccccagccc

SEQ ID NO: 6419100 - DNA, 21 bp, Homo sapiens
tcctctccccagcccagagac

SEQ ID NO: 6419101 - DNA, 17 bp, Homo sapiens
tcctctccccatgatgt

SEQ ID NO: 6419102 - DNA, 23 bp, Homo sapiens
tcctctcccccaaccccctgcaa

SEQ ID NO: 6419103 - DNA, 19 bp, Homo sapiens
tcctctccccctcctccag

SEQ ID NO: 6419104 - DNA, 22 bp, Homo sapiens
tcctctccccctcctccaggga

SEQ ID NO: 6419105 - DNA, 14 bp, Homo sapiens
tcctctcccctcca

SEQ ID NO: 6419106 - DNA, 18 bp, Homo sapiens
tcctctcccctccagcct

SEQ ID NO: 6419107 - DNA, 18 bp, Homo sapiens
tcctctcccctctgccct

SEQ ID NO: 6419108 - DNA, 19 bp, Homo sapiens
tcctctcccctctgccctg

SEQ ID NO: 6419109 - DNA, 14 bp, Homo sapiens
tcctctcccctttg

SEQ ID NO: 6419110 - DNA, 13 bp, Homo sapiens
tcctctccctcag

SEQ ID NO: 6419111 - DNA, 14 bp, Homo sapiens
tcctctccctcagg

SEQ ID NO: 6419112 - DNA, 17 bp, Homo sapiens
tcctctccctcctggcc

SEQ ID NO: 6419113 - DNA, 15 bp, Homo sapiens
tcctctccctctctc

SEQ ID NO: 6419114 - DNA, 20 bp, Homo sapiens
tcctctccctctctcttttc

SEQ ID NO: 6419115 - DNA, 22 bp, Homo sapiens
tatgaccattgaaaaaggaaaa

SEQ ID NO: 6419116 - DNA, 15 bp, Homo sapiens
tatgacccacactgc

SEQ ID NO: 6419117 - DNA, 14 bp, Homo sapiens
tatgacccctggcc

SEQ ID NO: 6419118 - DNA, 15 bp, Homo sapiens
tatgacccctggcca

SEQ ID NO: 6419119 - DNA, 22 bp, Homo sapiens
tatgacctaaatccattttcta

SEQ ID NO: 6419120 - DNA, 15 bp, Homo sapiens
tatgacctaagtcag

SEQ ID NO: 6419121 - DNA, 22 bp, Homo sapiens
tatgacctaagtcaggtaatat

SEQ ID NO: 6419122 - DNA, 16 bp, Homo sapiens
tatgacgctgatacat

SEQ ID NO: 6419123 - DNA, 23 bp, Homo sapiens
tatgacgctgatacataactaaa

SEQ ID NO: 6419124 - DNA, 20 bp, Homo sapiens
tatgacggaagaacatagaa

SEQ ID NO: 6419125 - DNA, 14 bp, Homo sapiens
tatgacgtgcacaa

SEQ ID NO: 6419126 - DNA, 20 bp, Homo sapiens
tatgactaaagagagaatgt

SEQ ID NO: 6419127 - DNA, 21 bp, Homo sapiens
tatgactaaagagagaatgta

SEQ ID NO: 6419128 - DNA, 14 bp, Homo sapiens
tatgactacatttt

SEQ ID NO: 6419129 - DNA, 15 bp, Homo sapiens
tatgactacattttg

SEQ ID NO: 6419130 - DNA, 16 bp, Homo sapiens
tatgactatgtaaact

SEQ ID NO: 6419131 - DNA, 17 bp, Homo sapiens
tatgactatgtaaacta

SEQ ID NO: 6419132 - DNA, 18 bp, Homo sapiens
tatgactatgtaaactac

SEQ ID NO: 6419133 - DNA, 17 bp, Homo sapiens
tatgactccagaatttc

SEQ ID NO: 6419134 - DNA, 23 bp, Homo sapiens
tatgactccagaatttcccaaag

SEQ ID NO: 6419135 - DNA, 17 bp, Homo sapiens
tatgactgaagtaataa

SEQ ID NO: 6419136 - DNA, 18 bp, Homo sapiens
tatgactgctccccagcc

SEQ ID NO: 6419137 - DNA, 13 bp, Homo sapiens
tatgactggagta

SEQ ID NO: 6419138 - DNA, 19 bp, Homo sapiens
tatgacttaattttagaaa

SEQ ID NO: 6419139 - DNA, 22 bp, Homo sapiens
tatgacttaattttagaaagaa

SEQ ID NO: 6419140 - DNA, 17 bp, Homo sapiens
tatgacttcttgttcat

SEQ ID NO: 6419141 - DNA, 20 bp, Homo sapiens
tatgacttcttgttcatgtt

SEQ ID NO: 6419142 - DNA, 21 bp, Homo sapiens
tatgacttgggcacccccagc

SEQ ID NO: 6419143 - DNA, 22 bp, Homo sapiens
tatgacttgggcacccccagcc

SEQ ID NO: 6419144 - DNA, 22 bp, Homo sapiens
tatgactttcctcagaacatga

SEQ ID NO: 6419145 - DNA, 18 bp, Homo sapiens
tatgactttgaataaaat

SEQ ID NO: 6419146 - DNA, 13 bp, Homo sapiens
tatgactttttat

SEQ ID NO: 6419147 - DNA, 19 bp, Homo sapiens
tatgactttttataaaatg

SEQ ID NO: 6419148 - DNA, 18 bp, Homo sapiens
tatgacttttttaaacta

SEQ ID NO: 6419149 - DNA, 15 bp, Homo sapiens
tatgagaaaaaaaca

SEQ ID NO: 6419150 - DNA, 22 bp, Homo sapiens
tatgagaaaaatattcaagtaa

SEQ ID NO: 6419151 - DNA, 20 bp, Homo sapiens
tatgagaaatataaaaataa

SEQ ID NO: 6419152 - DNA, 23 bp, Homo sapiens
tatgagaactggttcttgccttc

SEQ ID NO: 6419153 - DNA, 16 bp, Homo sapiens
tatgagaatatacctt

SEQ ID NO: 6419154 - DNA, 21 bp, Homo sapiens
tatgagaatgaccctgtcaag

SEQ ID NO: 6419155 - DNA, 14 bp, Homo sapiens
tatgagaatgtatt

SEQ ID NO: 6419156 - DNA, 15 bp, Homo sapiens
tatgagacacaggat

SEQ ID NO: 6419157 - DNA, 20 bp, Homo sapiens
tatgagacaggaaaaaccaa

SEQ ID NO: 6419158 - DNA, 15 bp, Homo sapiens
tatgagactgtgttt

SEQ ID NO: 6419159 - DNA, 16 bp, Homo sapiens
tatgagacttcctatt

SEQ ID NO: 6419160 - DNA, 22 bp, Homo sapiens
tatgagacttcctattaattta

SEQ ID NO: 6419161 - DNA, 15 bp, Homo sapiens
tatgagactttatgt

SEQ ID NO: 6419162 - DNA, 12 bp, Homo sapiens
tatgagactttc

SEQ ID NO: 6419163 - DNA, 15 bp, Homo sapiens
tatgagagaactatt

SEQ ID NO: 6419164 - DNA, 15 bp, Homo sapiens
tatgagaggcaatga

SEQ ID NO: 6419165 - DNA, 14 bp, Homo sapiens
tatgagatactttg

SEQ ID NO: 6419166 - DNA, 21 bp, Homo sapiens
tatgagatctaatgtgaaaat

SEQ ID NO: 6419167 - DNA, 16 bp, Homo sapiens
tatgagatggccatgc

SEQ ID NO: 6419168 - DNA, 17 bp, Homo sapiens
tatgagatggttaaaaa

SEQ ID NO: 6419169 - DNA, 19 bp, Homo sapiens
tatgagatggttaaaaagg

SEQ ID NO: 6419170 - DNA, 20 bp, Homo sapiens
tatgagatggttaaaaaggc

SEQ ID NO: 6419171 - DNA, 21 bp, Homo sapiens
tatgagatggttaaaaaggcc

SEQ ID NO: 6419172 - DNA, 22 bp, Homo sapiens
tatgagatggttaaaaaggcca

SEQ ID NO: 6419173 - DNA, 14 bp, Homo sapiens
tatgagatttactg

SEQ ID NO: 6419174 - DNA, 16 bp, Homo sapiens
tatgagatttactgct

SEQ ID NO: 6419175 - DNA, 13 bp, Homo sapiens
tatgagcatcctg

SEQ ID NO: 6419176 - DNA, 17 bp, Homo sapiens
tatgagcatcctgagcc

SEQ ID NO: 6419177 - DNA, 19 bp, Homo sapiens
tatgagccagacaaatgga

SEQ ID NO: 6419178 - DNA, 21 bp, Homo sapiens
tatgagccgtgaactgtgcat

SEQ ID NO: 6419179 - DNA, 15 bp, Homo sapiens
tatgagcctgccctc

SEQ ID NO: 6419180 - DNA, 20 bp, Homo sapiens
tatgagcctgccctcactcc

SEQ ID NO: 6419181 - DNA, 18 bp, Homo sapiens
tatgagctatcctttcaa

SEQ ID NO: 6419182 - DNA, 19 bp, Homo sapiens
tatgagctatcctttcaaa

SEQ ID NO: 6419183 - DNA, 16 bp, Homo sapiens
tatgagctgagggggg

SEQ ID NO: 6419184 - DNA, 14 bp, Homo sapiens
tatgagctggagct

SEQ ID NO: 6419185 - DNA, 18 bp, Homo sapiens
tatgagctttcagactcc

SEQ ID NO: 6419186 - DNA, 12 bp, Homo sapiens
tatgaggaaact

SEQ ID NO: 6419187 - DNA, 18 bp, Homo sapiens
tatgaggaaagcgtttct

SEQ ID NO: 6419188 - DNA, 22 bp, Homo sapiens
tatgaggaaagcgtttctgtgt

SEQ ID NO: 6419189 - DNA, 15 bp, Homo sapiens
tatgaggagcctctg

SEQ ID NO: 6419190 - DNA, 18 bp, Homo sapiens
tatgaggagtgaacattt

SEQ ID NO: 6419191 - DNA, 19 bp, Homo sapiens
tatgaggatgtatgtgtat

SEQ ID NO: 6419192 - DNA, 13 bp, Homo sapiens
tatgaggcatttg

SEQ ID NO: 6419193 - DNA, 22 bp, Homo sapiens
tatgagggcatgtgatattttc

SEQ ID NO: 6419194 - DNA, 16 bp, Homo sapiens
tatgaggggacccagc

SEQ ID NO: 6419195 - DNA, 21 bp, Homo sapiens
tatgaggggactgcatgcaag

SEQ ID NO: 6419196 - DNA, 20 bp, Homo sapiens
tatgaggggcagtggacagt

SEQ ID NO: 6419197 - DNA, 20 bp, Homo sapiens
tatgagggtactgtggctgg

SEQ ID NO: 6419198 - DNA, 18 bp, Homo sapiens
tatgagggtgtttcctct

SEQ ID NO: 6419199 - DNA, 18 bp, Homo sapiens
tatgaggtcaagaaatgt

SEQ ID NO: 6419200 - DNA, 14 bp, Homo sapiens
tatgaggtcctcag

SEQ ID NO: 6419201 - DNA, 16 bp, Homo sapiens
tatgaggtcctcaggt

SEQ ID NO: 6419202 - DNA, 14 bp, Homo sapiens
tatgaggtgaaatg

SEQ ID NO: 6419203 - DNA, 20 bp, Homo sapiens
tatgagtacaaatgccttaa

SEQ ID NO: 6419204 - DNA, 23 bp, Homo sapiens
tatgagtaggtttggccccctca

SEQ ID NO: 6419205 - DNA, 17 bp, Homo sapiens
tatgagtcaatgtgcag

SEQ ID NO: 6419206 - DNA, 15 bp, Homo sapiens
tatgagtcagtctct

SEQ ID NO: 6419207 - DNA, 16 bp, Homo sapiens
tatgagtctagatgtt

SEQ ID NO: 6419208 - DNA, 21 bp, Homo sapiens
tatgagtcttctgtaattcat

SEQ ID NO: 6419209 - DNA, 18 bp, Homo sapiens
tatgagtggaaaaagcca

SEQ ID NO: 6419210 - DNA, 17 bp, Homo sapiens
tatgagtgggaaataaa

SEQ ID NO: 6419211 - DNA, 12 bp, Homo sapiens
tatgagttcttc

SEQ ID NO: 6419212 - DNA, 15 bp, Homo sapiens
tatgagttcttcgta

SEQ ID NO: 6419213 - DNA, 20 bp, Homo sapiens
tatgagttgcatttgtaaaa

SEQ ID NO: 6419214 - DNA, 16 bp, Homo sapiens
tatgataaaaaatttt

SEQ ID NO: 6419215 - DNA, 23 bp, Homo sapiens
tatgataaaaaattttgtaattt

SEQ ID NO: 6419216 - DNA, 15 bp, Homo sapiens
tatgataaaacactg

SEQ ID NO: 6419217 - DNA, 17 bp, Homo sapiens
tatgataaagttgtaaa

SEQ ID NO: 6419218 - DNA, 21 bp, Homo sapiens
tatgataaagttgtaaataat

SEQ ID NO: 6419219 - DNA, 13 bp, Homo sapiens
tatgataaatttg

SEQ ID NO: 6419220 - DNA, 20 bp, Homo sapiens
tatgataaccaagaatgtct

SEQ ID NO: 6419221 - DNA, 18 bp, Homo sapiens
tatgataactatttacat

SEQ ID NO: 6419222 - DNA, 20 bp, Homo sapiens
tatgataactatttacatat

SEQ ID NO: 6419223 - DNA, 15 bp, Homo sapiens
tatgataatagattc

SEQ ID NO: 6419224 - DNA, 16 bp, Homo sapiens
tatgataatgataact

SEQ ID NO: 6419225 - DNA, 19 bp, Homo sapiens
tatgataattacaatacaa

SEQ ID NO: 6419226 - DNA, 17 bp, Homo sapiens
tatgatacttgaaaatt

SEQ ID NO: 6419227 - DNA, 16 bp, Homo sapiens
tatgatacttgaattt

SEQ ID NO: 6419228 - DNA, 20 bp, Homo sapiens
tatgatacttgaattttttg

SEQ ID NO: 6419229 - DNA, 15 bp, Homo sapiens
tatgataggcagcac

SEQ ID NO: 6419230 - DNA, 15 bp, Homo sapiens
tatgatagtataaaa

SEQ ID NO: 6419231 - DNA, 19 bp, Homo sapiens
tatgatataataaatatat

SEQ ID NO: 6419232 - DNA, 15 bp, Homo sapiens
tatgatatatatgta

SEQ ID NO: 6419233 - DNA, 13 bp, Homo sapiens
tatgatatcattg

SEQ ID NO: 6419234 - DNA, 13 bp, Homo sapiens
tatgatatgcatg

SEQ ID NO: 6419235 - DNA, 22 bp, Homo sapiens
tatgatatgcatgtagcatata

SEQ ID NO: 6419236 - DNA, 16 bp, Homo sapiens
tatgatattccatagt

SEQ ID NO: 6419237 - DNA, 14 bp, Homo sapiens
tatgatattctcat

SEQ ID NO: 6419238 - DNA, 13 bp, Homo sapiens
tatgatatttctt

SEQ ID NO: 6419239 - DNA, 19 bp, Homo sapiens
tatgatatttcttgctttc

SEQ ID NO: 6419240 - DNA, 15 bp, Homo sapiens
tatgatattttctgt

SEQ ID NO: 6419241 - DNA, 14 bp, Homo sapiens
tatgatatttttca

SEQ ID NO: 6419242 - DNA, 18 bp, Homo sapiens
tatgatcaaatgtttaat

SEQ ID NO: 6419243 - DNA, 14 bp, Homo sapiens
tatgatcagtgttg

SEQ ID NO: 6419244 - DNA, 19 bp, Homo sapiens
tatgatccagcagattatt

SEQ ID NO: 6419245 - DNA, 22 bp, Homo sapiens
tatgatccagcagattattcac

SEQ ID NO: 6419246 - DNA, 15 bp, Homo sapiens
tatgatcgcgccact

SEQ ID NO: 6419247 - DNA, 16 bp, Homo sapiens
tatgatctaataaact

SEQ ID NO: 6419248 - DNA, 20 bp, Homo sapiens
tatgatctaataaactttat

SEQ ID NO: 6419249 - DNA, 13 bp, Homo sapiens
tatgatctactca

SEQ ID NO: 6419250 - DNA, 21 bp, Homo sapiens
tatgatctactcatttgctga

SEQ ID NO: 6419251 - DNA, 16 bp, Homo sapiens
tatgatctatttgtag

SEQ ID NO: 6419252 - DNA, 18 bp, Homo sapiens
tatgatctccgtatgatg

SEQ ID NO: 6419253 - DNA, 14 bp, Homo sapiens
tatgatctctctag

SEQ ID NO: 6419254 - DNA, 16 bp, Homo sapiens
tatgatctgtctgtgg

SEQ ID NO: 6419255 - DNA, 20 bp, Homo sapiens
tatgatctgtggagaatgta

SEQ ID NO: 6419256 - DNA, 15 bp, Homo sapiens
tatgatctgttttgt

SEQ ID NO: 6419257 - DNA, 22 bp, Homo sapiens
tatgatcttagggaactttgat

SEQ ID NO: 6419258 - DNA, 16 bp, Homo sapiens
tatgatgacaatcaaa

SEQ ID NO: 6419259 - DNA, 18 bp, Homo sapiens
tatgatgagattcactta

SEQ ID NO: 6419260 - DNA, 22 bp, Homo sapiens
tatgatgcatacagttttctag

SEQ ID NO: 6419261 - DNA, 23 bp, Homo sapiens
tatgatgcatacagttttctagc

SEQ ID NO: 6419262 - DNA, 12 bp, Homo sapiens
tatgatgctaag

SEQ ID NO: 6419263 - DNA, 15 bp, Homo sapiens
tatgatgctgccggc

SEQ ID NO: 6419264 - DNA, 21 bp, Homo sapiens
tatgatgctgccggcacagct

SEQ ID NO: 6419265 - DNA, 15 bp, Homo sapiens
tatgatgctgttgcc

SEQ ID NO: 6419266 - DNA, 21 bp, Homo sapiens
tatgatggaagacaggaaagt

SEQ ID NO: 6419267 - DNA, 18 bp, Homo sapiens
tatgatggagcaactgaa

SEQ ID NO: 6419268 - DNA, 13 bp, Homo sapiens
tatgatggatggc

SEQ ID NO: 6419269 - DNA, 20 bp, Homo sapiens
tatgatggcaggagaatcag

SEQ ID NO: 6419270 - DNA, 22 bp, Homo sapiens
tatgatggcaggtcctctgttg

SEQ ID NO: 6419271 - DNA, 14 bp, Homo sapiens
tatgatgggcttct

SEQ ID NO: 6419272 - DNA, 16 bp, Homo sapiens
tatgatgggcttctgt

SEQ ID NO: 6419273 - DNA, 16 bp, Homo sapiens
tatgatggttttaaac

SEQ ID NO: 6419274 - DNA, 13 bp, Homo sapiens
tatgatgtatatt

SEQ ID NO: 6419275 - DNA, 14 bp, Homo sapiens
tatgatgtgcttaa

SEQ ID NO: 6419276 - DNA, 21 bp, Homo sapiens
tatgatgtggacatatgtata

SEQ ID NO: 6419277 - DNA, 23 bp, Homo sapiens
tatgatgtggacatatgtatact

SEQ ID NO: 6419278 - DNA, 18 bp, Homo sapiens
tatgatgtgttgtgatag

SEQ ID NO: 6419279 - DNA, 14 bp, Homo sapiens
tatgatgttaaaaa

SEQ ID NO: 6419280 - DNA, 18 bp, Homo sapiens
tatgatgttaacatttca

SEQ ID NO: 6419281 - DNA, 19 bp, Homo sapiens
tatgatgttagttttcctt

SEQ ID NO: 6419282 - DNA, 21 bp, Homo sapiens
tatgatgttattttgtacgtg

SEQ ID NO: 6419283 - DNA, 15 bp, Homo sapiens
tatgatgttttgcaa

SEQ ID NO: 6419284 - DNA, 12 bp, Homo sapiens
tatgattaaaaa

SEQ ID NO: 6419285 - DNA, 15 bp, Homo sapiens
tatgattaaactggg

SEQ ID NO: 6419286 - DNA, 19 bp, Homo sapiens
tatgattaaattatcattg

SEQ ID NO: 6419287 - DNA, 16 bp, Homo sapiens
tatgattaagtaatga

SEQ ID NO: 6419288 - DNA, 22 bp, Homo sapiens
tatgattactggcctttttcat

SEQ ID NO: 6419289 - DNA, 15 bp, Homo sapiens
tatgattagttatgt

SEQ ID NO: 6419290 - DNA, 13 bp, Homo sapiens
tatgattatacaa

SEQ ID NO: 6419291 - DNA, 12 bp, Homo sapiens
tatgattattaa

SEQ ID NO: 6419292 - DNA, 15 bp, Homo sapiens
tatgattattaatca

SEQ ID NO: 6419293 - DNA, 13 bp, Homo sapiens
tatgattccaatt

SEQ ID NO: 6419294 - DNA, 13 bp, Homo sapiens
tcctctccctgcc

SEQ ID NO: 6419295 - DNA, 16 bp, Homo sapiens
tcctctccctgccaag

SEQ ID NO: 6419296 - DNA, 18 bp, Homo sapiens
tcctctccctgccaagtc

SEQ ID NO: 6419297 - DNA, 12 bp, Homo sapiens
tcctctccctgt

SEQ ID NO: 6419298 - DNA, 12 bp, Homo sapiens
tcctctcccttc

SEQ ID NO: 6419299 - DNA, 17 bp, Homo sapiens
tcctctcctagcccctg

SEQ ID NO: 6419300 - DNA, 13 bp, Homo sapiens
tcctctcctctct

SEQ ID NO: 6419301 - DNA, 15 bp, Homo sapiens
tcctctcctgcccag

SEQ ID NO: 6419302 - DNA, 19 bp, Homo sapiens
tcctctcctgcccagctct

SEQ ID NO: 6419303 - DNA, 12 bp, Homo sapiens
tcctctcctgga

SEQ ID NO: 6419304 - DNA, 15 bp, Homo sapiens
tcctctcctggagga

SEQ ID NO: 6419305 - DNA, 17 bp, Homo sapiens
tcctctccttcccacaa

SEQ ID NO: 6419306 - DNA, 21 bp, Homo sapiens
tcctctccttgggctcctggc

SEQ ID NO: 6419307 - DNA, 23 bp, Homo sapiens
tcctctccttgggctcctggctg

SEQ ID NO: 6419308 - DNA, 18 bp, Homo sapiens
tcctctcgagatagtttt

SEQ ID NO: 6419309 - DNA, 16 bp, Homo sapiens
tcctctcgagcccaga

SEQ ID NO: 6419310 - DNA, 21 bp, Homo sapiens
tcctctcggctgccaggggct

SEQ ID NO: 6419311 - DNA, 16 bp, Homo sapiens
tcctctcggctggaag

SEQ ID NO: 6419312 - DNA, 18 bp, Homo sapiens
tcctctcggctggaagaa

SEQ ID NO: 6419313 - DNA, 16 bp, Homo sapiens
tcctctctaacctcct

SEQ ID NO: 6419314 - DNA, 18 bp, Homo sapiens
tcctctctaagtgggcat

SEQ ID NO: 6419315 - DNA, 17 bp, Homo sapiens
tcctctctaccccccac

SEQ ID NO: 6419316 - DNA, 16 bp, Homo sapiens
tcctctctagggcaga

SEQ ID NO: 6419317 - DNA, 17 bp, Homo sapiens
tcctctctatctttttt

SEQ ID NO: 6419318 - DNA, 19 bp, Homo sapiens
tcctctctcaggtcactcc

SEQ ID NO: 6419319 - DNA, 17 bp, Homo sapiens
tcctctctccaggcccc

SEQ ID NO: 6419320 - DNA, 14 bp, Homo sapiens
tcctctctcccacc

SEQ ID NO: 6419321 - DNA, 12 bp, Homo sapiens
tcctctctcccc

SEQ ID NO: 6419322 - DNA, 13 bp, Homo sapiens
tcctctctcccct

SEQ ID NO: 6419323 - DNA, 14 bp, Homo sapiens
tcctctctcccctc

SEQ ID NO: 6419324 - DNA, 18 bp, Homo sapiens
tcctctctccctgcctca

SEQ ID NO: 6419325 - DNA, 20 bp, Homo sapiens
tcctctctccctgcctcaca

SEQ ID NO: 6419326 - DNA, 21 bp, Homo sapiens
tcctctctccctgcctcacat

SEQ ID NO: 6419327 - DNA, 20 bp, Homo sapiens
tcctctctctcacctacttc

SEQ ID NO: 6419328 - DNA, 13 bp, Homo sapiens
tcctctctctccc

SEQ ID NO: 6419329 - DNA, 15 bp, Homo sapiens
tcctctctctccctc

SEQ ID NO: 6419330 - DNA, 17 bp, Homo sapiens
tcctctctctccctcca

SEQ ID NO: 6419331 - DNA, 19 bp, Homo sapiens
tcctctctctccctccact

SEQ ID NO: 6419332 - DNA, 13 bp, Homo sapiens
tcctctctctctc

SEQ ID NO: 6419333 - DNA, 22 bp, Homo sapiens
tcctctctctcttcctctttct

SEQ ID NO: 6419334 - DNA, 22 bp, Homo sapiens
tcctctctgaagcgactctcct

SEQ ID NO: 6419335 - DNA, 18 bp, Homo sapiens
tcctctctgagtcaaatc

SEQ ID NO: 6419336 - DNA, 13 bp, Homo sapiens
tcctctctgccac

SEQ ID NO: 6419337 - DNA, 15 bp, Homo sapiens
tcctctctgccctaa

SEQ ID NO: 6419338 - DNA, 11 bp, Homo sapiens
tcctctctgct

SEQ ID NO: 6419339 - DNA, 13 bp, Homo sapiens
tcctctctgctgg

SEQ ID NO: 6419340 - DNA, 20 bp, Homo sapiens
tcctctctgctgggtttcca

SEQ ID NO: 6419341 - DNA, 13 bp, Homo sapiens
tcctctctggact

SEQ ID NO: 6419342 - DNA, 16 bp, Homo sapiens
tcctctctgtctgtct

SEQ ID NO: 6419343 - DNA, 20 bp, Homo sapiens
tcctctcttaaatgcaagtg

SEQ ID NO: 6419344 - DNA, 11 bp, Homo sapiens
tcctctcttcc

SEQ ID NO: 6419345 - DNA, 18 bp, Homo sapiens
tcctctcttccacagtgg

SEQ ID NO: 6419346 - DNA, 16 bp, Homo sapiens
tcctctcttgggtagg

SEQ ID NO: 6419347 - DNA, 11 bp, Homo sapiens
tcctctctttg

SEQ ID NO: 6419348 - DNA, 21 bp, Homo sapiens
tcctctctttgttctcagctc

SEQ ID NO: 6419349 - DNA, 10 bp, Homo sapiens
tcctctgaaa

SEQ ID NO: 6419350 - DNA, 13 bp, Homo sapiens
tcctctgaaacag

SEQ ID NO: 6419351 - DNA, 18 bp, Homo sapiens
tcctctgaaacagctgcc

SEQ ID NO: 6419352 - DNA, 22 bp, Homo sapiens
tcctctgactccactcaaagag

SEQ ID NO: 6419353 - DNA, 19 bp, Homo sapiens
tcctctgagcagcctctgc

SEQ ID NO: 6419354 - DNA, 23 bp, Homo sapiens
tcctctgagccataccgaccatc

SEQ ID NO: 6419355 - DNA, 19 bp, Homo sapiens
tcctctgagcccagctgcc

SEQ ID NO: 6419356 - DNA, 12 bp, Homo sapiens
tcctctgagccg

SEQ ID NO: 6419357 - DNA, 13 bp, Homo sapiens
tcctctgagccgc

SEQ ID NO: 6419358 - DNA, 17 bp, Homo sapiens
tcctctgagccttggga

SEQ ID NO: 6419359 - DNA, 21 bp, Homo sapiens
tcctctgagctgttatcttgt

SEQ ID NO: 6419360 - DNA, 21 bp, Homo sapiens
tcctctgaggaagcagttggg

SEQ ID NO: 6419361 - DNA, 22 bp, Homo sapiens
tcctctgaggaagcagttgggg

SEQ ID NO: 6419362 - DNA, 15 bp, Homo sapiens
tcctctgatacccag

SEQ ID NO: 6419363 - DNA, 13 bp, Homo sapiens
tcctctgattctg

SEQ ID NO: 6419364 - DNA, 15 bp, Homo sapiens
tcctctgcaagtgct

SEQ ID NO: 6419365 - DNA, 16 bp, Homo sapiens
tcctctgcaagtgctc

SEQ ID NO: 6419366 - DNA, 14 bp, Homo sapiens
tcctctgcagcctg

SEQ ID NO: 6419367 - DNA, 15 bp, Homo sapiens
tcctctgcagcctga

SEQ ID NO: 6419368 - DNA, 18 bp, Homo sapiens
tcctctgcagcctgagct

SEQ ID NO: 6419369 - DNA, 16 bp, Homo sapiens
tcctctgcagttttga

SEQ ID NO: 6419370 - DNA, 12 bp, Homo sapiens
tcctctgccacc

SEQ ID NO: 6419371 - DNA, 18 bp, Homo sapiens
tcctctgccacctcccct

SEQ ID NO: 6419372 - DNA, 22 bp, Homo sapiens
tcctctgccacctcccctatcc

SEQ ID NO: 6419373 - DNA, 23 bp, Homo sapiens
tcctctgccacctcccctatcca

SEQ ID NO: 6419374 - DNA, 15 bp, Homo sapiens
tcctctgccagcagg

SEQ ID NO: 6419375 - DNA, 16 bp, Homo sapiens
tcctctgccagcagga

SEQ ID NO: 6419376 - DNA, 21 bp, Homo sapiens
tcctctgccccctcccccgca

SEQ ID NO: 6419377 - DNA, 18 bp, Homo sapiens
tcctctgcctacagccag

SEQ ID NO: 6419378 - DNA, 19 bp, Homo sapiens
tcctctgcctacagccagg

SEQ ID NO: 6419379 - DNA, 12 bp, Homo sapiens
tcctctgcctcc

SEQ ID NO: 6419380 - DNA, 11 bp, Homo sapiens
tcctctgcctg

SEQ ID NO: 6419381 - DNA, 12 bp, Homo sapiens
tcctctgcctgc

SEQ ID NO: 6419382 - DNA, 14 bp, Homo sapiens
tcctctgcctgccc

SEQ ID NO: 6419383 - DNA, 15 bp, Homo sapiens
tcctctgcctgtgcc

SEQ ID NO: 6419384 - DNA, 14 bp, Homo sapiens
tcctctgccttgga

SEQ ID NO: 6419385 - DNA, 15 bp, Homo sapiens
tcctctgccttggac

SEQ ID NO: 6419386 - DNA, 17 bp, Homo sapiens
tcctctgccttggacac

SEQ ID NO: 6419387 - DNA, 22 bp, Homo sapiens
tcctctgccttggacaccatcc

SEQ ID NO: 6419388 - DNA, 24 bp, Homo sapiens
tcctctgcctttgttcactgtgag

SEQ ID NO: 6419389 - DNA, 23 bp, Homo sapiens
tcctctgctaaattgatgttgat

SEQ ID NO: 6419390 - DNA, 22 bp, Homo sapiens
tcctctgctccaacagacaccc

SEQ ID NO: 6419391 - DNA, 13 bp, Homo sapiens
tcctctgctccag

SEQ ID NO: 6419392 - DNA, 16 bp, Homo sapiens
tcctctgctccagcaa

SEQ ID NO: 6419393 - DNA, 20 bp, Homo sapiens
tcctctgctccagcaactgc

SEQ ID NO: 6419394 - DNA, 19 bp, Homo sapiens
tcctctgctcccccttttc

SEQ ID NO: 6419395 - DNA, 21 bp, Homo sapiens
tcctctgctgacctgctgacc

SEQ ID NO: 6419396 - DNA, 16 bp, Homo sapiens
tcctctgctgccattt

SEQ ID NO: 6419397 - DNA, 14 bp, Homo sapiens
tcctctgctgctcc

SEQ ID NO: 6419398 - DNA, 17 bp, Homo sapiens
tcctctgcttgtcattc

SEQ ID NO: 6419399 - DNA, 15 bp, Homo sapiens
tcctctgctttgaaa

SEQ ID NO: 6419400 - DNA, 11 bp, Homo sapiens
tcctctggagc

SEQ ID NO: 6419401 - DNA, 9 bp, Homo sapiens
tcctctggc

SEQ ID NO: 6419402 - DNA, 17 bp, Homo sapiens
tcctctggcaggcttcc

SEQ ID NO: 6419403 - DNA, 20 bp, Homo sapiens
tcctctggcaggcttccccc

SEQ ID NO: 6419404 - DNA, 13 bp, Homo sapiens
tcctctggccgca

SEQ ID NO: 6419405 - DNA, 15 bp, Homo sapiens
tcctctggctcccca

SEQ ID NO: 6419406 - DNA, 23 bp, Homo sapiens
tcctctggcttccctctctgaaa

SEQ ID NO: 6419407 - DNA, 15 bp, Homo sapiens
tcctctggcttggcc

SEQ ID NO: 6419408 - DNA, 22 bp, Homo sapiens
tcctctggcttggccacagcca

SEQ ID NO: 6419409 - DNA, 15 bp, Homo sapiens
tcctctggctttccc

SEQ ID NO: 6419410 - DNA, 17 bp, Homo sapiens
tcctctggctttcccag

SEQ ID NO: 6419411 - DNA, 20 bp, Homo sapiens
tcctctggctttcccaggag

SEQ ID NO: 6419412 - DNA, 13 bp, Homo sapiens
tcctctgggcctg

SEQ ID NO: 6419413 - DNA, 15 bp, Homo sapiens
tcctctgggcctggg

SEQ ID NO: 6419414 - DNA, 13 bp, Homo sapiens
tcctctggggctc

SEQ ID NO: 6419415 - DNA, 16 bp, Homo sapiens
tcctctggtgtttatt

SEQ ID NO: 6419416 - DNA, 17 bp, Homo sapiens
tcctctggtttctgtgt

SEQ ID NO: 6419417 - DNA, 22 bp, Homo sapiens
tcctctggtttctgtgtgtccg

SEQ ID NO: 6419418 - DNA, 18 bp, Homo sapiens
tcctctgtaagacaacat

SEQ ID NO: 6419419 - DNA, 13 bp, Homo sapiens
tcctctgtacaga

SEQ ID NO: 6419420 - DNA, 15 bp, Homo sapiens
tcctctgtacagagc

SEQ ID NO: 6419421 - DNA, 18 bp, Homo sapiens
tcctctgtacagagccca

SEQ ID NO: 6419422 - DNA, 20 bp, Homo sapiens
tcctctgtagtattttttaa

SEQ ID NO: 6419423 - DNA, 22 bp, Homo sapiens
tcctctgtcagtcacagccacc

SEQ ID NO: 6419424 - DNA, 22 bp, Homo sapiens
tcctctgtcagtttgtgaagtg

SEQ ID NO: 6419425 - DNA, 13 bp, Homo sapiens
tcctctgtccagg

SEQ ID NO: 6419426 - DNA, 17 bp, Homo sapiens
tcctctgtccccatagc

SEQ ID NO: 6419427 - DNA, 22 bp, Homo sapiens
tcctctgtccgtctgtcctgcg

SEQ ID NO: 6419428 - DNA, 12 bp, Homo sapiens
tcctctgtgaaa

SEQ ID NO: 6419429 - DNA, 20 bp, Homo sapiens
tcctctgtgaccaatgtctt

SEQ ID NO: 6419430 - DNA, 13 bp, Homo sapiens
tcctctgtgctcc

SEQ ID NO: 6419431 - DNA, 21 bp, Homo sapiens
tcctctgtgctcctgtccctc

SEQ ID NO: 6419432 - DNA, 18 bp, Homo sapiens
tcctctgtggtgtctgcc

SEQ ID NO: 6419433 - DNA, 12 bp, Homo sapiens
tcctctgttcac

SEQ ID NO: 6419434 - DNA, 13 bp, Homo sapiens
tcctctgttcaca

SEQ ID NO: 6419435 - DNA, 15 bp, Homo sapiens
tcctctgttcacaaa

SEQ ID NO: 6419436 - DNA, 11 bp, Homo sapiens
tcctctgttct

SEQ ID NO: 6419437 - DNA, 21 bp, Homo sapiens
tcctcttaatgtctcaaaata

SEQ ID NO: 6419438 - DNA, 12 bp, Homo sapiens
tcctcttacctg

SEQ ID NO: 6419439 - DNA, 14 bp, Homo sapiens
tcctcttacctgta

SEQ ID NO: 6419440 - DNA, 23 bp, Homo sapiens
tcctcttacctgtaatagcctca

SEQ ID NO: 6419441 - DNA, 15 bp, Homo sapiens
tcctcttagcctctg

SEQ ID NO: 6419442 - DNA, 18 bp, Homo sapiens
tcctcttaggtcccggga

SEQ ID NO: 6419443 - DNA, 15 bp, Homo sapiens
tcctcttataacttc

SEQ ID NO: 6419444 - DNA, 13 bp, Homo sapiens
tcctcttcaccag

SEQ ID NO: 6419445 - DNA, 14 bp, Homo sapiens
tcctcttcaccagg

SEQ ID NO: 6419446 - DNA, 15 bp, Homo sapiens
tcctcttcaccaggt

SEQ ID NO: 6419447 - DNA, 15 bp, Homo sapiens
tcctcttccatgctg

SEQ ID NO: 6419448 - DNA, 12 bp, Homo sapiens
tcctcttcccag

SEQ ID NO: 6419449 - DNA, 14 bp, Homo sapiens
tcctcttcccagag

SEQ ID NO: 6419450 - DNA, 18 bp, Homo sapiens
tcctcttccctctctgca

SEQ ID NO: 6419451 - DNA, 19 bp, Homo sapiens
tcctcttcccttagcctct

SEQ ID NO: 6419452 - DNA, 18 bp, Homo sapiens
tcctcttccgagctgctt

SEQ ID NO: 6419453 - DNA, 12 bp, Homo sapiens
tcctcttcctct

SEQ ID NO: 6419454 - DNA, 15 bp, Homo sapiens
tcctcttcctctgag

SEQ ID NO: 6419455 - DNA, 21 bp, Homo sapiens
tcctcttcctgaattttattt

SEQ ID NO: 6419456 - DNA, 13 bp, Homo sapiens
tcctcttccttct

SEQ ID NO: 6419457 - DNA, 14 bp, Homo sapiens
tcctcttccttctc

SEQ ID NO: 6419458 - DNA, 16 bp, Homo sapiens
tcctcttcggccctca

SEQ ID NO: 6419459 - DNA, 19 bp, Homo sapiens
tcctcttcgtggttgtgtt

SEQ ID NO: 6419460 - DNA, 16 bp, Homo sapiens
tcctcttctaactcat

SEQ ID NO: 6419461 - DNA, 22 bp, Homo sapiens
tcctcttctactcacttttccc

SEQ ID NO: 6419462 - DNA, 17 bp, Homo sapiens
tcctcttctgacgtgcc

SEQ ID NO: 6419463 - DNA, 17 bp, Homo sapiens
tcctcttctgcatcttg

SEQ ID NO: 6419464 - DNA, 19 bp, Homo sapiens
tcctcttctgctcttttcc

SEQ ID NO: 6419465 - DNA, 13 bp, Homo sapiens
tcctcttctgggc

SEQ ID NO: 6419466 - DNA, 16 bp, Homo sapiens
tcctcttcttgttgac

SEQ ID NO: 6419467 - DNA, 13 bp, Homo sapiens
tcctcttctttat

SEQ ID NO: 6419468 - DNA, 17 bp, Homo sapiens
tcctcttgattcctggt

SEQ ID NO: 6419469 - DNA, 20 bp, Homo sapiens
tcctcttgccacatcttgaa

SEQ ID NO: 6419470 - DNA, 14 bp, Homo sapiens
tcctcttgctcaaa

SEQ ID NO: 6419471 - DNA, 21 bp, Homo sapiens
tcctcttggtgggtgtggcca

SEQ ID NO: 6419472 - DNA, 23 bp, Homo sapiens
tcctcttggtgggtgtggccagc

SEQ ID NO: 6419473 - DNA, 19 bp, Homo sapiens
tcctcttgtaaataaagcc

SEQ ID NO: 6419474 - DNA, 17 bp, Homo sapiens
tcctcttgttcctgaaa

SEQ ID NO: 6419475 - DNA, 18 bp, Homo sapiens
tcctctttaaaacaaaac

SEQ ID NO: 6419476 - DNA, 16 bp, Homo sapiens
tatgattcccagccag

SEQ ID NO: 6419477 - DNA, 23 bp, Homo sapiens
tatgattcccttttctttaagtt

SEQ ID NO: 6419478 - DNA, 20 bp, Homo sapiens
tatgattctagtacataatt

SEQ ID NO: 6419479 - DNA, 15 bp, Homo sapiens
tatgattctattata

SEQ ID NO: 6419480 - DNA, 14 bp, Homo sapiens
tatgattctcctct

SEQ ID NO: 6419481 - DNA, 14 bp, Homo sapiens
tatgattctctgtg

SEQ ID NO: 6419482 - DNA, 14 bp, Homo sapiens
tatgattgaaaaga

SEQ ID NO: 6419483 - DNA, 17 bp, Homo sapiens
tatgattgaaaagaaga

SEQ ID NO: 6419484 - DNA, 15 bp, Homo sapiens
tatgattgcactaaa

SEQ ID NO: 6419485 - DNA, 20 bp, Homo sapiens
tatgattgcctttttataac

SEQ ID NO: 6419486 - DNA, 15 bp, Homo sapiens
tatgattgctccaga

SEQ ID NO: 6419487 - DNA, 17 bp, Homo sapiens
tatgattggttcagttt

SEQ ID NO: 6419488 - DNA, 18 bp, Homo sapiens
tatgattggttcagtttt

SEQ ID NO: 6419489 - DNA, 15 bp, Homo sapiens
tatgattgtaacata

SEQ ID NO: 6419490 - DNA, 15 bp, Homo sapiens
tatgattgtttgcac

SEQ ID NO: 6419491 - DNA, 17 bp, Homo sapiens
tatgattgtttgcacag

SEQ ID NO: 6419492 - DNA, 17 bp, Homo sapiens
tatgatttaaaaaataa

SEQ ID NO: 6419493 - DNA, 20 bp, Homo sapiens
tatgatttaaaaaataaata

SEQ ID NO: 6419494 - DNA, 18 bp, Homo sapiens
tatgatttaaaacatgta

SEQ ID NO: 6419495 - DNA, 17 bp, Homo sapiens
tatgatttataaacaga

SEQ ID NO: 6419496 - DNA, 22 bp, Homo sapiens
tatgatttcactagaaaagctg

SEQ ID NO: 6419497 - DNA, 20 bp, Homo sapiens
tatgatttctgttgttattc

SEQ ID NO: 6419498 - DNA, 16 bp, Homo sapiens
tatgatttgcatgtgt

SEQ ID NO: 6419499 - DNA, 14 bp, Homo sapiens
tatgatttgcattt

SEQ ID NO: 6419500 - DNA, 15 bp, Homo sapiens
tatgatttggaaaat

SEQ ID NO: 6419501 - DNA, 18 bp, Homo sapiens
tatgatttggaaaataaa

SEQ ID NO: 6419502 - DNA, 20 bp, Homo sapiens
tatgatttgttcctttctgg

SEQ ID NO: 6419503 - DNA, 21 bp, Homo sapiens
tatgatttgttcctttctgga

SEQ ID NO: 6419504 - DNA, 16 bp, Homo sapiens
tatgattttatttgac

SEQ ID NO: 6419505 - DNA, 16 bp, Homo sapiens
tatgattttcataact

SEQ ID NO: 6419506 - DNA, 19 bp, Homo sapiens
tatgattttccctaaaaga

SEQ ID NO: 6419507 - DNA, 18 bp, Homo sapiens
tatgattttctatttttc

SEQ ID NO: 6419508 - DNA, 20 bp, Homo sapiens
tatgattttttaaaagaaat

SEQ ID NO: 6419509 - DNA, 21 bp, Homo sapiens
tatgattttttaaaagaaatt

SEQ ID NO: 6419510 - DNA, 17 bp, Homo sapiens
tatgatttttttttcat

SEQ ID NO: 6419511 - DNA, 17 bp, Homo sapiens
tatgatttttttttcca

SEQ ID NO: 6419512 - DNA, 14 bp, Homo sapiens
tatgcaaaaacata

SEQ ID NO: 6419513 - DNA, 15 bp, Homo sapiens
tatgcaaaaacatat

SEQ ID NO: 6419514 - DNA, 21 bp, Homo sapiens
tatgcaaaaacatatgtctgt

SEQ ID NO: 6419515 - DNA, 22 bp, Homo sapiens
tatgcaaaaacatatgtctgtc

SEQ ID NO: 6419516 - DNA, 14 bp, Homo sapiens
tatgcaaaagcaag

SEQ ID NO: 6419517 - DNA, 23 bp, Homo sapiens
tatgcaaaagtacaagggctgag

SEQ ID NO: 6419518 - DNA, 16 bp, Homo sapiens
tatgcaaaatgtctgt

SEQ ID NO: 6419519 - DNA, 15 bp, Homo sapiens
tatgcaaaatttaga

SEQ ID NO: 6419520 - DNA, 19 bp, Homo sapiens
tatgcaaaatttagaagaa

SEQ ID NO: 6419521 - DNA, 16 bp, Homo sapiens
tatgcaaacagggtaa

SEQ ID NO: 6419522 - DNA, 21 bp, Homo sapiens
tatgcaaacagttcttggacc

SEQ ID NO: 6419523 - DNA, 19 bp, Homo sapiens
tatgcaaagcactctctgc

SEQ ID NO: 6419524 - DNA, 20 bp, Homo sapiens
tatgcaaagcactctctgca

SEQ ID NO: 6419525 - DNA, 13 bp, Homo sapiens
tatgcaaagtcta

SEQ ID NO: 6419526 - DNA, 13 bp, Homo sapiens
tatgcaaatgaga

SEQ ID NO: 6419527 - DNA, 19 bp, Homo sapiens
tatgcaaatgagatttctt

SEQ ID NO: 6419528 - DNA, 13 bp, Homo sapiens
tatgcaacctgtg

SEQ ID NO: 6419529 - DNA, 14 bp, Homo sapiens
tatgcaacctgtgc

SEQ ID NO: 6419530 - DNA, 18 bp, Homo sapiens
tatgcaacctgtgcaaaa

SEQ ID NO: 6419531 - DNA, 19 bp, Homo sapiens
tatgcaacctgtgcaaaat

SEQ ID NO: 6419532 - DNA, 18 bp, Homo sapiens
tatgcaacgtttaacatt

SEQ ID NO: 6419533 - DNA, 14 bp, Homo sapiens
tatgcaagcagctt

SEQ ID NO: 6419534 - DNA, 18 bp, Homo sapiens
tatgcaagcagtttcaat

SEQ ID NO: 6419535 - DNA, 23 bp, Homo sapiens
tatgcaagcagtttcaataaagt

SEQ ID NO: 6419536 - DNA, 20 bp, Homo sapiens
tatgcaaggaaggaaagaaa

SEQ ID NO: 6419537 - DNA, 18 bp, Homo sapiens
tatgcaaggcggtacact

SEQ ID NO: 6419538 - DNA, 15 bp, Homo sapiens
tatgcaagtctgtga

SEQ ID NO: 6419539 - DNA, 23 bp, Homo sapiens
tatgcaagtgggagatgaaaacc

SEQ ID NO: 6419540 - DNA, 15 bp, Homo sapiens
tatgcaatatatcta

SEQ ID NO: 6419541 - DNA, 18 bp, Homo sapiens
tatgcaatcaaatctgct

SEQ ID NO: 6419542 - DNA, 22 bp, Homo sapiens
tatgcaatggattttcaaccag

SEQ ID NO: 6419543 - DNA, 12 bp, Homo sapiens
tatgcaattcag

SEQ ID NO: 6419544 - DNA, 16 bp, Homo sapiens
tatgcaatttcctttt

SEQ ID NO: 6419545 - DNA, 18 bp, Homo sapiens
tatgcaatttttaaacta

SEQ ID NO: 6419546 - DNA, 21 bp, Homo sapiens
tatgcaatttttaaactagta

SEQ ID NO: 6419547 - DNA, 23 bp, Homo sapiens
tatgcaatttttaaactagtaat

SEQ ID NO: 6419548 - DNA, 14 bp, Homo sapiens
tatgcacacacata

SEQ ID NO: 6419549 - DNA, 14 bp, Homo sapiens
tatgcacacatttt

SEQ ID NO: 6419550 - DNA, 21 bp, Homo sapiens
tatgcacacttttaattttgt

SEQ ID NO: 6419551 - DNA, 13 bp, Homo sapiens
tatgcacagagcc

SEQ ID NO: 6419552 - DNA, 22 bp, Homo sapiens
tatgcacagagcccaatgcata

SEQ ID NO: 6419553 - DNA, 14 bp, Homo sapiens
tatgcacagcctag

SEQ ID NO: 6419554 - DNA, 14 bp, Homo sapiens
tatgcacagtaaaa

SEQ ID NO: 6419555 - DNA, 16 bp, Homo sapiens
tatgcacatgaactta

SEQ ID NO: 6419556 - DNA, 19 bp, Homo sapiens
tatgcacatgaacttagat

SEQ ID NO: 6419557 - DNA, 21 bp, Homo sapiens
tatgcaccaggtctcaaggtt

SEQ ID NO: 6419558 - DNA, 12 bp, Homo sapiens
tatgcacccctg

SEQ ID NO: 6419559 - DNA, 18 bp, Homo sapiens
tatgcaccttgtgtctgt

SEQ ID NO: 6419560 - DNA, 19 bp, Homo sapiens
tatgcaccttgtgtctgta

SEQ ID NO: 6419561 - DNA, 18 bp, Homo sapiens
tatgcactaagtctcttt

SEQ ID NO: 6419562 - DNA, 16 bp, Homo sapiens
tatgcactgaagagct

SEQ ID NO: 6419563 - DNA, 18 bp, Homo sapiens
tatgcactgaagagctct

SEQ ID NO: 6419564 - DNA, 19 bp, Homo sapiens
tatgcactgaagagctctt

SEQ ID NO: 6419565 - DNA, 20 bp, Homo sapiens
tatgcactgaagagctcttg

SEQ ID NO: 6419566 - DNA, 23 bp, Homo sapiens
tatgcactgaagagctcttggcc

SEQ ID NO: 6419567 - DNA, 21 bp, Homo sapiens
tatgcactgtggtttcagatg

SEQ ID NO: 6419568 - DNA, 20 bp, Homo sapiens
tatgcacttataattttcct

SEQ ID NO: 6419569 - DNA, 14 bp, Homo sapiens
tatgcacttggcct

SEQ ID NO: 6419570 - DNA, 20 bp, Homo sapiens
tatgcactttccctagaaag

SEQ ID NO: 6419571 - DNA, 21 bp, Homo sapiens
tatgcagaacaggcagaaata

SEQ ID NO: 6419572 - DNA, 19 bp, Homo sapiens
tatgcagaacgtatttagc

SEQ ID NO: 6419573 - DNA, 17 bp, Homo sapiens
tatgcagaagcatattt

SEQ ID NO: 6419574 - DNA, 23 bp, Homo sapiens
tatgcagaagcatattttgctgg

SEQ ID NO: 6419575 - DNA, 15 bp, Homo sapiens
tatgcagaatacttt

SEQ ID NO: 6419576 - DNA, 15 bp, Homo sapiens
tatgcagagcttgtg

SEQ ID NO: 6419577 - DNA, 17 bp, Homo sapiens
tatgcagatagaatcaa

SEQ ID NO: 6419578 - DNA, 19 bp, Homo sapiens
tatgcagccatatatggaa

SEQ ID NO: 6419579 - DNA, 13 bp, Homo sapiens
tatgcagcctgct

SEQ ID NO: 6419580 - DNA, 16 bp, Homo sapiens
tatgcagggagcactg

SEQ ID NO: 6419581 - DNA, 17 bp, Homo sapiens
tatgcagggagcactgt

SEQ ID NO: 6419582 - DNA, 20 bp, Homo sapiens
tatgcagggagcactgttca

SEQ ID NO: 6419583 - DNA, 21 bp, Homo sapiens
tatgcagtatgctacccacag

SEQ ID NO: 6419584 - DNA, 15 bp, Homo sapiens
tatgcagtattcttg

SEQ ID NO: 6419585 - DNA, 14 bp, Homo sapiens
tatgcagtgctgct

SEQ ID NO: 6419586 - DNA, 15 bp, Homo sapiens
tatgcagtgctgctt

SEQ ID NO: 6419587 - DNA, 23 bp, Homo sapiens
tatgcagtgtttccctctgtgtt

SEQ ID NO: 6419588 - DNA, 14 bp, Homo sapiens
tatgcataaagtca

SEQ ID NO: 6419589 - DNA, 15 bp, Homo sapiens
tatgcataaagtcag

SEQ ID NO: 6419590 - DNA, 20 bp, Homo sapiens
tatgcataactgacaaatca

SEQ ID NO: 6419591 - DNA, 23 bp, Homo sapiens
tatgcataactgacaaatcaagt

SEQ ID NO: 6419592 - DNA, 21 bp, Homo sapiens
tatgcatacaaatctcactgt

SEQ ID NO: 6419593 - DNA, 15 bp, Homo sapiens
tatgcatagatatat

SEQ ID NO: 6419594 - DNA, 19 bp, Homo sapiens
tatgcatatatatatgtgt

SEQ ID NO: 6419595 - DNA, 16 bp, Homo sapiens
tatgcatatatatgta

SEQ ID NO: 6419596 - DNA, 20 bp, Homo sapiens
tatgcatatatatgtatatt

SEQ ID NO: 6419597 - DNA, 16 bp, Homo sapiens
tatgcatattcaatgt

SEQ ID NO: 6419598 - DNA, 15 bp, Homo sapiens
tatgcatatttgttt

SEQ ID NO: 6419599 - DNA, 18 bp, Homo sapiens
tatgcatcccacagccag

SEQ ID NO: 6419600 - DNA, 23 bp, Homo sapiens
tatgcatccccatccccatgccc

SEQ ID NO: 6419601 - DNA, 16 bp, Homo sapiens
tatgcatctaataaaa

SEQ ID NO: 6419602 - DNA, 22 bp, Homo sapiens
tatgcatgaaatgaatgtctga

SEQ ID NO: 6419603 - DNA, 18 bp, Homo sapiens
tatgcatgaagtaatatg

SEQ ID NO: 6419604 - DNA, 15 bp, Homo sapiens
tatgcatgagaacta

SEQ ID NO: 6419605 - DNA, 18 bp, Homo sapiens
tatgcatgagaactaaat

SEQ ID NO: 6419606 - DNA, 19 bp, Homo sapiens
tatgcatgagaactaaata

SEQ ID NO: 6419607 - DNA, 21 bp, Homo sapiens
tatgcatgagaactaaataga

SEQ ID NO: 6419608 - DNA, 21 bp, Homo sapiens
tatgcatgtagcatataaatg

SEQ ID NO: 6419609 - DNA, 15 bp, Homo sapiens
tatgcattagtatca

SEQ ID NO: 6419610 - DNA, 17 bp, Homo sapiens
tatgcattagtatcaca

SEQ ID NO: 6419611 - DNA, 14 bp, Homo sapiens
tatgcattatatca

SEQ ID NO: 6419612 - DNA, 16 bp, Homo sapiens
tatgcattatatcaaa

SEQ ID NO: 6419613 - DNA, 15 bp, Homo sapiens
tatgcattcaagaga

SEQ ID NO: 6419614 - DNA, 18 bp, Homo sapiens
tatgcattcaagagaggt

SEQ ID NO: 6419615 - DNA, 12 bp, Homo sapiens
tatgcattgtct

SEQ ID NO: 6419616 - DNA, 22 bp, Homo sapiens
tatgcatttaaatacagtcttc

SEQ ID NO: 6419617 - DNA, 19 bp, Homo sapiens
tatgcatttaattctgaaa

SEQ ID NO: 6419618 - DNA, 19 bp, Homo sapiens
tatgcatttatgcatgaga

SEQ ID NO: 6419619 - DNA, 17 bp, Homo sapiens
tatgcatttcattcaaa

SEQ ID NO: 6419620 - DNA, 11 bp, Homo sapiens
tatgcatttga

SEQ ID NO: 6419621 - DNA, 17 bp, Homo sapiens
tatgccaaagatcactt

SEQ ID NO: 6419622 - DNA, 15 bp, Homo sapiens
tatgccaaatgttaa

SEQ ID NO: 6419623 - DNA, 20 bp, Homo sapiens
tatgccaatcttaaagacaa

SEQ ID NO: 6419624 - DNA, 18 bp, Homo sapiens
tatgccacacctggcctt

SEQ ID NO: 6419625 - DNA, 21 bp, Homo sapiens
tatgccaccaacttacaaaaa

SEQ ID NO: 6419626 - DNA, 21 bp, Homo sapiens
tatgccaccccatgtgccttt

SEQ ID NO: 6419627 - DNA, 15 bp, Homo sapiens
tatgccactgcactc

SEQ ID NO: 6419628 - DNA, 22 bp, Homo sapiens
tatgccatagcaagattgctta

SEQ ID NO: 6419629 - DNA, 17 bp, Homo sapiens
tatgccatgatggaaat

SEQ ID NO: 6419630 - DNA, 15 bp, Homo sapiens
tatgccatgtatgtt

SEQ ID NO: 6419631 - DNA, 19 bp, Homo sapiens
tatgccattggggtagttg

SEQ ID NO: 6419632 - DNA, 20 bp, Homo sapiens
tatgccatttcttctctctg

SEQ ID NO: 6419633 - DNA, 21 bp, Homo sapiens
tatgccatttcttctctctgt

SEQ ID NO: 6419634 - DNA, 18 bp, Homo sapiens
tatgcccaggtaccaccc

SEQ ID NO: 6419635 - DNA, 12 bp, Homo sapiens
tatgcccagttt

SEQ ID NO: 6419636 - DNA, 15 bp, Homo sapiens
tatgcccatgaacaa

SEQ ID NO: 6419637 - DNA, 18 bp, Homo sapiens
tatgcccattcttttcac

SEQ ID NO: 6419638 - DNA, 20 bp, Homo sapiens
tatgcccattcttttcactt

SEQ ID NO: 6419639 - DNA, 15 bp, Homo sapiens
tatgccccaaatata

SEQ ID NO: 6419640 - DNA, 15 bp, Homo sapiens
tatgccccattcaac

SEQ ID NO: 6419641 - DNA, 21 bp, Homo sapiens
tatgcccctagtaactgctgt

SEQ ID NO: 6419642 - DNA, 20 bp, Homo sapiens
tatgccccttcttgggcccc

SEQ ID NO: 6419643 - DNA, 23 bp, Homo sapiens
tatgccccttcttgggccccaga

SEQ ID NO: 6419644 - DNA, 19 bp, Homo sapiens
tatgcccggcgccgggcac

SEQ ID NO: 6419645 - DNA, 23 bp, Homo sapiens
tatgccctcaagtaaaagaaaag

SEQ ID NO: 6419646 - DNA, 17 bp, Homo sapiens
tatgccctgcagagcaa

SEQ ID NO: 6419647 - DNA, 20 bp, Homo sapiens
tatgccgaatgccctcaggg

SEQ ID NO: 6419648 - DNA, 18 bp, Homo sapiens
tatgccgtgtagtttctg

SEQ ID NO: 6419649 - DNA, 21 bp, Homo sapiens
tatgccgtgtagtttctggta

SEQ ID NO: 6419650 - DNA, 18 bp, Homo sapiens
tatgcctacagccctcac

SEQ ID NO: 6419651 - DNA, 13 bp, Homo sapiens
tatgcctatattt

SEQ ID NO: 6419652 - DNA, 14 bp, Homo sapiens
tatgcctcatgctg

SEQ ID NO: 6419653 - DNA, 15 bp, Homo sapiens
tcctctttactctgg

SEQ ID NO: 6419654 - DNA, 15 bp, Homo sapiens
tcctctttagagtta

SEQ ID NO: 6419655 - DNA, 20 bp, Homo sapiens
tcctctttagagttagactg

SEQ ID NO: 6419656 - DNA, 18 bp, Homo sapiens
tcctctttcagaaaacag

SEQ ID NO: 6419657 - DNA, 21 bp, Homo sapiens
tcctctttcagaaaacagaaa

SEQ ID NO: 6419658 - DNA, 12 bp, Homo sapiens
tcctctttcagc

SEQ ID NO: 6419659 - DNA, 14 bp, Homo sapiens
tcctctttcagctc

SEQ ID NO: 6419660 - DNA, 15 bp, Homo sapiens
tcctctttcagctcc

SEQ ID NO: 6419661 - DNA, 18 bp, Homo sapiens
tcctctttcccctccttt

SEQ ID NO: 6419662 - DNA, 17 bp, Homo sapiens
tcctctttctctcccca

SEQ ID NO: 6419663 - DNA, 21 bp, Homo sapiens
tcctctttctctccttcttcc

SEQ ID NO: 6419664 - DNA, 22 bp, Homo sapiens
tcctctttctgctctgccatct

SEQ ID NO: 6419665 - DNA, 22 bp, Homo sapiens
tcctctttggtctacactgtgc

SEQ ID NO: 6419666 - DNA, 22 bp, Homo sapiens
tcctcttttcctggcagctgct

SEQ ID NO: 6419667 - DNA, 21 bp, Homo sapiens
tcctcttttgtgagaagatgg

SEQ ID NO: 6419668 - DNA, 18 bp, Homo sapiens
tcctcttttgttgtttct

SEQ ID NO: 6419669 - DNA, 16 bp, Homo sapiens
tcctgaaacagtgttt

SEQ ID NO: 6419670 - DNA, 18 bp, Homo sapiens
tcctgaaacctcttccta

SEQ ID NO: 6419671 - DNA, 17 bp, Homo sapiens
tcctgaaacgctccttt

SEQ ID NO: 6419672 - DNA, 14 bp, Homo sapiens
tcctgaaactatat

SEQ ID NO: 6419673 - DNA, 21 bp, Homo sapiens
tcctgaaactatattttgtca

SEQ ID NO: 6419674 - DNA, 23 bp, Homo sapiens
tcctgaaactatattttgtcata

SEQ ID NO: 6419675 - DNA, 16 bp, Homo sapiens
tcctgaaagacaatat

SEQ ID NO: 6419676 - DNA, 15 bp, Homo sapiens
tcctgaaagccagca

SEQ ID NO: 6419677 - DNA, 13 bp, Homo sapiens
tcctgaaagcggc

SEQ ID NO: 6419678 - DNA, 20 bp, Homo sapiens
tcctgaaagcggctgcctcc

SEQ ID NO: 6419679 - DNA, 12 bp, Homo sapiens
tcctgaaagctg

SEQ ID NO: 6419680 - DNA, 15 bp, Homo sapiens
tcctgaaagggcact

SEQ ID NO: 6419681 - DNA, 16 bp, Homo sapiens
tcctgaaagggcactt

SEQ ID NO: 6419682 - DNA, 22 bp, Homo sapiens
tcctgaaagtgtttttaaataa

SEQ ID NO: 6419683 - DNA, 15 bp, Homo sapiens
tcctgaaataaacac

SEQ ID NO: 6419684 - DNA, 15 bp, Homo sapiens
tcctgaaataaatgt

SEQ ID NO: 6419685 - DNA, 19 bp, Homo sapiens
tcctgaaatatccaggaat

SEQ ID NO: 6419686 - DNA, 15 bp, Homo sapiens
tcctgaaatgtgttt

SEQ ID NO: 6419687 - DNA, 14 bp, Homo sapiens
tcctgaaattcaga

SEQ ID NO: 6419688 - DNA, 14 bp, Homo sapiens
tcctgaaatttcag

SEQ ID NO: 6419689 - DNA, 16 bp, Homo sapiens
tcctgaacaagaaaga

SEQ ID NO: 6419690 - DNA, 20 bp, Homo sapiens
tcctgaacagcatggcactc

SEQ ID NO: 6419691 - DNA, 15 bp, Homo sapiens
tcctgaacagctggg

SEQ ID NO: 6419692 - DNA, 22 bp, Homo sapiens
tcctgaacagctgggaccacag

SEQ ID NO: 6419693 - DNA, 19 bp, Homo sapiens
tcctgaaccagtcctgctg

SEQ ID NO: 6419694 - DNA, 22 bp, Homo sapiens
tcctgaaccagtcctgctgcct

SEQ ID NO: 6419695 - DNA, 23 bp, Homo sapiens
tcctgaaccagtcctgctgcctg

SEQ ID NO: 6419696 - DNA, 18 bp, Homo sapiens
tcctgaaccgactgaccc

SEQ ID NO: 6419697 - DNA, 21 bp, Homo sapiens
tcctgaaccgcacagctcagg

SEQ ID NO: 6419698 - DNA, 13 bp, Homo sapiens
tcctgaactgtga

SEQ ID NO: 6419699 - DNA, 12 bp, Homo sapiens
tcctgaagaaat

SEQ ID NO: 6419700 - DNA, 14 bp, Homo sapiens
tcctgaagaggcgg

SEQ ID NO: 6419701 - DNA, 23 bp, Homo sapiens
tcctgaagaggcgggccagccag

SEQ ID NO: 6419702 - DNA, 19 bp, Homo sapiens
tcctgaagatcaagccagt

SEQ ID NO: 6419703 - DNA, 10 bp, Homo sapiens
tcctgaagca

SEQ ID NO: 6419704 - DNA, 14 bp, Homo sapiens
tcctgaagccagat

SEQ ID NO: 6419705 - DNA, 19 bp, Homo sapiens
tcctgaagccagatccacc

SEQ ID NO: 6419706 - DNA, 21 bp, Homo sapiens
tcctgaagccagatccaccct

SEQ ID NO: 6419707 - DNA, 17 bp, Homo sapiens
tcctgaagcctctgccc

SEQ ID NO: 6419708 - DNA, 13 bp, Homo sapiens
tcctgaagctgct

SEQ ID NO: 6419709 - DNA, 18 bp, Homo sapiens
tcctgaagctgctgtgtc

SEQ ID NO: 6419710 - DNA, 19 bp, Homo sapiens
tcctgaagctgctgtgtcc

SEQ ID NO: 6419711 - DNA, 22 bp, Homo sapiens
tcctgaaggaggcggggctcta

SEQ ID NO: 6419712 - DNA, 17 bp, Homo sapiens
tcctgaaggcctgaggt

SEQ ID NO: 6419713 - DNA, 15 bp, Homo sapiens
tcctgaagggaacta

SEQ ID NO: 6419714 - DNA, 19 bp, Homo sapiens
tcctgaagggggacactcc

SEQ ID NO: 6419715 - DNA, 17 bp, Homo sapiens
tcctgaagtgacctcac

SEQ ID NO: 6419716 - DNA, 13 bp, Homo sapiens
tcctgaagtgagt

SEQ ID NO: 6419717 - DNA, 15 bp, Homo sapiens
tcctgaataaaccag

SEQ ID NO: 6419718 - DNA, 11 bp, Homo sapiens
tcctgaataac

SEQ ID NO: 6419719 - DNA, 16 bp, Homo sapiens
tcctgaatacaagcct

SEQ ID NO: 6419720 - DNA, 16 bp, Homo sapiens
tcctgaatattaatcc

SEQ ID NO: 6419721 - DNA, 14 bp, Homo sapiens
tcctgaatctgtgc

SEQ ID NO: 6419722 - DNA, 14 bp, Homo sapiens
tcctgaatgaaata

SEQ ID NO: 6419723 - DNA, 22 bp, Homo sapiens
tcctgaatgaggcggagctcca

SEQ ID NO: 6419724 - DNA, 14 bp, Homo sapiens
tcctgaatgcatcc

SEQ ID NO: 6419725 - DNA, 23 bp, Homo sapiens
tcctgaatggctttgtcttgaaa

SEQ ID NO: 6419726 - DNA, 13 bp, Homo sapiens
tcctgaatgtaat

SEQ ID NO: 6419727 - DNA, 13 bp, Homo sapiens
tcctgaatgtagc

SEQ ID NO: 6419728 - DNA, 21 bp, Homo sapiens
tcctgaatttattattgttct

SEQ ID NO: 6419729 - DNA, 22 bp, Homo sapiens
tcctgaatttattattgttctt

SEQ ID NO: 6419730 - DNA, 19 bp, Homo sapiens
tcctgacaagttattactg

SEQ ID NO: 6419731 - DNA, 21 bp, Homo sapiens
tcctgacaagttcctaggaaa

SEQ ID NO: 6419732 - DNA, 23 bp, Homo sapiens
tcctgacaccaggcaagaaaagc

SEQ ID NO: 6419733 - DNA, 20 bp, Homo sapiens
tcctgacacccttctcccac

SEQ ID NO: 6419734 - DNA, 13 bp, Homo sapiens
tcctgacactgca

SEQ ID NO: 6419735 - DNA, 13 bp, Homo sapiens
tcctgacacttta

SEQ ID NO: 6419736 - DNA, 20 bp, Homo sapiens
tcctgacatattcaagtgat

SEQ ID NO: 6419737 - DNA, 20 bp, Homo sapiens
tcctgacatcacagcagcct

SEQ ID NO: 6419738 - DNA, 15 bp, Homo sapiens
tcctgaccaccctcc

SEQ ID NO: 6419739 - DNA, 16 bp, Homo sapiens
tcctgaccaccctccc

SEQ ID NO: 6419740 - DNA, 22 bp, Homo sapiens
tcctgaccaggatggagcaagc

SEQ ID NO: 6419741 - DNA, 18 bp, Homo sapiens
tcctgaccagggcaaggc

SEQ ID NO: 6419742 - DNA, 22 bp, Homo sapiens
tcctgaccagttgcagtcactc

SEQ ID NO: 6419743 - DNA, 16 bp, Homo sapiens
tcctgacccattgctg

SEQ ID NO: 6419744 - DNA, 15 bp, Homo sapiens
tcctgaccctcactt

SEQ ID NO: 6419745 - DNA, 13 bp, Homo sapiens
tcctgaccctccc

SEQ ID NO: 6419746 - DNA, 16 bp, Homo sapiens
tcctgaccctcccact

SEQ ID NO: 6419747 - DNA, 18 bp, Homo sapiens
tcctgaccctcccactcc

SEQ ID NO: 6419748 - DNA, 15 bp, Homo sapiens
tcctgacctcaggca

SEQ ID NO: 6419749 - DNA, 16 bp, Homo sapiens
tcctgaccttgtgatc

SEQ ID NO: 6419750 - DNA, 20 bp, Homo sapiens
tcctgacgaaactggccccg

SEQ ID NO: 6419751 - DNA, 21 bp, Homo sapiens
tcctgacgaaactggccccgg

SEQ ID NO: 6419752 - DNA, 22 bp, Homo sapiens
tcctgacgaaactggccccgga

SEQ ID NO: 6419753 - DNA, 13 bp, Homo sapiens
tcctgacgccctg

SEQ ID NO: 6419754 - DNA, 18 bp, Homo sapiens
tcctgactattatgttgt

SEQ ID NO: 6419755 - DNA, 17 bp, Homo sapiens
tcctgactcatccgcct

SEQ ID NO: 6419756 - DNA, 20 bp, Homo sapiens
tcctgactcatccgcctggc

SEQ ID NO: 6419757 - DNA, 19 bp, Homo sapiens
tcctgactccagtgagctg

SEQ ID NO: 6419758 - DNA, 23 bp, Homo sapiens
tcctgactcctacctgccctgga

SEQ ID NO: 6419759 - DNA, 23 bp, Homo sapiens
tcctgactcggtcaaaatatttt

SEQ ID NO: 6419760 - DNA, 20 bp, Homo sapiens
tcctgactctcacctgtact

SEQ ID NO: 6419761 - DNA, 16 bp, Homo sapiens
tcctgactctgccccc

SEQ ID NO: 6419762 - DNA, 22 bp, Homo sapiens
tcctgactctgccccctgctgg

SEQ ID NO: 6419763 - DNA, 13 bp, Homo sapiens
tcctgactgcccg

SEQ ID NO: 6419764 - DNA, 18 bp, Homo sapiens
tcctgactgggctgggtt

SEQ ID NO: 6419765 - DNA, 19 bp, Homo sapiens
tcctgactgggctgggttt

SEQ ID NO: 6419766 - DNA, 23 bp, Homo sapiens
tcctgactgggctgggtttgctg

SEQ ID NO: 6419767 - DNA, 13 bp, Homo sapiens
tcctgactgtaac

SEQ ID NO: 6419768 - DNA, 11 bp, Homo sapiens
tcctgacttca

SEQ ID NO: 6419769 - DNA, 21 bp, Homo sapiens
tcctgacttcaggggctgccc

SEQ ID NO: 6419770 - DNA, 12 bp, Homo sapiens
tcctgacttgag

SEQ ID NO: 6419771 - DNA, 24 bp, Homo sapiens
tcctgagaaaaaaggttccgcttg

SEQ ID NO: 6419772 - DNA, 22 bp, Homo sapiens
tcctgagaaacgtccatctctc

SEQ ID NO: 6419773 - DNA, 18 bp, Homo sapiens
tcctgagaaagcccacct

SEQ ID NO: 6419774 - DNA, 20 bp, Homo sapiens
tcctgagaaggcgaggagag

SEQ ID NO: 6419775 - DNA, 23 bp, Homo sapiens
tcctgagaataagaaagtttcac

SEQ ID NO: 6419776 - DNA, 14 bp, Homo sapiens
tcctgagacccctg

SEQ ID NO: 6419777 - DNA, 20 bp, Homo sapiens
tcctgagacccctggcctcc

SEQ ID NO: 6419778 - DNA, 15 bp, Homo sapiens
tcctgagacctcaat

SEQ ID NO: 6419779 - DNA, 14 bp, Homo sapiens
tcctgagattctgg

SEQ ID NO: 6419780 - DNA, 19 bp, Homo sapiens
tcctgagattctgggaaag

SEQ ID NO: 6419781 - DNA, 21 bp, Homo sapiens
tcctgagattctgggaaaggt

SEQ ID NO: 6419782 - DNA, 20 bp, Homo sapiens
tcctgagatttcctcctggc

SEQ ID NO: 6419783 - DNA, 12 bp, Homo sapiens
tcctgagcactg

SEQ ID NO: 6419784 - DNA, 16 bp, Homo sapiens
tcctgagcactgccag

SEQ ID NO: 6419785 - DNA, 20 bp, Homo sapiens
tcctgagcactgccaggagg

SEQ ID NO: 6419786 - DNA, 19 bp, Homo sapiens
tcctgagcagtccctgctt

SEQ ID NO: 6419787 - DNA, 14 bp, Homo sapiens
tcctgagccagatt

SEQ ID NO: 6419788 - DNA, 19 bp, Homo sapiens
tcctgagccagatttcact

SEQ ID NO: 6419789 - DNA, 21 bp, Homo sapiens
tcctgagccagatttcactct

SEQ ID NO: 6419790 - DNA, 20 bp, Homo sapiens
tcctgagcccaaccaggccc

SEQ ID NO: 6419791 - DNA, 11 bp, Homo sapiens
tcctgagcccc

SEQ ID NO: 6419792 - DNA, 16 bp, Homo sapiens
tcctgagcccccagct

SEQ ID NO: 6419793 - DNA, 15 bp, Homo sapiens
tcctgagccccctgc

SEQ ID NO: 6419794 - DNA, 18 bp, Homo sapiens
tcctgagccccgccctct

SEQ ID NO: 6419795 - DNA, 22 bp, Homo sapiens
tcctgagccccgccctcttcct

SEQ ID NO: 6419796 - DNA, 23 bp, Homo sapiens
tcctgagccccgccctcttcctg

SEQ ID NO: 6419797 - DNA, 18 bp, Homo sapiens
tcctgagcctgtctctcc

SEQ ID NO: 6419798 - DNA, 19 bp, Homo sapiens
tcctgagcctgtgggtccc

SEQ ID NO: 6419799 - DNA, 15 bp, Homo sapiens
tcctgagctaacact

SEQ ID NO: 6419800 - DNA, 13 bp, Homo sapiens
tcctgagctagga

SEQ ID NO: 6419801 - DNA, 14 bp, Homo sapiens
tcctgagctcaaat

SEQ ID NO: 6419802 - DNA, 12 bp, Homo sapiens
tcctgagctcag

SEQ ID NO: 6419803 - DNA, 13 bp, Homo sapiens
tcctgagctcagc

SEQ ID NO: 6419804 - DNA, 14 bp, Homo sapiens
tcctgagctgctgt

SEQ ID NO: 6419805 - DNA, 12 bp, Homo sapiens
tcctgagctgtc

SEQ ID NO: 6419806 - DNA, 13 bp, Homo sapiens
tcctgagctgtcg

SEQ ID NO: 6419807 - DNA, 16 bp, Homo sapiens
tcctgagctgtcgctg

SEQ ID NO: 6419808 - DNA, 18 bp, Homo sapiens
tcctgagctgtcgctgcc

SEQ ID NO: 6419809 - DNA, 23 bp, Homo sapiens
tcctgagctgtcgctgcctccat

SEQ ID NO: 6419810 - DNA, 20 bp, Homo sapiens
tcctgagcttggccagaagg

SEQ ID NO: 6419811 - DNA, 16 bp, Homo sapiens
tcctgaggacagctgt

SEQ ID NO: 6419812 - DNA, 19 bp, Homo sapiens
tcctgaggagcagcccacc

SEQ ID NO: 6419813 - DNA, 23 bp, Homo sapiens
tcctgaggagctgttggcctggg

SEQ ID NO: 6419814 - DNA, 15 bp, Homo sapiens
tcctgaggatcagaa

SEQ ID NO: 6419815 - DNA, 21 bp, Homo sapiens
tcctgaggcagaacctggtgg

SEQ ID NO: 6419816 - DNA, 13 bp, Homo sapiens
tcctgaggccagt

SEQ ID NO: 6419817 - DNA, 18 bp, Homo sapiens
tcctgaggccagtggccc

SEQ ID NO: 6419818 - DNA, 19 bp, Homo sapiens
tcctgaggccagtggcccc

SEQ ID NO: 6419819 - DNA, 15 bp, Homo sapiens
tcctgaggctccact

SEQ ID NO: 6419820 - DNA, 19 bp, Homo sapiens
tcctgaggctccacttggt

SEQ ID NO: 6419821 - DNA, 21 bp, Homo sapiens
tcctgaggctccacttggtct

SEQ ID NO: 6419822 - DNA, 13 bp, Homo sapiens
tcctgaggctgag

SEQ ID NO: 6419823 - DNA, 12 bp, Homo sapiens
tcctgaggctgg

SEQ ID NO: 6419824 - DNA, 17 bp, Homo sapiens
tcctgaggctgggctcc

SEQ ID NO: 6419825 - DNA, 18 bp, Homo sapiens
tcctgaggctttggattt

SEQ ID NO: 6419826 - DNA, 21 bp, Homo sapiens
tcctgagggaggacctggggc

SEQ ID NO: 6419827 - DNA, 23 bp, Homo sapiens
tcctgagggaggacctggggcac

SEQ ID NO: 6419828 - DNA, 20 bp, Homo sapiens
tcctgaggggagacagagca

SEQ ID NO: 6419829 - DNA, 16 bp, Homo sapiens
tcctgaggggcatctg

SEQ ID NO: 6419830 - DNA, 20 bp, Homo sapiens
tcctgaggggcatctgcccc

SEQ ID NO: 6419831 - DNA, 19 bp, Homo sapiens
tatgcctctcctttgtata

SEQ ID NO: 6419832 - DNA, 22 bp, Homo sapiens
tatgcctctgacagtccacagg

SEQ ID NO: 6419833 - DNA, 22 bp, Homo sapiens
tatgcctgagttataaatattt

SEQ ID NO: 6419834 - DNA, 23 bp, Homo sapiens
tatgcctgagttataaatatttt

SEQ ID NO: 6419835 - DNA, 17 bp, Homo sapiens
tatgcctgcactgggaa

SEQ ID NO: 6419836 - DNA, 12 bp, Homo sapiens
tatgcctggcta

SEQ ID NO: 6419837 - DNA, 17 bp, Homo sapiens
tatgcctgggcagaagg

SEQ ID NO: 6419838 - DNA, 20 bp, Homo sapiens
tatgcctgtactaaggagca

SEQ ID NO: 6419839 - DNA, 22 bp, Homo sapiens
tatgcctgtactcgcttgtgca

SEQ ID NO: 6419840 - DNA, 15 bp, Homo sapiens
tatgcctgtggtgaa

SEQ ID NO: 6419841 - DNA, 19 bp, Homo sapiens
tatgcctgtggtgaagtgt

SEQ ID NO: 6419842 - DNA, 19 bp, Homo sapiens
tatgcctgttgatctatgg

SEQ ID NO: 6419843 - DNA, 24 bp, Homo sapiens
tatgcctgttgatctatgggaaat

SEQ ID NO: 6419844 - DNA, 23 bp, Homo sapiens
tatgcctgttgcaggcaaatgta

SEQ ID NO: 6419845 - DNA, 16 bp, Homo sapiens
tatgccttaagcagaa

SEQ ID NO: 6419846 - DNA, 22 bp, Homo sapiens
tatgccttaagcagaacaaatg

SEQ ID NO: 6419847 - DNA, 15 bp, Homo sapiens
tatgccttaatttag

SEQ ID NO: 6419848 - DNA, 18 bp, Homo sapiens
tatgccttaatttagaaa

SEQ ID NO: 6419849 - DNA, 22 bp, Homo sapiens
tatgccttaatttagaaactga

SEQ ID NO: 6419850 - DNA, 13 bp, Homo sapiens
tatgccttctgta

SEQ ID NO: 6419851 - DNA, 14 bp, Homo sapiens
tatgccttgctatt

SEQ ID NO: 6419852 - DNA, 17 bp, Homo sapiens
tatgccttgtctgggga

SEQ ID NO: 6419853 - DNA, 22 bp, Homo sapiens
tatgcctttaaatctgtgatga

SEQ ID NO: 6419854 - DNA, 16 bp, Homo sapiens
tatgccttttgtagct

SEQ ID NO: 6419855 - DNA, 22 bp, Homo sapiens
tatgccttttgtagctgtcatg

SEQ ID NO: 6419856 - DNA, 18 bp, Homo sapiens
tatgcgaacagttattgt

SEQ ID NO: 6419857 - DNA, 21 bp, Homo sapiens
tatgcgcaaatacaaaatgat

SEQ ID NO: 6419858 - DNA, 22 bp, Homo sapiens
tatgcgccctggtatgtgcctg

SEQ ID NO: 6419859 - DNA, 17 bp, Homo sapiens
tatgcggaattccacct

SEQ ID NO: 6419860 - DNA, 13 bp, Homo sapiens
tatgcggttaatt

SEQ ID NO: 6419861 - DNA, 17 bp, Homo sapiens
tatgcgtaatttaatgg

SEQ ID NO: 6419862 - DNA, 20 bp, Homo sapiens
tatgcgtgtccgtctgtctg

SEQ ID NO: 6419863 - DNA, 13 bp, Homo sapiens
tatgctaaactgt

SEQ ID NO: 6419864 - DNA, 22 bp, Homo sapiens
tatgctaatttttggagaaatg

SEQ ID NO: 6419865 - DNA, 18 bp, Homo sapiens
tatgctaccaccagctgt

SEQ ID NO: 6419866 - DNA, 19 bp, Homo sapiens
tatgctaccaccagctgtg

SEQ ID NO: 6419867 - DNA, 23 bp, Homo sapiens
tatgctagaggcttttattagaa

SEQ ID NO: 6419868 - DNA, 15 bp, Homo sapiens
tatgctatggaatat

SEQ ID NO: 6419869 - DNA, 15 bp, Homo sapiens
tatgctattgacaat

SEQ ID NO: 6419870 - DNA, 20 bp, Homo sapiens
tatgctattgacaataaaat

SEQ ID NO: 6419871 - DNA, 17 bp, Homo sapiens
tatgctatttctggcct

SEQ ID NO: 6419872 - DNA, 20 bp, Homo sapiens
tatgctatttctggcctcag

SEQ ID NO: 6419873 - DNA, 23 bp, Homo sapiens
tatgctcacctgacattaattat

SEQ ID NO: 6419874 - DNA, 16 bp, Homo sapiens
tatgctcagaagccag

SEQ ID NO: 6419875 - DNA, 16 bp, Homo sapiens
tatgctcaggggccct

SEQ ID NO: 6419876 - DNA, 19 bp, Homo sapiens
tatgctctcgcacctttcc

SEQ ID NO: 6419877 - DNA, 23 bp, Homo sapiens
tatgctctgagtagctttacact

SEQ ID NO: 6419878 - DNA, 13 bp, Homo sapiens
tatgctctgcttt

SEQ ID NO: 6419879 - DNA, 14 bp, Homo sapiens
tatgctcttttgtt

SEQ ID NO: 6419880 - DNA, 16 bp, Homo sapiens
tatgctcttttttact

SEQ ID NO: 6419881 - DNA, 20 bp, Homo sapiens
tatgctcttttttactcatt

SEQ ID NO: 6419882 - DNA, 14 bp, Homo sapiens
tatgctgaattgaa

SEQ ID NO: 6419883 - DNA, 14 bp, Homo sapiens
tatgctgacagctc

SEQ ID NO: 6419884 - DNA, 15 bp, Homo sapiens
tatgctgacagctct

SEQ ID NO: 6419885 - DNA, 15 bp, Homo sapiens
tatgctgagtttgtg

SEQ ID NO: 6419886 - DNA, 22 bp, Homo sapiens
tatgctgatcatcgccagaggt

SEQ ID NO: 6419887 - DNA, 15 bp, Homo sapiens
tatgctgatgatcaa

SEQ ID NO: 6419888 - DNA, 16 bp, Homo sapiens
tatgctgccaaatttt

SEQ ID NO: 6419889 - DNA, 20 bp, Homo sapiens
tatgctgccaaattttggcc

SEQ ID NO: 6419890 - DNA, 22 bp, Homo sapiens
tatgctgccaaattttggccaa

SEQ ID NO: 6419891 - DNA, 11 bp, Homo sapiens
tatgctgctgt

SEQ ID NO: 6419892 - DNA, 15 bp, Homo sapiens
tatgctgctgtgaat

SEQ ID NO: 6419893 - DNA, 18 bp, Homo sapiens
tatgctgctgtgaatttt

SEQ ID NO: 6419894 - DNA, 18 bp, Homo sapiens
tatgctgcttgtgacctt

SEQ ID NO: 6419895 - DNA, 12 bp, Homo sapiens
tatgctgctttt

SEQ ID NO: 6419896 - DNA, 15 bp, Homo sapiens
tatgctggaggcaga

SEQ ID NO: 6419897 - DNA, 22 bp, Homo sapiens
tatgctggccagcaccctctcc

SEQ ID NO: 6419898 - DNA, 22 bp, Homo sapiens
tatgctggggtacacagtgaga

SEQ ID NO: 6419899 - DNA, 19 bp, Homo sapiens
tatgctgtatttctttgta

SEQ ID NO: 6419900 - DNA, 17 bp, Homo sapiens
tatgctgtattttaaag

SEQ ID NO: 6419901 - DNA, 20 bp, Homo sapiens
tatgctgtattttcttttta

SEQ ID NO: 6419902 - DNA, 22 bp, Homo sapiens
tatgctgtggagtcccaacccc

SEQ ID NO: 6419903 - DNA, 22 bp, Homo sapiens
tatgctgtgtgcagagtataca

SEQ ID NO: 6419904 - DNA, 13 bp, Homo sapiens
tatgctgtgttta

SEQ ID NO: 6419905 - DNA, 14 bp, Homo sapiens
tatgctgtttccta

SEQ ID NO: 6419906 - DNA, 16 bp, Homo sapiens
tatgctgtttcctagc

SEQ ID NO: 6419907 - DNA, 15 bp, Homo sapiens
tatgctgtttgtaca

SEQ ID NO: 6419908 - DNA, 17 bp, Homo sapiens
tatgctgtttgtacaaa

SEQ ID NO: 6419909 - DNA, 19 bp, Homo sapiens
tatgcttaaaataagcagg

SEQ ID NO: 6419910 - DNA, 14 bp, Homo sapiens
tatgcttaagcttt

SEQ ID NO: 6419911 - DNA, 19 bp, Homo sapiens
tatgcttaataaaagaaca

SEQ ID NO: 6419912 - DNA, 22 bp, Homo sapiens
tatgcttactaaatcttcagca

SEQ ID NO: 6419913 - DNA, 15 bp, Homo sapiens
tatgcttatacactt

SEQ ID NO: 6419914 - DNA, 17 bp, Homo sapiens
tatgcttccattaacaa

SEQ ID NO: 6419915 - DNA, 14 bp, Homo sapiens
tatgcttcccagag

SEQ ID NO: 6419916 - DNA, 22 bp, Homo sapiens
tatgcttcccagagaagctcat

SEQ ID NO: 6419917 - DNA, 15 bp, Homo sapiens
tatgcttctagaaag

SEQ ID NO: 6419918 - DNA, 15 bp, Homo sapiens
tatgcttctgtttta

SEQ ID NO: 6419919 - DNA, 16 bp, Homo sapiens
tatgcttctgttttat

SEQ ID NO: 6419920 - DNA, 13 bp, Homo sapiens
tatgcttcttgga

SEQ ID NO: 6419921 - DNA, 16 bp, Homo sapiens
tatgcttgcaaaaact

SEQ ID NO: 6419922 - DNA, 19 bp, Homo sapiens
tatgcttgcatatatttca

SEQ ID NO: 6419923 - DNA, 17 bp, Homo sapiens
tatgcttgggccctgca

SEQ ID NO: 6419924 - DNA, 21 bp, Homo sapiens
tatgctttaacttcagagtga

SEQ ID NO: 6419925 - DNA, 13 bp, Homo sapiens
tatgctttaagac

SEQ ID NO: 6419926 - DNA, 13 bp, Homo sapiens
tatgctttattaa

SEQ ID NO: 6419927 - DNA, 21 bp, Homo sapiens
tatgctttcacttcccacctc

SEQ ID NO: 6419928 - DNA, 21 bp, Homo sapiens
tatgctttccaaaccttatct

SEQ ID NO: 6419929 - DNA, 15 bp, Homo sapiens
tatgctttccctgag

SEQ ID NO: 6419930 - DNA, 13 bp, Homo sapiens
tatgctttccttc

SEQ ID NO: 6419931 - DNA, 13 bp, Homo sapiens
tatgctttcttca

SEQ ID NO: 6419932 - DNA, 14 bp, Homo sapiens
tatgctttgaactt

SEQ ID NO: 6419933 - DNA, 12 bp, Homo sapiens
tatgctttgaat

SEQ ID NO: 6419934 - DNA, 13 bp, Homo sapiens
tatgctttgaatg

SEQ ID NO: 6419935 - DNA, 15 bp, Homo sapiens
tatgctttgaatgta

SEQ ID NO: 6419936 - DNA, 14 bp, Homo sapiens
tatgcttttctcaa

SEQ ID NO: 6419937 - DNA, 16 bp, Homo sapiens
tatgctttttctcaga

SEQ ID NO: 6419938 - DNA, 17 bp, Homo sapiens
tatgctttttctcagat

SEQ ID NO: 6419939 - DNA, 21 bp, Homo sapiens
tatgctttttctcagatctgg

SEQ ID NO: 6419940 - DNA, 16 bp, Homo sapiens
tatgcttttttgcaat

SEQ ID NO: 6419941 - DNA, 17 bp, Homo sapiens
tatgcttttttgcaata

SEQ ID NO: 6419942 - DNA, 17 bp, Homo sapiens
tatggaaaacatttcaa

SEQ ID NO: 6419943 - DNA, 22 bp, Homo sapiens
tatggaaaagggtcttcttggc

SEQ ID NO: 6419944 - DNA, 23 bp, Homo sapiens
tatggaaacactgattttgtaaa

SEQ ID NO: 6419945 - DNA, 23 bp, Homo sapiens
tatggaaagggtgtggcttggaa

SEQ ID NO: 6419946 - DNA, 16 bp, Homo sapiens
tatggaaataataccc

SEQ ID NO: 6419947 - DNA, 22 bp, Homo sapiens
tatggaaataccaggaccagtt

SEQ ID NO: 6419948 - DNA, 11 bp, Homo sapiens
tatggaaatag

SEQ ID NO: 6419949 - DNA, 22 bp, Homo sapiens
tatggaaatattaagaacattt

SEQ ID NO: 6419950 - DNA, 21 bp, Homo sapiens
tatggaaatcttttacatttt

SEQ ID NO: 6419951 - DNA, 21 bp, Homo sapiens
tatggaaatgcaccctccctc

SEQ ID NO: 6419952 - DNA, 19 bp, Homo sapiens
tatggaaatgtgagaaatg

SEQ ID NO: 6419953 - DNA, 16 bp, Homo sapiens
tatggaacactctgag

SEQ ID NO: 6419954 - DNA, 17 bp, Homo sapiens
tatggaacactctgaga

SEQ ID NO: 6419955 - DNA, 13 bp, Homo sapiens
tatggaactctct

SEQ ID NO: 6419956 - DNA, 15 bp, Homo sapiens
tatggaacttctaat

SEQ ID NO: 6419957 - DNA, 14 bp, Homo sapiens
tatggaagaaagta

SEQ ID NO: 6419958 - DNA, 23 bp, Homo sapiens
tatggaagaacgaggtttatatt

SEQ ID NO: 6419959 - DNA, 22 bp, Homo sapiens
tatggaagacaaatacacatac

SEQ ID NO: 6419960 - DNA, 15 bp, Homo sapiens
tatggaagccacatc

SEQ ID NO: 6419961 - DNA, 19 bp, Homo sapiens
tatggaaggtggagcgttc

SEQ ID NO: 6419962 - DNA, 18 bp, Homo sapiens
tatggaagttgcataatt

SEQ ID NO: 6419963 - DNA, 19 bp, Homo sapiens
tatggaagttgttgctata

SEQ ID NO: 6419964 - DNA, 14 bp, Homo sapiens
tatggaataacaac

SEQ ID NO: 6419965 - DNA, 14 bp, Homo sapiens
tatggaataagtgt

SEQ ID NO: 6419966 - DNA, 14 bp, Homo sapiens
tatggaatacagtg

SEQ ID NO: 6419967 - DNA, 23 bp, Homo sapiens
tatggaatacagtgttattttct

SEQ ID NO: 6419968 - DNA, 24 bp, Homo sapiens
tatggaatacagtgttattttctt

SEQ ID NO: 6419969 - DNA, 21 bp, Homo sapiens
tatggaatatcatctgtcatt

SEQ ID NO: 6419970 - DNA, 17 bp, Homo sapiens
tatggaatgcttcttaa

SEQ ID NO: 6419971 - DNA, 11 bp, Homo sapiens
tatggaattga

SEQ ID NO: 6419972 - DNA, 22 bp, Homo sapiens
tatggaatttataattcagtat

SEQ ID NO: 6419973 - DNA, 16 bp, Homo sapiens
tatggaatttttaagt

SEQ ID NO: 6419974 - DNA, 20 bp, Homo sapiens
tatggaatttttgaatctat

SEQ ID NO: 6419975 - DNA, 20 bp, Homo sapiens
tatggacaaaattaatacat

SEQ ID NO: 6419976 - DNA, 20 bp, Homo sapiens
tatggacactgccttagcct

SEQ ID NO: 6419977 - DNA, 14 bp, Homo sapiens
tatggacactgtga

SEQ ID NO: 6419978 - DNA, 16 bp, Homo sapiens
tatggacactgtgaca

SEQ ID NO: 6419979 - DNA, 18 bp, Homo sapiens
tatggacagcattgccag

SEQ ID NO: 6419980 - DNA, 21 bp, Homo sapiens
tatggacatcgatatgaaaaa

SEQ ID NO: 6419981 - DNA, 20 bp, Homo sapiens
tatggacatgtaaaaagaca

SEQ ID NO: 6419982 - DNA, 15 bp, Homo sapiens
tatggaccaaatgta

SEQ ID NO: 6419983 - DNA, 16 bp, Homo sapiens
tatggaccaaatgtaa

SEQ ID NO: 6419984 - DNA, 21 bp, Homo sapiens
tatggaccaaatgtaaaatat

SEQ ID NO: 6419985 - DNA, 16 bp, Homo sapiens
tatggacggtgctcca

SEQ ID NO: 6419986 - DNA, 13 bp, Homo sapiens
tatggactatctg

SEQ ID NO: 6419987 - DNA, 21 bp, Homo sapiens
tatggactatctgtctggtgg

SEQ ID NO: 6419988 - DNA, 18 bp, Homo sapiens
tatggactcagccttgca

SEQ ID NO: 6419989 - DNA, 16 bp, Homo sapiens
tatggactctgcacat

SEQ ID NO: 6419990 - DNA, 19 bp, Homo sapiens
tatggagaaacaaaatcct

SEQ ID NO: 6419991 - DNA, 16 bp, Homo sapiens
tatggagagccctggg

SEQ ID NO: 6419992 - DNA, 15 bp, Homo sapiens
tatggagcagccgga

SEQ ID NO: 6419993 - DNA, 18 bp, Homo sapiens
tatggagccctgtaattt

SEQ ID NO: 6419994 - DNA, 13 bp, Homo sapiens
tatggagcctctg

SEQ ID NO: 6419995 - DNA, 18 bp, Homo sapiens
tatggaggaacaactctc

SEQ ID NO: 6419996 - DNA, 19 bp, Homo sapiens
tatggaggactgtgacaga

SEQ ID NO: 6419997 - DNA, 21 bp, Homo sapiens
tatggaggattctttccccag

SEQ ID NO: 6419998 - DNA, 14 bp, Homo sapiens
tatggagggcagag

SEQ ID NO: 6419999 - DNA, 18 bp, Homo sapiens
tatggaggttcaatgaga

SEQ ID NO: 6420000 - DNA, 20 bp, Homo sapiens
tatggagtcttgtgaaagtg

SEQ ID NO: 6420001 - DNA, 21 bp, Homo sapiens
tatggagtgagtcacctgctc

SEQ ID NO: 6420002 - DNA, 22 bp, Homo sapiens
tatggagtgagtcacctgctcc

SEQ ID NO: 6420003 - DNA, 18 bp, Homo sapiens
tatggataatctgagcag

SEQ ID NO: 6420004 - DNA, 19 bp, Homo sapiens
tatggataatctgagcagg

SEQ ID NO: 6420005 - DNA, 13 bp, Homo sapiens
tatggataatgcc

SEQ ID NO: 6420006 - DNA, 16 bp, Homo sapiens
tatggatatatttgaa

SEQ ID NO: 6420007 - DNA, 23 bp, Homo sapiens
tatggatatgtgtaaatgttatg

SEQ ID NO: 6420008 - DNA, 21 bp, Homo sapiens
tcctgaggggcatctgcccct

SEQ ID NO: 6420009 - DNA, 17 bp, Homo sapiens
tcctgagggtcctgctg

SEQ ID NO: 6420010 - DNA, 18 bp, Homo sapiens
tcctgagggttttctcat

SEQ ID NO: 6420011 - DNA, 23 bp, Homo sapiens
tcctgaggtgatgaagacagccc

SEQ ID NO: 6420012 - DNA, 15 bp, Homo sapiens
tcctgaggtgcctcc

SEQ ID NO: 6420013 - DNA, 19 bp, Homo sapiens
tcctgagtagctggattac

SEQ ID NO: 6420014 - DNA, 18 bp, Homo sapiens
tcctgagtagctgggact

SEQ ID NO: 6420015 - DNA, 18 bp, Homo sapiens
tcctgagtagctgggatt

SEQ ID NO: 6420016 - DNA, 18 bp, Homo sapiens
tcctgagtagctgggcct

SEQ ID NO: 6420017 - DNA, 19 bp, Homo sapiens
tcctgagtagctgggcctg

SEQ ID NO: 6420018 - DNA, 21 bp, Homo sapiens
tcctgagtagctgggcctgtg

SEQ ID NO: 6420019 - DNA, 15 bp, Homo sapiens
tcctgagtgcttgct

SEQ ID NO: 6420020 - DNA, 15 bp, Homo sapiens
tcctgagtggtgcca

SEQ ID NO: 6420021 - DNA, 17 bp, Homo sapiens
tcctgagtgtggacttg

SEQ ID NO: 6420022 - DNA, 18 bp, Homo sapiens
tcctgataaacattaaac

SEQ ID NO: 6420023 - DNA, 20 bp, Homo sapiens
tcctgataaagcacagctgt

SEQ ID NO: 6420024 - DNA, 21 bp, Homo sapiens
tcctgataaagcacagctgta

SEQ ID NO: 6420025 - DNA, 19 bp, Homo sapiens
tcctgataataattgatca

SEQ ID NO: 6420026 - DNA, 13 bp, Homo sapiens
tcctgataattgt

SEQ ID NO: 6420027 - DNA, 19 bp, Homo sapiens
tcctgataccattctattc

SEQ ID NO: 6420028 - DNA, 20 bp, Homo sapiens
tcctgatcagaggcatttga

SEQ ID NO: 6420029 - DNA, 20 bp, Homo sapiens
tcctgatccactttggggga

SEQ ID NO: 6420030 - DNA, 16 bp, Homo sapiens
tcctgatcccagaccc

SEQ ID NO: 6420031 - DNA, 18 bp, Homo sapiens
tcctgatccctccacccc

SEQ ID NO: 6420032 - DNA, 20 bp, Homo sapiens
tcctgatcctaaccctgggc

SEQ ID NO: 6420033 - DNA, 11 bp, Homo sapiens
tcctgatctag

SEQ ID NO: 6420034 - DNA, 14 bp, Homo sapiens
tcctgatcttccca

SEQ ID NO: 6420035 - DNA, 23 bp, Homo sapiens
tcctgatgaaaaatatgtgcttg

SEQ ID NO: 6420036 - DNA, 14 bp, Homo sapiens
tcctgatgacccag

SEQ ID NO: 6420037 - DNA, 20 bp, Homo sapiens
tcctgatgacccaggctgcc

SEQ ID NO: 6420038 - DNA, 17 bp, Homo sapiens
tcctgatgatgctggcc

SEQ ID NO: 6420039 - DNA, 14 bp, Homo sapiens
tcctgatgattttt

SEQ ID NO: 6420040 - DNA, 19 bp, Homo sapiens
tcctgatgcaaaggtgggg

SEQ ID NO: 6420041 - DNA, 21 bp, Homo sapiens
tcctgatgcccgttgtctagg

SEQ ID NO: 6420042 - DNA, 20 bp, Homo sapiens
tcctgatgccctcttctcct

SEQ ID NO: 6420043 - DNA, 19 bp, Homo sapiens
tcctgatgcttcttcagag

SEQ ID NO: 6420044 - DNA, 20 bp, Homo sapiens
tcctgatgcttcttcagaga

SEQ ID NO: 6420045 - DNA, 14 bp, Homo sapiens
tcctgatggcaccc

SEQ ID NO: 6420046 - DNA, 21 bp, Homo sapiens
tcctgatggcaggatggcctg

SEQ ID NO: 6420047 - DNA, 16 bp, Homo sapiens
tcctgatggccaagag

SEQ ID NO: 6420048 - DNA, 18 bp, Homo sapiens
tcctgatggccaagagca

SEQ ID NO: 6420049 - DNA, 23 bp, Homo sapiens
tcctgatggtacaggaaagctca

SEQ ID NO: 6420050 - DNA, 21 bp, Homo sapiens
tcctgatggtcagctcccttc

SEQ ID NO: 6420051 - DNA, 19 bp, Homo sapiens
tcctgatggtgtcattctg

SEQ ID NO: 6420052 - DNA, 23 bp, Homo sapiens
tcctgatggtgtcattctgcctg

SEQ ID NO: 6420053 - DNA, 13 bp, Homo sapiens
tcctgatgtcttg

SEQ ID NO: 6420054 - DNA, 22 bp, Homo sapiens
tcctgatgtgccagaacttcga

SEQ ID NO: 6420055 - DNA, 17 bp, Homo sapiens
tcctgatgtttttccca

SEQ ID NO: 6420056 - DNA, 16 bp, Homo sapiens
tcctgatgtttttctg

SEQ ID NO: 6420057 - DNA, 21 bp, Homo sapiens
tcctgatgtttttctgtgtta

SEQ ID NO: 6420058 - DNA, 15 bp, Homo sapiens
tcctgattaaaacag

SEQ ID NO: 6420059 - DNA, 22 bp, Homo sapiens
tcctgattaaggcgtggcttct

SEQ ID NO: 6420060 - DNA, 13 bp, Homo sapiens
tcctgattaatat

SEQ ID NO: 6420061 - DNA, 20 bp, Homo sapiens
tcctgattatttatcacata

SEQ ID NO: 6420062 - DNA, 13 bp, Homo sapiens
tcctgattcccca

SEQ ID NO: 6420063 - DNA, 14 bp, Homo sapiens
tcctgattctccct

SEQ ID NO: 6420064 - DNA, 16 bp, Homo sapiens
tcctgattctccctgg

SEQ ID NO: 6420065 - DNA, 21 bp, Homo sapiens
tcctgattggtttctcttctc

SEQ ID NO: 6420066 - DNA, 17 bp, Homo sapiens
tcctgatttcagggaaa

SEQ ID NO: 6420067 - DNA, 19 bp, Homo sapiens
tcctgatttctctgaacag

SEQ ID NO: 6420068 - DNA, 19 bp, Homo sapiens
tcctgatttcttattgaat

SEQ ID NO: 6420069 - DNA, 15 bp, Homo sapiens
tcctgatttgagttt

SEQ ID NO: 6420070 - DNA, 13 bp, Homo sapiens
tcctgattttgta

SEQ ID NO: 6420071 - DNA, 12 bp, Homo sapiens
tcctgatttttc

SEQ ID NO: 6420072 - DNA, 18 bp, Homo sapiens
tcctgatttttcatatgt

SEQ ID NO: 6420073 - DNA, 16 bp, Homo sapiens
tcctgcaaaggccctt

SEQ ID NO: 6420074 - DNA, 17 bp, Homo sapiens
tcctgcaaagggaactg

SEQ ID NO: 6420075 - DNA, 22 bp, Homo sapiens
tcctgcaaatttagtttgttaa

SEQ ID NO: 6420076 - DNA, 16 bp, Homo sapiens
tcctgcaaccactctg

SEQ ID NO: 6420077 - DNA, 23 bp, Homo sapiens
tcctgcaagagtgggctttccag

SEQ ID NO: 6420078 - DNA, 15 bp, Homo sapiens
tcctgcaatgaagtc

SEQ ID NO: 6420079 - DNA, 18 bp, Homo sapiens
tcctgcaatgaagtctct

SEQ ID NO: 6420080 - DNA, 17 bp, Homo sapiens
tcctgcaattctacagt

SEQ ID NO: 6420081 - DNA, 16 bp, Homo sapiens
tcctgcaattttctaa

SEQ ID NO: 6420082 - DNA, 22 bp, Homo sapiens
tcctgcacacagaatgctcagg

SEQ ID NO: 6420083 - DNA, 14 bp, Homo sapiens
tcctgcacacaggg

SEQ ID NO: 6420084 - DNA, 16 bp, Homo sapiens
tcctgcacaccctggg

SEQ ID NO: 6420085 - DNA, 18 bp, Homo sapiens
tcctgcacaccctgggcc

SEQ ID NO: 6420086 - DNA, 22 bp, Homo sapiens
tcctgcacacgctccttcctct

SEQ ID NO: 6420087 - DNA, 17 bp, Homo sapiens
tcctgcacagattccca

SEQ ID NO: 6420088 - DNA, 19 bp, Homo sapiens
tcctgcacagattcccagg

SEQ ID NO: 6420089 - DNA, 23 bp, Homo sapiens
tcctgcacagattcccaggccag

SEQ ID NO: 6420090 - DNA, 21 bp, Homo sapiens
tcctgcacagttttctggctg

SEQ ID NO: 6420091 - DNA, 20 bp, Homo sapiens
tcctgcacatgagtggaaat

SEQ ID NO: 6420092 - DNA, 14 bp, Homo sapiens
tcctgcaccccagc

SEQ ID NO: 6420093 - DNA, 14 bp, Homo sapiens
tcctgcaccctctg

SEQ ID NO: 6420094 - DNA, 19 bp, Homo sapiens
tcctgcaccggggcctggg

SEQ ID NO: 6420095 - DNA, 21 bp, Homo sapiens
tcctgcaccggggcctgggca

SEQ ID NO: 6420096 - DNA, 16 bp, Homo sapiens
tcctgcacgaagtggc

SEQ ID NO: 6420097 - DNA, 12 bp, Homo sapiens
tcctgcactcca

SEQ ID NO: 6420098 - DNA, 21 bp, Homo sapiens
tcctgcactgacccacagcct

SEQ ID NO: 6420099 - DNA, 14 bp, Homo sapiens
tcctgcactgtccc

SEQ ID NO: 6420100 - DNA, 13 bp, Homo sapiens
tcctgcagacctg

SEQ ID NO: 6420101 - DNA, 17 bp, Homo sapiens
tcctgcagacctggctg

SEQ ID NO: 6420102 - DNA, 19 bp, Homo sapiens
tcctgcagacctggctggg

SEQ ID NO: 6420103 - DNA, 23 bp, Homo sapiens
tcctgcagacctggctgggcctg

SEQ ID NO: 6420104 - DNA, 13 bp, Homo sapiens
tcctgcagcaaac

SEQ ID NO: 6420105 - DNA, 20 bp, Homo sapiens
tcctgcagcaaacactccac

SEQ ID NO: 6420106 - DNA, 15 bp, Homo sapiens
tcctgcagcagagcc

SEQ ID NO: 6420107 - DNA, 12 bp, Homo sapiens
tcctgcagcatg

SEQ ID NO: 6420108 - DNA, 17 bp, Homo sapiens
tcctgcagccagaaagg

SEQ ID NO: 6420109 - DNA, 17 bp, Homo sapiens
tcctgcagccccagaag

SEQ ID NO: 6420110 - DNA, 19 bp, Homo sapiens
tcctgcagccccagaagaa

SEQ ID NO: 6420111 - DNA, 17 bp, Homo sapiens
tcctgcagcctgcagga

SEQ ID NO: 6420112 - DNA, 14 bp, Homo sapiens
tcctgcagcctgga

SEQ ID NO: 6420113 - DNA, 14 bp, Homo sapiens
tcctgcaggaaata

SEQ ID NO: 6420114 - DNA, 16 bp, Homo sapiens
tcctgcaggcagccag

SEQ ID NO: 6420115 - DNA, 17 bp, Homo sapiens
tcctgcaggcagccagg

SEQ ID NO: 6420116 - DNA, 20 bp, Homo sapiens
tcctgcaggcagccaggcca

SEQ ID NO: 6420117 - DNA, 14 bp, Homo sapiens
tcctgcaggccagg

SEQ ID NO: 6420118 - DNA, 20 bp, Homo sapiens
tcctgcaggccaggccagct

SEQ ID NO: 6420119 - DNA, 10 bp, Homo sapiens
tcctgcaggg

SEQ ID NO: 6420120 - DNA, 22 bp, Homo sapiens
tcctgcagggagccttctgcca

SEQ ID NO: 6420121 - DNA, 18 bp, Homo sapiens
tcctgcaggtaaacagtt

SEQ ID NO: 6420122 - DNA, 24 bp, Homo sapiens
tcctgcagtcccacactgtgcaga

SEQ ID NO: 6420123 - DNA, 21 bp, Homo sapiens
tcctgcagtctggctgagccc

SEQ ID NO: 6420124 - DNA, 16 bp, Homo sapiens
tcctgcatccctccac

SEQ ID NO: 6420125 - DNA, 14 bp, Homo sapiens
tcctgcatctttca

SEQ ID NO: 6420126 - DNA, 19 bp, Homo sapiens
tcctgcatctttcatagtt

SEQ ID NO: 6420127 - DNA, 19 bp, Homo sapiens
tcctgcatgcataatgaac

SEQ ID NO: 6420128 - DNA, 13 bp, Homo sapiens
tcctgcatggaca

SEQ ID NO: 6420129 - DNA, 13 bp, Homo sapiens
tcctgcatgtgta

SEQ ID NO: 6420130 - DNA, 11 bp, Homo sapiens
tcctgcatgtt

SEQ ID NO: 6420131 - DNA, 14 bp, Homo sapiens
tcctgcatttctct

SEQ ID NO: 6420132 - DNA, 17 bp, Homo sapiens
tcctgcatttctcttct

SEQ ID NO: 6420133 - DNA, 16 bp, Homo sapiens
tcctgcatttgtgaaa

SEQ ID NO: 6420134 - DNA, 20 bp, Homo sapiens
tcctgccaaaagatctgggg

SEQ ID NO: 6420135 - DNA, 13 bp, Homo sapiens
tcctgccaagcca

SEQ ID NO: 6420136 - DNA, 18 bp, Homo sapiens
tcctgccacatggagccc

SEQ ID NO: 6420137 - DNA, 18 bp, Homo sapiens
tcctgccacattagaact

SEQ ID NO: 6420138 - DNA, 14 bp, Homo sapiens
tcctgccaccaccc

SEQ ID NO: 6420139 - DNA, 23 bp, Homo sapiens
tcctgccaccaccctgtcttcct

SEQ ID NO: 6420140 - DNA, 13 bp, Homo sapiens
tcctgccaccagc

SEQ ID NO: 6420141 - DNA, 17 bp, Homo sapiens
tcctgccaccagtcact

SEQ ID NO: 6420142 - DNA, 16 bp, Homo sapiens
tcctgccacccagccc

SEQ ID NO: 6420143 - DNA, 16 bp, Homo sapiens
tcctgccaccccttcc

SEQ ID NO: 6420144 - DNA, 20 bp, Homo sapiens
tcctgccaccccttcctccc

SEQ ID NO: 6420145 - DNA, 17 bp, Homo sapiens
tcctgccactgacctca

SEQ ID NO: 6420146 - DNA, 13 bp, Homo sapiens
tcctgccactgtt

SEQ ID NO: 6420147 - DNA, 14 bp, Homo sapiens
tcctgccagcccag

SEQ ID NO: 6420148 - DNA, 17 bp, Homo sapiens
tcctgccagcccagctg

SEQ ID NO: 6420149 - DNA, 18 bp, Homo sapiens
tcctgccagcccagctgg

SEQ ID NO: 6420150 - DNA, 14 bp, Homo sapiens
tcctgccagctctg

SEQ ID NO: 6420151 - DNA, 12 bp, Homo sapiens
tcctgccagctg

SEQ ID NO: 6420152 - DNA, 21 bp, Homo sapiens
tcctgccagctggatcgctgc

SEQ ID NO: 6420153 - DNA, 21 bp, Homo sapiens
tcctgccaggcacacacagcc

SEQ ID NO: 6420154 - DNA, 19 bp, Homo sapiens
tcctgccaggctctccctc

SEQ ID NO: 6420155 - DNA, 15 bp, Homo sapiens
tcctgccatgtttag

SEQ ID NO: 6420156 - DNA, 17 bp, Homo sapiens
tcctgccattcttctgg

SEQ ID NO: 6420157 - DNA, 18 bp, Homo sapiens
tcctgccattcttctggt

SEQ ID NO: 6420158 - DNA, 15 bp, Homo sapiens
tcctgcccaccctac

SEQ ID NO: 6420159 - DNA, 16 bp, Homo sapiens
tcctgcccaccctacc

SEQ ID NO: 6420160 - DNA, 17 bp, Homo sapiens
tcctgcccaccctacca

SEQ ID NO: 6420161 - DNA, 18 bp, Homo sapiens
tcctgcccaccctaccag

SEQ ID NO: 6420162 - DNA, 23 bp, Homo sapiens
tcctgcccaccctaccagctcct

SEQ ID NO: 6420163 - DNA, 18 bp, Homo sapiens
tcctgcccacgggaggac

SEQ ID NO: 6420164 - DNA, 22 bp, Homo sapiens
tcctgcccacgtgcagcacctg

SEQ ID NO: 6420165 - DNA, 15 bp, Homo sapiens
tcctgcccagccacc

SEQ ID NO: 6420166 - DNA, 15 bp, Homo sapiens
tcctgcccagctctg

SEQ ID NO: 6420167 - DNA, 23 bp, Homo sapiens
tcctgcccaggagagccagccct

SEQ ID NO: 6420168 - DNA, 14 bp, Homo sapiens
tcctgcccaggcca

SEQ ID NO: 6420169 - DNA, 16 bp, Homo sapiens
tcctgcccaggccaca

SEQ ID NO: 6420170 - DNA, 18 bp, Homo sapiens
tcctgcccaggccacaga

SEQ ID NO: 6420171 - DNA, 16 bp, Homo sapiens
tcctgcccagtccccc

SEQ ID NO: 6420172 - DNA, 17 bp, Homo sapiens
tcctgcccagtgttgtt

SEQ ID NO: 6420173 - DNA, 19 bp, Homo sapiens
tcctgcccagtgttgtttg

SEQ ID NO: 6420174 - DNA, 13 bp, Homo sapiens
tcctgcccatgtg

SEQ ID NO: 6420175 - DNA, 16 bp, Homo sapiens
tcctgcccatgtgtcc

SEQ ID NO: 6420176 - DNA, 19 bp, Homo sapiens
tcctgccccaactgcagga

SEQ ID NO: 6420177 - DNA, 20 bp, Homo sapiens
tcctgccccaactgcaggaa

SEQ ID NO: 6420178 - DNA, 12 bp, Homo sapiens
tcctgccccaca

SEQ ID NO: 6420179 - DNA, 15 bp, Homo sapiens
tcctgccccaggcct

SEQ ID NO: 6420180 - DNA, 16 bp, Homo sapiens
tcctgccccatcactt

SEQ ID NO: 6420181 - DNA, 23 bp, Homo sapiens
tcctgcccccaaggaggcagcct

SEQ ID NO: 6420182 - DNA, 15 bp, Homo sapiens
tcctgcccccacacc

SEQ ID NO: 6420183 - DNA, 15 bp, Homo sapiens
tcctgcccccacccc

SEQ ID NO: 6420184 - DNA, 12 bp, Homo sapiens
tcctgccccctg

SEQ ID NO: 6420185 - DNA, 15 bp, Homo sapiens
tcctgccccctgaaa

SEQ ID NO: 6420186 - DNA, 17 bp, Homo sapiens
tcctgccccctgaaact

SEQ ID NO: 6420187 - DNA, 23 bp, Homo sapiens
tatggatccactggctggacaaa

SEQ ID NO: 6420188 - DNA, 15 bp, Homo sapiens
tatggatgattaaat

SEQ ID NO: 6420189 - DNA, 20 bp, Homo sapiens
tatggatgattcagaaattg

SEQ ID NO: 6420190 - DNA, 16 bp, Homo sapiens
tatggatgatttaagt

SEQ ID NO: 6420191 - DNA, 18 bp, Homo sapiens
tatggatgatttaagtgt

SEQ ID NO: 6420192 - DNA, 15 bp, Homo sapiens
tatggatgtccccag

SEQ ID NO: 6420193 - DNA, 13 bp, Homo sapiens
tatggattaaaaa

SEQ ID NO: 6420194 - DNA, 14 bp, Homo sapiens
tatggattcacttc

SEQ ID NO: 6420195 - DNA, 14 bp, Homo sapiens
tatggatttaagag

SEQ ID NO: 6420196 - DNA, 16 bp, Homo sapiens
tatggatttgaagttt

SEQ ID NO: 6420197 - DNA, 19 bp, Homo sapiens
tatggcaaatagccacaat

SEQ ID NO: 6420198 - DNA, 19 bp, Homo sapiens
tatggcaaggaactttccc

SEQ ID NO: 6420199 - DNA, 15 bp, Homo sapiens
tatggcactattttt

SEQ ID NO: 6420200 - DNA, 21 bp, Homo sapiens
tatggcacttattatgaggct

SEQ ID NO: 6420201 - DNA, 13 bp, Homo sapiens
tatggcagaagac

SEQ ID NO: 6420202 - DNA, 23 bp, Homo sapiens
tatggcagaagacaccagagcag

SEQ ID NO: 6420203 - DNA, 23 bp, Homo sapiens
tatggcagaagggaattgctcag

SEQ ID NO: 6420204 - DNA, 17 bp, Homo sapiens
tatggcaggactcctgg

SEQ ID NO: 6420205 - DNA, 18 bp, Homo sapiens
tatggcaggactcctggc

SEQ ID NO: 6420206 - DNA, 21 bp, Homo sapiens
tatggcaggactcctggcagg

SEQ ID NO: 6420207 - DNA, 19 bp, Homo sapiens
tatggcaggagctactgag

SEQ ID NO: 6420208 - DNA, 18 bp, Homo sapiens
tatggcagtccagccagc

SEQ ID NO: 6420209 - DNA, 15 bp, Homo sapiens
tatggcatgatttat

SEQ ID NO: 6420210 - DNA, 14 bp, Homo sapiens
tatggcatttctat

SEQ ID NO: 6420211 - DNA, 23 bp, Homo sapiens
tatggccaggaagtagcacaggc

SEQ ID NO: 6420212 - DNA, 17 bp, Homo sapiens
tatggcccagccactgc

SEQ ID NO: 6420213 - DNA, 18 bp, Homo sapiens
tatggcccagccactgca

SEQ ID NO: 6420214 - DNA, 21 bp, Homo sapiens
tatggcccagccactgcagca

SEQ ID NO: 6420215 - DNA, 14 bp, Homo sapiens
tatggcccagcctt

SEQ ID NO: 6420216 - DNA, 13 bp, Homo sapiens
tatggcccaggca

SEQ ID NO: 6420217 - DNA, 15 bp, Homo sapiens
tatggcccaggcagc

SEQ ID NO: 6420218 - DNA, 21 bp, Homo sapiens
tatggccctggcctagcatac

SEQ ID NO: 6420219 - DNA, 22 bp, Homo sapiens
tatggccctggcctagcatacg

SEQ ID NO: 6420220 - DNA, 12 bp, Homo sapiens
tatggcctcagc

SEQ ID NO: 6420221 - DNA, 17 bp, Homo sapiens
tatggcgtaagtacaga

SEQ ID NO: 6420222 - DNA, 19 bp, Homo sapiens
tatggctcatgtctgaaaa

SEQ ID NO: 6420223 - DNA, 19 bp, Homo sapiens
tatggctctatcttttcct

SEQ ID NO: 6420224 - DNA, 16 bp, Homo sapiens
tatggctctcaagtga

SEQ ID NO: 6420225 - DNA, 22 bp, Homo sapiens
tatggctctgcacccctctgcc

SEQ ID NO: 6420226 - DNA, 16 bp, Homo sapiens
tatggcttataaatgt

SEQ ID NO: 6420227 - DNA, 17 bp, Homo sapiens
tatggcttgtgaactgc

SEQ ID NO: 6420228 - DNA, 14 bp, Homo sapiens
tatggctttcaaag

SEQ ID NO: 6420229 - DNA, 22 bp, Homo sapiens
tatggctttgtgcttgttcttc

SEQ ID NO: 6420230 - DNA, 16 bp, Homo sapiens
tatggcttttgtgcat

SEQ ID NO: 6420231 - DNA, 17 bp, Homo sapiens
tatggcttttgtgcatt

SEQ ID NO: 6420232 - DNA, 17 bp, Homo sapiens
tatgggaagctctgtgt

SEQ ID NO: 6420233 - DNA, 18 bp, Homo sapiens
tatgggaagctctgtgtg

SEQ ID NO: 6420234 - DNA, 16 bp, Homo sapiens
tatgggactcaatgca

SEQ ID NO: 6420235 - DNA, 23 bp, Homo sapiens
tatgggagatggcagcagtgaag

SEQ ID NO: 6420236 - DNA, 16 bp, Homo sapiens
tatgggagccccaggg

SEQ ID NO: 6420237 - DNA, 19 bp, Homo sapiens
tatgggagcttaactttat

SEQ ID NO: 6420238 - DNA, 13 bp, Homo sapiens
tatgggaggcagc

SEQ ID NO: 6420239 - DNA, 16 bp, Homo sapiens
tatgggaggcagccga

SEQ ID NO: 6420240 - DNA, 19 bp, Homo sapiens
tatgggaggcagccgaggc

SEQ ID NO: 6420241 - DNA, 14 bp, Homo sapiens
tatgggatgtaaac

SEQ ID NO: 6420242 - DNA, 16 bp, Homo sapiens
tatgggcattgacaaa

SEQ ID NO: 6420243 - DNA, 12 bp, Homo sapiens
tatgggctgggg

SEQ ID NO: 6420244 - DNA, 14 bp, Homo sapiens
tatgggctgggggc

SEQ ID NO: 6420245 - DNA, 23 bp, Homo sapiens
tatgggctgttctgtttcctgtg

SEQ ID NO: 6420246 - DNA, 21 bp, Homo sapiens
tatgggcttccgcacatgccg

SEQ ID NO: 6420247 - DNA, 19 bp, Homo sapiens
tatgggctttctctttggt

SEQ ID NO: 6420248 - DNA, 23 bp, Homo sapiens
tatgggcttttggggagccagaa

SEQ ID NO: 6420249 - DNA, 23 bp, Homo sapiens
tatggggaaggttatcagtgctt

SEQ ID NO: 6420250 - DNA, 22 bp, Homo sapiens
tatggggagaaaagacatgaat

SEQ ID NO: 6420251 - DNA, 23 bp, Homo sapiens
tatggggagaggaactccttggc

SEQ ID NO: 6420252 - DNA, 18 bp, Homo sapiens
tatggggatagtctgggt

SEQ ID NO: 6420253 - DNA, 19 bp, Homo sapiens
tatggggatagtctgggtc

SEQ ID NO: 6420254 - DNA, 17 bp, Homo sapiens
tatgggggaaaattatt

SEQ ID NO: 6420255 - DNA, 19 bp, Homo sapiens
tatgggggcatctcttccc

SEQ ID NO: 6420256 - DNA, 22 bp, Homo sapiens
tatgggggcctggattcatttc

SEQ ID NO: 6420257 - DNA, 15 bp, Homo sapiens
tatgggggggaggga

SEQ ID NO: 6420258 - DNA, 23 bp, Homo sapiens
tatgggggttgtaaattggcatg

SEQ ID NO: 6420259 - DNA, 23 bp, Homo sapiens
tatgggtagcactactaaaagtt

SEQ ID NO: 6420260 - DNA, 11 bp, Homo sapiens
tatgggtcaca

SEQ ID NO: 6420261 - DNA, 14 bp, Homo sapiens
tatgggtcacagga

SEQ ID NO: 6420262 - DNA, 14 bp, Homo sapiens
tatgggtcctgcaa

SEQ ID NO: 6420263 - DNA, 15 bp, Homo sapiens
tatgggtcctgcaat

SEQ ID NO: 6420264 - DNA, 14 bp, Homo sapiens
tatgggtgaaaata

SEQ ID NO: 6420265 - DNA, 12 bp, Homo sapiens
tatgggtgctgg

SEQ ID NO: 6420266 - DNA, 17 bp, Homo sapiens
tatgggtggctttcaag

SEQ ID NO: 6420267 - DNA, 22 bp, Homo sapiens
tatgggtttagttactttagat

SEQ ID NO: 6420268 - DNA, 15 bp, Homo sapiens
tatgggtttattttc

SEQ ID NO: 6420269 - DNA, 13 bp, Homo sapiens
tatgggtttggct

SEQ ID NO: 6420270 - DNA, 14 bp, Homo sapiens
tatggtaaataact

SEQ ID NO: 6420271 - DNA, 15 bp, Homo sapiens
tatggtaaataactg

SEQ ID NO: 6420272 - DNA, 20 bp, Homo sapiens
tatggtaacactttgctttc

SEQ ID NO: 6420273 - DNA, 19 bp, Homo sapiens
tatggtaactgctttctgt

SEQ ID NO: 6420274 - DNA, 22 bp, Homo sapiens
tatggtagcttttactttttat

SEQ ID NO: 6420275 - DNA, 15 bp, Homo sapiens
tatggtaggaccctc

SEQ ID NO: 6420276 - DNA, 20 bp, Homo sapiens
tatggtataatggttgactg

SEQ ID NO: 6420277 - DNA, 17 bp, Homo sapiens
tatggtatatatacata

SEQ ID NO: 6420278 - DNA, 21 bp, Homo sapiens
tatggtatcatgtatctctct

SEQ ID NO: 6420279 - DNA, 16 bp, Homo sapiens
tatggtatgctggcca

SEQ ID NO: 6420280 - DNA, 17 bp, Homo sapiens
tatggtatgctggccag

SEQ ID NO: 6420281 - DNA, 22 bp, Homo sapiens
tatggtatgtagccagctgtgc

SEQ ID NO: 6420282 - DNA, 21 bp, Homo sapiens
tatggtatttattttttcttt

SEQ ID NO: 6420283 - DNA, 19 bp, Homo sapiens
tatggtcctaaaagcaaaa

SEQ ID NO: 6420284 - DNA, 14 bp, Homo sapiens
tatggtgatgactt

SEQ ID NO: 6420285 - DNA, 17 bp, Homo sapiens
tatggtgcaaaaatgag

SEQ ID NO: 6420286 - DNA, 20 bp, Homo sapiens
tatggtgcagagaagctgga

SEQ ID NO: 6420287 - DNA, 15 bp, Homo sapiens
tatggtgccaatgga

SEQ ID NO: 6420288 - DNA, 17 bp, Homo sapiens
tatggtgcctagtattg

SEQ ID NO: 6420289 - DNA, 13 bp, Homo sapiens
tatggtgcttcct

SEQ ID NO: 6420290 - DNA, 16 bp, Homo sapiens
tatggtggaaaagaac

SEQ ID NO: 6420291 - DNA, 12 bp, Homo sapiens
tatggtggaaga

SEQ ID NO: 6420292 - DNA, 18 bp, Homo sapiens
tatggtggatgaggcttc

SEQ ID NO: 6420293 - DNA, 14 bp, Homo sapiens
tatggtggccctgg

SEQ ID NO: 6420294 - DNA, 15 bp, Homo sapiens
tatggtggccctggg

SEQ ID NO: 6420295 - DNA, 18 bp, Homo sapiens
tatggtggccctggggaa

SEQ ID NO: 6420296 - DNA, 16 bp, Homo sapiens
tatggtgtaatgcaca

SEQ ID NO: 6420297 - DNA, 13 bp, Homo sapiens
tatggtgtatttt

SEQ ID NO: 6420298 - DNA, 17 bp, Homo sapiens
tatggttactaaaaagt

SEQ ID NO: 6420299 - DNA, 19 bp, Homo sapiens
tatggttacttcttctctt

SEQ ID NO: 6420300 - DNA, 22 bp, Homo sapiens
tatggttacttcttctcttaga

SEQ ID NO: 6420301 - DNA, 14 bp, Homo sapiens
tatggttatgtttt

SEQ ID NO: 6420302 - DNA, 14 bp, Homo sapiens
tatggttcaccagg

SEQ ID NO: 6420303 - DNA, 22 bp, Homo sapiens
tatggttccaatgaaatatgtt

SEQ ID NO: 6420304 - DNA, 16 bp, Homo sapiens
tatggttcccaataaa

SEQ ID NO: 6420305 - DNA, 17 bp, Homo sapiens
tatggttcccaataaaa

SEQ ID NO: 6420306 - DNA, 19 bp, Homo sapiens
tatggttcccaataaaagt

SEQ ID NO: 6420307 - DNA, 20 bp, Homo sapiens
tatggttctccaagaaactg

SEQ ID NO: 6420308 - DNA, 21 bp, Homo sapiens
tatggttgatagtttacctga

SEQ ID NO: 6420309 - DNA, 13 bp, Homo sapiens
tatggttggagag

SEQ ID NO: 6420310 - DNA, 14 bp, Homo sapiens
tatggttgtataca

SEQ ID NO: 6420311 - DNA, 18 bp, Homo sapiens
tatggttttataactata

SEQ ID NO: 6420312 - DNA, 18 bp, Homo sapiens
tatggttttgttttcaat

SEQ ID NO: 6420313 - DNA, 13 bp, Homo sapiens
tatgtaaaacatt

SEQ ID NO: 6420314 - DNA, 15 bp, Homo sapiens
tatgtaaaacattta

SEQ ID NO: 6420315 - DNA, 19 bp, Homo sapiens
tatgtaaaaggattattac

SEQ ID NO: 6420316 - DNA, 19 bp, Homo sapiens
tatgtaaaataaaattatg

SEQ ID NO: 6420317 - DNA, 15 bp, Homo sapiens
tatgtaaaatattgt

SEQ ID NO: 6420318 - DNA, 17 bp, Homo sapiens
tatgtaaaatgttttag

SEQ ID NO: 6420319 - DNA, 14 bp, Homo sapiens
tatgtaaaattttg

SEQ ID NO: 6420320 - DNA, 22 bp, Homo sapiens
tatgtaaacaaaccacagcagg

SEQ ID NO: 6420321 - DNA, 13 bp, Homo sapiens
tatgtaaacatca

SEQ ID NO: 6420322 - DNA, 12 bp, Homo sapiens
tatgtaaagtat

SEQ ID NO: 6420323 - DNA, 17 bp, Homo sapiens
tatgtaaagtatgtaaa

SEQ ID NO: 6420324 - DNA, 19 bp, Homo sapiens
tatgtaaagtatgtaaaca

SEQ ID NO: 6420325 - DNA, 23 bp, Homo sapiens
tatgtaaagtatgtttttacatt

SEQ ID NO: 6420326 - DNA, 15 bp, Homo sapiens
tatgtaaataactct

SEQ ID NO: 6420327 - DNA, 13 bp, Homo sapiens
tatgtaaataatt

SEQ ID NO: 6420328 - DNA, 18 bp, Homo sapiens
tatgtaaatatacagcat

SEQ ID NO: 6420329 - DNA, 16 bp, Homo sapiens
tatgtaaatatgaaga

SEQ ID NO: 6420330 - DNA, 20 bp, Homo sapiens
tatgtaaatcccattattca

SEQ ID NO: 6420331 - DNA, 23 bp, Homo sapiens
tatgtaaatcccattattcaaag

SEQ ID NO: 6420332 - DNA, 17 bp, Homo sapiens
tatgtaaattataagta

SEQ ID NO: 6420333 - DNA, 15 bp, Homo sapiens
tatgtaaattatgta

SEQ ID NO: 6420334 - DNA, 14 bp, Homo sapiens
tatgtaaattattg

SEQ ID NO: 6420335 - DNA, 17 bp, Homo sapiens
tatgtaaattattgtaa

SEQ ID NO: 6420336 - DNA, 20 bp, Homo sapiens
tatgtaaattattgtaaact

SEQ ID NO: 6420337 - DNA, 12 bp, Homo sapiens
tatgtaaatttt

SEQ ID NO: 6420338 - DNA, 21 bp, Homo sapiens
tatgtaacaaacctgcactta

SEQ ID NO: 6420339 - DNA, 11 bp, Homo sapiens
tatgtaacatg

SEQ ID NO: 6420340 - DNA, 16 bp, Homo sapiens
tatgtaagaacacatt

SEQ ID NO: 6420341 - DNA, 16 bp, Homo sapiens
tatgtaagaagaaact

SEQ ID NO: 6420342 - DNA, 17 bp, Homo sapiens
tatgtaagaagaaactg

SEQ ID NO: 6420343 - DNA, 21 bp, Homo sapiens
tatgtaagaattcagaagacc

SEQ ID NO: 6420344 - DNA, 15 bp, Homo sapiens
tatgtaagagcacct

SEQ ID NO: 6420345 - DNA, 18 bp, Homo sapiens
tatgtaagcatttgtaca

SEQ ID NO: 6420346 - DNA, 23 bp, Homo sapiens
tatgtaagggctttaaataaaag

SEQ ID NO: 6420347 - DNA, 13 bp, Homo sapiens
tatgtaagtttct

SEQ ID NO: 6420348 - DNA, 15 bp, Homo sapiens
tatgtaagtttctaa

SEQ ID NO: 6420349 - DNA, 16 bp, Homo sapiens
tatgtaagtttgcata

SEQ ID NO: 6420350 - DNA, 16 bp, Homo sapiens
tatgtaataatgtgaa

SEQ ID NO: 6420351 - DNA, 14 bp, Homo sapiens
tatgtaatacttaa

SEQ ID NO: 6420352 - DNA, 19 bp, Homo sapiens
tatgtaatacttaaataaa

SEQ ID NO: 6420353 - DNA, 15 bp, Homo sapiens
tatgtaatatataca

SEQ ID NO: 6420354 - DNA, 20 bp, Homo sapiens
tatgtaatatattgtacaaa

SEQ ID NO: 6420355 - DNA, 23 bp, Homo sapiens
tatgtaatatttacataaagact

SEQ ID NO: 6420356 - DNA, 17 bp, Homo sapiens
tatgtaatcaaacttct

SEQ ID NO: 6420357 - DNA, 13 bp, Homo sapiens
tatgtaatctatg

SEQ ID NO: 6420358 - DNA, 23 bp, Homo sapiens
tatgtaatgaagtaaagccatta

SEQ ID NO: 6420359 - DNA, 16 bp, Homo sapiens
tatgtaatgcttatgt

SEQ ID NO: 6420360 - DNA, 20 bp, Homo sapiens
tatgtaatgcttatgtgttg

SEQ ID NO: 6420361 - DNA, 21 bp, Homo sapiens
tatgtaatgcttccaatcttg

SEQ ID NO: 6420362 - DNA, 14 bp, Homo sapiens
tatgtaatttatgc

SEQ ID NO: 6420363 - DNA, 14 bp, Homo sapiens
tatgtaatttcaaa

SEQ ID NO: 6420364 - DNA, 17 bp, Homo sapiens
tatgtaatttcaaaata

SEQ ID NO: 6420365 - DNA, 19 bp, Homo sapiens
tatgtaatttcaaaataca

SEQ ID NO: 6420366 - DNA, 21 bp, Homo sapiens
tcctgccccctgaaacttatt

SEQ ID NO: 6420367 - DNA, 12 bp, Homo sapiens
tcctgcccctct

SEQ ID NO: 6420368 - DNA, 17 bp, Homo sapiens
tcctgcccctctttctc

SEQ ID NO: 6420369 - DNA, 19 bp, Homo sapiens
tcctgcccctctttctctt

SEQ ID NO: 6420370 - DNA, 17 bp, Homo sapiens
tcctgcccctgagccca

SEQ ID NO: 6420371 - DNA, 20 bp, Homo sapiens
tcctgcccctttcaggccta

SEQ ID NO: 6420372 - DNA, 17 bp, Homo sapiens
tcctgcccgagggcagc

SEQ ID NO: 6420373 - DNA, 20 bp, Homo sapiens
tcctgcccgagggcagcccc

SEQ ID NO: 6420374 - DNA, 18 bp, Homo sapiens
tcctgcccgccctccctc

SEQ ID NO: 6420375 - DNA, 12 bp, Homo sapiens
tcctgccctaca

SEQ ID NO: 6420376 - DNA, 19 bp, Homo sapiens
tcctgccctccggaggagc

SEQ ID NO: 6420377 - DNA, 21 bp, Homo sapiens
tcctgccctccggaggagcag

SEQ ID NO: 6420378 - DNA, 13 bp, Homo sapiens
tcctgccctcctc

SEQ ID NO: 6420379 - DNA, 15 bp, Homo sapiens
tcctgccctcctctc

SEQ ID NO: 6420380 - DNA, 18 bp, Homo sapiens
tcctgccctgcagcacgc

SEQ ID NO: 6420381 - DNA, 14 bp, Homo sapiens
tcctgccctgcccc

SEQ ID NO: 6420382 - DNA, 12 bp, Homo sapiens
tcctgccctggg

SEQ ID NO: 6420383 - DNA, 13 bp, Homo sapiens
tcctgccctgtac

SEQ ID NO: 6420384 - DNA, 15 bp, Homo sapiens
tcctgccctgtacct

SEQ ID NO: 6420385 - DNA, 23 bp, Homo sapiens
tcctgccctgtcaagcttctctg

SEQ ID NO: 6420386 - DNA, 14 bp, Homo sapiens
tcctgccctgtcca

SEQ ID NO: 6420387 - DNA, 18 bp, Homo sapiens
tcctgcccttccctctgg

SEQ ID NO: 6420388 - DNA, 22 bp, Homo sapiens
tcctgcccttccctctgggcac

SEQ ID NO: 6420389 - DNA, 19 bp, Homo sapiens
tcctgcccttcctcagttt

SEQ ID NO: 6420390 - DNA, 12 bp, Homo sapiens
tcctgcccttga

SEQ ID NO: 6420391 - DNA, 14 bp, Homo sapiens
tcctgcccttgctc

SEQ ID NO: 6420392 - DNA, 15 bp, Homo sapiens
tcctgccgactcctg

SEQ ID NO: 6420393 - DNA, 17 bp, Homo sapiens
tcctgccgagtgctctg

SEQ ID NO: 6420394 - DNA, 18 bp, Homo sapiens
tcctgccgctcctctcta

SEQ ID NO: 6420395 - DNA, 23 bp, Homo sapiens
tcctgccggagaggaagagacac

SEQ ID NO: 6420396 - DNA, 23 bp, Homo sapiens
tcctgccggtgggaccctgtccg

SEQ ID NO: 6420397 - DNA, 18 bp, Homo sapiens
tcctgcctaaatttcaca

SEQ ID NO: 6420398 - DNA, 16 bp, Homo sapiens
tcctgcctaaggctga

SEQ ID NO: 6420399 - DNA, 19 bp, Homo sapiens
tcctgcctaaggctgaact

SEQ ID NO: 6420400 - DNA, 21 bp, Homo sapiens
tcctgcctacattccctggcc

SEQ ID NO: 6420401 - DNA, 22 bp, Homo sapiens
tcctgcctacattccctggcct

SEQ ID NO: 6420402 - DNA, 18 bp, Homo sapiens
tcctgcctatgtctcctc

SEQ ID NO: 6420403 - DNA, 13 bp, Homo sapiens
tcctgcctcagcc

SEQ ID NO: 6420404 - DNA, 14 bp, Homo sapiens
tcctgcctcagcct

SEQ ID NO: 6420405 - DNA, 15 bp, Homo sapiens
tcctgcctcagcctc

SEQ ID NO: 6420406 - DNA, 19 bp, Homo sapiens
tcctgcctcagcctccaga

SEQ ID NO: 6420407 - DNA, 18 bp, Homo sapiens
tcctgcctcagcctcccg

SEQ ID NO: 6420408 - DNA, 18 bp, Homo sapiens
tcctgcctcccaagcagc

SEQ ID NO: 6420409 - DNA, 17 bp, Homo sapiens
tcctgcctcccgcctcc

SEQ ID NO: 6420410 - DNA, 14 bp, Homo sapiens
tcctgcctccgctg

SEQ ID NO: 6420411 - DNA, 19 bp, Homo sapiens
tcctgcctccgctggcttt

SEQ ID NO: 6420412 - DNA, 14 bp, Homo sapiens
tcctgcctcctcat

SEQ ID NO: 6420413 - DNA, 20 bp, Homo sapiens
tcctgcctcgaactggctgc

SEQ ID NO: 6420414 - DNA, 19 bp, Homo sapiens
tcctgcctgaacagccctc

SEQ ID NO: 6420415 - DNA, 14 bp, Homo sapiens
tcctgcctgcccct

SEQ ID NO: 6420416 - DNA, 12 bp, Homo sapiens
tcctgcctggca

SEQ ID NO: 6420417 - DNA, 15 bp, Homo sapiens
tcctgcctggcactt

SEQ ID NO: 6420418 - DNA, 21 bp, Homo sapiens
tcctgcctggcacttactggt

SEQ ID NO: 6420419 - DNA, 17 bp, Homo sapiens
tcctgcctgggtgggac

SEQ ID NO: 6420420 - DNA, 11 bp, Homo sapiens
tcctgcctggt

SEQ ID NO: 6420421 - DNA, 20 bp, Homo sapiens
tcctgcctgtctcctttgca

SEQ ID NO: 6420422 - DNA, 16 bp, Homo sapiens
tcctgcctgtctgccc

SEQ ID NO: 6420423 - DNA, 20 bp, Homo sapiens
tcctgcctgtctgccccagc

SEQ ID NO: 6420424 - DNA, 14 bp, Homo sapiens
tcctgcctgtgctg

SEQ ID NO: 6420425 - DNA, 13 bp, Homo sapiens
tcctgcctgtggc

SEQ ID NO: 6420426 - DNA, 15 bp, Homo sapiens
tcctgcctgtggcca

SEQ ID NO: 6420427 - DNA, 14 bp, Homo sapiens
tcctgcctgtggcg

SEQ ID NO: 6420428 - DNA, 14 bp, Homo sapiens
tcctgccttcctcc

SEQ ID NO: 6420429 - DNA, 16 bp, Homo sapiens
tcctgccttcctcctg

SEQ ID NO: 6420430 - DNA, 19 bp, Homo sapiens
tcctgccttcctcctgggc

SEQ ID NO: 6420431 - DNA, 22 bp, Homo sapiens
tcctgccttcctcctgggccct

SEQ ID NO: 6420432 - DNA, 23 bp, Homo sapiens
tcctgccttctgtcctggtgtca

SEQ ID NO: 6420433 - DNA, 19 bp, Homo sapiens
tcctgccttcttccttgag

SEQ ID NO: 6420434 - DNA, 21 bp, Homo sapiens
tcctgccttcttccttgaggg

SEQ ID NO: 6420435 - DNA, 16 bp, Homo sapiens
tcctgccttcttcttt

SEQ ID NO: 6420436 - DNA, 16 bp, Homo sapiens
tcctgcctttaagcca

SEQ ID NO: 6420437 - DNA, 18 bp, Homo sapiens
tcctgcctttaagccaaa

SEQ ID NO: 6420438 - DNA, 19 bp, Homo sapiens
tcctgcctttaagccaaag

SEQ ID NO: 6420439 - DNA, 20 bp, Homo sapiens
tcctgcctttaagccaaaga

SEQ ID NO: 6420440 - DNA, 19 bp, Homo sapiens
tcctgcctttctcaactgt

SEQ ID NO: 6420441 - DNA, 11 bp, Homo sapiens
tcctgcctttg

SEQ ID NO: 6420442 - DNA, 14 bp, Homo sapiens
tcctgcctttgcct

SEQ ID NO: 6420443 - DNA, 18 bp, Homo sapiens
tcctgcctttgcctccag

SEQ ID NO: 6420444 - DNA, 12 bp, Homo sapiens
tcctgcctttta

SEQ ID NO: 6420445 - DNA, 21 bp, Homo sapiens
tcctgccttttaccttcagta

SEQ ID NO: 6420446 - DNA, 14 bp, Homo sapiens
tcctgcgaggctat

SEQ ID NO: 6420447 - DNA, 17 bp, Homo sapiens
tcctgcgaggctatgag

SEQ ID NO: 6420448 - DNA, 21 bp, Homo sapiens
tcctgcgccccgcccacaccc

SEQ ID NO: 6420449 - DNA, 13 bp, Homo sapiens
tcctgcgccctgt

SEQ ID NO: 6420450 - DNA, 14 bp, Homo sapiens
tcctgcgcctgcct

SEQ ID NO: 6420451 - DNA, 17 bp, Homo sapiens
tcctgcggcaggactgc

SEQ ID NO: 6420452 - DNA, 20 bp, Homo sapiens
tcctgcggcaggactgcaga

SEQ ID NO: 6420453 - DNA, 23 bp, Homo sapiens
tcctgcggcaggactgcagagca

SEQ ID NO: 6420454 - DNA, 14 bp, Homo sapiens
tcctgcggctcagc

SEQ ID NO: 6420455 - DNA, 16 bp, Homo sapiens
tcctgcggctcagcct

SEQ ID NO: 6420456 - DNA, 22 bp, Homo sapiens
tcctgcggctcagccttgcaca

SEQ ID NO: 6420457 - DNA, 14 bp, Homo sapiens
tcctgcgggtgggg

SEQ ID NO: 6420458 - DNA, 13 bp, Homo sapiens
tcctgcgtcccag

SEQ ID NO: 6420459 - DNA, 13 bp, Homo sapiens
tcctgcgtcctcc

SEQ ID NO: 6420460 - DNA, 15 bp, Homo sapiens
tcctgcgtcctcctc

SEQ ID NO: 6420461 - DNA, 19 bp, Homo sapiens
tcctgcgtgtgcccactga

SEQ ID NO: 6420462 - DNA, 15 bp, Homo sapiens
tcctgcgtgttctca

SEQ ID NO: 6420463 - DNA, 22 bp, Homo sapiens
tcctgcgttttctccgggtcct

SEQ ID NO: 6420464 - DNA, 16 bp, Homo sapiens
tcctgctacaagtgtt

SEQ ID NO: 6420465 - DNA, 19 bp, Homo sapiens
tcctgctacaagtgtttta

SEQ ID NO: 6420466 - DNA, 19 bp, Homo sapiens
tcctgctacctttgtctca

SEQ ID NO: 6420467 - DNA, 14 bp, Homo sapiens
tcctgctacttccc

SEQ ID NO: 6420468 - DNA, 21 bp, Homo sapiens
tcctgctacttccccagctct

SEQ ID NO: 6420469 - DNA, 23 bp, Homo sapiens
tcctgctacttccccagctctca

SEQ ID NO: 6420470 - DNA, 16 bp, Homo sapiens
tcctgctagcacctcc

SEQ ID NO: 6420471 - DNA, 21 bp, Homo sapiens
tcctgctagcacctccccaga

SEQ ID NO: 6420472 - DNA, 18 bp, Homo sapiens
tcctgctagctgtagaaa

SEQ ID NO: 6420473 - DNA, 16 bp, Homo sapiens
tcctgctagctgtctc

SEQ ID NO: 6420474 - DNA, 23 bp, Homo sapiens
tcctgctatattaacatcatctt

SEQ ID NO: 6420475 - DNA, 21 bp, Homo sapiens
tcctgctatgacagctggcta

SEQ ID NO: 6420476 - DNA, 23 bp, Homo sapiens
tcctgctcaactctacccctgct

SEQ ID NO: 6420477 - DNA, 13 bp, Homo sapiens
tcctgctcacatc

SEQ ID NO: 6420478 - DNA, 17 bp, Homo sapiens
tcctgctcaccacctgc

SEQ ID NO: 6420479 - DNA, 18 bp, Homo sapiens
tcctgctcaccacctgcc

SEQ ID NO: 6420480 - DNA, 21 bp, Homo sapiens
tcctgctcaccacctgcctct

SEQ ID NO: 6420481 - DNA, 23 bp, Homo sapiens
tcctgctcacctgtgtgcccagc

SEQ ID NO: 6420482 - DNA, 18 bp, Homo sapiens
tcctgctcagatgctggt

SEQ ID NO: 6420483 - DNA, 13 bp, Homo sapiens
tcctgctccacag

SEQ ID NO: 6420484 - DNA, 14 bp, Homo sapiens
tcctgctccacagc

SEQ ID NO: 6420485 - DNA, 15 bp, Homo sapiens
tcctgctccacagtg

SEQ ID NO: 6420486 - DNA, 16 bp, Homo sapiens
tcctgctccacagtgt

SEQ ID NO: 6420487 - DNA, 12 bp, Homo sapiens
tcctgctccaga

SEQ ID NO: 6420488 - DNA, 21 bp, Homo sapiens
tcctgctccagcagcacacct

SEQ ID NO: 6420489 - DNA, 14 bp, Homo sapiens
tcctgctccagtgt

SEQ ID NO: 6420490 - DNA, 13 bp, Homo sapiens
tcctgctccgtgg

SEQ ID NO: 6420491 - DNA, 14 bp, Homo sapiens
tcctgctccgtgga

SEQ ID NO: 6420492 - DNA, 22 bp, Homo sapiens
tcctgctccgtggactgcagtc

SEQ ID NO: 6420493 - DNA, 10 bp, Homo sapiens
tcctgctcct

SEQ ID NO: 6420494 - DNA, 18 bp, Homo sapiens
tcctgctcctcacccctg

SEQ ID NO: 6420495 - DNA, 15 bp, Homo sapiens
tcctgctcctccctg

SEQ ID NO: 6420496 - DNA, 18 bp, Homo sapiens
tcctgctcgccctgtgcc

SEQ ID NO: 6420497 - DNA, 17 bp, Homo sapiens
tcctgctctctacccag

SEQ ID NO: 6420498 - DNA, 22 bp, Homo sapiens
tcctgctctctacccagcccat

SEQ ID NO: 6420499 - DNA, 14 bp, Homo sapiens
tcctgctctctgct

SEQ ID NO: 6420500 - DNA, 16 bp, Homo sapiens
tcctgctctctgctca

SEQ ID NO: 6420501 - DNA, 21 bp, Homo sapiens
tcctgctctctgctcatgggt

SEQ ID NO: 6420502 - DNA, 18 bp, Homo sapiens
tcctgctctctggaggta

SEQ ID NO: 6420503 - DNA, 11 bp, Homo sapiens
tcctgctctgc

SEQ ID NO: 6420504 - DNA, 16 bp, Homo sapiens
tcctgctctgcacggt

SEQ ID NO: 6420505 - DNA, 14 bp, Homo sapiens
tcctgctctgcttc

SEQ ID NO: 6420506 - DNA, 16 bp, Homo sapiens
tcctgctctgcttcct

SEQ ID NO: 6420507 - DNA, 17 bp, Homo sapiens
tcctgctctgcttcctc

SEQ ID NO: 6420508 - DNA, 12 bp, Homo sapiens
tcctgctctggg

SEQ ID NO: 6420509 - DNA, 13 bp, Homo sapiens
tcctgctcttcca

SEQ ID NO: 6420510 - DNA, 22 bp, Homo sapiens
tcctgctcttccatttcttcca

SEQ ID NO: 6420511 - DNA, 21 bp, Homo sapiens
tcctgctgaaagtcctgcttt

SEQ ID NO: 6420512 - DNA, 15 bp, Homo sapiens
tcctgctgagctgcc

SEQ ID NO: 6420513 - DNA, 20 bp, Homo sapiens
tcctgctgagtccctcacgt

SEQ ID NO: 6420514 - DNA, 17 bp, Homo sapiens
tcctgctgcacaggccc

SEQ ID NO: 6420515 - DNA, 13 bp, Homo sapiens
tcctgctgcacca

SEQ ID NO: 6420516 - DNA, 17 bp, Homo sapiens
tcctgctgcaccaaccc

SEQ ID NO: 6420517 - DNA, 20 bp, Homo sapiens
tcctgctgcaccaacccagc

SEQ ID NO: 6420518 - DNA, 21 bp, Homo sapiens
tcctgctgcaccctgcgcctc

SEQ ID NO: 6420519 - DNA, 18 bp, Homo sapiens
tcctgctgcagaggggca

SEQ ID NO: 6420520 - DNA, 21 bp, Homo sapiens
tcctgctgcagttgccagtca

SEQ ID NO: 6420521 - DNA, 21 bp, Homo sapiens
tcctgctgccagtaccagccc

SEQ ID NO: 6420522 - DNA, 13 bp, Homo sapiens
tcctgctgccctc

SEQ ID NO: 6420523 - DNA, 14 bp, Homo sapiens
tcctgctgccctcc

SEQ ID NO: 6420524 - DNA, 16 bp, Homo sapiens
tcctgctgccctccca

SEQ ID NO: 6420525 - DNA, 20 bp, Homo sapiens
tcctgctgcctaataaagag

SEQ ID NO: 6420526 - DNA, 16 bp, Homo sapiens
tcctgctgcctggagt

SEQ ID NO: 6420527 - DNA, 17 bp, Homo sapiens
tcctgctgcctggagtc

SEQ ID NO: 6420528 - DNA, 16 bp, Homo sapiens
tcctgctgctcactcc

SEQ ID NO: 6420529 - DNA, 15 bp, Homo sapiens
tcctgctgctccctc

SEQ ID NO: 6420530 - DNA, 17 bp, Homo sapiens
tcctgctgctccctcag

SEQ ID NO: 6420531 - DNA, 19 bp, Homo sapiens
tcctgctgctccctcagac

SEQ ID NO: 6420532 - DNA, 15 bp, Homo sapiens
tcctgctgctcctgt

SEQ ID NO: 6420533 - DNA, 16 bp, Homo sapiens
tcctgctgctcctgtt

SEQ ID NO: 6420534 - DNA, 19 bp, Homo sapiens
tcctgctgctcgggaaggc

SEQ ID NO: 6420535 - DNA, 17 bp, Homo sapiens
tcctgctgctgctactg

SEQ ID NO: 6420536 - DNA, 13 bp, Homo sapiens
tcctgctgctgta

SEQ ID NO: 6420537 - DNA, 22 bp, Homo sapiens
tcctgctgctgtaactgctgag

SEQ ID NO: 6420538 - DNA, 18 bp, Homo sapiens
tcctgctgctgtctgggt

SEQ ID NO: 6420539 - DNA, 20 bp, Homo sapiens
tcctgctgctttgggctggg

SEQ ID NO: 6420540 - DNA, 13 bp, Homo sapiens
tcctgctggacag

SEQ ID NO: 6420541 - DNA, 20 bp, Homo sapiens
tcctgctggcacctcagaca

SEQ ID NO: 6420542 - DNA, 15 bp, Homo sapiens
tcctgctggcctgct

SEQ ID NO: 6420543 - DNA, 18 bp, Homo sapiens
tcctgctggcctgctctt

SEQ ID NO: 6420544 - DNA, 14 bp, Homo sapiens
tcctgctggctgag

SEQ ID NO: 6420545 - DNA, 23 bp, Homo sapiens
tcctgctggcttccagcttcagg

SEQ ID NO: 6420546 - DNA, 22 bp, Homo sapiens
tatgtaatttttaaagcaaata

SEQ ID NO: 6420547 - DNA, 15 bp, Homo sapiens
tatgtacaaacatgt

SEQ ID NO: 6420548 - DNA, 20 bp, Homo sapiens
tatgtacaaataatattgcc

SEQ ID NO: 6420549 - DNA, 23 bp, Homo sapiens
tatgtacaaataatattgccttg

SEQ ID NO: 6420550 - DNA, 13 bp, Homo sapiens
tatgtacaaccct

SEQ ID NO: 6420551 - DNA, 17 bp, Homo sapiens
tatgtacaaccctgacc

SEQ ID NO: 6420552 - DNA, 11 bp, Homo sapiens
tatgtacaata

SEQ ID NO: 6420553 - DNA, 21 bp, Homo sapiens
tatgtacacaacttagaaacc

SEQ ID NO: 6420554 - DNA, 13 bp, Homo sapiens
tatgtacacagac

SEQ ID NO: 6420555 - DNA, 13 bp, Homo sapiens
tatgtacagagct

SEQ ID NO: 6420556 - DNA, 16 bp, Homo sapiens
tatgtacagagctttc

SEQ ID NO: 6420557 - DNA, 14 bp, Homo sapiens
tatgtacagttata

SEQ ID NO: 6420558 - DNA, 19 bp, Homo sapiens
tatgtacagttcataaatt

SEQ ID NO: 6420559 - DNA, 16 bp, Homo sapiens
tatgtacatttctaag

SEQ ID NO: 6420560 - DNA, 10 bp, Homo sapiens
tatgtaccaa

SEQ ID NO: 6420561 - DNA, 14 bp, Homo sapiens
tatgtaccaagaat

SEQ ID NO: 6420562 - DNA, 21 bp, Homo sapiens
tatgtaccatatgatctgttt

SEQ ID NO: 6420563 - DNA, 16 bp, Homo sapiens
tatgtaccatgaatat

SEQ ID NO: 6420564 - DNA, 19 bp, Homo sapiens
tatgtacctctagctgttc

SEQ ID NO: 6420565 - DNA, 14 bp, Homo sapiens
tatgtacctctttt

SEQ ID NO: 6420566 - DNA, 16 bp, Homo sapiens
tatgtacgataaagta

SEQ ID NO: 6420567 - DNA, 15 bp, Homo sapiens
tatgtacgtatatat

SEQ ID NO: 6420568 - DNA, 19 bp, Homo sapiens
tatgtacgtttgtatgtgt

SEQ ID NO: 6420569 - DNA, 20 bp, Homo sapiens
tatgtactaagaatgtcctt

SEQ ID NO: 6420570 - DNA, 14 bp, Homo sapiens
tatgtactacatga

SEQ ID NO: 6420571 - DNA, 14 bp, Homo sapiens
tatgtactagtgtt

SEQ ID NO: 6420572 - DNA, 20 bp, Homo sapiens
tatgtactcctctttacact

SEQ ID NO: 6420573 - DNA, 21 bp, Homo sapiens
tatgtactctacgccaaagtg

SEQ ID NO: 6420574 - DNA, 19 bp, Homo sapiens
tatgtacttagctgtacta

SEQ ID NO: 6420575 - DNA, 23 bp, Homo sapiens
tatgtacttagctgtactataag

SEQ ID NO: 6420576 - DNA, 20 bp, Homo sapiens
tatgtacttgatactgaatg

SEQ ID NO: 6420577 - DNA, 20 bp, Homo sapiens
tatgtacttgtttgctatga

SEQ ID NO: 6420578 - DNA, 16 bp, Homo sapiens
tatgtacttttccatt

SEQ ID NO: 6420579 - DNA, 13 bp, Homo sapiens
tatgtagaaacat

SEQ ID NO: 6420580 - DNA, 14 bp, Homo sapiens
tatgtagaaacatt

SEQ ID NO: 6420581 - DNA, 14 bp, Homo sapiens
tatgtagaaatatt

SEQ ID NO: 6420582 - DNA, 14 bp, Homo sapiens
tatgtagaactgtt

SEQ ID NO: 6420583 - DNA, 24 bp, Homo sapiens
tatgtagacaaaacttataatttc

SEQ ID NO: 6420584 - DNA, 15 bp, Homo sapiens
tatgtagacaatata

SEQ ID NO: 6420585 - DNA, 13 bp, Homo sapiens
tatgtagacattg

SEQ ID NO: 6420586 - DNA, 18 bp, Homo sapiens
tatgtagactatatacat

SEQ ID NO: 6420587 - DNA, 22 bp, Homo sapiens
tatgtagactatatacatgtgt

SEQ ID NO: 6420588 - DNA, 18 bp, Homo sapiens
tatgtagatatttggctt

SEQ ID NO: 6420589 - DNA, 22 bp, Homo sapiens
tatgtagatatttggcttaaat

SEQ ID NO: 6420590 - DNA, 19 bp, Homo sapiens
tatgtagcagggaaaatat

SEQ ID NO: 6420591 - DNA, 16 bp, Homo sapiens
tatgtagccagacagt

SEQ ID NO: 6420592 - DNA, 18 bp, Homo sapiens
tatgtagcccggccaggg

SEQ ID NO: 6420593 - DNA, 19 bp, Homo sapiens
tatgtagccttcacacaga

SEQ ID NO: 6420594 - DNA, 20 bp, Homo sapiens
tatgtagctgtcgtacattg

SEQ ID NO: 6420595 - DNA, 21 bp, Homo sapiens
tatgtaggtaagactgtagat

SEQ ID NO: 6420596 - DNA, 16 bp, Homo sapiens
tatgtagtcataataa

SEQ ID NO: 6420597 - DNA, 15 bp, Homo sapiens
tatgtagtggtttta

SEQ ID NO: 6420598 - DNA, 15 bp, Homo sapiens
tatgtagttaaatag

SEQ ID NO: 6420599 - DNA, 22 bp, Homo sapiens
tatgtataaaatgtaacactga

SEQ ID NO: 6420600 - DNA, 14 bp, Homo sapiens
tatgtatacacaca

SEQ ID NO: 6420601 - DNA, 23 bp, Homo sapiens
tatgtatacgcacgcacccacac

SEQ ID NO: 6420602 - DNA, 20 bp, Homo sapiens
tatgtatagaaaataaaata

SEQ ID NO: 6420603 - DNA, 19 bp, Homo sapiens
tatgtataggggaaagaag

SEQ ID NO: 6420604 - DNA, 20 bp, Homo sapiens
tatgtatatatattctcagc

SEQ ID NO: 6420605 - DNA, 18 bp, Homo sapiens
tatgtatatctgtgtaag

SEQ ID NO: 6420606 - DNA, 18 bp, Homo sapiens
tatgtatatctttgcact

SEQ ID NO: 6420607 - DNA, 16 bp, Homo sapiens
tatgtatatgtatata

SEQ ID NO: 6420608 - DNA, 17 bp, Homo sapiens
tatgtatatgtatatct

SEQ ID NO: 6420609 - DNA, 15 bp, Homo sapiens
tatgtatatgtctag

SEQ ID NO: 6420610 - DNA, 15 bp, Homo sapiens
tatgtatatttttga

SEQ ID NO: 6420611 - DNA, 23 bp, Homo sapiens
tatgtatatttttttaatttaac

SEQ ID NO: 6420612 - DNA, 15 bp, Homo sapiens
tatgtatcaagccct

SEQ ID NO: 6420613 - DNA, 16 bp, Homo sapiens
tatgtatcagaagaga

SEQ ID NO: 6420614 - DNA, 22 bp, Homo sapiens
tatgtatctaaatgaaaagaga

SEQ ID NO: 6420615 - DNA, 22 bp, Homo sapiens
tatgtatctaatttcattcaaa

SEQ ID NO: 6420616 - DNA, 14 bp, Homo sapiens
tatgtatcttgatg

SEQ ID NO: 6420617 - DNA, 21 bp, Homo sapiens
tatgtatctttggggaaacta

SEQ ID NO: 6420618 - DNA, 15 bp, Homo sapiens
tatgtatgataaaca

SEQ ID NO: 6420619 - DNA, 20 bp, Homo sapiens
tatgtatggaaacacatact

SEQ ID NO: 6420620 - DNA, 22 bp, Homo sapiens
tatgtatggatatatttgaaat

SEQ ID NO: 6420621 - DNA, 19 bp, Homo sapiens
tatgtatgggagatggcag

SEQ ID NO: 6420622 - DNA, 23 bp, Homo sapiens
tatgtatgggtagggtaaatcag

SEQ ID NO: 6420623 - DNA, 16 bp, Homo sapiens
tatgtatggtttgaaa

SEQ ID NO: 6420624 - DNA, 17 bp, Homo sapiens
tatgtatggtttgaaaa

SEQ ID NO: 6420625 - DNA, 16 bp, Homo sapiens
tatgtatgtaaaaatg

SEQ ID NO: 6420626 - DNA, 16 bp, Homo sapiens
tatgtatgtgaaagtt

SEQ ID NO: 6420627 - DNA, 16 bp, Homo sapiens
tatgtatgtgtagtgt

SEQ ID NO: 6420628 - DNA, 17 bp, Homo sapiens
tatgtatgtgtagtgtg

SEQ ID NO: 6420629 - DNA, 12 bp, Homo sapiens
tatgtatgtgtg

SEQ ID NO: 6420630 - DNA, 22 bp, Homo sapiens
tatgtatgtgtgagtgtatgta

SEQ ID NO: 6420631 - DNA, 13 bp, Homo sapiens
tatgtatgtgtgt

SEQ ID NO: 6420632 - DNA, 17 bp, Homo sapiens
tatgtatgtgtgtatgg

SEQ ID NO: 6420633 - DNA, 17 bp, Homo sapiens
tatgtatgtgtttagaa

SEQ ID NO: 6420634 - DNA, 21 bp, Homo sapiens
tatgtatgtgtttagaattga

SEQ ID NO: 6420635 - DNA, 21 bp, Homo sapiens
tatgtattaagccaaacatga

SEQ ID NO: 6420636 - DNA, 23 bp, Homo sapiens
tatgtattagtgatatttctcta

SEQ ID NO: 6420637 - DNA, 13 bp, Homo sapiens
tatgtattataca

SEQ ID NO: 6420638 - DNA, 17 bp, Homo sapiens
tatgtattatttgcaca

SEQ ID NO: 6420639 - DNA, 22 bp, Homo sapiens
tatgtattattttctatagctc

SEQ ID NO: 6420640 - DNA, 14 bp, Homo sapiens
tatgtattcctatg

SEQ ID NO: 6420641 - DNA, 13 bp, Homo sapiens
tatgtattctgta

SEQ ID NO: 6420642 - DNA, 18 bp, Homo sapiens
tatgtattgtaaacatgt

SEQ ID NO: 6420643 - DNA, 20 bp, Homo sapiens
tatgtattgtgcaatgtgta

SEQ ID NO: 6420644 - DNA, 14 bp, Homo sapiens
tatgtatttaaagt

SEQ ID NO: 6420645 - DNA, 13 bp, Homo sapiens
tatgtatttaaga

SEQ ID NO: 6420646 - DNA, 11 bp, Homo sapiens
tatgtatttcc

SEQ ID NO: 6420647 - DNA, 10 bp, Homo sapiens
tatgtatttt

SEQ ID NO: 6420648 - DNA, 14 bp, Homo sapiens
tatgtattttccta

SEQ ID NO: 6420649 - DNA, 16 bp, Homo sapiens
tatgtattttcctaat

SEQ ID NO: 6420650 - DNA, 14 bp, Homo sapiens
tatgtattttgaaa

SEQ ID NO: 6420651 - DNA, 16 bp, Homo sapiens
tatgtatttttctatg

SEQ ID NO: 6420652 - DNA, 13 bp, Homo sapiens
tatgtcaaatgga

SEQ ID NO: 6420653 - DNA, 21 bp, Homo sapiens
tatgtcaataaacaacagctg

SEQ ID NO: 6420654 - DNA, 17 bp, Homo sapiens
tatgtcaatttgtatat

SEQ ID NO: 6420655 - DNA, 17 bp, Homo sapiens
tatgtcacaaagagctg

SEQ ID NO: 6420656 - DNA, 17 bp, Homo sapiens
tatgtcacgaacttgaa

SEQ ID NO: 6420657 - DNA, 18 bp, Homo sapiens
tatgtcagcagctctgag

SEQ ID NO: 6420658 - DNA, 22 bp, Homo sapiens
tatgtcagcagctctgagacag

SEQ ID NO: 6420659 - DNA, 13 bp, Homo sapiens
tatgtcagttata

SEQ ID NO: 6420660 - DNA, 14 bp, Homo sapiens
tatgtcatagaaat

SEQ ID NO: 6420661 - DNA, 15 bp, Homo sapiens
tatgtcatcactcta

SEQ ID NO: 6420662 - DNA, 18 bp, Homo sapiens
tatgtcatcagtaaagta

SEQ ID NO: 6420663 - DNA, 15 bp, Homo sapiens
tatgtcatcatacat

SEQ ID NO: 6420664 - DNA, 15 bp, Homo sapiens
tatgtcatcatgctt

SEQ ID NO: 6420665 - DNA, 19 bp, Homo sapiens
tatgtcatgcctcactttc

SEQ ID NO: 6420666 - DNA, 16 bp, Homo sapiens
tatgtcatttcatttc

SEQ ID NO: 6420667 - DNA, 23 bp, Homo sapiens
tatgtcattttcagatccttcca

SEQ ID NO: 6420668 - DNA, 15 bp, Homo sapiens
tatgtccaaacctgg

SEQ ID NO: 6420669 - DNA, 17 bp, Homo sapiens
tatgtccactgtgtata

SEQ ID NO: 6420670 - DNA, 23 bp, Homo sapiens
tatgtccactgtgtatagaagta

SEQ ID NO: 6420671 - DNA, 13 bp, Homo sapiens
tatgtccatatct

SEQ ID NO: 6420672 - DNA, 15 bp, Homo sapiens
tatgtcccaagagcc

SEQ ID NO: 6420673 - DNA, 21 bp, Homo sapiens
tatgtccccataagacaaaca

SEQ ID NO: 6420674 - DNA, 23 bp, Homo sapiens
tatgtccccataagacaaacact

SEQ ID NO: 6420675 - DNA, 20 bp, Homo sapiens
tatgtcccttcacatagttt

SEQ ID NO: 6420676 - DNA, 15 bp, Homo sapiens
tatgtcccttgctgt

SEQ ID NO: 6420677 - DNA, 23 bp, Homo sapiens
tatgtccggctttaactatcttc

SEQ ID NO: 6420678 - DNA, 20 bp, Homo sapiens
tatgtcctgtgagatgtgta

SEQ ID NO: 6420679 - DNA, 16 bp, Homo sapiens
tatgtccttcagctga

SEQ ID NO: 6420680 - DNA, 19 bp, Homo sapiens
tatgtcgtagaattccttc

SEQ ID NO: 6420681 - DNA, 21 bp, Homo sapiens
tatgtcgtgttttcaaggaag

SEQ ID NO: 6420682 - DNA, 22 bp, Homo sapiens
tatgtcgtgttttcaaggaaga

SEQ ID NO: 6420683 - DNA, 15 bp, Homo sapiens
tatgtctatatttaa

SEQ ID NO: 6420684 - DNA, 12 bp, Homo sapiens
tatgtctatgtg

SEQ ID NO: 6420685 - DNA, 21 bp, Homo sapiens
tatgtctatgtgtatatatta

SEQ ID NO: 6420686 - DNA, 12 bp, Homo sapiens
tatgtctattta

SEQ ID NO: 6420687 - DNA, 15 bp, Homo sapiens
tatgtctatttaagc

SEQ ID NO: 6420688 - DNA, 19 bp, Homo sapiens
tatgtctctagcagtgagt

SEQ ID NO: 6420689 - DNA, 19 bp, Homo sapiens
tatgtctcttctgagctat

SEQ ID NO: 6420690 - DNA, 13 bp, Homo sapiens
tatgtctcttgag

SEQ ID NO: 6420691 - DNA, 14 bp, Homo sapiens
tatgtctgaacata

SEQ ID NO: 6420692 - DNA, 14 bp, Homo sapiens
tatgtctgccttcg

SEQ ID NO: 6420693 - DNA, 14 bp, Homo sapiens
tatgtctgcttctg

SEQ ID NO: 6420694 - DNA, 13 bp, Homo sapiens
tatgtctggcaga

SEQ ID NO: 6420695 - DNA, 16 bp, Homo sapiens
tatgtctgtcattgta

SEQ ID NO: 6420696 - DNA, 13 bp, Homo sapiens
tatgtctgtcttt

SEQ ID NO: 6420697 - DNA, 18 bp, Homo sapiens
tatgtctgtctttgcaaa

SEQ ID NO: 6420698 - DNA, 20 bp, Homo sapiens
tatgtctgtctttgcaaagg

SEQ ID NO: 6420699 - DNA, 15 bp, Homo sapiens
tatgtctgtgccatt

SEQ ID NO: 6420700 - DNA, 11 bp, Homo sapiens
tatgtctgtgt

SEQ ID NO: 6420701 - DNA, 12 bp, Homo sapiens
tatgtctgtgtg

SEQ ID NO: 6420702 - DNA, 15 bp, Homo sapiens
tatgtctgtttttgt

SEQ ID NO: 6420703 - DNA, 21 bp, Homo sapiens
tatgtctgtttttgtatcttt

SEQ ID NO: 6420704 - DNA, 19 bp, Homo sapiens
tatgtcttactactttaaa

SEQ ID NO: 6420705 - DNA, 22 bp, Homo sapiens
tatgtcttataagaaaacatgt

SEQ ID NO: 6420706 - DNA, 19 bp, Homo sapiens
tatgtcttggacactgtac

SEQ ID NO: 6420707 - DNA, 22 bp, Homo sapiens
tatgtcttgtatttaaaaacat

SEQ ID NO: 6420708 - DNA, 16 bp, Homo sapiens
tatgtctttaaaatga

SEQ ID NO: 6420709 - DNA, 14 bp, Homo sapiens
tatgtcttttaata

SEQ ID NO: 6420710 - DNA, 15 bp, Homo sapiens
tatgtgaaaaattaa

SEQ ID NO: 6420711 - DNA, 23 bp, Homo sapiens
tatgtgaaactacagatctttgg

SEQ ID NO: 6420712 - DNA, 17 bp, Homo sapiens
tatgtgaaaggaacatt

SEQ ID NO: 6420713 - DNA, 17 bp, Homo sapiens
tatgtgaaagtgtaaaa

SEQ ID NO: 6420714 - DNA, 22 bp, Homo sapiens
tatgtgaaagtgtaaaatagaa

SEQ ID NO: 6420715 - DNA, 13 bp, Homo sapiens
tatgtgaacattc

SEQ ID NO: 6420716 - DNA, 15 bp, Homo sapiens
tatgtgaacattcct

SEQ ID NO: 6420717 - DNA, 13 bp, Homo sapiens
tatgtgaagaaaa

SEQ ID NO: 6420718 - DNA, 19 bp, Homo sapiens
tatgtgaagatataagtaa

SEQ ID NO: 6420719 - DNA, 12 bp, Homo sapiens
tatgtgaagttt

SEQ ID NO: 6420720 - DNA, 22 bp, Homo sapiens
tatgtgaatatggactcagttt

SEQ ID NO: 6420721 - DNA, 22 bp, Homo sapiens
tatgtgaatgatctctctgaat

SEQ ID NO: 6420722 - DNA, 15 bp, Homo sapiens
tatgtgaatttaatg

SEQ ID NO: 6420723 - DNA, 15 bp, Homo sapiens
tatgtgaatttgttt

SEQ ID NO: 6420724 - DNA, 12 bp, Homo sapiens
tatgtgaatttt

SEQ ID NO: 6420725 - DNA, 16 bp, Homo sapiens
tatgtgacaacatttt

SEQ ID NO: 6420726 - DNA, 10 bp, Homo sapiens
tcctgctggg

SEQ ID NO: 6420727 - DNA, 13 bp, Homo sapiens
tcctgctggggcc

SEQ ID NO: 6420728 - DNA, 13 bp, Homo sapiens
tcctgctggtacc

SEQ ID NO: 6420729 - DNA, 19 bp, Homo sapiens
tcctgctgtagtcctttct

SEQ ID NO: 6420730 - DNA, 14 bp, Homo sapiens
tcctgctgtatttc

SEQ ID NO: 6420731 - DNA, 17 bp, Homo sapiens
tcctgctgtatttcctg

SEQ ID NO: 6420732 - DNA, 18 bp, Homo sapiens
tcctgctgtccctgtcag

SEQ ID NO: 6420733 - DNA, 15 bp, Homo sapiens
tcctgctgtcctggt

SEQ ID NO: 6420734 - DNA, 17 bp, Homo sapiens
tcctgctgtcctggtgg

SEQ ID NO: 6420735 - DNA, 15 bp, Homo sapiens
tcctgctgtggcctc

SEQ ID NO: 6420736 - DNA, 17 bp, Homo sapiens
tcctgctgtggcctcac

SEQ ID NO: 6420737 - DNA, 11 bp, Homo sapiens
tcctgcttccc

SEQ ID NO: 6420738 - DNA, 12 bp, Homo sapiens
tcctgcttcccc

SEQ ID NO: 6420739 - DNA, 18 bp, Homo sapiens
tcctgcttcccctcccta

SEQ ID NO: 6420740 - DNA, 18 bp, Homo sapiens
tcctgcttccgagatccc

SEQ ID NO: 6420741 - DNA, 15 bp, Homo sapiens
tcctgcttcctgaaa

SEQ ID NO: 6420742 - DNA, 21 bp, Homo sapiens
tcctgcttctctcagccagct

SEQ ID NO: 6420743 - DNA, 19 bp, Homo sapiens
tcctgcttgaactgctgcc

SEQ ID NO: 6420744 - DNA, 19 bp, Homo sapiens
tcctgcttgccaaggcaga

SEQ ID NO: 6420745 - DNA, 19 bp, Homo sapiens
tcctgctttccatgggccc

SEQ ID NO: 6420746 - DNA, 18 bp, Homo sapiens
tcctgctttccctcccca

SEQ ID NO: 6420747 - DNA, 16 bp, Homo sapiens
tcctgctttctctttc

SEQ ID NO: 6420748 - DNA, 18 bp, Homo sapiens
tcctgctttctctttcag

SEQ ID NO: 6420749 - DNA, 19 bp, Homo sapiens
tcctgctttgcgtgcccgg

SEQ ID NO: 6420750 - DNA, 18 bp, Homo sapiens
tcctgctttgggaagact

SEQ ID NO: 6420751 - DNA, 18 bp, Homo sapiens
tcctgctttgggaagccg

SEQ ID NO: 6420752 - DNA, 18 bp, Homo sapiens
tcctgcttttctgtcctg

SEQ ID NO: 6420753 - DNA, 19 bp, Homo sapiens
tcctgcttttctgtcctgg

SEQ ID NO: 6420754 - DNA, 18 bp, Homo sapiens
tcctgcttttgaggacag

SEQ ID NO: 6420755 - DNA, 14 bp, Homo sapiens
tcctggaaaactgg

SEQ ID NO: 6420756 - DNA, 13 bp, Homo sapiens
tcctggaaacagc

SEQ ID NO: 6420757 - DNA, 17 bp, Homo sapiens
tcctggaaacagcatga

SEQ ID NO: 6420758 - DNA, 23 bp, Homo sapiens
tcctggaaagactgattgtttta

SEQ ID NO: 6420759 - DNA, 16 bp, Homo sapiens
tcctggaaaggctcag

SEQ ID NO: 6420760 - DNA, 19 bp, Homo sapiens
tcctggaaaggctcagtct

SEQ ID NO: 6420761 - DNA, 22 bp, Homo sapiens
tcctggaaaggctcagtctcag

SEQ ID NO: 6420762 - DNA, 15 bp, Homo sapiens
tcctggaaatattaa

SEQ ID NO: 6420763 - DNA, 16 bp, Homo sapiens
tcctggaaatcagggt

SEQ ID NO: 6420764 - DNA, 22 bp, Homo sapiens
tcctggaaattgacgaggggtg

SEQ ID NO: 6420765 - DNA, 20 bp, Homo sapiens
tcctggaaatttgtgtgctt

SEQ ID NO: 6420766 - DNA, 16 bp, Homo sapiens
tcctggaacaatattt

SEQ ID NO: 6420767 - DNA, 22 bp, Homo sapiens
tcctggaacactatagagaacc

SEQ ID NO: 6420768 - DNA, 15 bp, Homo sapiens
tcctggaaccaatcc

SEQ ID NO: 6420769 - DNA, 16 bp, Homo sapiens
tcctggaacctggacc

SEQ ID NO: 6420770 - DNA, 17 bp, Homo sapiens
tcctggaacctggaccc

SEQ ID NO: 6420771 - DNA, 23 bp, Homo sapiens
tcctggaacctggaccccagcct

SEQ ID NO: 6420772 - DNA, 16 bp, Homo sapiens
tcctggaacctggcag

SEQ ID NO: 6420773 - DNA, 17 bp, Homo sapiens
tcctggaacctggcagg

SEQ ID NO: 6420774 - DNA, 17 bp, Homo sapiens
tcctggaacctgtctcc

SEQ ID NO: 6420775 - DNA, 20 bp, Homo sapiens
tcctggaaccttgctgtcct

SEQ ID NO: 6420776 - DNA, 21 bp, Homo sapiens
tcctggaaccttgctgtcctg

SEQ ID NO: 6420777 - DNA, 14 bp, Homo sapiens
tcctggaagcagag

SEQ ID NO: 6420778 - DNA, 13 bp, Homo sapiens
tcctggaagcagg

SEQ ID NO: 6420779 - DNA, 14 bp, Homo sapiens
tcctggaagccagc

SEQ ID NO: 6420780 - DNA, 15 bp, Homo sapiens
tcctggaaggacaca

SEQ ID NO: 6420781 - DNA, 22 bp, Homo sapiens
tcctggaagtcaaataaatgtt

SEQ ID NO: 6420782 - DNA, 19 bp, Homo sapiens
tcctggaagtgtgtgtttc

SEQ ID NO: 6420783 - DNA, 23 bp, Homo sapiens
tcctggaataaacatctgtgtct

SEQ ID NO: 6420784 - DNA, 21 bp, Homo sapiens
tcctggaatcaaggaatcctg

SEQ ID NO: 6420785 - DNA, 20 bp, Homo sapiens
tcctggaattgccagctgac

SEQ ID NO: 6420786 - DNA, 15 bp, Homo sapiens
tcctggacacactct

SEQ ID NO: 6420787 - DNA, 20 bp, Homo sapiens
tcctggacaccacccagagc

SEQ ID NO: 6420788 - DNA, 15 bp, Homo sapiens
tcctggacacctccc

SEQ ID NO: 6420789 - DNA, 11 bp, Homo sapiens
tcctggacagc

SEQ ID NO: 6420790 - DNA, 13 bp, Homo sapiens
tcctggacagctg

SEQ ID NO: 6420791 - DNA, 14 bp, Homo sapiens
tcctggacagctgt

SEQ ID NO: 6420792 - DNA, 15 bp, Homo sapiens
tcctggacagctgtg

SEQ ID NO: 6420793 - DNA, 15 bp, Homo sapiens
tcctggacaggccag

SEQ ID NO: 6420794 - DNA, 19 bp, Homo sapiens
tcctggacagtgagagcag

SEQ ID NO: 6420795 - DNA, 21 bp, Homo sapiens
tcctggacatcctcttctgct

SEQ ID NO: 6420796 - DNA, 15 bp, Homo sapiens
tcctggacccagcag

SEQ ID NO: 6420797 - DNA, 19 bp, Homo sapiens
tcctggactcattgcttca

SEQ ID NO: 6420798 - DNA, 15 bp, Homo sapiens
tcctggactcccctc

SEQ ID NO: 6420799 - DNA, 16 bp, Homo sapiens
tcctggactcccctcc

SEQ ID NO: 6420800 - DNA, 21 bp, Homo sapiens
tcctggactcccctccctgcc

SEQ ID NO: 6420801 - DNA, 15 bp, Homo sapiens
tcctggactccggag

SEQ ID NO: 6420802 - DNA, 20 bp, Homo sapiens
tcctggactccggaggactg

SEQ ID NO: 6420803 - DNA, 20 bp, Homo sapiens
tcctggactggttatcttgt

SEQ ID NO: 6420804 - DNA, 16 bp, Homo sapiens
tcctggacttaaagaa

SEQ ID NO: 6420805 - DNA, 16 bp, Homo sapiens
tcctggagaagcctcg

SEQ ID NO: 6420806 - DNA, 20 bp, Homo sapiens
tcctggagaagtgggtgggg

SEQ ID NO: 6420807 - DNA, 21 bp, Homo sapiens
tcctggagaggtggctgcgcc

SEQ ID NO: 6420808 - DNA, 13 bp, Homo sapiens
tcctggagcaagc

SEQ ID NO: 6420809 - DNA, 15 bp, Homo sapiens
tcctggagcaagctc

SEQ ID NO: 6420810 - DNA, 18 bp, Homo sapiens
tcctggagcaagctctgc

SEQ ID NO: 6420811 - DNA, 19 bp, Homo sapiens
tcctggagcaagctctgcc

SEQ ID NO: 6420812 - DNA, 20 bp, Homo sapiens
tcctggagcaagctctgccc

SEQ ID NO: 6420813 - DNA, 14 bp, Homo sapiens
tcctggagcagaag

SEQ ID NO: 6420814 - DNA, 16 bp, Homo sapiens
tcctggagcagaagca

SEQ ID NO: 6420815 - DNA, 16 bp, Homo sapiens
tcctggagccccagaa

SEQ ID NO: 6420816 - DNA, 22 bp, Homo sapiens
tcctggagccccagaaccccaa

SEQ ID NO: 6420817 - DNA, 15 bp, Homo sapiens
tcctggagcccgagg

SEQ ID NO: 6420818 - DNA, 21 bp, Homo sapiens
tcctggagcccgaggcaccag

SEQ ID NO: 6420819 - DNA, 13 bp, Homo sapiens
tcctggaggacca

SEQ ID NO: 6420820 - DNA, 18 bp, Homo sapiens
tcctggaggatgaccagg

SEQ ID NO: 6420821 - DNA, 22 bp, Homo sapiens
tcctggaggcaggggctgctgc

SEQ ID NO: 6420822 - DNA, 13 bp, Homo sapiens
tcctggaggccca

SEQ ID NO: 6420823 - DNA, 15 bp, Homo sapiens
tcctggaggctgcct

SEQ ID NO: 6420824 - DNA, 17 bp, Homo sapiens
tcctggagggcgcccag

SEQ ID NO: 6420825 - DNA, 17 bp, Homo sapiens
tcctggagggggcaagc

SEQ ID NO: 6420826 - DNA, 19 bp, Homo sapiens
tcctggaggggtgttgtat

SEQ ID NO: 6420827 - DNA, 17 bp, Homo sapiens
tcctggaggttccccag

SEQ ID NO: 6420828 - DNA, 18 bp, Homo sapiens
tcctggagtctcactgtc

SEQ ID NO: 6420829 - DNA, 19 bp, Homo sapiens
tcctggagtctgaagcctg

SEQ ID NO: 6420830 - DNA, 17 bp, Homo sapiens
tcctggagtgaagaaaa

SEQ ID NO: 6420831 - DNA, 14 bp, Homo sapiens
tcctggagtgatat

SEQ ID NO: 6420832 - DNA, 19 bp, Homo sapiens
tcctggagtgccctgcagg

SEQ ID NO: 6420833 - DNA, 14 bp, Homo sapiens
tcctggagttctgg

SEQ ID NO: 6420834 - DNA, 14 bp, Homo sapiens
tcctggagttgcat

SEQ ID NO: 6420835 - DNA, 16 bp, Homo sapiens
tcctggagttgcattg

SEQ ID NO: 6420836 - DNA, 16 bp, Homo sapiens
tcctggagttttgatt

SEQ ID NO: 6420837 - DNA, 16 bp, Homo sapiens
tcctggataaaaaaga

SEQ ID NO: 6420838 - DNA, 17 bp, Homo sapiens
tcctggataaaaaagaa

SEQ ID NO: 6420839 - DNA, 14 bp, Homo sapiens
tcctggatgaaaga

SEQ ID NO: 6420840 - DNA, 22 bp, Homo sapiens
tcctggatgatactaataaact

SEQ ID NO: 6420841 - DNA, 14 bp, Homo sapiens
tcctggatggggca

SEQ ID NO: 6420842 - DNA, 20 bp, Homo sapiens
tcctggatggggcagagctt

SEQ ID NO: 6420843 - DNA, 23 bp, Homo sapiens
tcctggatggggcagagcttctc

SEQ ID NO: 6420844 - DNA, 14 bp, Homo sapiens
tcctggatgtctga

SEQ ID NO: 6420845 - DNA, 13 bp, Homo sapiens
tcctggatttata

SEQ ID NO: 6420846 - DNA, 23 bp, Homo sapiens
tcctggatttatagtatgtgact

SEQ ID NO: 6420847 - DNA, 21 bp, Homo sapiens
tcctggcaatagtgtgttctg

SEQ ID NO: 6420848 - DNA, 22 bp, Homo sapiens
tcctggcacagaagaggagtca

SEQ ID NO: 6420849 - DNA, 16 bp, Homo sapiens
tcctggcactgcttcc

SEQ ID NO: 6420850 - DNA, 18 bp, Homo sapiens
tcctggcactgcttccag

SEQ ID NO: 6420851 - DNA, 22 bp, Homo sapiens
tcctggcactgcttccagtgag

SEQ ID NO: 6420852 - DNA, 13 bp, Homo sapiens
tcctggcactgga

SEQ ID NO: 6420853 - DNA, 18 bp, Homo sapiens
tcctggcactggacccca

SEQ ID NO: 6420854 - DNA, 19 bp, Homo sapiens
tcctggcactggaccccag

SEQ ID NO: 6420855 - DNA, 13 bp, Homo sapiens
tcctggcagccca

SEQ ID NO: 6420856 - DNA, 15 bp, Homo sapiens
tcctggcagctgctg

SEQ ID NO: 6420857 - DNA, 17 bp, Homo sapiens
tcctggcagctgctgtg

SEQ ID NO: 6420858 - DNA, 17 bp, Homo sapiens
tcctggcagctggacca

SEQ ID NO: 6420859 - DNA, 13 bp, Homo sapiens
tcctggcagggcg

SEQ ID NO: 6420860 - DNA, 19 bp, Homo sapiens
tcctggcatttgctgattt

SEQ ID NO: 6420861 - DNA, 20 bp, Homo sapiens
tcctggccagatggcccgga

SEQ ID NO: 6420862 - DNA, 11 bp, Homo sapiens
tcctggccatc

SEQ ID NO: 6420863 - DNA, 22 bp, Homo sapiens
tcctggccattttcttgcctga

SEQ ID NO: 6420864 - DNA, 21 bp, Homo sapiens
tcctggcccaagtctcttcct

SEQ ID NO: 6420865 - DNA, 20 bp, Homo sapiens
tcctggcccactctgtaata

SEQ ID NO: 6420866 - DNA, 13 bp, Homo sapiens
tcctggcccagcc

SEQ ID NO: 6420867 - DNA, 17 bp, Homo sapiens
tcctggcccagcctttg

SEQ ID NO: 6420868 - DNA, 19 bp, Homo sapiens
tcctggcccaggccttgct

SEQ ID NO: 6420869 - DNA, 20 bp, Homo sapiens
tcctggcccaggccttgctg

SEQ ID NO: 6420870 - DNA, 15 bp, Homo sapiens
tcctggcccagggca

SEQ ID NO: 6420871 - DNA, 19 bp, Homo sapiens
tcctggcccagggcatctg

SEQ ID NO: 6420872 - DNA, 13 bp, Homo sapiens
tcctggccccagc

SEQ ID NO: 6420873 - DNA, 18 bp, Homo sapiens
tcctggccccagccccca

SEQ ID NO: 6420874 - DNA, 17 bp, Homo sapiens
tcctggccccctcgtca

SEQ ID NO: 6420875 - DNA, 22 bp, Homo sapiens
tcctggccccgggctctggcca

SEQ ID NO: 6420876 - DNA, 12 bp, Homo sapiens
tcctggcccctc

SEQ ID NO: 6420877 - DNA, 18 bp, Homo sapiens
tcctggcccctcaacctc

SEQ ID NO: 6420878 - DNA, 16 bp, Homo sapiens
tcctggcccgccctca

SEQ ID NO: 6420879 - DNA, 17 bp, Homo sapiens
tcctggcccgccctcac

SEQ ID NO: 6420880 - DNA, 18 bp, Homo sapiens
tcctggcccgggagccgc

SEQ ID NO: 6420881 - DNA, 16 bp, Homo sapiens
tcctggccctccactc

SEQ ID NO: 6420882 - DNA, 19 bp, Homo sapiens
tcctggccctccactcctc

SEQ ID NO: 6420883 - DNA, 12 bp, Homo sapiens
tcctggccctct

SEQ ID NO: 6420884 - DNA, 20 bp, Homo sapiens
tcctggcccttgatgcccag

SEQ ID NO: 6420885 - DNA, 18 bp, Homo sapiens
tcctggcctatccgctgc

SEQ ID NO: 6420886 - DNA, 23 bp, Homo sapiens
tcctggcctatccgctgccagcc

SEQ ID NO: 6420887 - DNA, 21 bp, Homo sapiens
tcctggcctcaagccatcttc

SEQ ID NO: 6420888 - DNA, 22 bp, Homo sapiens
tcctggcctcaagccatcttcc

SEQ ID NO: 6420889 - DNA, 23 bp, Homo sapiens
tcctggcctcactggctggggca

SEQ ID NO: 6420890 - DNA, 16 bp, Homo sapiens
tcctggcctcagagct

SEQ ID NO: 6420891 - DNA, 17 bp, Homo sapiens
tcctggcctcagagctt

SEQ ID NO: 6420892 - DNA, 20 bp, Homo sapiens
tcctggcctcagccagctgc

SEQ ID NO: 6420893 - DNA, 18 bp, Homo sapiens
tcctggcctcccttctcc

SEQ ID NO: 6420894 - DNA, 13 bp, Homo sapiens
tcctggcctgaga

SEQ ID NO: 6420895 - DNA, 21 bp, Homo sapiens
tcctggcctgagcgcagcgcc

SEQ ID NO: 6420896 - DNA, 15 bp, Homo sapiens
tcctggccttcctcg

SEQ ID NO: 6420897 - DNA, 22 bp, Homo sapiens
tcctggccttctaggaatggag

SEQ ID NO: 6420898 - DNA, 16 bp, Homo sapiens
tcctggccttttgtgg

SEQ ID NO: 6420899 - DNA, 20 bp, Homo sapiens
tcctggcgcctggcagtccg

SEQ ID NO: 6420900 - DNA, 18 bp, Homo sapiens
tcctggctacatcccagc

SEQ ID NO: 6420901 - DNA, 17 bp, Homo sapiens
tcctggctaggactgtg

SEQ ID NO: 6420902 - DNA, 12 bp, Homo sapiens
tcctggctcaca

SEQ ID NO: 6420903 - DNA, 15 bp, Homo sapiens
tcctggctcacagcc

SEQ ID NO: 6420904 - DNA, 16 bp, Homo sapiens
tcctggctcacagcca

SEQ ID NO: 6420905 - DNA, 21 bp, Homo sapiens
tatgtgacaacctttgtgtaa

SEQ ID NO: 6420906 - DNA, 19 bp, Homo sapiens
tatgtgacaattttgtaca

SEQ ID NO: 6420907 - DNA, 20 bp, Homo sapiens
tatgtgacaccaaagccacc

SEQ ID NO: 6420908 - DNA, 16 bp, Homo sapiens
tatgtgacagacattt

SEQ ID NO: 6420909 - DNA, 15 bp, Homo sapiens
tatgtgacattcctg

SEQ ID NO: 6420910 - DNA, 17 bp, Homo sapiens
tatgtgacttgcaataa

SEQ ID NO: 6420911 - DNA, 18 bp, Homo sapiens
tatgtgacttgcaataaa

SEQ ID NO: 6420912 - DNA, 14 bp, Homo sapiens
tatgtgagatttcc

SEQ ID NO: 6420913 - DNA, 21 bp, Homo sapiens
tatgtgagattttttattgct

SEQ ID NO: 6420914 - DNA, 14 bp, Homo sapiens
tatgtgagcatgaa

SEQ ID NO: 6420915 - DNA, 17 bp, Homo sapiens
tatgtgagcatgaaact

SEQ ID NO: 6420916 - DNA, 19 bp, Homo sapiens
tatgtgagctgtaaaaatg

SEQ ID NO: 6420917 - DNA, 23 bp, Homo sapiens
tatgtgagggtatgaagagctgt

SEQ ID NO: 6420918 - DNA, 22 bp, Homo sapiens
tatgtgagtagtcttatgtaaa

SEQ ID NO: 6420919 - DNA, 18 bp, Homo sapiens
tatgtgagtattctcatt

SEQ ID NO: 6420920 - DNA, 20 bp, Homo sapiens
tatgtgagtgaaagtacttc

SEQ ID NO: 6420921 - DNA, 14 bp, Homo sapiens
tatgtgatctgtct

SEQ ID NO: 6420922 - DNA, 12 bp, Homo sapiens
tatgtgatgaaa

SEQ ID NO: 6420923 - DNA, 20 bp, Homo sapiens
tatgtgatgccaaagatgtt

SEQ ID NO: 6420924 - DNA, 15 bp, Homo sapiens
tatgtgatgcctcta

SEQ ID NO: 6420925 - DNA, 18 bp, Homo sapiens
tatgtgattatcatttat

SEQ ID NO: 6420926 - DNA, 22 bp, Homo sapiens
tatgtgattgttccataataaa

SEQ ID NO: 6420927 - DNA, 19 bp, Homo sapiens
tatgtgattttcaaatatg

SEQ ID NO: 6420928 - DNA, 22 bp, Homo sapiens
tatgtgattttcaaatatgtaa

SEQ ID NO: 6420929 - DNA, 21 bp, Homo sapiens
tatgtgattttttttcccatt

SEQ ID NO: 6420930 - DNA, 17 bp, Homo sapiens
tatgtgcactaccatag

SEQ ID NO: 6420931 - DNA, 21 bp, Homo sapiens
tatgtgcactgtcactttgct

SEQ ID NO: 6420932 - DNA, 19 bp, Homo sapiens
tatgtgcataatggaaagt

SEQ ID NO: 6420933 - DNA, 21 bp, Homo sapiens
tatgtgcattattcataaaaa

SEQ ID NO: 6420934 - DNA, 17 bp, Homo sapiens
tatgtgccaaaactagt

SEQ ID NO: 6420935 - DNA, 17 bp, Homo sapiens
tatgtgccaattttgtc

SEQ ID NO: 6420936 - DNA, 17 bp, Homo sapiens
tatgtgccataaacaga

SEQ ID NO: 6420937 - DNA, 16 bp, Homo sapiens
tatgtgcccctcctgg

SEQ ID NO: 6420938 - DNA, 16 bp, Homo sapiens
tatgtgcgtctctctt

SEQ ID NO: 6420939 - DNA, 16 bp, Homo sapiens
tatgtgcgtgtgcgtg

SEQ ID NO: 6420940 - DNA, 19 bp, Homo sapiens
tatgtgctatacacacaca

SEQ ID NO: 6420941 - DNA, 19 bp, Homo sapiens
tatgtgctatcacatgtga

SEQ ID NO: 6420942 - DNA, 23 bp, Homo sapiens
tatgtgctattaatatttgttta

SEQ ID NO: 6420943 - DNA, 16 bp, Homo sapiens
tatgtgcttgaagatt

SEQ ID NO: 6420944 - DNA, 14 bp, Homo sapiens
tatgtgcttgtgct

SEQ ID NO: 6420945 - DNA, 17 bp, Homo sapiens
tatgtgcttgtgtgtat

SEQ ID NO: 6420946 - DNA, 19 bp, Homo sapiens
tatgtgcttgtgtgtatgt

SEQ ID NO: 6420947 - DNA, 20 bp, Homo sapiens
tatgtgcttgtgtgtatgtc

SEQ ID NO: 6420948 - DNA, 21 bp, Homo sapiens
tatgtgcttgtgtgtatgtct

SEQ ID NO: 6420949 - DNA, 23 bp, Homo sapiens
tatgtgcttgtgtgtatgtctat

SEQ ID NO: 6420950 - DNA, 18 bp, Homo sapiens
tatgtgctttcatcacaa

SEQ ID NO: 6420951 - DNA, 13 bp, Homo sapiens
tatgtggaaatat

SEQ ID NO: 6420952 - DNA, 12 bp, Homo sapiens
tatgtggaagta

SEQ ID NO: 6420953 - DNA, 16 bp, Homo sapiens
tatgtggaagtatacc

SEQ ID NO: 6420954 - DNA, 15 bp, Homo sapiens
tatgtggatacagtc

SEQ ID NO: 6420955 - DNA, 19 bp, Homo sapiens
tatgtggattttgcatgta

SEQ ID NO: 6420956 - DNA, 21 bp, Homo sapiens
tatgtggcaaaacatatacca

SEQ ID NO: 6420957 - DNA, 14 bp, Homo sapiens
tatgtggcagctgg

SEQ ID NO: 6420958 - DNA, 17 bp, Homo sapiens
tatgtggcagctgggga

SEQ ID NO: 6420959 - DNA, 22 bp, Homo sapiens
tatgtggcccaagtcattccta

SEQ ID NO: 6420960 - DNA, 20 bp, Homo sapiens
tatgtggctgaaaatgcaaa

SEQ ID NO: 6420961 - DNA, 18 bp, Homo sapiens
tatgtgggaaaaaagaaa

SEQ ID NO: 6420962 - DNA, 19 bp, Homo sapiens
tatgtgggatattgaatgt

SEQ ID NO: 6420963 - DNA, 23 bp, Homo sapiens
tatgtgggcagattttcagcaaa

SEQ ID NO: 6420964 - DNA, 19 bp, Homo sapiens
tatgtgggggcttcatctc

SEQ ID NO: 6420965 - DNA, 18 bp, Homo sapiens
tatgtgggggtctgtgtg

SEQ ID NO: 6420966 - DNA, 20 bp, Homo sapiens
tatgtggtccatctctgaaa

SEQ ID NO: 6420967 - DNA, 21 bp, Homo sapiens
tatgtggtccatctctgaaaa

SEQ ID NO: 6420968 - DNA, 14 bp, Homo sapiens
tatgtggtcttatg

SEQ ID NO: 6420969 - DNA, 14 bp, Homo sapiens
tatgtgtaaataca

SEQ ID NO: 6420970 - DNA, 16 bp, Homo sapiens
tatgtgtaataaatat

SEQ ID NO: 6420971 - DNA, 18 bp, Homo sapiens
tatgtgtacacatatgaa

SEQ ID NO: 6420972 - DNA, 10 bp, Homo sapiens
tatgtgtata

SEQ ID NO: 6420973 - DNA, 17 bp, Homo sapiens
tatgtgtatatatacat

SEQ ID NO: 6420974 - DNA, 12 bp, Homo sapiens
tatgtgtatatg

SEQ ID NO: 6420975 - DNA, 18 bp, Homo sapiens
tatgtgtatatgtttata

SEQ ID NO: 6420976 - DNA, 20 bp, Homo sapiens
tatgtgtatgcacagtaaaa

SEQ ID NO: 6420977 - DNA, 22 bp, Homo sapiens
tatgtgtatttgtatgtactgt

SEQ ID NO: 6420978 - DNA, 15 bp, Homo sapiens
tatgtgtctggaaga

SEQ ID NO: 6420979 - DNA, 12 bp, Homo sapiens
tatgtgtgaagt

SEQ ID NO: 6420980 - DNA, 17 bp, Homo sapiens
tatgtgtgacaagtgtg

SEQ ID NO: 6420981 - DNA, 17 bp, Homo sapiens
tatgtgtgagtgtatgt

SEQ ID NO: 6420982 - DNA, 20 bp, Homo sapiens
tatgtgtgcatgtgtgtata

SEQ ID NO: 6420983 - DNA, 14 bp, Homo sapiens
tatgtgtgccctgg

SEQ ID NO: 6420984 - DNA, 13 bp, Homo sapiens
tatgtgtggctgt

SEQ ID NO: 6420985 - DNA, 14 bp, Homo sapiens
tatgtgtgggtaca

SEQ ID NO: 6420986 - DNA, 16 bp, Homo sapiens
tatgtgtggtttcagt

SEQ ID NO: 6420987 - DNA, 14 bp, Homo sapiens
tatgtgtgtagaca

SEQ ID NO: 6420988 - DNA, 12 bp, Homo sapiens
tatgtgtgtatg

SEQ ID NO: 6420989 - DNA, 21 bp, Homo sapiens
tatgtgtgtatgggtgtgtgt

SEQ ID NO: 6420990 - DNA, 13 bp, Homo sapiens
tatgtgtgtgtat

SEQ ID NO: 6420991 - DNA, 13 bp, Homo sapiens
tatgtgtgtgtgt

SEQ ID NO: 6420992 - DNA, 22 bp, Homo sapiens
tatgtgtgttgtttccatagct

SEQ ID NO: 6420993 - DNA, 20 bp, Homo sapiens
tatgtgtgtttaaataaagt

SEQ ID NO: 6420994 - DNA, 16 bp, Homo sapiens
tatgtgtgtttctgtc

SEQ ID NO: 6420995 - DNA, 18 bp, Homo sapiens
tatgtgtgtttctgtcct

SEQ ID NO: 6420996 - DNA, 16 bp, Homo sapiens
tatgtgttacattatt

SEQ ID NO: 6420997 - DNA, 16 bp, Homo sapiens
tatgtgttgaaaacca

SEQ ID NO: 6420998 - DNA, 22 bp, Homo sapiens
tatgtgttgataattttttaat

SEQ ID NO: 6420999 - DNA, 18 bp, Homo sapiens
tatgtgttgcataaacaa

SEQ ID NO: 6421000 - DNA, 14 bp, Homo sapiens
tatgtgttggcttg

SEQ ID NO: 6421001 - DNA, 21 bp, Homo sapiens
tatgtgttgtgtttgtagtct

SEQ ID NO: 6421002 - DNA, 13 bp, Homo sapiens
tatgtgtttactt

SEQ ID NO: 6421003 - DNA, 16 bp, Homo sapiens
tatgtgtttactttaa

SEQ ID NO: 6421004 - DNA, 15 bp, Homo sapiens
tatgtgtttttcaca

SEQ ID NO: 6421005 - DNA, 16 bp, Homo sapiens
tatgtgtttttcacat

SEQ ID NO: 6421006 - DNA, 12 bp, Homo sapiens
tatgttaaaact

SEQ ID NO: 6421007 - DNA, 18 bp, Homo sapiens
tatgttaaatactgtgca

SEQ ID NO: 6421008 - DNA, 22 bp, Homo sapiens
tatgttaaatactgtgcagaat

SEQ ID NO: 6421009 - DNA, 14 bp, Homo sapiens
tatgttaagggctt

SEQ ID NO: 6421010 - DNA, 20 bp, Homo sapiens
tatgttaataaactgcaaat

SEQ ID NO: 6421011 - DNA, 14 bp, Homo sapiens
tatgttaatatctg

SEQ ID NO: 6421012 - DNA, 22 bp, Homo sapiens
tatgttaatattttatgtgtaa

SEQ ID NO: 6421013 - DNA, 19 bp, Homo sapiens
tatgttaattttaatttct

SEQ ID NO: 6421014 - DNA, 15 bp, Homo sapiens
tatgttactattttc

SEQ ID NO: 6421015 - DNA, 21 bp, Homo sapiens
tatgttactgtatttttcaga

SEQ ID NO: 6421016 - DNA, 15 bp, Homo sapiens
tatgttacttaaaca

SEQ ID NO: 6421017 - DNA, 16 bp, Homo sapiens
tatgttacttaaacat

SEQ ID NO: 6421018 - DNA, 13 bp, Homo sapiens
tatgttagaatca

SEQ ID NO: 6421019 - DNA, 19 bp, Homo sapiens
tatgttagagtcatttctg

SEQ ID NO: 6421020 - DNA, 19 bp, Homo sapiens
tatgttagatacacaaaat

SEQ ID NO: 6421021 - DNA, 22 bp, Homo sapiens
tatgttagattaggtgtaagac

SEQ ID NO: 6421022 - DNA, 20 bp, Homo sapiens
tatgttatatataaatatat

SEQ ID NO: 6421023 - DNA, 21 bp, Homo sapiens
tatgttatatataaatatatt

SEQ ID NO: 6421024 - DNA, 18 bp, Homo sapiens
tatgttatcatcctccct

SEQ ID NO: 6421025 - DNA, 23 bp, Homo sapiens
tatgttattggaattttctttca

SEQ ID NO: 6421026 - DNA, 13 bp, Homo sapiens
tatgttatttgat

SEQ ID NO: 6421027 - DNA, 16 bp, Homo sapiens
tatgttattttgtgta

SEQ ID NO: 6421028 - DNA, 23 bp, Homo sapiens
tatgttcaatgaatattgtaaat

SEQ ID NO: 6421029 - DNA, 21 bp, Homo sapiens
tatgttcagaacttcatctgc

SEQ ID NO: 6421030 - DNA, 16 bp, Homo sapiens
tatgttcagattattg

SEQ ID NO: 6421031 - DNA, 16 bp, Homo sapiens
tatgttcatattggat

SEQ ID NO: 6421032 - DNA, 20 bp, Homo sapiens
tatgttcatgagtcttgtaa

SEQ ID NO: 6421033 - DNA, 12 bp, Homo sapiens
tatgttcatgta

SEQ ID NO: 6421034 - DNA, 15 bp, Homo sapiens
tatgttcattaaatt

SEQ ID NO: 6421035 - DNA, 21 bp, Homo sapiens
tatgttccaaaccctcctggg

SEQ ID NO: 6421036 - DNA, 14 bp, Homo sapiens
tatgttccaaggct

SEQ ID NO: 6421037 - DNA, 17 bp, Homo sapiens
tatgttccatgcctggc

SEQ ID NO: 6421038 - DNA, 20 bp, Homo sapiens
tatgttccatgcctggccct

SEQ ID NO: 6421039 - DNA, 14 bp, Homo sapiens
tatgttccattaaa

SEQ ID NO: 6421040 - DNA, 15 bp, Homo sapiens
tatgttccattaaac

SEQ ID NO: 6421041 - DNA, 19 bp, Homo sapiens
tatgttcctaacaaaatga

SEQ ID NO: 6421042 - DNA, 21 bp, Homo sapiens
tatgttcctaacaaaatgaga

SEQ ID NO: 6421043 - DNA, 15 bp, Homo sapiens
tatgttcctgctgta

SEQ ID NO: 6421044 - DNA, 17 bp, Homo sapiens
tatgttctaagaagtga

SEQ ID NO: 6421045 - DNA, 22 bp, Homo sapiens
tatgttctaggtcagtctaaca

SEQ ID NO: 6421046 - DNA, 15 bp, Homo sapiens
tatgttctcagaatc

SEQ ID NO: 6421047 - DNA, 10 bp, Homo sapiens
tatgttctct

SEQ ID NO: 6421048 - DNA, 17 bp, Homo sapiens
tatgttctctgaatgag

SEQ ID NO: 6421049 - DNA, 22 bp, Homo sapiens
tatgttctgcaagaattaaaac

SEQ ID NO: 6421050 - DNA, 16 bp, Homo sapiens
tatgttctgtcttccc

SEQ ID NO: 6421051 - DNA, 15 bp, Homo sapiens
tatgttcttagcaat

SEQ ID NO: 6421052 - DNA, 19 bp, Homo sapiens
tatgttcttatagaataaa

SEQ ID NO: 6421053 - DNA, 12 bp, Homo sapiens
tatgttctttca

SEQ ID NO: 6421054 - DNA, 12 bp, Homo sapiens
tatgttgaatac

SEQ ID NO: 6421055 - DNA, 14 bp, Homo sapiens
tatgttgacatttt

SEQ ID NO: 6421056 - DNA, 18 bp, Homo sapiens
tatgttgacctttgcaaa

SEQ ID NO: 6421057 - DNA, 17 bp, Homo sapiens
tatgttgagtgttcatt

SEQ ID NO: 6421058 - DNA, 13 bp, Homo sapiens
tatgttgataaac

SEQ ID NO: 6421059 - DNA, 20 bp, Homo sapiens
tatgttgcccaggcaggtct

SEQ ID NO: 6421060 - DNA, 14 bp, Homo sapiens
tatgttgcctttat

SEQ ID NO: 6421061 - DNA, 20 bp, Homo sapiens
tatgttgcctttatggtttc

SEQ ID NO: 6421062 - DNA, 16 bp, Homo sapiens
tatgttgctataagaa

SEQ ID NO: 6421063 - DNA, 21 bp, Homo sapiens
tatgttgctataataaagaag

SEQ ID NO: 6421064 - DNA, 12 bp, Homo sapiens
tatgttgctatt

SEQ ID NO: 6421065 - DNA, 14 bp, Homo sapiens
tatgttgctcagtc

SEQ ID NO: 6421066 - DNA, 13 bp, Homo sapiens
tatgttgctgaaa

SEQ ID NO: 6421067 - DNA, 16 bp, Homo sapiens
tatgttgctgaaacac

SEQ ID NO: 6421068 - DNA, 15 bp, Homo sapiens
tatgttggcattaac

SEQ ID NO: 6421069 - DNA, 20 bp, Homo sapiens
tatgttggtactttccacaa

SEQ ID NO: 6421070 - DNA, 20 bp, Homo sapiens
tatgttgtaataaaacttat

SEQ ID NO: 6421071 - DNA, 16 bp, Homo sapiens
tatgttgtcaaagaga

SEQ ID NO: 6421072 - DNA, 12 bp, Homo sapiens
tatgttgtcata

SEQ ID NO: 6421073 - DNA, 15 bp, Homo sapiens
tatgttgtcataaca

SEQ ID NO: 6421074 - DNA, 16 bp, Homo sapiens
tatgttgtcataacat

SEQ ID NO: 6421075 - DNA, 17 bp, Homo sapiens
tatgttgtcataacatt

SEQ ID NO: 6421076 - DNA, 21 bp, Homo sapiens
tatgttgtccaattgttgaca

SEQ ID NO: 6421077 - DNA, 16 bp, Homo sapiens
tatgttgtgaagatgt

SEQ ID NO: 6421078 - DNA, 20 bp, Homo sapiens
tatgttgtgaagatgtttgc

SEQ ID NO: 6421079 - DNA, 16 bp, Homo sapiens
tatgttgtgttctaat

SEQ ID NO: 6421080 - DNA, 17 bp, Homo sapiens
tatgttgttagagaaaa

SEQ ID NO: 6421081 - DNA, 19 bp, Homo sapiens
tatgttgttagagaaaaat

SEQ ID NO: 6421082 - DNA, 20 bp, Homo sapiens
tatgttgttgaactaatata

SEQ ID NO: 6421083 - DNA, 18 bp, Homo sapiens
tatgttgtttataataaa

SEQ ID NO: 6421084 - DNA, 19 bp, Homo sapiens
tcctggctcacagccacca

SEQ ID NO: 6421085 - DNA, 18 bp, Homo sapiens
tcctggctcaggcccagc

SEQ ID NO: 6421086 - DNA, 14 bp, Homo sapiens
tcctggctcgcagg

SEQ ID NO: 6421087 - DNA, 23 bp, Homo sapiens
tcctggctcggggtaaaaagtgg

SEQ ID NO: 6421088 - DNA, 22 bp, Homo sapiens
tcctggctctaccctgtctgtc

SEQ ID NO: 6421089 - DNA, 14 bp, Homo sapiens
tcctggctctgatt

SEQ ID NO: 6421090 - DNA, 16 bp, Homo sapiens
tcctggctgcactctt

SEQ ID NO: 6421091 - DNA, 24 bp, Homo sapiens
tcctggctgctgccatgtctcaga

SEQ ID NO: 6421092 - DNA, 14 bp, Homo sapiens
tcctggctggaagg

SEQ ID NO: 6421093 - DNA, 11 bp, Homo sapiens
tcctggctggc

SEQ ID NO: 6421094 - DNA, 14 bp, Homo sapiens
tcctggctgggcca

SEQ ID NO: 6421095 - DNA, 14 bp, Homo sapiens
tcctggctgtccta

SEQ ID NO: 6421096 - DNA, 18 bp, Homo sapiens
tcctggctgtgcccagca

SEQ ID NO: 6421097 - DNA, 22 bp, Homo sapiens
tcctggctgtgcccagcaggcc

SEQ ID NO: 6421098 - DNA, 22 bp, Homo sapiens
tcctggcttcccatccccagcg

SEQ ID NO: 6421099 - DNA, 11 bp, Homo sapiens
tcctggcttct

SEQ ID NO: 6421100 - DNA, 14 bp, Homo sapiens
tcctggcttctaga

SEQ ID NO: 6421101 - DNA, 19 bp, Homo sapiens
tcctggcttctagatctgg

SEQ ID NO: 6421102 - DNA, 20 bp, Homo sapiens
tcctggcttctagatctgga

SEQ ID NO: 6421103 - DNA, 17 bp, Homo sapiens
tcctggctttccaggag

SEQ ID NO: 6421104 - DNA, 18 bp, Homo sapiens
tcctggctttccaggaga

SEQ ID NO: 6421105 - DNA, 17 bp, Homo sapiens
tcctggctttgcccaac

SEQ ID NO: 6421106 - DNA, 23 bp, Homo sapiens
tcctggctttgcccaacctcagc

SEQ ID NO: 6421107 - DNA, 20 bp, Homo sapiens
tcctggcttttaaacctgtt

SEQ ID NO: 6421108 - DNA, 23 bp, Homo sapiens
tcctggcttttaaacctgttcct

SEQ ID NO: 6421109 - DNA, 23 bp, Homo sapiens
tcctggctttttaactcccctgt

SEQ ID NO: 6421110 - DNA, 18 bp, Homo sapiens
tcctgggaaacctgcctt

SEQ ID NO: 6421111 - DNA, 21 bp, Homo sapiens
tcctgggaaagggagatgtca

SEQ ID NO: 6421112 - DNA, 21 bp, Homo sapiens
tcctgggaacctccttacctg

SEQ ID NO: 6421113 - DNA, 21 bp, Homo sapiens
tcctgggaccatggacacatt

SEQ ID NO: 6421114 - DNA, 19 bp, Homo sapiens
tcctgggaccccctcgcca

SEQ ID NO: 6421115 - DNA, 21 bp, Homo sapiens
tcctgggacctccccagccca

SEQ ID NO: 6421116 - DNA, 19 bp, Homo sapiens
tcctgggagaacctcaggc

SEQ ID NO: 6421117 - DNA, 23 bp, Homo sapiens
tcctgggagaacctcaggcttcc

SEQ ID NO: 6421118 - DNA, 23 bp, Homo sapiens
tcctgggagaggacagggacttc

SEQ ID NO: 6421119 - DNA, 15 bp, Homo sapiens
tcctgggagcttttg

SEQ ID NO: 6421120 - DNA, 19 bp, Homo sapiens
tcctgggaggacaggcagg

SEQ ID NO: 6421121 - DNA, 20 bp, Homo sapiens
tcctgggaggccctggcaga

SEQ ID NO: 6421122 - DNA, 19 bp, Homo sapiens
tcctgggaggctgcagcca

SEQ ID NO: 6421123 - DNA, 22 bp, Homo sapiens
tcctgggaggctgcagccaggc

SEQ ID NO: 6421124 - DNA, 18 bp, Homo sapiens
tcctgggatgatgtgtga

SEQ ID NO: 6421125 - DNA, 20 bp, Homo sapiens
tcctgggatggcgatgggga

SEQ ID NO: 6421126 - DNA, 13 bp, Homo sapiens
tcctgggatgtgg

SEQ ID NO: 6421127 - DNA, 22 bp, Homo sapiens
tcctgggatgtggctgcagcag

SEQ ID NO: 6421128 - DNA, 21 bp, Homo sapiens
tcctgggcacacgctgctctg

SEQ ID NO: 6421129 - DNA, 15 bp, Homo sapiens
tcctgggcagcccag

SEQ ID NO: 6421130 - DNA, 22 bp, Homo sapiens
tcctgggcagccgttttcctca

SEQ ID NO: 6421131 - DNA, 15 bp, Homo sapiens
tcctgggcagcttga

SEQ ID NO: 6421132 - DNA, 22 bp, Homo sapiens
tcctgggcagcttgggctggcg

SEQ ID NO: 6421133 - DNA, 14 bp, Homo sapiens
tcctgggcaggtgg

SEQ ID NO: 6421134 - DNA, 15 bp, Homo sapiens
tcctgggcaggtggg

SEQ ID NO: 6421135 - DNA, 21 bp, Homo sapiens
tcctgggcaggtgggagctga

SEQ ID NO: 6421136 - DNA, 17 bp, Homo sapiens
tcctgggcatccccagc

SEQ ID NO: 6421137 - DNA, 14 bp, Homo sapiens
tcctgggcatctgg

SEQ ID NO: 6421138 - DNA, 21 bp, Homo sapiens
tcctgggcatctggccctgct

SEQ ID NO: 6421139 - DNA, 22 bp, Homo sapiens
tcctgggcatctggccctgctg

SEQ ID NO: 6421140 - DNA, 20 bp, Homo sapiens
tcctgggcatgggtccaggg

SEQ ID NO: 6421141 - DNA, 22 bp, Homo sapiens
tcctgggcatgggtccagggcc

SEQ ID NO: 6421142 - DNA, 20 bp, Homo sapiens
tcctgggcatgtccccagtg

SEQ ID NO: 6421143 - DNA, 12 bp, Homo sapiens
tcctgggccagg

SEQ ID NO: 6421144 - DNA, 13 bp, Homo sapiens
tcctgggcccagg

SEQ ID NO: 6421145 - DNA, 15 bp, Homo sapiens
tcctgggcccctccc

SEQ ID NO: 6421146 - DNA, 16 bp, Homo sapiens
tcctgggcccctccct

SEQ ID NO: 6421147 - DNA, 17 bp, Homo sapiens
tcctgggcccctcccta

SEQ ID NO: 6421148 - DNA, 16 bp, Homo sapiens
tcctgggccctctctg

SEQ ID NO: 6421149 - DNA, 16 bp, Homo sapiens
tcctgggccggctgag

SEQ ID NO: 6421150 - DNA, 13 bp, Homo sapiens
tcctgggcctgcc

SEQ ID NO: 6421151 - DNA, 15 bp, Homo sapiens
tcctgggcctgtccc

SEQ ID NO: 6421152 - DNA, 19 bp, Homo sapiens
tcctgggccttctcagctc

SEQ ID NO: 6421153 - DNA, 18 bp, Homo sapiens
tcctgggcctttgcaaga

SEQ ID NO: 6421154 - DNA, 13 bp, Homo sapiens
tcctgggcgccct

SEQ ID NO: 6421155 - DNA, 20 bp, Homo sapiens
tcctgggcgccctggaagcc

SEQ ID NO: 6421156 - DNA, 22 bp, Homo sapiens
tcctgggcgtgacccgtccatt

SEQ ID NO: 6421157 - DNA, 22 bp, Homo sapiens
tcctgggctggggccaccatcc

SEQ ID NO: 6421158 - DNA, 20 bp, Homo sapiens
tcctgggcttttgttttgct

SEQ ID NO: 6421159 - DNA, 22 bp, Homo sapiens
tcctggggaaggtggagcagct

SEQ ID NO: 6421160 - DNA, 23 bp, Homo sapiens
tcctggggacgaattccactcgt

SEQ ID NO: 6421161 - DNA, 19 bp, Homo sapiens
tcctggggagctcctggga

SEQ ID NO: 6421162 - DNA, 19 bp, Homo sapiens
tcctggggaggctgagact

SEQ ID NO: 6421163 - DNA, 19 bp, Homo sapiens
tcctggggccccgctggga

SEQ ID NO: 6421164 - DNA, 20 bp, Homo sapiens
tcctggggccccgctgggat

SEQ ID NO: 6421165 - DNA, 13 bp, Homo sapiens
tcctggggccgcc

SEQ ID NO: 6421166 - DNA, 21 bp, Homo sapiens
tcctggggccgcctgccctgc

SEQ ID NO: 6421167 - DNA, 23 bp, Homo sapiens
tcctggggccgcctgccctgcct

SEQ ID NO: 6421168 - DNA, 22 bp, Homo sapiens
tcctggggcctcggagcctcat

SEQ ID NO: 6421169 - DNA, 14 bp, Homo sapiens
tcctggggctccct

SEQ ID NO: 6421170 - DNA, 15 bp, Homo sapiens
tcctggggctccctt

SEQ ID NO: 6421171 - DNA, 15 bp, Homo sapiens
tcctggggctctgtg

SEQ ID NO: 6421172 - DNA, 19 bp, Homo sapiens
tcctggggctctgtgcagg

SEQ ID NO: 6421173 - DNA, 23 bp, Homo sapiens
tcctggggctgggtgtgtttcag

SEQ ID NO: 6421174 - DNA, 18 bp, Homo sapiens
tcctgggggatgcaaata

SEQ ID NO: 6421175 - DNA, 18 bp, Homo sapiens
tcctgggggatgtgcacg

SEQ ID NO: 6421176 - DNA, 22 bp, Homo sapiens
tcctgggggcccattctgcatg

SEQ ID NO: 6421177 - DNA, 13 bp, Homo sapiens
tcctgggggcctg

SEQ ID NO: 6421178 - DNA, 17 bp, Homo sapiens
tcctgggggcctgacct

SEQ ID NO: 6421179 - DNA, 19 bp, Homo sapiens
tcctgggggcctgacctcc

SEQ ID NO: 6421180 - DNA, 19 bp, Homo sapiens
tcctgggggctgctgcact

SEQ ID NO: 6421181 - DNA, 20 bp, Homo sapiens
tcctgggggctgctgcactg

SEQ ID NO: 6421182 - DNA, 15 bp, Homo sapiens
tcctgggggctggct

SEQ ID NO: 6421183 - DNA, 16 bp, Homo sapiens
tcctgggggctggctc

SEQ ID NO: 6421184 - DNA, 17 bp, Homo sapiens
tcctgggggctggctcc

SEQ ID NO: 6421185 - DNA, 21 bp, Homo sapiens
tcctgggggctggctcccagg

SEQ ID NO: 6421186 - DNA, 22 bp, Homo sapiens
tcctgggggctggctcccaggg

SEQ ID NO: 6421187 - DNA, 21 bp, Homo sapiens
tcctgggggttctttcttcct

SEQ ID NO: 6421188 - DNA, 22 bp, Homo sapiens
tcctggggtgccctccactgcc

SEQ ID NO: 6421189 - DNA, 14 bp, Homo sapiens
tcctgggtaatgag

SEQ ID NO: 6421190 - DNA, 13 bp, Homo sapiens
tcctgggtcctgc

SEQ ID NO: 6421191 - DNA, 21 bp, Homo sapiens
tcctgggtctgtgtcagcggg

SEQ ID NO: 6421192 - DNA, 15 bp, Homo sapiens
tcctgggtgctcacc

SEQ ID NO: 6421193 - DNA, 22 bp, Homo sapiens
tcctgggtgctcaccgcctgct

SEQ ID NO: 6421194 - DNA, 15 bp, Homo sapiens
tcctgggtgctcagg

SEQ ID NO: 6421195 - DNA, 15 bp, Homo sapiens
tcctgggtggctact

SEQ ID NO: 6421196 - DNA, 22 bp, Homo sapiens
tcctgggtggctactctgtgcc

SEQ ID NO: 6421197 - DNA, 19 bp, Homo sapiens
tcctgggtggtctgcaggc

SEQ ID NO: 6421198 - DNA, 19 bp, Homo sapiens
tcctgggttcaagcgattt

SEQ ID NO: 6421199 - DNA, 17 bp, Homo sapiens
tcctgggttctggggca

SEQ ID NO: 6421200 - DNA, 18 bp, Homo sapiens
tcctgggttctggggcat

SEQ ID NO: 6421201 - DNA, 16 bp, Homo sapiens
tcctgggttggaggga

SEQ ID NO: 6421202 - DNA, 21 bp, Homo sapiens
tcctgggttttgtattctctg

SEQ ID NO: 6421203 - DNA, 23 bp, Homo sapiens
tcctgggttttgtattctctgag

SEQ ID NO: 6421204 - DNA, 19 bp, Homo sapiens
tcctggtaattcctctcca

SEQ ID NO: 6421205 - DNA, 17 bp, Homo sapiens
tcctggtacagcagggt

SEQ ID NO: 6421206 - DNA, 17 bp, Homo sapiens
tcctggtcaaagctcct

SEQ ID NO: 6421207 - DNA, 16 bp, Homo sapiens
tcctggtccctctgag

SEQ ID NO: 6421208 - DNA, 14 bp, Homo sapiens
tcctggtcctggac

SEQ ID NO: 6421209 - DNA, 16 bp, Homo sapiens
tcctggtcctggacac

SEQ ID NO: 6421210 - DNA, 14 bp, Homo sapiens
tcctggtctgtgaa

SEQ ID NO: 6421211 - DNA, 14 bp, Homo sapiens
tcctggtgactcct

SEQ ID NO: 6421212 - DNA, 23 bp, Homo sapiens
tcctggtgactcgggggctgtct

SEQ ID NO: 6421213 - DNA, 13 bp, Homo sapiens
tcctggtgagaac

SEQ ID NO: 6421214 - DNA, 21 bp, Homo sapiens
tcctggtgagaactgaggagc

SEQ ID NO: 6421215 - DNA, 17 bp, Homo sapiens
tcctggtgaggcccagc

SEQ ID NO: 6421216 - DNA, 19 bp, Homo sapiens
tcctggtgaggcccagcct

SEQ ID NO: 6421217 - DNA, 24 bp, Homo sapiens
tcctggtgaggcccagcctgtcct

SEQ ID NO: 6421218 - DNA, 14 bp, Homo sapiens
tcctggtgcccctc

SEQ ID NO: 6421219 - DNA, 14 bp, Homo sapiens
tcctggtgctctct

SEQ ID NO: 6421220 - DNA, 15 bp, Homo sapiens
tcctggtgctctctg

SEQ ID NO: 6421221 - DNA, 16 bp, Homo sapiens
tcctggtgctctctgc

SEQ ID NO: 6421222 - DNA, 18 bp, Homo sapiens
tcctggtgctctctgcca

SEQ ID NO: 6421223 - DNA, 19 bp, Homo sapiens
tcctggtgctctctgccac

SEQ ID NO: 6421224 - DNA, 12 bp, Homo sapiens
tcctggtgctgc

SEQ ID NO: 6421225 - DNA, 19 bp, Homo sapiens
tcctggtgctgccgagggc

SEQ ID NO: 6421226 - DNA, 14 bp, Homo sapiens
tcctggtgctggag

SEQ ID NO: 6421227 - DNA, 17 bp, Homo sapiens
tcctggtggccttctgc

SEQ ID NO: 6421228 - DNA, 13 bp, Homo sapiens
tcctggtggctgg

SEQ ID NO: 6421229 - DNA, 15 bp, Homo sapiens
tcctggtggctgggc

SEQ ID NO: 6421230 - DNA, 16 bp, Homo sapiens
tcctggtggggcagaa

SEQ ID NO: 6421231 - DNA, 17 bp, Homo sapiens
tcctggtggggcagctc

SEQ ID NO: 6421232 - DNA, 19 bp, Homo sapiens
tcctggtggggcagctcct

SEQ ID NO: 6421233 - DNA, 16 bp, Homo sapiens
tcctggtggggctgag

SEQ ID NO: 6421234 - DNA, 22 bp, Homo sapiens
tcctggtggggctgagcctgag

SEQ ID NO: 6421235 - DNA, 16 bp, Homo sapiens
tcctggtgggtcagcc

SEQ ID NO: 6421236 - DNA, 18 bp, Homo sapiens
tcctggtgggtcagccca

SEQ ID NO: 6421237 - DNA, 17 bp, Homo sapiens
tcctggtgtcaccccag

SEQ ID NO: 6421238 - DNA, 13 bp, Homo sapiens
tcctggtgtgggt

SEQ ID NO: 6421239 - DNA, 20 bp, Homo sapiens
tcctggtgtgggtccctctg

SEQ ID NO: 6421240 - DNA, 23 bp, Homo sapiens
tcctggtgtgggtccctctgccc

SEQ ID NO: 6421241 - DNA, 23 bp, Homo sapiens
tcctggtgtttttctctctggac

SEQ ID NO: 6421242 - DNA, 21 bp, Homo sapiens
tcctggttcccgtttctccac

SEQ ID NO: 6421243 - DNA, 11 bp, Homo sapiens
tcctggttcct

SEQ ID NO: 6421244 - DNA, 22 bp, Homo sapiens
tcctggttgtctgaacccaggc

SEQ ID NO: 6421245 - DNA, 17 bp, Homo sapiens
tcctggtttcctggcag

SEQ ID NO: 6421246 - DNA, 14 bp, Homo sapiens
tcctggtttccttt

SEQ ID NO: 6421247 - DNA, 17 bp, Homo sapiens
tcctggtttcctttctc

SEQ ID NO: 6421248 - DNA, 19 bp, Homo sapiens
tcctggtttcctttctcat

SEQ ID NO: 6421249 - DNA, 21 bp, Homo sapiens
tcctggttttgtacactgctg

SEQ ID NO: 6421250 - DNA, 16 bp, Homo sapiens
tcctggtttttgccta

SEQ ID NO: 6421251 - DNA, 16 bp, Homo sapiens
tcctgtaaaatccatt

SEQ ID NO: 6421252 - DNA, 19 bp, Homo sapiens
tcctgtaaaggttacaagc

SEQ ID NO: 6421253 - DNA, 15 bp, Homo sapiens
tcctgtaaataagag

SEQ ID NO: 6421254 - DNA, 15 bp, Homo sapiens
tcctgtaaatatatc

SEQ ID NO: 6421255 - DNA, 20 bp, Homo sapiens
tcctgtaaatggtgtacata

SEQ ID NO: 6421256 - DNA, 21 bp, Homo sapiens
tcctgtaacacaagccacaga

SEQ ID NO: 6421257 - DNA, 15 bp, Homo sapiens
tcctgtaacaggtgt

SEQ ID NO: 6421258 - DNA, 13 bp, Homo sapiens
tcctgtaactgtt

SEQ ID NO: 6421259 - DNA, 16 bp, Homo sapiens
tcctgtaagaagcggc

SEQ ID NO: 6421260 - DNA, 18 bp, Homo sapiens
aactagcttggaaactgg

SEQ ID NO: 6421261 - DNA, 18 bp, Homo sapiens
aactaggaaggcacttct

SEQ ID NO: 6421262 - DNA, 14 bp, Homo sapiens
aactaggacctcat

SEQ ID NO: 6421263 - DNA, 21 bp, Homo sapiens
aactaggatatgtatatttta

SEQ ID NO: 6421264 - DNA, 18 bp, Homo sapiens
aactaggcatttgtaaat

SEQ ID NO: 6421265 - DNA, 23 bp, Homo sapiens
aactaggcatttgtaaatattaa

SEQ ID NO: 6421266 - DNA, 17 bp, Homo sapiens
aactagggctagtcttc

SEQ ID NO: 6421267 - DNA, 16 bp, Homo sapiens
aactagggctcatttt

SEQ ID NO: 6421268 - DNA, 17 bp, Homo sapiens
aactagggttttggcct

SEQ ID NO: 6421269 - DNA, 16 bp, Homo sapiens
aactaggtatgaagta

SEQ ID NO: 6421270 - DNA, 22 bp, Homo sapiens
aactaggtgtgcaagaaccaaa

SEQ ID NO: 6421271 - DNA, 13 bp, Homo sapiens
aactagtaaaact

SEQ ID NO: 6421272 - DNA, 22 bp, Homo sapiens
aactagtaatgggccaattaaa

SEQ ID NO: 6421273 - DNA, 18 bp, Homo sapiens
aactagtatctctggcct

SEQ ID NO: 6421274 - DNA, 19 bp, Homo sapiens
aactagtatctctggcctc

SEQ ID NO: 6421275 - DNA, 15 bp, Homo sapiens
aactagtatgaaata

SEQ ID NO: 6421276 - DNA, 20 bp, Homo sapiens
aactagtggtggctctgaga

SEQ ID NO: 6421277 - DNA, 16 bp, Homo sapiens
aactagttaaaagcct

SEQ ID NO: 6421278 - DNA, 13 bp, Homo sapiens
aactagtttaatt

SEQ ID NO: 6421279 - DNA, 15 bp, Homo sapiens
aactagtttttatag

SEQ ID NO: 6421280 - DNA, 20 bp, Homo sapiens
aactagtttttatagctatc

SEQ ID NO: 6421281 - DNA, 13 bp, Homo sapiens
aactataaactta

SEQ ID NO: 6421282 - DNA, 14 bp, Homo sapiens
aactataaatacaa

SEQ ID NO: 6421283 - DNA, 15 bp, Homo sapiens
aactataaatacaaa

SEQ ID NO: 6421284 - DNA, 18 bp, Homo sapiens
aactataaatacaaatct

SEQ ID NO: 6421285 - DNA, 15 bp, Homo sapiens
aactataacattata

SEQ ID NO: 6421286 - DNA, 18 bp, Homo sapiens
aactataacattatataa

SEQ ID NO: 6421287 - DNA, 22 bp, Homo sapiens
aactataacattatataacaaa

SEQ ID NO: 6421288 - DNA, 13 bp, Homo sapiens
aactataacattc

SEQ ID NO: 6421289 - DNA, 18 bp, Homo sapiens
aactataagatacaataa

SEQ ID NO: 6421290 - DNA, 16 bp, Homo sapiens
aactatacccgggacc

SEQ ID NO: 6421291 - DNA, 17 bp, Homo sapiens
aactatacttgaacaaa

SEQ ID NO: 6421292 - DNA, 23 bp, Homo sapiens
aactatagcttgcagaactgtag

SEQ ID NO: 6421293 - DNA, 14 bp, Homo sapiens
aactatataaatga

SEQ ID NO: 6421294 - DNA, 19 bp, Homo sapiens
aactatataaatgacatta

SEQ ID NO: 6421295 - DNA, 20 bp, Homo sapiens
aactatataaatgacattat

SEQ ID NO: 6421296 - DNA, 13 bp, Homo sapiens
aactatatgtaca

SEQ ID NO: 6421297 - DNA, 13 bp, Homo sapiens
aactatattgttt

SEQ ID NO: 6421298 - DNA, 23 bp, Homo sapiens
aactatatttaataccaccaaca

SEQ ID NO: 6421299 - DNA, 21 bp, Homo sapiens
aactatatttggagaaaacag

SEQ ID NO: 6421300 - DNA, 16 bp, Homo sapiens
aactatattttgtcat

SEQ ID NO: 6421301 - DNA, 15 bp, Homo sapiens
aactatcaccagtgc

SEQ ID NO: 6421302 - DNA, 18 bp, Homo sapiens
aactatcaggcagaagaa

SEQ ID NO: 6421303 - DNA, 17 bp, Homo sapiens
aactatcagggcaagct

SEQ ID NO: 6421304 - DNA, 20 bp, Homo sapiens
aactatcagggcaagctcat

SEQ ID NO: 6421305 - DNA, 17 bp, Homo sapiens
aactatccaagtgttat

SEQ ID NO: 6421306 - DNA, 15 bp, Homo sapiens
aactatccaattaaa

SEQ ID NO: 6421307 - DNA, 22 bp, Homo sapiens
aactatccaattaaaattaagg

SEQ ID NO: 6421308 - DNA, 22 bp, Homo sapiens
aactatcctatgccttcaaata

SEQ ID NO: 6421309 - DNA, 24 bp, Homo sapiens
aactatctcacttccagatatcca

SEQ ID NO: 6421310 - DNA, 23 bp, Homo sapiens
aactatctcatttccaagcaagt

SEQ ID NO: 6421311 - DNA, 22 bp, Homo sapiens
aactatctgcattatctatgca

SEQ ID NO: 6421312 - DNA, 16 bp, Homo sapiens
aactatctgtatttat

SEQ ID NO: 6421313 - DNA, 21 bp, Homo sapiens
aactatctgttcccttcctct

SEQ ID NO: 6421314 - DNA, 19 bp, Homo sapiens
aactatcttctctatattt

SEQ ID NO: 6421315 - DNA, 18 bp, Homo sapiens
aactatcttctttggact

SEQ ID NO: 6421316 - DNA, 11 bp, Homo sapiens
aactatcttgg

SEQ ID NO: 6421317 - DNA, 17 bp, Homo sapiens
aactatctttttgaaag

SEQ ID NO: 6421318 - DNA, 17 bp, Homo sapiens
aactatgaacactgtca

SEQ ID NO: 6421319 - DNA, 19 bp, Homo sapiens
aactatgacagatatattt

SEQ ID NO: 6421320 - DNA, 18 bp, Homo sapiens
aactatgatcacagtgac

SEQ ID NO: 6421321 - DNA, 15 bp, Homo sapiens
aactatgcacctata

SEQ ID NO: 6421322 - DNA, 23 bp, Homo sapiens
aactatgcatggtgccccaggac

SEQ ID NO: 6421323 - DNA, 22 bp, Homo sapiens
aactatgccgtgtagtttctgg

SEQ ID NO: 6421324 - DNA, 12 bp, Homo sapiens
aactatggcctg

SEQ ID NO: 6421325 - DNA, 20 bp, Homo sapiens
aactatggtaaataactgtg

SEQ ID NO: 6421326 - DNA, 21 bp, Homo sapiens
aactatggtaaataactgtga

SEQ ID NO: 6421327 - DNA, 22 bp, Homo sapiens
aactatggtaaataactgtgac

SEQ ID NO: 6421328 - DNA, 20 bp, Homo sapiens
aactatggttcccaataaaa

SEQ ID NO: 6421329 - DNA, 22 bp, Homo sapiens
aactatgtacaatattttaagc

SEQ ID NO: 6421330 - DNA, 23 bp, Homo sapiens
aactatgtgatgaaactttgaaa

SEQ ID NO: 6421331 - DNA, 13 bp, Homo sapiens
aactatgtgatgt

SEQ ID NO: 6421332 - DNA, 22 bp, Homo sapiens
aactatgtgatgttaactatta

SEQ ID NO: 6421333 - DNA, 16 bp, Homo sapiens
aactattaaagtgcca

SEQ ID NO: 6421334 - DNA, 14 bp, Homo sapiens
aactattaaccttt

SEQ ID NO: 6421335 - DNA, 15 bp, Homo sapiens
aactattacagtgtt

SEQ ID NO: 6421336 - DNA, 23 bp, Homo sapiens
aactattagagtatttcccttcc

SEQ ID NO: 6421337 - DNA, 14 bp, Homo sapiens
aactattatattga

SEQ ID NO: 6421338 - DNA, 23 bp, Homo sapiens
aactattcaggagagtagaacag

SEQ ID NO: 6421339 - DNA, 17 bp, Homo sapiens
aactattccatgtttta

SEQ ID NO: 6421340 - DNA, 13 bp, Homo sapiens
aactattgaattg

SEQ ID NO: 6421341 - DNA, 17 bp, Homo sapiens
aactattgagccttgca

SEQ ID NO: 6421342 - DNA, 21 bp, Homo sapiens
aactattgagccttgcatgta

SEQ ID NO: 6421343 - DNA, 16 bp, Homo sapiens
aactattgcatttata

SEQ ID NO: 6421344 - DNA, 15 bp, Homo sapiens
aactattggaaagta

SEQ ID NO: 6421345 - DNA, 15 bp, Homo sapiens
aactattgggtgaat

SEQ ID NO: 6421346 - DNA, 22 bp, Homo sapiens
aactattgggtgaatatggtgg

SEQ ID NO: 6421347 - DNA, 24 bp, Homo sapiens
aactattgtgctcagagacactgt

SEQ ID NO: 6421348 - DNA, 14 bp, Homo sapiens
aactatttaaaata

SEQ ID NO: 6421349 - DNA, 20 bp, Homo sapiens
aactatttaaaattggcacc

SEQ ID NO: 6421350 - DNA, 14 bp, Homo sapiens
aactatttagagaa

SEQ ID NO: 6421351 - DNA, 19 bp, Homo sapiens
aactatttagagaatgatt

SEQ ID NO: 6421352 - DNA, 18 bp, Homo sapiens
aactatttagtgttagtt

SEQ ID NO: 6421353 - DNA, 23 bp, Homo sapiens
aactatttagtgttagttataaa

SEQ ID NO: 6421354 - DNA, 20 bp, Homo sapiens
aactatttattaaaaacatg

SEQ ID NO: 6421355 - DNA, 19 bp, Homo sapiens
aactatttcaataagtgtt

SEQ ID NO: 6421356 - DNA, 17 bp, Homo sapiens
aactatttcagaatatt

SEQ ID NO: 6421357 - DNA, 14 bp, Homo sapiens
aactatttcttcag

SEQ ID NO: 6421358 - DNA, 21 bp, Homo sapiens
aactattttaaagctgacttt

SEQ ID NO: 6421359 - DNA, 16 bp, Homo sapiens
aactattttaaataaa

SEQ ID NO: 6421360 - DNA, 17 bp, Homo sapiens
aactattttaaataaaa

SEQ ID NO: 6421361 - DNA, 14 bp, Homo sapiens
aactattttatgtt

SEQ ID NO: 6421362 - DNA, 12 bp, Homo sapiens
aactattttcag

SEQ ID NO: 6421363 - DNA, 16 bp, Homo sapiens
aactattttcagatgt

SEQ ID NO: 6421364 - DNA, 14 bp, Homo sapiens
aactattttgaaga

SEQ ID NO: 6421365 - DNA, 15 bp, Homo sapiens
aactattttgtttta

SEQ ID NO: 6421366 - DNA, 16 bp, Homo sapiens
aactatttttgaggaa

SEQ ID NO: 6421367 - DNA, 19 bp, Homo sapiens
aactatttttgtgtttgaa

SEQ ID NO: 6421368 - DNA, 18 bp, Homo sapiens
aactcaaagaatgtgtat

SEQ ID NO: 6421369 - DNA, 23 bp, Homo sapiens
aactcaaagcaagctcttctcct

SEQ ID NO: 6421370 - DNA, 13 bp, Homo sapiens
aactcaaatcccc

SEQ ID NO: 6421371 - DNA, 22 bp, Homo sapiens
aactcaaatgcttggcttctca

SEQ ID NO: 6421372 - DNA, 18 bp, Homo sapiens
aactcaaatggggccaga

SEQ ID NO: 6421373 - DNA, 21 bp, Homo sapiens
aactcaaatggggccagatcc

SEQ ID NO: 6421374 - DNA, 15 bp, Homo sapiens
aactcaacatttgtc

SEQ ID NO: 6421375 - DNA, 20 bp, Homo sapiens
aactcaagatggattaaaga

SEQ ID NO: 6421376 - DNA, 19 bp, Homo sapiens
aactcaaggtggctggaga

SEQ ID NO: 6421377 - DNA, 18 bp, Homo sapiens
aactcaagtgtcacctcc

SEQ ID NO: 6421378 - DNA, 20 bp, Homo sapiens
aactcaatattttccatgaa

SEQ ID NO: 6421379 - DNA, 17 bp, Homo sapiens
aactcaatctaaattaa

SEQ ID NO: 6421380 - DNA, 14 bp, Homo sapiens
aactcaatctccag

SEQ ID NO: 6421381 - DNA, 15 bp, Homo sapiens
aactcaatgcatgat

SEQ ID NO: 6421382 - DNA, 20 bp, Homo sapiens
aactcaatgcatgatgactc

SEQ ID NO: 6421383 - DNA, 20 bp, Homo sapiens
aactcaatgctttatttgta

SEQ ID NO: 6421384 - DNA, 21 bp, Homo sapiens
aactcaatgctttatttgtaa

SEQ ID NO: 6421385 - DNA, 16 bp, Homo sapiens
aactcacacccctgcc

SEQ ID NO: 6421386 - DNA, 18 bp, Homo sapiens
aactcaccagcctctgct

SEQ ID NO: 6421387 - DNA, 19 bp, Homo sapiens
aactcaccatttcatccat

SEQ ID NO: 6421388 - DNA, 12 bp, Homo sapiens
aactcaccccag

SEQ ID NO: 6421389 - DNA, 16 bp, Homo sapiens
aactcacccctcagca

SEQ ID NO: 6421390 - DNA, 23 bp, Homo sapiens
aactcaccctgggagccagtcct

SEQ ID NO: 6421391 - DNA, 14 bp, Homo sapiens
aactcacctaactc

SEQ ID NO: 6421392 - DNA, 16 bp, Homo sapiens
aactcacctgcccctc

SEQ ID NO: 6421393 - DNA, 12 bp, Homo sapiens
aactcacctgct

SEQ ID NO: 6421394 - DNA, 20 bp, Homo sapiens
aactcacctgctggcccctc

SEQ ID NO: 6421395 - DNA, 20 bp, Homo sapiens
aactcacctggggctgctgg

SEQ ID NO: 6421396 - DNA, 17 bp, Homo sapiens
aactcactaacagggag

SEQ ID NO: 6421397 - DNA, 17 bp, Homo sapiens
aactcactcactgttta

SEQ ID NO: 6421398 - DNA, 15 bp, Homo sapiens
aactcactctttaga

SEQ ID NO: 6421399 - DNA, 22 bp, Homo sapiens
aactcactgctcaagaagacat

SEQ ID NO: 6421400 - DNA, 15 bp, Homo sapiens
aactcactgtgatca

SEQ ID NO: 6421401 - DNA, 14 bp, Homo sapiens
aactcagaagagaa

SEQ ID NO: 6421402 - DNA, 12 bp, Homo sapiens
aactcagaaggg

SEQ ID NO: 6421403 - DNA, 21 bp, Homo sapiens
aactcagaattatttttaaaa

SEQ ID NO: 6421404 - DNA, 16 bp, Homo sapiens
aactcagagcacagcc

SEQ ID NO: 6421405 - DNA, 19 bp, Homo sapiens
aactcagagcccctccctg

SEQ ID NO: 6421406 - DNA, 14 bp, Homo sapiens
aactcagagcctcc

SEQ ID NO: 6421407 - DNA, 19 bp, Homo sapiens
aactcagatcactactgca

SEQ ID NO: 6421408 - DNA, 14 bp, Homo sapiens
aactcagatccagg

SEQ ID NO: 6421409 - DNA, 15 bp, Homo sapiens
aactcagatccaggg

SEQ ID NO: 6421410 - DNA, 13 bp, Homo sapiens
aactcagatctgt

SEQ ID NO: 6421411 - DNA, 17 bp, Homo sapiens
aactcagatttaaaaca

SEQ ID NO: 6421412 - DNA, 14 bp, Homo sapiens
aactcagcagttga

SEQ ID NO: 6421413 - DNA, 12 bp, Homo sapiens
aactcagccaag

SEQ ID NO: 6421414 - DNA, 14 bp, Homo sapiens
aactcagccaagca

SEQ ID NO: 6421415 - DNA, 15 bp, Homo sapiens
aactcagccaagcac

SEQ ID NO: 6421416 - DNA, 17 bp, Homo sapiens
aactcagccaagcacag

SEQ ID NO: 6421417 - DNA, 23 bp, Homo sapiens
aactcagccgtagggtggcactg

SEQ ID NO: 6421418 - DNA, 18 bp, Homo sapiens
aactcaggactccagccc

SEQ ID NO: 6421419 - DNA, 14 bp, Homo sapiens
aactcaggcaaaga

SEQ ID NO: 6421420 - DNA, 18 bp, Homo sapiens
aactcaggcaaagaaaat

SEQ ID NO: 6421421 - DNA, 17 bp, Homo sapiens
aactcagggacagagcc

SEQ ID NO: 6421422 - DNA, 20 bp, Homo sapiens
aactcaggttcacagcagct

SEQ ID NO: 6421423 - DNA, 21 bp, Homo sapiens
aactcaggttcacagcagctt

SEQ ID NO: 6421424 - DNA, 23 bp, Homo sapiens
aactcaggttcacagcagctttg

SEQ ID NO: 6421425 - DNA, 21 bp, Homo sapiens
aactcagtagagatctatatt

SEQ ID NO: 6421426 - DNA, 17 bp, Homo sapiens
aactcagtgccacacct

SEQ ID NO: 6421427 - DNA, 15 bp, Homo sapiens
aactcagttttaact

SEQ ID NO: 6421428 - DNA, 15 bp, Homo sapiens
aactcatacagtctc

SEQ ID NO: 6421429 - DNA, 15 bp, Homo sapiens
aactcatcataaaat

SEQ ID NO: 6421430 - DNA, 14 bp, Homo sapiens
aactcatcattttt

SEQ ID NO: 6421431 - DNA, 11 bp, Homo sapiens
aactcatccct

SEQ ID NO: 6421432 - DNA, 16 bp, Homo sapiens
aactcatccttcttcc

SEQ ID NO: 6421433 - DNA, 22 bp, Homo sapiens
aactcatccttcttccactgtc

SEQ ID NO: 6421434 - DNA, 12 bp, Homo sapiens
aactcatctcat

SEQ ID NO: 6421435 - DNA, 14 bp, Homo sapiens
aactcatctgaaat

SEQ ID NO: 6421436 - DNA, 17 bp, Homo sapiens
aactcatctgaaatgtt

SEQ ID NO: 6421437 - DNA, 18 bp, Homo sapiens
aactcatctgaaatgtta

SEQ ID NO: 6421438 - DNA, 14 bp, Homo sapiens
tatgtttaaaaaca

SEQ ID NO: 6421439 - DNA, 16 bp, Homo sapiens
tatgtttaaaagaaat

SEQ ID NO: 6421440 - DNA, 19 bp, Homo sapiens
tatgtttaaaagaaatata

SEQ ID NO: 6421441 - DNA, 13 bp, Homo sapiens
tatgtttaaaata

SEQ ID NO: 6421442 - DNA, 23 bp, Homo sapiens
tatgtttaaagtaattgttccag

SEQ ID NO: 6421443 - DNA, 12 bp, Homo sapiens
tatgtttaagtg

SEQ ID NO: 6421444 - DNA, 16 bp, Homo sapiens
tatgtttacactgtca

SEQ ID NO: 6421445 - DNA, 15 bp, Homo sapiens
tatgtttattacaat

SEQ ID NO: 6421446 - DNA, 16 bp, Homo sapiens
tatgtttattcaaaat

SEQ ID NO: 6421447 - DNA, 20 bp, Homo sapiens
tatgtttccatggttaccat

SEQ ID NO: 6421448 - DNA, 18 bp, Homo sapiens
tatgtttccccatctctg

SEQ ID NO: 6421449 - DNA, 12 bp, Homo sapiens
tatgtttccttg

SEQ ID NO: 6421450 - DNA, 22 bp, Homo sapiens
tatgtttcttctttcttttaag

SEQ ID NO: 6421451 - DNA, 12 bp, Homo sapiens
tatgtttgaata

SEQ ID NO: 6421452 - DNA, 12 bp, Homo sapiens
tatgtttgcatt

SEQ ID NO: 6421453 - DNA, 13 bp, Homo sapiens
tatgtttgctgat

SEQ ID NO: 6421454 - DNA, 19 bp, Homo sapiens
tatgtttgctgattattta

SEQ ID NO: 6421455 - DNA, 19 bp, Homo sapiens
tatgtttgctttaatgtgt

SEQ ID NO: 6421456 - DNA, 19 bp, Homo sapiens
tatgtttggaatattccac

SEQ ID NO: 6421457 - DNA, 18 bp, Homo sapiens
tatgtttggctgaaatta

SEQ ID NO: 6421458 - DNA, 20 bp, Homo sapiens
tatgtttggctgaaattatg

SEQ ID NO: 6421459 - DNA, 19 bp, Homo sapiens
tatgtttgtacaagattgt

SEQ ID NO: 6421460 - DNA, 22 bp, Homo sapiens
tatgtttgtataatgaatgaga

SEQ ID NO: 6421461 - DNA, 16 bp, Homo sapiens
tatgttttaatatcct

SEQ ID NO: 6421462 - DNA, 15 bp, Homo sapiens
tatgttttacactgt

SEQ ID NO: 6421463 - DNA, 16 bp, Homo sapiens
tatgttttagcatgtg

SEQ ID NO: 6421464 - DNA, 15 bp, Homo sapiens
tatgttttataattc

SEQ ID NO: 6421465 - DNA, 15 bp, Homo sapiens
tatgttttatatcaa

SEQ ID NO: 6421466 - DNA, 16 bp, Homo sapiens
tatgttttatatcaaa

SEQ ID NO: 6421467 - DNA, 19 bp, Homo sapiens
tatgttttatttaaatgct

SEQ ID NO: 6421468 - DNA, 21 bp, Homo sapiens
tatgttttccacataaatttt

SEQ ID NO: 6421469 - DNA, 21 bp, Homo sapiens
tatgttttctactccaattca

SEQ ID NO: 6421470 - DNA, 13 bp, Homo sapiens
tatgttttgagaa

SEQ ID NO: 6421471 - DNA, 14 bp, Homo sapiens
tatgttttgagaaa

SEQ ID NO: 6421472 - DNA, 16 bp, Homo sapiens
tatgttttgagaaaaa

SEQ ID NO: 6421473 - DNA, 12 bp, Homo sapiens
tatgttttggta

SEQ ID NO: 6421474 - DNA, 20 bp, Homo sapiens
tatgttttggtatctgttct

SEQ ID NO: 6421475 - DNA, 12 bp, Homo sapiens
tatgttttggtc

SEQ ID NO: 6421476 - DNA, 21 bp, Homo sapiens
tatgtttttaaagtgtacatt

SEQ ID NO: 6421477 - DNA, 13 bp, Homo sapiens
tatgtttttaatg

SEQ ID NO: 6421478 - DNA, 20 bp, Homo sapiens
tatgtttttacattatgcaa

SEQ ID NO: 6421479 - DNA, 16 bp, Homo sapiens
tatgtttttataaaaa

SEQ ID NO: 6421480 - DNA, 17 bp, Homo sapiens
tatgtttttatttatga

SEQ ID NO: 6421481 - DNA, 13 bp, Homo sapiens
tatgtttttcagt

SEQ ID NO: 6421482 - DNA, 14 bp, Homo sapiens
tatgtttttctgta

SEQ ID NO: 6421483 - DNA, 14 bp, Homo sapiens
tatgtttttgaagg

SEQ ID NO: 6421484 - DNA, 16 bp, Homo sapiens
tatgtttttgaaggca

SEQ ID NO: 6421485 - DNA, 15 bp, Homo sapiens
tatgtttttgttcaa

SEQ ID NO: 6421486 - DNA, 14 bp, Homo sapiens
tattaaaaaaaaca

SEQ ID NO: 6421487 - DNA, 23 bp, Homo sapiens
tattaaaaaaaacaaaaagaaca

SEQ ID NO: 6421488 - DNA, 18 bp, Homo sapiens
tattaaaaaaacacaaaa

SEQ ID NO: 6421489 - DNA, 14 bp, Homo sapiens
tattaaaaaaatgc

SEQ ID NO: 6421490 - DNA, 23 bp, Homo sapiens
tattaaaaaagagacatccaaat

SEQ ID NO: 6421491 - DNA, 20 bp, Homo sapiens
tattaaaaagaagtttctat

SEQ ID NO: 6421492 - DNA, 12 bp, Homo sapiens
tattaaaaagtc

SEQ ID NO: 6421493 - DNA, 13 bp, Homo sapiens
tattaaaaagtct

SEQ ID NO: 6421494 - DNA, 18 bp, Homo sapiens
tattaaaaagtctgtatg

SEQ ID NO: 6421495 - DNA, 22 bp, Homo sapiens
tattaaaaagtcttttaaaaag

SEQ ID NO: 6421496 - DNA, 15 bp, Homo sapiens
tattaaaaataaaat

SEQ ID NO: 6421497 - DNA, 18 bp, Homo sapiens
tattaaaaatataaaact

SEQ ID NO: 6421498 - DNA, 22 bp, Homo sapiens
tattaaaaatatggaacttcta

SEQ ID NO: 6421499 - DNA, 16 bp, Homo sapiens
tattaaaaatctcaaa

SEQ ID NO: 6421500 - DNA, 22 bp, Homo sapiens
tattaaaaatctcaaatttcta

SEQ ID NO: 6421501 - DNA, 17 bp, Homo sapiens
tattaaaaattatagac

SEQ ID NO: 6421502 - DNA, 13 bp, Homo sapiens
tattaaaaattga

SEQ ID NO: 6421503 - DNA, 18 bp, Homo sapiens
tattaaaaattgaaaact

SEQ ID NO: 6421504 - DNA, 23 bp, Homo sapiens
tattaaaaattggctagttgaat

SEQ ID NO: 6421505 - DNA, 20 bp, Homo sapiens
tattaaaacacattatgtat

SEQ ID NO: 6421506 - DNA, 22 bp, Homo sapiens
tattaaaacacattatgtatct

SEQ ID NO: 6421507 - DNA, 22 bp, Homo sapiens
tattaaaacagaaattaatctt

SEQ ID NO: 6421508 - DNA, 12 bp, Homo sapiens
tattaaaacatt

SEQ ID NO: 6421509 - DNA, 12 bp, Homo sapiens
tattaaaactca

SEQ ID NO: 6421510 - DNA, 16 bp, Homo sapiens
tattaaaactcatttt

SEQ ID NO: 6421511 - DNA, 14 bp, Homo sapiens
tattaaaagaatga

SEQ ID NO: 6421512 - DNA, 14 bp, Homo sapiens
tattaaaagactca

SEQ ID NO: 6421513 - DNA, 14 bp, Homo sapiens
tattaaaagtcaca

SEQ ID NO: 6421514 - DNA, 17 bp, Homo sapiens
tattaaaatacatttta

SEQ ID NO: 6421515 - DNA, 19 bp, Homo sapiens
tattaaaatacattttaag

SEQ ID NO: 6421516 - DNA, 15 bp, Homo sapiens
tattaaaatatgaag

SEQ ID NO: 6421517 - DNA, 16 bp, Homo sapiens
tattaaaatatgaagg

SEQ ID NO: 6421518 - DNA, 16 bp, Homo sapiens
tattaaaatatttcag

SEQ ID NO: 6421519 - DNA, 15 bp, Homo sapiens
tattaaaatattttg

SEQ ID NO: 6421520 - DNA, 10 bp, Homo sapiens
tattaaaatc

SEQ ID NO: 6421521 - DNA, 14 bp, Homo sapiens
tattaaaatgcata

SEQ ID NO: 6421522 - DNA, 10 bp, Homo sapiens
tattaaaatt

SEQ ID NO: 6421523 - DNA, 14 bp, Homo sapiens
tattaaaattccaa

SEQ ID NO: 6421524 - DNA, 15 bp, Homo sapiens
tattaaaattccaaa

SEQ ID NO: 6421525 - DNA, 14 bp, Homo sapiens
tattaaaattgtaa

SEQ ID NO: 6421526 - DNA, 14 bp, Homo sapiens
tattaaaattgtta

SEQ ID NO: 6421527 - DNA, 21 bp, Homo sapiens
tattaaacagatttttacaaa

SEQ ID NO: 6421528 - DNA, 19 bp, Homo sapiens
tattaaacagtgaacttgt

SEQ ID NO: 6421529 - DNA, 17 bp, Homo sapiens
tattaaacatgctgtac

SEQ ID NO: 6421530 - DNA, 17 bp, Homo sapiens
tattaaaccataagatg

SEQ ID NO: 6421531 - DNA, 16 bp, Homo sapiens
tattaaaccttcagat

SEQ ID NO: 6421532 - DNA, 19 bp, Homo sapiens
tattaaaccttcagattaa

SEQ ID NO: 6421533 - DNA, 20 bp, Homo sapiens
tattaaacgtatgcatgtga

SEQ ID NO: 6421534 - DNA, 16 bp, Homo sapiens
tattaaacgtgtaaat

SEQ ID NO: 6421535 - DNA, 13 bp, Homo sapiens
tattaaactgaat

SEQ ID NO: 6421536 - DNA, 19 bp, Homo sapiens
tattaaactgtaaatcata

SEQ ID NO: 6421537 - DNA, 13 bp, Homo sapiens
tattaaacttgaa

SEQ ID NO: 6421538 - DNA, 14 bp, Homo sapiens
tattaaacttttca

SEQ ID NO: 6421539 - DNA, 16 bp, Homo sapiens
tattaaacttttcatt

SEQ ID NO: 6421540 - DNA, 17 bp, Homo sapiens
tattaaacttttcatta

SEQ ID NO: 6421541 - DNA, 20 bp, Homo sapiens
tattaaagaaaaaaatgtat

SEQ ID NO: 6421542 - DNA, 21 bp, Homo sapiens
tattaaagaaaaaaatgtatt

SEQ ID NO: 6421543 - DNA, 16 bp, Homo sapiens
tattaaagatgcaggt

SEQ ID NO: 6421544 - DNA, 23 bp, Homo sapiens
tattaaagatgcaggttttctaa

SEQ ID NO: 6421545 - DNA, 12 bp, Homo sapiens
tattaaagccat

SEQ ID NO: 6421546 - DNA, 13 bp, Homo sapiens
tattaaagccatg

SEQ ID NO: 6421547 - DNA, 14 bp, Homo sapiens
tattaaagccatgt

SEQ ID NO: 6421548 - DNA, 13 bp, Homo sapiens
tattaaaggaaaa

SEQ ID NO: 6421549 - DNA, 23 bp, Homo sapiens
tattaaaggaagcactctgtata

SEQ ID NO: 6421550 - DNA, 13 bp, Homo sapiens
tattaaaggcttt

SEQ ID NO: 6421551 - DNA, 18 bp, Homo sapiens
tattaaagggtctggaaa

SEQ ID NO: 6421552 - DNA, 20 bp, Homo sapiens
tattaaaggttaaattgctt

SEQ ID NO: 6421553 - DNA, 20 bp, Homo sapiens
tattaaagtctaaacaaaat

SEQ ID NO: 6421554 - DNA, 19 bp, Homo sapiens
tattaaagtctgagaaatt

SEQ ID NO: 6421555 - DNA, 12 bp, Homo sapiens
tattaaagtgac

SEQ ID NO: 6421556 - DNA, 14 bp, Homo sapiens
tattaaagtgactt

SEQ ID NO: 6421557 - DNA, 14 bp, Homo sapiens
tattaaagtgctaa

SEQ ID NO: 6421558 - DNA, 13 bp, Homo sapiens
tattaaagtttca

SEQ ID NO: 6421559 - DNA, 14 bp, Homo sapiens
tattaaagtttcaa

SEQ ID NO: 6421560 - DNA, 18 bp, Homo sapiens
tattaaagtttcaaaaat

SEQ ID NO: 6421561 - DNA, 22 bp, Homo sapiens
tattaaagtttcaaaaatctga

SEQ ID NO: 6421562 - DNA, 13 bp, Homo sapiens
tattaaagttttc

SEQ ID NO: 6421563 - DNA, 22 bp, Homo sapiens
tattaaagttttcaaattattt

SEQ ID NO: 6421564 - DNA, 14 bp, Homo sapiens
tattaaataaaatg

SEQ ID NO: 6421565 - DNA, 13 bp, Homo sapiens
tattaaatacaga

SEQ ID NO: 6421566 - DNA, 17 bp, Homo sapiens
tattaaatacagacact

SEQ ID NO: 6421567 - DNA, 21 bp, Homo sapiens
tattaaatacagacactaagt

SEQ ID NO: 6421568 - DNA, 17 bp, Homo sapiens
tattaaatagttaatat

SEQ ID NO: 6421569 - DNA, 14 bp, Homo sapiens
tattaaatcagaat

SEQ ID NO: 6421570 - DNA, 13 bp, Homo sapiens
tattaaatcagtt

SEQ ID NO: 6421571 - DNA, 18 bp, Homo sapiens
tattaaatcgtttaatgt

SEQ ID NO: 6421572 - DNA, 21 bp, Homo sapiens
tattaaatcgtttaatgttta

SEQ ID NO: 6421573 - DNA, 23 bp, Homo sapiens
tattaaatgcttcatttgtatgt

SEQ ID NO: 6421574 - DNA, 19 bp, Homo sapiens
tattaaatggtttttaaat

SEQ ID NO: 6421575 - DNA, 22 bp, Homo sapiens
tattaaatgtatatgtcattta

SEQ ID NO: 6421576 - DNA, 15 bp, Homo sapiens
tattaaatgtttcaa

SEQ ID NO: 6421577 - DNA, 22 bp, Homo sapiens
tattaaatgtttcaaaatagac

SEQ ID NO: 6421578 - DNA, 23 bp, Homo sapiens
tattaaatgtttcaaaatagaca

SEQ ID NO: 6421579 - DNA, 21 bp, Homo sapiens
tattaaattaaattttgtgtc

SEQ ID NO: 6421580 - DNA, 12 bp, Homo sapiens
tattaaattaca

SEQ ID NO: 6421581 - DNA, 14 bp, Homo sapiens
tattaaattacatt

SEQ ID NO: 6421582 - DNA, 15 bp, Homo sapiens
tattaaattcctcct

SEQ ID NO: 6421583 - DNA, 16 bp, Homo sapiens
tattaaattgtgtaca

SEQ ID NO: 6421584 - DNA, 20 bp, Homo sapiens
tattaaatttattaaatgtt

SEQ ID NO: 6421585 - DNA, 17 bp, Homo sapiens
tattaaatttttttgta

SEQ ID NO: 6421586 - DNA, 18 bp, Homo sapiens
tattaaatttttttgtat

SEQ ID NO: 6421587 - DNA, 22 bp, Homo sapiens
tattaaatttttttgtatgaaa

SEQ ID NO: 6421588 - DNA, 13 bp, Homo sapiens
tattaacaaaaca

SEQ ID NO: 6421589 - DNA, 14 bp, Homo sapiens
tattaacaaaagtt

SEQ ID NO: 6421590 - DNA, 18 bp, Homo sapiens
tattaacaaaagttccct

SEQ ID NO: 6421591 - DNA, 18 bp, Homo sapiens
tattaacaaattgcattt

SEQ ID NO: 6421592 - DNA, 20 bp, Homo sapiens
tattaacaaattgcatttgt

SEQ ID NO: 6421593 - DNA, 14 bp, Homo sapiens
tattaacaattaat

SEQ ID NO: 6421594 - DNA, 22 bp, Homo sapiens
tattaacactaataatagtact

SEQ ID NO: 6421595 - DNA, 17 bp, Homo sapiens
tattaacactactcaaa

SEQ ID NO: 6421596 - DNA, 22 bp, Homo sapiens
tattaaccaaattaacctttca

SEQ ID NO: 6421597 - DNA, 23 bp, Homo sapiens
tattaaccctctgagtttttgta

SEQ ID NO: 6421598 - DNA, 16 bp, Homo sapiens
tattaacctcagcatt

SEQ ID NO: 6421599 - DNA, 15 bp, Homo sapiens
tattaacgatgtcca

SEQ ID NO: 6421600 - DNA, 16 bp, Homo sapiens
tattaacgggcatgta

SEQ ID NO: 6421601 - DNA, 16 bp, Homo sapiens
tattaactacatttat

SEQ ID NO: 6421602 - DNA, 23 bp, Homo sapiens
tattaactactgtagaactgatt

SEQ ID NO: 6421603 - DNA, 18 bp, Homo sapiens
tattaactctgcatagac

SEQ ID NO: 6421604 - DNA, 20 bp, Homo sapiens
tattaactctgtaaaagtgt

SEQ ID NO: 6421605 - DNA, 19 bp, Homo sapiens
tattaactgctcagtgttt

SEQ ID NO: 6421606 - DNA, 19 bp, Homo sapiens
tattaactgggtacccaaa

SEQ ID NO: 6421607 - DNA, 17 bp, Homo sapiens
tattaactgtattttct

SEQ ID NO: 6421608 - DNA, 20 bp, Homo sapiens
tattaacttacggatttatt

SEQ ID NO: 6421609 - DNA, 17 bp, Homo sapiens
tattaagaaaatattct

SEQ ID NO: 6421610 - DNA, 24 bp, Homo sapiens
tattaagaaagactatctaaatgt

SEQ ID NO: 6421611 - DNA, 12 bp, Homo sapiens
tattaagaaagg

SEQ ID NO: 6421612 - DNA, 21 bp, Homo sapiens
tattaagaaaggaagcattgt

SEQ ID NO: 6421613 - DNA, 20 bp, Homo sapiens
tattaagaacattttataaa

SEQ ID NO: 6421614 - DNA, 14 bp, Homo sapiens
tattaagaactata

SEQ ID NO: 6421615 - DNA, 15 bp, Homo sapiens
tattaagaactgctg

SEQ ID NO: 6421616 - DNA, 19 bp, Homo sapiens
tattaagaatagtctctgg

SEQ ID NO: 6421617 - DNA, 21 bp, Homo sapiens
tattaagaatcttagataact

SEQ ID NO: 6421618 - DNA, 13 bp, Homo sapiens
tattaagaatgaa

SEQ ID NO: 6421619 - DNA, 16 bp, Homo sapiens
tcctgtaagccaaaga

SEQ ID NO: 6421620 - DNA, 16 bp, Homo sapiens
tcctgtaatcacaact

SEQ ID NO: 6421621 - DNA, 22 bp, Homo sapiens
tcctgtaatcacaactcagcat

SEQ ID NO: 6421622 - DNA, 17 bp, Homo sapiens
tcctgtaatgttaaact

SEQ ID NO: 6421623 - DNA, 16 bp, Homo sapiens
tcctgtaattcctacc

SEQ ID NO: 6421624 - DNA, 15 bp, Homo sapiens
tcctgtaattttgta

SEQ ID NO: 6421625 - DNA, 19 bp, Homo sapiens
tcctgtaattttgtagtag

SEQ ID NO: 6421626 - DNA, 12 bp, Homo sapiens
tcctgtacaagt

SEQ ID NO: 6421627 - DNA, 17 bp, Homo sapiens
tcctgtacaagtgctca

SEQ ID NO: 6421628 - DNA, 21 bp, Homo sapiens
tcctgtacactgaatatttat

SEQ ID NO: 6421629 - DNA, 20 bp, Homo sapiens
tcctgtacattgtgggatgt

SEQ ID NO: 6421630 - DNA, 22 bp, Homo sapiens
tcctgtacctcttgagccttga

SEQ ID NO: 6421631 - DNA, 18 bp, Homo sapiens
tcctgtagcacgctgcct

SEQ ID NO: 6421632 - DNA, 19 bp, Homo sapiens
tcctgtagcacgctgcctg

SEQ ID NO: 6421633 - DNA, 21 bp, Homo sapiens
tcctgtagcatcttctggagt

SEQ ID NO: 6421634 - DNA, 16 bp, Homo sapiens
tcctgtagccactggc

SEQ ID NO: 6421635 - DNA, 11 bp, Homo sapiens
tcctgtagccc

SEQ ID NO: 6421636 - DNA, 21 bp, Homo sapiens
tcctgtagctttaaaaccaca

SEQ ID NO: 6421637 - DNA, 24 bp, Homo sapiens
tcctgtagctttaaaaccacagct

SEQ ID NO: 6421638 - DNA, 18 bp, Homo sapiens
tcctgtaggctaaaaggc

SEQ ID NO: 6421639 - DNA, 23 bp, Homo sapiens
tcctgtagtgcccctcccatggc

SEQ ID NO: 6421640 - DNA, 22 bp, Homo sapiens
tcctgtagtggcaaaaaagaac

SEQ ID NO: 6421641 - DNA, 21 bp, Homo sapiens
tcctgtagttttattttatgt

SEQ ID NO: 6421642 - DNA, 19 bp, Homo sapiens
tcctgtatacctcctccag

SEQ ID NO: 6421643 - DNA, 23 bp, Homo sapiens
tcctgtatattatggtgtaatgc

SEQ ID NO: 6421644 - DNA, 23 bp, Homo sapiens
tcctgtatattctcttgtctggc

SEQ ID NO: 6421645 - DNA, 23 bp, Homo sapiens
tcctgtatgttgtacaatcaaaa

SEQ ID NO: 6421646 - DNA, 15 bp, Homo sapiens
tcctgtattcacccg

SEQ ID NO: 6421647 - DNA, 17 bp, Homo sapiens
tcctgtattcagacaga

SEQ ID NO: 6421648 - DNA, 14 bp, Homo sapiens
tcctgtattcttgt

SEQ ID NO: 6421649 - DNA, 20 bp, Homo sapiens
tcctgtattcttgttttaca

SEQ ID NO: 6421650 - DNA, 13 bp, Homo sapiens
tcctgtattgctt

SEQ ID NO: 6421651 - DNA, 21 bp, Homo sapiens
tcctgtatttgttcccaagag

SEQ ID NO: 6421652 - DNA, 14 bp, Homo sapiens
tcctgtcaatgttt

SEQ ID NO: 6421653 - DNA, 24 bp, Homo sapiens
tcctgtcacaaggcaggaggagct

SEQ ID NO: 6421654 - DNA, 22 bp, Homo sapiens
tcctgtcacctagaacgtgcat

SEQ ID NO: 6421655 - DNA, 15 bp, Homo sapiens
tcctgtcactcactg

SEQ ID NO: 6421656 - DNA, 17 bp, Homo sapiens
tcctgtcactgagcaca

SEQ ID NO: 6421657 - DNA, 24 bp, Homo sapiens
tcctgtcactgagcacagtcaggg

SEQ ID NO: 6421658 - DNA, 22 bp, Homo sapiens
tcctgtcagataggattttctc

SEQ ID NO: 6421659 - DNA, 15 bp, Homo sapiens
tcctgtcagtgagga

SEQ ID NO: 6421660 - DNA, 13 bp, Homo sapiens
tcctgtcagtgcc

SEQ ID NO: 6421661 - DNA, 16 bp, Homo sapiens
tcctgtcattcctcta

SEQ ID NO: 6421662 - DNA, 20 bp, Homo sapiens
tcctgtccaacctaacccct

SEQ ID NO: 6421663 - DNA, 19 bp, Homo sapiens
tcctgtccacacccagctc

SEQ ID NO: 6421664 - DNA, 13 bp, Homo sapiens
tcctgtccagcag

SEQ ID NO: 6421665 - DNA, 21 bp, Homo sapiens
tcctgtccattcggaaccagg

SEQ ID NO: 6421666 - DNA, 10 bp, Homo sapiens
tcctgtccca

SEQ ID NO: 6421667 - DNA, 16 bp, Homo sapiens
tcctgtcccaccatgc

SEQ ID NO: 6421668 - DNA, 15 bp, Homo sapiens
tcctgtcccagaggt

SEQ ID NO: 6421669 - DNA, 19 bp, Homo sapiens
tcctgtccccaaaatgtga

SEQ ID NO: 6421670 - DNA, 22 bp, Homo sapiens
tcctgtccccaaaatgtgatgc

SEQ ID NO: 6421671 - DNA, 13 bp, Homo sapiens
tcctgtccctacc

SEQ ID NO: 6421672 - DNA, 15 bp, Homo sapiens
tcctgtccctaccca

SEQ ID NO: 6421673 - DNA, 21 bp, Homo sapiens
tcctgtccctacccactcttt

SEQ ID NO: 6421674 - DNA, 13 bp, Homo sapiens
tcctgtccctcac

SEQ ID NO: 6421675 - DNA, 19 bp, Homo sapiens
tcctgtccctcatccatag

SEQ ID NO: 6421676 - DNA, 14 bp, Homo sapiens
tcctgtccctgcgc

SEQ ID NO: 6421677 - DNA, 16 bp, Homo sapiens
tcctgtccctgtagct

SEQ ID NO: 6421678 - DNA, 19 bp, Homo sapiens
tcctgtccctgtagctcag

SEQ ID NO: 6421679 - DNA, 21 bp, Homo sapiens
tcctgtcccttctcttaattt

SEQ ID NO: 6421680 - DNA, 15 bp, Homo sapiens
tcctgtccctttgtt

SEQ ID NO: 6421681 - DNA, 17 bp, Homo sapiens
tcctgtccctttgttac

SEQ ID NO: 6421682 - DNA, 18 bp, Homo sapiens
tcctgtcccttttccctt

SEQ ID NO: 6421683 - DNA, 22 bp, Homo sapiens
tcctgtccgccctcttcccctc

SEQ ID NO: 6421684 - DNA, 15 bp, Homo sapiens
tcctgtccggagcga

SEQ ID NO: 6421685 - DNA, 15 bp, Homo sapiens
tcctgtcctccctca

SEQ ID NO: 6421686 - DNA, 13 bp, Homo sapiens
tcctgtcctgccc

SEQ ID NO: 6421687 - DNA, 17 bp, Homo sapiens
tcctgtcctgcccgtga

SEQ ID NO: 6421688 - DNA, 19 bp, Homo sapiens
tcctgtcctgcctcctcat

SEQ ID NO: 6421689 - DNA, 14 bp, Homo sapiens
tcctgtcctggtcc

SEQ ID NO: 6421690 - DNA, 16 bp, Homo sapiens
tcctgtcctggtcctg

SEQ ID NO: 6421691 - DNA, 22 bp, Homo sapiens
tcctgtccttctctcacctcct

SEQ ID NO: 6421692 - DNA, 14 bp, Homo sapiens
tcctgtcctttctt

SEQ ID NO: 6421693 - DNA, 21 bp, Homo sapiens
tcctgtcgattagactggaca

SEQ ID NO: 6421694 - DNA, 16 bp, Homo sapiens
tcctgtcgtcctgcct

SEQ ID NO: 6421695 - DNA, 19 bp, Homo sapiens
tcctgtctaaagtgggaaa

SEQ ID NO: 6421696 - DNA, 19 bp, Homo sapiens
tcctgtctacagtttaata

SEQ ID NO: 6421697 - DNA, 17 bp, Homo sapiens
tcctgtctcagcctcct

SEQ ID NO: 6421698 - DNA, 14 bp, Homo sapiens
tcctgtctccaaga

SEQ ID NO: 6421699 - DNA, 21 bp, Homo sapiens
tcctgtctccaagaatgtttt

SEQ ID NO: 6421700 - DNA, 14 bp, Homo sapiens
tcctgtctcccagg

SEQ ID NO: 6421701 - DNA, 12 bp, Homo sapiens
tcctgtctcccc

SEQ ID NO: 6421702 - DNA, 17 bp, Homo sapiens
tcctgtctcccctctgc

SEQ ID NO: 6421703 - DNA, 15 bp, Homo sapiens
tcctgtctccctcct

SEQ ID NO: 6421704 - DNA, 12 bp, Homo sapiens
tcctgtctcctc

SEQ ID NO: 6421705 - DNA, 15 bp, Homo sapiens
tcctgtctcctctgt

SEQ ID NO: 6421706 - DNA, 16 bp, Homo sapiens
tcctgtctcctctgtc

SEQ ID NO: 6421707 - DNA, 14 bp, Homo sapiens
tcctgtctctgcct

SEQ ID NO: 6421708 - DNA, 15 bp, Homo sapiens
tcctgtctctgcctg

SEQ ID NO: 6421709 - DNA, 16 bp, Homo sapiens
tcctgtctcttgggaa

SEQ ID NO: 6421710 - DNA, 14 bp, Homo sapiens
tcctgtctgaacct

SEQ ID NO: 6421711 - DNA, 13 bp, Homo sapiens
tcctgtctgccag

SEQ ID NO: 6421712 - DNA, 16 bp, Homo sapiens
tcctgtctgccagcca

SEQ ID NO: 6421713 - DNA, 21 bp, Homo sapiens
tcctgtctgccagccagcagc

SEQ ID NO: 6421714 - DNA, 20 bp, Homo sapiens
tcctgtctgccctctgggtc

SEQ ID NO: 6421715 - DNA, 15 bp, Homo sapiens
tcctgtctgctgggc

SEQ ID NO: 6421716 - DNA, 18 bp, Homo sapiens
tcctgtctgtcctggagg

SEQ ID NO: 6421717 - DNA, 11 bp, Homo sapiens
tcctgtcttcc

SEQ ID NO: 6421718 - DNA, 13 bp, Homo sapiens
tcctgtcttctgc

SEQ ID NO: 6421719 - DNA, 14 bp, Homo sapiens
tcctgtcttctgct

SEQ ID NO: 6421720 - DNA, 15 bp, Homo sapiens
tcctgtcttggcctc

SEQ ID NO: 6421721 - DNA, 17 bp, Homo sapiens
tcctgtctttaaggaaa

SEQ ID NO: 6421722 - DNA, 19 bp, Homo sapiens
tcctgtctttaaggaaaaa

SEQ ID NO: 6421723 - DNA, 19 bp, Homo sapiens
tcctgtctttgttgtctcc

SEQ ID NO: 6421724 - DNA, 23 bp, Homo sapiens
tcctgtgaaaaataacggtgctt

SEQ ID NO: 6421725 - DNA, 23 bp, Homo sapiens
tcctgtgaagtaacccctcctgg

SEQ ID NO: 6421726 - DNA, 18 bp, Homo sapiens
tcctgtgaatggaagcaa

SEQ ID NO: 6421727 - DNA, 24 bp, Homo sapiens
tcctgtgaatggaggcagagacct

SEQ ID NO: 6421728 - DNA, 18 bp, Homo sapiens
tcctgtgacaacactcat

SEQ ID NO: 6421729 - DNA, 18 bp, Homo sapiens
tcctgtgacagtgaaata

SEQ ID NO: 6421730 - DNA, 18 bp, Homo sapiens
tcctgtgacatgtaacag

SEQ ID NO: 6421731 - DNA, 21 bp, Homo sapiens
tcctgtgaccccaccttgacg

SEQ ID NO: 6421732 - DNA, 23 bp, Homo sapiens
tcctgtgaccccaccttgacggt

SEQ ID NO: 6421733 - DNA, 19 bp, Homo sapiens
tcctgtgacccgtgaatgt

SEQ ID NO: 6421734 - DNA, 14 bp, Homo sapiens
tcctgtgagctccc

SEQ ID NO: 6421735 - DNA, 11 bp, Homo sapiens
tcctgtgagga

SEQ ID NO: 6421736 - DNA, 21 bp, Homo sapiens
tcctgtgaggatagagacttg

SEQ ID NO: 6421737 - DNA, 17 bp, Homo sapiens
tcctgtgaggtttccca

SEQ ID NO: 6421738 - DNA, 17 bp, Homo sapiens
tcctgtgatgtcccagt

SEQ ID NO: 6421739 - DNA, 17 bp, Homo sapiens
tcctgtgattcctggtg

SEQ ID NO: 6421740 - DNA, 19 bp, Homo sapiens
tcctgtgcaaaaataaaat

SEQ ID NO: 6421741 - DNA, 13 bp, Homo sapiens
tcctgtgcacagc

SEQ ID NO: 6421742 - DNA, 22 bp, Homo sapiens
tcctgtgcattggtggcatcac

SEQ ID NO: 6421743 - DNA, 22 bp, Homo sapiens
tcctgtgccaacctgatgcccc

SEQ ID NO: 6421744 - DNA, 18 bp, Homo sapiens
tcctgtgcccatcatctc

SEQ ID NO: 6421745 - DNA, 19 bp, Homo sapiens
tcctgtgcccatcatctct

SEQ ID NO: 6421746 - DNA, 19 bp, Homo sapiens
tcctgtgccccagctgcca

SEQ ID NO: 6421747 - DNA, 18 bp, Homo sapiens
tcctgtgccccgacccca

SEQ ID NO: 6421748 - DNA, 23 bp, Homo sapiens
tcctgtgcccctcagagaggcat

SEQ ID NO: 6421749 - DNA, 23 bp, Homo sapiens
tcctgtgccctagatgcacgtgg

SEQ ID NO: 6421750 - DNA, 22 bp, Homo sapiens
tcctgtgccctcaccccaatcc

SEQ ID NO: 6421751 - DNA, 15 bp, Homo sapiens
tcctgtgccctgtgg

SEQ ID NO: 6421752 - DNA, 14 bp, Homo sapiens
tcctgtgccgtaag

SEQ ID NO: 6421753 - DNA, 20 bp, Homo sapiens
tcctgtgcctggccccagcc

SEQ ID NO: 6421754 - DNA, 19 bp, Homo sapiens
tcctgtgctaagtctttcc

SEQ ID NO: 6421755 - DNA, 12 bp, Homo sapiens
tcctgtgctaca

SEQ ID NO: 6421756 - DNA, 14 bp, Homo sapiens
tcctgtgctacaga

SEQ ID NO: 6421757 - DNA, 15 bp, Homo sapiens
tcctgtgctatttgt

SEQ ID NO: 6421758 - DNA, 21 bp, Homo sapiens
tcctgtgctatttgtacaaat

SEQ ID NO: 6421759 - DNA, 15 bp, Homo sapiens
tcctgtgctcagccc

SEQ ID NO: 6421760 - DNA, 12 bp, Homo sapiens
tcctgtgctggg

SEQ ID NO: 6421761 - DNA, 15 bp, Homo sapiens
tcctgtgcttatatt

SEQ ID NO: 6421762 - DNA, 13 bp, Homo sapiens
tcctgtgcttgct

SEQ ID NO: 6421763 - DNA, 17 bp, Homo sapiens
tcctgtgcttgcttaga

SEQ ID NO: 6421764 - DNA, 24 bp, Homo sapiens
tcctgtgcttgcttagagtgccca

SEQ ID NO: 6421765 - DNA, 13 bp, Homo sapiens
tcctgtggaaata

SEQ ID NO: 6421766 - DNA, 14 bp, Homo sapiens
tcctgtggaaatat

SEQ ID NO: 6421767 - DNA, 19 bp, Homo sapiens
tcctgtggaaatatgcaac

SEQ ID NO: 6421768 - DNA, 17 bp, Homo sapiens
tcctgtggaacccagca

SEQ ID NO: 6421769 - DNA, 21 bp, Homo sapiens
tcctgtggaaggcagagaaat

SEQ ID NO: 6421770 - DNA, 15 bp, Homo sapiens
tcctgtggaataaag

SEQ ID NO: 6421771 - DNA, 18 bp, Homo sapiens
tcctgtggaataaagatg

SEQ ID NO: 6421772 - DNA, 18 bp, Homo sapiens
tcctgtggagatgacttg

SEQ ID NO: 6421773 - DNA, 14 bp, Homo sapiens
tcctgtggcaggag

SEQ ID NO: 6421774 - DNA, 16 bp, Homo sapiens
tcctgtggcaggaggc

SEQ ID NO: 6421775 - DNA, 14 bp, Homo sapiens
tcctgtggcaggca

SEQ ID NO: 6421776 - DNA, 15 bp, Homo sapiens
tcctgtggcaggcag

SEQ ID NO: 6421777 - DNA, 19 bp, Homo sapiens
tcctgtggcataaattgca

SEQ ID NO: 6421778 - DNA, 17 bp, Homo sapiens
tcctgtggcctgccagt

SEQ ID NO: 6421779 - DNA, 16 bp, Homo sapiens
tcctgtggcctgctca

SEQ ID NO: 6421780 - DNA, 15 bp, Homo sapiens
tcctgtggctccctc

SEQ ID NO: 6421781 - DNA, 17 bp, Homo sapiens
tcctgtggctttgtttt

SEQ ID NO: 6421782 - DNA, 21 bp, Homo sapiens
tcctgtggctttgttttctta

SEQ ID NO: 6421783 - DNA, 19 bp, Homo sapiens
tcctgtgggacctgggcca

SEQ ID NO: 6421784 - DNA, 13 bp, Homo sapiens
tcctgtgggagcc

SEQ ID NO: 6421785 - DNA, 14 bp, Homo sapiens
tcctgtgggagcct

SEQ ID NO: 6421786 - DNA, 15 bp, Homo sapiens
tcctgtgggagcctc

SEQ ID NO: 6421787 - DNA, 18 bp, Homo sapiens
tcctgtgggccaggagct

SEQ ID NO: 6421788 - DNA, 22 bp, Homo sapiens
tcctgtgggccaggagctcagc

SEQ ID NO: 6421789 - DNA, 22 bp, Homo sapiens
tcctgtgggggaagagcacagc

SEQ ID NO: 6421790 - DNA, 18 bp, Homo sapiens
tcctgtggggttgttttt

SEQ ID NO: 6421791 - DNA, 20 bp, Homo sapiens
tcctgtgggtgttctttcct

SEQ ID NO: 6421792 - DNA, 20 bp, Homo sapiens
tcctgtggtagtcctcccaa

SEQ ID NO: 6421793 - DNA, 23 bp, Homo sapiens
tcctgtggtagtcctcccaagct

SEQ ID NO: 6421794 - DNA, 18 bp, Homo sapiens
tcctgtggttttattaca

SEQ ID NO: 6421795 - DNA, 14 bp, Homo sapiens
tcctgtgtaaatta

SEQ ID NO: 6421796 - DNA, 19 bp, Homo sapiens
tcctgtgtaacgactacaa

SEQ ID NO: 6421797 - DNA, 18 bp, Homo sapiens
tattaagacagtgtacaa

SEQ ID NO: 6421798 - DNA, 15 bp, Homo sapiens
tattaagagctattt

SEQ ID NO: 6421799 - DNA, 22 bp, Homo sapiens
tattaagaggcagaaaattgca

SEQ ID NO: 6421800 - DNA, 14 bp, Homo sapiens
tattaagagtgaaa

SEQ ID NO: 6421801 - DNA, 15 bp, Homo sapiens
tattaagatggattc

SEQ ID NO: 6421802 - DNA, 20 bp, Homo sapiens
tattaagatggattctcaga

SEQ ID NO: 6421803 - DNA, 18 bp, Homo sapiens
tattaagattataattgt

SEQ ID NO: 6421804 - DNA, 17 bp, Homo sapiens
tattaagattggaaatg

SEQ ID NO: 6421805 - DNA, 17 bp, Homo sapiens
tattaagatttccaagt

SEQ ID NO: 6421806 - DNA, 22 bp, Homo sapiens
tattaagcagaggatggaagta

SEQ ID NO: 6421807 - DNA, 15 bp, Homo sapiens
tattaagcatcagaa

SEQ ID NO: 6421808 - DNA, 19 bp, Homo sapiens
tattaagcctaccgtattt

SEQ ID NO: 6421809 - DNA, 21 bp, Homo sapiens
tattaagcctaccgtatttca

SEQ ID NO: 6421810 - DNA, 13 bp, Homo sapiens
tattaagcttttt

SEQ ID NO: 6421811 - DNA, 20 bp, Homo sapiens
tattaaggatgtagcttttc

SEQ ID NO: 6421812 - DNA, 15 bp, Homo sapiens
tattaagggcatttt

SEQ ID NO: 6421813 - DNA, 18 bp, Homo sapiens
tattaagggtaggatgtt

SEQ ID NO: 6421814 - DNA, 16 bp, Homo sapiens
tattaaggtgtggctt

SEQ ID NO: 6421815 - DNA, 16 bp, Homo sapiens
tattaagtaacttatt

SEQ ID NO: 6421816 - DNA, 20 bp, Homo sapiens
tattaagtgaaattttaaat

SEQ ID NO: 6421817 - DNA, 20 bp, Homo sapiens
tattaagtgcagcttgacat

SEQ ID NO: 6421818 - DNA, 19 bp, Homo sapiens
tattaataaacattctatc

SEQ ID NO: 6421819 - DNA, 13 bp, Homo sapiens
tattaataaagca

SEQ ID NO: 6421820 - DNA, 19 bp, Homo sapiens
tattaataaagcattcttt

SEQ ID NO: 6421821 - DNA, 17 bp, Homo sapiens
tattaataaatagagca

SEQ ID NO: 6421822 - DNA, 21 bp, Homo sapiens
tattaataaatagagcaatta

SEQ ID NO: 6421823 - DNA, 14 bp, Homo sapiens
tattaataccaaat

SEQ ID NO: 6421824 - DNA, 19 bp, Homo sapiens
tattaatagagaagtaaaa

SEQ ID NO: 6421825 - DNA, 17 bp, Homo sapiens
tattaatagtaatttgt

SEQ ID NO: 6421826 - DNA, 18 bp, Homo sapiens
tattaatataaaaacatt

SEQ ID NO: 6421827 - DNA, 21 bp, Homo sapiens
tattaatataataatgatgat

SEQ ID NO: 6421828 - DNA, 23 bp, Homo sapiens
tattaatatatattatcttttca

SEQ ID NO: 6421829 - DNA, 14 bp, Homo sapiens
tattaatatatgta

SEQ ID NO: 6421830 - DNA, 13 bp, Homo sapiens
tattaatattatt

SEQ ID NO: 6421831 - DNA, 12 bp, Homo sapiens
tattaatattta

SEQ ID NO: 6421832 - DNA, 19 bp, Homo sapiens
tattaatcaagagaaactt

SEQ ID NO: 6421833 - DNA, 23 bp, Homo sapiens
tattaatcactgtgtatatttga

SEQ ID NO: 6421834 - DNA, 14 bp, Homo sapiens
tattaatcattcca

SEQ ID NO: 6421835 - DNA, 15 bp, Homo sapiens
tattaatcattccat

SEQ ID NO: 6421836 - DNA, 20 bp, Homo sapiens
tattaatccccatcattact

SEQ ID NO: 6421837 - DNA, 16 bp, Homo sapiens
tattaatctactgtat

SEQ ID NO: 6421838 - DNA, 14 bp, Homo sapiens
tattaatctctgtg

SEQ ID NO: 6421839 - DNA, 12 bp, Homo sapiens
tattaatctgtt

SEQ ID NO: 6421840 - DNA, 18 bp, Homo sapiens
tattaatcttagtgtatg

SEQ ID NO: 6421841 - DNA, 20 bp, Homo sapiens
tattaatcttattgtttaat

SEQ ID NO: 6421842 - DNA, 14 bp, Homo sapiens
tattaatcttcagc

SEQ ID NO: 6421843 - DNA, 16 bp, Homo sapiens
tattaatcttggatag

SEQ ID NO: 6421844 - DNA, 22 bp, Homo sapiens
tattaatcttggatagctaata

SEQ ID NO: 6421845 - DNA, 13 bp, Homo sapiens
tattaatgaactg

SEQ ID NO: 6421846 - DNA, 15 bp, Homo sapiens
tattaatgaactgtg

SEQ ID NO: 6421847 - DNA, 18 bp, Homo sapiens
tattaatgaactgtgaca

SEQ ID NO: 6421848 - DNA, 19 bp, Homo sapiens
tattaatgaactgtgacag

SEQ ID NO: 6421849 - DNA, 16 bp, Homo sapiens
tattaatgaatgccca

SEQ ID NO: 6421850 - DNA, 18 bp, Homo sapiens
tattaatgaggtctttaa

SEQ ID NO: 6421851 - DNA, 13 bp, Homo sapiens
tattaatgcactt

SEQ ID NO: 6421852 - DNA, 17 bp, Homo sapiens
tattaatgcactttcta

SEQ ID NO: 6421853 - DNA, 22 bp, Homo sapiens
tattaatgcctttaaagtatga

SEQ ID NO: 6421854 - DNA, 15 bp, Homo sapiens
tattaatgcgatttc

SEQ ID NO: 6421855 - DNA, 12 bp, Homo sapiens
tattaatggcat

SEQ ID NO: 6421856 - DNA, 22 bp, Homo sapiens
tattaatgtctcactttacttt

SEQ ID NO: 6421857 - DNA, 16 bp, Homo sapiens
tattaatgtttcttct

SEQ ID NO: 6421858 - DNA, 12 bp, Homo sapiens
tattaattaaag

SEQ ID NO: 6421859 - DNA, 20 bp, Homo sapiens
tattaattataccagtgtta

SEQ ID NO: 6421860 - DNA, 14 bp, Homo sapiens
tattaattatttaa

SEQ ID NO: 6421861 - DNA, 17 bp, Homo sapiens
tattaattcttcacctg

SEQ ID NO: 6421862 - DNA, 13 bp, Homo sapiens
tattaattgcctg

SEQ ID NO: 6421863 - DNA, 13 bp, Homo sapiens
tattaattgcttt

SEQ ID NO: 6421864 - DNA, 19 bp, Homo sapiens
tattaattgtcctgtgtct

SEQ ID NO: 6421865 - DNA, 17 bp, Homo sapiens
tattaatttatgcagaa

SEQ ID NO: 6421866 - DNA, 14 bp, Homo sapiens
tattaatttattgg

SEQ ID NO: 6421867 - DNA, 16 bp, Homo sapiens
tattaatttgaaacca

SEQ ID NO: 6421868 - DNA, 19 bp, Homo sapiens
tattaattttcaggatttt

SEQ ID NO: 6421869 - DNA, 20 bp, Homo sapiens
tattaattttccaatgcaca

SEQ ID NO: 6421870 - DNA, 14 bp, Homo sapiens
tattacaaaaacaa

SEQ ID NO: 6421871 - DNA, 13 bp, Homo sapiens
tattacaaaacaa

SEQ ID NO: 6421872 - DNA, 15 bp, Homo sapiens
tattacaaatgcaaa

SEQ ID NO: 6421873 - DNA, 21 bp, Homo sapiens
tattacaaatgcaaatttcta

SEQ ID NO: 6421874 - DNA, 21 bp, Homo sapiens
tattacaataccgttaagata

SEQ ID NO: 6421875 - DNA, 15 bp, Homo sapiens
tattacaatgatcac

SEQ ID NO: 6421876 - DNA, 12 bp, Homo sapiens
tattacaatgta

SEQ ID NO: 6421877 - DNA, 15 bp, Homo sapiens
tattacaatgtatct

SEQ ID NO: 6421878 - DNA, 22 bp, Homo sapiens
tattacacctcagaaattgaaa

SEQ ID NO: 6421879 - DNA, 22 bp, Homo sapiens
tattacactgcctggaggatag

SEQ ID NO: 6421880 - DNA, 16 bp, Homo sapiens
tattacactgtaagaa

SEQ ID NO: 6421881 - DNA, 21 bp, Homo sapiens
tattacactgtatttgtatct

SEQ ID NO: 6421882 - DNA, 17 bp, Homo sapiens
tattacagataaaatgt

SEQ ID NO: 6421883 - DNA, 22 bp, Homo sapiens
tattacaggggcttgaacaaca

SEQ ID NO: 6421884 - DNA, 12 bp, Homo sapiens
tattacagtata

SEQ ID NO: 6421885 - DNA, 20 bp, Homo sapiens
tattacagtataattaacat

SEQ ID NO: 6421886 - DNA, 12 bp, Homo sapiens
tattacagtatt

SEQ ID NO: 6421887 - DNA, 23 bp, Homo sapiens
tattacagtggggaatgaagata

SEQ ID NO: 6421888 - DNA, 19 bp, Homo sapiens
tattacagtgtttatcctt

SEQ ID NO: 6421889 - DNA, 22 bp, Homo sapiens
tattacataaaggctaactatg

SEQ ID NO: 6421890 - DNA, 20 bp, Homo sapiens
tattacataactgatctatt

SEQ ID NO: 6421891 - DNA, 14 bp, Homo sapiens
tattacatagctct

SEQ ID NO: 6421892 - DNA, 18 bp, Homo sapiens
tattacatccttgtggca

SEQ ID NO: 6421893 - DNA, 23 bp, Homo sapiens
tattacatccttgtggcacattt

SEQ ID NO: 6421894 - DNA, 12 bp, Homo sapiens
tattacatcttt

SEQ ID NO: 6421895 - DNA, 13 bp, Homo sapiens
tattacatcttta

SEQ ID NO: 6421896 - DNA, 17 bp, Homo sapiens
tattacatctttcacat

SEQ ID NO: 6421897 - DNA, 19 bp, Homo sapiens
tattacatgactgtttctt

SEQ ID NO: 6421898 - DNA, 14 bp, Homo sapiens
tattacatttcatt

SEQ ID NO: 6421899 - DNA, 16 bp, Homo sapiens
tattacatttcattta

SEQ ID NO: 6421900 - DNA, 20 bp, Homo sapiens
tattacattttactgattaa

SEQ ID NO: 6421901 - DNA, 15 bp, Homo sapiens
tattacattttcagt

SEQ ID NO: 6421902 - DNA, 17 bp, Homo sapiens
tattaccaaaagtcaac

SEQ ID NO: 6421903 - DNA, 16 bp, Homo sapiens
tattaccagaaaatga

SEQ ID NO: 6421904 - DNA, 17 bp, Homo sapiens
tattaccagaaaatgag

SEQ ID NO: 6421905 - DNA, 23 bp, Homo sapiens
tattaccagattcacttctgaat

SEQ ID NO: 6421906 - DNA, 16 bp, Homo sapiens
tattaccagcaagaat

SEQ ID NO: 6421907 - DNA, 19 bp, Homo sapiens
tattaccagcaagaataaa

SEQ ID NO: 6421908 - DNA, 14 bp, Homo sapiens
tattaccagccccc

SEQ ID NO: 6421909 - DNA, 15 bp, Homo sapiens
tattaccatcttaat

SEQ ID NO: 6421910 - DNA, 18 bp, Homo sapiens
tattaccatcttaatctt

SEQ ID NO: 6421911 - DNA, 22 bp, Homo sapiens
tattaccatcttaatctttatt

SEQ ID NO: 6421912 - DNA, 14 bp, Homo sapiens
tattaccatgtaaa

SEQ ID NO: 6421913 - DNA, 19 bp, Homo sapiens
tattaccatgtaaataatc

SEQ ID NO: 6421914 - DNA, 18 bp, Homo sapiens
tattaccctcagaatatt

SEQ ID NO: 6421915 - DNA, 15 bp, Homo sapiens
tattacctattaggt

SEQ ID NO: 6421916 - DNA, 21 bp, Homo sapiens
tattacctattaggtggaaat

SEQ ID NO: 6421917 - DNA, 16 bp, Homo sapiens
tattacctcaggtgcc

SEQ ID NO: 6421918 - DNA, 11 bp, Homo sapiens
tattacctctg

SEQ ID NO: 6421919 - DNA, 21 bp, Homo sapiens
tattaccttccacttccatgt

SEQ ID NO: 6421920 - DNA, 16 bp, Homo sapiens
tattaccttctttcta

SEQ ID NO: 6421921 - DNA, 19 bp, Homo sapiens
tattacctttacatattat

SEQ ID NO: 6421922 - DNA, 16 bp, Homo sapiens
tattacgtatgtctgg

SEQ ID NO: 6421923 - DNA, 16 bp, Homo sapiens
tattactaattctatt

SEQ ID NO: 6421924 - DNA, 22 bp, Homo sapiens
tattactaattctatttctcta

SEQ ID NO: 6421925 - DNA, 23 bp, Homo sapiens
tattactacaaaaccgtttagtc

SEQ ID NO: 6421926 - DNA, 21 bp, Homo sapiens
tattactagtgtttaagtcat

SEQ ID NO: 6421927 - DNA, 18 bp, Homo sapiens
tattactctacactgaaa

SEQ ID NO: 6421928 - DNA, 14 bp, Homo sapiens
tattactctatgat

SEQ ID NO: 6421929 - DNA, 16 bp, Homo sapiens
tattactctgacataa

SEQ ID NO: 6421930 - DNA, 18 bp, Homo sapiens
tattactctgacataaac

SEQ ID NO: 6421931 - DNA, 22 bp, Homo sapiens
tattactcttcctctaacattt

SEQ ID NO: 6421932 - DNA, 19 bp, Homo sapiens
tattactgaataatatcaa

SEQ ID NO: 6421933 - DNA, 18 bp, Homo sapiens
tattactgacatttcttc

SEQ ID NO: 6421934 - DNA, 18 bp, Homo sapiens
tattactgatgtgtgcaa

SEQ ID NO: 6421935 - DNA, 15 bp, Homo sapiens
tattactgatttaga

SEQ ID NO: 6421936 - DNA, 18 bp, Homo sapiens
tattactgctgctgtgct

SEQ ID NO: 6421937 - DNA, 21 bp, Homo sapiens
tattactgcttgcagtaattc

SEQ ID NO: 6421938 - DNA, 16 bp, Homo sapiens
tattactggataaatt

SEQ ID NO: 6421939 - DNA, 22 bp, Homo sapiens
tattactggcgtggattaaact

SEQ ID NO: 6421940 - DNA, 18 bp, Homo sapiens
tattactgtctggtttta

SEQ ID NO: 6421941 - DNA, 23 bp, Homo sapiens
tattactgtctggttttaacaat

SEQ ID NO: 6421942 - DNA, 22 bp, Homo sapiens
tattactgtctttattcttatt

SEQ ID NO: 6421943 - DNA, 14 bp, Homo sapiens
tattactgtctttt

SEQ ID NO: 6421944 - DNA, 17 bp, Homo sapiens
tattactgttgcattta

SEQ ID NO: 6421945 - DNA, 19 bp, Homo sapiens
tattactgttgcatttact

SEQ ID NO: 6421946 - DNA, 20 bp, Homo sapiens
tattactgttgcatttactt

SEQ ID NO: 6421947 - DNA, 15 bp, Homo sapiens
tattactgtttatta

SEQ ID NO: 6421948 - DNA, 21 bp, Homo sapiens
tattactgtttgtcttctccc

SEQ ID NO: 6421949 - DNA, 19 bp, Homo sapiens
tattactgtttttgctatt

SEQ ID NO: 6421950 - DNA, 18 bp, Homo sapiens
tattacttaggttatttt

SEQ ID NO: 6421951 - DNA, 18 bp, Homo sapiens
tattacttccatgaattt

SEQ ID NO: 6421952 - DNA, 13 bp, Homo sapiens
tattacttctgct

SEQ ID NO: 6421953 - DNA, 14 bp, Homo sapiens
tattacttgaactt

SEQ ID NO: 6421954 - DNA, 17 bp, Homo sapiens
tattacttgcctatctg

SEQ ID NO: 6421955 - DNA, 20 bp, Homo sapiens
tattacttggcaaattctga

SEQ ID NO: 6421956 - DNA, 21 bp, Homo sapiens
tattacttgttgcaaaggtct

SEQ ID NO: 6421957 - DNA, 23 bp, Homo sapiens
tattactttatcactttttgaac

SEQ ID NO: 6421958 - DNA, 14 bp, Homo sapiens
tattactttctctg

SEQ ID NO: 6421959 - DNA, 16 bp, Homo sapiens
tattactttctctgta

SEQ ID NO: 6421960 - DNA, 15 bp, Homo sapiens
tattactttctgccg

SEQ ID NO: 6421961 - DNA, 23 bp, Homo sapiens
tattactttgtcttttcaatctt

SEQ ID NO: 6421962 - DNA, 13 bp, Homo sapiens
tattacttttcat

SEQ ID NO: 6421963 - DNA, 15 bp, Homo sapiens
tattacttttcatct

SEQ ID NO: 6421964 - DNA, 15 bp, Homo sapiens
tattacttttctgca

SEQ ID NO: 6421965 - DNA, 16 bp, Homo sapiens
tattacttttctgttt

SEQ ID NO: 6421966 - DNA, 15 bp, Homo sapiens
tattactttttttgt

SEQ ID NO: 6421967 - DNA, 19 bp, Homo sapiens
tattactttttttgtagat

SEQ ID NO: 6421968 - DNA, 18 bp, Homo sapiens
tattagaaagccatattt

SEQ ID NO: 6421969 - DNA, 14 bp, Homo sapiens
tattagaagccaag

SEQ ID NO: 6421970 - DNA, 12 bp, Homo sapiens
tattagaataat

SEQ ID NO: 6421971 - DNA, 15 bp, Homo sapiens
tattagaataccaca

SEQ ID NO: 6421972 - DNA, 22 bp, Homo sapiens
tattagaatcaaacattttgaa

SEQ ID NO: 6421973 - DNA, 13 bp, Homo sapiens
tattagacatcaa

SEQ ID NO: 6421974 - DNA, 23 bp, Homo sapiens
tattagacatcaatcctggtaac

SEQ ID NO: 6421975 - DNA, 14 bp, Homo sapiens
tattagactctcta

SEQ ID NO: 6421976 - DNA, 23 bp, Homo sapiens
tcctgtgtaatcatttcttgggc

SEQ ID NO: 6421977 - DNA, 19 bp, Homo sapiens
tcctgtgtattaaaccttt

SEQ ID NO: 6421978 - DNA, 15 bp, Homo sapiens
tcctgtgtattctca

SEQ ID NO: 6421979 - DNA, 16 bp, Homo sapiens
tcctgtgtcaatccag

SEQ ID NO: 6421980 - DNA, 20 bp, Homo sapiens
tcctgtgtcagaaaccctgg

SEQ ID NO: 6421981 - DNA, 14 bp, Homo sapiens
tcctgtgtcatctg

SEQ ID NO: 6421982 - DNA, 16 bp, Homo sapiens
tcctgtgtcatctgtc

SEQ ID NO: 6421983 - DNA, 22 bp, Homo sapiens
tcctgtgtcccctgacctgtcc

SEQ ID NO: 6421984 - DNA, 23 bp, Homo sapiens
tcctgtgtcccctgacctgtcca

SEQ ID NO: 6421985 - DNA, 12 bp, Homo sapiens
tcctgtgtcctg

SEQ ID NO: 6421986 - DNA, 21 bp, Homo sapiens
tcctgtgtcggggctgacctc

SEQ ID NO: 6421987 - DNA, 19 bp, Homo sapiens
tcctgtgtgattgacagct

SEQ ID NO: 6421988 - DNA, 14 bp, Homo sapiens
tcctgtgtggggag

SEQ ID NO: 6421989 - DNA, 16 bp, Homo sapiens
tcctgtgtggggaggc

SEQ ID NO: 6421990 - DNA, 18 bp, Homo sapiens
tcctgtgtgtctgcagac

SEQ ID NO: 6421991 - DNA, 13 bp, Homo sapiens
tcctgtgtgtgcg

SEQ ID NO: 6421992 - DNA, 18 bp, Homo sapiens
tcctgtgtgtgcgcctac

SEQ ID NO: 6421993 - DNA, 21 bp, Homo sapiens
tcctgtgtttgtcctgggttc

SEQ ID NO: 6421994 - DNA, 20 bp, Homo sapiens
tcctgttaaccctccacctc

SEQ ID NO: 6421995 - DNA, 15 bp, Homo sapiens
tcctgttaagagata

SEQ ID NO: 6421996 - DNA, 22 bp, Homo sapiens
tcctgttacttgcttctgctgt

SEQ ID NO: 6421997 - DNA, 14 bp, Homo sapiens
tcctgttaggccaa

SEQ ID NO: 6421998 - DNA, 22 bp, Homo sapiens
tcctgttaggccaactgcctcc

SEQ ID NO: 6421999 - DNA, 22 bp, Homo sapiens
tcctgttaggtattagaaagtg

SEQ ID NO: 6422000 - DNA, 14 bp, Homo sapiens
tcctgttcagcatt

SEQ ID NO: 6422001 - DNA, 16 bp, Homo sapiens
tcctgttcagcattct

SEQ ID NO: 6422002 - DNA, 15 bp, Homo sapiens
tcctgttcagtgaga

SEQ ID NO: 6422003 - DNA, 17 bp, Homo sapiens
tcctgttcatggggttt

SEQ ID NO: 6422004 - DNA, 21 bp, Homo sapiens
tcctgttccctcctggtcctg

SEQ ID NO: 6422005 - DNA, 22 bp, Homo sapiens
tcctgttccctcctggtcctgg

SEQ ID NO: 6422006 - DNA, 15 bp, Homo sapiens
tcctgttcctgcctt

SEQ ID NO: 6422007 - DNA, 12 bp, Homo sapiens
tcctgttctcag

SEQ ID NO: 6422008 - DNA, 14 bp, Homo sapiens
tcctgttctcttgt

SEQ ID NO: 6422009 - DNA, 15 bp, Homo sapiens
tcctgttctcttgta

SEQ ID NO: 6422010 - DNA, 12 bp, Homo sapiens
tcctgttctgaa

SEQ ID NO: 6422011 - DNA, 14 bp, Homo sapiens
tcctgttctgccca

SEQ ID NO: 6422012 - DNA, 15 bp, Homo sapiens
tcctgttctgcgctg

SEQ ID NO: 6422013 - DNA, 18 bp, Homo sapiens
tcctgttcttccttccta

SEQ ID NO: 6422014 - DNA, 22 bp, Homo sapiens
tcctgttgaaaagccatgttta

SEQ ID NO: 6422015 - DNA, 13 bp, Homo sapiens
tcctgttgacctt

SEQ ID NO: 6422016 - DNA, 22 bp, Homo sapiens
tcctgttgaccttcccacacaa

SEQ ID NO: 6422017 - DNA, 13 bp, Homo sapiens
tcctgttgcaccc

SEQ ID NO: 6422018 - DNA, 16 bp, Homo sapiens
tcctgttgcacccagc

SEQ ID NO: 6422019 - DNA, 19 bp, Homo sapiens
tcctgttgctgtcttcagt

SEQ ID NO: 6422020 - DNA, 21 bp, Homo sapiens
tcctgttggatttgtttaaaa

SEQ ID NO: 6422021 - DNA, 16 bp, Homo sapiens
tcctgttggctgctgc

SEQ ID NO: 6422022 - DNA, 16 bp, Homo sapiens
tcctgttggtttcatt

SEQ ID NO: 6422023 - DNA, 19 bp, Homo sapiens
tcctgttgttgttaatgaa

SEQ ID NO: 6422024 - DNA, 15 bp, Homo sapiens
tcctgttgttttctt

SEQ ID NO: 6422025 - DNA, 17 bp, Homo sapiens
tcctgtttataatctga

SEQ ID NO: 6422026 - DNA, 15 bp, Homo sapiens
tcctgtttattttta

SEQ ID NO: 6422027 - DNA, 16 bp, Homo sapiens
tcctgtttatttttaa

SEQ ID NO: 6422028 - DNA, 16 bp, Homo sapiens
tcctgtttcagaccag

SEQ ID NO: 6422029 - DNA, 18 bp, Homo sapiens
tcctgtttcagacccccc

SEQ ID NO: 6422030 - DNA, 14 bp, Homo sapiens
tcctgtttctaagt

SEQ ID NO: 6422031 - DNA, 18 bp, Homo sapiens
tcctgtttgaaatatcat

SEQ ID NO: 6422032 - DNA, 14 bp, Homo sapiens
tcctgtttgcaggc

SEQ ID NO: 6422033 - DNA, 18 bp, Homo sapiens
tcctgtttgggcccctct

SEQ ID NO: 6422034 - DNA, 15 bp, Homo sapiens
tcctgtttgtatttt

SEQ ID NO: 6422035 - DNA, 17 bp, Homo sapiens
tcctgtttgtctgatgt

SEQ ID NO: 6422036 - DNA, 17 bp, Homo sapiens
tcctgttttatatatta

SEQ ID NO: 6422037 - DNA, 20 bp, Homo sapiens
tcctgttttcacaccttaca

SEQ ID NO: 6422038 - DNA, 17 bp, Homo sapiens
tcctgttttcatggaca

SEQ ID NO: 6422039 - DNA, 23 bp, Homo sapiens
tcctgttttctaaaaaaaaaaac

SEQ ID NO: 6422040 - DNA, 14 bp, Homo sapiens
tcctgttttctaat

SEQ ID NO: 6422041 - DNA, 20 bp, Homo sapiens
tcctgtttttctgggtggcc

SEQ ID NO: 6422042 - DNA, 18 bp, Homo sapiens
tccttaaaaatgtatgtt

SEQ ID NO: 6422043 - DNA, 16 bp, Homo sapiens
tccttaaactgtgtgg

SEQ ID NO: 6422044 - DNA, 23 bp, Homo sapiens
tccttaaactgtgtggactgtga

SEQ ID NO: 6422045 - DNA, 21 bp, Homo sapiens
tccttaaatcttaatgttcct

SEQ ID NO: 6422046 - DNA, 12 bp, Homo sapiens
tccttaaatgaa

SEQ ID NO: 6422047 - DNA, 20 bp, Homo sapiens
tccttaaatgacttttctta

SEQ ID NO: 6422048 - DNA, 21 bp, Homo sapiens
tccttaaatgtctaacaacaa

SEQ ID NO: 6422049 - DNA, 19 bp, Homo sapiens
tccttaaatttttagccat

SEQ ID NO: 6422050 - DNA, 23 bp, Homo sapiens
tccttaacacctgatctggccca

SEQ ID NO: 6422051 - DNA, 19 bp, Homo sapiens
tccttaacagctgtattat

SEQ ID NO: 6422052 - DNA, 13 bp, Homo sapiens
tccttaacatttc

SEQ ID NO: 6422053 - DNA, 17 bp, Homo sapiens
tccttaacatttctctc

SEQ ID NO: 6422054 - DNA, 22 bp, Homo sapiens
tccttaaccaccgcatatgcat

SEQ ID NO: 6422055 - DNA, 19 bp, Homo sapiens
tccttaacccacctctcct

SEQ ID NO: 6422056 - DNA, 20 bp, Homo sapiens
tccttaacccacctctcctg

SEQ ID NO: 6422057 - DNA, 19 bp, Homo sapiens
tccttaacctccagcagac

SEQ ID NO: 6422058 - DNA, 20 bp, Homo sapiens
tccttaagagctatttgtgg

SEQ ID NO: 6422059 - DNA, 16 bp, Homo sapiens
tccttaagcagaggaa

SEQ ID NO: 6422060 - DNA, 14 bp, Homo sapiens
tccttaagcatctg

SEQ ID NO: 6422061 - DNA, 17 bp, Homo sapiens
tccttaatccagctgat

SEQ ID NO: 6422062 - DNA, 19 bp, Homo sapiens
tccttaatgaaaaatacat

SEQ ID NO: 6422063 - DNA, 20 bp, Homo sapiens
tccttaatggccttaattaa

SEQ ID NO: 6422064 - DNA, 17 bp, Homo sapiens
tccttaattcactccca

SEQ ID NO: 6422065 - DNA, 17 bp, Homo sapiens
tccttaatttaattgct

SEQ ID NO: 6422066 - DNA, 18 bp, Homo sapiens
tccttaatttaattgctt

SEQ ID NO: 6422067 - DNA, 16 bp, Homo sapiens
tccttaattttatatg

SEQ ID NO: 6422068 - DNA, 18 bp, Homo sapiens
tccttacaaatgattgct

SEQ ID NO: 6422069 - DNA, 14 bp, Homo sapiens
tccttacaatgtga

SEQ ID NO: 6422070 - DNA, 16 bp, Homo sapiens
tccttacaatgtgaat

SEQ ID NO: 6422071 - DNA, 20 bp, Homo sapiens
tccttaccagcagagcacct

SEQ ID NO: 6422072 - DNA, 14 bp, Homo sapiens
tccttacccatctg

SEQ ID NO: 6422073 - DNA, 18 bp, Homo sapiens
tccttacccatctgcacc

SEQ ID NO: 6422074 - DNA, 13 bp, Homo sapiens
tccttaccccagc

SEQ ID NO: 6422075 - DNA, 18 bp, Homo sapiens
tccttaccccagctgcgg

SEQ ID NO: 6422076 - DNA, 22 bp, Homo sapiens
tccttaccgtgggcactgaagg

SEQ ID NO: 6422077 - DNA, 18 bp, Homo sapiens
tccttacctcggggagag

SEQ ID NO: 6422078 - DNA, 14 bp, Homo sapiens
tccttacctctgga

SEQ ID NO: 6422079 - DNA, 15 bp, Homo sapiens
tccttacctctggaa

SEQ ID NO: 6422080 - DNA, 14 bp, Homo sapiens
tccttacctggagt

SEQ ID NO: 6422081 - DNA, 15 bp, Homo sapiens
tccttactagaaata

SEQ ID NO: 6422082 - DNA, 14 bp, Homo sapiens
tccttactcagagc

SEQ ID NO: 6422083 - DNA, 18 bp, Homo sapiens
tccttactcagagctgcg

SEQ ID NO: 6422084 - DNA, 16 bp, Homo sapiens
tccttactcctgtggg

SEQ ID NO: 6422085 - DNA, 16 bp, Homo sapiens
tccttactctgagccc

SEQ ID NO: 6422086 - DNA, 20 bp, Homo sapiens
tccttactctgagcccaggc

SEQ ID NO: 6422087 - DNA, 11 bp, Homo sapiens
tccttactgtg

SEQ ID NO: 6422088 - DNA, 12 bp, Homo sapiens
tccttactgtgc

SEQ ID NO: 6422089 - DNA, 14 bp, Homo sapiens
tccttactgtgcat

SEQ ID NO: 6422090 - DNA, 16 bp, Homo sapiens
tccttactgtgtttca

SEQ ID NO: 6422091 - DNA, 13 bp, Homo sapiens
tccttacttccag

SEQ ID NO: 6422092 - DNA, 14 bp, Homo sapiens
tccttacttgcact

SEQ ID NO: 6422093 - DNA, 15 bp, Homo sapiens
tccttacttttaagg

SEQ ID NO: 6422094 - DNA, 20 bp, Homo sapiens
tccttactttttatatatat

SEQ ID NO: 6422095 - DNA, 17 bp, Homo sapiens
tccttagaccttccata

SEQ ID NO: 6422096 - DNA, 18 bp, Homo sapiens
tccttagactcttttcct

SEQ ID NO: 6422097 - DNA, 19 bp, Homo sapiens
tccttagagacatcaaaat

SEQ ID NO: 6422098 - DNA, 20 bp, Homo sapiens
tccttagaggtcctctggag

SEQ ID NO: 6422099 - DNA, 17 bp, Homo sapiens
tccttagatctggcatg

SEQ ID NO: 6422100 - DNA, 16 bp, Homo sapiens
tccttagcaacagccg

SEQ ID NO: 6422101 - DNA, 17 bp, Homo sapiens
tccttagcaaggggctc

SEQ ID NO: 6422102 - DNA, 14 bp, Homo sapiens
tccttagcctggac

SEQ ID NO: 6422103 - DNA, 21 bp, Homo sapiens
tccttagcctggacctctgac

SEQ ID NO: 6422104 - DNA, 22 bp, Homo sapiens
tccttagcctggacctctgaca

SEQ ID NO: 6422105 - DNA, 13 bp, Homo sapiens
tccttagcctggg

SEQ ID NO: 6422106 - DNA, 14 bp, Homo sapiens
tccttagcctgggc

SEQ ID NO: 6422107 - DNA, 12 bp, Homo sapiens
tccttagctagt

SEQ ID NO: 6422108 - DNA, 21 bp, Homo sapiens
tccttagctatttatcccttt

SEQ ID NO: 6422109 - DNA, 22 bp, Homo sapiens
tccttagctatttatccctttc

SEQ ID NO: 6422110 - DNA, 16 bp, Homo sapiens
tccttagctgccaagc

SEQ ID NO: 6422111 - DNA, 22 bp, Homo sapiens
tccttaggagacgctgcacttg

SEQ ID NO: 6422112 - DNA, 24 bp, Homo sapiens
tccttaggcttacaatgtgcactg

SEQ ID NO: 6422113 - DNA, 14 bp, Homo sapiens
tccttaggttttct

SEQ ID NO: 6422114 - DNA, 15 bp, Homo sapiens
tccttaggttttctt

SEQ ID NO: 6422115 - DNA, 15 bp, Homo sapiens
tccttagtcttctca

SEQ ID NO: 6422116 - DNA, 14 bp, Homo sapiens
tccttagtggtaga

SEQ ID NO: 6422117 - DNA, 16 bp, Homo sapiens
tccttagttggctgga

SEQ ID NO: 6422118 - DNA, 14 bp, Homo sapiens
tccttataaaaatt

SEQ ID NO: 6422119 - DNA, 20 bp, Homo sapiens
tccttatagggaaaaatgca

SEQ ID NO: 6422120 - DNA, 14 bp, Homo sapiens
tccttatcaaagga

SEQ ID NO: 6422121 - DNA, 15 bp, Homo sapiens
tccttatcagagcta

SEQ ID NO: 6422122 - DNA, 22 bp, Homo sapiens
tccttatcagagctaagggtgg

SEQ ID NO: 6422123 - DNA, 22 bp, Homo sapiens
tccttatccctctcttcccctt

SEQ ID NO: 6422124 - DNA, 16 bp, Homo sapiens
tccttatcctagcctt

SEQ ID NO: 6422125 - DNA, 16 bp, Homo sapiens
tccttatctctttcca

SEQ ID NO: 6422126 - DNA, 12 bp, Homo sapiens
tccttatgcata

SEQ ID NO: 6422127 - DNA, 22 bp, Homo sapiens
tccttatgtatcagtgtccttt

SEQ ID NO: 6422128 - DNA, 16 bp, Homo sapiens
tccttatgtcctgtca

SEQ ID NO: 6422129 - DNA, 17 bp, Homo sapiens
tccttatgtgtgtagga

SEQ ID NO: 6422130 - DNA, 15 bp, Homo sapiens
tccttattatcccag

SEQ ID NO: 6422131 - DNA, 12 bp, Homo sapiens
tccttattcagc

SEQ ID NO: 6422132 - DNA, 19 bp, Homo sapiens
tccttattgaaaaatcagt

SEQ ID NO: 6422133 - DNA, 13 bp, Homo sapiens
tccttatttaaga

SEQ ID NO: 6422134 - DNA, 22 bp, Homo sapiens
tccttatttaagacatgtttaa

SEQ ID NO: 6422135 - DNA, 15 bp, Homo sapiens
tccttatttatatat

SEQ ID NO: 6422136 - DNA, 14 bp, Homo sapiens
tccttatttcaagg

SEQ ID NO: 6422137 - DNA, 19 bp, Homo sapiens
tccttatttctctctcctg

SEQ ID NO: 6422138 - DNA, 20 bp, Homo sapiens
tccttatttctctctcctgg

SEQ ID NO: 6422139 - DNA, 21 bp, Homo sapiens
tccttatttctctctcctggt

SEQ ID NO: 6422140 - DNA, 21 bp, Homo sapiens
tccttatttgccttctactcc

SEQ ID NO: 6422141 - DNA, 20 bp, Homo sapiens
tccttatttggcgtgacccg

SEQ ID NO: 6422142 - DNA, 15 bp, Homo sapiens
tccttatttttactt

SEQ ID NO: 6422143 - DNA, 19 bp, Homo sapiens
tccttatttttacttgtat

SEQ ID NO: 6422144 - DNA, 23 bp, Homo sapiens
tccttcaaaaagcaatctggaag

SEQ ID NO: 6422145 - DNA, 21 bp, Homo sapiens
tccttcaaagtttaataaatt

SEQ ID NO: 6422146 - DNA, 13 bp, Homo sapiens
tccttcaaataaa

SEQ ID NO: 6422147 - DNA, 18 bp, Homo sapiens
tccttcaacaattctaaa

SEQ ID NO: 6422148 - DNA, 23 bp, Homo sapiens
tccttcaattccatatatccttt

SEQ ID NO: 6422149 - DNA, 16 bp, Homo sapiens
tccttcaccaaagatc

SEQ ID NO: 6422150 - DNA, 23 bp, Homo sapiens
tccttcaccaaagatctgctcct

SEQ ID NO: 6422151 - DNA, 14 bp, Homo sapiens
tccttcaccacccc

SEQ ID NO: 6422152 - DNA, 15 bp, Homo sapiens
tccttcaccagagcc

SEQ ID NO: 6422153 - DNA, 20 bp, Homo sapiens
tccttcaccagagcccatgc

SEQ ID NO: 6422154 - DNA, 20 bp, Homo sapiens
tccttcacctttgtccccac

SEQ ID NO: 6422155 - DNA, 20 bp, Homo sapiens
tattagacttctgttttcaa

SEQ ID NO: 6422156 - DNA, 12 bp, Homo sapiens
tattagagaaga

SEQ ID NO: 6422157 - DNA, 18 bp, Homo sapiens
tattagagtatttccctt

SEQ ID NO: 6422158 - DNA, 21 bp, Homo sapiens
tattagagtgcccttaaaata

SEQ ID NO: 6422159 - DNA, 18 bp, Homo sapiens
tattagagtgtctttcca

SEQ ID NO: 6422160 - DNA, 17 bp, Homo sapiens
tattagataatattttt

SEQ ID NO: 6422161 - DNA, 21 bp, Homo sapiens
tattagatcccatatttactt

SEQ ID NO: 6422162 - DNA, 14 bp, Homo sapiens
tattagatgctctg

SEQ ID NO: 6422163 - DNA, 23 bp, Homo sapiens
tattagatgctctgagaaattga

SEQ ID NO: 6422164 - DNA, 13 bp, Homo sapiens
tattagatgtgat

SEQ ID NO: 6422165 - DNA, 14 bp, Homo sapiens
tattagatgttctc

SEQ ID NO: 6422166 - DNA, 17 bp, Homo sapiens
tattagatgttctctat

SEQ ID NO: 6422167 - DNA, 18 bp, Homo sapiens
tattagattttcctcctt

SEQ ID NO: 6422168 - DNA, 15 bp, Homo sapiens
tattagcaactgtgc

SEQ ID NO: 6422169 - DNA, 16 bp, Homo sapiens
tattagcagcaaaaca

SEQ ID NO: 6422170 - DNA, 20 bp, Homo sapiens
tattagcattctgaaagaag

SEQ ID NO: 6422171 - DNA, 13 bp, Homo sapiens
tattagcatttgt

SEQ ID NO: 6422172 - DNA, 15 bp, Homo sapiens
tattagcatttgttt

SEQ ID NO: 6422173 - DNA, 13 bp, Homo sapiens
tattagccaactg

SEQ ID NO: 6422174 - DNA, 23 bp, Homo sapiens
tattagccaggatcatggtgtaa

SEQ ID NO: 6422175 - DNA, 22 bp, Homo sapiens
tattagccctgcattttcatag

SEQ ID NO: 6422176 - DNA, 21 bp, Homo sapiens
tattagcgacaacagattgga

SEQ ID NO: 6422177 - DNA, 22 bp, Homo sapiens
tattagctgtaaatacatgtgt

SEQ ID NO: 6422178 - DNA, 18 bp, Homo sapiens
tattaggaaaagatattt

SEQ ID NO: 6422179 - DNA, 19 bp, Homo sapiens
tattaggaaaagatatttt

SEQ ID NO: 6422180 - DNA, 17 bp, Homo sapiens
tattaggaaaataaaca

SEQ ID NO: 6422181 - DNA, 15 bp, Homo sapiens
tattaggagtaattc

SEQ ID NO: 6422182 - DNA, 16 bp, Homo sapiens
tattaggataatacat

SEQ ID NO: 6422183 - DNA, 18 bp, Homo sapiens
tattaggccagttgaagt

SEQ ID NO: 6422184 - DNA, 22 bp, Homo sapiens
tattaggctataagaagtagca

SEQ ID NO: 6422185 - DNA, 17 bp, Homo sapiens
tattaggggtaatatat

SEQ ID NO: 6422186 - DNA, 15 bp, Homo sapiens
tattaggtggaaatt

SEQ ID NO: 6422187 - DNA, 15 bp, Homo sapiens
tattagtaaaagatg

SEQ ID NO: 6422188 - DNA, 22 bp, Homo sapiens
tattagtaggttttttttattt

SEQ ID NO: 6422189 - DNA, 15 bp, Homo sapiens
tattagtattgttgt

SEQ ID NO: 6422190 - DNA, 16 bp, Homo sapiens
tattagtattgttgtc

SEQ ID NO: 6422191 - DNA, 21 bp, Homo sapiens
tattagtattgttgtcctttt

SEQ ID NO: 6422192 - DNA, 21 bp, Homo sapiens
tattagtgaagatggtttcaa

SEQ ID NO: 6422193 - DNA, 19 bp, Homo sapiens
tattagtgacctcagcttt

SEQ ID NO: 6422194 - DNA, 20 bp, Homo sapiens
tattagtgatatttctctag

SEQ ID NO: 6422195 - DNA, 16 bp, Homo sapiens
tattagtgatgtcatc

SEQ ID NO: 6422196 - DNA, 14 bp, Homo sapiens
tattagtgattctg

SEQ ID NO: 6422197 - DNA, 16 bp, Homo sapiens
tattagtgctttgcca

SEQ ID NO: 6422198 - DNA, 16 bp, Homo sapiens
tattagtggaaagtga

SEQ ID NO: 6422199 - DNA, 22 bp, Homo sapiens
tattagtggtttatcagcaaaa

SEQ ID NO: 6422200 - DNA, 16 bp, Homo sapiens
tattagtgtatgcttt

SEQ ID NO: 6422201 - DNA, 14 bp, Homo sapiens
tattagtgttatat

SEQ ID NO: 6422202 - DNA, 21 bp, Homo sapiens
tattagttaggtgtgccaaac

SEQ ID NO: 6422203 - DNA, 18 bp, Homo sapiens
tattagttgccaatatgc

SEQ ID NO: 6422204 - DNA, 13 bp, Homo sapiens
tattagttgcttt

SEQ ID NO: 6422205 - DNA, 14 bp, Homo sapiens
tattagttgctttg

SEQ ID NO: 6422206 - DNA, 21 bp, Homo sapiens
tattagtttgatttaatatct

SEQ ID NO: 6422207 - DNA, 22 bp, Homo sapiens
tattagtttgatttaatatctg

SEQ ID NO: 6422208 - DNA, 20 bp, Homo sapiens
tattagtttgttatgtgtgt

SEQ ID NO: 6422209 - DNA, 19 bp, Homo sapiens
tattagttttctgtatatg

SEQ ID NO: 6422210 - DNA, 20 bp, Homo sapiens
tattagttttctttgtaaag

SEQ ID NO: 6422211 - DNA, 13 bp, Homo sapiens
tattataaaaata

SEQ ID NO: 6422212 - DNA, 12 bp, Homo sapiens
tattataaaagc

SEQ ID NO: 6422213 - DNA, 14 bp, Homo sapiens
tattataaactata

SEQ ID NO: 6422214 - DNA, 18 bp, Homo sapiens
tattataaagcttaaatt

SEQ ID NO: 6422215 - DNA, 16 bp, Homo sapiens
tattataaaggataaa

SEQ ID NO: 6422216 - DNA, 18 bp, Homo sapiens
tattataaaggataaaga

SEQ ID NO: 6422217 - DNA, 13 bp, Homo sapiens
tattataaataaa

SEQ ID NO: 6422218 - DNA, 22 bp, Homo sapiens
tattataaatatatataaagaa

SEQ ID NO: 6422219 - DNA, 23 bp, Homo sapiens
tattataaatatatataaagaat

SEQ ID NO: 6422220 - DNA, 14 bp, Homo sapiens
tattataaatgtta

SEQ ID NO: 6422221 - DNA, 20 bp, Homo sapiens
tattataaattatgtttata

SEQ ID NO: 6422222 - DNA, 21 bp, Homo sapiens
tattataaattctactaagtt

SEQ ID NO: 6422223 - DNA, 20 bp, Homo sapiens
tattataaattgtgtattta

SEQ ID NO: 6422224 - DNA, 15 bp, Homo sapiens
tattataactgcata

SEQ ID NO: 6422225 - DNA, 15 bp, Homo sapiens
tattataacttaaaa

SEQ ID NO: 6422226 - DNA, 20 bp, Homo sapiens
tattataagcattgaaatta

SEQ ID NO: 6422227 - DNA, 21 bp, Homo sapiens
tattataagggagagctgagc

SEQ ID NO: 6422228 - DNA, 12 bp, Homo sapiens
tattataagttg

SEQ ID NO: 6422229 - DNA, 21 bp, Homo sapiens
tattataatactaaaactcag

SEQ ID NO: 6422230 - DNA, 14 bp, Homo sapiens
tattataatcttat

SEQ ID NO: 6422231 - DNA, 14 bp, Homo sapiens
tattataattgtat

SEQ ID NO: 6422232 - DNA, 20 bp, Homo sapiens
tattataccagatgaacatt

SEQ ID NO: 6422233 - DNA, 15 bp, Homo sapiens
tattatactaagaaa

SEQ ID NO: 6422234 - DNA, 13 bp, Homo sapiens
tattatactgtat

SEQ ID NO: 6422235 - DNA, 15 bp, Homo sapiens
tattatactgtatta

SEQ ID NO: 6422236 - DNA, 19 bp, Homo sapiens
tattatactgtattaagag

SEQ ID NO: 6422237 - DNA, 12 bp, Homo sapiens
tattatagaaaa

SEQ ID NO: 6422238 - DNA, 12 bp, Homo sapiens
tattatagaaat

SEQ ID NO: 6422239 - DNA, 16 bp, Homo sapiens
tattatagaaattctg

SEQ ID NO: 6422240 - DNA, 18 bp, Homo sapiens
tattatagacaaaagaat

SEQ ID NO: 6422241 - DNA, 19 bp, Homo sapiens
tattatagagcagaaattc

SEQ ID NO: 6422242 - DNA, 22 bp, Homo sapiens
tattatagagcagaaattctgt

SEQ ID NO: 6422243 - DNA, 15 bp, Homo sapiens
tattatagatataaa

SEQ ID NO: 6422244 - DNA, 17 bp, Homo sapiens
tattatagtctgtactt

SEQ ID NO: 6422245 - DNA, 21 bp, Homo sapiens
tattatagtctgtacttcagt

SEQ ID NO: 6422246 - DNA, 18 bp, Homo sapiens
tattatagttattcaaat

SEQ ID NO: 6422247 - DNA, 15 bp, Homo sapiens
tattatataaactgt

SEQ ID NO: 6422248 - DNA, 14 bp, Homo sapiens
tattatatatacat

SEQ ID NO: 6422249 - DNA, 14 bp, Homo sapiens
tattatatatactt

SEQ ID NO: 6422250 - DNA, 14 bp, Homo sapiens
tattatatatagaa

SEQ ID NO: 6422251 - DNA, 16 bp, Homo sapiens
tattatatatataata

SEQ ID NO: 6422252 - DNA, 13 bp, Homo sapiens
tattatatatatc

SEQ ID NO: 6422253 - DNA, 22 bp, Homo sapiens
tattatatatatctatatcata

SEQ ID NO: 6422254 - DNA, 22 bp, Homo sapiens
tattatatatgtatatctgtgt

SEQ ID NO: 6422255 - DNA, 12 bp, Homo sapiens
tattatatattt

SEQ ID NO: 6422256 - DNA, 15 bp, Homo sapiens
tattatatatttaca

SEQ ID NO: 6422257 - DNA, 17 bp, Homo sapiens
tattatatcagcttttc

SEQ ID NO: 6422258 - DNA, 12 bp, Homo sapiens
tattatatggaa

SEQ ID NO: 6422259 - DNA, 13 bp, Homo sapiens
tattatatggaaa

SEQ ID NO: 6422260 - DNA, 13 bp, Homo sapiens
tattatattcatt

SEQ ID NO: 6422261 - DNA, 23 bp, Homo sapiens
tattatattcattctttttgaaa

SEQ ID NO: 6422262 - DNA, 13 bp, Homo sapiens
tattatattgttt

SEQ ID NO: 6422263 - DNA, 14 bp, Homo sapiens
tattatatttcttt

SEQ ID NO: 6422264 - DNA, 14 bp, Homo sapiens
tattatatttggat

SEQ ID NO: 6422265 - DNA, 15 bp, Homo sapiens
tattatatttggatg

SEQ ID NO: 6422266 - DNA, 16 bp, Homo sapiens
tattatatttggatgc

SEQ ID NO: 6422267 - DNA, 15 bp, Homo sapiens
tattatcaacaatag

SEQ ID NO: 6422268 - DNA, 16 bp, Homo sapiens
tattatcaagtagact

SEQ ID NO: 6422269 - DNA, 22 bp, Homo sapiens
tattatcaagtagactactgtt

SEQ ID NO: 6422270 - DNA, 18 bp, Homo sapiens
tattatcagacaagatga

SEQ ID NO: 6422271 - DNA, 20 bp, Homo sapiens
tattatcaggggagaaaaat

SEQ ID NO: 6422272 - DNA, 18 bp, Homo sapiens
tattatcagtgaatataa

SEQ ID NO: 6422273 - DNA, 23 bp, Homo sapiens
tattatcagttaaaatcacattt

SEQ ID NO: 6422274 - DNA, 17 bp, Homo sapiens
tattatcatatatgctt

SEQ ID NO: 6422275 - DNA, 20 bp, Homo sapiens
tattatcatcctataaagaa

SEQ ID NO: 6422276 - DNA, 13 bp, Homo sapiens
tattatcatttct

SEQ ID NO: 6422277 - DNA, 15 bp, Homo sapiens
tattatcccagctgc

SEQ ID NO: 6422278 - DNA, 16 bp, Homo sapiens
tattatccccatttct

SEQ ID NO: 6422279 - DNA, 21 bp, Homo sapiens
tattatcctagattatatcaa

SEQ ID NO: 6422280 - DNA, 23 bp, Homo sapiens
tattatcctagattatatcaaag

SEQ ID NO: 6422281 - DNA, 22 bp, Homo sapiens
tattatcctcctgttctgaaac

SEQ ID NO: 6422282 - DNA, 13 bp, Homo sapiens
tattatcctgcat

SEQ ID NO: 6422283 - DNA, 16 bp, Homo sapiens
tattatccttcacaat

SEQ ID NO: 6422284 - DNA, 16 bp, Homo sapiens
tattatctaaatgaat

SEQ ID NO: 6422285 - DNA, 16 bp, Homo sapiens
tattatctatggaaat

SEQ ID NO: 6422286 - DNA, 14 bp, Homo sapiens
tattatctgggctt

SEQ ID NO: 6422287 - DNA, 17 bp, Homo sapiens
tattatctgtaaaaatt

SEQ ID NO: 6422288 - DNA, 14 bp, Homo sapiens
tattatctgtcagc

SEQ ID NO: 6422289 - DNA, 18 bp, Homo sapiens
tattatcttacttgcaaa

SEQ ID NO: 6422290 - DNA, 21 bp, Homo sapiens
tattatcttgttcaggaaaag

SEQ ID NO: 6422291 - DNA, 19 bp, Homo sapiens
tattatctttgttctccta

SEQ ID NO: 6422292 - DNA, 12 bp, Homo sapiens
tattatcttttc

SEQ ID NO: 6422293 - DNA, 16 bp, Homo sapiens
tattatgaaaaagatt

SEQ ID NO: 6422294 - DNA, 21 bp, Homo sapiens
tattatgaaaattaagattat

SEQ ID NO: 6422295 - DNA, 21 bp, Homo sapiens
tattatgaaacttgtgtaaat

SEQ ID NO: 6422296 - DNA, 17 bp, Homo sapiens
tattatgaaatttcact

SEQ ID NO: 6422297 - DNA, 19 bp, Homo sapiens
tattatgaaggaatttgat

SEQ ID NO: 6422298 - DNA, 22 bp, Homo sapiens
tattatgaaggaatttgattgc

SEQ ID NO: 6422299 - DNA, 13 bp, Homo sapiens
tattatgaataaa

SEQ ID NO: 6422300 - DNA, 22 bp, Homo sapiens
tattatgaatgtgaagccttcc

SEQ ID NO: 6422301 - DNA, 19 bp, Homo sapiens
tattatgacaaatgaaaga

SEQ ID NO: 6422302 - DNA, 23 bp, Homo sapiens
tattatgacaaatgaaagagaaa

SEQ ID NO: 6422303 - DNA, 20 bp, Homo sapiens
tattatgaggctattaaaag

SEQ ID NO: 6422304 - DNA, 19 bp, Homo sapiens
tattatgatctctgctttg

SEQ ID NO: 6422305 - DNA, 14 bp, Homo sapiens
tattatgcaaagta

SEQ ID NO: 6422306 - DNA, 15 bp, Homo sapiens
tattatgcaaattcc

SEQ ID NO: 6422307 - DNA, 16 bp, Homo sapiens
tattatgcaaattccc

SEQ ID NO: 6422308 - DNA, 12 bp, Homo sapiens
tattatgcaaca

SEQ ID NO: 6422309 - DNA, 13 bp, Homo sapiens
tattatgcataaa

SEQ ID NO: 6422310 - DNA, 12 bp, Homo sapiens
tattatgctacc

SEQ ID NO: 6422311 - DNA, 15 bp, Homo sapiens
tattatggaaaacat

SEQ ID NO: 6422312 - DNA, 21 bp, Homo sapiens
tattatggaagattttaaatt

SEQ ID NO: 6422313 - DNA, 15 bp, Homo sapiens
tattatggaattact

SEQ ID NO: 6422314 - DNA, 19 bp, Homo sapiens
tattatggcttgtgaactg

SEQ ID NO: 6422315 - DNA, 22 bp, Homo sapiens
tattatggcttgtgaactgctg

SEQ ID NO: 6422316 - DNA, 14 bp, Homo sapiens
tattatgtaaatat

SEQ ID NO: 6422317 - DNA, 15 bp, Homo sapiens
tattatgtaaatccc

SEQ ID NO: 6422318 - DNA, 18 bp, Homo sapiens
tattatgtaacatccaga

SEQ ID NO: 6422319 - DNA, 18 bp, Homo sapiens
tattatgtaggtaagact

SEQ ID NO: 6422320 - DNA, 12 bp, Homo sapiens
tattatgtataa

SEQ ID NO: 6422321 - DNA, 14 bp, Homo sapiens
tattatgtatagaa

SEQ ID NO: 6422322 - DNA, 19 bp, Homo sapiens
tattatgtcctgtgagatg

SEQ ID NO: 6422323 - DNA, 21 bp, Homo sapiens
tattatgtcctgtgagatgtg

SEQ ID NO: 6422324 - DNA, 16 bp, Homo sapiens
tattatgtgcaacatt

SEQ ID NO: 6422325 - DNA, 17 bp, Homo sapiens
tattatgtgcctaattt

SEQ ID NO: 6422326 - DNA, 17 bp, Homo sapiens
tattatgttatgaaaac

SEQ ID NO: 6422327 - DNA, 13 bp, Homo sapiens
tattatgttctta

SEQ ID NO: 6422328 - DNA, 16 bp, Homo sapiens
tattatgtttattaca

SEQ ID NO: 6422329 - DNA, 17 bp, Homo sapiens
tattatgtttattacaa

SEQ ID NO: 6422330 - DNA, 20 bp, Homo sapiens
tattatgtttattacaattt

SEQ ID NO: 6422331 - DNA, 14 bp, Homo sapiens
tattattaaagtct

SEQ ID NO: 6422332 - DNA, 16 bp, Homo sapiens
tattattaataatgaa

SEQ ID NO: 6422333 - DNA, 11 bp, Homo sapiens
tattattaatg

SEQ ID NO: 6422334 - DNA, 15 bp, Homo sapiens
tattattaatgcttt

SEQ ID NO: 6422335 - DNA, 20 bp, Homo sapiens
tccttcactctaaaaataga

SEQ ID NO: 6422336 - DNA, 12 bp, Homo sapiens
tccttcactgcc

SEQ ID NO: 6422337 - DNA, 13 bp, Homo sapiens
tccttcactgctc

SEQ ID NO: 6422338 - DNA, 20 bp, Homo sapiens
tccttcactgttccctctgg

SEQ ID NO: 6422339 - DNA, 14 bp, Homo sapiens
tccttcagatattt

SEQ ID NO: 6422340 - DNA, 17 bp, Homo sapiens
tccttcagcaatcctta

SEQ ID NO: 6422341 - DNA, 12 bp, Homo sapiens
tccttcagcacg

SEQ ID NO: 6422342 - DNA, 18 bp, Homo sapiens
tccttcagcactttagaa

SEQ ID NO: 6422343 - DNA, 21 bp, Homo sapiens
tccttcagcatctcacttctt

SEQ ID NO: 6422344 - DNA, 13 bp, Homo sapiens
tccttcagccctc

SEQ ID NO: 6422345 - DNA, 14 bp, Homo sapiens
tccttcagccctca

SEQ ID NO: 6422346 - DNA, 20 bp, Homo sapiens
tccttcagctgactccagta

SEQ ID NO: 6422347 - DNA, 12 bp, Homo sapiens
tccttcaggcag

SEQ ID NO: 6422348 - DNA, 16 bp, Homo sapiens
tccttcaggcagctga

SEQ ID NO: 6422349 - DNA, 20 bp, Homo sapiens
tccttcaggcagctgaaatt

SEQ ID NO: 6422350 - DNA, 18 bp, Homo sapiens
tccttcagggtgatgcca

SEQ ID NO: 6422351 - DNA, 23 bp, Homo sapiens
tccttcagggtgatgccaggttc

SEQ ID NO: 6422352 - DNA, 12 bp, Homo sapiens
tccttcaggttt

SEQ ID NO: 6422353 - DNA, 14 bp, Homo sapiens
tccttcagtcactc

SEQ ID NO: 6422354 - DNA, 19 bp, Homo sapiens
tccttcagtgagcccctcc

SEQ ID NO: 6422355 - DNA, 20 bp, Homo sapiens
tccttcagtgagcccctccc

SEQ ID NO: 6422356 - DNA, 17 bp, Homo sapiens
tccttcagtgccttatg

SEQ ID NO: 6422357 - DNA, 22 bp, Homo sapiens
tccttcagtgccttatggaaca

SEQ ID NO: 6422358 - DNA, 18 bp, Homo sapiens
tccttcagttctgcttgc

SEQ ID NO: 6422359 - DNA, 21 bp, Homo sapiens
tccttcagttctgcttgctcc

SEQ ID NO: 6422360 - DNA, 14 bp, Homo sapiens
tccttcagtttgaa

SEQ ID NO: 6422361 - DNA, 16 bp, Homo sapiens
tccttcataattttca

SEQ ID NO: 6422362 - DNA, 18 bp, Homo sapiens
tccttcataattttcaaa

SEQ ID NO: 6422363 - DNA, 21 bp, Homo sapiens
tccttcatcgaacaaactgat

SEQ ID NO: 6422364 - DNA, 20 bp, Homo sapiens
tccttcatcttttaaagaaa

SEQ ID NO: 6422365 - DNA, 19 bp, Homo sapiens
tccttcatgacagcctcca

SEQ ID NO: 6422366 - DNA, 15 bp, Homo sapiens
tccttcatgcttttc

SEQ ID NO: 6422367 - DNA, 15 bp, Homo sapiens
tccttcattcatagg

SEQ ID NO: 6422368 - DNA, 19 bp, Homo sapiens
tccttcattccgttaggaa

SEQ ID NO: 6422369 - DNA, 17 bp, Homo sapiens
tccttccaaaaaattaa

SEQ ID NO: 6422370 - DNA, 18 bp, Homo sapiens
tccttccaaaaattatta

SEQ ID NO: 6422371 - DNA, 19 bp, Homo sapiens
tccttccaaaaattattat

SEQ ID NO: 6422372 - DNA, 21 bp, Homo sapiens
tccttccaaggtcactcttgg

SEQ ID NO: 6422373 - DNA, 19 bp, Homo sapiens
tccttccaagtcttcctga

SEQ ID NO: 6422374 - DNA, 20 bp, Homo sapiens
tccttccaatgtctggagac

SEQ ID NO: 6422375 - DNA, 17 bp, Homo sapiens
tccttccacagttatct

SEQ ID NO: 6422376 - DNA, 12 bp, Homo sapiens
tccttccactgt

SEQ ID NO: 6422377 - DNA, 15 bp, Homo sapiens
tccttccagcccaga

SEQ ID NO: 6422378 - DNA, 14 bp, Homo sapiens
tccttccagcccat

SEQ ID NO: 6422379 - DNA, 16 bp, Homo sapiens
tccttccagcccatcc

SEQ ID NO: 6422380 - DNA, 12 bp, Homo sapiens
tccttccagcct

SEQ ID NO: 6422381 - DNA, 19 bp, Homo sapiens
tccttccagcctgagatgt

SEQ ID NO: 6422382 - DNA, 13 bp, Homo sapiens
tccttccaggccc

SEQ ID NO: 6422383 - DNA, 16 bp, Homo sapiens
tccttccaggccccag

SEQ ID NO: 6422384 - DNA, 22 bp, Homo sapiens
tccttccaggccccaggctgga

SEQ ID NO: 6422385 - DNA, 16 bp, Homo sapiens
tccttccaggccccca

SEQ ID NO: 6422386 - DNA, 21 bp, Homo sapiens
tccttccaggcccccaccact

SEQ ID NO: 6422387 - DNA, 19 bp, Homo sapiens
tccttccagggctcttcca

SEQ ID NO: 6422388 - DNA, 15 bp, Homo sapiens
tccttccagtataac

SEQ ID NO: 6422389 - DNA, 18 bp, Homo sapiens
tccttccagtataaccag

SEQ ID NO: 6422390 - DNA, 19 bp, Homo sapiens
tccttccatatccctgccc

SEQ ID NO: 6422391 - DNA, 15 bp, Homo sapiens
tccttccatcaaata

SEQ ID NO: 6422392 - DNA, 16 bp, Homo sapiens
tccttccatccctacc

SEQ ID NO: 6422393 - DNA, 12 bp, Homo sapiens
tccttccatcct

SEQ ID NO: 6422394 - DNA, 22 bp, Homo sapiens
tccttccatctagcagctggcc

SEQ ID NO: 6422395 - DNA, 16 bp, Homo sapiens
tccttccatctgcctg

SEQ ID NO: 6422396 - DNA, 17 bp, Homo sapiens
tccttccatcttgtggg

SEQ ID NO: 6422397 - DNA, 22 bp, Homo sapiens
tccttccatcttgtggggccag

SEQ ID NO: 6422398 - DNA, 14 bp, Homo sapiens
tccttccatgctcc

SEQ ID NO: 6422399 - DNA, 13 bp, Homo sapiens
tccttccattcca

SEQ ID NO: 6422400 - DNA, 22 bp, Homo sapiens
tccttcccaactcactgtgctc

SEQ ID NO: 6422401 - DNA, 13 bp, Homo sapiens
tccttcccaaggc

SEQ ID NO: 6422402 - DNA, 16 bp, Homo sapiens
tccttcccaaggcagc

SEQ ID NO: 6422403 - DNA, 14 bp, Homo sapiens
tccttcccacccct

SEQ ID NO: 6422404 - DNA, 23 bp, Homo sapiens
tccttcccacccctacacacaca

SEQ ID NO: 6422405 - DNA, 17 bp, Homo sapiens
tccttcccactgtcctt

SEQ ID NO: 6422406 - DNA, 18 bp, Homo sapiens
tccttcccactgtccttt

SEQ ID NO: 6422407 - DNA, 21 bp, Homo sapiens
tccttcccagaatgttactga

SEQ ID NO: 6422408 - DNA, 22 bp, Homo sapiens
tccttcccagaggggcctgcca

SEQ ID NO: 6422409 - DNA, 14 bp, Homo sapiens
tccttcccagctgc

SEQ ID NO: 6422410 - DNA, 15 bp, Homo sapiens
tccttcccaggccct

SEQ ID NO: 6422411 - DNA, 18 bp, Homo sapiens
tccttcccaggccctttg

SEQ ID NO: 6422412 - DNA, 15 bp, Homo sapiens
tccttcccatgcctg

SEQ ID NO: 6422413 - DNA, 18 bp, Homo sapiens
tccttcccattggctttc

SEQ ID NO: 6422414 - DNA, 23 bp, Homo sapiens
tccttccccaacttccctagtcc

SEQ ID NO: 6422415 - DNA, 15 bp, Homo sapiens
tccttccccagaccc

SEQ ID NO: 6422416 - DNA, 15 bp, Homo sapiens
tccttccccagctcc

SEQ ID NO: 6422417 - DNA, 23 bp, Homo sapiens
tccttccccagctcccccaggca

SEQ ID NO: 6422418 - DNA, 12 bp, Homo sapiens
tccttccccagg

SEQ ID NO: 6422419 - DNA, 14 bp, Homo sapiens
tccttccccaggat

SEQ ID NO: 6422420 - DNA, 13 bp, Homo sapiens
tccttcccccagc

SEQ ID NO: 6422421 - DNA, 22 bp, Homo sapiens
tccttcccccagcccaataaag

SEQ ID NO: 6422422 - DNA, 18 bp, Homo sapiens
tccttccccccatctctg

SEQ ID NO: 6422423 - DNA, 21 bp, Homo sapiens
tccttccccctcactgaagct

SEQ ID NO: 6422424 - DNA, 19 bp, Homo sapiens
tccttcccctgcacctggc

SEQ ID NO: 6422425 - DNA, 21 bp, Homo sapiens
tccttcccctgcacctggcct

SEQ ID NO: 6422426 - DNA, 20 bp, Homo sapiens
tccttccccttgtccctggg

SEQ ID NO: 6422427 - DNA, 24 bp, Homo sapiens
tccttccccttgtccctggggcac

SEQ ID NO: 6422428 - DNA, 12 bp, Homo sapiens
tccttcccgcag

SEQ ID NO: 6422429 - DNA, 14 bp, Homo sapiens
tccttcccgcagca

SEQ ID NO: 6422430 - DNA, 12 bp, Homo sapiens
tccttccctagg

SEQ ID NO: 6422431 - DNA, 16 bp, Homo sapiens
tccttccctcaccccc

SEQ ID NO: 6422432 - DNA, 20 bp, Homo sapiens
tccttccctccttttaaaat

SEQ ID NO: 6422433 - DNA, 13 bp, Homo sapiens
tccttccctctcc

SEQ ID NO: 6422434 - DNA, 15 bp, Homo sapiens
tccttccctctcctg

SEQ ID NO: 6422435 - DNA, 14 bp, Homo sapiens
tccttccctctctg

SEQ ID NO: 6422436 - DNA, 15 bp, Homo sapiens
tccttccctgccact

SEQ ID NO: 6422437 - DNA, 15 bp, Homo sapiens
tccttccctgggaag

SEQ ID NO: 6422438 - DNA, 20 bp, Homo sapiens
tccttccctggtccagattg

SEQ ID NO: 6422439 - DNA, 16 bp, Homo sapiens
tccttcccttttctgt

SEQ ID NO: 6422440 - DNA, 17 bp, Homo sapiens
tccttcccttttctgtt

SEQ ID NO: 6422441 - DNA, 19 bp, Homo sapiens
tccttccgatgacagtgct

SEQ ID NO: 6422442 - DNA, 21 bp, Homo sapiens
tccttcctacacccttggact

SEQ ID NO: 6422443 - DNA, 22 bp, Homo sapiens
tccttcctagttcatcccttct

SEQ ID NO: 6422444 - DNA, 18 bp, Homo sapiens
tccttcctatgcccaggt

SEQ ID NO: 6422445 - DNA, 11 bp, Homo sapiens
tccttcctcat

SEQ ID NO: 6422446 - DNA, 13 bp, Homo sapiens
tccttcctccact

SEQ ID NO: 6422447 - DNA, 14 bp, Homo sapiens
tccttcctctcaag

SEQ ID NO: 6422448 - DNA, 14 bp, Homo sapiens
tccttcctctcctt

SEQ ID NO: 6422449 - DNA, 14 bp, Homo sapiens
tccttcctgaaact

SEQ ID NO: 6422450 - DNA, 10 bp, Homo sapiens
tccttcctgc

SEQ ID NO: 6422451 - DNA, 15 bp, Homo sapiens
tccttcctgcagacc

SEQ ID NO: 6422452 - DNA, 19 bp, Homo sapiens
tccttcctgcagacctggc

SEQ ID NO: 6422453 - DNA, 14 bp, Homo sapiens
tccttcctgcccca

SEQ ID NO: 6422454 - DNA, 14 bp, Homo sapiens
tccttcctgccctg

SEQ ID NO: 6422455 - DNA, 15 bp, Homo sapiens
tccttcctgccctgt

SEQ ID NO: 6422456 - DNA, 12 bp, Homo sapiens
tccttcctgggg

SEQ ID NO: 6422457 - DNA, 13 bp, Homo sapiens
tccttcctgggga

SEQ ID NO: 6422458 - DNA, 16 bp, Homo sapiens
tccttcctgtgccctg

SEQ ID NO: 6422459 - DNA, 15 bp, Homo sapiens
tccttcctgtggcct

SEQ ID NO: 6422460 - DNA, 18 bp, Homo sapiens
tccttcctgttctgtgtc

SEQ ID NO: 6422461 - DNA, 20 bp, Homo sapiens
tccttcctgttctgtgtctg

SEQ ID NO: 6422462 - DNA, 18 bp, Homo sapiens
tccttcctgtttgttttg

SEQ ID NO: 6422463 - DNA, 14 bp, Homo sapiens
tccttccttccctg

SEQ ID NO: 6422464 - DNA, 16 bp, Homo sapiens
tccttcctttttattc

SEQ ID NO: 6422465 - DNA, 21 bp, Homo sapiens
tccttcgaaaggccttcagac

SEQ ID NO: 6422466 - DNA, 18 bp, Homo sapiens
tccttcggggaccagccc

SEQ ID NO: 6422467 - DNA, 17 bp, Homo sapiens
tccttcggtcttttgta

SEQ ID NO: 6422468 - DNA, 23 bp, Homo sapiens
tccttcgtatcccgagtctggga

SEQ ID NO: 6422469 - DNA, 20 bp, Homo sapiens
tccttcgtccccagttgccg

SEQ ID NO: 6422470 - DNA, 20 bp, Homo sapiens
tccttctaagaggatacaaa

SEQ ID NO: 6422471 - DNA, 14 bp, Homo sapiens
tccttctacatgta

SEQ ID NO: 6422472 - DNA, 23 bp, Homo sapiens
tccttctaccccaaggccagtag

SEQ ID NO: 6422473 - DNA, 17 bp, Homo sapiens
tccttctagtttcccac

SEQ ID NO: 6422474 - DNA, 22 bp, Homo sapiens
tccttctatacatgtttgcagt

SEQ ID NO: 6422475 - DNA, 15 bp, Homo sapiens
tccttctcagcactt

SEQ ID NO: 6422476 - DNA, 22 bp, Homo sapiens
tccttctcagccttggttcctg

SEQ ID NO: 6422477 - DNA, 19 bp, Homo sapiens
tccttctcattgctgcccg

SEQ ID NO: 6422478 - DNA, 14 bp, Homo sapiens
tccttctccacccc

SEQ ID NO: 6422479 - DNA, 14 bp, Homo sapiens
tccttctcccatct

SEQ ID NO: 6422480 - DNA, 18 bp, Homo sapiens
tccttctcccatctcttc

SEQ ID NO: 6422481 - DNA, 17 bp, Homo sapiens
tccttctcccctgccgg

SEQ ID NO: 6422482 - DNA, 18 bp, Homo sapiens
tccttctccgaggggctg

SEQ ID NO: 6422483 - DNA, 11 bp, Homo sapiens
tccttctcctc

SEQ ID NO: 6422484 - DNA, 20 bp, Homo sapiens
tccttctcctcttgtagcca

SEQ ID NO: 6422485 - DNA, 14 bp, Homo sapiens
tccttctcgtcttc

SEQ ID NO: 6422486 - DNA, 16 bp, Homo sapiens
tccttctcgtcttcct

SEQ ID NO: 6422487 - DNA, 23 bp, Homo sapiens
tccttctcgtcttcctctctctc

SEQ ID NO: 6422488 - DNA, 21 bp, Homo sapiens
tccttctctactcatgccaga

SEQ ID NO: 6422489 - DNA, 20 bp, Homo sapiens
tccttctctgaacacaggca

SEQ ID NO: 6422490 - DNA, 21 bp, Homo sapiens
tccttctctgaacacaggcag

SEQ ID NO: 6422491 - DNA, 13 bp, Homo sapiens
tccttctctgccc

SEQ ID NO: 6422492 - DNA, 15 bp, Homo sapiens
tccttctctgtctca

SEQ ID NO: 6422493 - DNA, 18 bp, Homo sapiens
tccttctctttcaatgtg

SEQ ID NO: 6422494 - DNA, 22 bp, Homo sapiens
tccttctgaaaatatttacatt

SEQ ID NO: 6422495 - DNA, 17 bp, Homo sapiens
tccttctgaccacagca

SEQ ID NO: 6422496 - DNA, 19 bp, Homo sapiens
tccttctgagctccacctc

SEQ ID NO: 6422497 - DNA, 23 bp, Homo sapiens
tccttctgagctccacctctggt

SEQ ID NO: 6422498 - DNA, 15 bp, Homo sapiens
tccttctgcacccag

SEQ ID NO: 6422499 - DNA, 20 bp, Homo sapiens
tccttctgcagtcagactga

SEQ ID NO: 6422500 - DNA, 17 bp, Homo sapiens
tccttctgccagttccc

SEQ ID NO: 6422501 - DNA, 20 bp, Homo sapiens
tccttctgcccttcctccag

SEQ ID NO: 6422502 - DNA, 20 bp, Homo sapiens
tccttctgcctaacttgtaa

SEQ ID NO: 6422503 - DNA, 18 bp, Homo sapiens
tccttctgcggccagagc

SEQ ID NO: 6422504 - DNA, 21 bp, Homo sapiens
tccttctgctcccaccccaga

SEQ ID NO: 6422505 - DNA, 20 bp, Homo sapiens
tccttctggcagattcaaat

SEQ ID NO: 6422506 - DNA, 12 bp, Homo sapiens
tccttctggcct

SEQ ID NO: 6422507 - DNA, 20 bp, Homo sapiens
tccttctggcctttcctctc

SEQ ID NO: 6422508 - DNA, 16 bp, Homo sapiens
tccttctgtagcctga

SEQ ID NO: 6422509 - DNA, 19 bp, Homo sapiens
tccttctgtgaagaagccc

SEQ ID NO: 6422510 - DNA, 22 bp, Homo sapiens
tccttctgtgaagaagccctgt

SEQ ID NO: 6422511 - DNA, 17 bp, Homo sapiens
tccttctgttaagaaag

SEQ ID NO: 6422512 - DNA, 18 bp, Homo sapiens
tccttctgttaagaaagg

SEQ ID NO: 6422513 - DNA, 21 bp, Homo sapiens
tccttcttactctcctcttct

SEQ ID NO: 6422514 - DNA, 14 bp, Homo sapiens
tattattaatttat

SEQ ID NO: 6422515 - DNA, 14 bp, Homo sapiens
tattattacaaata

SEQ ID NO: 6422516 - DNA, 15 bp, Homo sapiens
tattattagattctc

SEQ ID NO: 6422517 - DNA, 22 bp, Homo sapiens
tattattataatcttataattg

SEQ ID NO: 6422518 - DNA, 13 bp, Homo sapiens
tattattatatat

SEQ ID NO: 6422519 - DNA, 14 bp, Homo sapiens
tattattatattgt

SEQ ID NO: 6422520 - DNA, 13 bp, Homo sapiens
tattattatgttc

SEQ ID NO: 6422521 - DNA, 15 bp, Homo sapiens
tattattatgttctt

SEQ ID NO: 6422522 - DNA, 16 bp, Homo sapiens
tattattattaaagaa

SEQ ID NO: 6422523 - DNA, 14 bp, Homo sapiens
tattattattttcc

SEQ ID NO: 6422524 - DNA, 23 bp, Homo sapiens
tattattcaaaccaatttcttcc

SEQ ID NO: 6422525 - DNA, 15 bp, Homo sapiens
tattattctcattta

SEQ ID NO: 6422526 - DNA, 14 bp, Homo sapiens
tattattctgtttt

SEQ ID NO: 6422527 - DNA, 16 bp, Homo sapiens
tattattgcttcatgt

SEQ ID NO: 6422528 - DNA, 17 bp, Homo sapiens
tattattgcttcatgtt

SEQ ID NO: 6422529 - DNA, 19 bp, Homo sapiens
tattattgtaagttgtaca

SEQ ID NO: 6422530 - DNA, 21 bp, Homo sapiens
tattattgtctgttttccttc

SEQ ID NO: 6422531 - DNA, 15 bp, Homo sapiens
tattattgtgacaaa

SEQ ID NO: 6422532 - DNA, 20 bp, Homo sapiens
tattattgtgacaaaatgtt

SEQ ID NO: 6422533 - DNA, 20 bp, Homo sapiens
tattattgtggtaggccttt

SEQ ID NO: 6422534 - DNA, 22 bp, Homo sapiens
tattattgtggtaggcctttta

SEQ ID NO: 6422535 - DNA, 14 bp, Homo sapiens
tattattgttaata

SEQ ID NO: 6422536 - DNA, 15 bp, Homo sapiens
tattatttaaatgtt

SEQ ID NO: 6422537 - DNA, 19 bp, Homo sapiens
tattatttaaatgttgaaa

SEQ ID NO: 6422538 - DNA, 15 bp, Homo sapiens
tattatttaactctt

SEQ ID NO: 6422539 - DNA, 15 bp, Homo sapiens
tattatttagaaatg

SEQ ID NO: 6422540 - DNA, 16 bp, Homo sapiens
tattatttagtaaaat

SEQ ID NO: 6422541 - DNA, 17 bp, Homo sapiens
tattatttagtaaaatt

SEQ ID NO: 6422542 - DNA, 13 bp, Homo sapiens
tattatttatata

SEQ ID NO: 6422543 - DNA, 15 bp, Homo sapiens
tattatttatttctg

SEQ ID NO: 6422544 - DNA, 21 bp, Homo sapiens
tattatttctaatccttttcc

SEQ ID NO: 6422545 - DNA, 22 bp, Homo sapiens
tattatttctaggaagaatttt

SEQ ID NO: 6422546 - DNA, 23 bp, Homo sapiens
tattatttctccatcccctccct

SEQ ID NO: 6422547 - DNA, 21 bp, Homo sapiens
tattatttctggctttttgaa

SEQ ID NO: 6422548 - DNA, 13 bp, Homo sapiens
tattatttcttct

SEQ ID NO: 6422549 - DNA, 14 bp, Homo sapiens
tattatttcttctc

SEQ ID NO: 6422550 - DNA, 16 bp, Homo sapiens
tattatttgatatctg

SEQ ID NO: 6422551 - DNA, 12 bp, Homo sapiens
tattatttggag

SEQ ID NO: 6422552 - DNA, 21 bp, Homo sapiens
tattatttgtatgtattaaac

SEQ ID NO: 6422553 - DNA, 19 bp, Homo sapiens
tattattttcaaaggaaaa

SEQ ID NO: 6422554 - DNA, 12 bp, Homo sapiens
tattattttcca

SEQ ID NO: 6422555 - DNA, 19 bp, Homo sapiens
tattattttctgtaattct

SEQ ID NO: 6422556 - DNA, 13 bp, Homo sapiens
tattatttttcaa

SEQ ID NO: 6422557 - DNA, 16 bp, Homo sapiens
tattatttttctctct

SEQ ID NO: 6422558 - DNA, 20 bp, Homo sapiens
tattatttttttaaaatttt

SEQ ID NO: 6422559 - DNA, 14 bp, Homo sapiens
tattcaaaaattat

SEQ ID NO: 6422560 - DNA, 15 bp, Homo sapiens
tattcaaaaattata

SEQ ID NO: 6422561 - DNA, 20 bp, Homo sapiens
tattcaaaaattatattttg

SEQ ID NO: 6422562 - DNA, 12 bp, Homo sapiens
tattcaaaatat

SEQ ID NO: 6422563 - DNA, 23 bp, Homo sapiens
tattcaaacagtctcaggaaatc

SEQ ID NO: 6422564 - DNA, 15 bp, Homo sapiens
tattcaaaccaattt

SEQ ID NO: 6422565 - DNA, 20 bp, Homo sapiens
tattcaaaccaatttcttcc

SEQ ID NO: 6422566 - DNA, 13 bp, Homo sapiens
tattcaaactacc

SEQ ID NO: 6422567 - DNA, 14 bp, Homo sapiens
tattcaaactacct

SEQ ID NO: 6422568 - DNA, 18 bp, Homo sapiens
tattcaaactacctatat

SEQ ID NO: 6422569 - DNA, 23 bp, Homo sapiens
tattcaaactacctatattcctt

SEQ ID NO: 6422570 - DNA, 14 bp, Homo sapiens
tattcaaagatgat

SEQ ID NO: 6422571 - DNA, 17 bp, Homo sapiens
tattcaaagcagctgta

SEQ ID NO: 6422572 - DNA, 21 bp, Homo sapiens
tattcaaagtatatacagagc

SEQ ID NO: 6422573 - DNA, 12 bp, Homo sapiens
tattcaaagttg

SEQ ID NO: 6422574 - DNA, 16 bp, Homo sapiens
tattcaaagttgccta

SEQ ID NO: 6422575 - DNA, 13 bp, Homo sapiens
tattcaaatgaag

SEQ ID NO: 6422576 - DNA, 13 bp, Homo sapiens
tattcaaatttga

SEQ ID NO: 6422577 - DNA, 13 bp, Homo sapiens
tattcaaatttgt

SEQ ID NO: 6422578 - DNA, 18 bp, Homo sapiens
tattcaaatttgtgtcat

SEQ ID NO: 6422579 - DNA, 18 bp, Homo sapiens
tattcaacaatttcaata

SEQ ID NO: 6422580 - DNA, 19 bp, Homo sapiens
tattcaacaatttcaataa

SEQ ID NO: 6422581 - DNA, 17 bp, Homo sapiens
tattcaacagagaggga

SEQ ID NO: 6422582 - DNA, 14 bp, Homo sapiens
tattcaaccatgga

SEQ ID NO: 6422583 - DNA, 16 bp, Homo sapiens
tattcaagaaagatat

SEQ ID NO: 6422584 - DNA, 18 bp, Homo sapiens
tattcaagaaagatatct

SEQ ID NO: 6422585 - DNA, 20 bp, Homo sapiens
tattcaagaaagatatctat

SEQ ID NO: 6422586 - DNA, 17 bp, Homo sapiens
tattcaagaagatagtt

SEQ ID NO: 6422587 - DNA, 21 bp, Homo sapiens
tattcaagagtggggggagga

SEQ ID NO: 6422588 - DNA, 17 bp, Homo sapiens
tattcaagcaaacatca

SEQ ID NO: 6422589 - DNA, 20 bp, Homo sapiens
tattcaagcaaacatcaaat

SEQ ID NO: 6422590 - DNA, 18 bp, Homo sapiens
tattcaagcaacagcact

SEQ ID NO: 6422591 - DNA, 24 bp, Homo sapiens
tattcaagcaacagcactttctgt

SEQ ID NO: 6422592 - DNA, 16 bp, Homo sapiens
tattcaagcctttgga

SEQ ID NO: 6422593 - DNA, 16 bp, Homo sapiens
tattcaaggaagtttt

SEQ ID NO: 6422594 - DNA, 11 bp, Homo sapiens
tattcaaggta

SEQ ID NO: 6422595 - DNA, 21 bp, Homo sapiens
tattcaaggtaaaattctaaa

SEQ ID NO: 6422596 - DNA, 11 bp, Homo sapiens
tattcaagtaa

SEQ ID NO: 6422597 - DNA, 13 bp, Homo sapiens
tattcaagtaaca

SEQ ID NO: 6422598 - DNA, 19 bp, Homo sapiens
tattcaagtgcctcttgtt

SEQ ID NO: 6422599 - DNA, 22 bp, Homo sapiens
tattcaataaaaaaaagaaatg

SEQ ID NO: 6422600 - DNA, 23 bp, Homo sapiens
tattcaataaaaaaaagaaatga

SEQ ID NO: 6422601 - DNA, 14 bp, Homo sapiens
tattcaataaagct

SEQ ID NO: 6422602 - DNA, 15 bp, Homo sapiens
tattcaataaagtat

SEQ ID NO: 6422603 - DNA, 17 bp, Homo sapiens
tattcaataaagtattt

SEQ ID NO: 6422604 - DNA, 21 bp, Homo sapiens
tattcaataaagtatttaatt

SEQ ID NO: 6422605 - DNA, 17 bp, Homo sapiens
tattcaataagagatta

SEQ ID NO: 6422606 - DNA, 22 bp, Homo sapiens
tattcaataccgctcagtattt

SEQ ID NO: 6422607 - DNA, 19 bp, Homo sapiens
tattcaatatttactgaga

SEQ ID NO: 6422608 - DNA, 12 bp, Homo sapiens
tattcaatctta

SEQ ID NO: 6422609 - DNA, 16 bp, Homo sapiens
tattcaatgcatttaa

SEQ ID NO: 6422610 - DNA, 16 bp, Homo sapiens
tattcaattcttttaa

SEQ ID NO: 6422611 - DNA, 14 bp, Homo sapiens
tattcacaaaacat

SEQ ID NO: 6422612 - DNA, 15 bp, Homo sapiens
tattcacaaaatatc

SEQ ID NO: 6422613 - DNA, 17 bp, Homo sapiens
tattcacaacctcacca

SEQ ID NO: 6422614 - DNA, 12 bp, Homo sapiens
tattcacacaca

SEQ ID NO: 6422615 - DNA, 22 bp, Homo sapiens
tattcacagtgaacataactgt

SEQ ID NO: 6422616 - DNA, 20 bp, Homo sapiens
tattcacagttttttaaaaa

SEQ ID NO: 6422617 - DNA, 20 bp, Homo sapiens
tattcacatatgtcttacta

SEQ ID NO: 6422618 - DNA, 14 bp, Homo sapiens
tattcacatcattt

SEQ ID NO: 6422619 - DNA, 14 bp, Homo sapiens
tattcacatgttct

SEQ ID NO: 6422620 - DNA, 17 bp, Homo sapiens
tattcacatgttctaat

SEQ ID NO: 6422621 - DNA, 11 bp, Homo sapiens
tattcaccacc

SEQ ID NO: 6422622 - DNA, 20 bp, Homo sapiens
tattcaccatgtaaaacaaa

SEQ ID NO: 6422623 - DNA, 18 bp, Homo sapiens
tattcaccccacacccag

SEQ ID NO: 6422624 - DNA, 22 bp, Homo sapiens
tattcacctttttaataaaaat

SEQ ID NO: 6422625 - DNA, 22 bp, Homo sapiens
tattcacgccgtaattctttct

SEQ ID NO: 6422626 - DNA, 21 bp, Homo sapiens
tattcacgtgcagcagcaaca

SEQ ID NO: 6422627 - DNA, 20 bp, Homo sapiens
tattcactctcccagaggct

SEQ ID NO: 6422628 - DNA, 14 bp, Homo sapiens
tattcactgggcca

SEQ ID NO: 6422629 - DNA, 19 bp, Homo sapiens
tattcactggttttacaca

SEQ ID NO: 6422630 - DNA, 15 bp, Homo sapiens
tattcactgtaagtt

SEQ ID NO: 6422631 - DNA, 21 bp, Homo sapiens
tattcacttgtgtttgtatat

SEQ ID NO: 6422632 - DNA, 22 bp, Homo sapiens
tattcagaaaatagagcatcat

SEQ ID NO: 6422633 - DNA, 13 bp, Homo sapiens
tattcagaaatta

SEQ ID NO: 6422634 - DNA, 21 bp, Homo sapiens
tattcagaaattaaaatatta

SEQ ID NO: 6422635 - DNA, 15 bp, Homo sapiens
tattcagaactattt

SEQ ID NO: 6422636 - DNA, 17 bp, Homo sapiens
tattcagaactatttaa

SEQ ID NO: 6422637 - DNA, 20 bp, Homo sapiens
tattcagaacttgtaactaa

SEQ ID NO: 6422638 - DNA, 13 bp, Homo sapiens
tattcagaacttt

SEQ ID NO: 6422639 - DNA, 15 bp, Homo sapiens
tattcagaactttag

SEQ ID NO: 6422640 - DNA, 20 bp, Homo sapiens
tattcagaactttagtatta

SEQ ID NO: 6422641 - DNA, 12 bp, Homo sapiens
tattcagaatat

SEQ ID NO: 6422642 - DNA, 15 bp, Homo sapiens
tattcagaatattca

SEQ ID NO: 6422643 - DNA, 16 bp, Homo sapiens
tattcagaatctttgt

SEQ ID NO: 6422644 - DNA, 20 bp, Homo sapiens
tattcagaattatgatggaa

SEQ ID NO: 6422645 - DNA, 15 bp, Homo sapiens
tattcagacaaaatg

SEQ ID NO: 6422646 - DNA, 16 bp, Homo sapiens
tattcagacaaaatgg

SEQ ID NO: 6422647 - DNA, 13 bp, Homo sapiens
tattcagacagat

SEQ ID NO: 6422648 - DNA, 14 bp, Homo sapiens
tattcagagatgta

SEQ ID NO: 6422649 - DNA, 19 bp, Homo sapiens
tattcagagatgtaccatg

SEQ ID NO: 6422650 - DNA, 20 bp, Homo sapiens
tattcagagatgtaccatgt

SEQ ID NO: 6422651 - DNA, 12 bp, Homo sapiens
tattcagagcca

SEQ ID NO: 6422652 - DNA, 12 bp, Homo sapiens
tattcagagtta

SEQ ID NO: 6422653 - DNA, 22 bp, Homo sapiens
tattcagagttagatattattt

SEQ ID NO: 6422654 - DNA, 23 bp, Homo sapiens
tattcagcaaggcgctaacttgc

SEQ ID NO: 6422655 - DNA, 18 bp, Homo sapiens
tattcagcatttgatttc

SEQ ID NO: 6422656 - DNA, 21 bp, Homo sapiens
tattcagcttgcacatttggt

SEQ ID NO: 6422657 - DNA, 13 bp, Homo sapiens
tattcaggaaatg

SEQ ID NO: 6422658 - DNA, 16 bp, Homo sapiens
tattcaggaagataaa

SEQ ID NO: 6422659 - DNA, 16 bp, Homo sapiens
tattcaggaagctcag

SEQ ID NO: 6422660 - DNA, 18 bp, Homo sapiens
tattcaggaagctcaggg

SEQ ID NO: 6422661 - DNA, 13 bp, Homo sapiens
tattcaggacccc

SEQ ID NO: 6422662 - DNA, 12 bp, Homo sapiens
tattcaggactt

SEQ ID NO: 6422663 - DNA, 20 bp, Homo sapiens
tattcaggacttgaaagaaa

SEQ ID NO: 6422664 - DNA, 14 bp, Homo sapiens
tattcaggagttgg

SEQ ID NO: 6422665 - DNA, 19 bp, Homo sapiens
tattcaggggaaacttgat

SEQ ID NO: 6422666 - DNA, 16 bp, Homo sapiens
tattcagggtaaatag

SEQ ID NO: 6422667 - DNA, 19 bp, Homo sapiens
tattcagtaaacaacttgt

SEQ ID NO: 6422668 - DNA, 15 bp, Homo sapiens
tattcagtagtttga

SEQ ID NO: 6422669 - DNA, 18 bp, Homo sapiens
tattcagtgacttctggc

SEQ ID NO: 6422670 - DNA, 20 bp, Homo sapiens
tattcagtgacttctggctt

SEQ ID NO: 6422671 - DNA, 22 bp, Homo sapiens
tattcagtgctgtggcctgggc

SEQ ID NO: 6422672 - DNA, 17 bp, Homo sapiens
tattcagtggtgaaatc

SEQ ID NO: 6422673 - DNA, 16 bp, Homo sapiens
tattcagttaagaaaa

SEQ ID NO: 6422674 - DNA, 21 bp, Homo sapiens
tattcagttaagaaaaaaata

SEQ ID NO: 6422675 - DNA, 21 bp, Homo sapiens
tattcagttcccagaatcaaa

SEQ ID NO: 6422676 - DNA, 20 bp, Homo sapiens
tattcataaaaaataatggt

SEQ ID NO: 6422677 - DNA, 20 bp, Homo sapiens
tattcataagccaatttttc

SEQ ID NO: 6422678 - DNA, 14 bp, Homo sapiens
tattcataataaac

SEQ ID NO: 6422679 - DNA, 14 bp, Homo sapiens
tattcatacctgtt

SEQ ID NO: 6422680 - DNA, 19 bp, Homo sapiens
tattcatacgtaaaatttt

SEQ ID NO: 6422681 - DNA, 20 bp, Homo sapiens
tattcatagctgtatatttg

SEQ ID NO: 6422682 - DNA, 21 bp, Homo sapiens
tattcatatattgcatttctg

SEQ ID NO: 6422683 - DNA, 16 bp, Homo sapiens
tattcatattggaaaa

SEQ ID NO: 6422684 - DNA, 23 bp, Homo sapiens
tattcatatttgtactttctgtt

SEQ ID NO: 6422685 - DNA, 14 bp, Homo sapiens
tattcatcaaactc

SEQ ID NO: 6422686 - DNA, 18 bp, Homo sapiens
tattcatcaaataaacct

SEQ ID NO: 6422687 - DNA, 18 bp, Homo sapiens
tattcatcaatgaagatt

SEQ ID NO: 6422688 - DNA, 21 bp, Homo sapiens
tattcatccaagttaaatgta

SEQ ID NO: 6422689 - DNA, 14 bp, Homo sapiens
tattcatccagagt

SEQ ID NO: 6422690 - DNA, 15 bp, Homo sapiens
tattcatccagagtt

SEQ ID NO: 6422691 - DNA, 23 bp, Homo sapiens
tattcatcccttttcaaaagtca

SEQ ID NO: 6422692 - DNA, 16 bp, Homo sapiens
tattcatctaatgtat

SEQ ID NO: 6422693 - DNA, 19 bp, Homo sapiens
tattcatctattttctcag

SEQ ID NO: 6422694 - DNA, 13 bp, Homo sapiens
tccttcttcagca

SEQ ID NO: 6422695 - DNA, 15 bp, Homo sapiens
tccttcttcagctca

SEQ ID NO: 6422696 - DNA, 19 bp, Homo sapiens
tccttcttccacttctcca

SEQ ID NO: 6422697 - DNA, 18 bp, Homo sapiens
tccttcttggcttcctgg

SEQ ID NO: 6422698 - DNA, 14 bp, Homo sapiens
tccttctttcctct

SEQ ID NO: 6422699 - DNA, 15 bp, Homo sapiens
tccttctttctcttc

SEQ ID NO: 6422700 - DNA, 19 bp, Homo sapiens
tccttctttgataatgtta

SEQ ID NO: 6422701 - DNA, 22 bp, Homo sapiens
tccttctttgataatgttaaat

SEQ ID NO: 6422702 - DNA, 13 bp, Homo sapiens
tccttctttgccc

SEQ ID NO: 6422703 - DNA, 15 bp, Homo sapiens
tccttctttgggata

SEQ ID NO: 6422704 - DNA, 23 bp, Homo sapiens
tccttctttttcatatttctacc

SEQ ID NO: 6422705 - DNA, 16 bp, Homo sapiens
tccttgaaaaaaagtt

SEQ ID NO: 6422706 - DNA, 22 bp, Homo sapiens
tccttgaaaacactgttctctg

SEQ ID NO: 6422707 - DNA, 18 bp, Homo sapiens
tccttgaaaataaaaaga

SEQ ID NO: 6422708 - DNA, 20 bp, Homo sapiens
tccttgaaccctaataagac

SEQ ID NO: 6422709 - DNA, 22 bp, Homo sapiens
tccttgaaccctaataagaccc

SEQ ID NO: 6422710 - DNA, 13 bp, Homo sapiens
tccttgaactgag

SEQ ID NO: 6422711 - DNA, 18 bp, Homo sapiens
tccttgaagaactgcagg

SEQ ID NO: 6422712 - DNA, 19 bp, Homo sapiens
tccttgaagaactgcaggc

SEQ ID NO: 6422713 - DNA, 21 bp, Homo sapiens
tccttgaagacatatcatgtg

SEQ ID NO: 6422714 - DNA, 17 bp, Homo sapiens
tccttgaagcaaatgtg

SEQ ID NO: 6422715 - DNA, 15 bp, Homo sapiens
tccttgaagcttgta

SEQ ID NO: 6422716 - DNA, 17 bp, Homo sapiens
tccttgaagcttgtatc

SEQ ID NO: 6422717 - DNA, 19 bp, Homo sapiens
tccttgaagcttgtatctg

SEQ ID NO: 6422718 - DNA, 20 bp, Homo sapiens
tccttgaagcttgtatctga

SEQ ID NO: 6422719 - DNA, 13 bp, Homo sapiens
tccttgaaggtat

SEQ ID NO: 6422720 - DNA, 17 bp, Homo sapiens
tccttgaaggtatatct

SEQ ID NO: 6422721 - DNA, 19 bp, Homo sapiens
tccttgaatatctttcgat

SEQ ID NO: 6422722 - DNA, 20 bp, Homo sapiens
tccttgacctgcattgtaaa

SEQ ID NO: 6422723 - DNA, 19 bp, Homo sapiens
tccttgaccttcctctggg

SEQ ID NO: 6422724 - DNA, 22 bp, Homo sapiens
tccttgaccttcctctggggct

SEQ ID NO: 6422725 - DNA, 21 bp, Homo sapiens
tccttgactattacactgcct

SEQ ID NO: 6422726 - DNA, 20 bp, Homo sapiens
tccttgactgaagcgaacat

SEQ ID NO: 6422727 - DNA, 22 bp, Homo sapiens
tccttgactgaagcgaacatct

SEQ ID NO: 6422728 - DNA, 22 bp, Homo sapiens
tccttgactgtctagccactcc

SEQ ID NO: 6422729 - DNA, 16 bp, Homo sapiens
tccttgacttgatgaa

SEQ ID NO: 6422730 - DNA, 23 bp, Homo sapiens
tccttgagacacggagcccagcc

SEQ ID NO: 6422731 - DNA, 17 bp, Homo sapiens
tccttgagattctgaag

SEQ ID NO: 6422732 - DNA, 13 bp, Homo sapiens
tccttgagcattt

SEQ ID NO: 6422733 - DNA, 14 bp, Homo sapiens
tccttgagctgttg

SEQ ID NO: 6422734 - DNA, 16 bp, Homo sapiens
tccttgaggacctcca

SEQ ID NO: 6422735 - DNA, 21 bp, Homo sapiens
tccttgaggacctccacctgg

SEQ ID NO: 6422736 - DNA, 23 bp, Homo sapiens
tccttgaggacctccacctggga

SEQ ID NO: 6422737 - DNA, 19 bp, Homo sapiens
tccttgaggggagccagga

SEQ ID NO: 6422738 - DNA, 16 bp, Homo sapiens
tccttgagtgctcttg

SEQ ID NO: 6422739 - DNA, 16 bp, Homo sapiens
tccttgatatcattca

SEQ ID NO: 6422740 - DNA, 14 bp, Homo sapiens
tccttgatcatttt

SEQ ID NO: 6422741 - DNA, 18 bp, Homo sapiens
tccttgatgccagagggc

SEQ ID NO: 6422742 - DNA, 21 bp, Homo sapiens
tccttgatgccagagggccag

SEQ ID NO: 6422743 - DNA, 23 bp, Homo sapiens
tccttgatgccagagggccagca

SEQ ID NO: 6422744 - DNA, 19 bp, Homo sapiens
tccttgatgtacagatttt

SEQ ID NO: 6422745 - DNA, 20 bp, Homo sapiens
tccttgatgtacagatttta

SEQ ID NO: 6422746 - DNA, 14 bp, Homo sapiens
tccttgatttcaaa

SEQ ID NO: 6422747 - DNA, 22 bp, Homo sapiens
tccttgatttcaaagttttgtt

SEQ ID NO: 6422748 - DNA, 23 bp, Homo sapiens
tccttgattttagccttctctgt

SEQ ID NO: 6422749 - DNA, 17 bp, Homo sapiens
tccttgatttttggtag

SEQ ID NO: 6422750 - DNA, 15 bp, Homo sapiens
tccttgcacccctca

SEQ ID NO: 6422751 - DNA, 21 bp, Homo sapiens
tccttgcacccctcactctgg

SEQ ID NO: 6422752 - DNA, 22 bp, Homo sapiens
tccttgcacccctcactctggc

SEQ ID NO: 6422753 - DNA, 16 bp, Homo sapiens
tccttgcacctgagcc

SEQ ID NO: 6422754 - DNA, 17 bp, Homo sapiens
tccttgcacctgcatcc

SEQ ID NO: 6422755 - DNA, 15 bp, Homo sapiens
tccttgcacttctgt

SEQ ID NO: 6422756 - DNA, 14 bp, Homo sapiens
tccttgcagcaggg

SEQ ID NO: 6422757 - DNA, 21 bp, Homo sapiens
tccttgcaggtgggggttgct

SEQ ID NO: 6422758 - DNA, 23 bp, Homo sapiens
tccttgcagtttaagatgacact

SEQ ID NO: 6422759 - DNA, 14 bp, Homo sapiens
tccttgccaccccc

SEQ ID NO: 6422760 - DNA, 22 bp, Homo sapiens
tccttgccaccccccgccggca

SEQ ID NO: 6422761 - DNA, 14 bp, Homo sapiens
tccttgccccacag

SEQ ID NO: 6422762 - DNA, 15 bp, Homo sapiens
tccttgccccacagt

SEQ ID NO: 6422763 - DNA, 17 bp, Homo sapiens
tccttgccccacagttg

SEQ ID NO: 6422764 - DNA, 17 bp, Homo sapiens
tccttgccccactcctc

SEQ ID NO: 6422765 - DNA, 20 bp, Homo sapiens
tccttgccccactcctctcc

SEQ ID NO: 6422766 - DNA, 15 bp, Homo sapiens
tccttgccccagtcc

SEQ ID NO: 6422767 - DNA, 17 bp, Homo sapiens
tccttgccccagtcctg

SEQ ID NO: 6422768 - DNA, 14 bp, Homo sapiens
tccttgcccctgct

SEQ ID NO: 6422769 - DNA, 16 bp, Homo sapiens
tccttgcccctgctct

SEQ ID NO: 6422770 - DNA, 13 bp, Homo sapiens
tccttgccctggg

SEQ ID NO: 6422771 - DNA, 16 bp, Homo sapiens
tccttgccctgggcca

SEQ ID NO: 6422772 - DNA, 16 bp, Homo sapiens
tccttgcctcctggaa

SEQ ID NO: 6422773 - DNA, 17 bp, Homo sapiens
tccttgcctcctggaag

SEQ ID NO: 6422774 - DNA, 14 bp, Homo sapiens
tccttgcctctgct

SEQ ID NO: 6422775 - DNA, 18 bp, Homo sapiens
tccttgcctgaactccag

SEQ ID NO: 6422776 - DNA, 12 bp, Homo sapiens
tccttgccttaa

SEQ ID NO: 6422777 - DNA, 18 bp, Homo sapiens
tccttgccttgcttctcc

SEQ ID NO: 6422778 - DNA, 15 bp, Homo sapiens
tccttgcgaccacca

SEQ ID NO: 6422779 - DNA, 17 bp, Homo sapiens
tccttgcgcctcagccc

SEQ ID NO: 6422780 - DNA, 19 bp, Homo sapiens
tccttgcgcctcagccctc

SEQ ID NO: 6422781 - DNA, 14 bp, Homo sapiens
tccttgctctgcag

SEQ ID NO: 6422782 - DNA, 16 bp, Homo sapiens
tccttgctctgcaggc

SEQ ID NO: 6422783 - DNA, 16 bp, Homo sapiens
tccttgctgaccccag

SEQ ID NO: 6422784 - DNA, 13 bp, Homo sapiens
tccttgctgcagc

SEQ ID NO: 6422785 - DNA, 17 bp, Homo sapiens
tccttgctgtcctaggc

SEQ ID NO: 6422786 - DNA, 19 bp, Homo sapiens
tccttgctgtcctaggcca

SEQ ID NO: 6422787 - DNA, 21 bp, Homo sapiens
tccttgctgtcctaggccaca

SEQ ID NO: 6422788 - DNA, 15 bp, Homo sapiens
tccttgcttcctgat

SEQ ID NO: 6422789 - DNA, 13 bp, Homo sapiens
tccttgcttggct

SEQ ID NO: 6422790 - DNA, 15 bp, Homo sapiens
tccttgcttgttaca

SEQ ID NO: 6422791 - DNA, 16 bp, Homo sapiens
tccttgcttttatgtt

SEQ ID NO: 6422792 - DNA, 12 bp, Homo sapiens
tccttggaaatc

SEQ ID NO: 6422793 - DNA, 22 bp, Homo sapiens
tccttggaaatcaaatgtaaag

SEQ ID NO: 6422794 - DNA, 15 bp, Homo sapiens
tccttggaaggtctt

SEQ ID NO: 6422795 - DNA, 21 bp, Homo sapiens
tccttggagaaatgaaaacag

SEQ ID NO: 6422796 - DNA, 20 bp, Homo sapiens
tccttggagagcagctggct

SEQ ID NO: 6422797 - DNA, 21 bp, Homo sapiens
tccttggaggaaacttaagat

SEQ ID NO: 6422798 - DNA, 18 bp, Homo sapiens
tccttggaggacagtggg

SEQ ID NO: 6422799 - DNA, 19 bp, Homo sapiens
tccttggagtcccaggggc

SEQ ID NO: 6422800 - DNA, 22 bp, Homo sapiens
tccttggatcctgaatctgtgc

SEQ ID NO: 6422801 - DNA, 20 bp, Homo sapiens
tccttggatggcaccatcca

SEQ ID NO: 6422802 - DNA, 21 bp, Homo sapiens
tccttggatttgcatttttgt

SEQ ID NO: 6422803 - DNA, 18 bp, Homo sapiens
tccttggattttcctgaa

SEQ ID NO: 6422804 - DNA, 15 bp, Homo sapiens
tccttggcaccaaag

SEQ ID NO: 6422805 - DNA, 21 bp, Homo sapiens
tccttggcagtggactcagaa

SEQ ID NO: 6422806 - DNA, 16 bp, Homo sapiens
tccttggcccagcagc

SEQ ID NO: 6422807 - DNA, 22 bp, Homo sapiens
tccttggcctagcccaccctgc

SEQ ID NO: 6422808 - DNA, 23 bp, Homo sapiens
tccttggcctagcccaccctgct

SEQ ID NO: 6422809 - DNA, 17 bp, Homo sapiens
tccttggcggacactgg

SEQ ID NO: 6422810 - DNA, 20 bp, Homo sapiens
tccttggctcccattcactc

SEQ ID NO: 6422811 - DNA, 15 bp, Homo sapiens
tccttggctgaatta

SEQ ID NO: 6422812 - DNA, 22 bp, Homo sapiens
tccttggctgaattaaaatggt

SEQ ID NO: 6422813 - DNA, 15 bp, Homo sapiens
tccttggctgcagcc

SEQ ID NO: 6422814 - DNA, 19 bp, Homo sapiens
tccttggctgcagccatcc

SEQ ID NO: 6422815 - DNA, 19 bp, Homo sapiens
tccttggctgtctgtgggc

SEQ ID NO: 6422816 - DNA, 23 bp, Homo sapiens
tccttggctttatgcaaatacaa

SEQ ID NO: 6422817 - DNA, 18 bp, Homo sapiens
tccttgggaggaagcaga

SEQ ID NO: 6422818 - DNA, 19 bp, Homo sapiens
tccttgggaggaagcagaa

SEQ ID NO: 6422819 - DNA, 21 bp, Homo sapiens
tccttgggaggccccactggg

SEQ ID NO: 6422820 - DNA, 13 bp, Homo sapiens
tccttgggcaggg

SEQ ID NO: 6422821 - DNA, 22 bp, Homo sapiens
tccttgggccataattatgaaa

SEQ ID NO: 6422822 - DNA, 14 bp, Homo sapiens
tccttgggcccttt

SEQ ID NO: 6422823 - DNA, 22 bp, Homo sapiens
tccttgggccctttttcccttc

SEQ ID NO: 6422824 - DNA, 20 bp, Homo sapiens
tccttgggcgtctcccccag

SEQ ID NO: 6422825 - DNA, 18 bp, Homo sapiens
tccttgggctcctggctg

SEQ ID NO: 6422826 - DNA, 22 bp, Homo sapiens
tccttggggaggggtcagctct

SEQ ID NO: 6422827 - DNA, 12 bp, Homo sapiens
tccttggggcac

SEQ ID NO: 6422828 - DNA, 23 bp, Homo sapiens
tccttggggcagggcctgggcct

SEQ ID NO: 6422829 - DNA, 24 bp, Homo sapiens
tccttggggcagggcctgggcctc

SEQ ID NO: 6422830 - DNA, 18 bp, Homo sapiens
tccttgggtcattgacct

SEQ ID NO: 6422831 - DNA, 15 bp, Homo sapiens
tccttgggttgctgg

SEQ ID NO: 6422832 - DNA, 13 bp, Homo sapiens
tccttggtgcctc

SEQ ID NO: 6422833 - DNA, 16 bp, Homo sapiens
tccttggtgcctctgg

SEQ ID NO: 6422834 - DNA, 16 bp, Homo sapiens
tccttggtgctgtgtg

SEQ ID NO: 6422835 - DNA, 23 bp, Homo sapiens
tccttggtgctgtgtgccccact

SEQ ID NO: 6422836 - DNA, 21 bp, Homo sapiens
tccttggttatatttttttaa

SEQ ID NO: 6422837 - DNA, 16 bp, Homo sapiens
tccttggttatgtgca

SEQ ID NO: 6422838 - DNA, 19 bp, Homo sapiens
tccttggttttgcctcttt

SEQ ID NO: 6422839 - DNA, 12 bp, Homo sapiens
tccttgtaatac

SEQ ID NO: 6422840 - DNA, 16 bp, Homo sapiens
tccttgtaatacctga

SEQ ID NO: 6422841 - DNA, 18 bp, Homo sapiens
tccttgtactcttaggat

SEQ ID NO: 6422842 - DNA, 15 bp, Homo sapiens
tccttgtacttgaat

SEQ ID NO: 6422843 - DNA, 15 bp, Homo sapiens
tccttgtagcctttt

SEQ ID NO: 6422844 - DNA, 23 bp, Homo sapiens
tccttgtatgaataaaaggctgg

SEQ ID NO: 6422845 - DNA, 15 bp, Homo sapiens
tccttgtatttaaat

SEQ ID NO: 6422846 - DNA, 16 bp, Homo sapiens
tccttgtatttagtaa

SEQ ID NO: 6422847 - DNA, 20 bp, Homo sapiens
tccttgtcaatactgagcca

SEQ ID NO: 6422848 - DNA, 21 bp, Homo sapiens
tccttgtcacgatcacaggcc

SEQ ID NO: 6422849 - DNA, 14 bp, Homo sapiens
tccttgtcactgaa

SEQ ID NO: 6422850 - DNA, 21 bp, Homo sapiens
tccttgtcagggtctccttcc

SEQ ID NO: 6422851 - DNA, 13 bp, Homo sapiens
tccttgtcagttg

SEQ ID NO: 6422852 - DNA, 23 bp, Homo sapiens
tccttgtcccgtctggacctggg

SEQ ID NO: 6422853 - DNA, 20 bp, Homo sapiens
tccttgtctaaagatctttt

SEQ ID NO: 6422854 - DNA, 21 bp, Homo sapiens
tccttgtcttggcagcctact

SEQ ID NO: 6422855 - DNA, 22 bp, Homo sapiens
tccttgtgacttacaatttgca

SEQ ID NO: 6422856 - DNA, 12 bp, Homo sapiens
tccttgtgattg

SEQ ID NO: 6422857 - DNA, 23 bp, Homo sapiens
tccttgtgcaaaatatttgacta

SEQ ID NO: 6422858 - DNA, 21 bp, Homo sapiens
tccttgtgcaattgtcttttt

SEQ ID NO: 6422859 - DNA, 16 bp, Homo sapiens
tccttgtgccagagaa

SEQ ID NO: 6422860 - DNA, 23 bp, Homo sapiens
tccttgtgcctgctcctgtactt

SEQ ID NO: 6422861 - DNA, 21 bp, Homo sapiens
tccttgtggactggctgtgcc

SEQ ID NO: 6422862 - DNA, 23 bp, Homo sapiens
tccttgtggactggctgtgcccc

SEQ ID NO: 6422863 - DNA, 16 bp, Homo sapiens
tccttgtggcacattt

SEQ ID NO: 6422864 - DNA, 15 bp, Homo sapiens
tccttgtggcagagg

SEQ ID NO: 6422865 - DNA, 18 bp, Homo sapiens
tccttgtggcctatgaaa

SEQ ID NO: 6422866 - DNA, 16 bp, Homo sapiens
tccttgtggccttttt

SEQ ID NO: 6422867 - DNA, 20 bp, Homo sapiens
tccttgtggtctttgctgct

SEQ ID NO: 6422868 - DNA, 22 bp, Homo sapiens
tccttgtggtttatgtcatcat

SEQ ID NO: 6422869 - DNA, 15 bp, Homo sapiens
tccttgttcatggag

SEQ ID NO: 6422870 - DNA, 15 bp, Homo sapiens
tattcatctcaagga

SEQ ID NO: 6422871 - DNA, 11 bp, Homo sapiens
tattcatctgt

SEQ ID NO: 6422872 - DNA, 16 bp, Homo sapiens
tattcatctgttgaca

SEQ ID NO: 6422873 - DNA, 13 bp, Homo sapiens
tattcatgaagag

SEQ ID NO: 6422874 - DNA, 19 bp, Homo sapiens
tattcatgaagagttgttt

SEQ ID NO: 6422875 - DNA, 20 bp, Homo sapiens
tattcatgaagcggtcacag

SEQ ID NO: 6422876 - DNA, 23 bp, Homo sapiens
tattcatgctctcatatatattt

SEQ ID NO: 6422877 - DNA, 21 bp, Homo sapiens
tattcatgctgcctgccatgt

SEQ ID NO: 6422878 - DNA, 22 bp, Homo sapiens
tattcatgctgcctgccatgtg

SEQ ID NO: 6422879 - DNA, 20 bp, Homo sapiens
tattcatgctttctcctttt

SEQ ID NO: 6422880 - DNA, 17 bp, Homo sapiens
tattcatggatggctca

SEQ ID NO: 6422881 - DNA, 13 bp, Homo sapiens
tattcatggctac

SEQ ID NO: 6422882 - DNA, 14 bp, Homo sapiens
tattcatgtaataa

SEQ ID NO: 6422883 - DNA, 16 bp, Homo sapiens
tattcatgtaataaat

SEQ ID NO: 6422884 - DNA, 20 bp, Homo sapiens
tattcatgtaataaatctga

SEQ ID NO: 6422885 - DNA, 15 bp, Homo sapiens
tattcatgttcatgt

SEQ ID NO: 6422886 - DNA, 13 bp, Homo sapiens
tattcatgttttg

SEQ ID NO: 6422887 - DNA, 21 bp, Homo sapiens
tattcattacatcctctgctt

SEQ ID NO: 6422888 - DNA, 23 bp, Homo sapiens
tattcattactagataaaatgta

SEQ ID NO: 6422889 - DNA, 18 bp, Homo sapiens
tattcattatttgtcaaa

SEQ ID NO: 6422890 - DNA, 19 bp, Homo sapiens
tattcattcagatataaga

SEQ ID NO: 6422891 - DNA, 23 bp, Homo sapiens
tattcattcatggaccactgttt

SEQ ID NO: 6422892 - DNA, 16 bp, Homo sapiens
tattcattcctcacaa

SEQ ID NO: 6422893 - DNA, 20 bp, Homo sapiens
tattcattctgtgatcattt

SEQ ID NO: 6422894 - DNA, 16 bp, Homo sapiens
tattcattggcagctc

SEQ ID NO: 6422895 - DNA, 12 bp, Homo sapiens
tattcatttaaa

SEQ ID NO: 6422896 - DNA, 19 bp, Homo sapiens
tattcatttaaaatgatta

SEQ ID NO: 6422897 - DNA, 12 bp, Homo sapiens
tattcatttagt

SEQ ID NO: 6422898 - DNA, 13 bp, Homo sapiens
tattcattttact

SEQ ID NO: 6422899 - DNA, 15 bp, Homo sapiens
tattcattttctcta

SEQ ID NO: 6422900 - DNA, 16 bp, Homo sapiens
tattcattttctctaa

SEQ ID NO: 6422901 - DNA, 16 bp, Homo sapiens
tattcattttgcttct

SEQ ID NO: 6422902 - DNA, 21 bp, Homo sapiens
tattccaaaaaggttgctgtt

SEQ ID NO: 6422903 - DNA, 17 bp, Homo sapiens
tattccaaaccaaattt

SEQ ID NO: 6422904 - DNA, 19 bp, Homo sapiens
tattccaaggaaaattgaa

SEQ ID NO: 6422905 - DNA, 14 bp, Homo sapiens
tattccaagtgcat

SEQ ID NO: 6422906 - DNA, 13 bp, Homo sapiens
tattccaatcact

SEQ ID NO: 6422907 - DNA, 17 bp, Homo sapiens
tattccacaaacacatt

SEQ ID NO: 6422908 - DNA, 19 bp, Homo sapiens
tattccacagatatctttt

SEQ ID NO: 6422909 - DNA, 20 bp, Homo sapiens
tattccacagatatcttttt

SEQ ID NO: 6422910 - DNA, 22 bp, Homo sapiens
tattccacagatatctttttca

SEQ ID NO: 6422911 - DNA, 16 bp, Homo sapiens
tattccaccattcaca

SEQ ID NO: 6422912 - DNA, 19 bp, Homo sapiens
tattccaccttaaattaaa

SEQ ID NO: 6422913 - DNA, 22 bp, Homo sapiens
tattccaccttaaattaaacaa

SEQ ID NO: 6422914 - DNA, 15 bp, Homo sapiens
tattccactatttgc

SEQ ID NO: 6422915 - DNA, 16 bp, Homo sapiens
tattccagaagaacaa

SEQ ID NO: 6422916 - DNA, 22 bp, Homo sapiens
tattccagaccaaaataataca

SEQ ID NO: 6422917 - DNA, 22 bp, Homo sapiens
tattccagacttgggaggatgt

SEQ ID NO: 6422918 - DNA, 18 bp, Homo sapiens
tattccagctcattcatt

SEQ ID NO: 6422919 - DNA, 23 bp, Homo sapiens
tattccagctcattcattttata

SEQ ID NO: 6422920 - DNA, 14 bp, Homo sapiens
tattccatattaga

SEQ ID NO: 6422921 - DNA, 19 bp, Homo sapiens
tattccatattagaaaact

SEQ ID NO: 6422922 - DNA, 23 bp, Homo sapiens
tattccatattagaaaactttgt

SEQ ID NO: 6422923 - DNA, 15 bp, Homo sapiens
tattccatatttatt

SEQ ID NO: 6422924 - DNA, 17 bp, Homo sapiens
tattccatatttattca

SEQ ID NO: 6422925 - DNA, 16 bp, Homo sapiens
tattccatgaatgtat

SEQ ID NO: 6422926 - DNA, 12 bp, Homo sapiens
tattccatgact

SEQ ID NO: 6422927 - DNA, 23 bp, Homo sapiens
tattccatgactgcttgccctaa

SEQ ID NO: 6422928 - DNA, 16 bp, Homo sapiens
tattccatgagctgct

SEQ ID NO: 6422929 - DNA, 21 bp, Homo sapiens
tattccatgagctgctcatta

SEQ ID NO: 6422930 - DNA, 12 bp, Homo sapiens
tattccatgttt

SEQ ID NO: 6422931 - DNA, 14 bp, Homo sapiens
tattccatgtttta

SEQ ID NO: 6422932 - DNA, 23 bp, Homo sapiens
tattccatttttactaaagcagt

SEQ ID NO: 6422933 - DNA, 22 bp, Homo sapiens
tattcccaactgctctgcccac

SEQ ID NO: 6422934 - DNA, 13 bp, Homo sapiens
tattcccaagccg

SEQ ID NO: 6422935 - DNA, 24 bp, Homo sapiens
tattcccaagctgaatgttcttga

SEQ ID NO: 6422936 - DNA, 20 bp, Homo sapiens
tattcccaagtatgccttaa

SEQ ID NO: 6422937 - DNA, 21 bp, Homo sapiens
tattcccactttcattcaatc

SEQ ID NO: 6422938 - DNA, 14 bp, Homo sapiens
tattcccaggcagg

SEQ ID NO: 6422939 - DNA, 23 bp, Homo sapiens
tattcccagggccgcttctcctg

SEQ ID NO: 6422940 - DNA, 17 bp, Homo sapiens
tattccccagtgactcc

SEQ ID NO: 6422941 - DNA, 19 bp, Homo sapiens
tattccccagtgactccag

SEQ ID NO: 6422942 - DNA, 18 bp, Homo sapiens
tattccccatttcctgta

SEQ ID NO: 6422943 - DNA, 21 bp, Homo sapiens
tattccccatttcctgtacaa

SEQ ID NO: 6422944 - DNA, 16 bp, Homo sapiens
tattcccccaaacttt

SEQ ID NO: 6422945 - DNA, 15 bp, Homo sapiens
tattccctgcacaca

SEQ ID NO: 6422946 - DNA, 17 bp, Homo sapiens
tattccctgcacacaca

SEQ ID NO: 6422947 - DNA, 16 bp, Homo sapiens
tattcccttatctttt

SEQ ID NO: 6422948 - DNA, 22 bp, Homo sapiens
tattcccttctgatcttggaaa

SEQ ID NO: 6422949 - DNA, 21 bp, Homo sapiens
tattcccttgtattttgttaa

SEQ ID NO: 6422950 - DNA, 20 bp, Homo sapiens
tattccctttgacttcagct

SEQ ID NO: 6422951 - DNA, 19 bp, Homo sapiens
tattcctaacctgtcagaa

SEQ ID NO: 6422952 - DNA, 24 bp, Homo sapiens
tattcctagttggtgagaaacctg

SEQ ID NO: 6422953 - DNA, 20 bp, Homo sapiens
tattcctatatagtttattg

SEQ ID NO: 6422954 - DNA, 18 bp, Homo sapiens
tattcctcctgctcatat

SEQ ID NO: 6422955 - DNA, 17 bp, Homo sapiens
tattcctctgctgaaca

SEQ ID NO: 6422956 - DNA, 22 bp, Homo sapiens
tattcctgaccctccctacctg

SEQ ID NO: 6422957 - DNA, 22 bp, Homo sapiens
tattcctgacctccgccatcca

SEQ ID NO: 6422958 - DNA, 13 bp, Homo sapiens
tattcctgccttt

SEQ ID NO: 6422959 - DNA, 22 bp, Homo sapiens
tattcctgtggatgtaaagtga

SEQ ID NO: 6422960 - DNA, 17 bp, Homo sapiens
tattcctgttgctgtct

SEQ ID NO: 6422961 - DNA, 18 bp, Homo sapiens
tattcctgttgctgtctt

SEQ ID NO: 6422962 - DNA, 19 bp, Homo sapiens
tattccttactagaaatat

SEQ ID NO: 6422963 - DNA, 22 bp, Homo sapiens
tattccttactagaaatatatt

SEQ ID NO: 6422964 - DNA, 16 bp, Homo sapiens
tattccttctggcctt

SEQ ID NO: 6422965 - DNA, 19 bp, Homo sapiens
tattccttgatatttttct

SEQ ID NO: 6422966 - DNA, 13 bp, Homo sapiens
tattccttgttct

SEQ ID NO: 6422967 - DNA, 13 bp, Homo sapiens
tattcctttaaag

SEQ ID NO: 6422968 - DNA, 13 bp, Homo sapiens
tattcctttccct

SEQ ID NO: 6422969 - DNA, 19 bp, Homo sapiens
tattcctttcccttcctct

SEQ ID NO: 6422970 - DNA, 12 bp, Homo sapiens
tattcctttcct

SEQ ID NO: 6422971 - DNA, 14 bp, Homo sapiens
tattcctttccttt

SEQ ID NO: 6422972 - DNA, 21 bp, Homo sapiens
tattcctttccttttttgaga

SEQ ID NO: 6422973 - DNA, 16 bp, Homo sapiens
tattcctttctatcat

SEQ ID NO: 6422974 - DNA, 17 bp, Homo sapiens
tattcctttgaatattt

SEQ ID NO: 6422975 - DNA, 22 bp, Homo sapiens
tattcctttgttacttctctaa

SEQ ID NO: 6422976 - DNA, 23 bp, Homo sapiens
tattccttttaaagaagctttat

SEQ ID NO: 6422977 - DNA, 15 bp, Homo sapiens
tattccttttctgta

SEQ ID NO: 6422978 - DNA, 21 bp, Homo sapiens
tattcctttttattcctttta

SEQ ID NO: 6422979 - DNA, 15 bp, Homo sapiens
tattcctttttctat

SEQ ID NO: 6422980 - DNA, 16 bp, Homo sapiens
tattcgaaacctgtga

SEQ ID NO: 6422981 - DNA, 16 bp, Homo sapiens
tattcgaatgaaaaga

SEQ ID NO: 6422982 - DNA, 17 bp, Homo sapiens
tattcgaatgaaaagac

SEQ ID NO: 6422983 - DNA, 14 bp, Homo sapiens
tattcgaatgaaat

SEQ ID NO: 6422984 - DNA, 20 bp, Homo sapiens
tattcgccacacagtatttt

SEQ ID NO: 6422985 - DNA, 16 bp, Homo sapiens
tattcgtaagttctgt

SEQ ID NO: 6422986 - DNA, 23 bp, Homo sapiens
tattcgtgaataagttgattctg

SEQ ID NO: 6422987 - DNA, 14 bp, Homo sapiens
tattctaaaatata

SEQ ID NO: 6422988 - DNA, 22 bp, Homo sapiens
tattctaaagctttctgacaag

SEQ ID NO: 6422989 - DNA, 15 bp, Homo sapiens
tattctaaagttttg

SEQ ID NO: 6422990 - DNA, 19 bp, Homo sapiens
tattctaaattcactgttg

SEQ ID NO: 6422991 - DNA, 13 bp, Homo sapiens
tattctaacattt

SEQ ID NO: 6422992 - DNA, 12 bp, Homo sapiens
tattctaactta

SEQ ID NO: 6422993 - DNA, 13 bp, Homo sapiens
tattctaagactt

SEQ ID NO: 6422994 - DNA, 23 bp, Homo sapiens
tattctaaggagcaaatacctta

SEQ ID NO: 6422995 - DNA, 16 bp, Homo sapiens
tattctaataaatata

SEQ ID NO: 6422996 - DNA, 15 bp, Homo sapiens
tattctaataagcta

SEQ ID NO: 6422997 - DNA, 20 bp, Homo sapiens
tattctaataagctagttga

SEQ ID NO: 6422998 - DNA, 14 bp, Homo sapiens
tattctaatagttt

SEQ ID NO: 6422999 - DNA, 16 bp, Homo sapiens
tattctaattcttcat

SEQ ID NO: 6423000 - DNA, 17 bp, Homo sapiens
tattctaattcttcatt

SEQ ID NO: 6423001 - DNA, 15 bp, Homo sapiens
tattctaattttata

SEQ ID NO: 6423002 - DNA, 13 bp, Homo sapiens
tattctactatac

SEQ ID NO: 6423003 - DNA, 14 bp, Homo sapiens
tattctacttttaa

SEQ ID NO: 6423004 - DNA, 16 bp, Homo sapiens
tattctagagctttta

SEQ ID NO: 6423005 - DNA, 19 bp, Homo sapiens
tattctagctaatgtaata

SEQ ID NO: 6423006 - DNA, 18 bp, Homo sapiens
tattctagggtttcttaa

SEQ ID NO: 6423007 - DNA, 15 bp, Homo sapiens
tattctagtggctgt

SEQ ID NO: 6423008 - DNA, 17 bp, Homo sapiens
tattctagtggctgttc

SEQ ID NO: 6423009 - DNA, 19 bp, Homo sapiens
tattctataaaactctgca

SEQ ID NO: 6423010 - DNA, 15 bp, Homo sapiens
tattctataaacata

SEQ ID NO: 6423011 - DNA, 19 bp, Homo sapiens
tattctatatgaatttaaa

SEQ ID NO: 6423012 - DNA, 15 bp, Homo sapiens
tattctatctgtttt

SEQ ID NO: 6423013 - DNA, 12 bp, Homo sapiens
tattctatgtag

SEQ ID NO: 6423014 - DNA, 12 bp, Homo sapiens
tattctattgca

SEQ ID NO: 6423015 - DNA, 16 bp, Homo sapiens
tattctattgtattat

SEQ ID NO: 6423016 - DNA, 19 bp, Homo sapiens
tattctatttgtgtaagga

SEQ ID NO: 6423017 - DNA, 12 bp, Homo sapiens
tattctatttta

SEQ ID NO: 6423018 - DNA, 14 bp, Homo sapiens
tattctattttaca

SEQ ID NO: 6423019 - DNA, 22 bp, Homo sapiens
tattctattttcattttctgca

SEQ ID NO: 6423020 - DNA, 17 bp, Homo sapiens
tattctcaaacacagtt

SEQ ID NO: 6423021 - DNA, 13 bp, Homo sapiens
tattctcaaagat

SEQ ID NO: 6423022 - DNA, 18 bp, Homo sapiens
tattctcaaagatgcatt

SEQ ID NO: 6423023 - DNA, 14 bp, Homo sapiens
tattctcaaagcag

SEQ ID NO: 6423024 - DNA, 16 bp, Homo sapiens
tattctcaaagttaaa

SEQ ID NO: 6423025 - DNA, 15 bp, Homo sapiens
tattctcaccaggaa

SEQ ID NO: 6423026 - DNA, 16 bp, Homo sapiens
tattctcactccacca

SEQ ID NO: 6423027 - DNA, 19 bp, Homo sapiens
tattctcactccaccaccc

SEQ ID NO: 6423028 - DNA, 19 bp, Homo sapiens
tattctcagaacaccaagt

SEQ ID NO: 6423029 - DNA, 22 bp, Homo sapiens
tattctcagaacaccaagtaaa

SEQ ID NO: 6423030 - DNA, 23 bp, Homo sapiens
tattctcagaacaccaagtaaat

SEQ ID NO: 6423031 - DNA, 15 bp, Homo sapiens
tattctcagagcatg

SEQ ID NO: 6423032 - DNA, 20 bp, Homo sapiens
tattctcagtaacttttaaa

SEQ ID NO: 6423033 - DNA, 13 bp, Homo sapiens
tattctcataata

SEQ ID NO: 6423034 - DNA, 14 bp, Homo sapiens
tattctcataatac

SEQ ID NO: 6423035 - DNA, 15 bp, Homo sapiens
tattctcatggcttt

SEQ ID NO: 6423036 - DNA, 18 bp, Homo sapiens
tattctcattatgttgat

SEQ ID NO: 6423037 - DNA, 16 bp, Homo sapiens
tattctcattatttca

SEQ ID NO: 6423038 - DNA, 14 bp, Homo sapiens
tattctcatttagt

SEQ ID NO: 6423039 - DNA, 15 bp, Homo sapiens
tattctcatttagtg

SEQ ID NO: 6423040 - DNA, 16 bp, Homo sapiens
tattctcctatgtttg

SEQ ID NO: 6423041 - DNA, 15 bp, Homo sapiens
tattctcctccctgt

SEQ ID NO: 6423042 - DNA, 16 bp, Homo sapiens
tattctcctccctgtt

SEQ ID NO: 6423043 - DNA, 15 bp, Homo sapiens
tattctctaactatt

SEQ ID NO: 6423044 - DNA, 15 bp, Homo sapiens
tattctctatttgaa

SEQ ID NO: 6423045 - DNA, 24 bp, Homo sapiens
tattctctcctgtacctcttgagc

SEQ ID NO: 6423046 - DNA, 12 bp, Homo sapiens
tattctctctta

SEQ ID NO: 6423047 - DNA, 16 bp, Homo sapiens
tattctctcttattgt

SEQ ID NO: 6423048 - DNA, 14 bp, Homo sapiens
tattctctgatgtt

SEQ ID NO: 6423049 - DNA, 13 bp, Homo sapiens
tattctctgtaag

SEQ ID NO: 6423050 - DNA, 15 bp, Homo sapiens
tattctctgtacata

SEQ ID NO: 6423051 - DNA, 18 bp, Homo sapiens
tattctctgtccagggct

SEQ ID NO: 6423052 - DNA, 22 bp, Homo sapiens
tattctctgtttgcttttgaac

SEQ ID NO: 6423053 - DNA, 23 bp, Homo sapiens
tattctctttaccttctaaaagc

SEQ ID NO: 6423054 - DNA, 13 bp, Homo sapiens
tattctcttttca

SEQ ID NO: 6423055 - DNA, 18 bp, Homo sapiens
tattctgaaaaagacata

SEQ ID NO: 6423056 - DNA, 20 bp, Homo sapiens
tattctgaatcaccaattaa

SEQ ID NO: 6423057 - DNA, 15 bp, Homo sapiens
tattctgacatgtaa

SEQ ID NO: 6423058 - DNA, 19 bp, Homo sapiens
tattctgacatgtaagaaa

SEQ ID NO: 6423059 - DNA, 22 bp, Homo sapiens
tattctgaccttgtgaacatca

SEQ ID NO: 6423060 - DNA, 13 bp, Homo sapiens
tattctgataatg

SEQ ID NO: 6423061 - DNA, 14 bp, Homo sapiens
tattctgattccac

SEQ ID NO: 6423062 - DNA, 19 bp, Homo sapiens
tattctgcaacagcctgtt

SEQ ID NO: 6423063 - DNA, 20 bp, Homo sapiens
tattctgcctttgcagaaac

SEQ ID NO: 6423064 - DNA, 20 bp, Homo sapiens
tattctggatatcgtcattt

SEQ ID NO: 6423065 - DNA, 17 bp, Homo sapiens
tattctggctgataaaa

SEQ ID NO: 6423066 - DNA, 21 bp, Homo sapiens
tattctgggaaatgttttaat

SEQ ID NO: 6423067 - DNA, 19 bp, Homo sapiens
tattctgggaatgtatagt

SEQ ID NO: 6423068 - DNA, 23 bp, Homo sapiens
tattctgggaatgtatagtattt

SEQ ID NO: 6423069 - DNA, 20 bp, Homo sapiens
tattctgggctcctggaacc

SEQ ID NO: 6423070 - DNA, 15 bp, Homo sapiens
tattctgtaaaccta

SEQ ID NO: 6423071 - DNA, 15 bp, Homo sapiens
tattctgtaaagctt

SEQ ID NO: 6423072 - DNA, 22 bp, Homo sapiens
tattctgtcagtgttaaagatt

SEQ ID NO: 6423073 - DNA, 11 bp, Homo sapiens
tattctgtcat

SEQ ID NO: 6423074 - DNA, 12 bp, Homo sapiens
tattctgtccct

SEQ ID NO: 6423075 - DNA, 16 bp, Homo sapiens
tattctgtgaaactaa

SEQ ID NO: 6423076 - DNA, 22 bp, Homo sapiens
tattctgtgctgttacagtttt

SEQ ID NO: 6423077 - DNA, 14 bp, Homo sapiens
tattctgtggaaaa

SEQ ID NO: 6423078 - DNA, 19 bp, Homo sapiens
tattctgtggattctatat

SEQ ID NO: 6423079 - DNA, 14 bp, Homo sapiens
tattctgtgttgaa

SEQ ID NO: 6423080 - DNA, 21 bp, Homo sapiens
tattctgtgttgcattattca

SEQ ID NO: 6423081 - DNA, 22 bp, Homo sapiens
tattctgtgttgcattattcat

SEQ ID NO: 6423082 - DNA, 14 bp, Homo sapiens
tattctgttccaca

SEQ ID NO: 6423083 - DNA, 12 bp, Homo sapiens
tattctgtttat

SEQ ID NO: 6423084 - DNA, 19 bp, Homo sapiens
tattctgtttattatgaca

SEQ ID NO: 6423085 - DNA, 12 bp, Homo sapiens
tattctgtttgc

SEQ ID NO: 6423086 - DNA, 16 bp, Homo sapiens
tattctgttttgttaa

SEQ ID NO: 6423087 - DNA, 23 bp, Homo sapiens
tattcttaacagatctttactct

SEQ ID NO: 6423088 - DNA, 14 bp, Homo sapiens
tattcttaagcact

SEQ ID NO: 6423089 - DNA, 15 bp, Homo sapiens
tattcttaagcactt

SEQ ID NO: 6423090 - DNA, 19 bp, Homo sapiens
tattcttaagcactttgaa

SEQ ID NO: 6423091 - DNA, 16 bp, Homo sapiens
tattcttaagtaagga

SEQ ID NO: 6423092 - DNA, 16 bp, Homo sapiens
tattcttatgcagggt

SEQ ID NO: 6423093 - DNA, 14 bp, Homo sapiens
tattcttattcaaa

SEQ ID NO: 6423094 - DNA, 15 bp, Homo sapiens
tattcttattggaaa

SEQ ID NO: 6423095 - DNA, 22 bp, Homo sapiens
tattcttattggaaatgtactt

SEQ ID NO: 6423096 - DNA, 15 bp, Homo sapiens
tattcttatttaatg

SEQ ID NO: 6423097 - DNA, 15 bp, Homo sapiens
tattcttatttcatt

SEQ ID NO: 6423098 - DNA, 21 bp, Homo sapiens
tattcttcacgcagagatttt

SEQ ID NO: 6423099 - DNA, 14 bp, Homo sapiens
tattcttcataaca

SEQ ID NO: 6423100 - DNA, 15 bp, Homo sapiens
tattcttcatgaaat

SEQ ID NO: 6423101 - DNA, 18 bp, Homo sapiens
tattcttccaacacattt

SEQ ID NO: 6423102 - DNA, 15 bp, Homo sapiens
tattcttccttccca

SEQ ID NO: 6423103 - DNA, 13 bp, Homo sapiens
tattcttctagag

SEQ ID NO: 6423104 - DNA, 13 bp, Homo sapiens
tattcttcttgaa

SEQ ID NO: 6423105 - DNA, 13 bp, Homo sapiens
tattcttctttct

SEQ ID NO: 6423106 - DNA, 16 bp, Homo sapiens
tattcttgaaagtatt

SEQ ID NO: 6423107 - DNA, 23 bp, Homo sapiens
tattcttgatcagtagtttgcat

SEQ ID NO: 6423108 - DNA, 15 bp, Homo sapiens
tattcttgatgaaaa

SEQ ID NO: 6423109 - DNA, 14 bp, Homo sapiens
tattcttgcactga

SEQ ID NO: 6423110 - DNA, 21 bp, Homo sapiens
tattcttgctgggcatacttt

SEQ ID NO: 6423111 - DNA, 18 bp, Homo sapiens
tattcttggaccatgcca

SEQ ID NO: 6423112 - DNA, 20 bp, Homo sapiens
tattcttggaccatgccaga

SEQ ID NO: 6423113 - DNA, 14 bp, Homo sapiens
tattcttggttttc

SEQ ID NO: 6423114 - DNA, 16 bp, Homo sapiens
tattcttgtccacatt

SEQ ID NO: 6423115 - DNA, 14 bp, Homo sapiens
tattcttgtgaata

SEQ ID NO: 6423116 - DNA, 16 bp, Homo sapiens
tattcttgtggttaaa

SEQ ID NO: 6423117 - DNA, 18 bp, Homo sapiens
tattcttgttagaatctg

SEQ ID NO: 6423118 - DNA, 12 bp, Homo sapiens
tattctttacaa

SEQ ID NO: 6423119 - DNA, 20 bp, Homo sapiens
tattctttacaaaatgaatg

SEQ ID NO: 6423120 - DNA, 10 bp, Homo sapiens
tattctttga

SEQ ID NO: 6423121 - DNA, 22 bp, Homo sapiens
tattctttgatgttaacacatt

SEQ ID NO: 6423122 - DNA, 23 bp, Homo sapiens
tattctttgatgttaacacattt

SEQ ID NO: 6423123 - DNA, 14 bp, Homo sapiens
tattctttgcactt

SEQ ID NO: 6423124 - DNA, 15 bp, Homo sapiens
tattctttgttaatt

SEQ ID NO: 6423125 - DNA, 19 bp, Homo sapiens
tattctttgttaatttgga

SEQ ID NO: 6423126 - DNA, 16 bp, Homo sapiens
tattcttttatataac

SEQ ID NO: 6423127 - DNA, 13 bp, Homo sapiens
tattcttttctca

SEQ ID NO: 6423128 - DNA, 13 bp, Homo sapiens
tattctttttcca

SEQ ID NO: 6423129 - DNA, 21 bp, Homo sapiens
tattctttttgtgtgtgccaa

SEQ ID NO: 6423130 - DNA, 17 bp, Homo sapiens
tattctttttttctcta

SEQ ID NO: 6423131 - DNA, 15 bp, Homo sapiens
tattgaaaaaatcaa

SEQ ID NO: 6423132 - DNA, 23 bp, Homo sapiens
tattgaaaaatacgttttgtgta

SEQ ID NO: 6423133 - DNA, 14 bp, Homo sapiens
tattgaaaacactt

SEQ ID NO: 6423134 - DNA, 16 bp, Homo sapiens
tattgaaaacttcaaa

SEQ ID NO: 6423135 - DNA, 17 bp, Homo sapiens
tattgaaaacttcaaag

SEQ ID NO: 6423136 - DNA, 18 bp, Homo sapiens
tattgaaaacttcaaagc

SEQ ID NO: 6423137 - DNA, 17 bp, Homo sapiens
tattgaaaatgtcactg

SEQ ID NO: 6423138 - DNA, 23 bp, Homo sapiens
tattgaaagagtctgggaccctt

SEQ ID NO: 6423139 - DNA, 21 bp, Homo sapiens
tattgaaagccaacaactctg

SEQ ID NO: 6423140 - DNA, 14 bp, Homo sapiens
tattgaaagctcat

SEQ ID NO: 6423141 - DNA, 21 bp, Homo sapiens
tattgaaaggggacacctgta

SEQ ID NO: 6423142 - DNA, 16 bp, Homo sapiens
tattgaaatgatttca

SEQ ID NO: 6423143 - DNA, 15 bp, Homo sapiens
tattgaaatgtataa

SEQ ID NO: 6423144 - DNA, 16 bp, Homo sapiens
tattgaaatgtataat

SEQ ID NO: 6423145 - DNA, 13 bp, Homo sapiens
tattgaaattcta

SEQ ID NO: 6423146 - DNA, 14 bp, Homo sapiens
tattgaagaaacag

SEQ ID NO: 6423147 - DNA, 16 bp, Homo sapiens
tattgaagatacacaa

SEQ ID NO: 6423148 - DNA, 16 bp, Homo sapiens
tattgaagcagagtgg

SEQ ID NO: 6423149 - DNA, 13 bp, Homo sapiens
tattgaagcattt

SEQ ID NO: 6423150 - DNA, 19 bp, Homo sapiens
tattgaagcattttataaa

SEQ ID NO: 6423151 - DNA, 22 bp, Homo sapiens
tattgaaggaagccaaatttat

SEQ ID NO: 6423152 - DNA, 22 bp, Homo sapiens
tattgaaggaattagaaatgaa

SEQ ID NO: 6423153 - DNA, 17 bp, Homo sapiens
tattgaagtaagttcat

SEQ ID NO: 6423154 - DNA, 19 bp, Homo sapiens
tattgaagtaagttcatca

SEQ ID NO: 6423155 - DNA, 21 bp, Homo sapiens
tattgaagttgtttatcaact

SEQ ID NO: 6423156 - DNA, 15 bp, Homo sapiens
tattgaataaagaga

SEQ ID NO: 6423157 - DNA, 11 bp, Homo sapiens
tattgaataac

SEQ ID NO: 6423158 - DNA, 14 bp, Homo sapiens
tattgaatactgtc

SEQ ID NO: 6423159 - DNA, 20 bp, Homo sapiens
tattgaatataatatatttg

SEQ ID NO: 6423160 - DNA, 14 bp, Homo sapiens
tattgaatataatg

SEQ ID NO: 6423161 - DNA, 14 bp, Homo sapiens
tattgaatattgtg

SEQ ID NO: 6423162 - DNA, 23 bp, Homo sapiens
tattgaatattttattaaaacat

SEQ ID NO: 6423163 - DNA, 20 bp, Homo sapiens
tattgaatcagtttccaatt

SEQ ID NO: 6423164 - DNA, 22 bp, Homo sapiens
tattgaatcatgtagtatcaaa

SEQ ID NO: 6423165 - DNA, 17 bp, Homo sapiens
tattgaatgccttattt

SEQ ID NO: 6423166 - DNA, 15 bp, Homo sapiens
tattgaattagaaaa

SEQ ID NO: 6423167 - DNA, 17 bp, Homo sapiens
tattgaattagaaaatt

SEQ ID NO: 6423168 - DNA, 13 bp, Homo sapiens
tattgaattattt

SEQ ID NO: 6423169 - DNA, 16 bp, Homo sapiens
tattgaattattttgt

SEQ ID NO: 6423170 - DNA, 22 bp, Homo sapiens
tattgaattattttgttactgt

SEQ ID NO: 6423171 - DNA, 22 bp, Homo sapiens
tattgaatttgttagactagtt

SEQ ID NO: 6423172 - DNA, 13 bp, Homo sapiens
tattgaatttttc

SEQ ID NO: 6423173 - DNA, 15 bp, Homo sapiens
tattgaatttttcct

SEQ ID NO: 6423174 - DNA, 13 bp, Homo sapiens
tattgacaaaatg

SEQ ID NO: 6423175 - DNA, 16 bp, Homo sapiens
tattgacaaaatgtta

SEQ ID NO: 6423176 - DNA, 22 bp, Homo sapiens
tattgacaaaatgttatttccc

SEQ ID NO: 6423177 - DNA, 16 bp, Homo sapiens
tattgacaacagtttt

SEQ ID NO: 6423178 - DNA, 21 bp, Homo sapiens
tattgacaaccgagaaggttt

SEQ ID NO: 6423179 - DNA, 17 bp, Homo sapiens
tattgacaagtgtcttt

SEQ ID NO: 6423180 - DNA, 21 bp, Homo sapiens
tattgacaataaaatattatt

SEQ ID NO: 6423181 - DNA, 18 bp, Homo sapiens
tattgacaataatttcag

SEQ ID NO: 6423182 - DNA, 12 bp, Homo sapiens
tattgacactga

SEQ ID NO: 6423183 - DNA, 13 bp, Homo sapiens
tattgacactgaa

SEQ ID NO: 6423184 - DNA, 20 bp, Homo sapiens
tattgacaggtcttttcaaa

SEQ ID NO: 6423185 - DNA, 12 bp, Homo sapiens
tattgacagttg

SEQ ID NO: 6423186 - DNA, 17 bp, Homo sapiens
tattgacagttgtgcag

SEQ ID NO: 6423187 - DNA, 15 bp, Homo sapiens
tattgacatttgtag

SEQ ID NO: 6423188 - DNA, 16 bp, Homo sapiens
tattgacatttgtagt

SEQ ID NO: 6423189 - DNA, 21 bp, Homo sapiens
tattgacgacctacatctgaa

SEQ ID NO: 6423190 - DNA, 22 bp, Homo sapiens
tattgactaacaggccaaagag

SEQ ID NO: 6423191 - DNA, 14 bp, Homo sapiens
tattgactctgggt

SEQ ID NO: 6423192 - DNA, 22 bp, Homo sapiens
tattgactctgggtccttcctg

SEQ ID NO: 6423193 - DNA, 18 bp, Homo sapiens
tattgactgtctttccta

SEQ ID NO: 6423194 - DNA, 19 bp, Homo sapiens
tattgacttcaatgatagt

SEQ ID NO: 6423195 - DNA, 17 bp, Homo sapiens
tattgacttctcttgaa

SEQ ID NO: 6423196 - DNA, 19 bp, Homo sapiens
tattgactttgacaattac

SEQ ID NO: 6423197 - DNA, 19 bp, Homo sapiens
tattgagaacctggcctgt

SEQ ID NO: 6423198 - DNA, 20 bp, Homo sapiens
tattgagaatcccttaaaat

SEQ ID NO: 6423199 - DNA, 18 bp, Homo sapiens
tattgagaattttaaatt

SEQ ID NO: 6423200 - DNA, 15 bp, Homo sapiens
tattgagacaaaaat

SEQ ID NO: 6423201 - DNA, 16 bp, Homo sapiens
tattgagacactgtca

SEQ ID NO: 6423202 - DNA, 18 bp, Homo sapiens
tattgagacactgtcaag

SEQ ID NO: 6423203 - DNA, 19 bp, Homo sapiens
tattgagacattaatttgt

SEQ ID NO: 6423204 - DNA, 20 bp, Homo sapiens
tattgagacattaatttgta

SEQ ID NO: 6423205 - DNA, 19 bp, Homo sapiens
tattgagagagatgtgtaa

SEQ ID NO: 6423206 - DNA, 17 bp, Homo sapiens
tattgagattgtcctca

SEQ ID NO: 6423207 - DNA, 14 bp, Homo sapiens
tattgagatttctt

SEQ ID NO: 6423208 - DNA, 15 bp, Homo sapiens
tattgagatttctta

SEQ ID NO: 6423209 - DNA, 16 bp, Homo sapiens
tattgagattttccat

SEQ ID NO: 6423210 - DNA, 19 bp, Homo sapiens
tattgagcaatatgtcagt

SEQ ID NO: 6423211 - DNA, 21 bp, Homo sapiens
tattgagcagaattcattcat

SEQ ID NO: 6423212 - DNA, 18 bp, Homo sapiens
tattgagccttgcatgta

SEQ ID NO: 6423213 - DNA, 22 bp, Homo sapiens
tattgagctttgcatttatgat

SEQ ID NO: 6423214 - DNA, 15 bp, Homo sapiens
tattgaggaaaaata

SEQ ID NO: 6423215 - DNA, 22 bp, Homo sapiens
tattgaggaaaaatatgtgaag

SEQ ID NO: 6423216 - DNA, 20 bp, Homo sapiens
tattgaggatcagggctcct

SEQ ID NO: 6423217 - DNA, 17 bp, Homo sapiens
tattgaggccaagaata

SEQ ID NO: 6423218 - DNA, 16 bp, Homo sapiens
tattgaggcctgtcct

SEQ ID NO: 6423219 - DNA, 20 bp, Homo sapiens
tattgaggctttgtgttgta

SEQ ID NO: 6423220 - DNA, 23 bp, Homo sapiens
tattgaggctttgtgttgtaatt

SEQ ID NO: 6423221 - DNA, 21 bp, Homo sapiens
tattgagggatagattgtatc

SEQ ID NO: 6423222 - DNA, 17 bp, Homo sapiens
tattgagggccagtgat

SEQ ID NO: 6423223 - DNA, 22 bp, Homo sapiens
tattgagggccagtgatgatgt

SEQ ID NO: 6423224 - DNA, 17 bp, Homo sapiens
tattgaggggactaggc

SEQ ID NO: 6423225 - DNA, 21 bp, Homo sapiens
tattgagtcttaactgtattt

SEQ ID NO: 6423226 - DNA, 14 bp, Homo sapiens
tattgagtgtacat

SEQ ID NO: 6423227 - DNA, 19 bp, Homo sapiens
tattgagttccagttgaag

SEQ ID NO: 6423228 - DNA, 16 bp, Homo sapiens
tccttgttcatggaga

SEQ ID NO: 6423229 - DNA, 16 bp, Homo sapiens
tccttgttgtgatttt

SEQ ID NO: 6423230 - DNA, 14 bp, Homo sapiens
tccttgttgttggt

SEQ ID NO: 6423231 - DNA, 16 bp, Homo sapiens
tccttgttgtttgctt

SEQ ID NO: 6423232 - DNA, 17 bp, Homo sapiens
tccttgttgtttgcttt

SEQ ID NO: 6423233 - DNA, 14 bp, Homo sapiens
tccttgtttcctta

SEQ ID NO: 6423234 - DNA, 16 bp, Homo sapiens
tccttgttttaagatt

SEQ ID NO: 6423235 - DNA, 13 bp, Homo sapiens
tccttgttttgat

SEQ ID NO: 6423236 - DNA, 16 bp, Homo sapiens
tcctttaaaaaaattt

SEQ ID NO: 6423237 - DNA, 13 bp, Homo sapiens
tcctttaaaatat

SEQ ID NO: 6423238 - DNA, 17 bp, Homo sapiens
tcctttaaatttcagct

SEQ ID NO: 6423239 - DNA, 12 bp, Homo sapiens
tcctttaaccca

SEQ ID NO: 6423240 - DNA, 17 bp, Homo sapiens
tcctttaactatcagag

SEQ ID NO: 6423241 - DNA, 23 bp, Homo sapiens
tcctttaactatcagagggatct

SEQ ID NO: 6423242 - DNA, 13 bp, Homo sapiens
tcctttaactcgt

SEQ ID NO: 6423243 - DNA, 20 bp, Homo sapiens
tcctttaaggtactgaagct

SEQ ID NO: 6423244 - DNA, 22 bp, Homo sapiens
tcctttaatgacattgatttct

SEQ ID NO: 6423245 - DNA, 13 bp, Homo sapiens
tcctttaattgta

SEQ ID NO: 6423246 - DNA, 15 bp, Homo sapiens
tcctttacaaaagaa

SEQ ID NO: 6423247 - DNA, 21 bp, Homo sapiens
tcctttacaaaagaaatacct

SEQ ID NO: 6423248 - DNA, 18 bp, Homo sapiens
tcctttacaaccatactt

SEQ ID NO: 6423249 - DNA, 19 bp, Homo sapiens
tcctttacaaccatacttt

SEQ ID NO: 6423250 - DNA, 23 bp, Homo sapiens
tcctttacaactaaataacacag

SEQ ID NO: 6423251 - DNA, 14 bp, Homo sapiens
tcctttacagctgt

SEQ ID NO: 6423252 - DNA, 21 bp, Homo sapiens
tcctttaccgaggacagcctg

SEQ ID NO: 6423253 - DNA, 22 bp, Homo sapiens
tcctttacctaccaccttccct

SEQ ID NO: 6423254 - DNA, 16 bp, Homo sapiens
tcctttaccttttcta

SEQ ID NO: 6423255 - DNA, 18 bp, Homo sapiens
tcctttaccttttctata

SEQ ID NO: 6423256 - DNA, 21 bp, Homo sapiens
tcctttaggcagcctgccgcc

SEQ ID NO: 6423257 - DNA, 16 bp, Homo sapiens
tcctttaggtaagaag

SEQ ID NO: 6423258 - DNA, 16 bp, Homo sapiens
tcctttaggtttgaaa

SEQ ID NO: 6423259 - DNA, 19 bp, Homo sapiens
tcctttagtttgcttctgt

SEQ ID NO: 6423260 - DNA, 18 bp, Homo sapiens
tcctttataagttgcttt

SEQ ID NO: 6423261 - DNA, 16 bp, Homo sapiens
tcctttatactgtgaa

SEQ ID NO: 6423262 - DNA, 20 bp, Homo sapiens
tcctttatactgtgaagtta

SEQ ID NO: 6423263 - DNA, 20 bp, Homo sapiens
tcctttatattttttgtctg

SEQ ID NO: 6423264 - DNA, 16 bp, Homo sapiens
tcctttatctgcacct

SEQ ID NO: 6423265 - DNA, 13 bp, Homo sapiens
tcctttatgtatt

SEQ ID NO: 6423266 - DNA, 13 bp, Homo sapiens
tcctttatgtgaa

SEQ ID NO: 6423267 - DNA, 23 bp, Homo sapiens
tcctttatgtgaatttttaagct

SEQ ID NO: 6423268 - DNA, 23 bp, Homo sapiens
tcctttattataatcaaagctca

SEQ ID NO: 6423269 - DNA, 17 bp, Homo sapiens
tcctttattattatttt

SEQ ID NO: 6423270 - DNA, 18 bp, Homo sapiens
tcctttattattctgtat

SEQ ID NO: 6423271 - DNA, 17 bp, Homo sapiens
tcctttatttctgataa

SEQ ID NO: 6423272 - DNA, 19 bp, Homo sapiens
tcctttattttattgaaat

SEQ ID NO: 6423273 - DNA, 14 bp, Homo sapiens
tcctttcaataaag

SEQ ID NO: 6423274 - DNA, 20 bp, Homo sapiens
tcctttcaattccaccaggg

SEQ ID NO: 6423275 - DNA, 21 bp, Homo sapiens
tcctttcaattccaccagggc

SEQ ID NO: 6423276 - DNA, 19 bp, Homo sapiens
tcctttcacaaccttctgt

SEQ ID NO: 6423277 - DNA, 16 bp, Homo sapiens
tcctttcacacatctg

SEQ ID NO: 6423278 - DNA, 18 bp, Homo sapiens
tcctttcaccccagggcc

SEQ ID NO: 6423279 - DNA, 16 bp, Homo sapiens
tcctttcacttctttc

SEQ ID NO: 6423280 - DNA, 23 bp, Homo sapiens
tcctttcagcaatccatgagata

SEQ ID NO: 6423281 - DNA, 14 bp, Homo sapiens
tcctttcagccaca

SEQ ID NO: 6423282 - DNA, 22 bp, Homo sapiens
tcctttcagggaatttcaggaa

SEQ ID NO: 6423283 - DNA, 19 bp, Homo sapiens
tcctttcaggttttcaggt

SEQ ID NO: 6423284 - DNA, 17 bp, Homo sapiens
tcctttcatcctcagca

SEQ ID NO: 6423285 - DNA, 18 bp, Homo sapiens
tcctttcatcctcagcaa

SEQ ID NO: 6423286 - DNA, 20 bp, Homo sapiens
tcctttcatcctcagcaagt

SEQ ID NO: 6423287 - DNA, 15 bp, Homo sapiens
tcctttcattttctt

SEQ ID NO: 6423288 - DNA, 17 bp, Homo sapiens
tcctttccaaggcttct

SEQ ID NO: 6423289 - DNA, 21 bp, Homo sapiens
tcctttccaatagaaagaaac

SEQ ID NO: 6423290 - DNA, 21 bp, Homo sapiens
tcctttccagtggcctggctc

SEQ ID NO: 6423291 - DNA, 14 bp, Homo sapiens
tcctttccatcagc

SEQ ID NO: 6423292 - DNA, 17 bp, Homo sapiens
tcctttccatcagcttt

SEQ ID NO: 6423293 - DNA, 21 bp, Homo sapiens
tcctttcccaagccttcgggc

SEQ ID NO: 6423294 - DNA, 13 bp, Homo sapiens
tcctttcccacag

SEQ ID NO: 6423295 - DNA, 13 bp, Homo sapiens
tcctttccccagc

SEQ ID NO: 6423296 - DNA, 14 bp, Homo sapiens
tcctttccccagcc

SEQ ID NO: 6423297 - DNA, 20 bp, Homo sapiens
tcctttccccagcccagggt

SEQ ID NO: 6423298 - DNA, 14 bp, Homo sapiens
tcctttcccctctc

SEQ ID NO: 6423299 - DNA, 16 bp, Homo sapiens
tcctttcccctctctg

SEQ ID NO: 6423300 - DNA, 15 bp, Homo sapiens
tcctttccctctccc

SEQ ID NO: 6423301 - DNA, 12 bp, Homo sapiens
tcctttccctgg

SEQ ID NO: 6423302 - DNA, 15 bp, Homo sapiens
tcctttccctggagc

SEQ ID NO: 6423303 - DNA, 16 bp, Homo sapiens
tcctttccctggagct

SEQ ID NO: 6423304 - DNA, 13 bp, Homo sapiens
tcctttcccttcc

SEQ ID NO: 6423305 - DNA, 17 bp, Homo sapiens
tcctttcccttcctctt

SEQ ID NO: 6423306 - DNA, 18 bp, Homo sapiens
tcctttcctactgtcctg

SEQ ID NO: 6423307 - DNA, 14 bp, Homo sapiens
tcctttcctcctct

SEQ ID NO: 6423308 - DNA, 14 bp, Homo sapiens
tcctttcctctcct

SEQ ID NO: 6423309 - DNA, 23 bp, Homo sapiens
tcctttcctgatcaaggtgctct

SEQ ID NO: 6423310 - DNA, 12 bp, Homo sapiens
tcctttccttcc

SEQ ID NO: 6423311 - DNA, 15 bp, Homo sapiens
tcctttccttctcgt

SEQ ID NO: 6423312 - DNA, 19 bp, Homo sapiens
tcctttctaaggagcacta

SEQ ID NO: 6423313 - DNA, 19 bp, Homo sapiens
tcctttctagagcactgcc

SEQ ID NO: 6423314 - DNA, 13 bp, Homo sapiens
tcctttctcaccg

SEQ ID NO: 6423315 - DNA, 16 bp, Homo sapiens
tcctttctccagccag

SEQ ID NO: 6423316 - DNA, 15 bp, Homo sapiens
tcctttctccaggcc

SEQ ID NO: 6423317 - DNA, 16 bp, Homo sapiens
tcctttctccaggccc

SEQ ID NO: 6423318 - DNA, 19 bp, Homo sapiens
tcctttctcctgtgaatgg

SEQ ID NO: 6423319 - DNA, 13 bp, Homo sapiens
tcctttctctcta

SEQ ID NO: 6423320 - DNA, 13 bp, Homo sapiens
tcctttctctctt

SEQ ID NO: 6423321 - DNA, 15 bp, Homo sapiens
tcctttctctttctc

SEQ ID NO: 6423322 - DNA, 17 bp, Homo sapiens
tcctttctgactgtccc

SEQ ID NO: 6423323 - DNA, 18 bp, Homo sapiens
tcctttctgactgtccct

SEQ ID NO: 6423324 - DNA, 13 bp, Homo sapiens
tcctttctgccca

SEQ ID NO: 6423325 - DNA, 21 bp, Homo sapiens
tcctttctgccccccagggct

SEQ ID NO: 6423326 - DNA, 13 bp, Homo sapiens
tcctttctgcctt

SEQ ID NO: 6423327 - DNA, 23 bp, Homo sapiens
tcctttctgtaggtttctctctt

SEQ ID NO: 6423328 - DNA, 13 bp, Homo sapiens
tcctttctgtatt

SEQ ID NO: 6423329 - DNA, 15 bp, Homo sapiens
tcctttctgtgaagc

SEQ ID NO: 6423330 - DNA, 16 bp, Homo sapiens
tcctttctgtgaagct

SEQ ID NO: 6423331 - DNA, 17 bp, Homo sapiens
tcctttctgtgccctac

SEQ ID NO: 6423332 - DNA, 13 bp, Homo sapiens
tcctttcttatct

SEQ ID NO: 6423333 - DNA, 20 bp, Homo sapiens
tcctttcttatcttgaccat

SEQ ID NO: 6423334 - DNA, 22 bp, Homo sapiens
tcctttcttccctcatgttctc

SEQ ID NO: 6423335 - DNA, 20 bp, Homo sapiens
tcctttcttggttcataaat

SEQ ID NO: 6423336 - DNA, 21 bp, Homo sapiens
tcctttcttgtgccctgggcc

SEQ ID NO: 6423337 - DNA, 15 bp, Homo sapiens
tcctttctttctaac

SEQ ID NO: 6423338 - DNA, 20 bp, Homo sapiens
tcctttcttttttttcttgg

SEQ ID NO: 6423339 - DNA, 23 bp, Homo sapiens
tcctttgaacgtgcttctttgta

SEQ ID NO: 6423340 - DNA, 22 bp, Homo sapiens
tcctttgaacttgattgcctat

SEQ ID NO: 6423341 - DNA, 15 bp, Homo sapiens
tcctttgaagaggaa

SEQ ID NO: 6423342 - DNA, 20 bp, Homo sapiens
tcctttgaatcctctctctg

SEQ ID NO: 6423343 - DNA, 21 bp, Homo sapiens
tcctttgaatcctctctctgt

SEQ ID NO: 6423344 - DNA, 22 bp, Homo sapiens
tcctttgaccactgtctttttc

SEQ ID NO: 6423345 - DNA, 18 bp, Homo sapiens
tcctttgacctctcactt

SEQ ID NO: 6423346 - DNA, 15 bp, Homo sapiens
tcctttgagaaagaa

SEQ ID NO: 6423347 - DNA, 13 bp, Homo sapiens
tcctttgaggccc

SEQ ID NO: 6423348 - DNA, 21 bp, Homo sapiens
tcctttgagtgccaatttctt

SEQ ID NO: 6423349 - DNA, 20 bp, Homo sapiens
tcctttgataaaataaatga

SEQ ID NO: 6423350 - DNA, 16 bp, Homo sapiens
tcctttgatagaagat

SEQ ID NO: 6423351 - DNA, 18 bp, Homo sapiens
tcctttgatctcgctgta

SEQ ID NO: 6423352 - DNA, 24 bp, Homo sapiens
tcctttgatggctttttttgccta

SEQ ID NO: 6423353 - DNA, 15 bp, Homo sapiens
tcctttgcaggctca

SEQ ID NO: 6423354 - DNA, 15 bp, Homo sapiens
tcctttgcagggcag

SEQ ID NO: 6423355 - DNA, 18 bp, Homo sapiens
tcctttgcagggcagccc

SEQ ID NO: 6423356 - DNA, 17 bp, Homo sapiens
tcctttgcagtgtctta

SEQ ID NO: 6423357 - DNA, 19 bp, Homo sapiens
tcctttgcatggcagggcc

SEQ ID NO: 6423358 - DNA, 22 bp, Homo sapiens
tcctttgcattccatgatttta

SEQ ID NO: 6423359 - DNA, 17 bp, Homo sapiens
tcctttgccccaaggct

SEQ ID NO: 6423360 - DNA, 15 bp, Homo sapiens
tcctttgcccttcct

SEQ ID NO: 6423361 - DNA, 21 bp, Homo sapiens
tcctttgcccttcctcctgcc

SEQ ID NO: 6423362 - DNA, 23 bp, Homo sapiens
tcctttgcctaggaggccttctc

SEQ ID NO: 6423363 - DNA, 14 bp, Homo sapiens
tcctttgcctctgc

SEQ ID NO: 6423364 - DNA, 14 bp, Homo sapiens
tcctttgctagtgt

SEQ ID NO: 6423365 - DNA, 15 bp, Homo sapiens
tcctttgctctggat

SEQ ID NO: 6423366 - DNA, 13 bp, Homo sapiens
tcctttgctcttg

SEQ ID NO: 6423367 - DNA, 22 bp, Homo sapiens
tcctttggagggagggctgacc

SEQ ID NO: 6423368 - DNA, 17 bp, Homo sapiens
tcctttggcaatatcat

SEQ ID NO: 6423369 - DNA, 15 bp, Homo sapiens
tcctttggcatgttt

SEQ ID NO: 6423370 - DNA, 17 bp, Homo sapiens
tcctttggcatgtttaa

SEQ ID NO: 6423371 - DNA, 21 bp, Homo sapiens
tcctttggcatgtttaattgt

SEQ ID NO: 6423372 - DNA, 23 bp, Homo sapiens
tcctttgggcttcagctgccagt

SEQ ID NO: 6423373 - DNA, 19 bp, Homo sapiens
tcctttggggaagtttatt

SEQ ID NO: 6423374 - DNA, 18 bp, Homo sapiens
tcctttggtatttcactg

SEQ ID NO: 6423375 - DNA, 19 bp, Homo sapiens
tcctttgtatattatttct

SEQ ID NO: 6423376 - DNA, 23 bp, Homo sapiens
tcctttgtatattatttctagga

SEQ ID NO: 6423377 - DNA, 15 bp, Homo sapiens
tcctttgtattctgt

SEQ ID NO: 6423378 - DNA, 21 bp, Homo sapiens
tcctttgtcttcaaactgtga

SEQ ID NO: 6423379 - DNA, 13 bp, Homo sapiens
tcctttgtctttc

SEQ ID NO: 6423380 - DNA, 22 bp, Homo sapiens
tcctttgtctttctttgtcatt

SEQ ID NO: 6423381 - DNA, 14 bp, Homo sapiens
tcctttgtgaaaaa

SEQ ID NO: 6423382 - DNA, 19 bp, Homo sapiens
tcctttgtgagcctatgat

SEQ ID NO: 6423383 - DNA, 18 bp, Homo sapiens
tcctttgtgaggaagccg

SEQ ID NO: 6423384 - DNA, 18 bp, Homo sapiens
tcctttgtgtggctgccc

SEQ ID NO: 6423385 - DNA, 20 bp, Homo sapiens
tcctttgtgtggctgcccca

SEQ ID NO: 6423386 - DNA, 20 bp, Homo sapiens
tcctttgtgtttctattgac

SEQ ID NO: 6423387 - DNA, 19 bp, Homo sapiens
tcctttgttattatcctgc

SEQ ID NO: 6423388 - DNA, 22 bp, Homo sapiens
tcctttgttattatcctgcatt

SEQ ID NO: 6423389 - DNA, 13 bp, Homo sapiens
tcctttgttccct

SEQ ID NO: 6423390 - DNA, 20 bp, Homo sapiens
tcctttgtttaataaaggct

SEQ ID NO: 6423391 - DNA, 12 bp, Homo sapiens
tccttttaaaga

SEQ ID NO: 6423392 - DNA, 14 bp, Homo sapiens
tccttttaaagaaa

SEQ ID NO: 6423393 - DNA, 17 bp, Homo sapiens
tccttttaaagaagctt

SEQ ID NO: 6423394 - DNA, 12 bp, Homo sapiens
tccttttaagaa

SEQ ID NO: 6423395 - DNA, 15 bp, Homo sapiens
tccttttaagaaagc

SEQ ID NO: 6423396 - DNA, 21 bp, Homo sapiens
tccttttaagaaagcttcttg

SEQ ID NO: 6423397 - DNA, 20 bp, Homo sapiens
tccttttagcacatcactga

SEQ ID NO: 6423398 - DNA, 15 bp, Homo sapiens
tccttttagcctagt

SEQ ID NO: 6423399 - DNA, 16 bp, Homo sapiens
tccttttagtgataaa

SEQ ID NO: 6423400 - DNA, 20 bp, Homo sapiens
tccttttataagatttaatt

SEQ ID NO: 6423401 - DNA, 15 bp, Homo sapiens
tccttttataggtga

SEQ ID NO: 6423402 - DNA, 13 bp, Homo sapiens
tccttttatataa

SEQ ID NO: 6423403 - DNA, 17 bp, Homo sapiens
tccttttattctgtacc

SEQ ID NO: 6423404 - DNA, 17 bp, Homo sapiens
tccttttatttataaca

SEQ ID NO: 6423405 - DNA, 14 bp, Homo sapiens
tccttttatttctc

SEQ ID NO: 6423406 - DNA, 14 bp, Homo sapiens
tccttttcataggt

SEQ ID NO: 6423407 - DNA, 21 bp, Homo sapiens
tattgagttccagttgaagtt

SEQ ID NO: 6423408 - DNA, 14 bp, Homo sapiens
tattgagtttgtag

SEQ ID NO: 6423409 - DNA, 21 bp, Homo sapiens
tattgagtttgtaggtaaaat

SEQ ID NO: 6423410 - DNA, 14 bp, Homo sapiens
tattgataaatttt

SEQ ID NO: 6423411 - DNA, 19 bp, Homo sapiens
tattgataagatcttttat

SEQ ID NO: 6423412 - DNA, 19 bp, Homo sapiens
tattgatacaacaggattt

SEQ ID NO: 6423413 - DNA, 21 bp, Homo sapiens
tattgatacaatattgtgcat

SEQ ID NO: 6423414 - DNA, 18 bp, Homo sapiens
tattgatagatgcaagag

SEQ ID NO: 6423415 - DNA, 14 bp, Homo sapiens
tattgatagtactc

SEQ ID NO: 6423416 - DNA, 13 bp, Homo sapiens
tattgatatatat

SEQ ID NO: 6423417 - DNA, 11 bp, Homo sapiens
tattgatattc

SEQ ID NO: 6423418 - DNA, 14 bp, Homo sapiens
tattgatattcaat

SEQ ID NO: 6423419 - DNA, 18 bp, Homo sapiens
tattgatcaaaatcaaaa

SEQ ID NO: 6423420 - DNA, 14 bp, Homo sapiens
tattgatcccacat

SEQ ID NO: 6423421 - DNA, 23 bp, Homo sapiens
tattgatcccttctcctgccctt

SEQ ID NO: 6423422 - DNA, 21 bp, Homo sapiens
tattgatctttttatcatgat

SEQ ID NO: 6423423 - DNA, 12 bp, Homo sapiens
tattgatgaaaa

SEQ ID NO: 6423424 - DNA, 17 bp, Homo sapiens
tattgatgaaaagattt

SEQ ID NO: 6423425 - DNA, 13 bp, Homo sapiens
tattgatgaaaat

SEQ ID NO: 6423426 - DNA, 24 bp, Homo sapiens
tattgatgaggtttattctatctg

SEQ ID NO: 6423427 - DNA, 14 bp, Homo sapiens
tattgatgcaatat

SEQ ID NO: 6423428 - DNA, 22 bp, Homo sapiens
tattgatgcaatataagcataa

SEQ ID NO: 6423429 - DNA, 23 bp, Homo sapiens
tattgatgcaatataagcataaa

SEQ ID NO: 6423430 - DNA, 19 bp, Homo sapiens
tattgatgcagacaaatga

SEQ ID NO: 6423431 - DNA, 22 bp, Homo sapiens
tattgatgtacagtctgtcatg

SEQ ID NO: 6423432 - DNA, 13 bp, Homo sapiens
tattgatgtcagt

SEQ ID NO: 6423433 - DNA, 19 bp, Homo sapiens
tattgatgtttccagaaaa

SEQ ID NO: 6423434 - DNA, 13 bp, Homo sapiens
tattgatgttttc

SEQ ID NO: 6423435 - DNA, 14 bp, Homo sapiens
tattgattaagcct

SEQ ID NO: 6423436 - DNA, 23 bp, Homo sapiens
tattgattcacctcctaaaacaa

SEQ ID NO: 6423437 - DNA, 20 bp, Homo sapiens
tattgattgaaaaaagagaa

SEQ ID NO: 6423438 - DNA, 17 bp, Homo sapiens
tattgatttaaaagtgt

SEQ ID NO: 6423439 - DNA, 22 bp, Homo sapiens
tattgatttgaaaagaatttgt

SEQ ID NO: 6423440 - DNA, 22 bp, Homo sapiens
tattgatttgtcccagaatttt

SEQ ID NO: 6423441 - DNA, 16 bp, Homo sapiens
tattgattttctttct

SEQ ID NO: 6423442 - DNA, 15 bp, Homo sapiens
tattgatttttaaga

SEQ ID NO: 6423443 - DNA, 17 bp, Homo sapiens
tattgcaaaaacatagt

SEQ ID NO: 6423444 - DNA, 12 bp, Homo sapiens
tattgcaaaata

SEQ ID NO: 6423445 - DNA, 21 bp, Homo sapiens
tattgcaaaggttccaactgt

SEQ ID NO: 6423446 - DNA, 14 bp, Homo sapiens
tattgcaaagtcag

SEQ ID NO: 6423447 - DNA, 14 bp, Homo sapiens
tattgcaaatgagg

SEQ ID NO: 6423448 - DNA, 24 bp, Homo sapiens
tattgcaaatgagggaagaacatt

SEQ ID NO: 6423449 - DNA, 15 bp, Homo sapiens
tattgcaactctttt

SEQ ID NO: 6423450 - DNA, 18 bp, Homo sapiens
tattgcaaggcagtctct

SEQ ID NO: 6423451 - DNA, 23 bp, Homo sapiens
tattgcaaggcagtctctatatt

SEQ ID NO: 6423452 - DNA, 16 bp, Homo sapiens
tattgcacatcatatt

SEQ ID NO: 6423453 - DNA, 12 bp, Homo sapiens
tattgcacatgt

SEQ ID NO: 6423454 - DNA, 23 bp, Homo sapiens
tattgcacatgtcttaatgaagt

SEQ ID NO: 6423455 - DNA, 17 bp, Homo sapiens
tattgcacattgtaaaa

SEQ ID NO: 6423456 - DNA, 20 bp, Homo sapiens
tattgcactagagaaaataa

SEQ ID NO: 6423457 - DNA, 18 bp, Homo sapiens
tattgcaggagacatttt

SEQ ID NO: 6423458 - DNA, 21 bp, Homo sapiens
tattgcagttcatactgaatg

SEQ ID NO: 6423459 - DNA, 13 bp, Homo sapiens
tattgcagtttat

SEQ ID NO: 6423460 - DNA, 11 bp, Homo sapiens
tattgcataag

SEQ ID NO: 6423461 - DNA, 13 bp, Homo sapiens
tattgcatataga

SEQ ID NO: 6423462 - DNA, 18 bp, Homo sapiens
tattgcatatagatttag

SEQ ID NO: 6423463 - DNA, 22 bp, Homo sapiens
tattgcatctgggtagctgtaa

SEQ ID NO: 6423464 - DNA, 16 bp, Homo sapiens
tattgcatctgtataa

SEQ ID NO: 6423465 - DNA, 19 bp, Homo sapiens
tattgcatgtaaaatgcag

SEQ ID NO: 6423466 - DNA, 17 bp, Homo sapiens
tattgcatttgctgttg

SEQ ID NO: 6423467 - DNA, 21 bp, Homo sapiens
tattgccaaaacccagctgca

SEQ ID NO: 6423468 - DNA, 15 bp, Homo sapiens
tattgccaaacatta

SEQ ID NO: 6423469 - DNA, 22 bp, Homo sapiens
tattgccaaacattaatgttga

SEQ ID NO: 6423470 - DNA, 14 bp, Homo sapiens
tattgccaatgcta

SEQ ID NO: 6423471 - DNA, 21 bp, Homo sapiens
tattgccacaatgcctctccc

SEQ ID NO: 6423472 - DNA, 22 bp, Homo sapiens
tattgccaggaatgtttcagct

SEQ ID NO: 6423473 - DNA, 20 bp, Homo sapiens
tattgccatccactcctttt

SEQ ID NO: 6423474 - DNA, 21 bp, Homo sapiens
tattgccatcgggtgccaaat

SEQ ID NO: 6423475 - DNA, 21 bp, Homo sapiens
tattgccattatagcgcctgt

SEQ ID NO: 6423476 - DNA, 15 bp, Homo sapiens
tattgcccaggctgg

SEQ ID NO: 6423477 - DNA, 20 bp, Homo sapiens
tattgcccaggctggtcttg

SEQ ID NO: 6423478 - DNA, 14 bp, Homo sapiens
tattgcccccatgg

SEQ ID NO: 6423479 - DNA, 20 bp, Homo sapiens
tattgcctaagaataaacat

SEQ ID NO: 6423480 - DNA, 15 bp, Homo sapiens
tattgcctctgagag

SEQ ID NO: 6423481 - DNA, 13 bp, Homo sapiens
tattgccttattt

SEQ ID NO: 6423482 - DNA, 11 bp, Homo sapiens
tattgccttct

SEQ ID NO: 6423483 - DNA, 21 bp, Homo sapiens
tattgccttctcaccagctgc

SEQ ID NO: 6423484 - DNA, 15 bp, Homo sapiens
tattgccttctttga

SEQ ID NO: 6423485 - DNA, 17 bp, Homo sapiens
tattgccttctttgaag

SEQ ID NO: 6423486 - DNA, 18 bp, Homo sapiens
tattgccttctttgaaga

SEQ ID NO: 6423487 - DNA, 19 bp, Homo sapiens
tattgccttgatgtttcta

SEQ ID NO: 6423488 - DNA, 23 bp, Homo sapiens
tattgccttggctctatttggca

SEQ ID NO: 6423489 - DNA, 22 bp, Homo sapiens
tattgctaaaagtgcatttaag

SEQ ID NO: 6423490 - DNA, 15 bp, Homo sapiens
tattgctagagctcc

SEQ ID NO: 6423491 - DNA, 15 bp, Homo sapiens
tattgctagtatttg

SEQ ID NO: 6423492 - DNA, 16 bp, Homo sapiens
tattgctagtatttga

SEQ ID NO: 6423493 - DNA, 14 bp, Homo sapiens
tattgctatatttg

SEQ ID NO: 6423494 - DNA, 17 bp, Homo sapiens
tattgctatctaatggg

SEQ ID NO: 6423495 - DNA, 17 bp, Homo sapiens
tattgctatgttcttct

SEQ ID NO: 6423496 - DNA, 19 bp, Homo sapiens
tattgctatttatattcat

SEQ ID NO: 6423497 - DNA, 18 bp, Homo sapiens
tattgctcaggctggtct

SEQ ID NO: 6423498 - DNA, 17 bp, Homo sapiens
tattgctctaattcttt

SEQ ID NO: 6423499 - DNA, 15 bp, Homo sapiens
tattgctctatgtta

SEQ ID NO: 6423500 - DNA, 15 bp, Homo sapiens
tattgctgaagaatc

SEQ ID NO: 6423501 - DNA, 20 bp, Homo sapiens
tattgctgaagaatctactt

SEQ ID NO: 6423502 - DNA, 17 bp, Homo sapiens
tattgctgaatgcaaga

SEQ ID NO: 6423503 - DNA, 19 bp, Homo sapiens
tattgctgagagaaatatg

SEQ ID NO: 6423504 - DNA, 17 bp, Homo sapiens
tattgctgatggtgcaa

SEQ ID NO: 6423505 - DNA, 22 bp, Homo sapiens
tattgctgatggtgcaatgacc

SEQ ID NO: 6423506 - DNA, 20 bp, Homo sapiens
tattgctgcataaatttgta

SEQ ID NO: 6423507 - DNA, 21 bp, Homo sapiens
tattgctgcataaatttgtaa

SEQ ID NO: 6423508 - DNA, 14 bp, Homo sapiens
tattgctgcatttt

SEQ ID NO: 6423509 - DNA, 15 bp, Homo sapiens
tattgctgccaaaac

SEQ ID NO: 6423510 - DNA, 20 bp, Homo sapiens
tattgctgccaaaaccacat

SEQ ID NO: 6423511 - DNA, 22 bp, Homo sapiens
tattgctgctgtgcgtggaaaa

SEQ ID NO: 6423512 - DNA, 20 bp, Homo sapiens
tattgctgtaaataaaaata

SEQ ID NO: 6423513 - DNA, 13 bp, Homo sapiens
tattgctgtctgg

SEQ ID NO: 6423514 - DNA, 22 bp, Homo sapiens
tattgctgtctggtgaggtggc

SEQ ID NO: 6423515 - DNA, 23 bp, Homo sapiens
tattgctgtgagccttgcatgac

SEQ ID NO: 6423516 - DNA, 21 bp, Homo sapiens
tattgctgtgtcttcattttc

SEQ ID NO: 6423517 - DNA, 19 bp, Homo sapiens
tattgcttaatttctgcct

SEQ ID NO: 6423518 - DNA, 19 bp, Homo sapiens
tattgcttagtaaaattta

SEQ ID NO: 6423519 - DNA, 15 bp, Homo sapiens
tattgcttattttat

SEQ ID NO: 6423520 - DNA, 14 bp, Homo sapiens
tattgcttcaattt

SEQ ID NO: 6423521 - DNA, 21 bp, Homo sapiens
tattgcttcaatttcaaactt

SEQ ID NO: 6423522 - DNA, 15 bp, Homo sapiens
tattgcttcagctgc

SEQ ID NO: 6423523 - DNA, 21 bp, Homo sapiens
tattgcttgatacttttgaca

SEQ ID NO: 6423524 - DNA, 21 bp, Homo sapiens
tattgcttgcacaaaccaatt

SEQ ID NO: 6423525 - DNA, 19 bp, Homo sapiens
tattgcttgttggattttt

SEQ ID NO: 6423526 - DNA, 16 bp, Homo sapiens
tattgctttataaata

SEQ ID NO: 6423527 - DNA, 16 bp, Homo sapiens
tattggaagacttggg

SEQ ID NO: 6423528 - DNA, 14 bp, Homo sapiens
tattggaagctgct

SEQ ID NO: 6423529 - DNA, 18 bp, Homo sapiens
tattggaagtgttcaaga

SEQ ID NO: 6423530 - DNA, 17 bp, Homo sapiens
tattggaatagcagcct

SEQ ID NO: 6423531 - DNA, 17 bp, Homo sapiens
tattggacaaagaacct

SEQ ID NO: 6423532 - DNA, 16 bp, Homo sapiens
tattggacagacacag

SEQ ID NO: 6423533 - DNA, 20 bp, Homo sapiens
tattggacggtttctagcct

SEQ ID NO: 6423534 - DNA, 22 bp, Homo sapiens
tattggacggtttctagcctct

SEQ ID NO: 6423535 - DNA, 19 bp, Homo sapiens
tattggaggatttggtcag

SEQ ID NO: 6423536 - DNA, 17 bp, Homo sapiens
tattggattgcgccttt

SEQ ID NO: 6423537 - DNA, 20 bp, Homo sapiens
tattggattttcacagagga

SEQ ID NO: 6423538 - DNA, 20 bp, Homo sapiens
tattggcaaagtttaaatgt

SEQ ID NO: 6423539 - DNA, 17 bp, Homo sapiens
tattggcactgctaaaa

SEQ ID NO: 6423540 - DNA, 19 bp, Homo sapiens
tattggcagccaaggaatg

SEQ ID NO: 6423541 - DNA, 21 bp, Homo sapiens
tattggcagccaaggaatgtg

SEQ ID NO: 6423542 - DNA, 15 bp, Homo sapiens
tattggcataaaaca

SEQ ID NO: 6423543 - DNA, 20 bp, Homo sapiens
tattggccataagcaacaat

SEQ ID NO: 6423544 - DNA, 21 bp, Homo sapiens
tattggcctcccaaaagactc

SEQ ID NO: 6423545 - DNA, 23 bp, Homo sapiens
tattggctaaattgaaacctgga

SEQ ID NO: 6423546 - DNA, 16 bp, Homo sapiens
tattggctgctttgcc

SEQ ID NO: 6423547 - DNA, 23 bp, Homo sapiens
tattggcttgataaacataatta

SEQ ID NO: 6423548 - DNA, 20 bp, Homo sapiens
tattgggagtcttaataaaa

SEQ ID NO: 6423549 - DNA, 18 bp, Homo sapiens
tattgggatgtgagcccc

SEQ ID NO: 6423550 - DNA, 16 bp, Homo sapiens
tattgggcttaatata

SEQ ID NO: 6423551 - DNA, 22 bp, Homo sapiens
tattggggttggttggggtggg

SEQ ID NO: 6423552 - DNA, 19 bp, Homo sapiens
tattgggtgtagatttctg

SEQ ID NO: 6423553 - DNA, 20 bp, Homo sapiens
tattgggtgtagatttctga

SEQ ID NO: 6423554 - DNA, 15 bp, Homo sapiens
tattggtaaattctg

SEQ ID NO: 6423555 - DNA, 18 bp, Homo sapiens
tattggtaaattctggta

SEQ ID NO: 6423556 - DNA, 20 bp, Homo sapiens
tattggtaaattctggtata

SEQ ID NO: 6423557 - DNA, 15 bp, Homo sapiens
tattggtaacatcct

SEQ ID NO: 6423558 - DNA, 18 bp, Homo sapiens
tattggtaacatcctttc

SEQ ID NO: 6423559 - DNA, 22 bp, Homo sapiens
tattggtaattaaaagactcca

SEQ ID NO: 6423560 - DNA, 18 bp, Homo sapiens
tattggtatatttgtaga

SEQ ID NO: 6423561 - DNA, 18 bp, Homo sapiens
tattggtcaagaaaagca

SEQ ID NO: 6423562 - DNA, 21 bp, Homo sapiens
tattggtcttgccctattata

SEQ ID NO: 6423563 - DNA, 13 bp, Homo sapiens
tattggtgctgag

SEQ ID NO: 6423564 - DNA, 19 bp, Homo sapiens
tattggtgctttgtgtcta

SEQ ID NO: 6423565 - DNA, 18 bp, Homo sapiens
tattggtggttctcagca

SEQ ID NO: 6423566 - DNA, 17 bp, Homo sapiens
tattggtgtaaggtact

SEQ ID NO: 6423567 - DNA, 17 bp, Homo sapiens
tattggtgtactgtaat

SEQ ID NO: 6423568 - DNA, 18 bp, Homo sapiens
tattggtgtatattatat

SEQ ID NO: 6423569 - DNA, 20 bp, Homo sapiens
tattggtgtatattatataa

SEQ ID NO: 6423570 - DNA, 13 bp, Homo sapiens
tattggttcttcc

SEQ ID NO: 6423571 - DNA, 19 bp, Homo sapiens
tattggttggtgtgaagaa

SEQ ID NO: 6423572 - DNA, 17 bp, Homo sapiens
tattggtttctgtttga

SEQ ID NO: 6423573 - DNA, 18 bp, Homo sapiens
tattgtaaacatgtgttt

SEQ ID NO: 6423574 - DNA, 12 bp, Homo sapiens
tattgtaaagaa

SEQ ID NO: 6423575 - DNA, 13 bp, Homo sapiens
tattgtaaatgtg

SEQ ID NO: 6423576 - DNA, 14 bp, Homo sapiens
tattgtaaatgtgg

SEQ ID NO: 6423577 - DNA, 15 bp, Homo sapiens
tattgtaacagacat

SEQ ID NO: 6423578 - DNA, 19 bp, Homo sapiens
tattgtaacagacattgtt

SEQ ID NO: 6423579 - DNA, 14 bp, Homo sapiens
tattgtaactcaca

SEQ ID NO: 6423580 - DNA, 20 bp, Homo sapiens
tattgtaactcacatgcctt

SEQ ID NO: 6423581 - DNA, 17 bp, Homo sapiens
tattgtaagaaatactg

SEQ ID NO: 6423582 - DNA, 19 bp, Homo sapiens
tattgtaagaaatactgta

SEQ ID NO: 6423583 - DNA, 21 bp, Homo sapiens
tattgtaagttgtacaaatgt

SEQ ID NO: 6423584 - DNA, 22 bp, Homo sapiens
tccttttccagaaatacctgtc

SEQ ID NO: 6423585 - DNA, 14 bp, Homo sapiens
tccttttccctgct

SEQ ID NO: 6423586 - DNA, 15 bp, Homo sapiens
tccttttccgttctg

SEQ ID NO: 6423587 - DNA, 16 bp, Homo sapiens
tccttttcctatcctt

SEQ ID NO: 6423588 - DNA, 15 bp, Homo sapiens
tccttttcctctctc

SEQ ID NO: 6423589 - DNA, 18 bp, Homo sapiens
tccttttcgcaggattct

SEQ ID NO: 6423590 - DNA, 22 bp, Homo sapiens
tccttttcgcaggattcttcct

SEQ ID NO: 6423591 - DNA, 12 bp, Homo sapiens
tccttttctccc

SEQ ID NO: 6423592 - DNA, 21 bp, Homo sapiens
tccttttctgtgaagcccttt

SEQ ID NO: 6423593 - DNA, 15 bp, Homo sapiens
tccttttctgtgttt

SEQ ID NO: 6423594 - DNA, 10 bp, Homo sapiens
tccttttctt

SEQ ID NO: 6423595 - DNA, 18 bp, Homo sapiens
tccttttcttccttcttt

SEQ ID NO: 6423596 - DNA, 16 bp, Homo sapiens
tccttttcttctatgt

SEQ ID NO: 6423597 - DNA, 19 bp, Homo sapiens
tccttttcttgtctctgag

SEQ ID NO: 6423598 - DNA, 21 bp, Homo sapiens
tccttttcttgtctctgaggc

SEQ ID NO: 6423599 - DNA, 14 bp, Homo sapiens
tccttttcttttct

SEQ ID NO: 6423600 - DNA, 23 bp, Homo sapiens
tccttttcttttcttgaggcagg

SEQ ID NO: 6423601 - DNA, 18 bp, Homo sapiens
tccttttcttttgttact

SEQ ID NO: 6423602 - DNA, 19 bp, Homo sapiens
tccttttcttttgttactg

SEQ ID NO: 6423603 - DNA, 13 bp, Homo sapiens
tccttttgaactt

SEQ ID NO: 6423604 - DNA, 17 bp, Homo sapiens
tccttttgaacttgtca

SEQ ID NO: 6423605 - DNA, 18 bp, Homo sapiens
tccttttgaccttcattt

SEQ ID NO: 6423606 - DNA, 17 bp, Homo sapiens
tccttttgatggggaga

SEQ ID NO: 6423607 - DNA, 17 bp, Homo sapiens
tccttttgcctgcaggt

SEQ ID NO: 6423608 - DNA, 20 bp, Homo sapiens
tccttttgcgcttatttgga

SEQ ID NO: 6423609 - DNA, 14 bp, Homo sapiens
tccttttgctgtct

SEQ ID NO: 6423610 - DNA, 20 bp, Homo sapiens
tccttttgctgtctttctct

SEQ ID NO: 6423611 - DNA, 13 bp, Homo sapiens
tccttttgcttga

SEQ ID NO: 6423612 - DNA, 16 bp, Homo sapiens
tccttttggaacattt

SEQ ID NO: 6423613 - DNA, 16 bp, Homo sapiens
tccttttggcctgggg

SEQ ID NO: 6423614 - DNA, 22 bp, Homo sapiens
tccttttggcgtgatatccata

SEQ ID NO: 6423615 - DNA, 13 bp, Homo sapiens
tccttttgtaaag

SEQ ID NO: 6423616 - DNA, 19 bp, Homo sapiens
tccttttgtccacttgtaa

SEQ ID NO: 6423617 - DNA, 14 bp, Homo sapiens
tccttttgtcccca

SEQ ID NO: 6423618 - DNA, 16 bp, Homo sapiens
tccttttgtctgatag

SEQ ID NO: 6423619 - DNA, 17 bp, Homo sapiens
tccttttgtgtacagtg

SEQ ID NO: 6423620 - DNA, 18 bp, Homo sapiens
tccttttgtgtacagtgt

SEQ ID NO: 6423621 - DNA, 17 bp, Homo sapiens
tccttttgttttgaagc

SEQ ID NO: 6423622 - DNA, 16 bp, Homo sapiens
tcctttttaaatgaga

SEQ ID NO: 6423623 - DNA, 16 bp, Homo sapiens
tcctttttaaatgtga

SEQ ID NO: 6423624 - DNA, 21 bp, Homo sapiens
tcctttttatgaggcaacctg

SEQ ID NO: 6423625 - DNA, 20 bp, Homo sapiens
tcctttttattccttttaaa

SEQ ID NO: 6423626 - DNA, 22 bp, Homo sapiens
tcctttttatttatatgtatgt

SEQ ID NO: 6423627 - DNA, 18 bp, Homo sapiens
tcctttttcaacttggaa

SEQ ID NO: 6423628 - DNA, 16 bp, Homo sapiens
tcctttttcacgttta

SEQ ID NO: 6423629 - DNA, 17 bp, Homo sapiens
tcctttttccaacaaga

SEQ ID NO: 6423630 - DNA, 18 bp, Homo sapiens
tcctttttcccaataaat

SEQ ID NO: 6423631 - DNA, 20 bp, Homo sapiens
tcctttttctgattagcttt

SEQ ID NO: 6423632 - DNA, 21 bp, Homo sapiens
tcctttttcttcgctggacta

SEQ ID NO: 6423633 - DNA, 14 bp, Homo sapiens
tcctttttctttat

SEQ ID NO: 6423634 - DNA, 22 bp, Homo sapiens
tcctttttgcagtatatttctg

SEQ ID NO: 6423635 - DNA, 15 bp, Homo sapiens
tcctttttggggagt

SEQ ID NO: 6423636 - DNA, 12 bp, Homo sapiens
tcctttttgtaa

SEQ ID NO: 6423637 - DNA, 13 bp, Homo sapiens
tcctttttgtaac

SEQ ID NO: 6423638 - DNA, 14 bp, Homo sapiens
tccttttttaaaag

SEQ ID NO: 6423639 - DNA, 16 bp, Homo sapiens
tccttttttatacaca

SEQ ID NO: 6423640 - DNA, 18 bp, Homo sapiens
tccttttttatacacata

SEQ ID NO: 6423641 - DNA, 19 bp, Homo sapiens
tccttttttattgaataac

SEQ ID NO: 6423642 - DNA, 18 bp, Homo sapiens
tccttttttcaatatgca

SEQ ID NO: 6423643 - DNA, 12 bp, Homo sapiens
tccttttttccc

SEQ ID NO: 6423644 - DNA, 15 bp, Homo sapiens
tccttttttctttct

SEQ ID NO: 6423645 - DNA, 13 bp, Homo sapiens
tccttttttgtca

SEQ ID NO: 6423646 - DNA, 15 bp, Homo sapiens
tccttttttgtcatt

SEQ ID NO: 6423647 - DNA, 13 bp, Homo sapiens
tccttttttgtct

SEQ ID NO: 6423648 - DNA, 19 bp, Homo sapiens
tccttttttgtctatgaag

SEQ ID NO: 6423649 - DNA, 19 bp, Homo sapiens
tcctttttttaaattttct

SEQ ID NO: 6423650 - DNA, 20 bp, Homo sapiens
tcctttttttaaattttctc

SEQ ID NO: 6423651 - DNA, 21 bp, Homo sapiens
tcctttttttaaattttctcc

SEQ ID NO: 6423652 - DNA, 12 bp, Homo sapiens
tcgaaaaaataa

SEQ ID NO: 6423653 - DNA, 17 bp, Homo sapiens
tcgaaaaaataattatt

SEQ ID NO: 6423654 - DNA, 20 bp, Homo sapiens
tcgaaaacagatgagaagac

SEQ ID NO: 6423655 - DNA, 14 bp, Homo sapiens
tcgaaaagagcact

SEQ ID NO: 6423656 - DNA, 18 bp, Homo sapiens
tcgaaacacagaaacctt

SEQ ID NO: 6423657 - DNA, 19 bp, Homo sapiens
tcgaaacctgggattcagg

SEQ ID NO: 6423658 - DNA, 13 bp, Homo sapiens
tcgaaacctgtga

SEQ ID NO: 6423659 - DNA, 12 bp, Homo sapiens
tcgaaaggcctt

SEQ ID NO: 6423660 - DNA, 14 bp, Homo sapiens
tcgaaaggtgcagc

SEQ ID NO: 6423661 - DNA, 14 bp, Homo sapiens
tcgaaataacaatg

SEQ ID NO: 6423662 - DNA, 16 bp, Homo sapiens
tcgaaataacaatgtt

SEQ ID NO: 6423663 - DNA, 18 bp, Homo sapiens
tcgaaataacaatgttaa

SEQ ID NO: 6423664 - DNA, 20 bp, Homo sapiens
tcgaaataacaatgttaagg

SEQ ID NO: 6423665 - DNA, 20 bp, Homo sapiens
tcgaaatgaatttatctgaa

SEQ ID NO: 6423666 - DNA, 15 bp, Homo sapiens
tcgaaatgtattcac

SEQ ID NO: 6423667 - DNA, 14 bp, Homo sapiens
tcgaacaaactgat

SEQ ID NO: 6423668 - DNA, 14 bp, Homo sapiens
tcgaacatgtttca

SEQ ID NO: 6423669 - DNA, 13 bp, Homo sapiens
tcgaaccaaggca

SEQ ID NO: 6423670 - DNA, 20 bp, Homo sapiens
tcgaaccaaggcagcctcca

SEQ ID NO: 6423671 - DNA, 22 bp, Homo sapiens
tcgaacccgggaggcagaggtt

SEQ ID NO: 6423672 - DNA, 15 bp, Homo sapiens
tcgaaccgttttgaa

SEQ ID NO: 6423673 - DNA, 15 bp, Homo sapiens
tcgaacgtggtctga

SEQ ID NO: 6423674 - DNA, 18 bp, Homo sapiens
tcgaactccaggctttct

SEQ ID NO: 6423675 - DNA, 16 bp, Homo sapiens
tcgaactcctgacctc

SEQ ID NO: 6423676 - DNA, 21 bp, Homo sapiens
tcgaactcttctttgctgcat

SEQ ID NO: 6423677 - DNA, 14 bp, Homo sapiens
tcgaactgtgctcc

SEQ ID NO: 6423678 - DNA, 15 bp, Homo sapiens
tcgaactgtgctccc

SEQ ID NO: 6423679 - DNA, 13 bp, Homo sapiens
tcgaagaaaataa

SEQ ID NO: 6423680 - DNA, 23 bp, Homo sapiens
tcgaagccttgcctaaatttaat

SEQ ID NO: 6423681 - DNA, 17 bp, Homo sapiens
tcgaagctgttctctgc

SEQ ID NO: 6423682 - DNA, 16 bp, Homo sapiens
tcgaaggggaggcaca

SEQ ID NO: 6423683 - DNA, 13 bp, Homo sapiens
tcgaagtgctgag

SEQ ID NO: 6423684 - DNA, 16 bp, Homo sapiens
tcgaagttcattttta

SEQ ID NO: 6423685 - DNA, 15 bp, Homo sapiens
tcgaataaaatctgc

SEQ ID NO: 6423686 - DNA, 17 bp, Homo sapiens
tcgaatatagttctgtg

SEQ ID NO: 6423687 - DNA, 16 bp, Homo sapiens
tcgaatcactcattta

SEQ ID NO: 6423688 - DNA, 20 bp, Homo sapiens
tcgaatctactaattccaca

SEQ ID NO: 6423689 - DNA, 14 bp, Homo sapiens
tcgaatctctgccc

SEQ ID NO: 6423690 - DNA, 17 bp, Homo sapiens
tcgaatctctgcccctc

SEQ ID NO: 6423691 - DNA, 17 bp, Homo sapiens
tcgaatctctgtgcctt

SEQ ID NO: 6423692 - DNA, 22 bp, Homo sapiens
tcgaatctctgtgccttcgtct

SEQ ID NO: 6423693 - DNA, 17 bp, Homo sapiens
tcgaatcttaatttatt

SEQ ID NO: 6423694 - DNA, 15 bp, Homo sapiens
tcgaatgaaaagaca

SEQ ID NO: 6423695 - DNA, 17 bp, Homo sapiens
tcgaatgaaattaactg

SEQ ID NO: 6423696 - DNA, 15 bp, Homo sapiens
tcgaatgacactgtt

SEQ ID NO: 6423697 - DNA, 18 bp, Homo sapiens
tcgaatggggtagaaaca

SEQ ID NO: 6423698 - DNA, 15 bp, Homo sapiens
tcgaatgtaattgga

SEQ ID NO: 6423699 - DNA, 19 bp, Homo sapiens
tcgaatgtaattggaatct

SEQ ID NO: 6423700 - DNA, 14 bp, Homo sapiens
tcgaatttgaagag

SEQ ID NO: 6423701 - DNA, 21 bp, Homo sapiens
tcgacacgtgggctcccctct

SEQ ID NO: 6423702 - DNA, 22 bp, Homo sapiens
tcgacactgttcttagctcaat

SEQ ID NO: 6423703 - DNA, 15 bp, Homo sapiens
tcgacagcgcccctg

SEQ ID NO: 6423704 - DNA, 21 bp, Homo sapiens
tcgacagggcctggagcccca

SEQ ID NO: 6423705 - DNA, 20 bp, Homo sapiens
tcgacaggtgccctttctct

SEQ ID NO: 6423706 - DNA, 17 bp, Homo sapiens
tcgacagtgaatattca

SEQ ID NO: 6423707 - DNA, 16 bp, Homo sapiens
tcgacataccccactg

SEQ ID NO: 6423708 - DNA, 17 bp, Homo sapiens
tcgacatgctgccagga

SEQ ID NO: 6423709 - DNA, 18 bp, Homo sapiens
tcgaccacaccagcctcc

SEQ ID NO: 6423710 - DNA, 14 bp, Homo sapiens
tcgacccagaatgg

SEQ ID NO: 6423711 - DNA, 15 bp, Homo sapiens
tcgaccctttctctg

SEQ ID NO: 6423712 - DNA, 16 bp, Homo sapiens
tcgaccctttctctga

SEQ ID NO: 6423713 - DNA, 16 bp, Homo sapiens
tcgaccgactttcccc

SEQ ID NO: 6423714 - DNA, 16 bp, Homo sapiens
tcgacctccccacccg

SEQ ID NO: 6423715 - DNA, 22 bp, Homo sapiens
tcgacctccctggcttgagtga

SEQ ID NO: 6423716 - DNA, 20 bp, Homo sapiens
tcgacctgcggctgctgtgt

SEQ ID NO: 6423717 - DNA, 22 bp, Homo sapiens
tcgacctgcggctgctgtgtgc

SEQ ID NO: 6423718 - DNA, 18 bp, Homo sapiens
tcgacgccccgaacctca

SEQ ID NO: 6423719 - DNA, 22 bp, Homo sapiens
tcgacggcacgcacttgcctgt

SEQ ID NO: 6423720 - DNA, 16 bp, Homo sapiens
tcgacgtcccttggat

SEQ ID NO: 6423721 - DNA, 21 bp, Homo sapiens
tcgactactgctcctgtggca

SEQ ID NO: 6423722 - DNA, 13 bp, Homo sapiens
tcgactcagcacc

SEQ ID NO: 6423723 - DNA, 14 bp, Homo sapiens
tcgactcagcacca

SEQ ID NO: 6423724 - DNA, 16 bp, Homo sapiens
tcgactcaggatccag

SEQ ID NO: 6423725 - DNA, 21 bp, Homo sapiens
tcgactcaggatccagtccct

SEQ ID NO: 6423726 - DNA, 13 bp, Homo sapiens
tcgactcccccct

SEQ ID NO: 6423727 - DNA, 20 bp, Homo sapiens
tcgactctgtgctggccagc

SEQ ID NO: 6423728 - DNA, 14 bp, Homo sapiens
tcgactggtccagc

SEQ ID NO: 6423729 - DNA, 19 bp, Homo sapiens
tcgactggtccagctctga

SEQ ID NO: 6423730 - DNA, 17 bp, Homo sapiens
tcgactgtgacctgtgg

SEQ ID NO: 6423731 - DNA, 17 bp, Homo sapiens
tcgactgttgttatctg

SEQ ID NO: 6423732 - DNA, 12 bp, Homo sapiens
tcgacttttctt

SEQ ID NO: 6423733 - DNA, 19 bp, Homo sapiens
tcgagaaagaggcaccagg

SEQ ID NO: 6423734 - DNA, 16 bp, Homo sapiens
tcgagaactttcattt

SEQ ID NO: 6423735 - DNA, 22 bp, Homo sapiens
tcgagaactttcatttttttcc

SEQ ID NO: 6423736 - DNA, 14 bp, Homo sapiens
tcgagaagggtgga

SEQ ID NO: 6423737 - DNA, 14 bp, Homo sapiens
tcgagacagaacct

SEQ ID NO: 6423738 - DNA, 18 bp, Homo sapiens
tcgagacaggcagaatca

SEQ ID NO: 6423739 - DNA, 18 bp, Homo sapiens
tcgagaccaacctgacca

SEQ ID NO: 6423740 - DNA, 16 bp, Homo sapiens
tcgagaccagcctgac

SEQ ID NO: 6423741 - DNA, 17 bp, Homo sapiens
tcgagaccagcctggcc

SEQ ID NO: 6423742 - DNA, 16 bp, Homo sapiens
tcgagaccatcctggc

SEQ ID NO: 6423743 - DNA, 21 bp, Homo sapiens
tcgagaccatcctggcccctc

SEQ ID NO: 6423744 - DNA, 18 bp, Homo sapiens
tcgagagcagcctggcca

SEQ ID NO: 6423745 - DNA, 13 bp, Homo sapiens
tcgagagccttac

SEQ ID NO: 6423746 - DNA, 15 bp, Homo sapiens
tcgagagctggccaa

SEQ ID NO: 6423747 - DNA, 12 bp, Homo sapiens
tcgagagtgtgc

SEQ ID NO: 6423748 - DNA, 21 bp, Homo sapiens
tcgagatcccaacactgccag

SEQ ID NO: 6423749 - DNA, 14 bp, Homo sapiens
tcgagatggagcta

SEQ ID NO: 6423750 - DNA, 21 bp, Homo sapiens
tcgagatggcagattcccact

SEQ ID NO: 6423751 - DNA, 19 bp, Homo sapiens
tcgagattatcgttttctt

SEQ ID NO: 6423752 - DNA, 19 bp, Homo sapiens
tcgagattgcactgctgca

SEQ ID NO: 6423753 - DNA, 17 bp, Homo sapiens
tcgagatttgggagctg

SEQ ID NO: 6423754 - DNA, 18 bp, Homo sapiens
tcgagatttgggagctga

SEQ ID NO: 6423755 - DNA, 14 bp, Homo sapiens
tcgagcactctaat

SEQ ID NO: 6423756 - DNA, 20 bp, Homo sapiens
tcgagcagggtgctgtgggt

SEQ ID NO: 6423757 - DNA, 22 bp, Homo sapiens
tcgagcagtcctgcctcagcct

SEQ ID NO: 6423758 - DNA, 15 bp, Homo sapiens
tcgagcatgcctgga

SEQ ID NO: 6423759 - DNA, 21 bp, Homo sapiens
tcgagcatgttgttttttcat

SEQ ID NO: 6423760 - DNA, 16 bp, Homo sapiens
tcgagcccagatggaa

SEQ ID NO: 6423761 - DNA, 22 bp, Homo sapiens
tcgagccccctggatgtcccct

SEQ ID NO: 6423762 - DNA, 16 bp, Homo sapiens
tcgagcgccctgcaga

SEQ ID NO: 6423763 - DNA, 15 bp, Homo sapiens
tcgagctacatgcat

SEQ ID NO: 6423764 - DNA, 11 bp, Homo sapiens
tattgtaatat

SEQ ID NO: 6423765 - DNA, 15 bp, Homo sapiens
tattgtaatatgaca

SEQ ID NO: 6423766 - DNA, 22 bp, Homo sapiens
tattgtaatatgacagataacc

SEQ ID NO: 6423767 - DNA, 14 bp, Homo sapiens
tattgtaatgccaa

SEQ ID NO: 6423768 - DNA, 21 bp, Homo sapiens
tattgtaatgtatacttgaaa

SEQ ID NO: 6423769 - DNA, 16 bp, Homo sapiens
tattgtacaaagtatt

SEQ ID NO: 6423770 - DNA, 14 bp, Homo sapiens
tattgtacaaatgt

SEQ ID NO: 6423771 - DNA, 20 bp, Homo sapiens
tattgtacaaatgtaagcaa

SEQ ID NO: 6423772 - DNA, 12 bp, Homo sapiens
tattgtacactt

SEQ ID NO: 6423773 - DNA, 13 bp, Homo sapiens
tattgtacacttt

SEQ ID NO: 6423774 - DNA, 15 bp, Homo sapiens
tattgtacacttttt

SEQ ID NO: 6423775 - DNA, 18 bp, Homo sapiens
tattgtacagactgtttt

SEQ ID NO: 6423776 - DNA, 20 bp, Homo sapiens
tattgtacagctgtttaaga

SEQ ID NO: 6423777 - DNA, 16 bp, Homo sapiens
tattgtacataaaaga

SEQ ID NO: 6423778 - DNA, 15 bp, Homo sapiens
tattgtacataaaat

SEQ ID NO: 6423779 - DNA, 13 bp, Homo sapiens
tattgtaccattt

SEQ ID NO: 6423780 - DNA, 11 bp, Homo sapiens
tattgtacctc

SEQ ID NO: 6423781 - DNA, 14 bp, Homo sapiens
tattgtacctctct

SEQ ID NO: 6423782 - DNA, 13 bp, Homo sapiens
tattgtacctttt

SEQ ID NO: 6423783 - DNA, 16 bp, Homo sapiens
tattgtactctgcttt

SEQ ID NO: 6423784 - DNA, 12 bp, Homo sapiens
tattgtagtttg

SEQ ID NO: 6423785 - DNA, 15 bp, Homo sapiens
tattgtagtttgaaa

SEQ ID NO: 6423786 - DNA, 14 bp, Homo sapiens
tattgtataaaaag

SEQ ID NO: 6423787 - DNA, 21 bp, Homo sapiens
tattgtataaactatcagttt

SEQ ID NO: 6423788 - DNA, 22 bp, Homo sapiens
tattgtataagattagaatgaa

SEQ ID NO: 6423789 - DNA, 18 bp, Homo sapiens
tattgtatatatggatat

SEQ ID NO: 6423790 - DNA, 19 bp, Homo sapiens
tattgtatattacaatgat

SEQ ID NO: 6423791 - DNA, 13 bp, Homo sapiens
tattgtatattga

SEQ ID NO: 6423792 - DNA, 22 bp, Homo sapiens
tattgtatcaatctttagaaaa

SEQ ID NO: 6423793 - DNA, 13 bp, Homo sapiens
tattgtatcattt

SEQ ID NO: 6423794 - DNA, 15 bp, Homo sapiens
tattgtatctccttt

SEQ ID NO: 6423795 - DNA, 23 bp, Homo sapiens
tattgtattatcatatatgcttt

SEQ ID NO: 6423796 - DNA, 15 bp, Homo sapiens
tattgtattatttgg

SEQ ID NO: 6423797 - DNA, 15 bp, Homo sapiens
tattgtattgctgct

SEQ ID NO: 6423798 - DNA, 17 bp, Homo sapiens
tattgtattgttagatg

SEQ ID NO: 6423799 - DNA, 15 bp, Homo sapiens
tattgtatttatgtg

SEQ ID NO: 6423800 - DNA, 14 bp, Homo sapiens
tattgtattttaga

SEQ ID NO: 6423801 - DNA, 21 bp, Homo sapiens
tattgtattttagatatattc

SEQ ID NO: 6423802 - DNA, 16 bp, Homo sapiens
tattgtattttgatga

SEQ ID NO: 6423803 - DNA, 14 bp, Homo sapiens
tattgtcaccagga

SEQ ID NO: 6423804 - DNA, 16 bp, Homo sapiens
tattgtcagatatttt

SEQ ID NO: 6423805 - DNA, 22 bp, Homo sapiens
tattgtcagtatctgtatctct

SEQ ID NO: 6423806 - DNA, 14 bp, Homo sapiens
tattgtcagtccta

SEQ ID NO: 6423807 - DNA, 21 bp, Homo sapiens
tattgtcatggggatcaattt

SEQ ID NO: 6423808 - DNA, 13 bp, Homo sapiens
tattgtcatgttt

SEQ ID NO: 6423809 - DNA, 20 bp, Homo sapiens
tattgtcattactgcctttg

SEQ ID NO: 6423810 - DNA, 20 bp, Homo sapiens
tattgtccattccaatacat

SEQ ID NO: 6423811 - DNA, 20 bp, Homo sapiens
tattgtcccctttttagttt

SEQ ID NO: 6423812 - DNA, 17 bp, Homo sapiens
tattgtcctattagtgt

SEQ ID NO: 6423813 - DNA, 22 bp, Homo sapiens
tattgtcctattagtgttatat

SEQ ID NO: 6423814 - DNA, 20 bp, Homo sapiens
tattgtcctcccctatttta

SEQ ID NO: 6423815 - DNA, 18 bp, Homo sapiens
tattgtccttcagagctc

SEQ ID NO: 6423816 - DNA, 20 bp, Homo sapiens
tattgtccttgtgtatcctg

SEQ ID NO: 6423817 - DNA, 15 bp, Homo sapiens
tattgtctactctga

SEQ ID NO: 6423818 - DNA, 17 bp, Homo sapiens
tattgtctattatttag

SEQ ID NO: 6423819 - DNA, 16 bp, Homo sapiens
tattgtctgattgaaa

SEQ ID NO: 6423820 - DNA, 22 bp, Homo sapiens
tattgtctgattgaaacatgaa

SEQ ID NO: 6423821 - DNA, 15 bp, Homo sapiens
tattgtctgtaaaaa

SEQ ID NO: 6423822 - DNA, 16 bp, Homo sapiens
tattgtctgtaaatct

SEQ ID NO: 6423823 - DNA, 22 bp, Homo sapiens
tattgtctgtaaatctaacatt

SEQ ID NO: 6423824 - DNA, 15 bp, Homo sapiens
tattgtctgtctaca

SEQ ID NO: 6423825 - DNA, 14 bp, Homo sapiens
tattgtctttttgt

SEQ ID NO: 6423826 - DNA, 19 bp, Homo sapiens
tattgtgaaatttgttaat

SEQ ID NO: 6423827 - DNA, 20 bp, Homo sapiens
tattgtgaatatttggaatt

SEQ ID NO: 6423828 - DNA, 15 bp, Homo sapiens
tattgtgagatcctg

SEQ ID NO: 6423829 - DNA, 18 bp, Homo sapiens
tattgtgagatgatttgt

SEQ ID NO: 6423830 - DNA, 16 bp, Homo sapiens
tattgtgattctgttt

SEQ ID NO: 6423831 - DNA, 21 bp, Homo sapiens
tattgtgatttgactgttttt

SEQ ID NO: 6423832 - DNA, 21 bp, Homo sapiens
tattgtgcacatttaataatc

SEQ ID NO: 6423833 - DNA, 19 bp, Homo sapiens
tattgtgcgctaaactttt

SEQ ID NO: 6423834 - DNA, 22 bp, Homo sapiens
tattgtgcgctaaacttttctg

SEQ ID NO: 6423835 - DNA, 22 bp, Homo sapiens
tattgtgctgggtcccagcctg

SEQ ID NO: 6423836 - DNA, 19 bp, Homo sapiens
tattgtggaataaatcctt

SEQ ID NO: 6423837 - DNA, 16 bp, Homo sapiens
tattgtggatgtgttc

SEQ ID NO: 6423838 - DNA, 13 bp, Homo sapiens
tattgtggctccc

SEQ ID NO: 6423839 - DNA, 15 bp, Homo sapiens
tattgtggctccctg

SEQ ID NO: 6423840 - DNA, 23 bp, Homo sapiens
tattgtggtaggccttttaacat

SEQ ID NO: 6423841 - DNA, 19 bp, Homo sapiens
tattgtgtcttttgcatga

SEQ ID NO: 6423842 - DNA, 23 bp, Homo sapiens
tattgtgtgaaggtaactaagaa

SEQ ID NO: 6423843 - DNA, 14 bp, Homo sapiens
tattgtgttccttt

SEQ ID NO: 6423844 - DNA, 22 bp, Homo sapiens
tattgtgttgactttataaatt

SEQ ID NO: 6423845 - DNA, 14 bp, Homo sapiens
tattgtgttgcaaa

SEQ ID NO: 6423846 - DNA, 14 bp, Homo sapiens
tattgtgttgtgaa

SEQ ID NO: 6423847 - DNA, 17 bp, Homo sapiens
tattgtgtttatgcatt

SEQ ID NO: 6423848 - DNA, 18 bp, Homo sapiens
tattgtgtttatgcattt

SEQ ID NO: 6423849 - DNA, 14 bp, Homo sapiens
tattgtgtttgtca

SEQ ID NO: 6423850 - DNA, 16 bp, Homo sapiens
tattgtgtttgtgtat

SEQ ID NO: 6423851 - DNA, 13 bp, Homo sapiens
tattgtgttttaa

SEQ ID NO: 6423852 - DNA, 14 bp, Homo sapiens
tattgttaaatcct

SEQ ID NO: 6423853 - DNA, 20 bp, Homo sapiens
tattgttaataataattatt

SEQ ID NO: 6423854 - DNA, 16 bp, Homo sapiens
tattgttaatacaagg

SEQ ID NO: 6423855 - DNA, 13 bp, Homo sapiens
tattgttaatatt

SEQ ID NO: 6423856 - DNA, 18 bp, Homo sapiens
tattgttaatggttctta

SEQ ID NO: 6423857 - DNA, 19 bp, Homo sapiens
tattgttaattatgtacaa

SEQ ID NO: 6423858 - DNA, 19 bp, Homo sapiens
tattgttagggtcagccat

SEQ ID NO: 6423859 - DNA, 16 bp, Homo sapiens
tattgttatgttctcc

SEQ ID NO: 6423860 - DNA, 17 bp, Homo sapiens
tattgttcaaaaagata

SEQ ID NO: 6423861 - DNA, 18 bp, Homo sapiens
tattgttcaaaaagatat

SEQ ID NO: 6423862 - DNA, 14 bp, Homo sapiens
tattgttcaaacaa

SEQ ID NO: 6423863 - DNA, 20 bp, Homo sapiens
tattgttcaaacaatatcat

SEQ ID NO: 6423864 - DNA, 13 bp, Homo sapiens
tattgttccaaga

SEQ ID NO: 6423865 - DNA, 17 bp, Homo sapiens
tattgttccaagacatt

SEQ ID NO: 6423866 - DNA, 18 bp, Homo sapiens
tattgttccaagacattg

SEQ ID NO: 6423867 - DNA, 21 bp, Homo sapiens
tattgttccaagacattgtca

SEQ ID NO: 6423868 - DNA, 23 bp, Homo sapiens
tattgttccagcagttttcaagt

SEQ ID NO: 6423869 - DNA, 21 bp, Homo sapiens
tattgttcccagtgacacttc

SEQ ID NO: 6423870 - DNA, 18 bp, Homo sapiens
tattgttcccctaagtgg

SEQ ID NO: 6423871 - DNA, 13 bp, Homo sapiens
tattgttcctaag

SEQ ID NO: 6423872 - DNA, 13 bp, Homo sapiens
tattgttcctctt

SEQ ID NO: 6423873 - DNA, 16 bp, Homo sapiens
tattgttctatttttg

SEQ ID NO: 6423874 - DNA, 15 bp, Homo sapiens
tattgttctcacact

SEQ ID NO: 6423875 - DNA, 14 bp, Homo sapiens
tattgttcttgtaa

SEQ ID NO: 6423876 - DNA, 21 bp, Homo sapiens
tattgttcttgtaaaactgtg

SEQ ID NO: 6423877 - DNA, 22 bp, Homo sapiens
tattgttcttgtaaaactgtga

SEQ ID NO: 6423878 - DNA, 23 bp, Homo sapiens
tattgttgacaactgtgactgta

SEQ ID NO: 6423879 - DNA, 12 bp, Homo sapiens
tattgtttaaaa

SEQ ID NO: 6423880 - DNA, 16 bp, Homo sapiens
tattgtttaaaatcat

SEQ ID NO: 6423881 - DNA, 20 bp, Homo sapiens
tattgtttaaaatcatttct

SEQ ID NO: 6423882 - DNA, 16 bp, Homo sapiens
tattgtttaaaatgta

SEQ ID NO: 6423883 - DNA, 14 bp, Homo sapiens
tattgtttatgtaa

SEQ ID NO: 6423884 - DNA, 18 bp, Homo sapiens
tattgtttcaattgcatc

SEQ ID NO: 6423885 - DNA, 14 bp, Homo sapiens
tattgtttctacaa

SEQ ID NO: 6423886 - DNA, 21 bp, Homo sapiens
tattgtttctggtcactatat

SEQ ID NO: 6423887 - DNA, 13 bp, Homo sapiens
tattgtttcttta

SEQ ID NO: 6423888 - DNA, 20 bp, Homo sapiens
tattgtttctttaagaaagt

SEQ ID NO: 6423889 - DNA, 18 bp, Homo sapiens
tattgtttgaaatgtcga

SEQ ID NO: 6423890 - DNA, 14 bp, Homo sapiens
tattgtttgctgtt

SEQ ID NO: 6423891 - DNA, 15 bp, Homo sapiens
tattgtttgtaaaca

SEQ ID NO: 6423892 - DNA, 15 bp, Homo sapiens
tattgttttacaata

SEQ ID NO: 6423893 - DNA, 17 bp, Homo sapiens
tattgttttatgttcta

SEQ ID NO: 6423894 - DNA, 18 bp, Homo sapiens
tattgttttcagtgtaca

SEQ ID NO: 6423895 - DNA, 22 bp, Homo sapiens
tattgttttcagtgtacatgga

SEQ ID NO: 6423896 - DNA, 14 bp, Homo sapiens
tattgttttctgta

SEQ ID NO: 6423897 - DNA, 15 bp, Homo sapiens
tattgttttctgtaa

SEQ ID NO: 6423898 - DNA, 16 bp, Homo sapiens
tattgttttgtgactt

SEQ ID NO: 6423899 - DNA, 18 bp, Homo sapiens
tattgttttgttaacaat

SEQ ID NO: 6423900 - DNA, 22 bp, Homo sapiens
tattgtttttccttgtatttaa

SEQ ID NO: 6423901 - DNA, 23 bp, Homo sapiens
tattgtttttggatggcttaagc

SEQ ID NO: 6423902 - DNA, 16 bp, Homo sapiens
tatttaaaaaaaagaa

SEQ ID NO: 6423903 - DNA, 22 bp, Homo sapiens
tatttaaaaaaagaaatttgat

SEQ ID NO: 6423904 - DNA, 16 bp, Homo sapiens
tatttaaaaaactaaa

SEQ ID NO: 6423905 - DNA, 20 bp, Homo sapiens
tatttaaaaaactaaaaact

SEQ ID NO: 6423906 - DNA, 22 bp, Homo sapiens
tatttaaaaaatgaatagtaca

SEQ ID NO: 6423907 - DNA, 16 bp, Homo sapiens
tatttaaaaaattaaa

SEQ ID NO: 6423908 - DNA, 21 bp, Homo sapiens
tatttaaaaaattaaaaatga

SEQ ID NO: 6423909 - DNA, 18 bp, Homo sapiens
tatttaaaaaattatgga

SEQ ID NO: 6423910 - DNA, 14 bp, Homo sapiens
tatttaaaaacaaa

SEQ ID NO: 6423911 - DNA, 23 bp, Homo sapiens
tatttaaaaacaaaaagcaacag

SEQ ID NO: 6423912 - DNA, 17 bp, Homo sapiens
tatttaaaaataagtca

SEQ ID NO: 6423913 - DNA, 15 bp, Homo sapiens
tatttaaaaatagaa

SEQ ID NO: 6423914 - DNA, 18 bp, Homo sapiens
tatttaaaaatagaaaca

SEQ ID NO: 6423915 - DNA, 17 bp, Homo sapiens
tatttaaaaatatttca

SEQ ID NO: 6423916 - DNA, 19 bp, Homo sapiens
tatttaaaaatatttcaga

SEQ ID NO: 6423917 - DNA, 17 bp, Homo sapiens
tatttaaaaatgcatga

SEQ ID NO: 6423918 - DNA, 23 bp, Homo sapiens
tatttaaaaatgcatgataatga

SEQ ID NO: 6423919 - DNA, 15 bp, Homo sapiens
tatttaaaaatgtct

SEQ ID NO: 6423920 - DNA, 18 bp, Homo sapiens
tatttaaaaatgtcttgc

SEQ ID NO: 6423921 - DNA, 19 bp, Homo sapiens
tatttaaaaattgtttctt

SEQ ID NO: 6423922 - DNA, 18 bp, Homo sapiens
tatttaaaacaacttgtt

SEQ ID NO: 6423923 - DNA, 15 bp, Homo sapiens
tatttaaaactctgg

SEQ ID NO: 6423924 - DNA, 15 bp, Homo sapiens
tatttaaaagattca

SEQ ID NO: 6423925 - DNA, 16 bp, Homo sapiens
tatttaaaagattcat

SEQ ID NO: 6423926 - DNA, 15 bp, Homo sapiens
tatttaaaagtgtca

SEQ ID NO: 6423927 - DNA, 15 bp, Homo sapiens
tatttaaaataaaga

SEQ ID NO: 6423928 - DNA, 21 bp, Homo sapiens
tatttaaaatagcaaaagaag

SEQ ID NO: 6423929 - DNA, 23 bp, Homo sapiens
tatttaaaatagcaaaagaagaa

SEQ ID NO: 6423930 - DNA, 15 bp, Homo sapiens
tatttaaaatagttc

SEQ ID NO: 6423931 - DNA, 21 bp, Homo sapiens
tatttaaaatagttccagata

SEQ ID NO: 6423932 - DNA, 17 bp, Homo sapiens
tatttaaaattccatta

SEQ ID NO: 6423933 - DNA, 20 bp, Homo sapiens
tatttaaaattccattatct

SEQ ID NO: 6423934 - DNA, 22 bp, Homo sapiens
tatttaaaattccattatctta

SEQ ID NO: 6423935 - DNA, 19 bp, Homo sapiens
tatttaaaatttattgctt

SEQ ID NO: 6423936 - DNA, 21 bp, Homo sapiens
tatttaaaccgctaaaagaaa

SEQ ID NO: 6423937 - DNA, 15 bp, Homo sapiens
tatttaaaccttttt

SEQ ID NO: 6423938 - DNA, 15 bp, Homo sapiens
tatttaaactatctt

SEQ ID NO: 6423939 - DNA, 13 bp, Homo sapiens
tatttaaactatt

SEQ ID NO: 6423940 - DNA, 16 bp, Homo sapiens
tatttaaactttcaat

SEQ ID NO: 6423941 - DNA, 13 bp, Homo sapiens
tatttaaagaaag

SEQ ID NO: 6423942 - DNA, 20 bp, Homo sapiens
tatttaaagaagaaacgtct

SEQ ID NO: 6423943 - DNA, 19 bp, Homo sapiens
tcgagctccccccaggtct

SEQ ID NO: 6423944 - DNA, 22 bp, Homo sapiens
tcgagctctgtagcctggtctg

SEQ ID NO: 6423945 - DNA, 14 bp, Homo sapiens
tcgagctgtgctcg

SEQ ID NO: 6423946 - DNA, 20 bp, Homo sapiens
tcgaggaagcacctctcagc

SEQ ID NO: 6423947 - DNA, 17 bp, Homo sapiens
tcgaggacaagtgagag

SEQ ID NO: 6423948 - DNA, 21 bp, Homo sapiens
tcgaggaccgggcactcccgg

SEQ ID NO: 6423949 - DNA, 20 bp, Homo sapiens
tcgaggactgtatttgtgac

SEQ ID NO: 6423950 - DNA, 14 bp, Homo sapiens
tcgaggagctagaa

SEQ ID NO: 6423951 - DNA, 14 bp, Homo sapiens
tcgaggagtaacaa

SEQ ID NO: 6423952 - DNA, 17 bp, Homo sapiens
tcgaggagtaacaatac

SEQ ID NO: 6423953 - DNA, 23 bp, Homo sapiens
tcgaggattctgtgcctccagga

SEQ ID NO: 6423954 - DNA, 19 bp, Homo sapiens
tcgaggcaccggcgctgca

SEQ ID NO: 6423955 - DNA, 21 bp, Homo sapiens
tcgaggcaccggcgctgcagg

SEQ ID NO: 6423956 - DNA, 17 bp, Homo sapiens
tcgaggcatggggcatg

SEQ ID NO: 6423957 - DNA, 21 bp, Homo sapiens
tcgaggccacattgctggctg

SEQ ID NO: 6423958 - DNA, 23 bp, Homo sapiens
tcgaggccacattgctggctgcc

SEQ ID NO: 6423959 - DNA, 15 bp, Homo sapiens
tcgaggcctacagag

SEQ ID NO: 6423960 - DNA, 22 bp, Homo sapiens
tcgaggcctacagaggaggcct

SEQ ID NO: 6423961 - DNA, 20 bp, Homo sapiens
tcgaggcctgaagccagctg

SEQ ID NO: 6423962 - DNA, 17 bp, Homo sapiens
tcgaggcggatctttgg

SEQ ID NO: 6423963 - DNA, 22 bp, Homo sapiens
tcgaggcggatctttggacaga

SEQ ID NO: 6423964 - DNA, 13 bp, Homo sapiens
tcgaggctagagg

SEQ ID NO: 6423965 - DNA, 16 bp, Homo sapiens
tcgaggctgcagtcag

SEQ ID NO: 6423966 - DNA, 20 bp, Homo sapiens
tcgaggctgcagtcagccct

SEQ ID NO: 6423967 - DNA, 17 bp, Homo sapiens
tcgaggctggtgccagg

SEQ ID NO: 6423968 - DNA, 14 bp, Homo sapiens
tcgaggctggtggt

SEQ ID NO: 6423969 - DNA, 13 bp, Homo sapiens
tcgaggctgtgtg

SEQ ID NO: 6423970 - DNA, 20 bp, Homo sapiens
tcgaggctgtgtgtccgtca

SEQ ID NO: 6423971 - DNA, 15 bp, Homo sapiens
tcgagggccgcctgc

SEQ ID NO: 6423972 - DNA, 16 bp, Homo sapiens
tcgaggggctctcagc

SEQ ID NO: 6423973 - DNA, 18 bp, Homo sapiens
tcgaggggctctcagctc

SEQ ID NO: 6423974 - DNA, 18 bp, Homo sapiens
tcgaggtcctcctggcct

SEQ ID NO: 6423975 - DNA, 14 bp, Homo sapiens
tcgaggtgccttct

SEQ ID NO: 6423976 - DNA, 23 bp, Homo sapiens
tcgaggtgccttcttcagggcct

SEQ ID NO: 6423977 - DNA, 14 bp, Homo sapiens
tcgaggtgtcaccc

SEQ ID NO: 6423978 - DNA, 20 bp, Homo sapiens
tcgaggtgtcaccctgcaga

SEQ ID NO: 6423979 - DNA, 16 bp, Homo sapiens
tcgaggtttctcaaag

SEQ ID NO: 6423980 - DNA, 16 bp, Homo sapiens
tcgagtactgtgggca

SEQ ID NO: 6423981 - DNA, 17 bp, Homo sapiens
tcgagtactgtgggcaa

SEQ ID NO: 6423982 - DNA, 23 bp, Homo sapiens
tcgagtactgtgggcaatttaga

SEQ ID NO: 6423983 - DNA, 14 bp, Homo sapiens
tcgagtcaaaatgt

SEQ ID NO: 6423984 - DNA, 15 bp, Homo sapiens
tcgagtcacattctg

SEQ ID NO: 6423985 - DNA, 17 bp, Homo sapiens
tcgagtcacattctgct

SEQ ID NO: 6423986 - DNA, 23 bp, Homo sapiens
tcgagtccagtcctttgttgctg

SEQ ID NO: 6423987 - DNA, 13 bp, Homo sapiens
tcgagtctgaggc

SEQ ID NO: 6423988 - DNA, 14 bp, Homo sapiens
tcgagtgagacaga

SEQ ID NO: 6423989 - DNA, 21 bp, Homo sapiens
tcgagtgatatggcttgtagg

SEQ ID NO: 6423990 - DNA, 23 bp, Homo sapiens
tcgagtgccgcatctcacagcta

SEQ ID NO: 6423991 - DNA, 17 bp, Homo sapiens
tcgagtgtagctgtgaa

SEQ ID NO: 6423992 - DNA, 17 bp, Homo sapiens
tcgagttacagacaaag

SEQ ID NO: 6423993 - DNA, 18 bp, Homo sapiens
tcgagttcggctctgggt

SEQ ID NO: 6423994 - DNA, 22 bp, Homo sapiens
tcgatactgcgactttctgcct

SEQ ID NO: 6423995 - DNA, 20 bp, Homo sapiens
tcgatatcctgatctcgtga

SEQ ID NO: 6423996 - DNA, 13 bp, Homo sapiens
tcgatatgaaaaa

SEQ ID NO: 6423997 - DNA, 22 bp, Homo sapiens
tcgatatgtatatcattctaca

SEQ ID NO: 6423998 - DNA, 14 bp, Homo sapiens
tcgatatttattga

SEQ ID NO: 6423999 - DNA, 18 bp, Homo sapiens
tcgatatttattgatgtt

SEQ ID NO: 6424000 - DNA, 22 bp, Homo sapiens
tcgatatttattgatgttttca

SEQ ID NO: 6424001 - DNA, 18 bp, Homo sapiens
tcgatcaaaaccttcctt

SEQ ID NO: 6424002 - DNA, 22 bp, Homo sapiens
tcgatcaaaaccttccttccct

SEQ ID NO: 6424003 - DNA, 23 bp, Homo sapiens
tcgatcaaaaccttccttccctg

SEQ ID NO: 6424004 - DNA, 18 bp, Homo sapiens
tcgatcatatttcccctt

SEQ ID NO: 6424005 - DNA, 13 bp, Homo sapiens
tcgatctcctgac

SEQ ID NO: 6424006 - DNA, 19 bp, Homo sapiens
tcgatctgtactgtaattt

SEQ ID NO: 6424007 - DNA, 19 bp, Homo sapiens
tcgatgaagcccaataaac

SEQ ID NO: 6424008 - DNA, 15 bp, Homo sapiens
tcgatgagactgttt

SEQ ID NO: 6424009 - DNA, 14 bp, Homo sapiens
tcgatgcactgacc

SEQ ID NO: 6424010 - DNA, 22 bp, Homo sapiens
tcgatgccactcctgcttctct

SEQ ID NO: 6424011 - DNA, 15 bp, Homo sapiens
tcgatgcctgcatgc

SEQ ID NO: 6424012 - DNA, 18 bp, Homo sapiens
tcgatgcctgcatgctga

SEQ ID NO: 6424013 - DNA, 21 bp, Homo sapiens
tcgatgcctgcatgctgaaac

SEQ ID NO: 6424014 - DNA, 23 bp, Homo sapiens
tcgatgcgtattctgtggccgcc

SEQ ID NO: 6424015 - DNA, 24 bp, Homo sapiens
tcgatgcgtattctgtggccgcca

SEQ ID NO: 6424016 - DNA, 15 bp, Homo sapiens
tcgatggacctcagc

SEQ ID NO: 6424017 - DNA, 16 bp, Homo sapiens
tcgatgtcctcctctg

SEQ ID NO: 6424018 - DNA, 18 bp, Homo sapiens
tcgatgtcctcctctgtg

SEQ ID NO: 6424019 - DNA, 20 bp, Homo sapiens
tcgatgtcctcctctgtgaa

SEQ ID NO: 6424020 - DNA, 17 bp, Homo sapiens
tcgatgttcatggaatt

SEQ ID NO: 6424021 - DNA, 20 bp, Homo sapiens
tcgattaacctgcatgcagc

SEQ ID NO: 6424022 - DNA, 15 bp, Homo sapiens
tcgattcatattgaa

SEQ ID NO: 6424023 - DNA, 19 bp, Homo sapiens
tcgattgttgtaaactgtt

SEQ ID NO: 6424024 - DNA, 22 bp, Homo sapiens
tcgcaacccctcaccccacaat

SEQ ID NO: 6424025 - DNA, 16 bp, Homo sapiens
tcgcaactgaaggaag

SEQ ID NO: 6424026 - DNA, 16 bp, Homo sapiens
tcgcaaggcctgtgct

SEQ ID NO: 6424027 - DNA, 19 bp, Homo sapiens
tcgcaagtcacagaaaatg

SEQ ID NO: 6424028 - DNA, 19 bp, Homo sapiens
tcgcaagttaacttggaaa

SEQ ID NO: 6424029 - DNA, 14 bp, Homo sapiens
tcgcacaaggacat

SEQ ID NO: 6424030 - DNA, 15 bp, Homo sapiens
tcgcacaatgcatgt

SEQ ID NO: 6424031 - DNA, 15 bp, Homo sapiens
tcgcacacacagtga

SEQ ID NO: 6424032 - DNA, 16 bp, Homo sapiens
tcgcacacacagtgat

SEQ ID NO: 6424033 - DNA, 24 bp, Homo sapiens
tcgcacacagggctcacagggcag

SEQ ID NO: 6424034 - DNA, 11 bp, Homo sapiens
tcgcacactgg

SEQ ID NO: 6424035 - DNA, 15 bp, Homo sapiens
tcgcacactggggcc

SEQ ID NO: 6424036 - DNA, 23 bp, Homo sapiens
tcgcacagattacttcagggctg

SEQ ID NO: 6424037 - DNA, 17 bp, Homo sapiens
tcgcacaggccctagct

SEQ ID NO: 6424038 - DNA, 13 bp, Homo sapiens
tcgcacagtctct

SEQ ID NO: 6424039 - DNA, 17 bp, Homo sapiens
tcgcaccactgcactcc

SEQ ID NO: 6424040 - DNA, 21 bp, Homo sapiens
tcgcaccactgcactccagcc

SEQ ID NO: 6424041 - DNA, 17 bp, Homo sapiens
tcgcaccattctcctgc

SEQ ID NO: 6424042 - DNA, 13 bp, Homo sapiens
tcgcacccccact

SEQ ID NO: 6424043 - DNA, 14 bp, Homo sapiens
tcgcacccccactt

SEQ ID NO: 6424044 - DNA, 15 bp, Homo sapiens
tcgcacctgcctccg

SEQ ID NO: 6424045 - DNA, 17 bp, Homo sapiens
tcgcacctgtgctggag

SEQ ID NO: 6424046 - DNA, 19 bp, Homo sapiens
tcgcactctggcagcaccg

SEQ ID NO: 6424047 - DNA, 12 bp, Homo sapiens
tcgcactgcaaa

SEQ ID NO: 6424048 - DNA, 13 bp, Homo sapiens
tcgcactgcaaat

SEQ ID NO: 6424049 - DNA, 14 bp, Homo sapiens
tcgcagaccagagc

SEQ ID NO: 6424050 - DNA, 19 bp, Homo sapiens
tcgcagaccagagctgtct

SEQ ID NO: 6424051 - DNA, 21 bp, Homo sapiens
tcgcagactcctccacgtggc

SEQ ID NO: 6424052 - DNA, 19 bp, Homo sapiens
tcgcagagaggccaggtgc

SEQ ID NO: 6424053 - DNA, 17 bp, Homo sapiens
tcgcagagcttttcaga

SEQ ID NO: 6424054 - DNA, 14 bp, Homo sapiens
tcgcagatgataaa

SEQ ID NO: 6424055 - DNA, 18 bp, Homo sapiens
tcgcagcaggtgcaagag

SEQ ID NO: 6424056 - DNA, 12 bp, Homo sapiens
tcgcagccaccc

SEQ ID NO: 6424057 - DNA, 18 bp, Homo sapiens
tcgcagccaccctgagga

SEQ ID NO: 6424058 - DNA, 21 bp, Homo sapiens
tcgcagccaccctgaggagtc

SEQ ID NO: 6424059 - DNA, 18 bp, Homo sapiens
tcgcagcctgaagcctgg

SEQ ID NO: 6424060 - DNA, 13 bp, Homo sapiens
tcgcagcctggcg

SEQ ID NO: 6424061 - DNA, 21 bp, Homo sapiens
tcgcagcctggcggggcagga

SEQ ID NO: 6424062 - DNA, 14 bp, Homo sapiens
tcgcagctacataa

SEQ ID NO: 6424063 - DNA, 13 bp, Homo sapiens
tcgcagctaccct

SEQ ID NO: 6424064 - DNA, 18 bp, Homo sapiens
tcgcagctaccctcagcc

SEQ ID NO: 6424065 - DNA, 20 bp, Homo sapiens
tcgcagctaccctcagcctc

SEQ ID NO: 6424066 - DNA, 12 bp, Homo sapiens
tcgcagctgtgg

SEQ ID NO: 6424067 - DNA, 21 bp, Homo sapiens
tcgcaggagtctctgccaccc

SEQ ID NO: 6424068 - DNA, 19 bp, Homo sapiens
tcgcaggatccgctgccac

SEQ ID NO: 6424069 - DNA, 21 bp, Homo sapiens
tcgcaggatccgctgccacca

SEQ ID NO: 6424070 - DNA, 19 bp, Homo sapiens
tcgcaggcctccctgccag

SEQ ID NO: 6424071 - DNA, 20 bp, Homo sapiens
tcgcaggcctccctgccagt

SEQ ID NO: 6424072 - DNA, 18 bp, Homo sapiens
tcgcagtgcccagtgatg

SEQ ID NO: 6424073 - DNA, 21 bp, Homo sapiens
tcgcagtgcccagtgatggca

SEQ ID NO: 6424074 - DNA, 17 bp, Homo sapiens
tcgcagttactggttgg

SEQ ID NO: 6424075 - DNA, 14 bp, Homo sapiens
tcgcatcaaaagac

SEQ ID NO: 6424076 - DNA, 17 bp, Homo sapiens
tcgcatcaaaagacaat

SEQ ID NO: 6424077 - DNA, 15 bp, Homo sapiens
tcgcatccaccgcca

SEQ ID NO: 6424078 - DNA, 18 bp, Homo sapiens
tcgcatccaccgccaccc

SEQ ID NO: 6424079 - DNA, 16 bp, Homo sapiens
tcgcatccagacagtc

SEQ ID NO: 6424080 - DNA, 18 bp, Homo sapiens
tcgcatcccggctgaccc

SEQ ID NO: 6424081 - DNA, 22 bp, Homo sapiens
tcgcatcccggctgaccctgtg

SEQ ID NO: 6424082 - DNA, 19 bp, Homo sapiens
tcgcatggtcacacactga

SEQ ID NO: 6424083 - DNA, 16 bp, Homo sapiens
tcgcatgtttaatgtg

SEQ ID NO: 6424084 - DNA, 15 bp, Homo sapiens
tcgcattaagcacac

SEQ ID NO: 6424085 - DNA, 22 bp, Homo sapiens
tcgcattaagcacacacatctg

SEQ ID NO: 6424086 - DNA, 14 bp, Homo sapiens
tcgcattaatgaaa

SEQ ID NO: 6424087 - DNA, 17 bp, Homo sapiens
tcgcattccatatcttt

SEQ ID NO: 6424088 - DNA, 20 bp, Homo sapiens
tcgcattgaactctacaaca

SEQ ID NO: 6424089 - DNA, 12 bp, Homo sapiens
tcgcatttccta

SEQ ID NO: 6424090 - DNA, 19 bp, Homo sapiens
tcgccaacttgtctctgta

SEQ ID NO: 6424091 - DNA, 20 bp, Homo sapiens
tcgccaacttgtctctgtag

SEQ ID NO: 6424092 - DNA, 20 bp, Homo sapiens
tcgccaagccatcacaggct

SEQ ID NO: 6424093 - DNA, 22 bp, Homo sapiens
tcgccaaggactgactgagaca

SEQ ID NO: 6424094 - DNA, 19 bp, Homo sapiens
tcgccaaggctcacatgct

SEQ ID NO: 6424095 - DNA, 16 bp, Homo sapiens
tcgccacacagtattt

SEQ ID NO: 6424096 - DNA, 23 bp, Homo sapiens
tcgccacacccggctccccctgc

SEQ ID NO: 6424097 - DNA, 21 bp, Homo sapiens
tcgccacacgcctctgtgtac

SEQ ID NO: 6424098 - DNA, 20 bp, Homo sapiens
tcgccacccccccaccccag

SEQ ID NO: 6424099 - DNA, 22 bp, Homo sapiens
tcgccacccccccaccccaggc

SEQ ID NO: 6424100 - DNA, 16 bp, Homo sapiens
tcgccacgctcagtgc

SEQ ID NO: 6424101 - DNA, 19 bp, Homo sapiens
tcgccagaagactcctagg

SEQ ID NO: 6424102 - DNA, 21 bp, Homo sapiens
tcgccagaagactcctaggcc

SEQ ID NO: 6424103 - DNA, 17 bp, Homo sapiens
tcgccagccctgggcct

SEQ ID NO: 6424104 - DNA, 18 bp, Homo sapiens
tcgccagctgatgactca

SEQ ID NO: 6424105 - DNA, 20 bp, Homo sapiens
tcgccagctgatgactcaag

SEQ ID NO: 6424106 - DNA, 21 bp, Homo sapiens
tcgccagctgatgactcaaga

SEQ ID NO: 6424107 - DNA, 12 bp, Homo sapiens
tcgccagcttct

SEQ ID NO: 6424108 - DNA, 12 bp, Homo sapiens
tcgccagcttgg

SEQ ID NO: 6424109 - DNA, 21 bp, Homo sapiens
tcgccagtcactgctgcaagg

SEQ ID NO: 6424110 - DNA, 16 bp, Homo sapiens
tcgccataggccaagg

SEQ ID NO: 6424111 - DNA, 13 bp, Homo sapiens
tcgccatcaaggt

SEQ ID NO: 6424112 - DNA, 18 bp, Homo sapiens
tcgccatcaaggtccagt

SEQ ID NO: 6424113 - DNA, 23 bp, Homo sapiens
tcgccatccgtcaccagaattag

SEQ ID NO: 6424114 - DNA, 18 bp, Homo sapiens
tcgcccaaagccagacag

SEQ ID NO: 6424115 - DNA, 14 bp, Homo sapiens
tcgcccacccagct

SEQ ID NO: 6424116 - DNA, 17 bp, Homo sapiens
tcgcccacccagctggt

SEQ ID NO: 6424117 - DNA, 22 bp, Homo sapiens
tcgcccacccgagtacctccag

SEQ ID NO: 6424118 - DNA, 18 bp, Homo sapiens
tcgcccagacaccatgtg

SEQ ID NO: 6424119 - DNA, 11 bp, Homo sapiens
tcgcccaggag

SEQ ID NO: 6424120 - DNA, 22 bp, Homo sapiens
tatttaaagacagggaagagca

SEQ ID NO: 6424121 - DNA, 12 bp, Homo sapiens
tatttaaagttg

SEQ ID NO: 6424122 - DNA, 15 bp, Homo sapiens
tatttaaatagatga

SEQ ID NO: 6424123 - DNA, 17 bp, Homo sapiens
tatttaaatagatgaca

SEQ ID NO: 6424124 - DNA, 22 bp, Homo sapiens
tatttaaatattaaatatgtta

SEQ ID NO: 6424125 - DNA, 23 bp, Homo sapiens
tatttaaatattaccctccaagt

SEQ ID NO: 6424126 - DNA, 14 bp, Homo sapiens
tatttaaatgcttt

SEQ ID NO: 6424127 - DNA, 13 bp, Homo sapiens
tatttaaatgtga

SEQ ID NO: 6424128 - DNA, 18 bp, Homo sapiens
tatttaaatgttctaaca

SEQ ID NO: 6424129 - DNA, 14 bp, Homo sapiens
tatttaaattattt

SEQ ID NO: 6424130 - DNA, 16 bp, Homo sapiens
tatttaaattcttttt

SEQ ID NO: 6424131 - DNA, 18 bp, Homo sapiens
tatttaacaaaaaatgta

SEQ ID NO: 6424132 - DNA, 18 bp, Homo sapiens
tatttaacaactgggtca

SEQ ID NO: 6424133 - DNA, 15 bp, Homo sapiens
tatttaacaagatgt

SEQ ID NO: 6424134 - DNA, 16 bp, Homo sapiens
tatttaacaagatgtt

SEQ ID NO: 6424135 - DNA, 17 bp, Homo sapiens
tatttaacaagatgttt

SEQ ID NO: 6424136 - DNA, 22 bp, Homo sapiens
tatttaacaatgacaagatgtt

SEQ ID NO: 6424137 - DNA, 15 bp, Homo sapiens
tatttaacagctgaa

SEQ ID NO: 6424138 - DNA, 15 bp, Homo sapiens
tatttaacatgggag

SEQ ID NO: 6424139 - DNA, 18 bp, Homo sapiens
tatttaacctatttccac

SEQ ID NO: 6424140 - DNA, 20 bp, Homo sapiens
tatttaactaattaaaaaat

SEQ ID NO: 6424141 - DNA, 13 bp, Homo sapiens
tatttaactacat

SEQ ID NO: 6424142 - DNA, 18 bp, Homo sapiens
tatttaactacatctgcc

SEQ ID NO: 6424143 - DNA, 22 bp, Homo sapiens
tatttaactcataatttttgca

SEQ ID NO: 6424144 - DNA, 20 bp, Homo sapiens
tatttaactctgtaagaaac

SEQ ID NO: 6424145 - DNA, 15 bp, Homo sapiens
tatttaactggtgca

SEQ ID NO: 6424146 - DNA, 22 bp, Homo sapiens
tatttaactggtgcactttgta

SEQ ID NO: 6424147 - DNA, 23 bp, Homo sapiens
tatttaactggtgcactttgtaa

SEQ ID NO: 6424148 - DNA, 19 bp, Homo sapiens
tatttaacttaacccagat

SEQ ID NO: 6424149 - DNA, 19 bp, Homo sapiens
tatttaacttctagttgct

SEQ ID NO: 6424150 - DNA, 14 bp, Homo sapiens
tatttaacttctga

SEQ ID NO: 6424151 - DNA, 20 bp, Homo sapiens
tatttaacttgagctttaaa

SEQ ID NO: 6424152 - DNA, 14 bp, Homo sapiens
tatttaacttgagg

SEQ ID NO: 6424153 - DNA, 14 bp, Homo sapiens
tatttaactttttt

SEQ ID NO: 6424154 - DNA, 23 bp, Homo sapiens
tatttaagaaaaacaaaatgtta

SEQ ID NO: 6424155 - DNA, 15 bp, Homo sapiens
tatttaagaaaagca

SEQ ID NO: 6424156 - DNA, 22 bp, Homo sapiens
tatttaagaaaagcacttttgt

SEQ ID NO: 6424157 - DNA, 22 bp, Homo sapiens
tatttaagaaagggaaagctgt

SEQ ID NO: 6424158 - DNA, 14 bp, Homo sapiens
tatttaagacataa

SEQ ID NO: 6424159 - DNA, 15 bp, Homo sapiens
tatttaagacataaa

SEQ ID NO: 6424160 - DNA, 18 bp, Homo sapiens
tatttaagacataaacaa

SEQ ID NO: 6424161 - DNA, 22 bp, Homo sapiens
tatttaagacataaacaaagac

SEQ ID NO: 6424162 - DNA, 14 bp, Homo sapiens
tatttaagactaaa

SEQ ID NO: 6424163 - DNA, 17 bp, Homo sapiens
tatttaagataattata

SEQ ID NO: 6424164 - DNA, 20 bp, Homo sapiens
tatttaagataattataata

SEQ ID NO: 6424165 - DNA, 18 bp, Homo sapiens
tatttaagatgtacattt

SEQ ID NO: 6424166 - DNA, 22 bp, Homo sapiens
tatttaagatgtacatttaata

SEQ ID NO: 6424167 - DNA, 14 bp, Homo sapiens
tatttaagcaaata

SEQ ID NO: 6424168 - DNA, 15 bp, Homo sapiens
tatttaagcagcttg

SEQ ID NO: 6424169 - DNA, 14 bp, Homo sapiens
tatttaagcataat

SEQ ID NO: 6424170 - DNA, 17 bp, Homo sapiens
tatttaagcctaaagat

SEQ ID NO: 6424171 - DNA, 21 bp, Homo sapiens
tatttaagcctcatatttaaa

SEQ ID NO: 6424172 - DNA, 17 bp, Homo sapiens
tatttaagccttataaa

SEQ ID NO: 6424173 - DNA, 23 bp, Homo sapiens
tatttaagctttaaatgacagta

SEQ ID NO: 6424174 - DNA, 14 bp, Homo sapiens
tatttaaggagatg

SEQ ID NO: 6424175 - DNA, 23 bp, Homo sapiens
tatttaaggagatgtaagagctt

SEQ ID NO: 6424176 - DNA, 16 bp, Homo sapiens
tatttaaggatagtgt

SEQ ID NO: 6424177 - DNA, 12 bp, Homo sapiens
tatttaaggatg

SEQ ID NO: 6424178 - DNA, 18 bp, Homo sapiens
tatttaaggatggatggc

SEQ ID NO: 6424179 - DNA, 22 bp, Homo sapiens
tatttaaggatggatggcaccc

SEQ ID NO: 6424180 - DNA, 12 bp, Homo sapiens
tatttaagtagt

SEQ ID NO: 6424181 - DNA, 17 bp, Homo sapiens
tatttaagtatatagta

SEQ ID NO: 6424182 - DNA, 13 bp, Homo sapiens
tatttaagtatgg

SEQ ID NO: 6424183 - DNA, 18 bp, Homo sapiens
tatttaagtgaaggagaa

SEQ ID NO: 6424184 - DNA, 19 bp, Homo sapiens
tatttaagtggactgtatt

SEQ ID NO: 6424185 - DNA, 22 bp, Homo sapiens
tatttaagtttgttgctgtcaa

SEQ ID NO: 6424186 - DNA, 10 bp, Homo sapiens
tatttaataa

SEQ ID NO: 6424187 - DNA, 14 bp, Homo sapiens
tatttaataacatt

SEQ ID NO: 6424188 - DNA, 12 bp, Homo sapiens
tatttaataaga

SEQ ID NO: 6424189 - DNA, 13 bp, Homo sapiens
tatttaataagag

SEQ ID NO: 6424190 - DNA, 19 bp, Homo sapiens
tatttaataccaccaacaa

SEQ ID NO: 6424191 - DNA, 15 bp, Homo sapiens
tatttaatacctttg

SEQ ID NO: 6424192 - DNA, 20 bp, Homo sapiens
tatttaatagcaaagaattg

SEQ ID NO: 6424193 - DNA, 17 bp, Homo sapiens
tatttaatagctgtgat

SEQ ID NO: 6424194 - DNA, 14 bp, Homo sapiens
tatttaatatcaaa

SEQ ID NO: 6424195 - DNA, 22 bp, Homo sapiens
tatttaatatctggcactgtta

SEQ ID NO: 6424196 - DNA, 14 bp, Homo sapiens
tatttaatatgcat

SEQ ID NO: 6424197 - DNA, 20 bp, Homo sapiens
tatttaatatgcatctttga

SEQ ID NO: 6424198 - DNA, 15 bp, Homo sapiens
tatttaatatgctta

SEQ ID NO: 6424199 - DNA, 15 bp, Homo sapiens
tatttaatcttttat

SEQ ID NO: 6424200 - DNA, 22 bp, Homo sapiens
tatttaatgacacaccttggat

SEQ ID NO: 6424201 - DNA, 18 bp, Homo sapiens
tatttaatgatttttgtg

SEQ ID NO: 6424202 - DNA, 20 bp, Homo sapiens
tatttaatgatttttgtgta

SEQ ID NO: 6424203 - DNA, 22 bp, Homo sapiens
tatttaatgcattaaacctgtc

SEQ ID NO: 6424204 - DNA, 20 bp, Homo sapiens
tatttaatggaagtgtattt

SEQ ID NO: 6424205 - DNA, 20 bp, Homo sapiens
tatttaatgtatttttgtaa

SEQ ID NO: 6424206 - DNA, 14 bp, Homo sapiens
tatttaatgttgaa

SEQ ID NO: 6424207 - DNA, 17 bp, Homo sapiens
tatttaatgttgaacaa

SEQ ID NO: 6424208 - DNA, 21 bp, Homo sapiens
tatttaatgttttaaatgtac

SEQ ID NO: 6424209 - DNA, 20 bp, Homo sapiens
tatttaattaaatctcaaat

SEQ ID NO: 6424210 - DNA, 19 bp, Homo sapiens
tatttaattagtgctaagt

SEQ ID NO: 6424211 - DNA, 14 bp, Homo sapiens
tatttaattattaa

SEQ ID NO: 6424212 - DNA, 23 bp, Homo sapiens
tatttaattattaactacattta

SEQ ID NO: 6424213 - DNA, 13 bp, Homo sapiens
tatttaattgtaa

SEQ ID NO: 6424214 - DNA, 12 bp, Homo sapiens
tatttaattgtg

SEQ ID NO: 6424215 - DNA, 18 bp, Homo sapiens
tatttaattgtttcaaaa

SEQ ID NO: 6424216 - DNA, 14 bp, Homo sapiens
tatttaatttcata

SEQ ID NO: 6424217 - DNA, 11 bp, Homo sapiens
tatttaatttg

SEQ ID NO: 6424218 - DNA, 13 bp, Homo sapiens
tatttaatttgga

SEQ ID NO: 6424219 - DNA, 21 bp, Homo sapiens
tatttaatttgtatgctaaat

SEQ ID NO: 6424220 - DNA, 17 bp, Homo sapiens
tatttaatttttacatg

SEQ ID NO: 6424221 - DNA, 21 bp, Homo sapiens
tatttaatttttacatgacca

SEQ ID NO: 6424222 - DNA, 16 bp, Homo sapiens
tatttaatttttgcaa

SEQ ID NO: 6424223 - DNA, 19 bp, Homo sapiens
tatttacaaaattttaaca

SEQ ID NO: 6424224 - DNA, 19 bp, Homo sapiens
tatttacaaatgaagtatt

SEQ ID NO: 6424225 - DNA, 11 bp, Homo sapiens
tatttacaaga

SEQ ID NO: 6424226 - DNA, 15 bp, Homo sapiens
tatttacaagaagaa

SEQ ID NO: 6424227 - DNA, 16 bp, Homo sapiens
tatttacaagaagaac

SEQ ID NO: 6424228 - DNA, 13 bp, Homo sapiens
tatttacaataaa

SEQ ID NO: 6424229 - DNA, 16 bp, Homo sapiens
tatttacaataaatga

SEQ ID NO: 6424230 - DNA, 13 bp, Homo sapiens
tatttacaatgca

SEQ ID NO: 6424231 - DNA, 17 bp, Homo sapiens
tatttacaatgtgtatc

SEQ ID NO: 6424232 - DNA, 24 bp, Homo sapiens
tatttacaatgtgtatcaaaacta

SEQ ID NO: 6424233 - DNA, 13 bp, Homo sapiens
tatttacacatac

SEQ ID NO: 6424234 - DNA, 18 bp, Homo sapiens
tatttacacatacaactt

SEQ ID NO: 6424235 - DNA, 14 bp, Homo sapiens
tatttacagaagaa

SEQ ID NO: 6424236 - DNA, 18 bp, Homo sapiens
tatttacagctgtgctcc

SEQ ID NO: 6424237 - DNA, 17 bp, Homo sapiens
tatttacataaagactg

SEQ ID NO: 6424238 - DNA, 14 bp, Homo sapiens
tatttacatatgaa

SEQ ID NO: 6424239 - DNA, 20 bp, Homo sapiens
tatttacatgctactaaatt

SEQ ID NO: 6424240 - DNA, 16 bp, Homo sapiens
tatttacattctagtt

SEQ ID NO: 6424241 - DNA, 15 bp, Homo sapiens
tatttacattttata

SEQ ID NO: 6424242 - DNA, 21 bp, Homo sapiens
tatttacattttatatttttg

SEQ ID NO: 6424243 - DNA, 14 bp, Homo sapiens
tatttaccaaaaat

SEQ ID NO: 6424244 - DNA, 18 bp, Homo sapiens
tatttaccaaaaattttg

SEQ ID NO: 6424245 - DNA, 14 bp, Homo sapiens
tatttaccaaagta

SEQ ID NO: 6424246 - DNA, 23 bp, Homo sapiens
tatttaccagaagtttaaatctt

SEQ ID NO: 6424247 - DNA, 17 bp, Homo sapiens
tatttacccctccccta

SEQ ID NO: 6424248 - DNA, 19 bp, Homo sapiens
tatttaccgttgcttgaaa

SEQ ID NO: 6424249 - DNA, 20 bp, Homo sapiens
tatttaccgttgcttgaaat

SEQ ID NO: 6424250 - DNA, 21 bp, Homo sapiens
tatttaccgttgcttgaaatt

SEQ ID NO: 6424251 - DNA, 18 bp, Homo sapiens
tatttacctagtgcaaaa

SEQ ID NO: 6424252 - DNA, 13 bp, Homo sapiens
tatttacctcagc

SEQ ID NO: 6424253 - DNA, 16 bp, Homo sapiens
tatttacctcagcctg

SEQ ID NO: 6424254 - DNA, 19 bp, Homo sapiens
tatttacctgcgaacttgt

SEQ ID NO: 6424255 - DNA, 15 bp, Homo sapiens
tatttacgctttgat

SEQ ID NO: 6424256 - DNA, 15 bp, Homo sapiens
tatttactaaaagaa

SEQ ID NO: 6424257 - DNA, 14 bp, Homo sapiens
tatttactaactaa

SEQ ID NO: 6424258 - DNA, 17 bp, Homo sapiens
tatttactaactaaata

SEQ ID NO: 6424259 - DNA, 21 bp, Homo sapiens
tatttactaactaaataccat

SEQ ID NO: 6424260 - DNA, 14 bp, Homo sapiens
tatttactatttca

SEQ ID NO: 6424261 - DNA, 16 bp, Homo sapiens
tatttactatttcaat

SEQ ID NO: 6424262 - DNA, 16 bp, Homo sapiens
tatttactctttctaa

SEQ ID NO: 6424263 - DNA, 20 bp, Homo sapiens
tatttactctttctaacttt

SEQ ID NO: 6424264 - DNA, 13 bp, Homo sapiens
tatttactctttg

SEQ ID NO: 6424265 - DNA, 19 bp, Homo sapiens
tatttactgagcttctctg

SEQ ID NO: 6424266 - DNA, 23 bp, Homo sapiens
tatttactgagcttctctgtgaa

SEQ ID NO: 6424267 - DNA, 14 bp, Homo sapiens
tatttactgcaatg

SEQ ID NO: 6424268 - DNA, 13 bp, Homo sapiens
tatttactgtact

SEQ ID NO: 6424269 - DNA, 19 bp, Homo sapiens
tatttacttcgttttggtt

SEQ ID NO: 6424270 - DNA, 18 bp, Homo sapiens
tatttacttctaatctta

SEQ ID NO: 6424271 - DNA, 20 bp, Homo sapiens
tatttacttctaatcttaaa

SEQ ID NO: 6424272 - DNA, 17 bp, Homo sapiens
tatttacttgaaagatg

SEQ ID NO: 6424273 - DNA, 16 bp, Homo sapiens
tatttacttgtagaaa

SEQ ID NO: 6424274 - DNA, 12 bp, Homo sapiens
tatttacttgtt

SEQ ID NO: 6424275 - DNA, 21 bp, Homo sapiens
tatttactttttaaaaataac

SEQ ID NO: 6424276 - DNA, 13 bp, Homo sapiens
tatttagaaactg

SEQ ID NO: 6424277 - DNA, 16 bp, Homo sapiens
tatttagaaactggtt

SEQ ID NO: 6424278 - DNA, 16 bp, Homo sapiens
tatttagaagcagagg

SEQ ID NO: 6424279 - DNA, 15 bp, Homo sapiens
tatttagaatatgtt

SEQ ID NO: 6424280 - DNA, 20 bp, Homo sapiens
tatttagacaagagatggga

SEQ ID NO: 6424281 - DNA, 22 bp, Homo sapiens
tatttagacactacaacatatg

SEQ ID NO: 6424282 - DNA, 21 bp, Homo sapiens
tatttagactgtggccatata

SEQ ID NO: 6424283 - DNA, 17 bp, Homo sapiens
tatttagataacaagaa

SEQ ID NO: 6424284 - DNA, 18 bp, Homo sapiens
tatttagatataacacta

SEQ ID NO: 6424285 - DNA, 14 bp, Homo sapiens
tatttagattcact

SEQ ID NO: 6424286 - DNA, 15 bp, Homo sapiens
tatttagcataaatt

SEQ ID NO: 6424287 - DNA, 16 bp, Homo sapiens
tatttagcataaattt

SEQ ID NO: 6424288 - DNA, 17 bp, Homo sapiens
tatttagcataaattta

SEQ ID NO: 6424289 - DNA, 17 bp, Homo sapiens
tatttagcgcacccaga

SEQ ID NO: 6424290 - DNA, 19 bp, Homo sapiens
tatttagctacagcttgtt

SEQ ID NO: 6424291 - DNA, 18 bp, Homo sapiens
tatttagctgttttggaa

SEQ ID NO: 6424292 - DNA, 14 bp, Homo sapiens
tatttagctttaca

SEQ ID NO: 6424293 - DNA, 14 bp, Homo sapiens
tatttaggaaacac

SEQ ID NO: 6424294 - DNA, 18 bp, Homo sapiens
tatttaggaaacaccatt

SEQ ID NO: 6424295 - DNA, 17 bp, Homo sapiens
tatttaggcagattgaa

SEQ ID NO: 6424296 - DNA, 23 bp, Homo sapiens
tatttaggccatttgttacagtt

SEQ ID NO: 6424297 - DNA, 22 bp, Homo sapiens
tatttaggcctcttgaattttt

SEQ ID NO: 6424298 - DNA, 23 bp, Homo sapiens
tatttagtaaaattatctgttct

SEQ ID NO: 6424299 - DNA, 20 bp, Homo sapiens
aactcatctgtaaactttta

SEQ ID NO: 6424300 - DNA, 17 bp, Homo sapiens
aactcatctgtcaccaa

SEQ ID NO: 6424301 - DNA, 16 bp, Homo sapiens
aactcatgaacaaaat

SEQ ID NO: 6424302 - DNA, 15 bp, Homo sapiens
aactcatgtctttat

SEQ ID NO: 6424303 - DNA, 15 bp, Homo sapiens
aactcattagactgg

SEQ ID NO: 6424304 - DNA, 23 bp, Homo sapiens
aactcattagactggaacttgaa

SEQ ID NO: 6424305 - DNA, 22 bp, Homo sapiens
aactcattcctgcctgtctcct

SEQ ID NO: 6424306 - DNA, 17 bp, Homo sapiens
aactcattctatcccca

SEQ ID NO: 6424307 - DNA, 14 bp, Homo sapiens
aactcattgcagca

SEQ ID NO: 6424308 - DNA, 17 bp, Homo sapiens
aactcattgcagcagat

SEQ ID NO: 6424309 - DNA, 13 bp, Homo sapiens
aactcatttcaag

SEQ ID NO: 6424310 - DNA, 19 bp, Homo sapiens
aactcatttgttaaaatta

SEQ ID NO: 6424311 - DNA, 23 bp, Homo sapiens
aactcattttcatattgtaatct

SEQ ID NO: 6424312 - DNA, 19 bp, Homo sapiens
aactcatttttgccataca

SEQ ID NO: 6424313 - DNA, 24 bp, Homo sapiens
aactcatttttgttttcattatct

SEQ ID NO: 6424314 - DNA, 14 bp, Homo sapiens
aactccaaagtcca

SEQ ID NO: 6424315 - DNA, 19 bp, Homo sapiens
aactccaacatccactctc

SEQ ID NO: 6424316 - DNA, 23 bp, Homo sapiens
aactccaagacagccatacttcc

SEQ ID NO: 6424317 - DNA, 15 bp, Homo sapiens
aactccaaggcaaat

SEQ ID NO: 6424318 - DNA, 17 bp, Homo sapiens
aactccaaggcaaatgt

SEQ ID NO: 6424319 - DNA, 23 bp, Homo sapiens
aactccaagttgctgcagcttgg

SEQ ID NO: 6424320 - DNA, 15 bp, Homo sapiens
aactccacatctgcc

SEQ ID NO: 6424321 - DNA, 16 bp, Homo sapiens
aactccacatctgcct

SEQ ID NO: 6424322 - DNA, 17 bp, Homo sapiens
aactccacatctgcctt

SEQ ID NO: 6424323 - DNA, 19 bp, Homo sapiens
aactccaccttgcggggat

SEQ ID NO: 6424324 - DNA, 15 bp, Homo sapiens
aactccactcagcac

SEQ ID NO: 6424325 - DNA, 16 bp, Homo sapiens
aactccactctccttc

SEQ ID NO: 6424326 - DNA, 16 bp, Homo sapiens
aactccactggctcca

SEQ ID NO: 6424327 - DNA, 17 bp, Homo sapiens
aactccagagccccttt

SEQ ID NO: 6424328 - DNA, 13 bp, Homo sapiens
aactccagagtca

SEQ ID NO: 6424329 - DNA, 17 bp, Homo sapiens
aactccagcgtcctcag

SEQ ID NO: 6424330 - DNA, 22 bp, Homo sapiens
aactccagctgagtcctggggt

SEQ ID NO: 6424331 - DNA, 21 bp, Homo sapiens
aactccagctggtgcccccag

SEQ ID NO: 6424332 - DNA, 12 bp, Homo sapiens
aactccaggcag

SEQ ID NO: 6424333 - DNA, 19 bp, Homo sapiens
aactccaggcatgtgtctg

SEQ ID NO: 6424334 - DNA, 16 bp, Homo sapiens
aactccaggccctcct

SEQ ID NO: 6424335 - DNA, 17 bp, Homo sapiens
aactccaggggcaccta

SEQ ID NO: 6424336 - DNA, 17 bp, Homo sapiens
aactccagggtcccctg

SEQ ID NO: 6424337 - DNA, 22 bp, Homo sapiens
aactccagggttaaagaaaggc

SEQ ID NO: 6424338 - DNA, 18 bp, Homo sapiens
aactccagtactggagct

SEQ ID NO: 6424339 - DNA, 20 bp, Homo sapiens
aactccagtctcctgacatt

SEQ ID NO: 6424340 - DNA, 16 bp, Homo sapiens
aactccatacagcctc

SEQ ID NO: 6424341 - DNA, 19 bp, Homo sapiens
aactccatactccactcca

SEQ ID NO: 6424342 - DNA, 15 bp, Homo sapiens
aactccatgaccagg

SEQ ID NO: 6424343 - DNA, 23 bp, Homo sapiens
aactccatgaccaggccaccatc

SEQ ID NO: 6424344 - DNA, 15 bp, Homo sapiens
aactccatgatattt

SEQ ID NO: 6424345 - DNA, 16 bp, Homo sapiens
aactccatgatattta

SEQ ID NO: 6424346 - DNA, 11 bp, Homo sapiens
aactccatgcc

SEQ ID NO: 6424347 - DNA, 13 bp, Homo sapiens
aactccatgccta

SEQ ID NO: 6424348 - DNA, 14 bp, Homo sapiens
aactccatgcctat

SEQ ID NO: 6424349 - DNA, 20 bp, Homo sapiens
aactccatggggttcgagac

SEQ ID NO: 6424350 - DNA, 18 bp, Homo sapiens
aactcccaacttcttcct

SEQ ID NO: 6424351 - DNA, 14 bp, Homo sapiens
aactcccagccacc

SEQ ID NO: 6424352 - DNA, 14 bp, Homo sapiens
aactcccaggacct

SEQ ID NO: 6424353 - DNA, 23 bp, Homo sapiens
aactcccaggacctggagacagg

SEQ ID NO: 6424354 - DNA, 13 bp, Homo sapiens
aactcccccagag

SEQ ID NO: 6424355 - DNA, 15 bp, Homo sapiens
aactcccctccccca

SEQ ID NO: 6424356 - DNA, 23 bp, Homo sapiens
aactcccctgggggtttcacctg

SEQ ID NO: 6424357 - DNA, 22 bp, Homo sapiens
aactcccctgtttcaatcactg

SEQ ID NO: 6424358 - DNA, 14 bp, Homo sapiens
aactccccttccct

SEQ ID NO: 6424359 - DNA, 17 bp, Homo sapiens
aactccccttccctggg

SEQ ID NO: 6424360 - DNA, 19 bp, Homo sapiens
aactccccttccctgggga

SEQ ID NO: 6424361 - DNA, 21 bp, Homo sapiens
aactccccttccctggggagc

SEQ ID NO: 6424362 - DNA, 16 bp, Homo sapiens
aactccctaggcctga

SEQ ID NO: 6424363 - DNA, 20 bp, Homo sapiens
aactccctagttacccaccc

SEQ ID NO: 6424364 - DNA, 21 bp, Homo sapiens
aactccctagttacccaccct

SEQ ID NO: 6424365 - DNA, 17 bp, Homo sapiens
aactccctccaccagcc

SEQ ID NO: 6424366 - DNA, 18 bp, Homo sapiens
aactccctccaccagcct

SEQ ID NO: 6424367 - DNA, 19 bp, Homo sapiens
aactccctccaccagcctg

SEQ ID NO: 6424368 - DNA, 22 bp, Homo sapiens
aactccctccaccagcctgctg

SEQ ID NO: 6424369 - DNA, 20 bp, Homo sapiens
aactcccttctcccctcagc

SEQ ID NO: 6424370 - DNA, 12 bp, Homo sapiens
aactcccttctg

SEQ ID NO: 6424371 - DNA, 16 bp, Homo sapiens
aactcccttctgcttg

SEQ ID NO: 6424372 - DNA, 15 bp, Homo sapiens
aactcccttgtgttc

SEQ ID NO: 6424373 - DNA, 18 bp, Homo sapiens
aactcccttgtgttcctt

SEQ ID NO: 6424374 - DNA, 13 bp, Homo sapiens
aactccctttcaa

SEQ ID NO: 6424375 - DNA, 13 bp, Homo sapiens
aactccgagagca

SEQ ID NO: 6424376 - DNA, 17 bp, Homo sapiens
aactccgagtgaactgg

SEQ ID NO: 6424377 - DNA, 12 bp, Homo sapiens
aactcctacctg

SEQ ID NO: 6424378 - DNA, 20 bp, Homo sapiens
aactcctacctgaaggcagg

SEQ ID NO: 6424379 - DNA, 22 bp, Homo sapiens
aactcctacctgaaggcagggc

SEQ ID NO: 6424380 - DNA, 22 bp, Homo sapiens
aactcctactgcttcctctgaa

SEQ ID NO: 6424381 - DNA, 21 bp, Homo sapiens
aactcctagggccactgaaga

SEQ ID NO: 6424382 - DNA, 14 bp, Homo sapiens
aactcctagttcta

SEQ ID NO: 6424383 - DNA, 21 bp, Homo sapiens
aactcctagttctagaaaaac

SEQ ID NO: 6424384 - DNA, 22 bp, Homo sapiens
aactcctcacacaccctgaggt

SEQ ID NO: 6424385 - DNA, 22 bp, Homo sapiens
aactcctcgacatcactgttca

SEQ ID NO: 6424386 - DNA, 14 bp, Homo sapiens
aactcctgacctca

SEQ ID NO: 6424387 - DNA, 19 bp, Homo sapiens
aactcctgattttgtagtt

SEQ ID NO: 6424388 - DNA, 21 bp, Homo sapiens
aactcctgattttgtagttaa

SEQ ID NO: 6424389 - DNA, 11 bp, Homo sapiens
aactcctgcca

SEQ ID NO: 6424390 - DNA, 12 bp, Homo sapiens
aactcctgcccc

SEQ ID NO: 6424391 - DNA, 17 bp, Homo sapiens
aactcctgcccctgttc

SEQ ID NO: 6424392 - DNA, 12 bp, Homo sapiens
aactcctgcctg

SEQ ID NO: 6424393 - DNA, 18 bp, Homo sapiens
aactcctggaaatatcag

SEQ ID NO: 6424394 - DNA, 20 bp, Homo sapiens
aactcctggatccctttcac

SEQ ID NO: 6424395 - DNA, 17 bp, Homo sapiens
aactcctggcctcaagt

SEQ ID NO: 6424396 - DNA, 14 bp, Homo sapiens
aactcctggccttt

SEQ ID NO: 6424397 - DNA, 17 bp, Homo sapiens
aactcctgtcccttttc

SEQ ID NO: 6424398 - DNA, 20 bp, Homo sapiens
aactcctgtcccttttccct

SEQ ID NO: 6424399 - DNA, 22 bp, Homo sapiens
aactcctgtcccttttccctta

SEQ ID NO: 6424400 - DNA, 13 bp, Homo sapiens
aactcctgtttct

SEQ ID NO: 6424401 - DNA, 19 bp, Homo sapiens
aactcctgttttcacacct

SEQ ID NO: 6424402 - DNA, 11 bp, Homo sapiens
aactccttggc

SEQ ID NO: 6424403 - DNA, 24 bp, Homo sapiens
aactccttgttagcccttcagatt

SEQ ID NO: 6424404 - DNA, 18 bp, Homo sapiens
aactcctttagcaggtgg

SEQ ID NO: 6424405 - DNA, 19 bp, Homo sapiens
aactcctttctgcagacgt

SEQ ID NO: 6424406 - DNA, 19 bp, Homo sapiens
aactccttttgctgtcttt

SEQ ID NO: 6424407 - DNA, 19 bp, Homo sapiens
aactcgaggactgtatttg

SEQ ID NO: 6424408 - DNA, 15 bp, Homo sapiens
aactcgcacctgtgc

SEQ ID NO: 6424409 - DNA, 19 bp, Homo sapiens
aactcgccctgtttggcat

SEQ ID NO: 6424410 - DNA, 13 bp, Homo sapiens
aactcgcctcagc

SEQ ID NO: 6424411 - DNA, 21 bp, Homo sapiens
aactcgggagcattctgcctg

SEQ ID NO: 6424412 - DNA, 18 bp, Homo sapiens
aactcgggcactccctaa

SEQ ID NO: 6424413 - DNA, 17 bp, Homo sapiens
aactcgggctcccgggt

SEQ ID NO: 6424414 - DNA, 17 bp, Homo sapiens
aactcgggggcgcctgg

SEQ ID NO: 6424415 - DNA, 18 bp, Homo sapiens
aactcgggggcgcctgga

SEQ ID NO: 6424416 - DNA, 17 bp, Homo sapiens
aactcggtgtccccacc

SEQ ID NO: 6424417 - DNA, 18 bp, Homo sapiens
aactcggtgtccccacca

SEQ ID NO: 6424418 - DNA, 19 bp, Homo sapiens
aactcggtgtccccaccat

SEQ ID NO: 6424419 - DNA, 22 bp, Homo sapiens
aactcggtgtccccaccatctg

SEQ ID NO: 6424420 - DNA, 15 bp, Homo sapiens
aactcgtatagcatg

SEQ ID NO: 6424421 - DNA, 13 bp, Homo sapiens
aactcgtctgatg

SEQ ID NO: 6424422 - DNA, 15 bp, Homo sapiens
aactcgtctgatgtt

SEQ ID NO: 6424423 - DNA, 20 bp, Homo sapiens
aactcgtctgatgttttgat

SEQ ID NO: 6424424 - DNA, 17 bp, Homo sapiens
aactcgtgacagcctct

SEQ ID NO: 6424425 - DNA, 23 bp, Homo sapiens
aactcgtgacagcctctgactca

SEQ ID NO: 6424426 - DNA, 18 bp, Homo sapiens
aactcgttaatttgtagt

SEQ ID NO: 6424427 - DNA, 22 bp, Homo sapiens
aactctaaagccaagcacttta

SEQ ID NO: 6424428 - DNA, 23 bp, Homo sapiens
aactctaaccaaggctgtgttta

SEQ ID NO: 6424429 - DNA, 16 bp, Homo sapiens
aactctaaccagtgta

SEQ ID NO: 6424430 - DNA, 18 bp, Homo sapiens
aactctaaccctgtggaa

SEQ ID NO: 6424431 - DNA, 12 bp, Homo sapiens
aactctaactgt

SEQ ID NO: 6424432 - DNA, 18 bp, Homo sapiens
aactctaagtgtaaaaaa

SEQ ID NO: 6424433 - DNA, 20 bp, Homo sapiens
aactctaagtgtttgctgca

SEQ ID NO: 6424434 - DNA, 15 bp, Homo sapiens
aactctaatattgct

SEQ ID NO: 6424435 - DNA, 17 bp, Homo sapiens
aactctaatattgcttc

SEQ ID NO: 6424436 - DNA, 23 bp, Homo sapiens
aactctaatattgcttcttgtgt

SEQ ID NO: 6424437 - DNA, 17 bp, Homo sapiens
aactctacacagctcag

SEQ ID NO: 6424438 - DNA, 18 bp, Homo sapiens
aactctacaccctctgcc

SEQ ID NO: 6424439 - DNA, 22 bp, Homo sapiens
aactctacatgtaactatttct

SEQ ID NO: 6424440 - DNA, 17 bp, Homo sapiens
aactctacccctgctcc

SEQ ID NO: 6424441 - DNA, 19 bp, Homo sapiens
aactctaccctggtaggaa

SEQ ID NO: 6424442 - DNA, 22 bp, Homo sapiens
aactctagactgcaagaactgt

SEQ ID NO: 6424443 - DNA, 21 bp, Homo sapiens
aactctagagagccttaactt

SEQ ID NO: 6424444 - DNA, 18 bp, Homo sapiens
aactctagggatataaaa

SEQ ID NO: 6424445 - DNA, 20 bp, Homo sapiens
aactctagggatataaaaac

SEQ ID NO: 6424446 - DNA, 16 bp, Homo sapiens
aactctataaagaaac

SEQ ID NO: 6424447 - DNA, 18 bp, Homo sapiens
aactctataaagaaactt

SEQ ID NO: 6424448 - DNA, 22 bp, Homo sapiens
aactctatagttattgttttat

SEQ ID NO: 6424449 - DNA, 18 bp, Homo sapiens
aactctatctgggcctgg

SEQ ID NO: 6424450 - DNA, 24 bp, Homo sapiens
aactctatggtcttatatttacaa

SEQ ID NO: 6424451 - DNA, 14 bp, Homo sapiens
aactctattatgga

SEQ ID NO: 6424452 - DNA, 15 bp, Homo sapiens
aactctattttttac

SEQ ID NO: 6424453 - DNA, 20 bp, Homo sapiens
aactctcaaaagtctatttt

SEQ ID NO: 6424454 - DNA, 12 bp, Homo sapiens
aactctccactc

SEQ ID NO: 6424455 - DNA, 21 bp, Homo sapiens
aactctcccaaagggcacacc

SEQ ID NO: 6424456 - DNA, 11 bp, Homo sapiens
aactctcccca

SEQ ID NO: 6424457 - DNA, 13 bp, Homo sapiens
aactctcccctcc

SEQ ID NO: 6424458 - DNA, 14 bp, Homo sapiens
aactctcccctccc

SEQ ID NO: 6424459 - DNA, 15 bp, Homo sapiens
aactctcccctcccc

SEQ ID NO: 6424460 - DNA, 17 bp, Homo sapiens
aactctcccctccccat

SEQ ID NO: 6424461 - DNA, 19 bp, Homo sapiens
aactctcctctgctgctgg

SEQ ID NO: 6424462 - DNA, 22 bp, Homo sapiens
aactctcctctgctgctggctg

SEQ ID NO: 6424463 - DNA, 20 bp, Homo sapiens
aactctccttttccttacca

SEQ ID NO: 6424464 - DNA, 13 bp, Homo sapiens
aactctctagctt

SEQ ID NO: 6424465 - DNA, 17 bp, Homo sapiens
aactctctagcttaagt

SEQ ID NO: 6424466 - DNA, 23 bp, Homo sapiens
aactctctagttccctcagtgtg

SEQ ID NO: 6424467 - DNA, 20 bp, Homo sapiens
aactctctggaagcccctgg

SEQ ID NO: 6424468 - DNA, 19 bp, Homo sapiens
aactctcttattgcctcac

SEQ ID NO: 6424469 - DNA, 14 bp, Homo sapiens
aactctcttcttcc

SEQ ID NO: 6424470 - DNA, 10 bp, Homo sapiens
aactctcttt

SEQ ID NO: 6424471 - DNA, 19 bp, Homo sapiens
aactctctttgggaatgtt

SEQ ID NO: 6424472 - DNA, 18 bp, Homo sapiens
aactctgaactttggaga

SEQ ID NO: 6424473 - DNA, 11 bp, Homo sapiens
aactctgaaga

SEQ ID NO: 6424474 - DNA, 13 bp, Homo sapiens
aactctgaagcta

SEQ ID NO: 6424475 - DNA, 22 bp, Homo sapiens
aactctgaatttatctttgata

SEQ ID NO: 6424476 - DNA, 19 bp, Homo sapiens
aactctgaattttaaagca

SEQ ID NO: 6424477 - DNA, 18 bp, Homo sapiens
tatttagtataccagaga

SEQ ID NO: 6424478 - DNA, 19 bp, Homo sapiens
tatttagtataccagagaa

SEQ ID NO: 6424479 - DNA, 16 bp, Homo sapiens
tatttagtatatgaaa

SEQ ID NO: 6424480 - DNA, 12 bp, Homo sapiens
tatttagtatct

SEQ ID NO: 6424481 - DNA, 23 bp, Homo sapiens
tatttagtatctagtcagtatct

SEQ ID NO: 6424482 - DNA, 23 bp, Homo sapiens
tatttagtcaattgtttaatgtt

SEQ ID NO: 6424483 - DNA, 14 bp, Homo sapiens
tatttagtgacaaa

SEQ ID NO: 6424484 - DNA, 16 bp, Homo sapiens
tatttagtgatatatt

SEQ ID NO: 6424485 - DNA, 19 bp, Homo sapiens
tatttagttacgtataatg

SEQ ID NO: 6424486 - DNA, 23 bp, Homo sapiens
tatttagttacgtataatgcttt

SEQ ID NO: 6424487 - DNA, 20 bp, Homo sapiens
tatttagttatagtttcaga

SEQ ID NO: 6424488 - DNA, 14 bp, Homo sapiens
tatttagttattta

SEQ ID NO: 6424489 - DNA, 24 bp, Homo sapiens
tatttataaaaagatgatcgctgt

SEQ ID NO: 6424490 - DNA, 17 bp, Homo sapiens
tatttataaaacttctc

SEQ ID NO: 6424491 - DNA, 13 bp, Homo sapiens
tatttataaaatt

SEQ ID NO: 6424492 - DNA, 19 bp, Homo sapiens
tatttataaactaggtaaa

SEQ ID NO: 6424493 - DNA, 13 bp, Homo sapiens
tatttataaatat

SEQ ID NO: 6424494 - DNA, 17 bp, Homo sapiens
tatttataaatatattt

SEQ ID NO: 6424495 - DNA, 20 bp, Homo sapiens
tatttataacaacctaaatt

SEQ ID NO: 6424496 - DNA, 14 bp, Homo sapiens
tatttataacagca

SEQ ID NO: 6424497 - DNA, 17 bp, Homo sapiens
tatttataacattgtaa

SEQ ID NO: 6424498 - DNA, 21 bp, Homo sapiens
tatttataacattgtaaatga

SEQ ID NO: 6424499 - DNA, 20 bp, Homo sapiens
tatttataactcatcataaa

SEQ ID NO: 6424500 - DNA, 21 bp, Homo sapiens
tatttataactcatcataaaa

SEQ ID NO: 6424501 - DNA, 17 bp, Homo sapiens
tatttataagcagattt

SEQ ID NO: 6424502 - DNA, 18 bp, Homo sapiens
tatttataatacagaatc

SEQ ID NO: 6424503 - DNA, 17 bp, Homo sapiens
tatttataatacatttc

SEQ ID NO: 6424504 - DNA, 15 bp, Homo sapiens
tatttataattaaag

SEQ ID NO: 6424505 - DNA, 15 bp, Homo sapiens
tatttataattccta

SEQ ID NO: 6424506 - DNA, 18 bp, Homo sapiens
tatttataatttaaatga

SEQ ID NO: 6424507 - DNA, 17 bp, Homo sapiens
tatttatagagttcata

SEQ ID NO: 6424508 - DNA, 22 bp, Homo sapiens
tatttatagcaaagttatctta

SEQ ID NO: 6424509 - DNA, 18 bp, Homo sapiens
tatttatagcaatccatg

SEQ ID NO: 6424510 - DNA, 17 bp, Homo sapiens
tatttatagtttaatac

SEQ ID NO: 6424511 - DNA, 18 bp, Homo sapiens
tatttatataattatgtt

SEQ ID NO: 6424512 - DNA, 23 bp, Homo sapiens
tatttatataattatgttattga

SEQ ID NO: 6424513 - DNA, 13 bp, Homo sapiens
tatttatatactt

SEQ ID NO: 6424514 - DNA, 13 bp, Homo sapiens
tatttatatatga

SEQ ID NO: 6424515 - DNA, 16 bp, Homo sapiens
tatttatatatttgaa

SEQ ID NO: 6424516 - DNA, 13 bp, Homo sapiens
tatttatatcttt

SEQ ID NO: 6424517 - DNA, 15 bp, Homo sapiens
tatttatatgaagca

SEQ ID NO: 6424518 - DNA, 21 bp, Homo sapiens
tatttatatgaagcaagctgt

SEQ ID NO: 6424519 - DNA, 17 bp, Homo sapiens
tatttatatgtacatga

SEQ ID NO: 6424520 - DNA, 15 bp, Homo sapiens
tatttatatgtactg

SEQ ID NO: 6424521 - DNA, 22 bp, Homo sapiens
tatttatatgtatgtgtttaga

SEQ ID NO: 6424522 - DNA, 14 bp, Homo sapiens
tatttatatgttaa

SEQ ID NO: 6424523 - DNA, 21 bp, Homo sapiens
tatttatatgttattaaacag

SEQ ID NO: 6424524 - DNA, 23 bp, Homo sapiens
tatttatatgttattaaacaggt

SEQ ID NO: 6424525 - DNA, 19 bp, Homo sapiens
tatttatattcatcaaata

SEQ ID NO: 6424526 - DNA, 22 bp, Homo sapiens
tatttatattcatcaaataaac

SEQ ID NO: 6424527 - DNA, 15 bp, Homo sapiens
tatttatatttattg

SEQ ID NO: 6424528 - DNA, 16 bp, Homo sapiens
tatttatatttattga

SEQ ID NO: 6424529 - DNA, 17 bp, Homo sapiens
tatttatatttattgac

SEQ ID NO: 6424530 - DNA, 18 bp, Homo sapiens
tatttatatttattgact

SEQ ID NO: 6424531 - DNA, 16 bp, Homo sapiens
tatttatatttcctgt

SEQ ID NO: 6424532 - DNA, 14 bp, Homo sapiens
tatttatatttgga

SEQ ID NO: 6424533 - DNA, 20 bp, Homo sapiens
tatttatccagaaaactgtg

SEQ ID NO: 6424534 - DNA, 21 bp, Homo sapiens
tatttatccagaaaactgtga

SEQ ID NO: 6424535 - DNA, 14 bp, Homo sapiens
tatttatccctttc

SEQ ID NO: 6424536 - DNA, 18 bp, Homo sapiens
tatttatccctttcctgg

SEQ ID NO: 6424537 - DNA, 17 bp, Homo sapiens
tatttatcgaaagtaaa

SEQ ID NO: 6424538 - DNA, 20 bp, Homo sapiens
tatttatcgcaacatgaatt

SEQ ID NO: 6424539 - DNA, 16 bp, Homo sapiens
tatttatctctattta

SEQ ID NO: 6424540 - DNA, 17 bp, Homo sapiens
tatttatctctatttaa

SEQ ID NO: 6424541 - DNA, 21 bp, Homo sapiens
tatttatctgattaagttgtc

SEQ ID NO: 6424542 - DNA, 14 bp, Homo sapiens
tatttatctgtctg

SEQ ID NO: 6424543 - DNA, 16 bp, Homo sapiens
tatttatctgttcaaa

SEQ ID NO: 6424544 - DNA, 20 bp, Homo sapiens
tatttatgaagaaaatactt

SEQ ID NO: 6424545 - DNA, 16 bp, Homo sapiens
tatttatgaagtttaa

SEQ ID NO: 6424546 - DNA, 19 bp, Homo sapiens
tatttatgaagtttaaaac

SEQ ID NO: 6424547 - DNA, 13 bp, Homo sapiens
tatttatgaattg

SEQ ID NO: 6424548 - DNA, 14 bp, Homo sapiens
tatttatgacctca

SEQ ID NO: 6424549 - DNA, 20 bp, Homo sapiens
tatttatgatgttattttgt

SEQ ID NO: 6424550 - DNA, 19 bp, Homo sapiens
tatttatgcactgtgggat

SEQ ID NO: 6424551 - DNA, 18 bp, Homo sapiens
tatttatgcagaaggtat

SEQ ID NO: 6424552 - DNA, 19 bp, Homo sapiens
tatttatgccttgatgatt

SEQ ID NO: 6424553 - DNA, 18 bp, Homo sapiens
tatttatgcgtaatttaa

SEQ ID NO: 6424554 - DNA, 18 bp, Homo sapiens
tatttatggattaaaaac

SEQ ID NO: 6424555 - DNA, 21 bp, Homo sapiens
tatttatggcttataaatgtg

SEQ ID NO: 6424556 - DNA, 13 bp, Homo sapiens
tatttatggtttc

SEQ ID NO: 6424557 - DNA, 16 bp, Homo sapiens
tatttatgtaaaagga

SEQ ID NO: 6424558 - DNA, 16 bp, Homo sapiens
tatttatgtaatttgt

SEQ ID NO: 6424559 - DNA, 21 bp, Homo sapiens
tatttatgtaggatctgtcaa

SEQ ID NO: 6424560 - DNA, 13 bp, Homo sapiens
tatttatgtattg

SEQ ID NO: 6424561 - DNA, 23 bp, Homo sapiens
tatttatgtgaacaactgtttgt

SEQ ID NO: 6424562 - DNA, 13 bp, Homo sapiens
tatttatgtgtat

SEQ ID NO: 6424563 - DNA, 16 bp, Homo sapiens
tatttatgttctcaac

SEQ ID NO: 6424564 - DNA, 16 bp, Homo sapiens
tatttatgttttcaca

SEQ ID NO: 6424565 - DNA, 20 bp, Homo sapiens
tatttattaaacttcagcaa

SEQ ID NO: 6424566 - DNA, 12 bp, Homo sapiens
tatttattaaat

SEQ ID NO: 6424567 - DNA, 13 bp, Homo sapiens
tatttattaaata

SEQ ID NO: 6424568 - DNA, 17 bp, Homo sapiens
tatttattaaataaaat

SEQ ID NO: 6424569 - DNA, 19 bp, Homo sapiens
tatttattaatatttaaca

SEQ ID NO: 6424570 - DNA, 14 bp, Homo sapiens
tatttattaatttg

SEQ ID NO: 6424571 - DNA, 16 bp, Homo sapiens
tatttattaatttgaa

SEQ ID NO: 6424572 - DNA, 16 bp, Homo sapiens
tatttattacctctga

SEQ ID NO: 6424573 - DNA, 14 bp, Homo sapiens
tatttattactatg

SEQ ID NO: 6424574 - DNA, 20 bp, Homo sapiens
tatttattacttgtgcactt

SEQ ID NO: 6424575 - DNA, 18 bp, Homo sapiens
tatttattagccaactgt

SEQ ID NO: 6424576 - DNA, 16 bp, Homo sapiens
tatttattatttgaag

SEQ ID NO: 6424577 - DNA, 15 bp, Homo sapiens
tatttattcactgta

SEQ ID NO: 6424578 - DNA, 21 bp, Homo sapiens
tatttattcagcttcatttgt

SEQ ID NO: 6424579 - DNA, 22 bp, Homo sapiens
tatttattcattatttgtcaaa

SEQ ID NO: 6424580 - DNA, 20 bp, Homo sapiens
tatttattccatattcatgt

SEQ ID NO: 6424581 - DNA, 14 bp, Homo sapiens
tatttattccccag

SEQ ID NO: 6424582 - DNA, 21 bp, Homo sapiens
tatttattccccagtgactcc

SEQ ID NO: 6424583 - DNA, 21 bp, Homo sapiens
tatttattgactcttgagttg

SEQ ID NO: 6424584 - DNA, 16 bp, Homo sapiens
tatttattgagcatct

SEQ ID NO: 6424585 - DNA, 20 bp, Homo sapiens
tatttattgagcatctagta

SEQ ID NO: 6424586 - DNA, 14 bp, Homo sapiens
tatttattgcattg

SEQ ID NO: 6424587 - DNA, 13 bp, Homo sapiens
tatttattgcttt

SEQ ID NO: 6424588 - DNA, 14 bp, Homo sapiens
tatttattgcttta

SEQ ID NO: 6424589 - DNA, 22 bp, Homo sapiens
tatttattggatgatacagtgt

SEQ ID NO: 6424590 - DNA, 23 bp, Homo sapiens
tatttattgggatgtgagcccca

SEQ ID NO: 6424591 - DNA, 16 bp, Homo sapiens
tatttattggtcaggg

SEQ ID NO: 6424592 - DNA, 14 bp, Homo sapiens
tatttattggtttt

SEQ ID NO: 6424593 - DNA, 13 bp, Homo sapiens
tatttattgtatt

SEQ ID NO: 6424594 - DNA, 17 bp, Homo sapiens
tatttattgtattctgg

SEQ ID NO: 6424595 - DNA, 16 bp, Homo sapiens
tatttattgttaaatt

SEQ ID NO: 6424596 - DNA, 20 bp, Homo sapiens
tatttattgttagaaaatga

SEQ ID NO: 6424597 - DNA, 22 bp, Homo sapiens
tatttattgttcgatgcctgca

SEQ ID NO: 6424598 - DNA, 20 bp, Homo sapiens
tatttattgttgccttttca

SEQ ID NO: 6424599 - DNA, 16 bp, Homo sapiens
tatttattgtttattt

SEQ ID NO: 6424600 - DNA, 13 bp, Homo sapiens
tatttatttaaaa

SEQ ID NO: 6424601 - DNA, 17 bp, Homo sapiens
tatttatttaaacaaat

SEQ ID NO: 6424602 - DNA, 13 bp, Homo sapiens
tatttatttaaat

SEQ ID NO: 6424603 - DNA, 18 bp, Homo sapiens
tatttatttaaatgtcta

SEQ ID NO: 6424604 - DNA, 14 bp, Homo sapiens
tatttatttaaatt

SEQ ID NO: 6424605 - DNA, 12 bp, Homo sapiens
tatttatttaat

SEQ ID NO: 6424606 - DNA, 11 bp, Homo sapiens
tatttatttac

SEQ ID NO: 6424607 - DNA, 15 bp, Homo sapiens
tatttatttacaaat

SEQ ID NO: 6424608 - DNA, 16 bp, Homo sapiens
tatttatttacaaatg

SEQ ID NO: 6424609 - DNA, 13 bp, Homo sapiens
tatttatttactg

SEQ ID NO: 6424610 - DNA, 17 bp, Homo sapiens
tatttatttactgagct

SEQ ID NO: 6424611 - DNA, 11 bp, Homo sapiens
tatttatttat

SEQ ID NO: 6424612 - DNA, 13 bp, Homo sapiens
tatttatttatgt

SEQ ID NO: 6424613 - DNA, 18 bp, Homo sapiens
tatttatttatgtacttt

SEQ ID NO: 6424614 - DNA, 12 bp, Homo sapiens
tatttatttatt

SEQ ID NO: 6424615 - DNA, 15 bp, Homo sapiens
tatttatttattttg

SEQ ID NO: 6424616 - DNA, 13 bp, Homo sapiens
tatttatttcaga

SEQ ID NO: 6424617 - DNA, 15 bp, Homo sapiens
tatttatttcagcat

SEQ ID NO: 6424618 - DNA, 15 bp, Homo sapiens
tatttatttcctgct

SEQ ID NO: 6424619 - DNA, 14 bp, Homo sapiens
tatttatttcctta

SEQ ID NO: 6424620 - DNA, 19 bp, Homo sapiens
tatttatttgattaggtat

SEQ ID NO: 6424621 - DNA, 11 bp, Homo sapiens
tatttatttgt

SEQ ID NO: 6424622 - DNA, 13 bp, Homo sapiens
tatttatttgtga

SEQ ID NO: 6424623 - DNA, 14 bp, Homo sapiens
tatttattttaata

SEQ ID NO: 6424624 - DNA, 18 bp, Homo sapiens
tatttattttaataatgt

SEQ ID NO: 6424625 - DNA, 18 bp, Homo sapiens
tatttattttaatgtatt

SEQ ID NO: 6424626 - DNA, 15 bp, Homo sapiens
tatttattttagcaa

SEQ ID NO: 6424627 - DNA, 16 bp, Homo sapiens
tatttattttcctaaa

SEQ ID NO: 6424628 - DNA, 20 bp, Homo sapiens
tatttattttcctaaagaga

SEQ ID NO: 6424629 - DNA, 14 bp, Homo sapiens
tatttattttgtaa

SEQ ID NO: 6424630 - DNA, 16 bp, Homo sapiens
tatttattttgtaatt

SEQ ID NO: 6424631 - DNA, 21 bp, Homo sapiens
tatttatttttacctgctttt

SEQ ID NO: 6424632 - DNA, 15 bp, Homo sapiens
tatttatttttcttg

SEQ ID NO: 6424633 - DNA, 19 bp, Homo sapiens
tatttatttttgtgtaggt

SEQ ID NO: 6424634 - DNA, 16 bp, Homo sapiens
tatttcaaaaatttgg

SEQ ID NO: 6424635 - DNA, 17 bp, Homo sapiens
tatttcaaaaatttgga

SEQ ID NO: 6424636 - DNA, 22 bp, Homo sapiens
tatttcaaaaatttggaattct

SEQ ID NO: 6424637 - DNA, 20 bp, Homo sapiens
tatttcaaaatatacattca

SEQ ID NO: 6424638 - DNA, 14 bp, Homo sapiens
tatttcaaaatgtc

SEQ ID NO: 6424639 - DNA, 15 bp, Homo sapiens
tatttcaaaatgtcc

SEQ ID NO: 6424640 - DNA, 15 bp, Homo sapiens
tatttcaaacatcag

SEQ ID NO: 6424641 - DNA, 17 bp, Homo sapiens
tatttcaaacatcagct

SEQ ID NO: 6424642 - DNA, 22 bp, Homo sapiens
tatttcaaacatcagctgaatt

SEQ ID NO: 6424643 - DNA, 22 bp, Homo sapiens
tatttcaaaccagtttcacata

SEQ ID NO: 6424644 - DNA, 20 bp, Homo sapiens
tatttcaaatgaacacgtgc

SEQ ID NO: 6424645 - DNA, 16 bp, Homo sapiens
tatttcaaatgattat

SEQ ID NO: 6424646 - DNA, 18 bp, Homo sapiens
tatttcaaattggagctt

SEQ ID NO: 6424647 - DNA, 14 bp, Homo sapiens
tatttcaagacatt

SEQ ID NO: 6424648 - DNA, 18 bp, Homo sapiens
tatttcaagctcatgtca

SEQ ID NO: 6424649 - DNA, 18 bp, Homo sapiens
tatttcaaggaatagagt

SEQ ID NO: 6424650 - DNA, 18 bp, Homo sapiens
tatttcaagggttgcttc

SEQ ID NO: 6424651 - DNA, 19 bp, Homo sapiens
tatttcaagggttgcttct

SEQ ID NO: 6424652 - DNA, 14 bp, Homo sapiens
tatttcaagtgcct

SEQ ID NO: 6424653 - DNA, 17 bp, Homo sapiens
tatttcaataaatcttt

SEQ ID NO: 6424654 - DNA, 14 bp, Homo sapiens
tatttcaataacag

SEQ ID NO: 6424655 - DNA, 14 bp, Homo sapiens
tatttcaatctttt

SEQ ID NO: 6424656 - DNA, 15 bp, Homo sapiens
tatttcaatgtaatt

SEQ ID NO: 6424657 - DNA, 15 bp, Homo sapiens
tatttcaatgttagc

SEQ ID NO: 6424658 - DNA, 20 bp, Homo sapiens
tcgcccaggctggactgcag

SEQ ID NO: 6424659 - DNA, 17 bp, Homo sapiens
tcgcccagtcccagcag

SEQ ID NO: 6424660 - DNA, 18 bp, Homo sapiens
tcgcccagtcccagcagc

SEQ ID NO: 6424661 - DNA, 16 bp, Homo sapiens
tcgcccatccccttga

SEQ ID NO: 6424662 - DNA, 10 bp, Homo sapiens
tcgcccatga

SEQ ID NO: 6424663 - DNA, 13 bp, Homo sapiens
tcgccccaaagtt

SEQ ID NO: 6424664 - DNA, 23 bp, Homo sapiens
tcgccccaacactgtccttccct

SEQ ID NO: 6424665 - DNA, 13 bp, Homo sapiens
tcgccccacccag

SEQ ID NO: 6424666 - DNA, 20 bp, Homo sapiens
tcgccccagatcaccagccc

SEQ ID NO: 6424667 - DNA, 20 bp, Homo sapiens
tcgccccagcaggtgctgac

SEQ ID NO: 6424668 - DNA, 13 bp, Homo sapiens
tcgccccaggccc

SEQ ID NO: 6424669 - DNA, 12 bp, Homo sapiens
tcgccccagtgg

SEQ ID NO: 6424670 - DNA, 13 bp, Homo sapiens
tcgccccatccct

SEQ ID NO: 6424671 - DNA, 19 bp, Homo sapiens
tcgccccattttctttaca

SEQ ID NO: 6424672 - DNA, 15 bp, Homo sapiens
tcgcccccacacccc

SEQ ID NO: 6424673 - DNA, 13 bp, Homo sapiens
tcgcccccacctc

SEQ ID NO: 6424674 - DNA, 18 bp, Homo sapiens
tcgcccccaggaacgctc

SEQ ID NO: 6424675 - DNA, 19 bp, Homo sapiens
tcgcccccaggaacgctct

SEQ ID NO: 6424676 - DNA, 17 bp, Homo sapiens
tcgccccccgcccggcc

SEQ ID NO: 6424677 - DNA, 17 bp, Homo sapiens
tcgccccctgcctgcca

SEQ ID NO: 6424678 - DNA, 16 bp, Homo sapiens
tcgccccgtgtttgcg

SEQ ID NO: 6424679 - DNA, 16 bp, Homo sapiens
tcgcccctccagtgtt

SEQ ID NO: 6424680 - DNA, 14 bp, Homo sapiens
tcgcccctcccctc

SEQ ID NO: 6424681 - DNA, 15 bp, Homo sapiens
tcgcccctcccctca

SEQ ID NO: 6424682 - DNA, 19 bp, Homo sapiens
tcgcccctcccctcagcct

SEQ ID NO: 6424683 - DNA, 20 bp, Homo sapiens
tcgcccctcccctcagcctg

SEQ ID NO: 6424684 - DNA, 21 bp, Homo sapiens
tcgcccctccttttggcctgg

SEQ ID NO: 6424685 - DNA, 22 bp, Homo sapiens
tcgccccttccctctctccctg

SEQ ID NO: 6424686 - DNA, 15 bp, Homo sapiens
tcgcccgcccacacg

SEQ ID NO: 6424687 - DNA, 23 bp, Homo sapiens
tcgcccgcccactgtcctgggcg

SEQ ID NO: 6424688 - DNA, 15 bp, Homo sapiens
tcgccctcctttccc

SEQ ID NO: 6424689 - DNA, 18 bp, Homo sapiens
tcgccctcctttccctta

SEQ ID NO: 6424690 - DNA, 14 bp, Homo sapiens
tcgccctcctttct

SEQ ID NO: 6424691 - DNA, 16 bp, Homo sapiens
tcgccctcctttctgt

SEQ ID NO: 6424692 - DNA, 12 bp, Homo sapiens
tcgccctctctc

SEQ ID NO: 6424693 - DNA, 16 bp, Homo sapiens
tcgccctctgtgccta

SEQ ID NO: 6424694 - DNA, 18 bp, Homo sapiens
tcgccctggccagggcct

SEQ ID NO: 6424695 - DNA, 19 bp, Homo sapiens
tcgccctgtccctcccact

SEQ ID NO: 6424696 - DNA, 19 bp, Homo sapiens
tcgcccttacttcttgccc

SEQ ID NO: 6424697 - DNA, 14 bp, Homo sapiens
tcgcccttctcccg

SEQ ID NO: 6424698 - DNA, 22 bp, Homo sapiens
tcgcccttctcccggccctcac

SEQ ID NO: 6424699 - DNA, 16 bp, Homo sapiens
tcgccgcaacctgcag

SEQ ID NO: 6424700 - DNA, 17 bp, Homo sapiens
tcgccggatctgaggga

SEQ ID NO: 6424701 - DNA, 16 bp, Homo sapiens
tcgccgtccctctgcc

SEQ ID NO: 6424702 - DNA, 23 bp, Homo sapiens
tcgccgtgtctcagcctctgcca

SEQ ID NO: 6424703 - DNA, 17 bp, Homo sapiens
tcgcctaggatttcagc

SEQ ID NO: 6424704 - DNA, 20 bp, Homo sapiens
tcgcctaggatttcagccat

SEQ ID NO: 6424705 - DNA, 12 bp, Homo sapiens
tcgcctcagcct

SEQ ID NO: 6424706 - DNA, 18 bp, Homo sapiens
tcgcctcaggctttttcc

SEQ ID NO: 6424707 - DNA, 11 bp, Homo sapiens
tcgcctcctcc

SEQ ID NO: 6424708 - DNA, 14 bp, Homo sapiens
tcgcctcctccagc

SEQ ID NO: 6424709 - DNA, 18 bp, Homo sapiens
tcgcctcctccagctcct

SEQ ID NO: 6424710 - DNA, 15 bp, Homo sapiens
tcgcctctgcccagc

SEQ ID NO: 6424711 - DNA, 11 bp, Homo sapiens
tcgcctgacaa

SEQ ID NO: 6424712 - DNA, 20 bp, Homo sapiens
tcgcctgacaaccactggtc

SEQ ID NO: 6424713 - DNA, 14 bp, Homo sapiens
tcgcctgccctcct

SEQ ID NO: 6424714 - DNA, 16 bp, Homo sapiens
tcgcctgccctcctct

SEQ ID NO: 6424715 - DNA, 17 bp, Homo sapiens
tcgcctgccctcctctc

SEQ ID NO: 6424716 - DNA, 16 bp, Homo sapiens
tcgcctgcctgcagca

SEQ ID NO: 6424717 - DNA, 19 bp, Homo sapiens
tcgcctggaaacagaggta

SEQ ID NO: 6424718 - DNA, 13 bp, Homo sapiens
tcgcctggagccc

SEQ ID NO: 6424719 - DNA, 14 bp, Homo sapiens
tcgcctggagccct

SEQ ID NO: 6424720 - DNA, 14 bp, Homo sapiens
tcgcctgggcccag

SEQ ID NO: 6424721 - DNA, 19 bp, Homo sapiens
tcgcctgggcccaggctct

SEQ ID NO: 6424722 - DNA, 21 bp, Homo sapiens
tcgcctgggcccaggctctgg

SEQ ID NO: 6424723 - DNA, 22 bp, Homo sapiens
tcgcctgggcccaggctctggg

SEQ ID NO: 6424724 - DNA, 18 bp, Homo sapiens
tcgcctgtcacccccact

SEQ ID NO: 6424725 - DNA, 21 bp, Homo sapiens
tcgcctgtggagctcagcccc

SEQ ID NO: 6424726 - DNA, 12 bp, Homo sapiens
tcgccttaaact

SEQ ID NO: 6424727 - DNA, 15 bp, Homo sapiens
tcgccttcctgcagt

SEQ ID NO: 6424728 - DNA, 20 bp, Homo sapiens
tcgccttcctgcagtctccg

SEQ ID NO: 6424729 - DNA, 14 bp, Homo sapiens
tcgccttctggctg

SEQ ID NO: 6424730 - DNA, 13 bp, Homo sapiens
tcgccttctgggg

SEQ ID NO: 6424731 - DNA, 18 bp, Homo sapiens
tcgccttcttagagtttt

SEQ ID NO: 6424732 - DNA, 19 bp, Homo sapiens
tcgccttcttagagtttta

SEQ ID NO: 6424733 - DNA, 15 bp, Homo sapiens
tcgcctttcccaccc

SEQ ID NO: 6424734 - DNA, 23 bp, Homo sapiens
tcgccttttaggctcaggacgga

SEQ ID NO: 6424735 - DNA, 22 bp, Homo sapiens
tcgcgaaggtcccacagccctg

SEQ ID NO: 6424736 - DNA, 14 bp, Homo sapiens
tcgcgacaatgcaa

SEQ ID NO: 6424737 - DNA, 17 bp, Homo sapiens
tcgcgagtgtaactttc

SEQ ID NO: 6424738 - DNA, 22 bp, Homo sapiens
tcgcgatgggaaccgatggtgg

SEQ ID NO: 6424739 - DNA, 19 bp, Homo sapiens
tcgcgccagcgacctctct

SEQ ID NO: 6424740 - DNA, 21 bp, Homo sapiens
tcgcgccagcgacctctctgc

SEQ ID NO: 6424741 - DNA, 19 bp, Homo sapiens
tcgcgcccgcccctgcagc

SEQ ID NO: 6424742 - DNA, 22 bp, Homo sapiens
tcgcgcgcagcgcgtgcacagc

SEQ ID NO: 6424743 - DNA, 15 bp, Homo sapiens
tcgcgctctgctcag

SEQ ID NO: 6424744 - DNA, 13 bp, Homo sapiens
tcgcgctgcctgt

SEQ ID NO: 6424745 - DNA, 15 bp, Homo sapiens
tcgcgctggaatcca

SEQ ID NO: 6424746 - DNA, 16 bp, Homo sapiens
tcgcggcgcagcccct

SEQ ID NO: 6424747 - DNA, 18 bp, Homo sapiens
tcgcggcgcagcccctgg

SEQ ID NO: 6424748 - DNA, 16 bp, Homo sapiens
tcgcgtgccctcgctg

SEQ ID NO: 6424749 - DNA, 20 bp, Homo sapiens
tcgcgtgccctcgctgcttc

SEQ ID NO: 6424750 - DNA, 16 bp, Homo sapiens
tcgcgttcccaaagat

SEQ ID NO: 6424751 - DNA, 17 bp, Homo sapiens
tcgctaagctggctctg

SEQ ID NO: 6424752 - DNA, 21 bp, Homo sapiens
tcgctactggcatagtttcat

SEQ ID NO: 6424753 - DNA, 13 bp, Homo sapiens
tcgctagcactca

SEQ ID NO: 6424754 - DNA, 22 bp, Homo sapiens
tcgctagcagtggcaggcagag

SEQ ID NO: 6424755 - DNA, 18 bp, Homo sapiens
tcgctatgggaggcagcc

SEQ ID NO: 6424756 - DNA, 17 bp, Homo sapiens
tcgctattcccaggcag

SEQ ID NO: 6424757 - DNA, 23 bp, Homo sapiens
tcgctcaggctggagtgcagtga

SEQ ID NO: 6424758 - DNA, 19 bp, Homo sapiens
tcgctcagtcagtgcacta

SEQ ID NO: 6424759 - DNA, 14 bp, Homo sapiens
tcgctccccactct

SEQ ID NO: 6424760 - DNA, 15 bp, Homo sapiens
tcgctccccactctg

SEQ ID NO: 6424761 - DNA, 11 bp, Homo sapiens
tcgctcccctc

SEQ ID NO: 6424762 - DNA, 17 bp, Homo sapiens
tcgctcccgccagcagc

SEQ ID NO: 6424763 - DNA, 20 bp, Homo sapiens
tcgctcccgccagcagcata

SEQ ID NO: 6424764 - DNA, 16 bp, Homo sapiens
tcgctccctgtagctc

SEQ ID NO: 6424765 - DNA, 21 bp, Homo sapiens
tcgctccctgtagctctgcct

SEQ ID NO: 6424766 - DNA, 18 bp, Homo sapiens
tcgctcctcaacccctcc

SEQ ID NO: 6424767 - DNA, 16 bp, Homo sapiens
tcgctcctccttccca

SEQ ID NO: 6424768 - DNA, 12 bp, Homo sapiens
tcgctcctgtgt

SEQ ID NO: 6424769 - DNA, 13 bp, Homo sapiens
tcgctcctgtgtc

SEQ ID NO: 6424770 - DNA, 14 bp, Homo sapiens
tcgctcctgtgtct

SEQ ID NO: 6424771 - DNA, 14 bp, Homo sapiens
tcgctctcagttct

SEQ ID NO: 6424772 - DNA, 15 bp, Homo sapiens
tcgctctctctcgct

SEQ ID NO: 6424773 - DNA, 20 bp, Homo sapiens
tcgctctctgtctccaggca

SEQ ID NO: 6424774 - DNA, 13 bp, Homo sapiens
tcgctctgcatga

SEQ ID NO: 6424775 - DNA, 11 bp, Homo sapiens
tcgctctgctg

SEQ ID NO: 6424776 - DNA, 17 bp, Homo sapiens
tcgctctgctggcctgg

SEQ ID NO: 6424777 - DNA, 21 bp, Homo sapiens
tcgctctgctggcctggccgg

SEQ ID NO: 6424778 - DNA, 23 bp, Homo sapiens
tcgctctgctggcctggccggca

SEQ ID NO: 6424779 - DNA, 13 bp, Homo sapiens
tcgctctttgaga

SEQ ID NO: 6424780 - DNA, 15 bp, Homo sapiens
tcgctgaaattaaat

SEQ ID NO: 6424781 - DNA, 17 bp, Homo sapiens
tcgctgaaattgcttat

SEQ ID NO: 6424782 - DNA, 18 bp, Homo sapiens
tcgctgaacaattacctg

SEQ ID NO: 6424783 - DNA, 18 bp, Homo sapiens
tcgctgacttcatggaat

SEQ ID NO: 6424784 - DNA, 16 bp, Homo sapiens
tcgctgatgctgggct

SEQ ID NO: 6424785 - DNA, 18 bp, Homo sapiens
tcgctgatgctgggctgg

SEQ ID NO: 6424786 - DNA, 20 bp, Homo sapiens
tcgctgatgctgggctgggt

SEQ ID NO: 6424787 - DNA, 20 bp, Homo sapiens
tcgctgcacatggcctgagc

SEQ ID NO: 6424788 - DNA, 21 bp, Homo sapiens
tcgctgcacatggcctgagca

SEQ ID NO: 6424789 - DNA, 13 bp, Homo sapiens
tcgctgcagcccc

SEQ ID NO: 6424790 - DNA, 23 bp, Homo sapiens
tcgctgcagggagcaccacggcc

SEQ ID NO: 6424791 - DNA, 20 bp, Homo sapiens
tcgctgccagctctgtatca

SEQ ID NO: 6424792 - DNA, 12 bp, Homo sapiens
tcgctgccagga

SEQ ID NO: 6424793 - DNA, 22 bp, Homo sapiens
tcgctgccaggacacctgcccc

SEQ ID NO: 6424794 - DNA, 22 bp, Homo sapiens
tcgctgccatcaccgctgggtg

SEQ ID NO: 6424795 - DNA, 23 bp, Homo sapiens
tcgctgccatcaccgctgggtgg

SEQ ID NO: 6424796 - DNA, 22 bp, Homo sapiens
tcgctgccctgtggacaggatg

SEQ ID NO: 6424797 - DNA, 14 bp, Homo sapiens
tcgctgcctccatg

SEQ ID NO: 6424798 - DNA, 21 bp, Homo sapiens
tcgctgcctccatggcagcag

SEQ ID NO: 6424799 - DNA, 23 bp, Homo sapiens
tcgctgcctccatggcagcagcc

SEQ ID NO: 6424800 - DNA, 16 bp, Homo sapiens
tcgctgcgcagcctcc

SEQ ID NO: 6424801 - DNA, 18 bp, Homo sapiens
tcgctgctctagctggca

SEQ ID NO: 6424802 - DNA, 21 bp, Homo sapiens
tcgctgctctagctggcagga

SEQ ID NO: 6424803 - DNA, 13 bp, Homo sapiens
tcgctgctggcct

SEQ ID NO: 6424804 - DNA, 21 bp, Homo sapiens
tcgctggaatcaatttcccag

SEQ ID NO: 6424805 - DNA, 23 bp, Homo sapiens
tcgctggactctcagtctctgag

SEQ ID NO: 6424806 - DNA, 20 bp, Homo sapiens
tcgctggcagagaaggcttc

SEQ ID NO: 6424807 - DNA, 11 bp, Homo sapiens
tcgctggcccc

SEQ ID NO: 6424808 - DNA, 14 bp, Homo sapiens
tcgctggcccccac

SEQ ID NO: 6424809 - DNA, 18 bp, Homo sapiens
tcgctggcccccactggc

SEQ ID NO: 6424810 - DNA, 20 bp, Homo sapiens
tcgctggcccccactggctg

SEQ ID NO: 6424811 - DNA, 22 bp, Homo sapiens
tcgctggcccctttgggccctg

SEQ ID NO: 6424812 - DNA, 13 bp, Homo sapiens
tcgctggctttct

SEQ ID NO: 6424813 - DNA, 18 bp, Homo sapiens
tcgctggctttctctctg

SEQ ID NO: 6424814 - DNA, 20 bp, Homo sapiens
tcgctggctttctctctggc

SEQ ID NO: 6424815 - DNA, 22 bp, Homo sapiens
tcgctggctttctctctggctt

SEQ ID NO: 6424816 - DNA, 20 bp, Homo sapiens
tcgctgggctctaaggtact

SEQ ID NO: 6424817 - DNA, 14 bp, Homo sapiens
tcgctgggtcagtg

SEQ ID NO: 6424818 - DNA, 16 bp, Homo sapiens
tcgctgtcacaggcgg

SEQ ID NO: 6424819 - DNA, 17 bp, Homo sapiens
tcgctgtcccctcagcg

SEQ ID NO: 6424820 - DNA, 17 bp, Homo sapiens
tcgctgtccgtcctgct

SEQ ID NO: 6424821 - DNA, 15 bp, Homo sapiens
tcgctgtcctgctgt

SEQ ID NO: 6424822 - DNA, 19 bp, Homo sapiens
tcgctgtgatgcatgagct

SEQ ID NO: 6424823 - DNA, 22 bp, Homo sapiens
tcgctgtgatgcatgagctccc

SEQ ID NO: 6424824 - DNA, 11 bp, Homo sapiens
tcgctgtgcca

SEQ ID NO: 6424825 - DNA, 18 bp, Homo sapiens
tcgctgtgccaccacccc

SEQ ID NO: 6424826 - DNA, 21 bp, Homo sapiens
tcgctgtgtgttagttcccaa

SEQ ID NO: 6424827 - DNA, 15 bp, Homo sapiens
tcgctgttctgggca

SEQ ID NO: 6424828 - DNA, 18 bp, Homo sapiens
tcgctgttggagcaaacc

SEQ ID NO: 6424829 - DNA, 21 bp, Homo sapiens
tcgctgttggagcaaaccatt

SEQ ID NO: 6424830 - DNA, 23 bp, Homo sapiens
tcgcttatttagcccgagatctg

SEQ ID NO: 6424831 - DNA, 14 bp, Homo sapiens
tcgcttccaggccg

SEQ ID NO: 6424832 - DNA, 15 bp, Homo sapiens
tcgcttcccccatag

SEQ ID NO: 6424833 - DNA, 16 bp, Homo sapiens
tcgcttcctcagcctc

SEQ ID NO: 6424834 - DNA, 18 bp, Homo sapiens
tcgcttcctcagcctcca

SEQ ID NO: 6424835 - DNA, 14 bp, Homo sapiens
tcgcttctctgtga

SEQ ID NO: 6424836 - DNA, 22 bp, Homo sapiens
tcgcttcttagaacagtggaaa

SEQ ID NO: 6424837 - DNA, 22 bp, Homo sapiens
tatttcacaattatatttttgt

SEQ ID NO: 6424838 - DNA, 13 bp, Homo sapiens
tatttcacagagc

SEQ ID NO: 6424839 - DNA, 15 bp, Homo sapiens
tatttcacagagcac

SEQ ID NO: 6424840 - DNA, 17 bp, Homo sapiens
tatttcacaggctgtaa

SEQ ID NO: 6424841 - DNA, 18 bp, Homo sapiens
tatttcacaggctgtaaa

SEQ ID NO: 6424842 - DNA, 19 bp, Homo sapiens
tatttcacaggctgtaaat

SEQ ID NO: 6424843 - DNA, 20 bp, Homo sapiens
tatttcacatgtttatattt

SEQ ID NO: 6424844 - DNA, 13 bp, Homo sapiens
tatttcaccattt

SEQ ID NO: 6424845 - DNA, 23 bp, Homo sapiens
tatttcactatcttcttcaaata

SEQ ID NO: 6424846 - DNA, 14 bp, Homo sapiens
tatttcactggagc

SEQ ID NO: 6424847 - DNA, 12 bp, Homo sapiens
tatttcagaaat

SEQ ID NO: 6424848 - DNA, 23 bp, Homo sapiens
tatttcagaagtttaaatattaa

SEQ ID NO: 6424849 - DNA, 14 bp, Homo sapiens
tatttcagaatatt

SEQ ID NO: 6424850 - DNA, 16 bp, Homo sapiens
tatttcagacattttc

SEQ ID NO: 6424851 - DNA, 20 bp, Homo sapiens
tatttcagatatcaaaattc

SEQ ID NO: 6424852 - DNA, 16 bp, Homo sapiens
tatttcagatgtaatg

SEQ ID NO: 6424853 - DNA, 19 bp, Homo sapiens
tatttcagatgtaatgttt

SEQ ID NO: 6424854 - DNA, 21 bp, Homo sapiens
tatttcagatgtaatgttttc

SEQ ID NO: 6424855 - DNA, 17 bp, Homo sapiens
tatttcagattttgata

SEQ ID NO: 6424856 - DNA, 23 bp, Homo sapiens
tatttcagattttgataactgtt

SEQ ID NO: 6424857 - DNA, 19 bp, Homo sapiens
tatttcagcatggactgtt

SEQ ID NO: 6424858 - DNA, 15 bp, Homo sapiens
tatttcagccaatct

SEQ ID NO: 6424859 - DNA, 23 bp, Homo sapiens
tatttcagcccccatcacccaag

SEQ ID NO: 6424860 - DNA, 16 bp, Homo sapiens
tatttcagctgctttg

SEQ ID NO: 6424861 - DNA, 14 bp, Homo sapiens
tatttcaggattct

SEQ ID NO: 6424862 - DNA, 23 bp, Homo sapiens
tatttcaggcacatcattggaat

SEQ ID NO: 6424863 - DNA, 17 bp, Homo sapiens
tatttcagtattttcca

SEQ ID NO: 6424864 - DNA, 20 bp, Homo sapiens
tatttcagtgccatacatgt

SEQ ID NO: 6424865 - DNA, 13 bp, Homo sapiens
tatttcagtgttt

SEQ ID NO: 6424866 - DNA, 17 bp, Homo sapiens
tatttcagtgttttcat

SEQ ID NO: 6424867 - DNA, 23 bp, Homo sapiens
tatttcagttattgtccctggct

SEQ ID NO: 6424868 - DNA, 22 bp, Homo sapiens
tatttcataaattaacaaagtg

SEQ ID NO: 6424869 - DNA, 17 bp, Homo sapiens
tatttcataagcacatc

SEQ ID NO: 6424870 - DNA, 20 bp, Homo sapiens
tatttcatcagaacagctgt

SEQ ID NO: 6424871 - DNA, 23 bp, Homo sapiens
tatttcatcatgataattcagca

SEQ ID NO: 6424872 - DNA, 13 bp, Homo sapiens
tatttcatctttt

SEQ ID NO: 6424873 - DNA, 17 bp, Homo sapiens
tatttcatgaaaattgt

SEQ ID NO: 6424874 - DNA, 20 bp, Homo sapiens
tatttcatgaatacattgta

SEQ ID NO: 6424875 - DNA, 21 bp, Homo sapiens
tatttcatgctgggaatgaga

SEQ ID NO: 6424876 - DNA, 16 bp, Homo sapiens
tatttcatgtctttac

SEQ ID NO: 6424877 - DNA, 22 bp, Homo sapiens
tatttcatgtgctatagacatt

SEQ ID NO: 6424878 - DNA, 16 bp, Homo sapiens
tatttcattcatatcc

SEQ ID NO: 6424879 - DNA, 15 bp, Homo sapiens
tatttcattctctta

SEQ ID NO: 6424880 - DNA, 13 bp, Homo sapiens
tatttcattggtc

SEQ ID NO: 6424881 - DNA, 13 bp, Homo sapiens
tatttcatttatt

SEQ ID NO: 6424882 - DNA, 12 bp, Homo sapiens
tatttcatttta

SEQ ID NO: 6424883 - DNA, 19 bp, Homo sapiens
tatttccaaacctggttca

SEQ ID NO: 6424884 - DNA, 21 bp, Homo sapiens
tatttccaaatattctaaaaa

SEQ ID NO: 6424885 - DNA, 18 bp, Homo sapiens
tatttccaagaacctata

SEQ ID NO: 6424886 - DNA, 18 bp, Homo sapiens
tatttccacataaaggta

SEQ ID NO: 6424887 - DNA, 23 bp, Homo sapiens
tatttccaccatcaaatgctgta

SEQ ID NO: 6424888 - DNA, 14 bp, Homo sapiens
tatttccactaaaa

SEQ ID NO: 6424889 - DNA, 21 bp, Homo sapiens
tatttccactattttcaaaga

SEQ ID NO: 6424890 - DNA, 14 bp, Homo sapiens
tatttccactgaac

SEQ ID NO: 6424891 - DNA, 11 bp, Homo sapiens
tatttccagac

SEQ ID NO: 6424892 - DNA, 23 bp, Homo sapiens
tatttccagtggtcatgctcagc

SEQ ID NO: 6424893 - DNA, 22 bp, Homo sapiens
tatttccatattaaaatcacaa

SEQ ID NO: 6424894 - DNA, 21 bp, Homo sapiens
tatttccattaaaaaatcagt

SEQ ID NO: 6424895 - DNA, 21 bp, Homo sapiens
tatttccattctttcagctgt

SEQ ID NO: 6424896 - DNA, 18 bp, Homo sapiens
tatttcccatgatttcat

SEQ ID NO: 6424897 - DNA, 21 bp, Homo sapiens
tatttcccatttgtgccagag

SEQ ID NO: 6424898 - DNA, 19 bp, Homo sapiens
tatttcccccttactactt

SEQ ID NO: 6424899 - DNA, 22 bp, Homo sapiens
tatttcccccttcatccatcct

SEQ ID NO: 6424900 - DNA, 15 bp, Homo sapiens
tatttccccctttct

SEQ ID NO: 6424901 - DNA, 14 bp, Homo sapiens
tatttcccctgtca

SEQ ID NO: 6424902 - DNA, 21 bp, Homo sapiens
tatttccccttggacacttgg

SEQ ID NO: 6424903 - DNA, 16 bp, Homo sapiens
tatttccctaaaatac

SEQ ID NO: 6424904 - DNA, 17 bp, Homo sapiens
tatttccctacattaaa

SEQ ID NO: 6424905 - DNA, 12 bp, Homo sapiens
tatttcccttcc

SEQ ID NO: 6424906 - DNA, 17 bp, Homo sapiens
tatttcccttccaaaga

SEQ ID NO: 6424907 - DNA, 13 bp, Homo sapiens
tatttccctttag

SEQ ID NO: 6424908 - DNA, 17 bp, Homo sapiens
tatttcctatgatgtat

SEQ ID NO: 6424909 - DNA, 22 bp, Homo sapiens
tatttcctgaacctggaaatga

SEQ ID NO: 6424910 - DNA, 15 bp, Homo sapiens
tatttcctgacttga

SEQ ID NO: 6424911 - DNA, 17 bp, Homo sapiens
tatttcctgacttgagt

SEQ ID NO: 6424912 - DNA, 14 bp, Homo sapiens
tatttcctgctaca

SEQ ID NO: 6424913 - DNA, 20 bp, Homo sapiens
tatttccttagtgccaggag

SEQ ID NO: 6424914 - DNA, 21 bp, Homo sapiens
tatttccttccagccttttta

SEQ ID NO: 6424915 - DNA, 11 bp, Homo sapiens
tatttccttta

SEQ ID NO: 6424916 - DNA, 21 bp, Homo sapiens
tatttccttttgtaaagtaaa

SEQ ID NO: 6424917 - DNA, 21 bp, Homo sapiens
tatttcgagtgttgtgttaaa

SEQ ID NO: 6424918 - DNA, 20 bp, Homo sapiens
tatttcggaaatacactaca

SEQ ID NO: 6424919 - DNA, 20 bp, Homo sapiens
tatttcggctatgtctcatg

SEQ ID NO: 6424920 - DNA, 15 bp, Homo sapiens
tatttcgtgtactgc

SEQ ID NO: 6424921 - DNA, 23 bp, Homo sapiens
tatttcgtgttgtgttctttata

SEQ ID NO: 6424922 - DNA, 16 bp, Homo sapiens
tatttctaaagttgta

SEQ ID NO: 6424923 - DNA, 20 bp, Homo sapiens
tatttctaagcttatttcta

SEQ ID NO: 6424924 - DNA, 22 bp, Homo sapiens
tatttctaagcttatttctaac

SEQ ID NO: 6424925 - DNA, 16 bp, Homo sapiens
tatttctaagtattta

SEQ ID NO: 6424926 - DNA, 22 bp, Homo sapiens
tatttctacaaggtgttcattt

SEQ ID NO: 6424927 - DNA, 14 bp, Homo sapiens
tatttctacagaga

SEQ ID NO: 6424928 - DNA, 15 bp, Homo sapiens
tatttctacagagaa

SEQ ID NO: 6424929 - DNA, 20 bp, Homo sapiens
tatttctacattacagccat

SEQ ID NO: 6424930 - DNA, 18 bp, Homo sapiens
tatttctacctcactttg

SEQ ID NO: 6424931 - DNA, 20 bp, Homo sapiens
tatttctacctttctgagtc

SEQ ID NO: 6424932 - DNA, 15 bp, Homo sapiens
tatttctagagacaa

SEQ ID NO: 6424933 - DNA, 13 bp, Homo sapiens
tatttctagcaga

SEQ ID NO: 6424934 - DNA, 19 bp, Homo sapiens
tatttctagggctgggaaa

SEQ ID NO: 6424935 - DNA, 19 bp, Homo sapiens
tatttctagtagaaagaaa

SEQ ID NO: 6424936 - DNA, 22 bp, Homo sapiens
tatttctagtagaaagaaaatg

SEQ ID NO: 6424937 - DNA, 17 bp, Homo sapiens
tatttctagtccaaaat

SEQ ID NO: 6424938 - DNA, 16 bp, Homo sapiens
tatttctatattttca

SEQ ID NO: 6424939 - DNA, 14 bp, Homo sapiens
tatttctatgaaat

SEQ ID NO: 6424940 - DNA, 15 bp, Homo sapiens
tatttctatgaaata

SEQ ID NO: 6424941 - DNA, 22 bp, Homo sapiens
tatttctatgaaatattatgtt

SEQ ID NO: 6424942 - DNA, 16 bp, Homo sapiens
tatttctatgagaaaa

SEQ ID NO: 6424943 - DNA, 12 bp, Homo sapiens
tatttctatgtc

SEQ ID NO: 6424944 - DNA, 13 bp, Homo sapiens
tatttctattatt

SEQ ID NO: 6424945 - DNA, 21 bp, Homo sapiens
tatttctattattaattgcaa

SEQ ID NO: 6424946 - DNA, 18 bp, Homo sapiens
tatttctatttcctggaa

SEQ ID NO: 6424947 - DNA, 22 bp, Homo sapiens
tatttctcagactttggaaaat

SEQ ID NO: 6424948 - DNA, 14 bp, Homo sapiens
tatttctcagctgt

SEQ ID NO: 6424949 - DNA, 13 bp, Homo sapiens
tatttctcaggaa

SEQ ID NO: 6424950 - DNA, 21 bp, Homo sapiens
tatttctcataatgtgaaata

SEQ ID NO: 6424951 - DNA, 11 bp, Homo sapiens
tatttctcctt

SEQ ID NO: 6424952 - DNA, 15 bp, Homo sapiens
tatttctccttttgt

SEQ ID NO: 6424953 - DNA, 16 bp, Homo sapiens
tatttctctagtagtt

SEQ ID NO: 6424954 - DNA, 13 bp, Homo sapiens
tatttctctcccc

SEQ ID NO: 6424955 - DNA, 15 bp, Homo sapiens
tatttctctctcctg

SEQ ID NO: 6424956 - DNA, 16 bp, Homo sapiens
tatttctctggcaaac

SEQ ID NO: 6424957 - DNA, 20 bp, Homo sapiens
tatttctctggcaaactttt

SEQ ID NO: 6424958 - DNA, 23 bp, Homo sapiens
tatttctcttctacccttttcct

SEQ ID NO: 6424959 - DNA, 13 bp, Homo sapiens
tatttctctttct

SEQ ID NO: 6424960 - DNA, 14 bp, Homo sapiens
tatttctgaaggta

SEQ ID NO: 6424961 - DNA, 21 bp, Homo sapiens
tatttctgaattcaaagcttg

SEQ ID NO: 6424962 - DNA, 23 bp, Homo sapiens
tatttctgaattcaaagcttgtg

SEQ ID NO: 6424963 - DNA, 13 bp, Homo sapiens
tatttctgatcta

SEQ ID NO: 6424964 - DNA, 12 bp, Homo sapiens
tatttctgatga

SEQ ID NO: 6424965 - DNA, 14 bp, Homo sapiens
tatttctgatgatg

SEQ ID NO: 6424966 - DNA, 15 bp, Homo sapiens
tatttctgatgatgt

SEQ ID NO: 6424967 - DNA, 15 bp, Homo sapiens
tatttctgatgtttt

SEQ ID NO: 6424968 - DNA, 16 bp, Homo sapiens
tatttctgatttcata

SEQ ID NO: 6424969 - DNA, 14 bp, Homo sapiens
tatttctgcctata

SEQ ID NO: 6424970 - DNA, 10 bp, Homo sapiens
tatttctgcg

SEQ ID NO: 6424971 - DNA, 21 bp, Homo sapiens
tatttctgctgaattttcaca

SEQ ID NO: 6424972 - DNA, 17 bp, Homo sapiens
tatttctggcctcagca

SEQ ID NO: 6424973 - DNA, 22 bp, Homo sapiens
tatttctggctttttgaattaa

SEQ ID NO: 6424974 - DNA, 11 bp, Homo sapiens
tatttctgtag

SEQ ID NO: 6424975 - DNA, 21 bp, Homo sapiens
tatttctgtatatagatgtct

SEQ ID NO: 6424976 - DNA, 19 bp, Homo sapiens
tatttctgtatatttgtca

SEQ ID NO: 6424977 - DNA, 23 bp, Homo sapiens
tatttctgtctcataattgtcaa

SEQ ID NO: 6424978 - DNA, 13 bp, Homo sapiens
tatttctgtgaaa

SEQ ID NO: 6424979 - DNA, 18 bp, Homo sapiens
tatttctgtgaaagaagt

SEQ ID NO: 6424980 - DNA, 20 bp, Homo sapiens
tatttctgtgaaagaagtat

SEQ ID NO: 6424981 - DNA, 22 bp, Homo sapiens
tatttctgtggagggttgccat

SEQ ID NO: 6424982 - DNA, 15 bp, Homo sapiens
tatttctgttatttt

SEQ ID NO: 6424983 - DNA, 13 bp, Homo sapiens
tatttctgttcct

SEQ ID NO: 6424984 - DNA, 14 bp, Homo sapiens
tatttctgttctta

SEQ ID NO: 6424985 - DNA, 17 bp, Homo sapiens
tatttctgtttgtttaa

SEQ ID NO: 6424986 - DNA, 10 bp, Homo sapiens
tatttcttaa

SEQ ID NO: 6424987 - DNA, 16 bp, Homo sapiens
tatttcttaaacactt

SEQ ID NO: 6424988 - DNA, 19 bp, Homo sapiens
tatttcttaaatctagtaa

SEQ ID NO: 6424989 - DNA, 20 bp, Homo sapiens
tatttcttaacctttgctat

SEQ ID NO: 6424990 - DNA, 18 bp, Homo sapiens
tatttcttatacgctttt

SEQ ID NO: 6424991 - DNA, 16 bp, Homo sapiens
tatttcttatatatgt

SEQ ID NO: 6424992 - DNA, 23 bp, Homo sapiens
tatttcttcaaatatctctattt

SEQ ID NO: 6424993 - DNA, 22 bp, Homo sapiens
tatttcttcaaatccttccaaa

SEQ ID NO: 6424994 - DNA, 17 bp, Homo sapiens
tatttcttccagtgatg

SEQ ID NO: 6424995 - DNA, 14 bp, Homo sapiens
tatttcttccctgc

SEQ ID NO: 6424996 - DNA, 14 bp, Homo sapiens
tatttcttgctttc

SEQ ID NO: 6424997 - DNA, 23 bp, Homo sapiens
tatttcttggcatgcatctttaa

SEQ ID NO: 6424998 - DNA, 20 bp, Homo sapiens
tatttcttgtggttataact

SEQ ID NO: 6424999 - DNA, 9 bp, Homo sapiens
tatttcttt

SEQ ID NO: 6425000 - DNA, 21 bp, Homo sapiens
tatttctttaatctgttgttt

SEQ ID NO: 6425001 - DNA, 14 bp, Homo sapiens
tatttctttagaac

SEQ ID NO: 6425002 - DNA, 21 bp, Homo sapiens
tatttctttcctttaaaaata

SEQ ID NO: 6425003 - DNA, 13 bp, Homo sapiens
tatttctttgtta

SEQ ID NO: 6425004 - DNA, 14 bp, Homo sapiens
tatttctttgttat

SEQ ID NO: 6425005 - DNA, 19 bp, Homo sapiens
tatttcttttatatataaa

SEQ ID NO: 6425006 - DNA, 20 bp, Homo sapiens
tatttcttttatatataaaa

SEQ ID NO: 6425007 - DNA, 21 bp, Homo sapiens
tatttcttttatatataaaat

SEQ ID NO: 6425008 - DNA, 16 bp, Homo sapiens
tatttcttttgttgta

SEQ ID NO: 6425009 - DNA, 16 bp, Homo sapiens
tatttgaaaaaaactt

SEQ ID NO: 6425010 - DNA, 14 bp, Homo sapiens
tatttgaaaaaatt

SEQ ID NO: 6425011 - DNA, 20 bp, Homo sapiens
tatttgaaaacactgctgtt

SEQ ID NO: 6425012 - DNA, 18 bp, Homo sapiens
tatttgaaaacagaaatt

SEQ ID NO: 6425013 - DNA, 20 bp, Homo sapiens
tatttgaaaacagaaattgg

SEQ ID NO: 6425014 - DNA, 21 bp, Homo sapiens
tatttgaaaaccatattttat

SEQ ID NO: 6425015 - DNA, 21 bp, Homo sapiens
tcgcttcttgcctctgtgctg

SEQ ID NO: 6425016 - DNA, 15 bp, Homo sapiens
tcgcttctttttcaa

SEQ ID NO: 6425017 - DNA, 15 bp, Homo sapiens
tcgcttgaacctggg

SEQ ID NO: 6425018 - DNA, 16 bp, Homo sapiens
tcgcttgccaaagcag

SEQ ID NO: 6425019 - DNA, 18 bp, Homo sapiens
tcgcttgctggaacacag

SEQ ID NO: 6425020 - DNA, 22 bp, Homo sapiens
tcgcttgctggaacacaggggc

SEQ ID NO: 6425021 - DNA, 13 bp, Homo sapiens
tcgcttgcttctg

SEQ ID NO: 6425022 - DNA, 12 bp, Homo sapiens
tcgcttgtaaat

SEQ ID NO: 6425023 - DNA, 17 bp, Homo sapiens
tcgcttgtaaataccag

SEQ ID NO: 6425024 - DNA, 20 bp, Homo sapiens
tcgcttgtgcagaaaacatt

SEQ ID NO: 6425025 - DNA, 16 bp, Homo sapiens
tcgcttgttttaaaag

SEQ ID NO: 6425026 - DNA, 16 bp, Homo sapiens
tcgcttgttttttccc

SEQ ID NO: 6425027 - DNA, 19 bp, Homo sapiens
tcgctttattggctgagat

SEQ ID NO: 6425028 - DNA, 19 bp, Homo sapiens
tcgctttctcagtgtgtgt

SEQ ID NO: 6425029 - DNA, 21 bp, Homo sapiens
tcgcttttaataaactgcaag

SEQ ID NO: 6425030 - DNA, 23 bp, Homo sapiens
tcgcttttattttaatattgatg

SEQ ID NO: 6425031 - DNA, 15 bp, Homo sapiens
tcgcttttgataatc

SEQ ID NO: 6425032 - DNA, 16 bp, Homo sapiens
tcgcttttggtgcctg

SEQ ID NO: 6425033 - DNA, 11 bp, Homo sapiens
tcggaaaaaaa

SEQ ID NO: 6425034 - DNA, 17 bp, Homo sapiens
tcggaaaaaaaaaaaga

SEQ ID NO: 6425035 - DNA, 18 bp, Homo sapiens
tcggaaaaaaaaaaagaa

SEQ ID NO: 6425036 - DNA, 21 bp, Homo sapiens
tcggaaaccttggtgtagttg

SEQ ID NO: 6425037 - DNA, 21 bp, Homo sapiens
tcggaaatacactacaaatgt

SEQ ID NO: 6425038 - DNA, 15 bp, Homo sapiens
tcggaaatcttaaac

SEQ ID NO: 6425039 - DNA, 14 bp, Homo sapiens
tcggaacagctcct

SEQ ID NO: 6425040 - DNA, 19 bp, Homo sapiens
tcggaacccaagcttagaa

SEQ ID NO: 6425041 - DNA, 20 bp, Homo sapiens
tcggaaccgctcacctagag

SEQ ID NO: 6425042 - DNA, 20 bp, Homo sapiens
tcggaacctgtgagctgcac

SEQ ID NO: 6425043 - DNA, 18 bp, Homo sapiens
tcggaactgcatgctgct

SEQ ID NO: 6425044 - DNA, 13 bp, Homo sapiens
tcggaagagcccg

SEQ ID NO: 6425045 - DNA, 13 bp, Homo sapiens
tcggaagcagtgc

SEQ ID NO: 6425046 - DNA, 15 bp, Homo sapiens
tcggaagcagtgcct

SEQ ID NO: 6425047 - DNA, 16 bp, Homo sapiens
tcggaagcagtgcctt

SEQ ID NO: 6425048 - DNA, 16 bp, Homo sapiens
tcggaagggaaaacag

SEQ ID NO: 6425049 - DNA, 15 bp, Homo sapiens
tcggaatccaagcta

SEQ ID NO: 6425050 - DNA, 18 bp, Homo sapiens
tcggaatggtaaccgagc

SEQ ID NO: 6425051 - DNA, 21 bp, Homo sapiens
tcggacaagacccccagcact

SEQ ID NO: 6425052 - DNA, 19 bp, Homo sapiens
tcggacaccatcttgggat

SEQ ID NO: 6425053 - DNA, 21 bp, Homo sapiens
tcggacagcccatctgcctgt

SEQ ID NO: 6425054 - DNA, 14 bp, Homo sapiens
tcggacatagagtt

SEQ ID NO: 6425055 - DNA, 10 bp, Homo sapiens
tcggaccagc

SEQ ID NO: 6425056 - DNA, 22 bp, Homo sapiens
tcggacccaccaaactgcacac

SEQ ID NO: 6425057 - DNA, 18 bp, Homo sapiens
tcggacccaccccaactc

SEQ ID NO: 6425058 - DNA, 23 bp, Homo sapiens
tcggacccaccccaactctcccc

SEQ ID NO: 6425059 - DNA, 17 bp, Homo sapiens
tcggacctttcagctgt

SEQ ID NO: 6425060 - DNA, 23 bp, Homo sapiens
tcggacggccaatggtgcttccc

SEQ ID NO: 6425061 - DNA, 13 bp, Homo sapiens
tcggacggggcag

SEQ ID NO: 6425062 - DNA, 15 bp, Homo sapiens
tcggactctgcccct

SEQ ID NO: 6425063 - DNA, 14 bp, Homo sapiens
tcggactgccaaat

SEQ ID NO: 6425064 - DNA, 20 bp, Homo sapiens
tcggactgcccccagaaagc

SEQ ID NO: 6425065 - DNA, 16 bp, Homo sapiens
tcggactttgcaggag

SEQ ID NO: 6425066 - DNA, 18 bp, Homo sapiens
tcggagaaattctcttta

SEQ ID NO: 6425067 - DNA, 17 bp, Homo sapiens
tcggagacgggaccctg

SEQ ID NO: 6425068 - DNA, 18 bp, Homo sapiens
tcggagactatggcctcg

SEQ ID NO: 6425069 - DNA, 22 bp, Homo sapiens
tcggagactatggcctcgcctc

SEQ ID NO: 6425070 - DNA, 18 bp, Homo sapiens
tcggagagggacatagaa

SEQ ID NO: 6425071 - DNA, 18 bp, Homo sapiens
tcggagcacccttgcccg

SEQ ID NO: 6425072 - DNA, 12 bp, Homo sapiens
tcggagccaaca

SEQ ID NO: 6425073 - DNA, 21 bp, Homo sapiens
tcggagccaatgaacagctcc

SEQ ID NO: 6425074 - DNA, 13 bp, Homo sapiens
tcggagcccccca

SEQ ID NO: 6425075 - DNA, 14 bp, Homo sapiens
tcggagccccccac

SEQ ID NO: 6425076 - DNA, 13 bp, Homo sapiens
tcggagctcctgt

SEQ ID NO: 6425077 - DNA, 12 bp, Homo sapiens
tcggagctgcct

SEQ ID NO: 6425078 - DNA, 14 bp, Homo sapiens
tcggagctgcctgc

SEQ ID NO: 6425079 - DNA, 17 bp, Homo sapiens
tcggagctgcctgcagc

SEQ ID NO: 6425080 - DNA, 16 bp, Homo sapiens
tcggagctggcccagg

SEQ ID NO: 6425081 - DNA, 14 bp, Homo sapiens
tcggagctggctgt

SEQ ID NO: 6425082 - DNA, 19 bp, Homo sapiens
tcggagctggctgtgcctg

SEQ ID NO: 6425083 - DNA, 21 bp, Homo sapiens
tcggaggaccctggaaaacag

SEQ ID NO: 6425084 - DNA, 15 bp, Homo sapiens
tcggaggccaggccc

SEQ ID NO: 6425085 - DNA, 17 bp, Homo sapiens
tcggaggcccatgccct

SEQ ID NO: 6425086 - DNA, 20 bp, Homo sapiens
tcggaggccccaaaggaaaa

SEQ ID NO: 6425087 - DNA, 13 bp, Homo sapiens
tcggaggccccac

SEQ ID NO: 6425088 - DNA, 18 bp, Homo sapiens
tcggaggccccactgatg

SEQ ID NO: 6425089 - DNA, 13 bp, Homo sapiens
tcggaggctcctc

SEQ ID NO: 6425090 - DNA, 22 bp, Homo sapiens
tcggaggctcctccctctgcct

SEQ ID NO: 6425091 - DNA, 15 bp, Homo sapiens
tcggaggctgggccc

SEQ ID NO: 6425092 - DNA, 18 bp, Homo sapiens
tcggaggctgggcccctg

SEQ ID NO: 6425093 - DNA, 22 bp, Homo sapiens
tcggagggaattgaggtctgct

SEQ ID NO: 6425094 - DNA, 18 bp, Homo sapiens
tcggagggccgcagggcc

SEQ ID NO: 6425095 - DNA, 19 bp, Homo sapiens
tcggagggccgcagggccc

SEQ ID NO: 6425096 - DNA, 12 bp, Homo sapiens
tcggagggctgg

SEQ ID NO: 6425097 - DNA, 13 bp, Homo sapiens
tcggagggctgga

SEQ ID NO: 6425098 - DNA, 23 bp, Homo sapiens
tcggaggtccagctgggcctcct

SEQ ID NO: 6425099 - DNA, 14 bp, Homo sapiens
tcggagtgaatgtg

SEQ ID NO: 6425100 - DNA, 14 bp, Homo sapiens
tcggagtgcctgga

SEQ ID NO: 6425101 - DNA, 15 bp, Homo sapiens
tcggagtgcctggag

SEQ ID NO: 6425102 - DNA, 19 bp, Homo sapiens
tcggagtgcctggagtcag

SEQ ID NO: 6425103 - DNA, 19 bp, Homo sapiens
tcggagtgtggcctggatc

SEQ ID NO: 6425104 - DNA, 18 bp, Homo sapiens
tcggatagttgctatttt

SEQ ID NO: 6425105 - DNA, 14 bp, Homo sapiens
tcggatcagctgag

SEQ ID NO: 6425106 - DNA, 13 bp, Homo sapiens
tcggatccccttc

SEQ ID NO: 6425107 - DNA, 15 bp, Homo sapiens
tcggatcctgtgagt

SEQ ID NO: 6425108 - DNA, 18 bp, Homo sapiens
tcggatctagccatggct

SEQ ID NO: 6425109 - DNA, 19 bp, Homo sapiens
tcggatctagccatggctg

SEQ ID NO: 6425110 - DNA, 18 bp, Homo sapiens
tcggatctcacaggctga

SEQ ID NO: 6425111 - DNA, 19 bp, Homo sapiens
tcggatgacaccctggcct

SEQ ID NO: 6425112 - DNA, 22 bp, Homo sapiens
tcggatttattcccttttaaag

SEQ ID NO: 6425113 - DNA, 13 bp, Homo sapiens
tcggattttttcc

SEQ ID NO: 6425114 - DNA, 19 bp, Homo sapiens
tcggcaacagggcttctct

SEQ ID NO: 6425115 - DNA, 22 bp, Homo sapiens
tcggcacacactgtgccccaca

SEQ ID NO: 6425116 - DNA, 21 bp, Homo sapiens
tcggcaccagtgcctcagtgc

SEQ ID NO: 6425117 - DNA, 17 bp, Homo sapiens
tcggcagaactctctgt

SEQ ID NO: 6425118 - DNA, 19 bp, Homo sapiens
tcggcagaactctctgtct

SEQ ID NO: 6425119 - DNA, 13 bp, Homo sapiens
tcggcagccttaa

SEQ ID NO: 6425120 - DNA, 13 bp, Homo sapiens
tcggcaggaagga

SEQ ID NO: 6425121 - DNA, 16 bp, Homo sapiens
tcggcaggaaggagcg

SEQ ID NO: 6425122 - DNA, 19 bp, Homo sapiens
tcggcaggaaggagcggcg

SEQ ID NO: 6425123 - DNA, 22 bp, Homo sapiens
tcggcaggagagtgtgtgggca

SEQ ID NO: 6425124 - DNA, 23 bp, Homo sapiens
tcggcaggagagtgtgtgggcag

SEQ ID NO: 6425125 - DNA, 21 bp, Homo sapiens
tcggcaggcatggctggtgcc

SEQ ID NO: 6425126 - DNA, 16 bp, Homo sapiens
tcggcagtattttctg

SEQ ID NO: 6425127 - DNA, 21 bp, Homo sapiens
tcggcagtgtgcagtggtgca

SEQ ID NO: 6425128 - DNA, 23 bp, Homo sapiens
tcggcatgccaggacccgccagc

SEQ ID NO: 6425129 - DNA, 20 bp, Homo sapiens
tcggcattcacacacagcct

SEQ ID NO: 6425130 - DNA, 23 bp, Homo sapiens
tcggcattcacacacagcctggc

SEQ ID NO: 6425131 - DNA, 20 bp, Homo sapiens
tcggccaaacagacaggtgg

SEQ ID NO: 6425132 - DNA, 17 bp, Homo sapiens
tcggccacaccccagac

SEQ ID NO: 6425133 - DNA, 18 bp, Homo sapiens
tcggccacaccccagact

SEQ ID NO: 6425134 - DNA, 15 bp, Homo sapiens
tcggccacaggcagg

SEQ ID NO: 6425135 - DNA, 13 bp, Homo sapiens
tcggccactgtgt

SEQ ID NO: 6425136 - DNA, 14 bp, Homo sapiens
tcggccactgtgtc

SEQ ID NO: 6425137 - DNA, 22 bp, Homo sapiens
tcggccactgtgtctctgtttc

SEQ ID NO: 6425138 - DNA, 16 bp, Homo sapiens
tcggccagagctccca

SEQ ID NO: 6425139 - DNA, 11 bp, Homo sapiens
tcggccagccc

SEQ ID NO: 6425140 - DNA, 16 bp, Homo sapiens
tcggcccacagctccc

SEQ ID NO: 6425141 - DNA, 14 bp, Homo sapiens
tcggcccagggccg

SEQ ID NO: 6425142 - DNA, 21 bp, Homo sapiens
tcggcccatctgtccatcctc

SEQ ID NO: 6425143 - DNA, 23 bp, Homo sapiens
tcggcccatctgtccatcctcct

SEQ ID NO: 6425144 - DNA, 24 bp, Homo sapiens
tcggccccacccaccctctggtcc

SEQ ID NO: 6425145 - DNA, 13 bp, Homo sapiens
tcggccccatcgc

SEQ ID NO: 6425146 - DNA, 18 bp, Homo sapiens
tcggccccctcaccccag

SEQ ID NO: 6425147 - DNA, 22 bp, Homo sapiens
tcggccccctcaccccagctcc

SEQ ID NO: 6425148 - DNA, 18 bp, Homo sapiens
tcggcccctcaccacctc

SEQ ID NO: 6425149 - DNA, 15 bp, Homo sapiens
tcggcccctgtctgt

SEQ ID NO: 6425150 - DNA, 16 bp, Homo sapiens
tcggcccgctgcagcc

SEQ ID NO: 6425151 - DNA, 19 bp, Homo sapiens
tcggcccgctgcagcctct

SEQ ID NO: 6425152 - DNA, 15 bp, Homo sapiens
tcggccctccctgcg

SEQ ID NO: 6425153 - DNA, 22 bp, Homo sapiens
tcggccctgaaccacgaggctg

SEQ ID NO: 6425154 - DNA, 13 bp, Homo sapiens
tcggccctgcgtc

SEQ ID NO: 6425155 - DNA, 18 bp, Homo sapiens
tcggccgagctggtttcc

SEQ ID NO: 6425156 - DNA, 12 bp, Homo sapiens
tcggccgcccgg

SEQ ID NO: 6425157 - DNA, 15 bp, Homo sapiens
tcggcctccatcctg

SEQ ID NO: 6425158 - DNA, 16 bp, Homo sapiens
tcggcctccatcctga

SEQ ID NO: 6425159 - DNA, 17 bp, Homo sapiens
tcggcctccatcctgag

SEQ ID NO: 6425160 - DNA, 12 bp, Homo sapiens
tcggcctcccaa

SEQ ID NO: 6425161 - DNA, 15 bp, Homo sapiens
tcggcctcccaaaat

SEQ ID NO: 6425162 - DNA, 22 bp, Homo sapiens
tcggcctcccaaagtgctggga

SEQ ID NO: 6425163 - DNA, 18 bp, Homo sapiens
tcggcctctaaccccagg

SEQ ID NO: 6425164 - DNA, 15 bp, Homo sapiens
tcggcctgcccccac

SEQ ID NO: 6425165 - DNA, 16 bp, Homo sapiens
tcggcctgcccccacc

SEQ ID NO: 6425166 - DNA, 17 bp, Homo sapiens
tcggcctggctggccag

SEQ ID NO: 6425167 - DNA, 13 bp, Homo sapiens
tcggcctgtgtcc

SEQ ID NO: 6425168 - DNA, 19 bp, Homo sapiens
tcggcgcccccacccctgg

SEQ ID NO: 6425169 - DNA, 22 bp, Homo sapiens
tcggcgtggcccaaggctggca

SEQ ID NO: 6425170 - DNA, 23 bp, Homo sapiens
tcggctacccctcgactcagcac

SEQ ID NO: 6425171 - DNA, 19 bp, Homo sapiens
tcggctcactgaaacctct

SEQ ID NO: 6425172 - DNA, 20 bp, Homo sapiens
tcggctcaggctctgctggt

SEQ ID NO: 6425173 - DNA, 19 bp, Homo sapiens
tcggctcccgcttgctctc

SEQ ID NO: 6425174 - DNA, 22 bp, Homo sapiens
tcggctcccgcttgctctcctg

SEQ ID NO: 6425175 - DNA, 14 bp, Homo sapiens
tcggctccctggag

SEQ ID NO: 6425176 - DNA, 23 bp, Homo sapiens
tcggctccgggcaaatggctgag

SEQ ID NO: 6425177 - DNA, 11 bp, Homo sapiens
tcggctcctgc

SEQ ID NO: 6425178 - DNA, 14 bp, Homo sapiens
tcggctcctgctgc

SEQ ID NO: 6425179 - DNA, 16 bp, Homo sapiens
tcggctcctgctgcac

SEQ ID NO: 6425180 - DNA, 12 bp, Homo sapiens
tcggctctggag

SEQ ID NO: 6425181 - DNA, 13 bp, Homo sapiens
tcggctctggagg

SEQ ID NO: 6425182 - DNA, 14 bp, Homo sapiens
tcggctctgggtgg

SEQ ID NO: 6425183 - DNA, 15 bp, Homo sapiens
tcggctgaccatgct

SEQ ID NO: 6425184 - DNA, 14 bp, Homo sapiens
tcggctgccagggg

SEQ ID NO: 6425185 - DNA, 16 bp, Homo sapiens
tcggctgccaggggct

SEQ ID NO: 6425186 - DNA, 15 bp, Homo sapiens
tcggctggaagaaca

SEQ ID NO: 6425187 - DNA, 17 bp, Homo sapiens
tcggctggaagaacatc

SEQ ID NO: 6425188 - DNA, 17 bp, Homo sapiens
tcggctggctcccctgc

SEQ ID NO: 6425189 - DNA, 18 bp, Homo sapiens
tcggctggctcccctgca

SEQ ID NO: 6425190 - DNA, 19 bp, Homo sapiens
tcggctggctcccctgcag

SEQ ID NO: 6425191 - DNA, 20 bp, Homo sapiens
tcggctggctcccctgcagc

SEQ ID NO: 6425192 - DNA, 17 bp, Homo sapiens
tcggctgggcagggccg

SEQ ID NO: 6425193 - DNA, 18 bp, Homo sapiens
tcggctggggactgctac

SEQ ID NO: 6425194 - DNA, 16 bp, Homo sapiens
tcggctgtctcctgtc

SEQ ID NO: 6425195 - DNA, 19 bp, Homo sapiens
tatttgaaactgaatgttt

SEQ ID NO: 6425196 - DNA, 20 bp, Homo sapiens
tatttgaaagtgcctttgca

SEQ ID NO: 6425197 - DNA, 16 bp, Homo sapiens
tatttgaaatactaaa

SEQ ID NO: 6425198 - DNA, 22 bp, Homo sapiens
tatttgaaatactaaaagcaaa

SEQ ID NO: 6425199 - DNA, 23 bp, Homo sapiens
tatttgaaatactaaaagcaaat

SEQ ID NO: 6425200 - DNA, 22 bp, Homo sapiens
tatttgaaatagattttttcat

SEQ ID NO: 6425201 - DNA, 14 bp, Homo sapiens
tatttgaaatagta

SEQ ID NO: 6425202 - DNA, 15 bp, Homo sapiens
tatttgaaatagtat

SEQ ID NO: 6425203 - DNA, 20 bp, Homo sapiens
tatttgaaatagtatacatt

SEQ ID NO: 6425204 - DNA, 12 bp, Homo sapiens
tatttgaaattt

SEQ ID NO: 6425205 - DNA, 22 bp, Homo sapiens
tatttgaaattttatttagttc

SEQ ID NO: 6425206 - DNA, 23 bp, Homo sapiens
tatttgaacatgtgccttttctg

SEQ ID NO: 6425207 - DNA, 21 bp, Homo sapiens
tatttgaagaaaaaaatgtac

SEQ ID NO: 6425208 - DNA, 16 bp, Homo sapiens
tatttgaagatttaat

SEQ ID NO: 6425209 - DNA, 17 bp, Homo sapiens
tatttgaagatttaatt

SEQ ID NO: 6425210 - DNA, 13 bp, Homo sapiens
tatttgaagcagc

SEQ ID NO: 6425211 - DNA, 20 bp, Homo sapiens
tatttgaagcagctctgcct

SEQ ID NO: 6425212 - DNA, 21 bp, Homo sapiens
tatttgaagcagctctgcctt

SEQ ID NO: 6425213 - DNA, 22 bp, Homo sapiens
tatttgaagcatgctctgtaag

SEQ ID NO: 6425214 - DNA, 19 bp, Homo sapiens
tatttgaagcgagtcattt

SEQ ID NO: 6425215 - DNA, 19 bp, Homo sapiens
tatttgaaggttttaagtg

SEQ ID NO: 6425216 - DNA, 15 bp, Homo sapiens
tatttgaataaatta

SEQ ID NO: 6425217 - DNA, 17 bp, Homo sapiens
tatttgaatatccattc

SEQ ID NO: 6425218 - DNA, 14 bp, Homo sapiens
tatttgaatcttgt

SEQ ID NO: 6425219 - DNA, 18 bp, Homo sapiens
tatttgaatcttgtctca

SEQ ID NO: 6425220 - DNA, 14 bp, Homo sapiens
tatttgaatgaaaa

SEQ ID NO: 6425221 - DNA, 18 bp, Homo sapiens
tatttgaatgaaaacatt

SEQ ID NO: 6425222 - DNA, 13 bp, Homo sapiens
tatttgaatgact

SEQ ID NO: 6425223 - DNA, 23 bp, Homo sapiens
tatttgaatgtatgcttcataca

SEQ ID NO: 6425224 - DNA, 12 bp, Homo sapiens
tatttgaatttt

SEQ ID NO: 6425225 - DNA, 21 bp, Homo sapiens
tatttgaattttaaatctaaa

SEQ ID NO: 6425226 - DNA, 13 bp, Homo sapiens
tatttgactcttt

SEQ ID NO: 6425227 - DNA, 18 bp, Homo sapiens
tatttgactctttcaaag

SEQ ID NO: 6425228 - DNA, 22 bp, Homo sapiens
tatttgactgcttcacggactc

SEQ ID NO: 6425229 - DNA, 20 bp, Homo sapiens
tatttgactttaatttatgt

SEQ ID NO: 6425230 - DNA, 19 bp, Homo sapiens
tatttgagaaaatataata

SEQ ID NO: 6425231 - DNA, 22 bp, Homo sapiens
tatttgagaaaatataataaaa

SEQ ID NO: 6425232 - DNA, 22 bp, Homo sapiens
tatttgagacggggtctccctg

SEQ ID NO: 6425233 - DNA, 16 bp, Homo sapiens
tatttgagactagttt

SEQ ID NO: 6425234 - DNA, 13 bp, Homo sapiens
tatttgagagact

SEQ ID NO: 6425235 - DNA, 22 bp, Homo sapiens
tatttgaggagataacatttca

SEQ ID NO: 6425236 - DNA, 19 bp, Homo sapiens
tatttgaggggtttcagaa

SEQ ID NO: 6425237 - DNA, 16 bp, Homo sapiens
tatttgaggtcagtgt

SEQ ID NO: 6425238 - DNA, 16 bp, Homo sapiens
tatttgagtcacttgt

SEQ ID NO: 6425239 - DNA, 19 bp, Homo sapiens
tatttgagttggccaagaa

SEQ ID NO: 6425240 - DNA, 18 bp, Homo sapiens
tatttgagttgtgattga

SEQ ID NO: 6425241 - DNA, 20 bp, Homo sapiens
tatttgagttgtgattgaaa

SEQ ID NO: 6425242 - DNA, 13 bp, Homo sapiens
tatttgagtttct

SEQ ID NO: 6425243 - DNA, 18 bp, Homo sapiens
tatttgataacattttgt

SEQ ID NO: 6425244 - DNA, 14 bp, Homo sapiens
tatttgatacatat

SEQ ID NO: 6425245 - DNA, 16 bp, Homo sapiens
tatttgatacatataa

SEQ ID NO: 6425246 - DNA, 23 bp, Homo sapiens
tatttgatagatttttcttaaca

SEQ ID NO: 6425247 - DNA, 14 bp, Homo sapiens
tatttgatgtaata

SEQ ID NO: 6425248 - DNA, 13 bp, Homo sapiens
tatttgatttata

SEQ ID NO: 6425249 - DNA, 16 bp, Homo sapiens
tatttgatttattaac

SEQ ID NO: 6425250 - DNA, 18 bp, Homo sapiens
tatttgatttctaattgt

SEQ ID NO: 6425251 - DNA, 12 bp, Homo sapiens
tatttgcaaatc

SEQ ID NO: 6425252 - DNA, 18 bp, Homo sapiens
tatttgcaaggctgattt

SEQ ID NO: 6425253 - DNA, 21 bp, Homo sapiens
tatttgcaaggctgatttatg

SEQ ID NO: 6425254 - DNA, 15 bp, Homo sapiens
tatttgcacttatgt

SEQ ID NO: 6425255 - DNA, 18 bp, Homo sapiens
tatttgcacttatgtact

SEQ ID NO: 6425256 - DNA, 16 bp, Homo sapiens
tatttgcagactagaa

SEQ ID NO: 6425257 - DNA, 13 bp, Homo sapiens
tatttgcagaggc

SEQ ID NO: 6425258 - DNA, 16 bp, Homo sapiens
tatttgcagtatgaac

SEQ ID NO: 6425259 - DNA, 22 bp, Homo sapiens
tatttgcagtgcagtatagaat

SEQ ID NO: 6425260 - DNA, 21 bp, Homo sapiens
tatttgcataacaattcctct

SEQ ID NO: 6425261 - DNA, 22 bp, Homo sapiens
tatttgcataacaattcctcta

SEQ ID NO: 6425262 - DNA, 20 bp, Homo sapiens
tatttgcatatttttctaaa

SEQ ID NO: 6425263 - DNA, 11 bp, Homo sapiens
tatttgcatgt

SEQ ID NO: 6425264 - DNA, 16 bp, Homo sapiens
tatttgcatgttacct

SEQ ID NO: 6425265 - DNA, 16 bp, Homo sapiens
tatttgcatgttatgt

SEQ ID NO: 6425266 - DNA, 16 bp, Homo sapiens
tatttgcattatgtat

SEQ ID NO: 6425267 - DNA, 23 bp, Homo sapiens
tatttgccagagccaaattttat

SEQ ID NO: 6425268 - DNA, 16 bp, Homo sapiens
tatttgccatgggctt

SEQ ID NO: 6425269 - DNA, 13 bp, Homo sapiens
tatttgccattca

SEQ ID NO: 6425270 - DNA, 20 bp, Homo sapiens
tatttgcctccatgtagaac

SEQ ID NO: 6425271 - DNA, 18 bp, Homo sapiens
tatttgcgtaaatggttt

SEQ ID NO: 6425272 - DNA, 15 bp, Homo sapiens
tatttgctaagcata

SEQ ID NO: 6425273 - DNA, 21 bp, Homo sapiens
tatttgctaatcaaagccagg

SEQ ID NO: 6425274 - DNA, 20 bp, Homo sapiens
tatttgctcataagtaaatg

SEQ ID NO: 6425275 - DNA, 21 bp, Homo sapiens
tatttgctcataagtaaatgt

SEQ ID NO: 6425276 - DNA, 23 bp, Homo sapiens
tatttgctcataagtaaatgtct

SEQ ID NO: 6425277 - DNA, 14 bp, Homo sapiens
tatttgctgcaaag

SEQ ID NO: 6425278 - DNA, 15 bp, Homo sapiens
tatttgctgttaact

SEQ ID NO: 6425279 - DNA, 21 bp, Homo sapiens
tatttgctttagagacaggga

SEQ ID NO: 6425280 - DNA, 15 bp, Homo sapiens
tatttgctttttgct

SEQ ID NO: 6425281 - DNA, 15 bp, Homo sapiens
tatttggaaaatgtt

SEQ ID NO: 6425282 - DNA, 12 bp, Homo sapiens
tatttggaaaga

SEQ ID NO: 6425283 - DNA, 21 bp, Homo sapiens
tatttggaagaaaaaaatctt

SEQ ID NO: 6425284 - DNA, 22 bp, Homo sapiens
tatttggaagcaacgtgttaat

SEQ ID NO: 6425285 - DNA, 18 bp, Homo sapiens
tatttggaatatttgaat

SEQ ID NO: 6425286 - DNA, 11 bp, Homo sapiens
tatttggaatt

SEQ ID NO: 6425287 - DNA, 14 bp, Homo sapiens
tatttggaattaga

SEQ ID NO: 6425288 - DNA, 16 bp, Homo sapiens
tatttggaattagaac

SEQ ID NO: 6425289 - DNA, 19 bp, Homo sapiens
tatttggaattgacattct

SEQ ID NO: 6425290 - DNA, 16 bp, Homo sapiens
tatttggagtggaggc

SEQ ID NO: 6425291 - DNA, 19 bp, Homo sapiens
tatttggagtggaggcatt

SEQ ID NO: 6425292 - DNA, 23 bp, Homo sapiens
tatttggagtggaggcattgttt

SEQ ID NO: 6425293 - DNA, 14 bp, Homo sapiens
tatttggatatctg

SEQ ID NO: 6425294 - DNA, 16 bp, Homo sapiens
tatttggatgcagagt

SEQ ID NO: 6425295 - DNA, 19 bp, Homo sapiens
tatttggatgcagagttca

SEQ ID NO: 6425296 - DNA, 20 bp, Homo sapiens
tatttggatgcagagttcag

SEQ ID NO: 6425297 - DNA, 21 bp, Homo sapiens
tatttggcagtttggtatttg

SEQ ID NO: 6425298 - DNA, 20 bp, Homo sapiens
tatttggctgggctacaatt

SEQ ID NO: 6425299 - DNA, 19 bp, Homo sapiens
tatttggcttaaatatagt

SEQ ID NO: 6425300 - DNA, 16 bp, Homo sapiens
tatttgggaaacttgt

SEQ ID NO: 6425301 - DNA, 14 bp, Homo sapiens
tatttgggaagtga

SEQ ID NO: 6425302 - DNA, 15 bp, Homo sapiens
tatttgggaagtgaa

SEQ ID NO: 6425303 - DNA, 20 bp, Homo sapiens
tatttgggggaactggacac

SEQ ID NO: 6425304 - DNA, 21 bp, Homo sapiens
tatttggtgggagttatatca

SEQ ID NO: 6425305 - DNA, 22 bp, Homo sapiens
tatttggtgggagttatatcag

SEQ ID NO: 6425306 - DNA, 15 bp, Homo sapiens
tatttggtgtgttcg

SEQ ID NO: 6425307 - DNA, 14 bp, Homo sapiens
tatttgtaaaatga

SEQ ID NO: 6425308 - DNA, 15 bp, Homo sapiens
tatttgtaaaatgac

SEQ ID NO: 6425309 - DNA, 14 bp, Homo sapiens
tatttgtaaagcta

SEQ ID NO: 6425310 - DNA, 15 bp, Homo sapiens
tatttgtaaagtgat

SEQ ID NO: 6425311 - DNA, 13 bp, Homo sapiens
tatttgtaaatct

SEQ ID NO: 6425312 - DNA, 18 bp, Homo sapiens
tatttgtaacattgtaaa

SEQ ID NO: 6425313 - DNA, 15 bp, Homo sapiens
tatttgtaatagatg

SEQ ID NO: 6425314 - DNA, 14 bp, Homo sapiens
tatttgtacaaata

SEQ ID NO: 6425315 - DNA, 19 bp, Homo sapiens
tatttgtacaaataaacct

SEQ ID NO: 6425316 - DNA, 15 bp, Homo sapiens
tatttgtactttctg

SEQ ID NO: 6425317 - DNA, 17 bp, Homo sapiens
tatttgtactttctgtt

SEQ ID NO: 6425318 - DNA, 20 bp, Homo sapiens
tatttgtactttctgttaaa

SEQ ID NO: 6425319 - DNA, 16 bp, Homo sapiens
tatttgtactttgttt

SEQ ID NO: 6425320 - DNA, 21 bp, Homo sapiens
tatttgtagccaaagaaattt

SEQ ID NO: 6425321 - DNA, 21 bp, Homo sapiens
tatttgtagctagaatatcct

SEQ ID NO: 6425322 - DNA, 18 bp, Homo sapiens
tatttgtaggtatactat

SEQ ID NO: 6425323 - DNA, 21 bp, Homo sapiens
tatttgtataaaaattaagct

SEQ ID NO: 6425324 - DNA, 15 bp, Homo sapiens
tatttgtataaatta

SEQ ID NO: 6425325 - DNA, 17 bp, Homo sapiens
tatttgtatagttgctt

SEQ ID NO: 6425326 - DNA, 14 bp, Homo sapiens
tatttgtatgatat

SEQ ID NO: 6425327 - DNA, 13 bp, Homo sapiens
tatttgtattaat

SEQ ID NO: 6425328 - DNA, 22 bp, Homo sapiens
tatttgtattaataaagcattc

SEQ ID NO: 6425329 - DNA, 19 bp, Homo sapiens
tatttgtatttatttccag

SEQ ID NO: 6425330 - DNA, 10 bp, Homo sapiens
tatttgtcaa

SEQ ID NO: 6425331 - DNA, 20 bp, Homo sapiens
tatttgtcagtgtagatcaa

SEQ ID NO: 6425332 - DNA, 14 bp, Homo sapiens
tatttgtcatgaca

SEQ ID NO: 6425333 - DNA, 15 bp, Homo sapiens
tatttgtcattcctc

SEQ ID NO: 6425334 - DNA, 19 bp, Homo sapiens
tatttgtcattcctctcct

SEQ ID NO: 6425335 - DNA, 15 bp, Homo sapiens
tatttgtccttattg

SEQ ID NO: 6425336 - DNA, 17 bp, Homo sapiens
tatttgtcgtgttggaa

SEQ ID NO: 6425337 - DNA, 14 bp, Homo sapiens
tatttgtctcagat

SEQ ID NO: 6425338 - DNA, 14 bp, Homo sapiens
tatttgtctgtgtg

SEQ ID NO: 6425339 - DNA, 17 bp, Homo sapiens
tatttgtctgtgtgcta

SEQ ID NO: 6425340 - DNA, 19 bp, Homo sapiens
tatttgtctgtgtgctact

SEQ ID NO: 6425341 - DNA, 18 bp, Homo sapiens
tatttgtcttaaaaaatg

SEQ ID NO: 6425342 - DNA, 21 bp, Homo sapiens
tatttgtcttaaaaaatgtga

SEQ ID NO: 6425343 - DNA, 16 bp, Homo sapiens
tatttgtcttccgatc

SEQ ID NO: 6425344 - DNA, 22 bp, Homo sapiens
tatttgtcttccgatcaacatt

SEQ ID NO: 6425345 - DNA, 21 bp, Homo sapiens
tatttgtcttctccttcaaaa

SEQ ID NO: 6425346 - DNA, 12 bp, Homo sapiens
tatttgtgacta

SEQ ID NO: 6425347 - DNA, 21 bp, Homo sapiens
tatttgtgactaattgtataa

SEQ ID NO: 6425348 - DNA, 15 bp, Homo sapiens
tatttgtgcatttta

SEQ ID NO: 6425349 - DNA, 16 bp, Homo sapiens
tatttgtgctatttaa

SEQ ID NO: 6425350 - DNA, 16 bp, Homo sapiens
tatttgtgctttgaaa

SEQ ID NO: 6425351 - DNA, 18 bp, Homo sapiens
tatttgtgctttgaaaaa

SEQ ID NO: 6425352 - DNA, 18 bp, Homo sapiens
tatttgtggcccgtgcag

SEQ ID NO: 6425353 - DNA, 16 bp, Homo sapiens
tatttgtgtatgtgta

SEQ ID NO: 6425354 - DNA, 12 bp, Homo sapiens
tatttgtgtgct

SEQ ID NO: 6425355 - DNA, 15 bp, Homo sapiens
tatttgtgtgctaaa

SEQ ID NO: 6425356 - DNA, 18 bp, Homo sapiens
tatttgtgtgctaaacgt

SEQ ID NO: 6425357 - DNA, 22 bp, Homo sapiens
tatttgtgtgttcactaaactc

SEQ ID NO: 6425358 - DNA, 15 bp, Homo sapiens
tatttgtgttcagtt

SEQ ID NO: 6425359 - DNA, 12 bp, Homo sapiens
tatttgtgtttt

SEQ ID NO: 6425360 - DNA, 20 bp, Homo sapiens
tatttgttaatggtttgaat

SEQ ID NO: 6425361 - DNA, 17 bp, Homo sapiens
tatttgttatatataat

SEQ ID NO: 6425362 - DNA, 21 bp, Homo sapiens
tatttgttatgataaaaggaa

SEQ ID NO: 6425363 - DNA, 14 bp, Homo sapiens
tatttgttcagaga

SEQ ID NO: 6425364 - DNA, 15 bp, Homo sapiens
tatttgttcatgttt

SEQ ID NO: 6425365 - DNA, 16 bp, Homo sapiens
tatttgttcttcaaga

SEQ ID NO: 6425366 - DNA, 15 bp, Homo sapiens
tatttgtttggtcac

SEQ ID NO: 6425367 - DNA, 18 bp, Homo sapiens
tatttgtttgtagctttc

SEQ ID NO: 6425368 - DNA, 21 bp, Homo sapiens
tatttgtttttattgtaaaac

SEQ ID NO: 6425369 - DNA, 16 bp, Homo sapiens
tattttaaaaaatata

SEQ ID NO: 6425370 - DNA, 16 bp, Homo sapiens
tattttaaaaaatcaa

SEQ ID NO: 6425371 - DNA, 19 bp, Homo sapiens
tattttaaaaaatgaaaat

SEQ ID NO: 6425372 - DNA, 14 bp, Homo sapiens
tattttaaaatata

SEQ ID NO: 6425373 - DNA, 14 bp, Homo sapiens
tattttaaaatatt

SEQ ID NO: 6425374 - DNA, 20 bp, Homo sapiens
tcggcttcttggaccttggc

SEQ ID NO: 6425375 - DNA, 19 bp, Homo sapiens
tcggcttggatcctgggct

SEQ ID NO: 6425376 - DNA, 17 bp, Homo sapiens
tcggcttgtgggctggt

SEQ ID NO: 6425377 - DNA, 19 bp, Homo sapiens
tcggctttgggcttttatt

SEQ ID NO: 6425378 - DNA, 23 bp, Homo sapiens
tcgggaaaaaactttgctccagg

SEQ ID NO: 6425379 - DNA, 13 bp, Homo sapiens
tcgggaaacctcc

SEQ ID NO: 6425380 - DNA, 14 bp, Homo sapiens
tcgggaaagaagaa

SEQ ID NO: 6425381 - DNA, 17 bp, Homo sapiens
tcgggaaattctgctgc

SEQ ID NO: 6425382 - DNA, 14 bp, Homo sapiens
tcgggaacagtgtt

SEQ ID NO: 6425383 - DNA, 15 bp, Homo sapiens
tcgggaacctcactc

SEQ ID NO: 6425384 - DNA, 23 bp, Homo sapiens
tcgggaagaaggacttcctgcta

SEQ ID NO: 6425385 - DNA, 12 bp, Homo sapiens
tcgggaagagag

SEQ ID NO: 6425386 - DNA, 23 bp, Homo sapiens
tcgggaagagaggagttcaatga

SEQ ID NO: 6425387 - DNA, 12 bp, Homo sapiens
tcgggaagcaga

SEQ ID NO: 6425388 - DNA, 16 bp, Homo sapiens
tcgggaaggatgggaa

SEQ ID NO: 6425389 - DNA, 15 bp, Homo sapiens
tcgggaagggagggg

SEQ ID NO: 6425390 - DNA, 16 bp, Homo sapiens
tcgggaagggagggga

SEQ ID NO: 6425391 - DNA, 20 bp, Homo sapiens
tcgggacacctgccctgccc

SEQ ID NO: 6425392 - DNA, 14 bp, Homo sapiens
tcgggacagctgtg

SEQ ID NO: 6425393 - DNA, 22 bp, Homo sapiens
tcgggacatggttgggggaatg

SEQ ID NO: 6425394 - DNA, 16 bp, Homo sapiens
tcgggaccaatatata

SEQ ID NO: 6425395 - DNA, 16 bp, Homo sapiens
tcgggaccacatctgt

SEQ ID NO: 6425396 - DNA, 11 bp, Homo sapiens
tcgggaccagg

SEQ ID NO: 6425397 - DNA, 16 bp, Homo sapiens
tcgggaccctcccagt

SEQ ID NO: 6425398 - DNA, 19 bp, Homo sapiens
tcgggacctcccaggacaa

SEQ ID NO: 6425399 - DNA, 10 bp, Homo sapiens
tcgggactag

SEQ ID NO: 6425400 - DNA, 21 bp, Homo sapiens
tcgggactcagattggaatgt

SEQ ID NO: 6425401 - DNA, 16 bp, Homo sapiens
tcgggagacagcatca

SEQ ID NO: 6425402 - DNA, 17 bp, Homo sapiens
tcgggagcacccagagc

SEQ ID NO: 6425403 - DNA, 19 bp, Homo sapiens
tcgggagcagtgtcttcca

SEQ ID NO: 6425404 - DNA, 19 bp, Homo sapiens
tcgggagccctagccctgc

SEQ ID NO: 6425405 - DNA, 18 bp, Homo sapiens
tcgggagccttgtcagtg

SEQ ID NO: 6425406 - DNA, 20 bp, Homo sapiens
tcgggagccttgtcagtgtg

SEQ ID NO: 6425407 - DNA, 21 bp, Homo sapiens
tcgggagccttgtcagtgtgt

SEQ ID NO: 6425408 - DNA, 21 bp, Homo sapiens
tcgggagctgcacacacctgg

SEQ ID NO: 6425409 - DNA, 13 bp, Homo sapiens
tcgggaggagcag

SEQ ID NO: 6425410 - DNA, 14 bp, Homo sapiens
tcgggaggctgagg

SEQ ID NO: 6425411 - DNA, 19 bp, Homo sapiens
tcgggaggctgaggcagga

SEQ ID NO: 6425412 - DNA, 18 bp, Homo sapiens
tcgggataacaaaatcac

SEQ ID NO: 6425413 - DNA, 21 bp, Homo sapiens
tcgggatgccgttctgttcca

SEQ ID NO: 6425414 - DNA, 15 bp, Homo sapiens
tcgggatgtcagcag

SEQ ID NO: 6425415 - DNA, 18 bp, Homo sapiens
tcgggattacagaaacac

SEQ ID NO: 6425416 - DNA, 16 bp, Homo sapiens
tcgggcaccagccagc

SEQ ID NO: 6425417 - DNA, 21 bp, Homo sapiens
tcgggcagtggaggctgctgt

SEQ ID NO: 6425418 - DNA, 23 bp, Homo sapiens
tcgggcagtggaggctgctgtga

SEQ ID NO: 6425419 - DNA, 11 bp, Homo sapiens
tcgggcatgac

SEQ ID NO: 6425420 - DNA, 23 bp, Homo sapiens
tcgggcatgagtctgtttcccaa

SEQ ID NO: 6425421 - DNA, 11 bp, Homo sapiens
tcgggcccagc

SEQ ID NO: 6425422 - DNA, 15 bp, Homo sapiens
tcgggccccacctgc

SEQ ID NO: 6425423 - DNA, 17 bp, Homo sapiens
tcgggccccacctgcag

SEQ ID NO: 6425424 - DNA, 22 bp, Homo sapiens
tcgggccccatcctcatccctg

SEQ ID NO: 6425425 - DNA, 14 bp, Homo sapiens
tcgggcccctgagc

SEQ ID NO: 6425426 - DNA, 17 bp, Homo sapiens
tcgggcccctgcctgcc

SEQ ID NO: 6425427 - DNA, 12 bp, Homo sapiens
tcgggcccgcac

SEQ ID NO: 6425428 - DNA, 18 bp, Homo sapiens
tcgggccctctctccgcc

SEQ ID NO: 6425429 - DNA, 23 bp, Homo sapiens
tcgggccctctctccgccccgga

SEQ ID NO: 6425430 - DNA, 20 bp, Homo sapiens
tcgggcccttcttgctgccc

SEQ ID NO: 6425431 - DNA, 19 bp, Homo sapiens
tcgggccgcctcctccaga

SEQ ID NO: 6425432 - DNA, 20 bp, Homo sapiens
tcgggccgcctcctccagac

SEQ ID NO: 6425433 - DNA, 21 bp, Homo sapiens
tcgggccgtaggggctcctga

SEQ ID NO: 6425434 - DNA, 21 bp, Homo sapiens
tcgggcgcctgcgctcctctg

SEQ ID NO: 6425435 - DNA, 19 bp, Homo sapiens
tcgggcgctgtggctcctg

SEQ ID NO: 6425436 - DNA, 22 bp, Homo sapiens
tcgggcgctgtggctcctgcct

SEQ ID NO: 6425437 - DNA, 20 bp, Homo sapiens
tcgggctaagtccagctctc

SEQ ID NO: 6425438 - DNA, 15 bp, Homo sapiens
tcgggctcacgtcgc

SEQ ID NO: 6425439 - DNA, 17 bp, Homo sapiens
tcgggctcagctctggc

SEQ ID NO: 6425440 - DNA, 15 bp, Homo sapiens
tcgggctcctgtgcc

SEQ ID NO: 6425441 - DNA, 21 bp, Homo sapiens
tcgggctctctcacccagcct

SEQ ID NO: 6425442 - DNA, 22 bp, Homo sapiens
tcgggctctctcacccagcctg

SEQ ID NO: 6425443 - DNA, 12 bp, Homo sapiens
tcgggctgccag

SEQ ID NO: 6425444 - DNA, 19 bp, Homo sapiens
tcgggctgccagcccagct

SEQ ID NO: 6425445 - DNA, 21 bp, Homo sapiens
tcgggctgccagcccagctgg

SEQ ID NO: 6425446 - DNA, 18 bp, Homo sapiens
tcgggcttccctggcctc

SEQ ID NO: 6425447 - DNA, 16 bp, Homo sapiens
tcggggaactcctgga

SEQ ID NO: 6425448 - DNA, 22 bp, Homo sapiens
tcggggaataaaacatttctct

SEQ ID NO: 6425449 - DNA, 15 bp, Homo sapiens
tcggggacaggtgac

SEQ ID NO: 6425450 - DNA, 21 bp, Homo sapiens
tcggggacaggtgacagtggc

SEQ ID NO: 6425451 - DNA, 19 bp, Homo sapiens
tcggggaccagcccacagc

SEQ ID NO: 6425452 - DNA, 17 bp, Homo sapiens
tcggggatgtgtcctga

SEQ ID NO: 6425453 - DNA, 17 bp, Homo sapiens
tcggggccatttggccg

SEQ ID NO: 6425454 - DNA, 18 bp, Homo sapiens
tcggggccatttggccgg

SEQ ID NO: 6425455 - DNA, 17 bp, Homo sapiens
tcggggcccttggggcc

SEQ ID NO: 6425456 - DNA, 20 bp, Homo sapiens
tcggggcccttggggcctgg

SEQ ID NO: 6425457 - DNA, 22 bp, Homo sapiens
tcggggcccttggggcctggct

SEQ ID NO: 6425458 - DNA, 12 bp, Homo sapiens
tcggggcctgct

SEQ ID NO: 6425459 - DNA, 20 bp, Homo sapiens
tcggggcgacccctcagtgc

SEQ ID NO: 6425460 - DNA, 22 bp, Homo sapiens
tcggggcgatgctccctcagcc

SEQ ID NO: 6425461 - DNA, 14 bp, Homo sapiens
tcggggctccaggc

SEQ ID NO: 6425462 - DNA, 14 bp, Homo sapiens
tcggggctgggggc

SEQ ID NO: 6425463 - DNA, 18 bp, Homo sapiens
tcggggcttctgcggggc

SEQ ID NO: 6425464 - DNA, 17 bp, Homo sapiens
tcggggcttgccccact

SEQ ID NO: 6425465 - DNA, 15 bp, Homo sapiens
tcgggggagcagaga

SEQ ID NO: 6425466 - DNA, 18 bp, Homo sapiens
tcgggggagcagagagag

SEQ ID NO: 6425467 - DNA, 19 bp, Homo sapiens
tcgggggaggagcaccccc

SEQ ID NO: 6425468 - DNA, 22 bp, Homo sapiens
tcgggggaggagcacccccagc

SEQ ID NO: 6425469 - DNA, 23 bp, Homo sapiens
tcgggggaggagcacccccagcc

SEQ ID NO: 6425470 - DNA, 22 bp, Homo sapiens
tcgggggcccaagtggggtgct

SEQ ID NO: 6425471 - DNA, 12 bp, Homo sapiens
tcgggggcctgc

SEQ ID NO: 6425472 - DNA, 13 bp, Homo sapiens
tcgggggcctgca

SEQ ID NO: 6425473 - DNA, 14 bp, Homo sapiens
tcgggggcgcctgg

SEQ ID NO: 6425474 - DNA, 16 bp, Homo sapiens
tcgggggcggctctgg

SEQ ID NO: 6425475 - DNA, 17 bp, Homo sapiens
tcgggggcggctctggg

SEQ ID NO: 6425476 - DNA, 14 bp, Homo sapiens
tcgggggctggggc

SEQ ID NO: 6425477 - DNA, 16 bp, Homo sapiens
tcggggggacagctcc

SEQ ID NO: 6425478 - DNA, 19 bp, Homo sapiens
tcggggggcgagggagggg

SEQ ID NO: 6425479 - DNA, 16 bp, Homo sapiens
tcggggggctctgcct

SEQ ID NO: 6425480 - DNA, 19 bp, Homo sapiens
tcgggggggaccctccaag

SEQ ID NO: 6425481 - DNA, 18 bp, Homo sapiens
tcggggggtcacaggccc

SEQ ID NO: 6425482 - DNA, 21 bp, Homo sapiens
tcggggggtcacaggcccaga

SEQ ID NO: 6425483 - DNA, 21 bp, Homo sapiens
tcgggggtgctggggccaggg

SEQ ID NO: 6425484 - DNA, 16 bp, Homo sapiens
tcgggggtggcaaggg

SEQ ID NO: 6425485 - DNA, 20 bp, Homo sapiens
tcggggtaaaaagtggctgc

SEQ ID NO: 6425486 - DNA, 14 bp, Homo sapiens
tcggggtgcacagg

SEQ ID NO: 6425487 - DNA, 12 bp, Homo sapiens
tcggggtggggg

SEQ ID NO: 6425488 - DNA, 15 bp, Homo sapiens
tcgggtgccaggaca

SEQ ID NO: 6425489 - DNA, 13 bp, Homo sapiens
tcgggtggggctg

SEQ ID NO: 6425490 - DNA, 15 bp, Homo sapiens
tcgggtggggctggt

SEQ ID NO: 6425491 - DNA, 18 bp, Homo sapiens
tcgggtggggctggtggg

SEQ ID NO: 6425492 - DNA, 19 bp, Homo sapiens
tcgggtggggctggtgggt

SEQ ID NO: 6425493 - DNA, 18 bp, Homo sapiens
tcgggtttctctgtggct

SEQ ID NO: 6425494 - DNA, 21 bp, Homo sapiens
tcggtaaaccgaggacccatg

SEQ ID NO: 6425495 - DNA, 23 bp, Homo sapiens
tcggtaaaccgaggacccatgaa

SEQ ID NO: 6425496 - DNA, 21 bp, Homo sapiens
tcggtaagttgaatggcctgc

SEQ ID NO: 6425497 - DNA, 15 bp, Homo sapiens
tcggtacccaccaca

SEQ ID NO: 6425498 - DNA, 16 bp, Homo sapiens
tcggtaggttcagcca

SEQ ID NO: 6425499 - DNA, 20 bp, Homo sapiens
tcggtatccccccatcttgc

SEQ ID NO: 6425500 - DNA, 13 bp, Homo sapiens
tcggtatctggct

SEQ ID NO: 6425501 - DNA, 12 bp, Homo sapiens
tcggtcaccttg

SEQ ID NO: 6425502 - DNA, 24 bp, Homo sapiens
tcggtcagaacaacttgctactta

SEQ ID NO: 6425503 - DNA, 18 bp, Homo sapiens
tcggtcagcgactggatg

SEQ ID NO: 6425504 - DNA, 14 bp, Homo sapiens
tcggtcataaagaa

SEQ ID NO: 6425505 - DNA, 12 bp, Homo sapiens
tcggtctgcttt

SEQ ID NO: 6425506 - DNA, 14 bp, Homo sapiens
tcggtctgtgcccc

SEQ ID NO: 6425507 - DNA, 16 bp, Homo sapiens
tcggtcttttgtattt

SEQ ID NO: 6425508 - DNA, 16 bp, Homo sapiens
tcggtgacctccgtcc

SEQ ID NO: 6425509 - DNA, 15 bp, Homo sapiens
tcggtgatgccttcc

SEQ ID NO: 6425510 - DNA, 13 bp, Homo sapiens
tcggtgctccatc

SEQ ID NO: 6425511 - DNA, 18 bp, Homo sapiens
tcggtggcatttgctgaa

SEQ ID NO: 6425512 - DNA, 13 bp, Homo sapiens
tcggtggccctga

SEQ ID NO: 6425513 - DNA, 14 bp, Homo sapiens
tcggtggctgcctt

SEQ ID NO: 6425514 - DNA, 17 bp, Homo sapiens
tcggtgggacagcccca

SEQ ID NO: 6425515 - DNA, 15 bp, Homo sapiens
tcggtgggccagagc

SEQ ID NO: 6425516 - DNA, 17 bp, Homo sapiens
tcggtgggccagagctg

SEQ ID NO: 6425517 - DNA, 13 bp, Homo sapiens
tcggtgtgaactt

SEQ ID NO: 6425518 - DNA, 17 bp, Homo sapiens
tcggtgtttggaggctg

SEQ ID NO: 6425519 - DNA, 15 bp, Homo sapiens
tcggttaacaaataa

SEQ ID NO: 6425520 - DNA, 13 bp, Homo sapiens
tcggttagtcatt

SEQ ID NO: 6425521 - DNA, 21 bp, Homo sapiens
tcggttcaagttgatgtgaca

SEQ ID NO: 6425522 - DNA, 17 bp, Homo sapiens
tcggttcaggaggagac

SEQ ID NO: 6425523 - DNA, 18 bp, Homo sapiens
tcggttctccagaatgta

SEQ ID NO: 6425524 - DNA, 22 bp, Homo sapiens
tcggttctgcgccacttccttt

SEQ ID NO: 6425525 - DNA, 16 bp, Homo sapiens
tcggttgaccctactg

SEQ ID NO: 6425526 - DNA, 16 bp, Homo sapiens
tcggttgattgtgcat

SEQ ID NO: 6425527 - DNA, 13 bp, Homo sapiens
tcggtttctccaa

SEQ ID NO: 6425528 - DNA, 22 bp, Homo sapiens
tcggtttgccaaaattcatttc

SEQ ID NO: 6425529 - DNA, 19 bp, Homo sapiens
tcggtttttttcctgtttc

SEQ ID NO: 6425530 - DNA, 19 bp, Homo sapiens
tcgtaaaaaaatagaaaaa

SEQ ID NO: 6425531 - DNA, 13 bp, Homo sapiens
tcgtaaagatttg

SEQ ID NO: 6425532 - DNA, 16 bp, Homo sapiens
tcgtaacagcaggagc

SEQ ID NO: 6425533 - DNA, 15 bp, Homo sapiens
tcgtaacttcatatt

SEQ ID NO: 6425534 - DNA, 20 bp, Homo sapiens
tcgtaatagcttctgtgtgt

SEQ ID NO: 6425535 - DNA, 23 bp, Homo sapiens
tcgtaatgggtatattgataaat

SEQ ID NO: 6425536 - DNA, 19 bp, Homo sapiens
tcgtacataataagtttca

SEQ ID NO: 6425537 - DNA, 22 bp, Homo sapiens
tcgtacataatactgaaccact

SEQ ID NO: 6425538 - DNA, 22 bp, Homo sapiens
tcgtacattgtgccctgtagct

SEQ ID NO: 6425539 - DNA, 18 bp, Homo sapiens
tcgtacctgtccctccag

SEQ ID NO: 6425540 - DNA, 14 bp, Homo sapiens
tcgtaccttcccac

SEQ ID NO: 6425541 - DNA, 21 bp, Homo sapiens
tcgtacgcccaggacagctgg

SEQ ID NO: 6425542 - DNA, 15 bp, Homo sapiens
tcgtactcaggagcc

SEQ ID NO: 6425543 - DNA, 18 bp, Homo sapiens
tcgtactctctctctttt

SEQ ID NO: 6425544 - DNA, 20 bp, Homo sapiens
tcgtactttcacatctctgt

SEQ ID NO: 6425545 - DNA, 13 bp, Homo sapiens
tcgtagacacagg

SEQ ID NO: 6425546 - DNA, 15 bp, Homo sapiens
tcgtagatgctgcct

SEQ ID NO: 6425547 - DNA, 17 bp, Homo sapiens
tcgtagatgctgcctag

SEQ ID NO: 6425548 - DNA, 13 bp, Homo sapiens
tcgtagccatctc

SEQ ID NO: 6425549 - DNA, 18 bp, Homo sapiens
tcgtaggcagccacggcc

SEQ ID NO: 6425550 - DNA, 18 bp, Homo sapiens
tcgtagtccatcaccatt

SEQ ID NO: 6425551 - DNA, 17 bp, Homo sapiens
tcgtatagaagtcttca

SEQ ID NO: 6425552 - DNA, 20 bp, Homo sapiens
tcgtatatacacacaaaaag

SEQ ID NO: 6425553 - DNA, 18 bp, Homo sapiens
tattttaaaatctgtcac

SEQ ID NO: 6425554 - DNA, 14 bp, Homo sapiens
tattttaaaattca

SEQ ID NO: 6425555 - DNA, 14 bp, Homo sapiens
tattttaaacattt

SEQ ID NO: 6425556 - DNA, 13 bp, Homo sapiens
tattttaaagaat

SEQ ID NO: 6425557 - DNA, 14 bp, Homo sapiens
tattttaaagaatt

SEQ ID NO: 6425558 - DNA, 16 bp, Homo sapiens
tattttaaagaattgt

SEQ ID NO: 6425559 - DNA, 22 bp, Homo sapiens
tattttaaaggggtctgaaatt

SEQ ID NO: 6425560 - DNA, 20 bp, Homo sapiens
tattttaaagtaaaagtcta

SEQ ID NO: 6425561 - DNA, 16 bp, Homo sapiens
tattttaaatataaat

SEQ ID NO: 6425562 - DNA, 20 bp, Homo sapiens
tattttaaatataaatagct

SEQ ID NO: 6425563 - DNA, 20 bp, Homo sapiens
tattttaaatatccacagta

SEQ ID NO: 6425564 - DNA, 14 bp, Homo sapiens
tattttaaatgtgg

SEQ ID NO: 6425565 - DNA, 13 bp, Homo sapiens
tattttaaatgtt

SEQ ID NO: 6425566 - DNA, 11 bp, Homo sapiens
tattttaaatt

SEQ ID NO: 6425567 - DNA, 22 bp, Homo sapiens
tattttaaattactatatatgt

SEQ ID NO: 6425568 - DNA, 14 bp, Homo sapiens
tattttaaattctc

SEQ ID NO: 6425569 - DNA, 15 bp, Homo sapiens
tattttaacatagca

SEQ ID NO: 6425570 - DNA, 13 bp, Homo sapiens
tattttaactttt

SEQ ID NO: 6425571 - DNA, 19 bp, Homo sapiens
tattttaagaaagagaatg

SEQ ID NO: 6425572 - DNA, 20 bp, Homo sapiens
tattttaagaaagagaatga

SEQ ID NO: 6425573 - DNA, 20 bp, Homo sapiens
tattttaagaagttgctgca

SEQ ID NO: 6425574 - DNA, 14 bp, Homo sapiens
tattttaagacgaa

SEQ ID NO: 6425575 - DNA, 22 bp, Homo sapiens
tattttaagacgaaacatttgt

SEQ ID NO: 6425576 - DNA, 19 bp, Homo sapiens
tattttaagcactcttaaa

SEQ ID NO: 6425577 - DNA, 13 bp, Homo sapiens
tattttaagcatt

SEQ ID NO: 6425578 - DNA, 20 bp, Homo sapiens
tattttaagcattactcttg

SEQ ID NO: 6425579 - DNA, 17 bp, Homo sapiens
tattttaagtatgagtt

SEQ ID NO: 6425580 - DNA, 14 bp, Homo sapiens
tattttaataaaca

SEQ ID NO: 6425581 - DNA, 13 bp, Homo sapiens
tattttaatattg

SEQ ID NO: 6425582 - DNA, 17 bp, Homo sapiens
tattttaatattgatgt

SEQ ID NO: 6425583 - DNA, 16 bp, Homo sapiens
tattttaatattttgt

SEQ ID NO: 6425584 - DNA, 23 bp, Homo sapiens
tattttaatcctgtaccaaatct

SEQ ID NO: 6425585 - DNA, 13 bp, Homo sapiens
tattttaatttac

SEQ ID NO: 6425586 - DNA, 19 bp, Homo sapiens
tattttaatttatgagttt

SEQ ID NO: 6425587 - DNA, 15 bp, Homo sapiens
tattttaatttcaag

SEQ ID NO: 6425588 - DNA, 13 bp, Homo sapiens
tattttacaaatt

SEQ ID NO: 6425589 - DNA, 16 bp, Homo sapiens
tattttacaaattgtt

SEQ ID NO: 6425590 - DNA, 14 bp, Homo sapiens
tattttacaatttt

SEQ ID NO: 6425591 - DNA, 14 bp, Homo sapiens
tattttacacagaa

SEQ ID NO: 6425592 - DNA, 15 bp, Homo sapiens
tattttacacagaaa

SEQ ID NO: 6425593 - DNA, 18 bp, Homo sapiens
tattttacacagaaacac

SEQ ID NO: 6425594 - DNA, 19 bp, Homo sapiens
tattttacacagaaacact

SEQ ID NO: 6425595 - DNA, 11 bp, Homo sapiens
tattttacagt

SEQ ID NO: 6425596 - DNA, 15 bp, Homo sapiens
tattttacatttaga

SEQ ID NO: 6425597 - DNA, 18 bp, Homo sapiens
tattttacatttagagta

SEQ ID NO: 6425598 - DNA, 13 bp, Homo sapiens
tattttaccatac

SEQ ID NO: 6425599 - DNA, 16 bp, Homo sapiens
tattttactactgtgg

SEQ ID NO: 6425600 - DNA, 21 bp, Homo sapiens
tattttacttggaaatattaa

SEQ ID NO: 6425601 - DNA, 14 bp, Homo sapiens
tattttactttgta

SEQ ID NO: 6425602 - DNA, 13 bp, Homo sapiens
tattttacttttt

SEQ ID NO: 6425603 - DNA, 17 bp, Homo sapiens
tattttagaaagctaaa

SEQ ID NO: 6425604 - DNA, 22 bp, Homo sapiens
tattttagactcaaagaatata

SEQ ID NO: 6425605 - DNA, 16 bp, Homo sapiens
tattttagatatattc

SEQ ID NO: 6425606 - DNA, 15 bp, Homo sapiens
tattttagatgcaat

SEQ ID NO: 6425607 - DNA, 16 bp, Homo sapiens
tattttagatgttatt

SEQ ID NO: 6425608 - DNA, 19 bp, Homo sapiens
tattttagcaaatcagtat

SEQ ID NO: 6425609 - DNA, 19 bp, Homo sapiens
tattttaggaaactctcca

SEQ ID NO: 6425610 - DNA, 14 bp, Homo sapiens
tattttaggcactg

SEQ ID NO: 6425611 - DNA, 21 bp, Homo sapiens
tattttaggcagggatttgag

SEQ ID NO: 6425612 - DNA, 16 bp, Homo sapiens
tattttaggtgctgtt

SEQ ID NO: 6425613 - DNA, 20 bp, Homo sapiens
tattttaggtgctgttatgt

SEQ ID NO: 6425614 - DNA, 21 bp, Homo sapiens
tattttagtatacgtataaat

SEQ ID NO: 6425615 - DNA, 23 bp, Homo sapiens
tattttagtggaccctgaaatgt

SEQ ID NO: 6425616 - DNA, 14 bp, Homo sapiens
tattttagtgtgta

SEQ ID NO: 6425617 - DNA, 17 bp, Homo sapiens
tattttagtgtgtaaaa

SEQ ID NO: 6425618 - DNA, 20 bp, Homo sapiens
tattttagtgtgtaaaatta

SEQ ID NO: 6425619 - DNA, 22 bp, Homo sapiens
tattttagtgtgtaaaattaat

SEQ ID NO: 6425620 - DNA, 19 bp, Homo sapiens
tattttataacatgttaaa

SEQ ID NO: 6425621 - DNA, 14 bp, Homo sapiens
tattttataagaaa

SEQ ID NO: 6425622 - DNA, 16 bp, Homo sapiens
tattttataatgtcca

SEQ ID NO: 6425623 - DNA, 22 bp, Homo sapiens
tattttataatgttgtatttaa

SEQ ID NO: 6425624 - DNA, 16 bp, Homo sapiens
tattttatacattaac

SEQ ID NO: 6425625 - DNA, 23 bp, Homo sapiens
tattttatactcatggaagagat

SEQ ID NO: 6425626 - DNA, 13 bp, Homo sapiens
tattttatataaa

SEQ ID NO: 6425627 - DNA, 20 bp, Homo sapiens
tattttatataataaagtat

SEQ ID NO: 6425628 - DNA, 13 bp, Homo sapiens
tattttatatttg

SEQ ID NO: 6425629 - DNA, 14 bp, Homo sapiens
tattttatatttga

SEQ ID NO: 6425630 - DNA, 21 bp, Homo sapiens
tattttatcacttgccgtgtc

SEQ ID NO: 6425631 - DNA, 16 bp, Homo sapiens
tattttatgagaaatg

SEQ ID NO: 6425632 - DNA, 12 bp, Homo sapiens
tattttatgatc

SEQ ID NO: 6425633 - DNA, 19 bp, Homo sapiens
tattttatgggtgggaata

SEQ ID NO: 6425634 - DNA, 23 bp, Homo sapiens
tattttatggttatgtttttctg

SEQ ID NO: 6425635 - DNA, 15 bp, Homo sapiens
tattttatgtatata

SEQ ID NO: 6425636 - DNA, 14 bp, Homo sapiens
tattttatgttata

SEQ ID NO: 6425637 - DNA, 13 bp, Homo sapiens
tattttatgttta

SEQ ID NO: 6425638 - DNA, 13 bp, Homo sapiens
tattttattactg

SEQ ID NO: 6425639 - DNA, 14 bp, Homo sapiens
tattttattactgt

SEQ ID NO: 6425640 - DNA, 23 bp, Homo sapiens
tattttattatgaaacttgtgta

SEQ ID NO: 6425641 - DNA, 14 bp, Homo sapiens
tattttattatgca

SEQ ID NO: 6425642 - DNA, 17 bp, Homo sapiens
tattttattattcagaa

SEQ ID NO: 6425643 - DNA, 15 bp, Homo sapiens
tattttattcaaggt

SEQ ID NO: 6425644 - DNA, 16 bp, Homo sapiens
tattttattcaaggta

SEQ ID NO: 6425645 - DNA, 20 bp, Homo sapiens
tattttattcagtagtttga

SEQ ID NO: 6425646 - DNA, 19 bp, Homo sapiens
tattttattccctttcaca

SEQ ID NO: 6425647 - DNA, 15 bp, Homo sapiens
tattttattgaatac

SEQ ID NO: 6425648 - DNA, 19 bp, Homo sapiens
tattttattgcctttagaa

SEQ ID NO: 6425649 - DNA, 19 bp, Homo sapiens
tattttattgtaacagaca

SEQ ID NO: 6425650 - DNA, 15 bp, Homo sapiens
tattttatttatctt

SEQ ID NO: 6425651 - DNA, 16 bp, Homo sapiens
tattttatttcaatgt

SEQ ID NO: 6425652 - DNA, 14 bp, Homo sapiens
tattttatttgaaa

SEQ ID NO: 6425653 - DNA, 16 bp, Homo sapiens
tattttatttgaaaaa

SEQ ID NO: 6425654 - DNA, 13 bp, Homo sapiens
tattttatttgct

SEQ ID NO: 6425655 - DNA, 17 bp, Homo sapiens
tattttattttattgaa

SEQ ID NO: 6425656 - DNA, 19 bp, Homo sapiens
tattttattttttaccata

SEQ ID NO: 6425657 - DNA, 17 bp, Homo sapiens
tattttatttttttcta

SEQ ID NO: 6425658 - DNA, 14 bp, Homo sapiens
tattttcaaaacca

SEQ ID NO: 6425659 - DNA, 23 bp, Homo sapiens
tattttcaaagactgccacgtgc

SEQ ID NO: 6425660 - DNA, 21 bp, Homo sapiens
tattttcaacgcagccctgct

SEQ ID NO: 6425661 - DNA, 19 bp, Homo sapiens
tattttcaagatacatgtt

SEQ ID NO: 6425662 - DNA, 22 bp, Homo sapiens
tattttcaagatacatgttgta

SEQ ID NO: 6425663 - DNA, 12 bp, Homo sapiens
tattttcaagtt

SEQ ID NO: 6425664 - DNA, 20 bp, Homo sapiens
tattttcaagtttttcatac

SEQ ID NO: 6425665 - DNA, 16 bp, Homo sapiens
tattttcaataaagaa

SEQ ID NO: 6425666 - DNA, 18 bp, Homo sapiens
tattttcaatagccacta

SEQ ID NO: 6425667 - DNA, 21 bp, Homo sapiens
tattttcaatgaaacaaagaa

SEQ ID NO: 6425668 - DNA, 22 bp, Homo sapiens
tattttcaattcaaaaatgtac

SEQ ID NO: 6425669 - DNA, 11 bp, Homo sapiens
tattttcacaa

SEQ ID NO: 6425670 - DNA, 12 bp, Homo sapiens
tattttcacaat

SEQ ID NO: 6425671 - DNA, 14 bp, Homo sapiens
tattttcacaatgt

SEQ ID NO: 6425672 - DNA, 19 bp, Homo sapiens
tattttcacagatggaaga

SEQ ID NO: 6425673 - DNA, 14 bp, Homo sapiens
tattttcagaagaa

SEQ ID NO: 6425674 - DNA, 22 bp, Homo sapiens
tattttcagaagctgatgagga

SEQ ID NO: 6425675 - DNA, 20 bp, Homo sapiens
tattttcagaatctgaatgt

SEQ ID NO: 6425676 - DNA, 21 bp, Homo sapiens
tattttcagaatctgaatgta

SEQ ID NO: 6425677 - DNA, 14 bp, Homo sapiens
tattttcagagaac

SEQ ID NO: 6425678 - DNA, 21 bp, Homo sapiens
tattttcagtcaaaactttaa

SEQ ID NO: 6425679 - DNA, 22 bp, Homo sapiens
tattttcagtcccctctctctg

SEQ ID NO: 6425680 - DNA, 14 bp, Homo sapiens
tattttcataattc

SEQ ID NO: 6425681 - DNA, 20 bp, Homo sapiens
tattttcataattcatttaa

SEQ ID NO: 6425682 - DNA, 18 bp, Homo sapiens
tattttcatacagcatta

SEQ ID NO: 6425683 - DNA, 14 bp, Homo sapiens
tattttcatgaaaa

SEQ ID NO: 6425684 - DNA, 18 bp, Homo sapiens
tattttcatgtggtacta

SEQ ID NO: 6425685 - DNA, 14 bp, Homo sapiens
tattttcattgtga

SEQ ID NO: 6425686 - DNA, 15 bp, Homo sapiens
tattttcatttgtac

SEQ ID NO: 6425687 - DNA, 18 bp, Homo sapiens
tattttcatttgtacaag

SEQ ID NO: 6425688 - DNA, 16 bp, Homo sapiens
tattttccaaaatcta

SEQ ID NO: 6425689 - DNA, 17 bp, Homo sapiens
tattttccaaaggattt

SEQ ID NO: 6425690 - DNA, 14 bp, Homo sapiens
tattttccaagtgt

SEQ ID NO: 6425691 - DNA, 22 bp, Homo sapiens
tattttccaagtgtgcatattg

SEQ ID NO: 6425692 - DNA, 13 bp, Homo sapiens
tattttccacctt

SEQ ID NO: 6425693 - DNA, 20 bp, Homo sapiens
tattttccagccttatgtgt

SEQ ID NO: 6425694 - DNA, 11 bp, Homo sapiens
tattttccagg

SEQ ID NO: 6425695 - DNA, 13 bp, Homo sapiens
tattttccaggct

SEQ ID NO: 6425696 - DNA, 21 bp, Homo sapiens
tattttccctctcttgccttt

SEQ ID NO: 6425697 - DNA, 19 bp, Homo sapiens
tattttcccttcatgtttt

SEQ ID NO: 6425698 - DNA, 15 bp, Homo sapiens
tattttcccttttta

SEQ ID NO: 6425699 - DNA, 12 bp, Homo sapiens
tattttcctaaa

SEQ ID NO: 6425700 - DNA, 16 bp, Homo sapiens
tattttcctaatgtga

SEQ ID NO: 6425701 - DNA, 12 bp, Homo sapiens
tattttcctgcc

SEQ ID NO: 6425702 - DNA, 15 bp, Homo sapiens
tattttcctggattt

SEQ ID NO: 6425703 - DNA, 13 bp, Homo sapiens
tattttcctgtct

SEQ ID NO: 6425704 - DNA, 17 bp, Homo sapiens
tattttccttaatcaaa

SEQ ID NO: 6425705 - DNA, 17 bp, Homo sapiens
tattttcgtatgaaaat

SEQ ID NO: 6425706 - DNA, 16 bp, Homo sapiens
tattttcgtgtgagat

SEQ ID NO: 6425707 - DNA, 15 bp, Homo sapiens
tattttctaaagact

SEQ ID NO: 6425708 - DNA, 15 bp, Homo sapiens
tattttctacagtgg

SEQ ID NO: 6425709 - DNA, 14 bp, Homo sapiens
tattttctacgttt

SEQ ID NO: 6425710 - DNA, 17 bp, Homo sapiens
tattttctagactgtga

SEQ ID NO: 6425711 - DNA, 12 bp, Homo sapiens
tattttctatat

SEQ ID NO: 6425712 - DNA, 16 bp, Homo sapiens
tattttctatgtacta

SEQ ID NO: 6425713 - DNA, 14 bp, Homo sapiens
tattttctatttta

SEQ ID NO: 6425714 - DNA, 19 bp, Homo sapiens
tattttctattttaagact

SEQ ID NO: 6425715 - DNA, 14 bp, Homo sapiens
tattttctccatgt

SEQ ID NO: 6425716 - DNA, 18 bp, Homo sapiens
tattttctccatgtctgt

SEQ ID NO: 6425717 - DNA, 20 bp, Homo sapiens
tattttctctgtacttttca

SEQ ID NO: 6425718 - DNA, 22 bp, Homo sapiens
tattttctgaattcataaaaat

SEQ ID NO: 6425719 - DNA, 14 bp, Homo sapiens
tattttctgcaatc

SEQ ID NO: 6425720 - DNA, 23 bp, Homo sapiens
tattttctgcagaaatttgcaac

SEQ ID NO: 6425721 - DNA, 20 bp, Homo sapiens
tattttctggtagatagaaa

SEQ ID NO: 6425722 - DNA, 14 bp, Homo sapiens
tattttctgtaatt

SEQ ID NO: 6425723 - DNA, 13 bp, Homo sapiens
tattttctgtatt

SEQ ID NO: 6425724 - DNA, 12 bp, Homo sapiens
tattttctgtca

SEQ ID NO: 6425725 - DNA, 11 bp, Homo sapiens
tattttctgtg

SEQ ID NO: 6425726 - DNA, 14 bp, Homo sapiens
tattttctgtgtgt

SEQ ID NO: 6425727 - DNA, 20 bp, Homo sapiens
tattttctgtgtgttcctgg

SEQ ID NO: 6425728 - DNA, 14 bp, Homo sapiens
tattttctgttcag

SEQ ID NO: 6425729 - DNA, 14 bp, Homo sapiens
tattttctgttttt

SEQ ID NO: 6425730 - DNA, 15 bp, Homo sapiens
tattttcttaaacca

SEQ ID NO: 6425731 - DNA, 12 bp, Homo sapiens
tattttcttcat

SEQ ID NO: 6425732 - DNA, 18 bp, Homo sapiens
tattttcttcccatttgt

SEQ ID NO: 6425733 - DNA, 19 bp, Homo sapiens
tattttcttcccatttgta

SEQ ID NO: 6425734 - DNA, 22 bp, Homo sapiens
tattttcttcccatttgtaatg

SEQ ID NO: 6425735 - DNA, 15 bp, Homo sapiens
tcgtatgaaaatgag

SEQ ID NO: 6425736 - DNA, 21 bp, Homo sapiens
tcgtattctaattcttcatta

SEQ ID NO: 6425737 - DNA, 16 bp, Homo sapiens
tcgtcaactttcctca

SEQ ID NO: 6425738 - DNA, 18 bp, Homo sapiens
tcgtcacgagcacaatgg

SEQ ID NO: 6425739 - DNA, 18 bp, Homo sapiens
tcgtcactaatacacagt

SEQ ID NO: 6425740 - DNA, 20 bp, Homo sapiens
tcgtcagccacctgggaaca

SEQ ID NO: 6425741 - DNA, 14 bp, Homo sapiens
tcgtcagcctccct

SEQ ID NO: 6425742 - DNA, 20 bp, Homo sapiens
tcgtcaggaggtgcctgaga

SEQ ID NO: 6425743 - DNA, 22 bp, Homo sapiens
tcgtcaggaggtgcctgagagc

SEQ ID NO: 6425744 - DNA, 17 bp, Homo sapiens
tcgtcataggcttctgc

SEQ ID NO: 6425745 - DNA, 18 bp, Homo sapiens
tcgtcatcttccctgccc

SEQ ID NO: 6425746 - DNA, 21 bp, Homo sapiens
tcgtccaaggcagttctgtgt

SEQ ID NO: 6425747 - DNA, 19 bp, Homo sapiens
tcgtccaagggacagccca

SEQ ID NO: 6425748 - DNA, 17 bp, Homo sapiens
tcgtccacagcttcctg

SEQ ID NO: 6425749 - DNA, 19 bp, Homo sapiens
tcgtccacaggggcaggcc

SEQ ID NO: 6425750 - DNA, 20 bp, Homo sapiens
tcgtccacaggggcaggcct

SEQ ID NO: 6425751 - DNA, 17 bp, Homo sapiens
tcgtccaccccccacac

SEQ ID NO: 6425752 - DNA, 21 bp, Homo sapiens
tcgtccaccccccacacacac

SEQ ID NO: 6425753 - DNA, 13 bp, Homo sapiens
tcgtccagccctc

SEQ ID NO: 6425754 - DNA, 17 bp, Homo sapiens
tcgtccatgtttctcac

SEQ ID NO: 6425755 - DNA, 18 bp, Homo sapiens
tcgtccatgtttctcaca

SEQ ID NO: 6425756 - DNA, 13 bp, Homo sapiens
tcgtccccagacc

SEQ ID NO: 6425757 - DNA, 21 bp, Homo sapiens
tcgtccccagaccagtagtga

SEQ ID NO: 6425758 - DNA, 22 bp, Homo sapiens
tcgtccccagaccagtagtgac

SEQ ID NO: 6425759 - DNA, 15 bp, Homo sapiens
tcgtccccctccctg

SEQ ID NO: 6425760 - DNA, 17 bp, Homo sapiens
tcgtccccctccctgcc

SEQ ID NO: 6425761 - DNA, 14 bp, Homo sapiens
tcgtccgctcagcc

SEQ ID NO: 6425762 - DNA, 16 bp, Homo sapiens
tcgtccgctcagccaa

SEQ ID NO: 6425763 - DNA, 19 bp, Homo sapiens
tcgtccggcctgcagccca

SEQ ID NO: 6425764 - DNA, 20 bp, Homo sapiens
tcgtccggcctgcagcccag

SEQ ID NO: 6425765 - DNA, 22 bp, Homo sapiens
tcgtccggcctgcagcccagaa

SEQ ID NO: 6425766 - DNA, 15 bp, Homo sapiens
tcgtccgtctgtctc

SEQ ID NO: 6425767 - DNA, 14 bp, Homo sapiens
tcgtcctgatccct

SEQ ID NO: 6425768 - DNA, 21 bp, Homo sapiens
tcgtcctgggactcggagact

SEQ ID NO: 6425769 - DNA, 13 bp, Homo sapiens
tcgtcctgtccca

SEQ ID NO: 6425770 - DNA, 19 bp, Homo sapiens
tcgtccttactcctgtggg

SEQ ID NO: 6425771 - DNA, 16 bp, Homo sapiens
tcgtccttttggttta

SEQ ID NO: 6425772 - DNA, 14 bp, Homo sapiens
tcgtcgcacagtct

SEQ ID NO: 6425773 - DNA, 14 bp, Homo sapiens
tcgtctcagaaggc

SEQ ID NO: 6425774 - DNA, 21 bp, Homo sapiens
tcgtctccagccccttctcag

SEQ ID NO: 6425775 - DNA, 15 bp, Homo sapiens
tcgtctctcgttttg

SEQ ID NO: 6425776 - DNA, 15 bp, Homo sapiens
tcgtctgactctggg

SEQ ID NO: 6425777 - DNA, 17 bp, Homo sapiens
tcgtctgatgttttgat

SEQ ID NO: 6425778 - DNA, 21 bp, Homo sapiens
tcgtctgatgttttgatgcca

SEQ ID NO: 6425779 - DNA, 14 bp, Homo sapiens
tcgtctgtgaatgc

SEQ ID NO: 6425780 - DNA, 15 bp, Homo sapiens
tcgtcttccgtctcc

SEQ ID NO: 6425781 - DNA, 17 bp, Homo sapiens
tcgtcttccgtctcccc

SEQ ID NO: 6425782 - DNA, 15 bp, Homo sapiens
tcgtcttcctctctc

SEQ ID NO: 6425783 - DNA, 22 bp, Homo sapiens
tcgtcttgaacgagcagcccag

SEQ ID NO: 6425784 - DNA, 23 bp, Homo sapiens
tcgtcttgaacgagcagcccagg

SEQ ID NO: 6425785 - DNA, 15 bp, Homo sapiens
tcgtctttcccaaag

SEQ ID NO: 6425786 - DNA, 15 bp, Homo sapiens
tcgtctttcccatgg

SEQ ID NO: 6425787 - DNA, 10 bp, Homo sapiens
tcgtctttgt

SEQ ID NO: 6425788 - DNA, 16 bp, Homo sapiens
tcgtgaaaacacattt

SEQ ID NO: 6425789 - DNA, 22 bp, Homo sapiens
tcgtgaaaaccaaccctgtggg

SEQ ID NO: 6425790 - DNA, 14 bp, Homo sapiens
tcgtgaaaccctgt

SEQ ID NO: 6425791 - DNA, 15 bp, Homo sapiens
tcgtgaagaagcctg

SEQ ID NO: 6425792 - DNA, 21 bp, Homo sapiens
tcgtgaagagggaagccagga

SEQ ID NO: 6425793 - DNA, 19 bp, Homo sapiens
tcgtgaagtatactgtatt

SEQ ID NO: 6425794 - DNA, 12 bp, Homo sapiens
tcgtgacagcct

SEQ ID NO: 6425795 - DNA, 22 bp, Homo sapiens
tcgtgacagtggtgtgtggtgt

SEQ ID NO: 6425796 - DNA, 14 bp, Homo sapiens
tcgtgacccagtgg

SEQ ID NO: 6425797 - DNA, 19 bp, Homo sapiens
tcgtgacccttcagggcca

SEQ ID NO: 6425798 - DNA, 20 bp, Homo sapiens
tcgtgacccttcagggccag

SEQ ID NO: 6425799 - DNA, 15 bp, Homo sapiens
tcgtgacctacaggg

SEQ ID NO: 6425800 - DNA, 17 bp, Homo sapiens
tcgtgacctacagggaa

SEQ ID NO: 6425801 - DNA, 17 bp, Homo sapiens
tcgtgacgctgaataaa

SEQ ID NO: 6425802 - DNA, 13 bp, Homo sapiens
tcgtgagctgggg

SEQ ID NO: 6425803 - DNA, 13 bp, Homo sapiens
tcgtgaggggcaa

SEQ ID NO: 6425804 - DNA, 23 bp, Homo sapiens
tcgtgagtgtccgttgacgtgac

SEQ ID NO: 6425805 - DNA, 16 bp, Homo sapiens
tcgtgatcactgagcc

SEQ ID NO: 6425806 - DNA, 17 bp, Homo sapiens
tcgtgatcactgagcca

SEQ ID NO: 6425807 - DNA, 15 bp, Homo sapiens
tcgtgatgtggagga

SEQ ID NO: 6425808 - DNA, 20 bp, Homo sapiens
tcgtgatgtggaggaagagc

SEQ ID NO: 6425809 - DNA, 16 bp, Homo sapiens
tcgtgattgataagaa

SEQ ID NO: 6425810 - DNA, 20 bp, Homo sapiens
tcgtgcattggaagacccca

SEQ ID NO: 6425811 - DNA, 19 bp, Homo sapiens
tcgtgccaattatagtttg

SEQ ID NO: 6425812 - DNA, 19 bp, Homo sapiens
tcgtgccagtcgcgctgcc

SEQ ID NO: 6425813 - DNA, 21 bp, Homo sapiens
tcgtgccagtcgcgctgcctg

SEQ ID NO: 6425814 - DNA, 17 bp, Homo sapiens
tcgtgccatgatctgta

SEQ ID NO: 6425815 - DNA, 18 bp, Homo sapiens
tcgtgccatgatctgtat

SEQ ID NO: 6425816 - DNA, 23 bp, Homo sapiens
tcgtgccctttggggttgcccag

SEQ ID NO: 6425817 - DNA, 16 bp, Homo sapiens
tcgtgcctataaatag

SEQ ID NO: 6425818 - DNA, 17 bp, Homo sapiens
tcgtgcctgagaccagg

SEQ ID NO: 6425819 - DNA, 18 bp, Homo sapiens
tcgtgcctgagaccaggg

SEQ ID NO: 6425820 - DNA, 12 bp, Homo sapiens
tcgtgcctgtgt

SEQ ID NO: 6425821 - DNA, 13 bp, Homo sapiens
tcgtgcctgtgtc

SEQ ID NO: 6425822 - DNA, 15 bp, Homo sapiens
tcgtgcctgtgtcca

SEQ ID NO: 6425823 - DNA, 22 bp, Homo sapiens
tcgtgcgcaacaacaaggaccc

SEQ ID NO: 6425824 - DNA, 22 bp, Homo sapiens
tcgtgctgcatccctgtgtcca

SEQ ID NO: 6425825 - DNA, 21 bp, Homo sapiens
tcgtgctggcggacgcagctg

SEQ ID NO: 6425826 - DNA, 15 bp, Homo sapiens
tcgtgctgtgctctg

SEQ ID NO: 6425827 - DNA, 18 bp, Homo sapiens
tcgtggaagaagggccac

SEQ ID NO: 6425828 - DNA, 13 bp, Homo sapiens
tcgtggacacctg

SEQ ID NO: 6425829 - DNA, 10 bp, Homo sapiens
tcgtggagag

SEQ ID NO: 6425830 - DNA, 16 bp, Homo sapiens
tcgtggagccacaggc

SEQ ID NO: 6425831 - DNA, 18 bp, Homo sapiens
tcgtggagccacaggcag

SEQ ID NO: 6425832 - DNA, 21 bp, Homo sapiens
tcgtggagccctactcacaca

SEQ ID NO: 6425833 - DNA, 17 bp, Homo sapiens
tcgtggagctcgcccct

SEQ ID NO: 6425834 - DNA, 19 bp, Homo sapiens
tcgtggagctcgcccctcc

SEQ ID NO: 6425835 - DNA, 22 bp, Homo sapiens
tcgtggagctcgcccctcccct

SEQ ID NO: 6425836 - DNA, 21 bp, Homo sapiens
tcgtggcagataatcagcctc

SEQ ID NO: 6425837 - DNA, 15 bp, Homo sapiens
tcgtggcagcacggc

SEQ ID NO: 6425838 - DNA, 12 bp, Homo sapiens
tcgtggccagcc

SEQ ID NO: 6425839 - DNA, 18 bp, Homo sapiens
tcgtggccagcccggctg

SEQ ID NO: 6425840 - DNA, 13 bp, Homo sapiens
tcgtggctgtcaa

SEQ ID NO: 6425841 - DNA, 20 bp, Homo sapiens
tcgtggctttggcagtgttt

SEQ ID NO: 6425842 - DNA, 13 bp, Homo sapiens
tcgtgggaaaggg

SEQ ID NO: 6425843 - DNA, 22 bp, Homo sapiens
tcgtgggaaggaggggagcctt

SEQ ID NO: 6425844 - DNA, 19 bp, Homo sapiens
tcgtgggctctggctccct

SEQ ID NO: 6425845 - DNA, 12 bp, Homo sapiens
tcgtggggaggt

SEQ ID NO: 6425846 - DNA, 22 bp, Homo sapiens
tcgtggtccccaacagcgacat

SEQ ID NO: 6425847 - DNA, 14 bp, Homo sapiens
tcgtggtggagaat

SEQ ID NO: 6425848 - DNA, 23 bp, Homo sapiens
tcgtggtggagaatctgagggca

SEQ ID NO: 6425849 - DNA, 19 bp, Homo sapiens
tcgtgtagtggaagagcag

SEQ ID NO: 6425850 - DNA, 23 bp, Homo sapiens
tcgtgtagtggaagagcagcctg

SEQ ID NO: 6425851 - DNA, 22 bp, Homo sapiens
tcgtgtatcctggggctccctt

SEQ ID NO: 6425852 - DNA, 16 bp, Homo sapiens
tcgtgtcccctatcct

SEQ ID NO: 6425853 - DNA, 19 bp, Homo sapiens
tcgtgtcctgctagctgtc

SEQ ID NO: 6425854 - DNA, 14 bp, Homo sapiens
tcgtgtctggcaca

SEQ ID NO: 6425855 - DNA, 21 bp, Homo sapiens
tcgtgtctggcacagcctggc

SEQ ID NO: 6425856 - DNA, 21 bp, Homo sapiens
tcgtgtgatttcctacagaaa

SEQ ID NO: 6425857 - DNA, 15 bp, Homo sapiens
tcgtgtgcatgagaa

SEQ ID NO: 6425858 - DNA, 21 bp, Homo sapiens
tcgtgtgcatgagaatgtcat

SEQ ID NO: 6425859 - DNA, 16 bp, Homo sapiens
tcgtgtggctcctggt

SEQ ID NO: 6425860 - DNA, 15 bp, Homo sapiens
tcgtgttcgctggct

SEQ ID NO: 6425861 - DNA, 13 bp, Homo sapiens
tcgtgttctctcc

SEQ ID NO: 6425862 - DNA, 15 bp, Homo sapiens
tcgtgttggtatttt

SEQ ID NO: 6425863 - DNA, 21 bp, Homo sapiens
tcgtgttggtattttcagaga

SEQ ID NO: 6425864 - DNA, 14 bp, Homo sapiens
tcgtgttgtgttct

SEQ ID NO: 6425865 - DNA, 20 bp, Homo sapiens
tcgtgttgtgttctttataa

SEQ ID NO: 6425866 - DNA, 22 bp, Homo sapiens
tcgtgttgtgttctttataacc

SEQ ID NO: 6425867 - DNA, 18 bp, Homo sapiens
tcgtgtttgcttaaaata

SEQ ID NO: 6425868 - DNA, 14 bp, Homo sapiens
tcgtgttttcaagg

SEQ ID NO: 6425869 - DNA, 22 bp, Homo sapiens
tcgtgtttttggttttctcctt

SEQ ID NO: 6425870 - DNA, 14 bp, Homo sapiens
tcgttaacattgac

SEQ ID NO: 6425871 - DNA, 15 bp, Homo sapiens
tcgttaactgtgtat

SEQ ID NO: 6425872 - DNA, 23 bp, Homo sapiens
tcgttaagcagtacatcttgtgc

SEQ ID NO: 6425873 - DNA, 19 bp, Homo sapiens
tcgttaatatcgctgatat

SEQ ID NO: 6425874 - DNA, 18 bp, Homo sapiens
tcgttaatcttgctgctt

SEQ ID NO: 6425875 - DNA, 13 bp, Homo sapiens
tcgttaatttgta

SEQ ID NO: 6425876 - DNA, 17 bp, Homo sapiens
tcgttacatcttgtagg

SEQ ID NO: 6425877 - DNA, 20 bp, Homo sapiens
tcgttactctcacctcgtga

SEQ ID NO: 6425878 - DNA, 19 bp, Homo sapiens
tcgttagcgtccatttctt

SEQ ID NO: 6425879 - DNA, 17 bp, Homo sapiens
tcgttaggacaaggctg

SEQ ID NO: 6425880 - DNA, 22 bp, Homo sapiens
tcgttaggacaaggctgtgcca

SEQ ID NO: 6425881 - DNA, 17 bp, Homo sapiens
tcgttagggaagagaaa

SEQ ID NO: 6425882 - DNA, 14 bp, Homo sapiens
tcgttatctaatag

SEQ ID NO: 6425883 - DNA, 15 bp, Homo sapiens
tcgttattataaatg

SEQ ID NO: 6425884 - DNA, 19 bp, Homo sapiens
tcgttcaaaacattccaag

SEQ ID NO: 6425885 - DNA, 14 bp, Homo sapiens
tcgttcccttgtgt

SEQ ID NO: 6425886 - DNA, 18 bp, Homo sapiens
tcgttcgctcgctctctc

SEQ ID NO: 6425887 - DNA, 13 bp, Homo sapiens
tcgttctccttcc

SEQ ID NO: 6425888 - DNA, 19 bp, Homo sapiens
tcgttctcgtgacccagtg

SEQ ID NO: 6425889 - DNA, 20 bp, Homo sapiens
tcgttctgctgaccaaatgg

SEQ ID NO: 6425890 - DNA, 14 bp, Homo sapiens
tcgttctttctagc

SEQ ID NO: 6425891 - DNA, 14 bp, Homo sapiens
tcgttctttttaag

SEQ ID NO: 6425892 - DNA, 18 bp, Homo sapiens
tcgttctttttaagttaa

SEQ ID NO: 6425893 - DNA, 15 bp, Homo sapiens
tcgttgatggccaaa

SEQ ID NO: 6425894 - DNA, 14 bp, Homo sapiens
tcgttggagactga

SEQ ID NO: 6425895 - DNA, 18 bp, Homo sapiens
tcgttggagagcagcagg

SEQ ID NO: 6425896 - DNA, 19 bp, Homo sapiens
tcgttgttattaaagaatc

SEQ ID NO: 6425897 - DNA, 18 bp, Homo sapiens
tcgtttaatgaatgctta

SEQ ID NO: 6425898 - DNA, 15 bp, Homo sapiens
tcgtttaatgtttat

SEQ ID NO: 6425899 - DNA, 20 bp, Homo sapiens
tcgtttaatgtttatacaga

SEQ ID NO: 6425900 - DNA, 22 bp, Homo sapiens
tcgtttaccttcaaactttagg

SEQ ID NO: 6425901 - DNA, 15 bp, Homo sapiens
tcgtttactttttaa

SEQ ID NO: 6425902 - DNA, 16 bp, Homo sapiens
tcgtttagaatcagaa

SEQ ID NO: 6425903 - DNA, 14 bp, Homo sapiens
tcgtttagtgccaa

SEQ ID NO: 6425904 - DNA, 22 bp, Homo sapiens
tcgtttatatttttttaactgt

SEQ ID NO: 6425905 - DNA, 19 bp, Homo sapiens
tcgtttattgcttaatccc

SEQ ID NO: 6425906 - DNA, 19 bp, Homo sapiens
tcgtttattttcaagaata

SEQ ID NO: 6425907 - DNA, 21 bp, Homo sapiens
tcgtttcaggacatggggcat

SEQ ID NO: 6425908 - DNA, 21 bp, Homo sapiens
tcgtttccagcctttgtcact

SEQ ID NO: 6425909 - DNA, 15 bp, Homo sapiens
tcgtttccatcatgt

SEQ ID NO: 6425910 - DNA, 14 bp, Homo sapiens
tcgtttctgacata

SEQ ID NO: 6425911 - DNA, 14 bp, Homo sapiens
tcgtttctgcccag

SEQ ID NO: 6425912 - DNA, 12 bp, Homo sapiens
tcgtttctgtat

SEQ ID NO: 6425913 - DNA, 20 bp, Homo sapiens
tcgtttgtattctacctttg

SEQ ID NO: 6425914 - DNA, 12 bp, Homo sapiens
tattttcttcct

SEQ ID NO: 6425915 - DNA, 15 bp, Homo sapiens
tattttcttccttct

SEQ ID NO: 6425916 - DNA, 13 bp, Homo sapiens
tattttcttgagt

SEQ ID NO: 6425917 - DNA, 22 bp, Homo sapiens
tattttcttggaattttgtaaa

SEQ ID NO: 6425918 - DNA, 13 bp, Homo sapiens
tattttcttggat

SEQ ID NO: 6425919 - DNA, 15 bp, Homo sapiens
tattttcttgtttaa

SEQ ID NO: 6425920 - DNA, 22 bp, Homo sapiens
tattttctttctagtttgttta

SEQ ID NO: 6425921 - DNA, 13 bp, Homo sapiens
tattttcttttta

SEQ ID NO: 6425922 - DNA, 14 bp, Homo sapiens
tattttctttttat

SEQ ID NO: 6425923 - DNA, 17 bp, Homo sapiens
tattttgaaaaagagaa

SEQ ID NO: 6425924 - DNA, 19 bp, Homo sapiens
tattttgaaaaagagaaca

SEQ ID NO: 6425925 - DNA, 22 bp, Homo sapiens
tattttgaaaaagagaacagaa

SEQ ID NO: 6425926 - DNA, 18 bp, Homo sapiens
tattttgaaaacacttat

SEQ ID NO: 6425927 - DNA, 18 bp, Homo sapiens
tattttgaaatgaacttt

SEQ ID NO: 6425928 - DNA, 20 bp, Homo sapiens
tattttgaagaaaacacaac

SEQ ID NO: 6425929 - DNA, 23 bp, Homo sapiens
tattttgaagaaaacacaacatt

SEQ ID NO: 6425930 - DNA, 22 bp, Homo sapiens
tattttgaagaatatttaagaa

SEQ ID NO: 6425931 - DNA, 15 bp, Homo sapiens
tattttgaagtttac

SEQ ID NO: 6425932 - DNA, 17 bp, Homo sapiens
tattttgaagtttacat

SEQ ID NO: 6425933 - DNA, 23 bp, Homo sapiens
tattttgaatcaataatatattt

SEQ ID NO: 6425934 - DNA, 15 bp, Homo sapiens
tattttgaatgtacc

SEQ ID NO: 6425935 - DNA, 13 bp, Homo sapiens
tattttgaatgtc

SEQ ID NO: 6425936 - DNA, 16 bp, Homo sapiens
tattttgaatgtcaca

SEQ ID NO: 6425937 - DNA, 17 bp, Homo sapiens
tattttgaatgtcacaa

SEQ ID NO: 6425938 - DNA, 16 bp, Homo sapiens
tattttgaatgtgaag

SEQ ID NO: 6425939 - DNA, 12 bp, Homo sapiens
tattttgacaga

SEQ ID NO: 6425940 - DNA, 18 bp, Homo sapiens
tattttgacagaagctat

SEQ ID NO: 6425941 - DNA, 19 bp, Homo sapiens
tattttgacagaagctatt

SEQ ID NO: 6425942 - DNA, 16 bp, Homo sapiens
tattttgagaaactgc

SEQ ID NO: 6425943 - DNA, 18 bp, Homo sapiens
tattttgagaactccagc

SEQ ID NO: 6425944 - DNA, 20 bp, Homo sapiens
tattttgagccttattaaaa

SEQ ID NO: 6425945 - DNA, 14 bp, Homo sapiens
tattttgataaatt

SEQ ID NO: 6425946 - DNA, 15 bp, Homo sapiens
tattttgataataat

SEQ ID NO: 6425947 - DNA, 16 bp, Homo sapiens
tattttgatataattg

SEQ ID NO: 6425948 - DNA, 16 bp, Homo sapiens
tattttgatcagtgtt

SEQ ID NO: 6425949 - DNA, 15 bp, Homo sapiens
tattttgatgcagca

SEQ ID NO: 6425950 - DNA, 17 bp, Homo sapiens
tattttgattattgtat

SEQ ID NO: 6425951 - DNA, 12 bp, Homo sapiens
tattttgcaaac

SEQ ID NO: 6425952 - DNA, 21 bp, Homo sapiens
tattttgcactctgtaattgc

SEQ ID NO: 6425953 - DNA, 18 bp, Homo sapiens
tattttgcattccagaat

SEQ ID NO: 6425954 - DNA, 22 bp, Homo sapiens
tattttgccaagggcataaatt

SEQ ID NO: 6425955 - DNA, 23 bp, Homo sapiens
tattttgccaagggcataaatta

SEQ ID NO: 6425956 - DNA, 16 bp, Homo sapiens
tattttgccatttagc

SEQ ID NO: 6425957 - DNA, 21 bp, Homo sapiens
tattttgcctgttaaatcgta

SEQ ID NO: 6425958 - DNA, 12 bp, Homo sapiens
tattttgctaac

SEQ ID NO: 6425959 - DNA, 13 bp, Homo sapiens
tattttgctaact

SEQ ID NO: 6425960 - DNA, 13 bp, Homo sapiens
tattttgctccct

SEQ ID NO: 6425961 - DNA, 19 bp, Homo sapiens
tattttgctccctctgtta

SEQ ID NO: 6425962 - DNA, 15 bp, Homo sapiens
tattttgctcttgtt

SEQ ID NO: 6425963 - DNA, 18 bp, Homo sapiens
tattttgctgagttgttc

SEQ ID NO: 6425964 - DNA, 16 bp, Homo sapiens
tattttgctttggtta

SEQ ID NO: 6425965 - DNA, 15 bp, Homo sapiens
tattttggaaactgc

SEQ ID NO: 6425966 - DNA, 16 bp, Homo sapiens
tattttggaagacata

SEQ ID NO: 6425967 - DNA, 19 bp, Homo sapiens
tattttggacgtgtgagga

SEQ ID NO: 6425968 - DNA, 16 bp, Homo sapiens
tattttggagaaatta

SEQ ID NO: 6425969 - DNA, 15 bp, Homo sapiens
tattttggatatatt

SEQ ID NO: 6425970 - DNA, 20 bp, Homo sapiens
tattttggattgtatattgt

SEQ ID NO: 6425971 - DNA, 17 bp, Homo sapiens
tattttggcttcatttc

SEQ ID NO: 6425972 - DNA, 19 bp, Homo sapiens
tattttgggaagaaaacct

SEQ ID NO: 6425973 - DNA, 15 bp, Homo sapiens
tattttggtttagtg

SEQ ID NO: 6425974 - DNA, 16 bp, Homo sapiens
tattttgtaaaatgta

SEQ ID NO: 6425975 - DNA, 19 bp, Homo sapiens
tattttgtaaaatgtatta

SEQ ID NO: 6425976 - DNA, 20 bp, Homo sapiens
tattttgtaaactcaaaata

SEQ ID NO: 6425977 - DNA, 20 bp, Homo sapiens
tattttgtaaactgatgttt

SEQ ID NO: 6425978 - DNA, 12 bp, Homo sapiens
tattttgtaata

SEQ ID NO: 6425979 - DNA, 18 bp, Homo sapiens
tattttgtaataaactct

SEQ ID NO: 6425980 - DNA, 21 bp, Homo sapiens
tattttgtaataaactctcta

SEQ ID NO: 6425981 - DNA, 16 bp, Homo sapiens
tattttgtaatattct

SEQ ID NO: 6425982 - DNA, 18 bp, Homo sapiens
tattttgtaatattctgt

SEQ ID NO: 6425983 - DNA, 20 bp, Homo sapiens
tattttgtaatattctgttt

SEQ ID NO: 6425984 - DNA, 21 bp, Homo sapiens
tattttgtaatattctgtttt

SEQ ID NO: 6425985 - DNA, 20 bp, Homo sapiens
tattttgtactttgtggaga

SEQ ID NO: 6425986 - DNA, 16 bp, Homo sapiens
tattttgtagatgtga

SEQ ID NO: 6425987 - DNA, 18 bp, Homo sapiens
tattttgtagttaatata

SEQ ID NO: 6425988 - DNA, 18 bp, Homo sapiens
tattttgtatatttgtaa

SEQ ID NO: 6425989 - DNA, 14 bp, Homo sapiens
tattttgtatgcaa

SEQ ID NO: 6425990 - DNA, 16 bp, Homo sapiens
tattttgtatgcaagc

SEQ ID NO: 6425991 - DNA, 17 bp, Homo sapiens
tattttgtattgtggta

SEQ ID NO: 6425992 - DNA, 21 bp, Homo sapiens
tattttgtcactgctgtaaag

SEQ ID NO: 6425993 - DNA, 20 bp, Homo sapiens
tattttgtcataaaatgcta

SEQ ID NO: 6425994 - DNA, 21 bp, Homo sapiens
tattttgtcataaaatgctat

SEQ ID NO: 6425995 - DNA, 22 bp, Homo sapiens
tattttgtcataaaatgctatt

SEQ ID NO: 6425996 - DNA, 22 bp, Homo sapiens
tattttgtctaggagatgcttt

SEQ ID NO: 6425997 - DNA, 15 bp, Homo sapiens
tattttgtctcctac

SEQ ID NO: 6425998 - DNA, 19 bp, Homo sapiens
tattttgtcttattcttaa

SEQ ID NO: 6425999 - DNA, 14 bp, Homo sapiens
tattttgtgaacta

SEQ ID NO: 6426000 - DNA, 13 bp, Homo sapiens
tattttgtgaaga

SEQ ID NO: 6426001 - DNA, 13 bp, Homo sapiens
tattttgtgaata

SEQ ID NO: 6426002 - DNA, 21 bp, Homo sapiens
tattttgtgatgaatctacat

SEQ ID NO: 6426003 - DNA, 17 bp, Homo sapiens
tattttgtggaggcagt

SEQ ID NO: 6426004 - DNA, 20 bp, Homo sapiens
tattttgtgggcttaattga

SEQ ID NO: 6426005 - DNA, 23 bp, Homo sapiens
tattttgtgtcctccaggagctt

SEQ ID NO: 6426006 - DNA, 14 bp, Homo sapiens
tattttgtgtgaaa

SEQ ID NO: 6426007 - DNA, 17 bp, Homo sapiens
tattttgtgtgaaattg

SEQ ID NO: 6426008 - DNA, 13 bp, Homo sapiens
tattttgtgtgac

SEQ ID NO: 6426009 - DNA, 15 bp, Homo sapiens
tattttgtgtgacca

SEQ ID NO: 6426010 - DNA, 17 bp, Homo sapiens
tattttgtgtgaccaac

SEQ ID NO: 6426011 - DNA, 22 bp, Homo sapiens
tattttgtgtgaccaactgtgt

SEQ ID NO: 6426012 - DNA, 20 bp, Homo sapiens
tattttgtgtttaggaacta

SEQ ID NO: 6426013 - DNA, 12 bp, Homo sapiens
tattttgttaaa

SEQ ID NO: 6426014 - DNA, 15 bp, Homo sapiens
tattttgttaaagct

SEQ ID NO: 6426015 - DNA, 18 bp, Homo sapiens
tattttgttaacttttgt

SEQ ID NO: 6426016 - DNA, 16 bp, Homo sapiens
tattttgttcatacat

SEQ ID NO: 6426017 - DNA, 15 bp, Homo sapiens
tattttgttgtgatt

SEQ ID NO: 6426018 - DNA, 17 bp, Homo sapiens
tattttgtttcttttaa

SEQ ID NO: 6426019 - DNA, 17 bp, Homo sapiens
tattttgttttaatcta

SEQ ID NO: 6426020 - DNA, 13 bp, Homo sapiens
tatttttaaaaga

SEQ ID NO: 6426021 - DNA, 19 bp, Homo sapiens
tatttttaaaatatttaac

SEQ ID NO: 6426022 - DNA, 15 bp, Homo sapiens
tatttttaaacaaaa

SEQ ID NO: 6426023 - DNA, 17 bp, Homo sapiens
tatttttaaagaaatgc

SEQ ID NO: 6426024 - DNA, 17 bp, Homo sapiens
tatttttaaattctgct

SEQ ID NO: 6426025 - DNA, 12 bp, Homo sapiens
tatttttaacat

SEQ ID NO: 6426026 - DNA, 21 bp, Homo sapiens
tatttttaaccaaataagaat

SEQ ID NO: 6426027 - DNA, 23 bp, Homo sapiens
tatttttaactctggattttgaa

SEQ ID NO: 6426028 - DNA, 16 bp, Homo sapiens
tatttttaagaaaaat

SEQ ID NO: 6426029 - DNA, 17 bp, Homo sapiens
tatttttaagaaaaatt

SEQ ID NO: 6426030 - DNA, 21 bp, Homo sapiens
tatttttaattaattgggcca

SEQ ID NO: 6426031 - DNA, 15 bp, Homo sapiens
tatttttaatttaaa

SEQ ID NO: 6426032 - DNA, 18 bp, Homo sapiens
tatttttaatttatgata

SEQ ID NO: 6426033 - DNA, 12 bp, Homo sapiens
tatttttacagc

SEQ ID NO: 6426034 - DNA, 18 bp, Homo sapiens
tatttttacattctgaat

SEQ ID NO: 6426035 - DNA, 17 bp, Homo sapiens
tatttttacctaaagac

SEQ ID NO: 6426036 - DNA, 18 bp, Homo sapiens
tatttttacctgcttttt

SEQ ID NO: 6426037 - DNA, 23 bp, Homo sapiens
tatttttacgatctgtttccaaa

SEQ ID NO: 6426038 - DNA, 12 bp, Homo sapiens
tatttttactgc

SEQ ID NO: 6426039 - DNA, 20 bp, Homo sapiens
tatttttagaataagaattt

SEQ ID NO: 6426040 - DNA, 19 bp, Homo sapiens
tatttttagactcatcaat

SEQ ID NO: 6426041 - DNA, 13 bp, Homo sapiens
tatttttagatgg

SEQ ID NO: 6426042 - DNA, 18 bp, Homo sapiens
tatttttagcagagatgg

SEQ ID NO: 6426043 - DNA, 24 bp, Homo sapiens
tatttttataattaaagatgccat

SEQ ID NO: 6426044 - DNA, 20 bp, Homo sapiens
tatttttataattgtacaaa

SEQ ID NO: 6426045 - DNA, 12 bp, Homo sapiens
tatttttataca

SEQ ID NO: 6426046 - DNA, 22 bp, Homo sapiens
tatttttatacactgtaagctt

SEQ ID NO: 6426047 - DNA, 22 bp, Homo sapiens
tatttttatataatatctaaag

SEQ ID NO: 6426048 - DNA, 19 bp, Homo sapiens
tatttttatatcatgcaaa

SEQ ID NO: 6426049 - DNA, 16 bp, Homo sapiens
tatttttatatttact

SEQ ID NO: 6426050 - DNA, 18 bp, Homo sapiens
tatttttatcatgaattc

SEQ ID NO: 6426051 - DNA, 12 bp, Homo sapiens
tatttttatctt

SEQ ID NO: 6426052 - DNA, 14 bp, Homo sapiens
tatttttatgatga

SEQ ID NO: 6426053 - DNA, 15 bp, Homo sapiens
tatttttatgtgcag

SEQ ID NO: 6426054 - DNA, 17 bp, Homo sapiens
tatttttattaaatgta

SEQ ID NO: 6426055 - DNA, 15 bp, Homo sapiens
tatttttattacttt

SEQ ID NO: 6426056 - DNA, 12 bp, Homo sapiens
tatttttattat

SEQ ID NO: 6426057 - DNA, 12 bp, Homo sapiens
tatttttattca

SEQ ID NO: 6426058 - DNA, 13 bp, Homo sapiens
tatttttatttgt

SEQ ID NO: 6426059 - DNA, 15 bp, Homo sapiens
tatttttcaaaatca

SEQ ID NO: 6426060 - DNA, 18 bp, Homo sapiens
tatttttcaaaatcaaag

SEQ ID NO: 6426061 - DNA, 17 bp, Homo sapiens
tatttttcaaatagatt

SEQ ID NO: 6426062 - DNA, 16 bp, Homo sapiens
tatttttcaaccagca

SEQ ID NO: 6426063 - DNA, 22 bp, Homo sapiens
tatttttcaacttcttctatat

SEQ ID NO: 6426064 - DNA, 14 bp, Homo sapiens
tatttttcaaggaa

SEQ ID NO: 6426065 - DNA, 15 bp, Homo sapiens
tatttttcaaggaag

SEQ ID NO: 6426066 - DNA, 12 bp, Homo sapiens
tatttttcaatc

SEQ ID NO: 6426067 - DNA, 16 bp, Homo sapiens
tatttttcaattatgt

SEQ ID NO: 6426068 - DNA, 19 bp, Homo sapiens
tatttttcaattatgtttg

SEQ ID NO: 6426069 - DNA, 12 bp, Homo sapiens
tatttttcacat

SEQ ID NO: 6426070 - DNA, 13 bp, Homo sapiens
tatttttcacata

SEQ ID NO: 6426071 - DNA, 13 bp, Homo sapiens
tatttttcagaac

SEQ ID NO: 6426072 - DNA, 15 bp, Homo sapiens
tatttttcagatata

SEQ ID NO: 6426073 - DNA, 11 bp, Homo sapiens
tatttttcata

SEQ ID NO: 6426074 - DNA, 13 bp, Homo sapiens
tatttttcatatt

SEQ ID NO: 6426075 - DNA, 14 bp, Homo sapiens
tatttttcatattg

SEQ ID NO: 6426076 - DNA, 12 bp, Homo sapiens
tatttttcatga

SEQ ID NO: 6426077 - DNA, 21 bp, Homo sapiens
tatttttccactattaatctt

SEQ ID NO: 6426078 - DNA, 12 bp, Homo sapiens
tatttttcctgt

SEQ ID NO: 6426079 - DNA, 13 bp, Homo sapiens
tatttttcctgtc

SEQ ID NO: 6426080 - DNA, 11 bp, Homo sapiens
tatttttcctt

SEQ ID NO: 6426081 - DNA, 12 bp, Homo sapiens
tatttttccttt

SEQ ID NO: 6426082 - DNA, 23 bp, Homo sapiens
tatttttctagtcagtaaacatt

SEQ ID NO: 6426083 - DNA, 15 bp, Homo sapiens
tatttttctctttct

SEQ ID NO: 6426084 - DNA, 14 bp, Homo sapiens
tatttttctgagat

SEQ ID NO: 6426085 - DNA, 15 bp, Homo sapiens
tatttttctgagatt

SEQ ID NO: 6426086 - DNA, 14 bp, Homo sapiens
tatttttctgtgtg

SEQ ID NO: 6426087 - DNA, 13 bp, Homo sapiens
tatttttcttaaa

SEQ ID NO: 6426088 - DNA, 17 bp, Homo sapiens
tatttttcttgctgttc

SEQ ID NO: 6426089 - DNA, 18 bp, Homo sapiens
tatttttctttaaagcca

SEQ ID NO: 6426090 - DNA, 15 bp, Homo sapiens
tatttttcttttaaa

SEQ ID NO: 6426091 - DNA, 14 bp, Homo sapiens
tatttttcttttcc

SEQ ID NO: 6426092 - DNA, 16 bp, Homo sapiens
tatttttcttttcctg

SEQ ID NO: 6426093 - DNA, 12 bp, Homo sapiens
tatttttgaaag

SEQ ID NO: 6426094 - DNA, 13 bp, Homo sapiens
tatttttgaaaga

SEQ ID NO: 6426095 - DNA, 19 bp, Homo sapiens
tatttttgaacccctgtgt

SEQ ID NO: 6426096 - DNA, 15 bp, Homo sapiens
tcgtttgtgttctgt

SEQ ID NO: 6426097 - DNA, 15 bp, Homo sapiens
tcgttttacaagaaa

SEQ ID NO: 6426098 - DNA, 15 bp, Homo sapiens
tcgttttagtgtctg

SEQ ID NO: 6426099 - DNA, 13 bp, Homo sapiens
tcgttttccaaac

SEQ ID NO: 6426100 - DNA, 20 bp, Homo sapiens
tcgttttccaaactgactca

SEQ ID NO: 6426101 - DNA, 15 bp, Homo sapiens
tcgttttccaaagag

SEQ ID NO: 6426102 - DNA, 13 bp, Homo sapiens
tcgttttcttaaa

SEQ ID NO: 6426103 - DNA, 20 bp, Homo sapiens
tcgttttctttgctgtgcca

SEQ ID NO: 6426104 - DNA, 20 bp, Homo sapiens
tcgtttttgctgcagagaat

SEQ ID NO: 6426105 - DNA, 14 bp, Homo sapiens
tctaaaaaaataaa

SEQ ID NO: 6426106 - DNA, 23 bp, Homo sapiens
tctaaaaaaataaacaaagtgaa

SEQ ID NO: 6426107 - DNA, 21 bp, Homo sapiens
tctaaaaaaggagaattgaat

SEQ ID NO: 6426108 - DNA, 13 bp, Homo sapiens
tctaaaaacttct

SEQ ID NO: 6426109 - DNA, 14 bp, Homo sapiens
tctaaaaagtcaat

SEQ ID NO: 6426110 - DNA, 13 bp, Homo sapiens
tctaaaaatagaa

SEQ ID NO: 6426111 - DNA, 19 bp, Homo sapiens
tctaaaaatatacatgttt

SEQ ID NO: 6426112 - DNA, 18 bp, Homo sapiens
tctaaaaattttgcattt

SEQ ID NO: 6426113 - DNA, 13 bp, Homo sapiens
tctaaaacaaaat

SEQ ID NO: 6426114 - DNA, 13 bp, Homo sapiens
tctaaaacaataa

SEQ ID NO: 6426115 - DNA, 14 bp, Homo sapiens
tctaaaacaataaa

SEQ ID NO: 6426116 - DNA, 22 bp, Homo sapiens
tctaaaacattcccctccccac

SEQ ID NO: 6426117 - DNA, 22 bp, Homo sapiens
tctaaaacccttggtctgtgtt

SEQ ID NO: 6426118 - DNA, 20 bp, Homo sapiens
tctaaaactaaatagcatgt

SEQ ID NO: 6426119 - DNA, 23 bp, Homo sapiens
tctaaaactactgcctttcaaag

SEQ ID NO: 6426120 - DNA, 11 bp, Homo sapiens
tctaaaactcc

SEQ ID NO: 6426121 - DNA, 22 bp, Homo sapiens
tctaaaactgtactttgattca

SEQ ID NO: 6426122 - DNA, 17 bp, Homo sapiens
tctaaaagaatttaaat

SEQ ID NO: 6426123 - DNA, 12 bp, Homo sapiens
tctaaaagactt

SEQ ID NO: 6426124 - DNA, 14 bp, Homo sapiens
tctaaaagagaagg

SEQ ID NO: 6426125 - DNA, 13 bp, Homo sapiens
tctaaaagattct

SEQ ID NO: 6426126 - DNA, 17 bp, Homo sapiens
tctaaaagcagaaaata

SEQ ID NO: 6426127 - DNA, 14 bp, Homo sapiens
tctaaaagctctgt

SEQ ID NO: 6426128 - DNA, 18 bp, Homo sapiens
tctaaaaggtaatgtgtg

SEQ ID NO: 6426129 - DNA, 23 bp, Homo sapiens
tctaaaaggttcagggaaccgtt

SEQ ID NO: 6426130 - DNA, 13 bp, Homo sapiens
tctaaaagtgtca

SEQ ID NO: 6426131 - DNA, 21 bp, Homo sapiens
tctaaaagtgtcaccttttct

SEQ ID NO: 6426132 - DNA, 19 bp, Homo sapiens
tctaaaatacttgagaaat

SEQ ID NO: 6426133 - DNA, 22 bp, Homo sapiens
tctaaaataggttttccctgtt

SEQ ID NO: 6426134 - DNA, 23 bp, Homo sapiens
tctaaaataggttttccctgttc

SEQ ID NO: 6426135 - DNA, 13 bp, Homo sapiens
tctaaaatcagag

SEQ ID NO: 6426136 - DNA, 19 bp, Homo sapiens
tctaaaatctaaaatttca

SEQ ID NO: 6426137 - DNA, 15 bp, Homo sapiens
tctaaaatcttatag

SEQ ID NO: 6426138 - DNA, 19 bp, Homo sapiens
tctaaaatcttatagttct

SEQ ID NO: 6426139 - DNA, 18 bp, Homo sapiens
tctaaaatgctgttctca

SEQ ID NO: 6426140 - DNA, 23 bp, Homo sapiens
tctaaaatgctgttctcaatcat

SEQ ID NO: 6426141 - DNA, 19 bp, Homo sapiens
tctaaaatggacattttct

SEQ ID NO: 6426142 - DNA, 20 bp, Homo sapiens
tctaaaatggacattttctt

SEQ ID NO: 6426143 - DNA, 12 bp, Homo sapiens
tctaaaatggca

SEQ ID NO: 6426144 - DNA, 19 bp, Homo sapiens
tctaaaatgtgatgttcta

SEQ ID NO: 6426145 - DNA, 21 bp, Homo sapiens
tctaaaatgtgatgttctaag

SEQ ID NO: 6426146 - DNA, 14 bp, Homo sapiens
tctaaaatgtttta

SEQ ID NO: 6426147 - DNA, 14 bp, Homo sapiens
tctaaaattacata

SEQ ID NO: 6426148 - DNA, 12 bp, Homo sapiens
tctaaaattcta

SEQ ID NO: 6426149 - DNA, 15 bp, Homo sapiens
tctaaaattctagtc

SEQ ID NO: 6426150 - DNA, 14 bp, Homo sapiens
tctaaacaaaaaat

SEQ ID NO: 6426151 - DNA, 15 bp, Homo sapiens
tctaaacaaaattgc

SEQ ID NO: 6426152 - DNA, 16 bp, Homo sapiens
tctaaacaaaattgca

SEQ ID NO: 6426153 - DNA, 18 bp, Homo sapiens
tctaaacaaaattgcaat

SEQ ID NO: 6426154 - DNA, 20 bp, Homo sapiens
tctaaacaagaaccatttgc

SEQ ID NO: 6426155 - DNA, 21 bp, Homo sapiens
tctaaacaagaaccatttgca

SEQ ID NO: 6426156 - DNA, 19 bp, Homo sapiens
tctaaacaagattttaaag

SEQ ID NO: 6426157 - DNA, 14 bp, Homo sapiens
tctaaacaatgaat

SEQ ID NO: 6426158 - DNA, 22 bp, Homo sapiens
tctaaacaatgaattcttcaac

SEQ ID NO: 6426159 - DNA, 22 bp, Homo sapiens
tctaaacagatgtccctgaagt

SEQ ID NO: 6426160 - DNA, 19 bp, Homo sapiens
tctaaacagttatttctgt

SEQ ID NO: 6426161 - DNA, 13 bp, Homo sapiens
tctaaacattaat

SEQ ID NO: 6426162 - DNA, 16 bp, Homo sapiens
tctaaacattttttct

SEQ ID NO: 6426163 - DNA, 13 bp, Homo sapiens
tctaaaccaaaac

SEQ ID NO: 6426164 - DNA, 14 bp, Homo sapiens
tctaaaccagaagg

SEQ ID NO: 6426165 - DNA, 18 bp, Homo sapiens
tctaaaccagaaggaagc

SEQ ID NO: 6426166 - DNA, 21 bp, Homo sapiens
tctaaaccatatgaacatata

SEQ ID NO: 6426167 - DNA, 22 bp, Homo sapiens
tctaaaccatctatgtgaatat

SEQ ID NO: 6426168 - DNA, 22 bp, Homo sapiens
tctaaaccatgaaaagttttca

SEQ ID NO: 6426169 - DNA, 19 bp, Homo sapiens
tctaaaccatggcacttga

SEQ ID NO: 6426170 - DNA, 23 bp, Homo sapiens
tctaaacccaaataaatgtgtaa

SEQ ID NO: 6426171 - DNA, 19 bp, Homo sapiens
tctaaacccaatccaaatg

SEQ ID NO: 6426172 - DNA, 24 bp, Homo sapiens
tctaaaccccagattcttcagctt

SEQ ID NO: 6426173 - DNA, 18 bp, Homo sapiens
tctaaacctgtgcctccc

SEQ ID NO: 6426174 - DNA, 20 bp, Homo sapiens
tctaaaccttacatgtgtaa

SEQ ID NO: 6426175 - DNA, 19 bp, Homo sapiens
tctaaacgtaagcactgtt

SEQ ID NO: 6426176 - DNA, 20 bp, Homo sapiens
tctaaacgtaagcactgttt

SEQ ID NO: 6426177 - DNA, 22 bp, Homo sapiens
tctaaactaggattgacattct

SEQ ID NO: 6426178 - DNA, 23 bp, Homo sapiens
tctaaactgagctcgcagccccc

SEQ ID NO: 6426179 - DNA, 13 bp, Homo sapiens
tctaaactgcaaa

SEQ ID NO: 6426180 - DNA, 14 bp, Homo sapiens
tctaaactgcaaac

SEQ ID NO: 6426181 - DNA, 16 bp, Homo sapiens
tctaaactgccccctc

SEQ ID NO: 6426182 - DNA, 15 bp, Homo sapiens
tctaaactggagact

SEQ ID NO: 6426183 - DNA, 19 bp, Homo sapiens
tctaaactggagactgtgt

SEQ ID NO: 6426184 - DNA, 21 bp, Homo sapiens
tctaaactggcatctgctcta

SEQ ID NO: 6426185 - DNA, 16 bp, Homo sapiens
tctaaactggtacaat

SEQ ID NO: 6426186 - DNA, 17 bp, Homo sapiens
tctaaactggtacaatt

SEQ ID NO: 6426187 - DNA, 20 bp, Homo sapiens
tctaaacttttgagaatgtt

SEQ ID NO: 6426188 - DNA, 12 bp, Homo sapiens
tctaaagaaaaa

SEQ ID NO: 6426189 - DNA, 17 bp, Homo sapiens
tctaaagaaacagaaga

SEQ ID NO: 6426190 - DNA, 20 bp, Homo sapiens
tctaaagaaacttggctgga

SEQ ID NO: 6426191 - DNA, 15 bp, Homo sapiens
tctaaagagcactta

SEQ ID NO: 6426192 - DNA, 12 bp, Homo sapiens
tctaaagagcat

SEQ ID NO: 6426193 - DNA, 13 bp, Homo sapiens
tctaaagagcatc

SEQ ID NO: 6426194 - DNA, 15 bp, Homo sapiens
tctaaagaggaagcc

SEQ ID NO: 6426195 - DNA, 21 bp, Homo sapiens
tctaaagagtttattttaaga

SEQ ID NO: 6426196 - DNA, 23 bp, Homo sapiens
tctaaagattctatagttctaga

SEQ ID NO: 6426197 - DNA, 17 bp, Homo sapiens
tctaaagcagcaggtct

SEQ ID NO: 6426198 - DNA, 22 bp, Homo sapiens
tctaaagccttaactaagactc

SEQ ID NO: 6426199 - DNA, 14 bp, Homo sapiens
tctaaagctgccag

SEQ ID NO: 6426200 - DNA, 21 bp, Homo sapiens
tctaaagctggtttaatgttt

SEQ ID NO: 6426201 - DNA, 15 bp, Homo sapiens
tctaaagctttctga

SEQ ID NO: 6426202 - DNA, 18 bp, Homo sapiens
tctaaaggacatacattt

SEQ ID NO: 6426203 - DNA, 13 bp, Homo sapiens
tctaaaggagcag

SEQ ID NO: 6426204 - DNA, 20 bp, Homo sapiens
tctaaaggatggaaaaataa

SEQ ID NO: 6426205 - DNA, 21 bp, Homo sapiens
tctaaaggatggaaaaataaa

SEQ ID NO: 6426206 - DNA, 16 bp, Homo sapiens
tctaaaggctaccttt

SEQ ID NO: 6426207 - DNA, 17 bp, Homo sapiens
tctaaaggctacctttg

SEQ ID NO: 6426208 - DNA, 19 bp, Homo sapiens
tctaaagggatctgcttaa

SEQ ID NO: 6426209 - DNA, 20 bp, Homo sapiens
tctaaaggggttttttggga

SEQ ID NO: 6426210 - DNA, 22 bp, Homo sapiens
tctaaaggtttcactgttcatg

SEQ ID NO: 6426211 - DNA, 17 bp, Homo sapiens
tctaaagtaaaattgaa

SEQ ID NO: 6426212 - DNA, 19 bp, Homo sapiens
tctaaagtaaaattgaagc

SEQ ID NO: 6426213 - DNA, 16 bp, Homo sapiens
tctaaagtactgagca

SEQ ID NO: 6426214 - DNA, 20 bp, Homo sapiens
tctaaagtcatcatgaactg

SEQ ID NO: 6426215 - DNA, 22 bp, Homo sapiens
tctaaagtcttcctattgtact

SEQ ID NO: 6426216 - DNA, 19 bp, Homo sapiens
tctaaagtgtgttgttgct

SEQ ID NO: 6426217 - DNA, 19 bp, Homo sapiens
tctaaagttactactgatt

SEQ ID NO: 6426218 - DNA, 23 bp, Homo sapiens
tctaaagttagggcatttttctt

SEQ ID NO: 6426219 - DNA, 14 bp, Homo sapiens
tctaaagttctaag

SEQ ID NO: 6426220 - DNA, 16 bp, Homo sapiens
tctaaagttctaagat

SEQ ID NO: 6426221 - DNA, 18 bp, Homo sapiens
tctaaagttctaagattc

SEQ ID NO: 6426222 - DNA, 20 bp, Homo sapiens
tctaaagttctaagattctg

SEQ ID NO: 6426223 - DNA, 12 bp, Homo sapiens
tctaaagttgta

SEQ ID NO: 6426224 - DNA, 15 bp, Homo sapiens
tctaaagtttacagt

SEQ ID NO: 6426225 - DNA, 15 bp, Homo sapiens
tctaaagttttattg

SEQ ID NO: 6426226 - DNA, 21 bp, Homo sapiens
tctaaataaaaatatgtaatt

SEQ ID NO: 6426227 - DNA, 15 bp, Homo sapiens
tctaaataaaatgct

SEQ ID NO: 6426228 - DNA, 17 bp, Homo sapiens
tctaaataaaatgctag

SEQ ID NO: 6426229 - DNA, 21 bp, Homo sapiens
tctaaataaagagaactccag

SEQ ID NO: 6426230 - DNA, 20 bp, Homo sapiens
tctaaataaggaatttcctc

SEQ ID NO: 6426231 - DNA, 16 bp, Homo sapiens
tctaaatagatacttt

SEQ ID NO: 6426232 - DNA, 20 bp, Homo sapiens
tctaaatagatacttttgat

SEQ ID NO: 6426233 - DNA, 16 bp, Homo sapiens
tctaaatagcccagat

SEQ ID NO: 6426234 - DNA, 22 bp, Homo sapiens
tctaaatagcccagatcccaag

SEQ ID NO: 6426235 - DNA, 18 bp, Homo sapiens
tctaaatagtattttgtc

SEQ ID NO: 6426236 - DNA, 12 bp, Homo sapiens
tctaaatattat

SEQ ID NO: 6426237 - DNA, 13 bp, Homo sapiens
tctaaatatttcc

SEQ ID NO: 6426238 - DNA, 23 bp, Homo sapiens
tctaaatatttccttaaactgtg

SEQ ID NO: 6426239 - DNA, 17 bp, Homo sapiens
tctaaatcaagtattta

SEQ ID NO: 6426240 - DNA, 15 bp, Homo sapiens
tctaaatcagaaata

SEQ ID NO: 6426241 - DNA, 16 bp, Homo sapiens
tctaaatccttgttaa

SEQ ID NO: 6426242 - DNA, 14 bp, Homo sapiens
tctaaatctattta

SEQ ID NO: 6426243 - DNA, 16 bp, Homo sapiens
tctaaatctatttatt

SEQ ID NO: 6426244 - DNA, 21 bp, Homo sapiens
tctaaatctccaaaataaaac

SEQ ID NO: 6426245 - DNA, 22 bp, Homo sapiens
tctaaatctccaaaataaaact

SEQ ID NO: 6426246 - DNA, 21 bp, Homo sapiens
tctaaatctgtccaactgaga

SEQ ID NO: 6426247 - DNA, 18 bp, Homo sapiens
tctaaatcttccttgtga

SEQ ID NO: 6426248 - DNA, 22 bp, Homo sapiens
tctaaatgaatgagccaaaatg

SEQ ID NO: 6426249 - DNA, 16 bp, Homo sapiens
tctaaatgattatctt

SEQ ID NO: 6426250 - DNA, 11 bp, Homo sapiens
tctaaatgcaa

SEQ ID NO: 6426251 - DNA, 15 bp, Homo sapiens
tctaaatgcaataag

SEQ ID NO: 6426252 - DNA, 16 bp, Homo sapiens
tctaaatgcaataaga

SEQ ID NO: 6426253 - DNA, 19 bp, Homo sapiens
tctaaatgcaataagattt

SEQ ID NO: 6426254 - DNA, 19 bp, Homo sapiens
tctaaatgcagttttaaga

SEQ ID NO: 6426255 - DNA, 14 bp, Homo sapiens
tctaaatgcatatc

SEQ ID NO: 6426256 - DNA, 16 bp, Homo sapiens
tctaaatgcctttgac

SEQ ID NO: 6426257 - DNA, 21 bp, Homo sapiens
tctaaatgttggaattttcaa

SEQ ID NO: 6426258 - DNA, 13 bp, Homo sapiens
tctaaatgtttct

SEQ ID NO: 6426259 - DNA, 18 bp, Homo sapiens
tctaaatgtttctttttc

SEQ ID NO: 6426260 - DNA, 19 bp, Homo sapiens
tctaaatgtttctttttct

SEQ ID NO: 6426261 - DNA, 21 bp, Homo sapiens
tctaaatgtttggcatgtaaa

SEQ ID NO: 6426262 - DNA, 14 bp, Homo sapiens
tctaaattaaaaaa

SEQ ID NO: 6426263 - DNA, 14 bp, Homo sapiens
tctaaattgaataa

SEQ ID NO: 6426264 - DNA, 19 bp, Homo sapiens
tctaaattgatcattcata

SEQ ID NO: 6426265 - DNA, 18 bp, Homo sapiens
tctaaatttaattacctt

SEQ ID NO: 6426266 - DNA, 17 bp, Homo sapiens
tctaaatttatattcat

SEQ ID NO: 6426267 - DNA, 18 bp, Homo sapiens
tctaaatttccatatcct

SEQ ID NO: 6426268 - DNA, 16 bp, Homo sapiens
tctaaattttctaaat

SEQ ID NO: 6426269 - DNA, 18 bp, Homo sapiens
tctaacaaaaagcaatta

SEQ ID NO: 6426270 - DNA, 17 bp, Homo sapiens
tctaacaagctatggga

SEQ ID NO: 6426271 - DNA, 15 bp, Homo sapiens
tctaacaataatatt

SEQ ID NO: 6426272 - DNA, 18 bp, Homo sapiens
tctaacaataatatttca

SEQ ID NO: 6426273 - DNA, 20 bp, Homo sapiens
tctaacaataatatttcaag

SEQ ID NO: 6426274 - DNA, 23 bp, Homo sapiens
tctaacaataatatttcaagtgc

SEQ ID NO: 6426275 - DNA, 19 bp, Homo sapiens
tctaacaatgtattttctt

SEQ ID NO: 6426276 - DNA, 12 bp, Homo sapiens
tctaacacagtt

SEQ ID NO: 6426277 - DNA, 23 bp, Homo sapiens
tctaacacagttgaccctatttt

SEQ ID NO: 6426278 - DNA, 17 bp, Homo sapiens
tctaacaccacactgac

SEQ ID NO: 6426279 - DNA, 18 bp, Homo sapiens
tctaacaccacactgacc

SEQ ID NO: 6426280 - DNA, 20 bp, Homo sapiens
tctaacaccacactgaccac

SEQ ID NO: 6426281 - DNA, 20 bp, Homo sapiens
tctaacactagtctgtgtgc

SEQ ID NO: 6426282 - DNA, 12 bp, Homo sapiens
tctaacagacaa

SEQ ID NO: 6426283 - DNA, 13 bp, Homo sapiens
tctaacagcacca

SEQ ID NO: 6426284 - DNA, 22 bp, Homo sapiens
tctaacagctccatacttcttt

SEQ ID NO: 6426285 - DNA, 17 bp, Homo sapiens
tctaacaggacttgaat

SEQ ID NO: 6426286 - DNA, 16 bp, Homo sapiens
tctaacaggcactttg

SEQ ID NO: 6426287 - DNA, 16 bp, Homo sapiens
tctaacaggggctggt

SEQ ID NO: 6426288 - DNA, 24 bp, Homo sapiens
tctaacaggggctggtgggcacca

SEQ ID NO: 6426289 - DNA, 19 bp, Homo sapiens
tctaacataagtaagactt

SEQ ID NO: 6426290 - DNA, 21 bp, Homo sapiens
tctaacatattcaatgcaagt

SEQ ID NO: 6426291 - DNA, 17 bp, Homo sapiens
tctaacattactgcctt

SEQ ID NO: 6426292 - DNA, 23 bp, Homo sapiens
tctaacatttgagtcccttccag

SEQ ID NO: 6426293 - DNA, 13 bp, Homo sapiens
tctaacattttct

SEQ ID NO: 6426294 - DNA, 21 bp, Homo sapiens
tctaaccaaagagtctctggc

SEQ ID NO: 6426295 - DNA, 14 bp, Homo sapiens
tctaaccaaatgca

SEQ ID NO: 6426296 - DNA, 16 bp, Homo sapiens
tctaaccacagctcct

SEQ ID NO: 6426297 - DNA, 12 bp, Homo sapiens
tctaaccagtgt

SEQ ID NO: 6426298 - DNA, 18 bp, Homo sapiens
tctaacccagtggctgga

SEQ ID NO: 6426299 - DNA, 21 bp, Homo sapiens
tctaacccccagtgccacaga

SEQ ID NO: 6426300 - DNA, 14 bp, Homo sapiens
tctaaccctcccat

SEQ ID NO: 6426301 - DNA, 21 bp, Homo sapiens
tctaaccctcccatggcacct

SEQ ID NO: 6426302 - DNA, 22 bp, Homo sapiens
tctaaccctgtggaagcatggc

SEQ ID NO: 6426303 - DNA, 19 bp, Homo sapiens
tctaacctacgaccccaga

SEQ ID NO: 6426304 - DNA, 22 bp, Homo sapiens
tctaaccttcacgattaactgt

SEQ ID NO: 6426305 - DNA, 23 bp, Homo sapiens
tctaacgcaaaaatagctcttgc

SEQ ID NO: 6426306 - DNA, 21 bp, Homo sapiens
tctaacgcctgagcccaggga

SEQ ID NO: 6426307 - DNA, 23 bp, Homo sapiens
tctaacgcctgagcccagggagg

SEQ ID NO: 6426308 - DNA, 22 bp, Homo sapiens
tctaacgctgaactgacaatga

SEQ ID NO: 6426309 - DNA, 17 bp, Homo sapiens
tctaacggtctgttctg

SEQ ID NO: 6426310 - DNA, 22 bp, Homo sapiens
tctaactatatgtacagctctc

SEQ ID NO: 6426311 - DNA, 22 bp, Homo sapiens
tctaactcaaagacttcctctg

SEQ ID NO: 6426312 - DNA, 13 bp, Homo sapiens
tctaactcactgc

SEQ ID NO: 6426313 - DNA, 16 bp, Homo sapiens
tctaactcactgccta

SEQ ID NO: 6426314 - DNA, 14 bp, Homo sapiens
tctaactcagaatt

SEQ ID NO: 6426315 - DNA, 18 bp, Homo sapiens
tctaactcagaattattt

SEQ ID NO: 6426316 - DNA, 16 bp, Homo sapiens
tctaactcattcttca

SEQ ID NO: 6426317 - DNA, 13 bp, Homo sapiens
tctaactcctggg

SEQ ID NO: 6426318 - DNA, 16 bp, Homo sapiens
tctaactctgatgtaa

SEQ ID NO: 6426319 - DNA, 20 bp, Homo sapiens
tctaactctgatgtaaatga

SEQ ID NO: 6426320 - DNA, 21 bp, Homo sapiens
tctaactctgatgtaaatgaa

SEQ ID NO: 6426321 - DNA, 21 bp, Homo sapiens
tctaactgatgagtaaactga

SEQ ID NO: 6426322 - DNA, 17 bp, Homo sapiens
tctaactggacagcctc

SEQ ID NO: 6426323 - DNA, 21 bp, Homo sapiens
tctaactggacatgaaggaaa

SEQ ID NO: 6426324 - DNA, 12 bp, Homo sapiens
tctaactgtaaa

SEQ ID NO: 6426325 - DNA, 14 bp, Homo sapiens
tctaactgtaaatc

SEQ ID NO: 6426326 - DNA, 15 bp, Homo sapiens
tctaactgtaaatca

SEQ ID NO: 6426327 - DNA, 18 bp, Homo sapiens
tctaactgtaaatcactt

SEQ ID NO: 6426328 - DNA, 22 bp, Homo sapiens
tctaactgtaaatcacttgtaa

SEQ ID NO: 6426329 - DNA, 19 bp, Homo sapiens
tctaactgtggaatataaa

SEQ ID NO: 6426330 - DNA, 17 bp, Homo sapiens
tctaactgttgttactg

SEQ ID NO: 6426331 - DNA, 18 bp, Homo sapiens
tctaacttaaatagcttt

SEQ ID NO: 6426332 - DNA, 11 bp, Homo sapiens
tctaagaaaag

SEQ ID NO: 6426333 - DNA, 13 bp, Homo sapiens
tctaagaaaatgt

SEQ ID NO: 6426334 - DNA, 16 bp, Homo sapiens
tctaagaaaatgtagt

SEQ ID NO: 6426335 - DNA, 23 bp, Homo sapiens
tctaagaaacaaagtaatctact

SEQ ID NO: 6426336 - DNA, 13 bp, Homo sapiens
tctaagaaagaac

SEQ ID NO: 6426337 - DNA, 16 bp, Homo sapiens
tctaagaaatatctgt

SEQ ID NO: 6426338 - DNA, 22 bp, Homo sapiens
tctaagaaatatctgtgaaata

SEQ ID NO: 6426339 - DNA, 13 bp, Homo sapiens
tctaagaaatcaa

SEQ ID NO: 6426340 - DNA, 23 bp, Homo sapiens
tctaagaaatggctttccacatc

SEQ ID NO: 6426341 - DNA, 12 bp, Homo sapiens
tctaagaaattg

SEQ ID NO: 6426342 - DNA, 18 bp, Homo sapiens
tctaagaactctttgcct

SEQ ID NO: 6426343 - DNA, 18 bp, Homo sapiens
tctaagaagctgcaataa

SEQ ID NO: 6426344 - DNA, 17 bp, Homo sapiens
tctaagaatacagcttt

SEQ ID NO: 6426345 - DNA, 17 bp, Homo sapiens
tctaagacccaaagtgg

SEQ ID NO: 6426346 - DNA, 21 bp, Homo sapiens
tctaagactcaaatgttctaa

SEQ ID NO: 6426347 - DNA, 15 bp, Homo sapiens
tctaagactctgtgt

SEQ ID NO: 6426348 - DNA, 20 bp, Homo sapiens
tctaagacttactctaagat

SEQ ID NO: 6426349 - DNA, 20 bp, Homo sapiens
tctaagagaacaatgtgcta

SEQ ID NO: 6426350 - DNA, 15 bp, Homo sapiens
tctaagagacctgaa

SEQ ID NO: 6426351 - DNA, 17 bp, Homo sapiens
tctaagagcaattctgg

SEQ ID NO: 6426352 - DNA, 15 bp, Homo sapiens
tctaagagcagagtc

SEQ ID NO: 6426353 - DNA, 18 bp, Homo sapiens
tctaagatacactgcact

SEQ ID NO: 6426354 - DNA, 21 bp, Homo sapiens
tctaagatagtaacaatgaag

SEQ ID NO: 6426355 - DNA, 19 bp, Homo sapiens
tctaagatcttagattctc

SEQ ID NO: 6426356 - DNA, 21 bp, Homo sapiens
tctaagatgaatccaaatgtg

SEQ ID NO: 6426357 - DNA, 22 bp, Homo sapiens
tctaagatgccagcatatactg

SEQ ID NO: 6426358 - DNA, 19 bp, Homo sapiens
tctaagatgtgatattcta

SEQ ID NO: 6426359 - DNA, 21 bp, Homo sapiens
tctaagatgtgatattctaag

SEQ ID NO: 6426360 - DNA, 22 bp, Homo sapiens
tctaagatgtgatattctaaga

SEQ ID NO: 6426361 - DNA, 24 bp, Homo sapiens
tctaagatgtgatattctaagact

SEQ ID NO: 6426362 - DNA, 14 bp, Homo sapiens
tctaagatgttata

SEQ ID NO: 6426363 - DNA, 17 bp, Homo sapiens
tctaagattctaaaggt

SEQ ID NO: 6426364 - DNA, 19 bp, Homo sapiens
tctaagattctagatcaga

SEQ ID NO: 6426365 - DNA, 12 bp, Homo sapiens
tctaagattctg

SEQ ID NO: 6426366 - DNA, 23 bp, Homo sapiens
tctaagcaaccacactgcttggc

SEQ ID NO: 6426367 - DNA, 19 bp, Homo sapiens
tctaagcaagatgttttgt

SEQ ID NO: 6426368 - DNA, 17 bp, Homo sapiens
tctaagcaagtgaactc

SEQ ID NO: 6426369 - DNA, 23 bp, Homo sapiens
tctaagcaagtgaactcatccct

SEQ ID NO: 6426370 - DNA, 16 bp, Homo sapiens
tctaagcaatttcttg

SEQ ID NO: 6426371 - DNA, 14 bp, Homo sapiens
tctaagcagcattt

SEQ ID NO: 6426372 - DNA, 14 bp, Homo sapiens
tctaagcagccagg

SEQ ID NO: 6426373 - DNA, 21 bp, Homo sapiens
tctaagcagctggtcttttct

SEQ ID NO: 6426374 - DNA, 20 bp, Homo sapiens
tctaagcagttgcaatgatc

SEQ ID NO: 6426375 - DNA, 19 bp, Homo sapiens
tctaagcagttttgtaaat

SEQ ID NO: 6426376 - DNA, 12 bp, Homo sapiens
tctaagcccagg

SEQ ID NO: 6426377 - DNA, 14 bp, Homo sapiens
tctaagcccaggat

SEQ ID NO: 6426378 - DNA, 16 bp, Homo sapiens
tctaagcccaggatct

SEQ ID NO: 6426379 - DNA, 17 bp, Homo sapiens
tctaagcccaggatctc

SEQ ID NO: 6426380 - DNA, 20 bp, Homo sapiens
tctaagccctgttctcctgt

SEQ ID NO: 6426381 - DNA, 23 bp, Homo sapiens
tctaagcctatacgtttctgtgg

SEQ ID NO: 6426382 - DNA, 15 bp, Homo sapiens
tctaagcctgaaggg

SEQ ID NO: 6426383 - DNA, 14 bp, Homo sapiens
tctaagcctggctt

SEQ ID NO: 6426384 - DNA, 21 bp, Homo sapiens
tctaagctcagtgctctctcc

SEQ ID NO: 6426385 - DNA, 19 bp, Homo sapiens
tctaagctgcagcttcctg

SEQ ID NO: 6426386 - DNA, 14 bp, Homo sapiens
tctaagctgtgtgc

SEQ ID NO: 6426387 - DNA, 16 bp, Homo sapiens
tctaagctgtgtgcag

SEQ ID NO: 6426388 - DNA, 11 bp, Homo sapiens
tctaagctgtt

SEQ ID NO: 6426389 - DNA, 19 bp, Homo sapiens
tctaagcttatttctaact

SEQ ID NO: 6426390 - DNA, 20 bp, Homo sapiens
tctaagcttatttctaacta

SEQ ID NO: 6426391 - DNA, 23 bp, Homo sapiens
tctaaggaaatggagaagctctg

SEQ ID NO: 6426392 - DNA, 13 bp, Homo sapiens
tctaaggaatgca

SEQ ID NO: 6426393 - DNA, 21 bp, Homo sapiens
tctaaggacctgaaattccaa

SEQ ID NO: 6426394 - DNA, 18 bp, Homo sapiens
tctaaggagcaaatacct

SEQ ID NO: 6426395 - DNA, 19 bp, Homo sapiens
tctaaggatagcctttgta

SEQ ID NO: 6426396 - DNA, 20 bp, Homo sapiens
tctaaggatagcctttgtag

SEQ ID NO: 6426397 - DNA, 23 bp, Homo sapiens
tctaaggatgtcacagggccaac

SEQ ID NO: 6426398 - DNA, 19 bp, Homo sapiens
tctaaggcatgctcccagc

SEQ ID NO: 6426399 - DNA, 18 bp, Homo sapiens
tctaaggccctttttcct

SEQ ID NO: 6426400 - DNA, 13 bp, Homo sapiens
tctaaggctctga

SEQ ID NO: 6426401 - DNA, 16 bp, Homo sapiens
tctaaggctctgagag

SEQ ID NO: 6426402 - DNA, 16 bp, Homo sapiens
tctaaggctgtttgct

SEQ ID NO: 6426403 - DNA, 17 bp, Homo sapiens
tctaagggaaaaagttg

SEQ ID NO: 6426404 - DNA, 15 bp, Homo sapiens
tctaaggtaacaaat

SEQ ID NO: 6426405 - DNA, 12 bp, Homo sapiens
tctaaggtactg

SEQ ID NO: 6426406 - DNA, 14 bp, Homo sapiens
tctaaggtactgtg

SEQ ID NO: 6426407 - DNA, 15 bp, Homo sapiens
tctaaggtctatcaa

SEQ ID NO: 6426408 - DNA, 18 bp, Homo sapiens
tctaaggtctcatgctgt

SEQ ID NO: 6426409 - DNA, 21 bp, Homo sapiens
tctaagtaaaaccacagcagt

SEQ ID NO: 6426410 - DNA, 15 bp, Homo sapiens
tctaagtaaatacaa

SEQ ID NO: 6426411 - DNA, 22 bp, Homo sapiens
tctaagtacctttcctacattt

SEQ ID NO: 6426412 - DNA, 21 bp, Homo sapiens
tctaagtagagtatattgaaa

SEQ ID NO: 6426413 - DNA, 15 bp, Homo sapiens
tctaagtatatgtga

SEQ ID NO: 6426414 - DNA, 14 bp, Homo sapiens
tctaagtatttaaa

SEQ ID NO: 6426415 - DNA, 14 bp, Homo sapiens
tctaagtctgttat

SEQ ID NO: 6426416 - DNA, 18 bp, Homo sapiens
tctaagtctgttattgtt

SEQ ID NO: 6426417 - DNA, 17 bp, Homo sapiens
tctaagtgagatgtttg

SEQ ID NO: 6426418 - DNA, 17 bp, Homo sapiens
tctaagtgctgctgtgg

SEQ ID NO: 6426419 - DNA, 18 bp, Homo sapiens
tctaagtgctgctgtgga

SEQ ID NO: 6426420 - DNA, 19 bp, Homo sapiens
tctaagtgctgctgtggag

SEQ ID NO: 6426421 - DNA, 21 bp, Homo sapiens
tctaagtgggcattgccatgt

SEQ ID NO: 6426422 - DNA, 14 bp, Homo sapiens
tctaagtgtaaaag

SEQ ID NO: 6426423 - DNA, 14 bp, Homo sapiens
tctaagtgtaacct

SEQ ID NO: 6426424 - DNA, 21 bp, Homo sapiens
tctaagtgtaacctcagtatt

SEQ ID NO: 6426425 - DNA, 16 bp, Homo sapiens
tctaagttaatttaaa

SEQ ID NO: 6426426 - DNA, 20 bp, Homo sapiens
tctaagttaatttaaagttg

SEQ ID NO: 6426427 - DNA, 16 bp, Homo sapiens
tctaagttagactctt

SEQ ID NO: 6426428 - DNA, 23 bp, Homo sapiens
tctaagttatgactgtgaaatga

SEQ ID NO: 6426429 - DNA, 16 bp, Homo sapiens
tctaagttatgtacgt

SEQ ID NO: 6426430 - DNA, 17 bp, Homo sapiens
tctaagttccactgagc

SEQ ID NO: 6426431 - DNA, 12 bp, Homo sapiens
tctaagtttcta

SEQ ID NO: 6426432 - DNA, 17 bp, Homo sapiens
tctaagtttctaagatt

SEQ ID NO: 6426433 - DNA, 22 bp, Homo sapiens
tctaagtttctaagattctaaa

SEQ ID NO: 6426434 - DNA, 23 bp, Homo sapiens
tctaagttttagggtacatgtgc

SEQ ID NO: 6426435 - DNA, 16 bp, Homo sapiens
tctaataaaattcaga

SEQ ID NO: 6426436 - DNA, 14 bp, Homo sapiens
tctaataaacactg

SEQ ID NO: 6426437 - DNA, 16 bp, Homo sapiens
tctaataaacttggat

SEQ ID NO: 6426438 - DNA, 14 bp, Homo sapiens
tctaataaacttta

SEQ ID NO: 6426439 - DNA, 22 bp, Homo sapiens
tctaataaagagatagttctaa

SEQ ID NO: 6426440 - DNA, 13 bp, Homo sapiens
tctaataaagcca

SEQ ID NO: 6426441 - DNA, 15 bp, Homo sapiens
tctaataaagccatt

SEQ ID NO: 6426442 - DNA, 23 bp, Homo sapiens
tctaataaagctcctctgctcca

SEQ ID NO: 6426443 - DNA, 19 bp, Homo sapiens
tctaataaagtagttatta

SEQ ID NO: 6426444 - DNA, 20 bp, Homo sapiens
tctaataaatattgacttct

SEQ ID NO: 6426445 - DNA, 22 bp, Homo sapiens
tctaataaatcagtgaactgtt

SEQ ID NO: 6426446 - DNA, 13 bp, Homo sapiens
tctaataaattat

SEQ ID NO: 6426447 - DNA, 14 bp, Homo sapiens
tctaataataaata

SEQ ID NO: 6426448 - DNA, 22 bp, Homo sapiens
tctaataataaatagttcttct

SEQ ID NO: 6426449 - DNA, 17 bp, Homo sapiens
tctaatacctctgtgtg

SEQ ID NO: 6426450 - DNA, 18 bp, Homo sapiens
tctaatactaatgttatt

SEQ ID NO: 6426451 - DNA, 14 bp, Homo sapiens
tatttttgaattct

SEQ ID NO: 6426452 - DNA, 14 bp, Homo sapiens
tatttttgacagaa

SEQ ID NO: 6426453 - DNA, 15 bp, Homo sapiens
tatttttgacagaat

SEQ ID NO: 6426454 - DNA, 19 bp, Homo sapiens
tatttttgacagaatatgt

SEQ ID NO: 6426455 - DNA, 18 bp, Homo sapiens
tatttttgacatggaaat

SEQ ID NO: 6426456 - DNA, 16 bp, Homo sapiens
tatttttgactgtttt

SEQ ID NO: 6426457 - DNA, 17 bp, Homo sapiens
tatttttgagcaggagc

SEQ ID NO: 6426458 - DNA, 19 bp, Homo sapiens
tatttttgataccttcaat

SEQ ID NO: 6426459 - DNA, 21 bp, Homo sapiens
tatttttgcactggaatatct

SEQ ID NO: 6426460 - DNA, 12 bp, Homo sapiens
tatttttgcatg

SEQ ID NO: 6426461 - DNA, 18 bp, Homo sapiens
tatttttgctctccctcc

SEQ ID NO: 6426462 - DNA, 12 bp, Homo sapiens
tatttttggagg

SEQ ID NO: 6426463 - DNA, 16 bp, Homo sapiens
tatttttggcaaagcc

SEQ ID NO: 6426464 - DNA, 14 bp, Homo sapiens
tatttttggggcat

SEQ ID NO: 6426465 - DNA, 15 bp, Homo sapiens
tatttttggggcatc

SEQ ID NO: 6426466 - DNA, 21 bp, Homo sapiens
tatttttgggggctttccttt

SEQ ID NO: 6426467 - DNA, 17 bp, Homo sapiens
tatttttgtaaaaaggg

SEQ ID NO: 6426468 - DNA, 14 bp, Homo sapiens
tatttttgtaatgt

SEQ ID NO: 6426469 - DNA, 21 bp, Homo sapiens
tatttttgtaatgtgaaaagt

SEQ ID NO: 6426470 - DNA, 23 bp, Homo sapiens
tatttttgtaatgtgaaaagtat

SEQ ID NO: 6426471 - DNA, 16 bp, Homo sapiens
tatttttgtaattcct

SEQ ID NO: 6426472 - DNA, 20 bp, Homo sapiens
tatttttgtaattttaaata

SEQ ID NO: 6426473 - DNA, 13 bp, Homo sapiens
tatttttgtacat

SEQ ID NO: 6426474 - DNA, 14 bp, Homo sapiens
tatttttgtacata

SEQ ID NO: 6426475 - DNA, 13 bp, Homo sapiens
tatttttgtactt

SEQ ID NO: 6426476 - DNA, 17 bp, Homo sapiens
tatttttgtagagccag

SEQ ID NO: 6426477 - DNA, 17 bp, Homo sapiens
tatttttgtatgccttt

SEQ ID NO: 6426478 - DNA, 14 bp, Homo sapiens
tatttttgtccctg

SEQ ID NO: 6426479 - DNA, 14 bp, Homo sapiens
tatttttgtggaca

SEQ ID NO: 6426480 - DNA, 15 bp, Homo sapiens
tatttttgtgtaggt

SEQ ID NO: 6426481 - DNA, 16 bp, Homo sapiens
tatttttgtgtttcta

SEQ ID NO: 6426482 - DNA, 22 bp, Homo sapiens
tatttttgttgttgttgtttgt

SEQ ID NO: 6426483 - DNA, 14 bp, Homo sapiens
tatttttgtttaca

SEQ ID NO: 6426484 - DNA, 20 bp, Homo sapiens
tatttttgtttcttccaaag

SEQ ID NO: 6426485 - DNA, 18 bp, Homo sapiens
tattttttaaaataattt

SEQ ID NO: 6426486 - DNA, 17 bp, Homo sapiens
tattttttaaaattcta

SEQ ID NO: 6426487 - DNA, 15 bp, Homo sapiens
tattttttaaagact

SEQ ID NO: 6426488 - DNA, 18 bp, Homo sapiens
tattttttaaatcttgac

SEQ ID NO: 6426489 - DNA, 21 bp, Homo sapiens
tattttttaaatttacagaat

SEQ ID NO: 6426490 - DNA, 15 bp, Homo sapiens
tattttttaagtatt

SEQ ID NO: 6426491 - DNA, 16 bp, Homo sapiens
tattttttaatcattt

SEQ ID NO: 6426492 - DNA, 19 bp, Homo sapiens
tattttttaatgtgagaca

SEQ ID NO: 6426493 - DNA, 16 bp, Homo sapiens
tattttttaatttgat

SEQ ID NO: 6426494 - DNA, 20 bp, Homo sapiens
tattttttacttttcacact

SEQ ID NO: 6426495 - DNA, 14 bp, Homo sapiens
tattttttatacag

SEQ ID NO: 6426496 - DNA, 16 bp, Homo sapiens
tattttttatatatac

SEQ ID NO: 6426497 - DNA, 20 bp, Homo sapiens
tattttttatcattgaaaca

SEQ ID NO: 6426498 - DNA, 17 bp, Homo sapiens
tattttttattgttttc

SEQ ID NO: 6426499 - DNA, 22 bp, Homo sapiens
tattttttcagactgtgcaata

SEQ ID NO: 6426500 - DNA, 19 bp, Homo sapiens
tattttttcatagtcccac

SEQ ID NO: 6426501 - DNA, 13 bp, Homo sapiens
tattttttcctta

SEQ ID NO: 6426502 - DNA, 14 bp, Homo sapiens
tattttttctacac

SEQ ID NO: 6426503 - DNA, 18 bp, Homo sapiens
tattttttctacacagta

SEQ ID NO: 6426504 - DNA, 12 bp, Homo sapiens
tattttttctat

SEQ ID NO: 6426505 - DNA, 12 bp, Homo sapiens
tattttttctgt

SEQ ID NO: 6426506 - DNA, 18 bp, Homo sapiens
tattttttcttgcattga

SEQ ID NO: 6426507 - DNA, 15 bp, Homo sapiens
tattttttcttttgt

SEQ ID NO: 6426508 - DNA, 14 bp, Homo sapiens
tattttttgacact

SEQ ID NO: 6426509 - DNA, 13 bp, Homo sapiens
tattttttgagtg

SEQ ID NO: 6426510 - DNA, 19 bp, Homo sapiens
tattttttgggccattacc

SEQ ID NO: 6426511 - DNA, 17 bp, Homo sapiens
tattttttgtaactctt

SEQ ID NO: 6426512 - DNA, 17 bp, Homo sapiens
tattttttgtatagtat

SEQ ID NO: 6426513 - DNA, 12 bp, Homo sapiens
tattttttgtga

SEQ ID NO: 6426514 - DNA, 15 bp, Homo sapiens
tattttttgtgaatg

SEQ ID NO: 6426515 - DNA, 15 bp, Homo sapiens
tattttttgtttgta

SEQ ID NO: 6426516 - DNA, 16 bp, Homo sapiens
tattttttgtttgtat

SEQ ID NO: 6426517 - DNA, 19 bp, Homo sapiens
tatttttttaaaatcacta

SEQ ID NO: 6426518 - DNA, 16 bp, Homo sapiens
tatttttttaaaattt

SEQ ID NO: 6426519 - DNA, 22 bp, Homo sapiens
tatttttttaaacaaaatttca

SEQ ID NO: 6426520 - DNA, 16 bp, Homo sapiens
tatttttttaaatcaa

SEQ ID NO: 6426521 - DNA, 22 bp, Homo sapiens
tatttttttaactgaaaatgta

SEQ ID NO: 6426522 - DNA, 19 bp, Homo sapiens
tatttttttaagctgtaaa

SEQ ID NO: 6426523 - DNA, 15 bp, Homo sapiens
tatttttttactaat

SEQ ID NO: 6426524 - DNA, 14 bp, Homo sapiens
tatttttttccaag

SEQ ID NO: 6426525 - DNA, 16 bp, Homo sapiens
tatttttttcccatga

SEQ ID NO: 6426526 - DNA, 12 bp, Homo sapiens
tatttttttcct

SEQ ID NO: 6426527 - DNA, 19 bp, Homo sapiens
tatttttttccttacataa

SEQ ID NO: 6426528 - DNA, 23 bp, Homo sapiens
tatttttttcctttgcattcatc

SEQ ID NO: 6426529 - DNA, 14 bp, Homo sapiens
tatttttttctaat

SEQ ID NO: 6426530 - DNA, 23 bp, Homo sapiens
tatttttttctacataattgtga

SEQ ID NO: 6426531 - DNA, 14 bp, Homo sapiens
tatttttttctagc

SEQ ID NO: 6426532 - DNA, 22 bp, Homo sapiens
tatttttttctagctataacaa

SEQ ID NO: 6426533 - DNA, 15 bp, Homo sapiens
tatttttttctctat

SEQ ID NO: 6426534 - DNA, 13 bp, Homo sapiens
tatttttttctga

SEQ ID NO: 6426535 - DNA, 16 bp, Homo sapiens
tatttttttctgtaaa

SEQ ID NO: 6426536 - DNA, 17 bp, Homo sapiens
tatttttttgagactga

SEQ ID NO: 6426537 - DNA, 19 bp, Homo sapiens
tatttttttgcaagtgaag

SEQ ID NO: 6426538 - DNA, 16 bp, Homo sapiens
tatttttttgttgctg

SEQ ID NO: 6426539 - DNA, 17 bp, Homo sapiens
tattttttttaaagaaa

SEQ ID NO: 6426540 - DNA, 18 bp, Homo sapiens
tattttttttaatattat

SEQ ID NO: 6426541 - DNA, 19 bp, Homo sapiens
tattttttttaatattatt

SEQ ID NO: 6426542 - DNA, 16 bp, Homo sapiens
tattttttttaattgt

SEQ ID NO: 6426543 - DNA, 18 bp, Homo sapiens
tattttttttcaaaatga

SEQ ID NO: 6426544 - DNA, 18 bp, Homo sapiens
tatttttttttaagctct

SEQ ID NO: 6426545 - DNA, 16 bp, Homo sapiens
tatttttttttctaag

SEQ ID NO: 6426546 - DNA, 22 bp, Homo sapiens
tatttttttttctttttaaagt

SEQ ID NO: 6426547 - DNA, 13 bp, Homo sapiens
tatttttttttgg

SEQ ID NO: 6426548 - DNA, 21 bp, Homo sapiens
tattttttttttccattagta

SEQ ID NO: 6426549 - DNA, 16 bp, Homo sapiens
tatttttttttttgtt

SEQ ID NO: 6426550 - DNA, 21 bp, Homo sapiens
tcaaaaaaaaaaaaaaagact

SEQ ID NO: 6426551 - DNA, 22 bp, Homo sapiens
tcaaaaaaaaaaaaaacaacaa

SEQ ID NO: 6426552 - DNA, 18 bp, Homo sapiens
tcaaaaaaaaaaagaaaa

SEQ ID NO: 6426553 - DNA, 19 bp, Homo sapiens
tcaaaaaaaaaaagattct

SEQ ID NO: 6426554 - DNA, 16 bp, Homo sapiens
tcaaaaaaacactagt

SEQ ID NO: 6426555 - DNA, 16 bp, Homo sapiens
tcaaaaaaagccttta

SEQ ID NO: 6426556 - DNA, 14 bp, Homo sapiens
tcaaaaaaatgttt

SEQ ID NO: 6426557 - DNA, 18 bp, Homo sapiens
tcaaaaaactctctccca

SEQ ID NO: 6426558 - DNA, 13 bp, Homo sapiens
tcaaaaaagagga

SEQ ID NO: 6426559 - DNA, 17 bp, Homo sapiens
tcaaaaaataattagtt

SEQ ID NO: 6426560 - DNA, 19 bp, Homo sapiens
tcaaaaaattatttgctat

SEQ ID NO: 6426561 - DNA, 17 bp, Homo sapiens
tcaaaaacaaagctgat

SEQ ID NO: 6426562 - DNA, 16 bp, Homo sapiens
tcaaaaacaggcaggt

SEQ ID NO: 6426563 - DNA, 20 bp, Homo sapiens
tcaaaaacaggtttttgatt

SEQ ID NO: 6426564 - DNA, 21 bp, Homo sapiens
tcaaaaacatgcttttccaaa

SEQ ID NO: 6426565 - DNA, 15 bp, Homo sapiens
tcaaaaactgacttt

SEQ ID NO: 6426566 - DNA, 13 bp, Homo sapiens
tcaaaaactgcct

SEQ ID NO: 6426567 - DNA, 17 bp, Homo sapiens
tcaaaaactttggagtc

SEQ ID NO: 6426568 - DNA, 11 bp, Homo sapiens
tcaaaaagaaa

SEQ ID NO: 6426569 - DNA, 17 bp, Homo sapiens
tcaaaaagaaaaatcaa

SEQ ID NO: 6426570 - DNA, 19 bp, Homo sapiens
tcaaaaagaactaaatatg

SEQ ID NO: 6426571 - DNA, 23 bp, Homo sapiens
tcaaaaagagtcttaattttcta

SEQ ID NO: 6426572 - DNA, 13 bp, Homo sapiens
tcaaaaagcattt

SEQ ID NO: 6426573 - DNA, 18 bp, Homo sapiens
tcaaaaagccacagcaga

SEQ ID NO: 6426574 - DNA, 22 bp, Homo sapiens
tcaaaaagccacagcagagcat

SEQ ID NO: 6426575 - DNA, 17 bp, Homo sapiens
tcaaaaagtaatgattt

SEQ ID NO: 6426576 - DNA, 16 bp, Homo sapiens
tcaaaaagtataaatt

SEQ ID NO: 6426577 - DNA, 12 bp, Homo sapiens
tcaaaaagtatt

SEQ ID NO: 6426578 - DNA, 21 bp, Homo sapiens
tcaaaaagtattatcattgct

SEQ ID NO: 6426579 - DNA, 11 bp, Homo sapiens
tcaaaaagtca

SEQ ID NO: 6426580 - DNA, 13 bp, Homo sapiens
tcaaaaagtcatt

SEQ ID NO: 6426581 - DNA, 12 bp, Homo sapiens
tcaaaaagtgtt

SEQ ID NO: 6426582 - DNA, 22 bp, Homo sapiens
tcaaaaataaaaaatctgaaga

SEQ ID NO: 6426583 - DNA, 17 bp, Homo sapiens
tcaaaaataaactagtt

SEQ ID NO: 6426584 - DNA, 21 bp, Homo sapiens
tcaaaaataaactagtttcca

SEQ ID NO: 6426585 - DNA, 18 bp, Homo sapiens
tcaaaaataaattagaaa

SEQ ID NO: 6426586 - DNA, 13 bp, Homo sapiens
tcaaaaataatat

SEQ ID NO: 6426587 - DNA, 14 bp, Homo sapiens
tcaaaaataatgtg

SEQ ID NO: 6426588 - DNA, 21 bp, Homo sapiens
tcaaaaatacaaaataaaaac

SEQ ID NO: 6426589 - DNA, 15 bp, Homo sapiens
tcaaaaatataactt

SEQ ID NO: 6426590 - DNA, 20 bp, Homo sapiens
tcaaaaatatttttatgtga

SEQ ID NO: 6426591 - DNA, 24 bp, Homo sapiens
tcaaaaatccttatgcatgaaatg

SEQ ID NO: 6426592 - DNA, 11 bp, Homo sapiens
tcaaaaatctg

SEQ ID NO: 6426593 - DNA, 21 bp, Homo sapiens
tcaaaaatgattttattacct

SEQ ID NO: 6426594 - DNA, 20 bp, Homo sapiens
tcaaaaatgccacttaacag

SEQ ID NO: 6426595 - DNA, 14 bp, Homo sapiens
tcaaaaatgctgtt

SEQ ID NO: 6426596 - DNA, 23 bp, Homo sapiens
tcaaaaatgtacaaaataaagtt

SEQ ID NO: 6426597 - DNA, 18 bp, Homo sapiens
tcaaaaattacactacaa

SEQ ID NO: 6426598 - DNA, 19 bp, Homo sapiens
tcaaaaattacactacaag

SEQ ID NO: 6426599 - DNA, 18 bp, Homo sapiens
tcaaaaattgaagagaga

SEQ ID NO: 6426600 - DNA, 21 bp, Homo sapiens
tcaaaaattgaagagagatat

SEQ ID NO: 6426601 - DNA, 18 bp, Homo sapiens
tcaaaacaaaacaaaaca

SEQ ID NO: 6426602 - DNA, 16 bp, Homo sapiens
tcaaaacaaaggccta

SEQ ID NO: 6426603 - DNA, 13 bp, Homo sapiens
tcaaaacacacta

SEQ ID NO: 6426604 - DNA, 19 bp, Homo sapiens
tcaaaacacactactacct

SEQ ID NO: 6426605 - DNA, 20 bp, Homo sapiens
tcaaaacacactactacctc

SEQ ID NO: 6426606 - DNA, 21 bp, Homo sapiens
tcaaaacacatctttcctgtc

SEQ ID NO: 6426607 - DNA, 20 bp, Homo sapiens
tcaaaacacccaaaaatatc

SEQ ID NO: 6426608 - DNA, 20 bp, Homo sapiens
tcaaaacagaagcagcttct

SEQ ID NO: 6426609 - DNA, 19 bp, Homo sapiens
tcaaaacagtcatattttt

SEQ ID NO: 6426610 - DNA, 17 bp, Homo sapiens
tcaaaacatatcaattc

SEQ ID NO: 6426611 - DNA, 21 bp, Homo sapiens
tcaaaacatatcaattcaaca

SEQ ID NO: 6426612 - DNA, 13 bp, Homo sapiens
tcaaaacattcca

SEQ ID NO: 6426613 - DNA, 16 bp, Homo sapiens
tcaaaacattccaaga

SEQ ID NO: 6426614 - DNA, 23 bp, Homo sapiens
tcaaaaccagcctcatgctctga

SEQ ID NO: 6426615 - DNA, 14 bp, Homo sapiens
tcaaaaccatctct

SEQ ID NO: 6426616 - DNA, 19 bp, Homo sapiens
tcaaaacccatctgggctc

SEQ ID NO: 6426617 - DNA, 16 bp, Homo sapiens
tcaaaacccttaaaag

SEQ ID NO: 6426618 - DNA, 19 bp, Homo sapiens
tcaaaacctgattggccac

SEQ ID NO: 6426619 - DNA, 23 bp, Homo sapiens
tcaaaacctgattggccactgga

SEQ ID NO: 6426620 - DNA, 20 bp, Homo sapiens
tcaaaacctgcagttaacag

SEQ ID NO: 6426621 - DNA, 17 bp, Homo sapiens
tcaaaacctgtgccagg

SEQ ID NO: 6426622 - DNA, 14 bp, Homo sapiens
tcaaaactacctgt

SEQ ID NO: 6426623 - DNA, 13 bp, Homo sapiens
tcaaaactatttt

SEQ ID NO: 6426624 - DNA, 18 bp, Homo sapiens
tcaaaactatttttgtaa

SEQ ID NO: 6426625 - DNA, 19 bp, Homo sapiens
tcaaaactccactcagcac

SEQ ID NO: 6426626 - DNA, 14 bp, Homo sapiens
tcaaaactgaagct

SEQ ID NO: 6426627 - DNA, 17 bp, Homo sapiens
tcaaaacttctgctttt

SEQ ID NO: 6426628 - DNA, 20 bp, Homo sapiens
tcaaaacttggacccttgga

SEQ ID NO: 6426629 - DNA, 23 bp, Homo sapiens
tcaaaacttggacccttggaaaa

SEQ ID NO: 6426630 - DNA, 18 bp, Homo sapiens
tcaaaactttaaacctgt

SEQ ID NO: 6426631 - DNA, 17 bp, Homo sapiens
tctaatagagaactttt

SEQ ID NO: 6426632 - DNA, 14 bp, Homo sapiens
tctaatagaggcag

SEQ ID NO: 6426633 - DNA, 15 bp, Homo sapiens
tctaatagaggcagt

SEQ ID NO: 6426634 - DNA, 21 bp, Homo sapiens
tctaatagcgggttactttca

SEQ ID NO: 6426635 - DNA, 22 bp, Homo sapiens
tctaatagggcaattaattcct

SEQ ID NO: 6426636 - DNA, 14 bp, Homo sapiens
tctaatagtataaa

SEQ ID NO: 6426637 - DNA, 16 bp, Homo sapiens
tctaatataatgactt

SEQ ID NO: 6426638 - DNA, 15 bp, Homo sapiens
tctaatatatatgaa

SEQ ID NO: 6426639 - DNA, 19 bp, Homo sapiens
tctaatatatatgaataaa

SEQ ID NO: 6426640 - DNA, 14 bp, Homo sapiens
tctaatatcattca

SEQ ID NO: 6426641 - DNA, 14 bp, Homo sapiens
tctaatatgattat

SEQ ID NO: 6426642 - DNA, 17 bp, Homo sapiens
tctaatatgattataca

SEQ ID NO: 6426643 - DNA, 18 bp, Homo sapiens
tctaatattaaaaatatg

SEQ ID NO: 6426644 - DNA, 17 bp, Homo sapiens
tctaatattcacatgtt

SEQ ID NO: 6426645 - DNA, 14 bp, Homo sapiens
tctaatattgcttc

SEQ ID NO: 6426646 - DNA, 16 bp, Homo sapiens
tctaatcacagtgttg

SEQ ID NO: 6426647 - DNA, 19 bp, Homo sapiens
tctaatcaggttgttaatg

SEQ ID NO: 6426648 - DNA, 20 bp, Homo sapiens
tctaatcaggttgttaatgt

SEQ ID NO: 6426649 - DNA, 15 bp, Homo sapiens
tctaatcataacata

SEQ ID NO: 6426650 - DNA, 17 bp, Homo sapiens
tctaatccttttcctta

SEQ ID NO: 6426651 - DNA, 18 bp, Homo sapiens
tctaatccttttccttat

SEQ ID NO: 6426652 - DNA, 19 bp, Homo sapiens
tctaatctagatatcgact

SEQ ID NO: 6426653 - DNA, 13 bp, Homo sapiens
tctaatctcttat

SEQ ID NO: 6426654 - DNA, 14 bp, Homo sapiens
tctaatctctttat

SEQ ID NO: 6426655 - DNA, 23 bp, Homo sapiens
tctaatctgagctgcagcctggc

SEQ ID NO: 6426656 - DNA, 14 bp, Homo sapiens
tctaatgaaaaaca

SEQ ID NO: 6426657 - DNA, 21 bp, Homo sapiens
tctaatgaaaaacaaaaagct

SEQ ID NO: 6426658 - DNA, 11 bp, Homo sapiens
tctaatgaaga

SEQ ID NO: 6426659 - DNA, 14 bp, Homo sapiens
tctaatgacccaga

SEQ ID NO: 6426660 - DNA, 21 bp, Homo sapiens
tctaatgagttgctggaaaat

SEQ ID NO: 6426661 - DNA, 17 bp, Homo sapiens
tctaatgattcaaatgt

SEQ ID NO: 6426662 - DNA, 19 bp, Homo sapiens
tctaatgattcaaatgttt

SEQ ID NO: 6426663 - DNA, 12 bp, Homo sapiens
tctaatgcaaca

SEQ ID NO: 6426664 - DNA, 16 bp, Homo sapiens
tctaatgcatatttat

SEQ ID NO: 6426665 - DNA, 21 bp, Homo sapiens
tctaatggattataatcagaa

SEQ ID NO: 6426666 - DNA, 21 bp, Homo sapiens
tctaatggcccctccatttat

SEQ ID NO: 6426667 - DNA, 22 bp, Homo sapiens
tctaatgggggcagtctcccct

SEQ ID NO: 6426668 - DNA, 20 bp, Homo sapiens
tctaatgggtatttaaacaa

SEQ ID NO: 6426669 - DNA, 13 bp, Homo sapiens
tctaatggtaact

SEQ ID NO: 6426670 - DNA, 12 bp, Homo sapiens
tctaatgtaaat

SEQ ID NO: 6426671 - DNA, 20 bp, Homo sapiens
tctaatgtaacttcctctta

SEQ ID NO: 6426672 - DNA, 17 bp, Homo sapiens
tctaatgtaagaaaatt

SEQ ID NO: 6426673 - DNA, 22 bp, Homo sapiens
tctaatgtaagaaaatttgaag

SEQ ID NO: 6426674 - DNA, 15 bp, Homo sapiens
tctaatgtattttat

SEQ ID NO: 6426675 - DNA, 13 bp, Homo sapiens
tctaatgtctgca

SEQ ID NO: 6426676 - DNA, 14 bp, Homo sapiens
tctaatgtctgcag

SEQ ID NO: 6426677 - DNA, 14 bp, Homo sapiens
tctaatgtcttcat

SEQ ID NO: 6426678 - DNA, 15 bp, Homo sapiens
tctaatgtcttcatt

SEQ ID NO: 6426679 - DNA, 20 bp, Homo sapiens
tctaatgtggttatttctct

SEQ ID NO: 6426680 - DNA, 12 bp, Homo sapiens
tctaatgtttaa

SEQ ID NO: 6426681 - DNA, 17 bp, Homo sapiens
tctaatgtttgcatata

SEQ ID NO: 6426682 - DNA, 19 bp, Homo sapiens
tctaatgtttgcatataag

SEQ ID NO: 6426683 - DNA, 16 bp, Homo sapiens
tctaatgtttgtgaga

SEQ ID NO: 6426684 - DNA, 13 bp, Homo sapiens
tctaattaaaatg

SEQ ID NO: 6426685 - DNA, 14 bp, Homo sapiens
tctaattaaaatgt

SEQ ID NO: 6426686 - DNA, 20 bp, Homo sapiens
tctaattaaaatgtgcagta

SEQ ID NO: 6426687 - DNA, 15 bp, Homo sapiens
tctaattaaaggctt

SEQ ID NO: 6426688 - DNA, 12 bp, Homo sapiens
tctaattaaatg

SEQ ID NO: 6426689 - DNA, 23 bp, Homo sapiens
tctaattaaccttactaattata

SEQ ID NO: 6426690 - DNA, 18 bp, Homo sapiens
tctaattaagaaaactat

SEQ ID NO: 6426691 - DNA, 22 bp, Homo sapiens
tctaattaatagccaaagattt

SEQ ID NO: 6426692 - DNA, 17 bp, Homo sapiens
tctaattaattgtaatc

SEQ ID NO: 6426693 - DNA, 14 bp, Homo sapiens
tctaattagaaatt

SEQ ID NO: 6426694 - DNA, 18 bp, Homo sapiens
tctaattagagaactgga

SEQ ID NO: 6426695 - DNA, 23 bp, Homo sapiens
tctaattagtctatcaaatgaaa

SEQ ID NO: 6426696 - DNA, 15 bp, Homo sapiens
tctaattcaactctg

SEQ ID NO: 6426697 - DNA, 16 bp, Homo sapiens
tctaattcacagtgct

SEQ ID NO: 6426698 - DNA, 13 bp, Homo sapiens
tctaattcagaca

SEQ ID NO: 6426699 - DNA, 18 bp, Homo sapiens
tctaattcatttactcac

SEQ ID NO: 6426700 - DNA, 18 bp, Homo sapiens
tctaattcccattttgca

SEQ ID NO: 6426701 - DNA, 13 bp, Homo sapiens
tctaattcctgtt

SEQ ID NO: 6426702 - DNA, 15 bp, Homo sapiens
tctaattcctgttgc

SEQ ID NO: 6426703 - DNA, 19 bp, Homo sapiens
tctaattctattaaagtgc

SEQ ID NO: 6426704 - DNA, 21 bp, Homo sapiens
tctaattcttcctttgtaaaa

SEQ ID NO: 6426705 - DNA, 13 bp, Homo sapiens
tctaattctttaa

SEQ ID NO: 6426706 - DNA, 14 bp, Homo sapiens
tctaattcttttca

SEQ ID NO: 6426707 - DNA, 14 bp, Homo sapiens
tctaattgccatgt

SEQ ID NO: 6426708 - DNA, 20 bp, Homo sapiens
tctaattgtaagtgaaatta

SEQ ID NO: 6426709 - DNA, 20 bp, Homo sapiens
tctaatttatacaaaataat

SEQ ID NO: 6426710 - DNA, 22 bp, Homo sapiens
tctaatttatcttgtctctggg

SEQ ID NO: 6426711 - DNA, 15 bp, Homo sapiens
tctaatttattaatc

SEQ ID NO: 6426712 - DNA, 19 bp, Homo sapiens
tctaatttcaaaaatataa

SEQ ID NO: 6426713 - DNA, 12 bp, Homo sapiens
tctaatttcaag

SEQ ID NO: 6426714 - DNA, 15 bp, Homo sapiens
tctaatttgcacctt

SEQ ID NO: 6426715 - DNA, 17 bp, Homo sapiens
tctaatttgcattgtgt

SEQ ID NO: 6426716 - DNA, 15 bp, Homo sapiens
tctaatttgctgctg

SEQ ID NO: 6426717 - DNA, 16 bp, Homo sapiens
tctaattttggataat

SEQ ID NO: 6426718 - DNA, 22 bp, Homo sapiens
tctaattttggataatattcat

SEQ ID NO: 6426719 - DNA, 14 bp, Homo sapiens
tctaattttgtgct

SEQ ID NO: 6426720 - DNA, 17 bp, Homo sapiens
tctaattttgtgctctt

SEQ ID NO: 6426721 - DNA, 19 bp, Homo sapiens
tctaattttgtgctctttc

SEQ ID NO: 6426722 - DNA, 23 bp, Homo sapiens
tctaattttgtgctctttcctgc

SEQ ID NO: 6426723 - DNA, 18 bp, Homo sapiens
tctaatttttattcataa

SEQ ID NO: 6426724 - DNA, 18 bp, Homo sapiens
tctacaaaacattaaact

SEQ ID NO: 6426725 - DNA, 12 bp, Homo sapiens
tctacaaaagaa

SEQ ID NO: 6426726 - DNA, 13 bp, Homo sapiens
tctacaaaagaag

SEQ ID NO: 6426727 - DNA, 15 bp, Homo sapiens
tctacaaacttttat

SEQ ID NO: 6426728 - DNA, 18 bp, Homo sapiens
tctacaaacttttataaa

SEQ ID NO: 6426729 - DNA, 23 bp, Homo sapiens
tctacaaagcactagagaatgca

SEQ ID NO: 6426730 - DNA, 18 bp, Homo sapiens
tctacaaatataagattt

SEQ ID NO: 6426731 - DNA, 22 bp, Homo sapiens
tctacaacataatgatactgaa

SEQ ID NO: 6426732 - DNA, 15 bp, Homo sapiens
tctacaaccagagcc

SEQ ID NO: 6426733 - DNA, 17 bp, Homo sapiens
tctacaaccagagcccc

SEQ ID NO: 6426734 - DNA, 22 bp, Homo sapiens
tctacaactgttttaaaacttt

SEQ ID NO: 6426735 - DNA, 20 bp, Homo sapiens
tctacaagaaagctgtggct

SEQ ID NO: 6426736 - DNA, 17 bp, Homo sapiens
tctacaagcatatttga

SEQ ID NO: 6426737 - DNA, 19 bp, Homo sapiens
tctacaagcatttgccctg

SEQ ID NO: 6426738 - DNA, 20 bp, Homo sapiens
tctacaagcatttgccctgt

SEQ ID NO: 6426739 - DNA, 23 bp, Homo sapiens
tctacaaggactttccaaatcca

SEQ ID NO: 6426740 - DNA, 16 bp, Homo sapiens
tctacaagtatatgtg

SEQ ID NO: 6426741 - DNA, 17 bp, Homo sapiens
tctacaagtatatgtga

SEQ ID NO: 6426742 - DNA, 15 bp, Homo sapiens
tctacaatacatata

SEQ ID NO: 6426743 - DNA, 13 bp, Homo sapiens
tctacaatatata

SEQ ID NO: 6426744 - DNA, 22 bp, Homo sapiens
tctacacagcagtatgaatgat

SEQ ID NO: 6426745 - DNA, 13 bp, Homo sapiens
tctacacagcctg

SEQ ID NO: 6426746 - DNA, 17 bp, Homo sapiens
tctacacagcctggact

SEQ ID NO: 6426747 - DNA, 18 bp, Homo sapiens
tctacacagtgggaactc

SEQ ID NO: 6426748 - DNA, 23 bp, Homo sapiens
tctacacagtgggaactctgaca

SEQ ID NO: 6426749 - DNA, 17 bp, Homo sapiens
tctacacatgttgcctt

SEQ ID NO: 6426750 - DNA, 14 bp, Homo sapiens
tctacacattgcta

SEQ ID NO: 6426751 - DNA, 21 bp, Homo sapiens
tctacacatttcatctaattt

SEQ ID NO: 6426752 - DNA, 18 bp, Homo sapiens
tctacaccaatgaaaaca

SEQ ID NO: 6426753 - DNA, 21 bp, Homo sapiens
tctacaccaatgaaaacatgt

SEQ ID NO: 6426754 - DNA, 21 bp, Homo sapiens
tctacacctcctttaagattt

SEQ ID NO: 6426755 - DNA, 16 bp, Homo sapiens
tctacaccttgctttt

SEQ ID NO: 6426756 - DNA, 23 bp, Homo sapiens
tctacacgcatgatggagctgat

SEQ ID NO: 6426757 - DNA, 19 bp, Homo sapiens
tctacacgtcctttcctga

SEQ ID NO: 6426758 - DNA, 17 bp, Homo sapiens
tctacactaagagagaa

SEQ ID NO: 6426759 - DNA, 15 bp, Homo sapiens
tctacactctcctgg

SEQ ID NO: 6426760 - DNA, 17 bp, Homo sapiens
tctacactctcctgggc

SEQ ID NO: 6426761 - DNA, 12 bp, Homo sapiens
tctacactgaaa

SEQ ID NO: 6426762 - DNA, 20 bp, Homo sapiens
tctacactgcaatcatatgt

SEQ ID NO: 6426763 - DNA, 21 bp, Homo sapiens
tctacactgggtgctgatcct

SEQ ID NO: 6426764 - DNA, 13 bp, Homo sapiens
tctacactgtgaa

SEQ ID NO: 6426765 - DNA, 14 bp, Homo sapiens
tctacactgtgaac

SEQ ID NO: 6426766 - DNA, 15 bp, Homo sapiens
tctacactgtgctga

SEQ ID NO: 6426767 - DNA, 21 bp, Homo sapiens
tctacactgtgctgagtctga

SEQ ID NO: 6426768 - DNA, 12 bp, Homo sapiens
tctacagaaaaa

SEQ ID NO: 6426769 - DNA, 21 bp, Homo sapiens
tctacagaaataacagctggg

SEQ ID NO: 6426770 - DNA, 17 bp, Homo sapiens
tctacagaacaaagaac

SEQ ID NO: 6426771 - DNA, 12 bp, Homo sapiens
tctacagaataa

SEQ ID NO: 6426772 - DNA, 18 bp, Homo sapiens
tctacagaataatccagt

SEQ ID NO: 6426773 - DNA, 14 bp, Homo sapiens
tctacagagaaaat

SEQ ID NO: 6426774 - DNA, 16 bp, Homo sapiens
tctacagagcttccct

SEQ ID NO: 6426775 - DNA, 18 bp, Homo sapiens
tctacagagcttccctga

SEQ ID NO: 6426776 - DNA, 21 bp, Homo sapiens
tctacagaggccatgggcctc

SEQ ID NO: 6426777 - DNA, 21 bp, Homo sapiens
tctacagatagagagttgttg

SEQ ID NO: 6426778 - DNA, 16 bp, Homo sapiens
tctacagatccttttt

SEQ ID NO: 6426779 - DNA, 19 bp, Homo sapiens
tctacagatcctttttcca

SEQ ID NO: 6426780 - DNA, 17 bp, Homo sapiens
tctacagatgtcccatt

SEQ ID NO: 6426781 - DNA, 16 bp, Homo sapiens
tctacagcaaatttat

SEQ ID NO: 6426782 - DNA, 20 bp, Homo sapiens
tctacagcaccttaaaaatt

SEQ ID NO: 6426783 - DNA, 23 bp, Homo sapiens
tctacagccagtaaggcagctct

SEQ ID NO: 6426784 - DNA, 12 bp, Homo sapiens
tctacagcctaa

SEQ ID NO: 6426785 - DNA, 21 bp, Homo sapiens
tctacagctccagatgtttct

SEQ ID NO: 6426786 - DNA, 12 bp, Homo sapiens
tctacagctccc

SEQ ID NO: 6426787 - DNA, 15 bp, Homo sapiens
tctacagctccccca

SEQ ID NO: 6426788 - DNA, 22 bp, Homo sapiens
tctacaggcccggcccagccta

SEQ ID NO: 6426789 - DNA, 15 bp, Homo sapiens
tctacaggcctgcag

SEQ ID NO: 6426790 - DNA, 20 bp, Homo sapiens
tctacaggcctttcaggaag

SEQ ID NO: 6426791 - DNA, 19 bp, Homo sapiens
tctacagtactgacagaaa

SEQ ID NO: 6426792 - DNA, 17 bp, Homo sapiens
tctacagtacttccaga

SEQ ID NO: 6426793 - DNA, 17 bp, Homo sapiens
tctacagtagctgctac

SEQ ID NO: 6426794 - DNA, 23 bp, Homo sapiens
tctacagtcgtaaaagagataat

SEQ ID NO: 6426795 - DNA, 18 bp, Homo sapiens
tctacagtctcgtctctt

SEQ ID NO: 6426796 - DNA, 12 bp, Homo sapiens
tctacagtggtt

SEQ ID NO: 6426797 - DNA, 21 bp, Homo sapiens
tctacagtggttttatactga

SEQ ID NO: 6426798 - DNA, 13 bp, Homo sapiens
tctacagtgtcct

SEQ ID NO: 6426799 - DNA, 14 bp, Homo sapiens
tctacataatggaa

SEQ ID NO: 6426800 - DNA, 15 bp, Homo sapiens
tctacataattgtga

SEQ ID NO: 6426801 - DNA, 17 bp, Homo sapiens
tctacataattgtgacc

SEQ ID NO: 6426802 - DNA, 16 bp, Homo sapiens
tctacatactatggaa

SEQ ID NO: 6426803 - DNA, 15 bp, Homo sapiens
tctacatcttctgcc

SEQ ID NO: 6426804 - DNA, 16 bp, Homo sapiens
tctacatcttctgcct

SEQ ID NO: 6426805 - DNA, 22 bp, Homo sapiens
tctacatcttttttcacaaatt

SEQ ID NO: 6426806 - DNA, 15 bp, Homo sapiens
tctacatgactgggc

SEQ ID NO: 6426807 - DNA, 17 bp, Homo sapiens
tctacatgactgggcct

SEQ ID NO: 6426808 - DNA, 21 bp, Homo sapiens
tctacatgaggaactgtagat

SEQ ID NO: 6426809 - DNA, 20 bp, Homo sapiens
tctacatgcaaatctggctt

SEQ ID NO: 6426810 - DNA, 14 bp, Homo sapiens
tctacatgtctaga

SEQ ID NO: 6426811 - DNA, 17 bp, Homo sapiens
tcaaaagaaatagaaaa

SEQ ID NO: 6426812 - DNA, 21 bp, Homo sapiens
tcaaaagaagcctagaaaaga

SEQ ID NO: 6426813 - DNA, 14 bp, Homo sapiens
tcaaaagacaattc

SEQ ID NO: 6426814 - DNA, 15 bp, Homo sapiens
tcaaaagacaattct

SEQ ID NO: 6426815 - DNA, 23 bp, Homo sapiens
tcaaaagacaattctttatacaa

SEQ ID NO: 6426816 - DNA, 21 bp, Homo sapiens
tcaaaagagattaactgggat

SEQ ID NO: 6426817 - DNA, 23 bp, Homo sapiens
tcaaaagagccctggctctgccc

SEQ ID NO: 6426818 - DNA, 21 bp, Homo sapiens
tcaaaagaggttactttagtt

SEQ ID NO: 6426819 - DNA, 18 bp, Homo sapiens
tcaaaagcaaatgagatc

SEQ ID NO: 6426820 - DNA, 19 bp, Homo sapiens
tcaaaagctctctttggaa

SEQ ID NO: 6426821 - DNA, 16 bp, Homo sapiens
tcaaaagctgggcagg

SEQ ID NO: 6426822 - DNA, 14 bp, Homo sapiens
tcaaaagctttttg

SEQ ID NO: 6426823 - DNA, 17 bp, Homo sapiens
tcaaaaggaaaccaagt

SEQ ID NO: 6426824 - DNA, 17 bp, Homo sapiens
tcaaaaggaatgaactt

SEQ ID NO: 6426825 - DNA, 23 bp, Homo sapiens
tcaaaaggaatgaacttgttact

SEQ ID NO: 6426826 - DNA, 19 bp, Homo sapiens
tcaaaaggcactgtgaact

SEQ ID NO: 6426827 - DNA, 18 bp, Homo sapiens
tcaaaagggaagagtttt

SEQ ID NO: 6426828 - DNA, 20 bp, Homo sapiens
tcaaaagggccaaagaacca

SEQ ID NO: 6426829 - DNA, 20 bp, Homo sapiens
tcaaaaggtgattaaatatt

SEQ ID NO: 6426830 - DNA, 17 bp, Homo sapiens
tcaaaagtagaactttg

SEQ ID NO: 6426831 - DNA, 18 bp, Homo sapiens
tcaaaagtagaactttgt

SEQ ID NO: 6426832 - DNA, 23 bp, Homo sapiens
tcaaaagtagaactttgtatagt

SEQ ID NO: 6426833 - DNA, 14 bp, Homo sapiens
tcaaaagtattgaa

SEQ ID NO: 6426834 - DNA, 16 bp, Homo sapiens
tcaaaagtattttcct

SEQ ID NO: 6426835 - DNA, 16 bp, Homo sapiens
tcaaaagtccttagaa

SEQ ID NO: 6426836 - DNA, 19 bp, Homo sapiens
tcaaaagtgatcagcaatg

SEQ ID NO: 6426837 - DNA, 22 bp, Homo sapiens
tcaaaagtgatctgtcccctct

SEQ ID NO: 6426838 - DNA, 16 bp, Homo sapiens
tcaaaagtgcctcaag

SEQ ID NO: 6426839 - DNA, 13 bp, Homo sapiens
tcaaaagttccaa

SEQ ID NO: 6426840 - DNA, 16 bp, Homo sapiens
tcaaaagttgaaatta

SEQ ID NO: 6426841 - DNA, 20 bp, Homo sapiens
tcaaaagttggactaaatgc

SEQ ID NO: 6426842 - DNA, 20 bp, Homo sapiens
tcaaaataaaaagtgacaca

SEQ ID NO: 6426843 - DNA, 17 bp, Homo sapiens
tcaaaataaagaagtat

SEQ ID NO: 6426844 - DNA, 16 bp, Homo sapiens
tcaaaataaattgaaa

SEQ ID NO: 6426845 - DNA, 20 bp, Homo sapiens
tcaaaataagccatgctgct

SEQ ID NO: 6426846 - DNA, 17 bp, Homo sapiens
tcaaaataatctgaaat

SEQ ID NO: 6426847 - DNA, 18 bp, Homo sapiens
tcaaaataatctgaaatg

SEQ ID NO: 6426848 - DNA, 19 bp, Homo sapiens
tcaaaataattagctatat

SEQ ID NO: 6426849 - DNA, 13 bp, Homo sapiens
tcaaaataattct

SEQ ID NO: 6426850 - DNA, 14 bp, Homo sapiens
tcaaaataatttta

SEQ ID NO: 6426851 - DNA, 18 bp, Homo sapiens
tcaaaatacatttgtaag

SEQ ID NO: 6426852 - DNA, 18 bp, Homo sapiens
tcaaaatacgtgttcaaa

SEQ ID NO: 6426853 - DNA, 11 bp, Homo sapiens
tcaaaatacta

SEQ ID NO: 6426854 - DNA, 13 bp, Homo sapiens
tcaaaatactact

SEQ ID NO: 6426855 - DNA, 15 bp, Homo sapiens
tcaaaatacttcttt

SEQ ID NO: 6426856 - DNA, 21 bp, Homo sapiens
tcaaaatacttctttttcatt

SEQ ID NO: 6426857 - DNA, 14 bp, Homo sapiens
tcaaaatagaaaag

SEQ ID NO: 6426858 - DNA, 15 bp, Homo sapiens
tcaaaatagaaaagt

SEQ ID NO: 6426859 - DNA, 17 bp, Homo sapiens
tcaaaatagttctattt

SEQ ID NO: 6426860 - DNA, 20 bp, Homo sapiens
tcaaaatatattttcagtac

SEQ ID NO: 6426861 - DNA, 15 bp, Homo sapiens
tcaaaatatcctaag

SEQ ID NO: 6426862 - DNA, 21 bp, Homo sapiens
tcaaaatatgccccattcaac

SEQ ID NO: 6426863 - DNA, 15 bp, Homo sapiens
tcaaaatatgttctt

SEQ ID NO: 6426864 - DNA, 15 bp, Homo sapiens
tcaaaatattactca

SEQ ID NO: 6426865 - DNA, 14 bp, Homo sapiens
tcaaaatattgagc

SEQ ID NO: 6426866 - DNA, 20 bp, Homo sapiens
tcaaaatattgagcagaatt

SEQ ID NO: 6426867 - DNA, 22 bp, Homo sapiens
tcaaaatattgagcagaattca

SEQ ID NO: 6426868 - DNA, 14 bp, Homo sapiens
tcaaaatatttaaa

SEQ ID NO: 6426869 - DNA, 13 bp, Homo sapiens
tcaaaatatttgt

SEQ ID NO: 6426870 - DNA, 17 bp, Homo sapiens
tcaaaatatttgtacat

SEQ ID NO: 6426871 - DNA, 19 bp, Homo sapiens
tcaaaatattttttttaac

SEQ ID NO: 6426872 - DNA, 22 bp, Homo sapiens
tcaaaatcaaaaggtaatgcac

SEQ ID NO: 6426873 - DNA, 16 bp, Homo sapiens
tcaaaatccaaaaaga

SEQ ID NO: 6426874 - DNA, 21 bp, Homo sapiens
tcaaaatctctccactttcag

SEQ ID NO: 6426875 - DNA, 15 bp, Homo sapiens
tcaaaatctgtcata

SEQ ID NO: 6426876 - DNA, 14 bp, Homo sapiens
tcaaaatgaatttt

SEQ ID NO: 6426877 - DNA, 11 bp, Homo sapiens
tcaaaatgaca

SEQ ID NO: 6426878 - DNA, 21 bp, Homo sapiens
tcaaaatgacagtttcagaga

SEQ ID NO: 6426879 - DNA, 15 bp, Homo sapiens
tcaaaatgcatgtga

SEQ ID NO: 6426880 - DNA, 14 bp, Homo sapiens
tcaaaatgctctta

SEQ ID NO: 6426881 - DNA, 16 bp, Homo sapiens
tcaaaatgctcttatt

SEQ ID NO: 6426882 - DNA, 20 bp, Homo sapiens
tcaaaatgctcttatttcat

SEQ ID NO: 6426883 - DNA, 12 bp, Homo sapiens
tcaaaatgcttt

SEQ ID NO: 6426884 - DNA, 17 bp, Homo sapiens
tcaaaatgctttttatt

SEQ ID NO: 6426885 - DNA, 19 bp, Homo sapiens
tcaaaatgctttttatttc

SEQ ID NO: 6426886 - DNA, 21 bp, Homo sapiens
tcaaaatggtgttgagattta

SEQ ID NO: 6426887 - DNA, 14 bp, Homo sapiens
tcaaaatgtagctt

SEQ ID NO: 6426888 - DNA, 19 bp, Homo sapiens
tcaaaatgtccagatgtag

SEQ ID NO: 6426889 - DNA, 12 bp, Homo sapiens
tcaaaatgtgcc

SEQ ID NO: 6426890 - DNA, 19 bp, Homo sapiens
tcaaaatgttaataaaggt

SEQ ID NO: 6426891 - DNA, 21 bp, Homo sapiens
tcaaaatgttaataaaggttt

SEQ ID NO: 6426892 - DNA, 16 bp, Homo sapiens
tcaaaatgttctattt

SEQ ID NO: 6426893 - DNA, 15 bp, Homo sapiens
tcaaaattaaatctg

SEQ ID NO: 6426894 - DNA, 16 bp, Homo sapiens
tcaaaattaatagctt

SEQ ID NO: 6426895 - DNA, 18 bp, Homo sapiens
tcaaaattactggacata

SEQ ID NO: 6426896 - DNA, 24 bp, Homo sapiens
tcaaaattagtgctttttgtgtca

SEQ ID NO: 6426897 - DNA, 19 bp, Homo sapiens
tcaaaattctagctgtatg

SEQ ID NO: 6426898 - DNA, 20 bp, Homo sapiens
tcaaaattgacctcaaaaga

SEQ ID NO: 6426899 - DNA, 23 bp, Homo sapiens
tcaaaattgcttctaaaacaata

SEQ ID NO: 6426900 - DNA, 11 bp, Homo sapiens
tcaaaattgtt

SEQ ID NO: 6426901 - DNA, 12 bp, Homo sapiens
tcaaaatttaaa

SEQ ID NO: 6426902 - DNA, 19 bp, Homo sapiens
tcaaaatttcaaaagtgat

SEQ ID NO: 6426903 - DNA, 23 bp, Homo sapiens
tcaaaatttgctgccaaatgcgt

SEQ ID NO: 6426904 - DNA, 14 bp, Homo sapiens
tcaaacaaagccag

SEQ ID NO: 6426905 - DNA, 21 bp, Homo sapiens
tcaaacaaagccagaagctga

SEQ ID NO: 6426906 - DNA, 14 bp, Homo sapiens
tcaaacaaatcatt

SEQ ID NO: 6426907 - DNA, 18 bp, Homo sapiens
tcaaacaaatcattttga

SEQ ID NO: 6426908 - DNA, 22 bp, Homo sapiens
tcaaacaaccttcagctttatt

SEQ ID NO: 6426909 - DNA, 19 bp, Homo sapiens
tcaaacaagtatgaatcta

SEQ ID NO: 6426910 - DNA, 19 bp, Homo sapiens
tcaaacaatgacaaagcag

SEQ ID NO: 6426911 - DNA, 21 bp, Homo sapiens
tcaaacaatgacaaagcagat

SEQ ID NO: 6426912 - DNA, 18 bp, Homo sapiens
tcaaacaattcaatcaaa

SEQ ID NO: 6426913 - DNA, 22 bp, Homo sapiens
tcaaacaattcaatcaaagcta

SEQ ID NO: 6426914 - DNA, 22 bp, Homo sapiens
tcaaacacaatggagtgtgtaa

SEQ ID NO: 6426915 - DNA, 14 bp, Homo sapiens
tcaaacacacaaac

SEQ ID NO: 6426916 - DNA, 13 bp, Homo sapiens
tcaaacacacaca

SEQ ID NO: 6426917 - DNA, 16 bp, Homo sapiens
tcaaacacacagtatt

SEQ ID NO: 6426918 - DNA, 21 bp, Homo sapiens
tcaaacacacagtattcgtga

SEQ ID NO: 6426919 - DNA, 11 bp, Homo sapiens
tcaaacacagt

SEQ ID NO: 6426920 - DNA, 17 bp, Homo sapiens
tcaaacacctctgtatt

SEQ ID NO: 6426921 - DNA, 20 bp, Homo sapiens
tcaaacacggacccatagac

SEQ ID NO: 6426922 - DNA, 15 bp, Homo sapiens
tcaaacactgcttaa

SEQ ID NO: 6426923 - DNA, 19 bp, Homo sapiens
tcaaacacttattgtttga

SEQ ID NO: 6426924 - DNA, 15 bp, Homo sapiens
tcaaacaggctgtaa

SEQ ID NO: 6426925 - DNA, 23 bp, Homo sapiens
tcaaacagggacactacaaacat

SEQ ID NO: 6426926 - DNA, 20 bp, Homo sapiens
tcaaacagtctcaggaaatc

SEQ ID NO: 6426927 - DNA, 21 bp, Homo sapiens
tcaaacagtctcaggaaatca

SEQ ID NO: 6426928 - DNA, 14 bp, Homo sapiens
tcaaacagtgtggc

SEQ ID NO: 6426929 - DNA, 15 bp, Homo sapiens
tcaaacagtgtggct

SEQ ID NO: 6426930 - DNA, 17 bp, Homo sapiens
tcaaacatatataacaa

SEQ ID NO: 6426931 - DNA, 19 bp, Homo sapiens
tcaaacatcagctgaattc

SEQ ID NO: 6426932 - DNA, 20 bp, Homo sapiens
tcaaacatcagctgaattca

SEQ ID NO: 6426933 - DNA, 15 bp, Homo sapiens
tcaaacattagtact

SEQ ID NO: 6426934 - DNA, 18 bp, Homo sapiens
tcaaacattagtacttta

SEQ ID NO: 6426935 - DNA, 20 bp, Homo sapiens
tcaaacattagtactttata

SEQ ID NO: 6426936 - DNA, 17 bp, Homo sapiens
tcaaacatttgccaagt

SEQ ID NO: 6426937 - DNA, 20 bp, Homo sapiens
tcaaaccaaatcactgaact

SEQ ID NO: 6426938 - DNA, 19 bp, Homo sapiens
tcaaaccagagaaaggaaa

SEQ ID NO: 6426939 - DNA, 20 bp, Homo sapiens
tcaaaccagagaaaggaaag

SEQ ID NO: 6426940 - DNA, 14 bp, Homo sapiens
tcaaaccaggattt

SEQ ID NO: 6426941 - DNA, 16 bp, Homo sapiens
tcaaaccataaacttc

SEQ ID NO: 6426942 - DNA, 14 bp, Homo sapiens
tcaaaccatttaat

SEQ ID NO: 6426943 - DNA, 18 bp, Homo sapiens
tcaaaccatttaattcat

SEQ ID NO: 6426944 - DNA, 21 bp, Homo sapiens
tcaaaccatttaattcataat

SEQ ID NO: 6426945 - DNA, 19 bp, Homo sapiens
tcaaaccccgaccacctgc

SEQ ID NO: 6426946 - DNA, 20 bp, Homo sapiens
tcaaaccccgaccacctgcc

SEQ ID NO: 6426947 - DNA, 20 bp, Homo sapiens
tcaaaccctagccttgcttg

SEQ ID NO: 6426948 - DNA, 21 bp, Homo sapiens
tcaaaccctagccttgcttgt

SEQ ID NO: 6426949 - DNA, 10 bp, Homo sapiens
tcaaacctgc

SEQ ID NO: 6426950 - DNA, 18 bp, Homo sapiens
tcaaacctgcatattgtg

SEQ ID NO: 6426951 - DNA, 15 bp, Homo sapiens
tcaaacctggagctg

SEQ ID NO: 6426952 - DNA, 17 bp, Homo sapiens
tcaaaccttgaggagaa

SEQ ID NO: 6426953 - DNA, 19 bp, Homo sapiens
tcaaaccttgaggagaagt

SEQ ID NO: 6426954 - DNA, 20 bp, Homo sapiens
tcaaacctttctggcctgtt

SEQ ID NO: 6426955 - DNA, 13 bp, Homo sapiens
tcaaaccttttta

SEQ ID NO: 6426956 - DNA, 19 bp, Homo sapiens
tcaaacgggggccttctgg

SEQ ID NO: 6426957 - DNA, 16 bp, Homo sapiens
tcaaacgtgaaaatgc

SEQ ID NO: 6426958 - DNA, 17 bp, Homo sapiens
tcaaactaaaagacatt

SEQ ID NO: 6426959 - DNA, 23 bp, Homo sapiens
tcaaactaaattcaaagaagtac

SEQ ID NO: 6426960 - DNA, 14 bp, Homo sapiens
tcaaactaacacat

SEQ ID NO: 6426961 - DNA, 12 bp, Homo sapiens
tcaaactaacag

SEQ ID NO: 6426962 - DNA, 18 bp, Homo sapiens
tcaaactacatattgtaa

SEQ ID NO: 6426963 - DNA, 22 bp, Homo sapiens
tcaaactacattgagcccctga

SEQ ID NO: 6426964 - DNA, 17 bp, Homo sapiens
tcaaactactgtacatt

SEQ ID NO: 6426965 - DNA, 21 bp, Homo sapiens
tcaaactactttgctgctaat

SEQ ID NO: 6426966 - DNA, 18 bp, Homo sapiens
tcaaactaggaggaaaag

SEQ ID NO: 6426967 - DNA, 20 bp, Homo sapiens
tcaaactaggaggaaaagac

SEQ ID NO: 6426968 - DNA, 23 bp, Homo sapiens
tcaaactaggaggaaaagacaga

SEQ ID NO: 6426969 - DNA, 13 bp, Homo sapiens
tcaaactcaaggt

SEQ ID NO: 6426970 - DNA, 18 bp, Homo sapiens
tcaaactcaatgctttat

SEQ ID NO: 6426971 - DNA, 13 bp, Homo sapiens
tcaaactcattgc

SEQ ID NO: 6426972 - DNA, 15 bp, Homo sapiens
tcaaactcattgcag

SEQ ID NO: 6426973 - DNA, 21 bp, Homo sapiens
tcaaactccaaggttcccttg

SEQ ID NO: 6426974 - DNA, 15 bp, Homo sapiens
tcaaactcctgacct

SEQ ID NO: 6426975 - DNA, 16 bp, Homo sapiens
tcaaactcctgacctc

SEQ ID NO: 6426976 - DNA, 18 bp, Homo sapiens
tcaaactcctgacctcag

SEQ ID NO: 6426977 - DNA, 19 bp, Homo sapiens
tcaaactcctgacctcagg

SEQ ID NO: 6426978 - DNA, 20 bp, Homo sapiens
tcaaactcctgacctcaggt

SEQ ID NO: 6426979 - DNA, 23 bp, Homo sapiens
tcaaactcgtctgatgttttgat

SEQ ID NO: 6426980 - DNA, 22 bp, Homo sapiens
tcaaactcttgacctcaggtga

SEQ ID NO: 6426981 - DNA, 21 bp, Homo sapiens
tcaaactctttgcccagttca

SEQ ID NO: 6426982 - DNA, 17 bp, Homo sapiens
tcaaactgaaattcaga

SEQ ID NO: 6426983 - DNA, 22 bp, Homo sapiens
tcaaactgagtaaattggaaac

SEQ ID NO: 6426984 - DNA, 13 bp, Homo sapiens
tcaaactgctcca

SEQ ID NO: 6426985 - DNA, 16 bp, Homo sapiens
tcaaactgctggaaat

SEQ ID NO: 6426986 - DNA, 11 bp, Homo sapiens
tcaaactgctt

SEQ ID NO: 6426987 - DNA, 14 bp, Homo sapiens
tcaaactggggcct

SEQ ID NO: 6426988 - DNA, 16 bp, Homo sapiens
tcaaactggggcctcc

SEQ ID NO: 6426989 - DNA, 23 bp, Homo sapiens
tctacatgtgagatagttttcat

SEQ ID NO: 6426990 - DNA, 13 bp, Homo sapiens
tctacattaaaat

SEQ ID NO: 6426991 - DNA, 18 bp, Homo sapiens
tctacattaaaatgacaa

SEQ ID NO: 6426992 - DNA, 21 bp, Homo sapiens
tctacattataccgcagagta

SEQ ID NO: 6426993 - DNA, 16 bp, Homo sapiens
tctacattcagattat

SEQ ID NO: 6426994 - DNA, 14 bp, Homo sapiens
tctacattctgctc

SEQ ID NO: 6426995 - DNA, 15 bp, Homo sapiens
tctacattctgctct

SEQ ID NO: 6426996 - DNA, 18 bp, Homo sapiens
tctacattctgctctgcc

SEQ ID NO: 6426997 - DNA, 19 bp, Homo sapiens
tctacattctgctctgccc

SEQ ID NO: 6426998 - DNA, 20 bp, Homo sapiens
tctacattctgctctgccca

SEQ ID NO: 6426999 - DNA, 19 bp, Homo sapiens
tctacatttaaacaagtat

SEQ ID NO: 6427000 - DNA, 22 bp, Homo sapiens
tctacatttcacattattctgg

SEQ ID NO: 6427001 - DNA, 16 bp, Homo sapiens
tctacatttctgcaga

SEQ ID NO: 6427002 - DNA, 14 bp, Homo sapiens
tctacatttcttag

SEQ ID NO: 6427003 - DNA, 18 bp, Homo sapiens
tctacatttgagggccca

SEQ ID NO: 6427004 - DNA, 11 bp, Homo sapiens
tctacatttgt

SEQ ID NO: 6427005 - DNA, 12 bp, Homo sapiens
tctacatttgtt

SEQ ID NO: 6427006 - DNA, 13 bp, Homo sapiens
tctacatttgttt

SEQ ID NO: 6427007 - DNA, 18 bp, Homo sapiens
tctacatttgtttgtatt

SEQ ID NO: 6427008 - DNA, 14 bp, Homo sapiens
tctacattttatta

SEQ ID NO: 6427009 - DNA, 19 bp, Homo sapiens
tctacattttattacacta

SEQ ID NO: 6427010 - DNA, 18 bp, Homo sapiens
tctacattttttaaaact

SEQ ID NO: 6427011 - DNA, 15 bp, Homo sapiens
tctaccaaatgtgta

SEQ ID NO: 6427012 - DNA, 23 bp, Homo sapiens
tctaccaacaataaaccaaaccc

SEQ ID NO: 6427013 - DNA, 17 bp, Homo sapiens
tctaccaactttcaaga

SEQ ID NO: 6427014 - DNA, 18 bp, Homo sapiens
tctaccaactttcaagaa

SEQ ID NO: 6427015 - DNA, 22 bp, Homo sapiens
tctaccaactttcaagaacttg

SEQ ID NO: 6427016 - DNA, 20 bp, Homo sapiens
tctaccaagacataatgcac

SEQ ID NO: 6427017 - DNA, 14 bp, Homo sapiens
tctaccaatacaaa

SEQ ID NO: 6427018 - DNA, 19 bp, Homo sapiens
tctaccaatctgggaagat

SEQ ID NO: 6427019 - DNA, 18 bp, Homo sapiens
tctaccaccacaccaaat

SEQ ID NO: 6427020 - DNA, 19 bp, Homo sapiens
tctaccactggtgtaaaaa

SEQ ID NO: 6427021 - DNA, 17 bp, Homo sapiens
tctaccagatgtgcttt

SEQ ID NO: 6427022 - DNA, 20 bp, Homo sapiens
tctaccagtgcaggctggcc

SEQ ID NO: 6427023 - DNA, 16 bp, Homo sapiens
tctaccatggttctgc

SEQ ID NO: 6427024 - DNA, 20 bp, Homo sapiens
tctaccattaaaatcttgaa

SEQ ID NO: 6427025 - DNA, 22 bp, Homo sapiens
tctacccaaaccctaggttccc

SEQ ID NO: 6427026 - DNA, 21 bp, Homo sapiens
tctacccaaaggatactgtaa

SEQ ID NO: 6427027 - DNA, 22 bp, Homo sapiens
tctacccagagccttctcctgc

SEQ ID NO: 6427028 - DNA, 15 bp, Homo sapiens
tctacccagcccatc

SEQ ID NO: 6427029 - DNA, 17 bp, Homo sapiens
tctacccagcccatctt

SEQ ID NO: 6427030 - DNA, 14 bp, Homo sapiens
tctacccaggtgct

SEQ ID NO: 6427031 - DNA, 15 bp, Homo sapiens
tctacccatattaca

SEQ ID NO: 6427032 - DNA, 14 bp, Homo sapiens
tctacccatctccc

SEQ ID NO: 6427033 - DNA, 16 bp, Homo sapiens
tctacccatgagcctg

SEQ ID NO: 6427034 - DNA, 18 bp, Homo sapiens
tctacccatgagcctgcc

SEQ ID NO: 6427035 - DNA, 21 bp, Homo sapiens
tctacccatgttgggaaaaac

SEQ ID NO: 6427036 - DNA, 21 bp, Homo sapiens
tctacccccaacaccacccct

SEQ ID NO: 6427037 - DNA, 20 bp, Homo sapiens
tctacccctctcctttcact

SEQ ID NO: 6427038 - DNA, 20 bp, Homo sapiens
tctacccgtgcctgggcccc

SEQ ID NO: 6427039 - DNA, 18 bp, Homo sapiens
tctaccctcccaccccct

SEQ ID NO: 6427040 - DNA, 13 bp, Homo sapiens
tctaccctgaaag

SEQ ID NO: 6427041 - DNA, 12 bp, Homo sapiens
tctaccctgcag

SEQ ID NO: 6427042 - DNA, 21 bp, Homo sapiens
tctaccctgcatggctgagct

SEQ ID NO: 6427043 - DNA, 19 bp, Homo sapiens
tctaccctggcactataat

SEQ ID NO: 6427044 - DNA, 15 bp, Homo sapiens
tctaccctgggtcct

SEQ ID NO: 6427045 - DNA, 12 bp, Homo sapiens
tctaccctgtcc

SEQ ID NO: 6427046 - DNA, 18 bp, Homo sapiens
tctaccctgtcctttgca

SEQ ID NO: 6427047 - DNA, 23 bp, Homo sapiens
tctaccgacctgtctccctgggg

SEQ ID NO: 6427048 - DNA, 23 bp, Homo sapiens
tctaccgtaattgctttgtgcct

SEQ ID NO: 6427049 - DNA, 19 bp, Homo sapiens
tctaccgtggatttgtact

SEQ ID NO: 6427050 - DNA, 17 bp, Homo sapiens
tctacctacatatttgt

SEQ ID NO: 6427051 - DNA, 17 bp, Homo sapiens
tctacctagatttaata

SEQ ID NO: 6427052 - DNA, 19 bp, Homo sapiens
tctacctagatttaatata

SEQ ID NO: 6427053 - DNA, 16 bp, Homo sapiens
tctacctcacagaaat

SEQ ID NO: 6427054 - DNA, 15 bp, Homo sapiens
tctacctccaccctg

SEQ ID NO: 6427055 - DNA, 15 bp, Homo sapiens
tctacctcccgacct

SEQ ID NO: 6427056 - DNA, 16 bp, Homo sapiens
tctacctccttagctt

SEQ ID NO: 6427057 - DNA, 12 bp, Homo sapiens
tctacctctctc

SEQ ID NO: 6427058 - DNA, 13 bp, Homo sapiens
tctacctctctcc

SEQ ID NO: 6427059 - DNA, 15 bp, Homo sapiens
tctacctcttggctg

SEQ ID NO: 6427060 - DNA, 14 bp, Homo sapiens
tctacctgagcatt

SEQ ID NO: 6427061 - DNA, 16 bp, Homo sapiens
tctacctgaggccagg

SEQ ID NO: 6427062 - DNA, 18 bp, Homo sapiens
tctacctgcaggcggggc

SEQ ID NO: 6427063 - DNA, 20 bp, Homo sapiens
tctacctgcaggcggggctc

SEQ ID NO: 6427064 - DNA, 23 bp, Homo sapiens
tctacctgcaggcggggctcctc

SEQ ID NO: 6427065 - DNA, 12 bp, Homo sapiens
tctacctgccac

SEQ ID NO: 6427066 - DNA, 21 bp, Homo sapiens
tctacctgctggacagcctcc

SEQ ID NO: 6427067 - DNA, 23 bp, Homo sapiens
tctacctgctggacagcctccgc

SEQ ID NO: 6427068 - DNA, 18 bp, Homo sapiens
tctacctgcttggtcttt

SEQ ID NO: 6427069 - DNA, 13 bp, Homo sapiens
tctacctggaggg

SEQ ID NO: 6427070 - DNA, 18 bp, Homo sapiens
tctacctggagggaagag

SEQ ID NO: 6427071 - DNA, 22 bp, Homo sapiens
tctacctggccggtaggctgct

SEQ ID NO: 6427072 - DNA, 23 bp, Homo sapiens
tctacctggccggtaggctgctg

SEQ ID NO: 6427073 - DNA, 11 bp, Homo sapiens
tctacctgtgg

SEQ ID NO: 6427074 - DNA, 15 bp, Homo sapiens
tctacctgtgttttt

SEQ ID NO: 6427075 - DNA, 13 bp, Homo sapiens
tctacctgttcct

SEQ ID NO: 6427076 - DNA, 16 bp, Homo sapiens
tctacctgttctgtag

SEQ ID NO: 6427077 - DNA, 12 bp, Homo sapiens
tctaccttcctg

SEQ ID NO: 6427078 - DNA, 22 bp, Homo sapiens
tctaccttcctgtccctgaggt

SEQ ID NO: 6427079 - DNA, 16 bp, Homo sapiens
tctaccttctccccag

SEQ ID NO: 6427080 - DNA, 18 bp, Homo sapiens
tctaccttctccccagct

SEQ ID NO: 6427081 - DNA, 15 bp, Homo sapiens
tctacctttctgagt

SEQ ID NO: 6427082 - DNA, 21 bp, Homo sapiens
tctacctttgtaaaacagcct

SEQ ID NO: 6427083 - DNA, 19 bp, Homo sapiens
tctaccttttaaaattgaa

SEQ ID NO: 6427084 - DNA, 19 bp, Homo sapiens
tctacctttttttctctcc

SEQ ID NO: 6427085 - DNA, 21 bp, Homo sapiens
tctacctttttttctctccta

SEQ ID NO: 6427086 - DNA, 16 bp, Homo sapiens
tctacgaagccacagg

SEQ ID NO: 6427087 - DNA, 22 bp, Homo sapiens
tctacgacccttttgagcctag

SEQ ID NO: 6427088 - DNA, 15 bp, Homo sapiens
tctacgcaattgaca

SEQ ID NO: 6427089 - DNA, 22 bp, Homo sapiens
tctacgccactccacaaatgat

SEQ ID NO: 6427090 - DNA, 15 bp, Homo sapiens
tctacgctctccttt

SEQ ID NO: 6427091 - DNA, 20 bp, Homo sapiens
tctacgtcatgtattttatg

SEQ ID NO: 6427092 - DNA, 15 bp, Homo sapiens
tctacgttaagataa

SEQ ID NO: 6427093 - DNA, 16 bp, Homo sapiens
tctacgttctccagcc

SEQ ID NO: 6427094 - DNA, 20 bp, Homo sapiens
tctacgttctccagcccaca

SEQ ID NO: 6427095 - DNA, 13 bp, Homo sapiens
tctacgtttcttt

SEQ ID NO: 6427096 - DNA, 14 bp, Homo sapiens
tctacgtttcttta

SEQ ID NO: 6427097 - DNA, 14 bp, Homo sapiens
tctactaaaaagaa

SEQ ID NO: 6427098 - DNA, 17 bp, Homo sapiens
tctactaaaaatacaaa

SEQ ID NO: 6427099 - DNA, 22 bp, Homo sapiens
tctactaaaaatacaaaaaaat

SEQ ID NO: 6427100 - DNA, 16 bp, Homo sapiens
tctactaaataatact

SEQ ID NO: 6427101 - DNA, 22 bp, Homo sapiens
tctactaagtgatgctgtgata

SEQ ID NO: 6427102 - DNA, 15 bp, Homo sapiens
tctactaattccaca

SEQ ID NO: 6427103 - DNA, 14 bp, Homo sapiens
tctactacccccac

SEQ ID NO: 6427104 - DNA, 20 bp, Homo sapiens
tctactagcaccatcaccct

SEQ ID NO: 6427105 - DNA, 17 bp, Homo sapiens
tctactaggtctgctcc

SEQ ID NO: 6427106 - DNA, 15 bp, Homo sapiens
tctactatgatcaga

SEQ ID NO: 6427107 - DNA, 20 bp, Homo sapiens
tctactcacttttcccactc

SEQ ID NO: 6427108 - DNA, 16 bp, Homo sapiens
tctactcatgccagat

SEQ ID NO: 6427109 - DNA, 17 bp, Homo sapiens
tctactcatgccagatt

SEQ ID NO: 6427110 - DNA, 18 bp, Homo sapiens
tctactcattccccgggg

SEQ ID NO: 6427111 - DNA, 22 bp, Homo sapiens
tctactcatttaaagtatttta

SEQ ID NO: 6427112 - DNA, 15 bp, Homo sapiens
tctactccaggcttc

SEQ ID NO: 6427113 - DNA, 20 bp, Homo sapiens
tctactccaggcttccacac

SEQ ID NO: 6427114 - DNA, 20 bp, Homo sapiens
tctactccatggtgaactga

SEQ ID NO: 6427115 - DNA, 20 bp, Homo sapiens
tctactccatggttctcaat

SEQ ID NO: 6427116 - DNA, 13 bp, Homo sapiens
tctactcccagcg

SEQ ID NO: 6427117 - DNA, 12 bp, Homo sapiens
tctactcccctt

SEQ ID NO: 6427118 - DNA, 22 bp, Homo sapiens
tctactcctacctcagcctaga

SEQ ID NO: 6427119 - DNA, 19 bp, Homo sapiens
tctactcctagaagaacca

SEQ ID NO: 6427120 - DNA, 20 bp, Homo sapiens
tctactctcctcatctctaa

SEQ ID NO: 6427121 - DNA, 18 bp, Homo sapiens
tctactctgaagaccttt

SEQ ID NO: 6427122 - DNA, 18 bp, Homo sapiens
tctactctggaccaagga

SEQ ID NO: 6427123 - DNA, 16 bp, Homo sapiens
tctactcttaatgatg

SEQ ID NO: 6427124 - DNA, 18 bp, Homo sapiens
tctactcttcctgtccta

SEQ ID NO: 6427125 - DNA, 23 bp, Homo sapiens
tctactcttgagagctcaggcag

SEQ ID NO: 6427126 - DNA, 16 bp, Homo sapiens
tctactcttgtcattt

SEQ ID NO: 6427127 - DNA, 15 bp, Homo sapiens
tctactctttttgtt

SEQ ID NO: 6427128 - DNA, 22 bp, Homo sapiens
tctactgaatgacctctctact

SEQ ID NO: 6427129 - DNA, 16 bp, Homo sapiens
tctactgaattggctt

SEQ ID NO: 6427130 - DNA, 21 bp, Homo sapiens
tctactgacccaactgggggc

SEQ ID NO: 6427131 - DNA, 17 bp, Homo sapiens
tctactgagacatgact

SEQ ID NO: 6427132 - DNA, 14 bp, Homo sapiens
tctactgagccacg

SEQ ID NO: 6427133 - DNA, 21 bp, Homo sapiens
tctactgccctccccttcccc

SEQ ID NO: 6427134 - DNA, 14 bp, Homo sapiens
tctactgctgctga

SEQ ID NO: 6427135 - DNA, 22 bp, Homo sapiens
tctactggaaaaaaatacaaaa

SEQ ID NO: 6427136 - DNA, 22 bp, Homo sapiens
tctactggaaatgtagcactta

SEQ ID NO: 6427137 - DNA, 18 bp, Homo sapiens
tctactggagtggaaggt

SEQ ID NO: 6427138 - DNA, 11 bp, Homo sapiens
tctactgtaaa

SEQ ID NO: 6427139 - DNA, 23 bp, Homo sapiens
tctactgtgtaatataaaagatc

SEQ ID NO: 6427140 - DNA, 14 bp, Homo sapiens
tctactgttattat

SEQ ID NO: 6427141 - DNA, 17 bp, Homo sapiens
tctactgttattatgca

SEQ ID NO: 6427142 - DNA, 13 bp, Homo sapiens
tctacttaataaa

SEQ ID NO: 6427143 - DNA, 15 bp, Homo sapiens
tctacttcagctttg

SEQ ID NO: 6427144 - DNA, 20 bp, Homo sapiens
tctacttgccagaaccaaat

SEQ ID NO: 6427145 - DNA, 15 bp, Homo sapiens
tctacttgctctgga

SEQ ID NO: 6427146 - DNA, 17 bp, Homo sapiens
tctacttgctctggacc

SEQ ID NO: 6427147 - DNA, 19 bp, Homo sapiens
tctacttgctctggacctg

SEQ ID NO: 6427148 - DNA, 21 bp, Homo sapiens
tctacttgctctggacctgcc

SEQ ID NO: 6427149 - DNA, 22 bp, Homo sapiens
tctacttgctgtcccttggaac

SEQ ID NO: 6427150 - DNA, 15 bp, Homo sapiens
tctacttgtaaaatg

SEQ ID NO: 6427151 - DNA, 18 bp, Homo sapiens
tctacttgtaaaatgctt

SEQ ID NO: 6427152 - DNA, 17 bp, Homo sapiens
tctacttgttcatttgg

SEQ ID NO: 6427153 - DNA, 19 bp, Homo sapiens
tctacttgttttcaatgtg

SEQ ID NO: 6427154 - DNA, 16 bp, Homo sapiens
tctactttaagcacta

SEQ ID NO: 6427155 - DNA, 14 bp, Homo sapiens
tctactttattaat

SEQ ID NO: 6427156 - DNA, 21 bp, Homo sapiens
tctactttattaattgttttg

SEQ ID NO: 6427157 - DNA, 16 bp, Homo sapiens
tctactttcatcttaa

SEQ ID NO: 6427158 - DNA, 15 bp, Homo sapiens
tctactttccctctg

SEQ ID NO: 6427159 - DNA, 18 bp, Homo sapiens
tctactttccctctggga

SEQ ID NO: 6427160 - DNA, 12 bp, Homo sapiens
tctactttgaaa

SEQ ID NO: 6427161 - DNA, 22 bp, Homo sapiens
tctactttgataaagtaaaaaa

SEQ ID NO: 6427162 - DNA, 15 bp, Homo sapiens
tctactttgattctg

SEQ ID NO: 6427163 - DNA, 19 bp, Homo sapiens
tctactttgtcccctcacc

SEQ ID NO: 6427164 - DNA, 14 bp, Homo sapiens
tctactttgtttat

SEQ ID NO: 6427165 - DNA, 15 bp, Homo sapiens
tctacttttactcat

SEQ ID NO: 6427166 - DNA, 18 bp, Homo sapiens
tctactttttaattttta

SEQ ID NO: 6427167 - DNA, 19 bp, Homo sapiens
tcaaactggggcctccctg

SEQ ID NO: 6427168 - DNA, 13 bp, Homo sapiens
tcaaactgggtat

SEQ ID NO: 6427169 - DNA, 15 bp, Homo sapiens
tcaaactgtaaaaat

SEQ ID NO: 6427170 - DNA, 14 bp, Homo sapiens
tcaaacttaaacaa

SEQ ID NO: 6427171 - DNA, 16 bp, Homo sapiens
tcaaacttaaacaaaa

SEQ ID NO: 6427172 - DNA, 17 bp, Homo sapiens
tcaaacttaaacaaaaa

SEQ ID NO: 6427173 - DNA, 16 bp, Homo sapiens
tcaaacttactatttt

SEQ ID NO: 6427174 - DNA, 17 bp, Homo sapiens
tcaaacttctgtgtact

SEQ ID NO: 6427175 - DNA, 12 bp, Homo sapiens
tcaaacttggat

SEQ ID NO: 6427176 - DNA, 17 bp, Homo sapiens
tcaaacttgtgctgaga

SEQ ID NO: 6427177 - DNA, 16 bp, Homo sapiens
tcaaacttgtggcctc

SEQ ID NO: 6427178 - DNA, 13 bp, Homo sapiens
tcaaactttacta

SEQ ID NO: 6427179 - DNA, 15 bp, Homo sapiens
tcaaactttactatg

SEQ ID NO: 6427180 - DNA, 21 bp, Homo sapiens
tcaaactttactctaagtctc

SEQ ID NO: 6427181 - DNA, 12 bp, Homo sapiens
tcaaacttttga

SEQ ID NO: 6427182 - DNA, 15 bp, Homo sapiens
tcaaactttttccag

SEQ ID NO: 6427183 - DNA, 17 bp, Homo sapiens
tcaaactttttccagca

SEQ ID NO: 6427184 - DNA, 23 bp, Homo sapiens
tcaaactttttccagcaaaatgg

SEQ ID NO: 6427185 - DNA, 17 bp, Homo sapiens
tcaaagaaaaacaatga

SEQ ID NO: 6427186 - DNA, 16 bp, Homo sapiens
tcaaagaaagtgtatt

SEQ ID NO: 6427187 - DNA, 22 bp, Homo sapiens
tcaaagaaatccaaatttctca

SEQ ID NO: 6427188 - DNA, 17 bp, Homo sapiens
tcaaagaaattcagaac

SEQ ID NO: 6427189 - DNA, 13 bp, Homo sapiens
tcaaagaaatttc

SEQ ID NO: 6427190 - DNA, 19 bp, Homo sapiens
tcaaagaaatttccactca

SEQ ID NO: 6427191 - DNA, 20 bp, Homo sapiens
tcaaagaaatttccactcag

SEQ ID NO: 6427192 - DNA, 12 bp, Homo sapiens
tcaaagaacaga

SEQ ID NO: 6427193 - DNA, 18 bp, Homo sapiens
tcaaagaacccccctccc

SEQ ID NO: 6427194 - DNA, 16 bp, Homo sapiens
tcaaagaagactcagt

SEQ ID NO: 6427195 - DNA, 11 bp, Homo sapiens
tcaaagaagct

SEQ ID NO: 6427196 - DNA, 14 bp, Homo sapiens
tcaaagaagctgtc

SEQ ID NO: 6427197 - DNA, 16 bp, Homo sapiens
tcaaagaagtcggaat

SEQ ID NO: 6427198 - DNA, 23 bp, Homo sapiens
tcaaagaagtcggaatgtcatag

SEQ ID NO: 6427199 - DNA, 14 bp, Homo sapiens
tcaaagaattacag

SEQ ID NO: 6427200 - DNA, 17 bp, Homo sapiens
tcaaagaattacagtac

SEQ ID NO: 6427201 - DNA, 17 bp, Homo sapiens
tcaaagacattctgaca

SEQ ID NO: 6427202 - DNA, 12 bp, Homo sapiens
tcaaagacattt

SEQ ID NO: 6427203 - DNA, 17 bp, Homo sapiens
tcaaagacatttcatcc

SEQ ID NO: 6427204 - DNA, 16 bp, Homo sapiens
tcaaagagaaaactta

SEQ ID NO: 6427205 - DNA, 17 bp, Homo sapiens
tcaaagagaagatgcct

SEQ ID NO: 6427206 - DNA, 14 bp, Homo sapiens
tcaaagagaattgt

SEQ ID NO: 6427207 - DNA, 16 bp, Homo sapiens
tcaaagagagttttta

SEQ ID NO: 6427208 - DNA, 20 bp, Homo sapiens
tcaaagagatgggccttttc

SEQ ID NO: 6427209 - DNA, 21 bp, Homo sapiens
tcaaagagatgggccttttct

SEQ ID NO: 6427210 - DNA, 22 bp, Homo sapiens
tcaaagagggtgagggccttct

SEQ ID NO: 6427211 - DNA, 23 bp, Homo sapiens
tcaaagagggtgagggccttctt

SEQ ID NO: 6427212 - DNA, 16 bp, Homo sapiens
tcaaagaggtaactga

SEQ ID NO: 6427213 - DNA, 18 bp, Homo sapiens
tcaaagaggtgaacatta

SEQ ID NO: 6427214 - DNA, 20 bp, Homo sapiens
tcaaagagtctgtcttgaga

SEQ ID NO: 6427215 - DNA, 19 bp, Homo sapiens
tcaaagataaatgaaataa

SEQ ID NO: 6427216 - DNA, 18 bp, Homo sapiens
tcaaagatacaagaaaaa

SEQ ID NO: 6427217 - DNA, 19 bp, Homo sapiens
tcaaagatatagggtgtgg

SEQ ID NO: 6427218 - DNA, 13 bp, Homo sapiens
tcaaagatatttt

SEQ ID NO: 6427219 - DNA, 21 bp, Homo sapiens
tcaaagatgcgtttgcctcct

SEQ ID NO: 6427220 - DNA, 19 bp, Homo sapiens
tcaaagatgctgtgagtct

SEQ ID NO: 6427221 - DNA, 20 bp, Homo sapiens
tcaaagatgtaatgtagttc

SEQ ID NO: 6427222 - DNA, 15 bp, Homo sapiens
tcaaagatgtgttca

SEQ ID NO: 6427223 - DNA, 23 bp, Homo sapiens
tcaaagcaaatgtcttcctggat

SEQ ID NO: 6427224 - DNA, 15 bp, Homo sapiens
tcaaagcaaggaaac

SEQ ID NO: 6427225 - DNA, 16 bp, Homo sapiens
tcaaagcaaggaaact

SEQ ID NO: 6427226 - DNA, 20 bp, Homo sapiens
tcaaagcaaggaaactatgt

SEQ ID NO: 6427227 - DNA, 18 bp, Homo sapiens
tcaaagcaagggctccag

SEQ ID NO: 6427228 - DNA, 19 bp, Homo sapiens
tcaaagcaagggctccagc

SEQ ID NO: 6427229 - DNA, 15 bp, Homo sapiens
tcaaagcaatgcatt

SEQ ID NO: 6427230 - DNA, 15 bp, Homo sapiens
tcaaagcacaataac

SEQ ID NO: 6427231 - DNA, 20 bp, Homo sapiens
tcaaagcaccaaaataagaa

SEQ ID NO: 6427232 - DNA, 21 bp, Homo sapiens
tcaaagcaccaaaataagaaa

SEQ ID NO: 6427233 - DNA, 19 bp, Homo sapiens
tcaaagcacctgaaccact

SEQ ID NO: 6427234 - DNA, 18 bp, Homo sapiens
tcaaagcacttaagtgtt

SEQ ID NO: 6427235 - DNA, 12 bp, Homo sapiens
tcaaagcagagt

SEQ ID NO: 6427236 - DNA, 14 bp, Homo sapiens
tcaaagcagagtgg

SEQ ID NO: 6427237 - DNA, 14 bp, Homo sapiens
tcaaagcagcagcc

SEQ ID NO: 6427238 - DNA, 18 bp, Homo sapiens
tcaaagcataaaactttg

SEQ ID NO: 6427239 - DNA, 15 bp, Homo sapiens
tcaaagcataaaatg

SEQ ID NO: 6427240 - DNA, 14 bp, Homo sapiens
tcaaagcatagatg

SEQ ID NO: 6427241 - DNA, 18 bp, Homo sapiens
tcaaagcatcaaataata

SEQ ID NO: 6427242 - DNA, 12 bp, Homo sapiens
tcaaagccagcg

SEQ ID NO: 6427243 - DNA, 22 bp, Homo sapiens
tcaaagccagcgtcctcctctg

SEQ ID NO: 6427244 - DNA, 23 bp, Homo sapiens
tcaaagccatatggacactgtga

SEQ ID NO: 6427245 - DNA, 17 bp, Homo sapiens
tcaaagccccattaact

SEQ ID NO: 6427246 - DNA, 20 bp, Homo sapiens
tcaaagcccccacttctctc

SEQ ID NO: 6427247 - DNA, 12 bp, Homo sapiens
tcaaagccctgc

SEQ ID NO: 6427248 - DNA, 15 bp, Homo sapiens
tcaaagccctgcctc

SEQ ID NO: 6427249 - DNA, 19 bp, Homo sapiens
tcaaagccggcctgagaaa

SEQ ID NO: 6427250 - DNA, 22 bp, Homo sapiens
tcaaagccggcctgagaaacac

SEQ ID NO: 6427251 - DNA, 18 bp, Homo sapiens
tcaaagccggttgcagag

SEQ ID NO: 6427252 - DNA, 18 bp, Homo sapiens
tcaaagcctcttattttt

SEQ ID NO: 6427253 - DNA, 20 bp, Homo sapiens
tcaaagcggatgctggccac

SEQ ID NO: 6427254 - DNA, 15 bp, Homo sapiens
tcaaagctacctttt

SEQ ID NO: 6427255 - DNA, 22 bp, Homo sapiens
tcaaagctaggaaaggcagaaa

SEQ ID NO: 6427256 - DNA, 17 bp, Homo sapiens
tcaaagctgaagccgcc

SEQ ID NO: 6427257 - DNA, 13 bp, Homo sapiens
tcaaagctgaata

SEQ ID NO: 6427258 - DNA, 17 bp, Homo sapiens
tcaaagctgaatatttt

SEQ ID NO: 6427259 - DNA, 12 bp, Homo sapiens
tcaaagctgagt

SEQ ID NO: 6427260 - DNA, 17 bp, Homo sapiens
tcaaagctgcatgtgta

SEQ ID NO: 6427261 - DNA, 16 bp, Homo sapiens
tcaaagcttaaaaaga

SEQ ID NO: 6427262 - DNA, 15 bp, Homo sapiens
tcaaagcttcaaaaa

SEQ ID NO: 6427263 - DNA, 14 bp, Homo sapiens
tcaaagcttgaaga

SEQ ID NO: 6427264 - DNA, 15 bp, Homo sapiens
tcaaagctttttcca

SEQ ID NO: 6427265 - DNA, 21 bp, Homo sapiens
tcaaaggaaaacacctttatt

SEQ ID NO: 6427266 - DNA, 23 bp, Homo sapiens
tcaaaggaatataagaaaagtaa

SEQ ID NO: 6427267 - DNA, 14 bp, Homo sapiens
tcaaaggacggaag

SEQ ID NO: 6427268 - DNA, 15 bp, Homo sapiens
tcaaaggactgacct

SEQ ID NO: 6427269 - DNA, 23 bp, Homo sapiens
tcaaaggagaaaaaaaaccttgt

SEQ ID NO: 6427270 - DNA, 22 bp, Homo sapiens
tcaaaggagagtcacagaacaa

SEQ ID NO: 6427271 - DNA, 19 bp, Homo sapiens
tcaaaggattttggaaaag

SEQ ID NO: 6427272 - DNA, 19 bp, Homo sapiens
tcaaaggcacagtgaaggc

SEQ ID NO: 6427273 - DNA, 11 bp, Homo sapiens
tcaaaggcaga

SEQ ID NO: 6427274 - DNA, 16 bp, Homo sapiens
tcaaaggcagaaagga

SEQ ID NO: 6427275 - DNA, 19 bp, Homo sapiens
tcaaaggcagaaaggagat

SEQ ID NO: 6427276 - DNA, 17 bp, Homo sapiens
tcaaaggcatctccctt

SEQ ID NO: 6427277 - DNA, 17 bp, Homo sapiens
tcaaagggacttttgta

SEQ ID NO: 6427278 - DNA, 19 bp, Homo sapiens
tcaaagggacttttgtaaa

SEQ ID NO: 6427279 - DNA, 13 bp, Homo sapiens
tcaaagggcagtt

SEQ ID NO: 6427280 - DNA, 18 bp, Homo sapiens
tcaaagggcccacagtga

SEQ ID NO: 6427281 - DNA, 16 bp, Homo sapiens
tcaaagggtaaattat

SEQ ID NO: 6427282 - DNA, 22 bp, Homo sapiens
tcaaagggtaaattataaatgt

SEQ ID NO: 6427283 - DNA, 20 bp, Homo sapiens
tcaaaggttctaggtttcaa

SEQ ID NO: 6427284 - DNA, 19 bp, Homo sapiens
tcaaagtaaaacttgctgc

SEQ ID NO: 6427285 - DNA, 19 bp, Homo sapiens
tcaaagtaaaggcctcctc

SEQ ID NO: 6427286 - DNA, 23 bp, Homo sapiens
tcaaagtaaggctggtaagagaa

SEQ ID NO: 6427287 - DNA, 21 bp, Homo sapiens
tcaaagtaatatatcaaatcc

SEQ ID NO: 6427288 - DNA, 20 bp, Homo sapiens
tcaaagtactaaaactagat

SEQ ID NO: 6427289 - DNA, 18 bp, Homo sapiens
tcaaagtaggtatacaaa

SEQ ID NO: 6427290 - DNA, 22 bp, Homo sapiens
tcaaagtagttttattttaata

SEQ ID NO: 6427291 - DNA, 19 bp, Homo sapiens
tcaaagtataatctttcta

SEQ ID NO: 6427292 - DNA, 19 bp, Homo sapiens
tcaaagtatatacagagcc

SEQ ID NO: 6427293 - DNA, 13 bp, Homo sapiens
tcaaagtcaaaaa

SEQ ID NO: 6427294 - DNA, 17 bp, Homo sapiens
tcaaagtcattaaagac

SEQ ID NO: 6427295 - DNA, 21 bp, Homo sapiens
tcaaagtctcatagctttgga

SEQ ID NO: 6427296 - DNA, 18 bp, Homo sapiens
tcaaagtgaaagacattt

SEQ ID NO: 6427297 - DNA, 19 bp, Homo sapiens
tcaaagtgaaagacatttc

SEQ ID NO: 6427298 - DNA, 17 bp, Homo sapiens
tcaaagtgcacacacac

SEQ ID NO: 6427299 - DNA, 14 bp, Homo sapiens
tcaaagtgctatta

SEQ ID NO: 6427300 - DNA, 20 bp, Homo sapiens
tcaaagtgtatatttattca

SEQ ID NO: 6427301 - DNA, 20 bp, Homo sapiens
tcaaagtgtctagacatatt

SEQ ID NO: 6427302 - DNA, 17 bp, Homo sapiens
tcaaagtgtgtctggga

SEQ ID NO: 6427303 - DNA, 22 bp, Homo sapiens
tcaaagtgttgctgtggctcca

SEQ ID NO: 6427304 - DNA, 19 bp, Homo sapiens
tcaaagtgttgtgttcctg

SEQ ID NO: 6427305 - DNA, 13 bp, Homo sapiens
tcaaagtgtttaa

SEQ ID NO: 6427306 - DNA, 22 bp, Homo sapiens
tcaaagtgtttaattgtataaa

SEQ ID NO: 6427307 - DNA, 18 bp, Homo sapiens
tcaaagtgttttctctga

SEQ ID NO: 6427308 - DNA, 16 bp, Homo sapiens
tcaaagttaaaagtaa

SEQ ID NO: 6427309 - DNA, 17 bp, Homo sapiens
tcaaagttctgctttct

SEQ ID NO: 6427310 - DNA, 17 bp, Homo sapiens
tcaaagttgaaaattca

SEQ ID NO: 6427311 - DNA, 16 bp, Homo sapiens
tcaaagtttaacacaa

SEQ ID NO: 6427312 - DNA, 15 bp, Homo sapiens
tcaaagttttgaaaa

SEQ ID NO: 6427313 - DNA, 19 bp, Homo sapiens
tcaaagttttgaaaagcta

SEQ ID NO: 6427314 - DNA, 15 bp, Homo sapiens
tcaaataaaaattct

SEQ ID NO: 6427315 - DNA, 20 bp, Homo sapiens
tcaaataaaatatcataaag

SEQ ID NO: 6427316 - DNA, 11 bp, Homo sapiens
tcaaataaaca

SEQ ID NO: 6427317 - DNA, 16 bp, Homo sapiens
tcaaataaacactgtg

SEQ ID NO: 6427318 - DNA, 23 bp, Homo sapiens
tcaaataaaccttgtttctttct

SEQ ID NO: 6427319 - DNA, 17 bp, Homo sapiens
tcaaataaagaaatttg

SEQ ID NO: 6427320 - DNA, 18 bp, Homo sapiens
tcaaataaagttcaaagc

SEQ ID NO: 6427321 - DNA, 14 bp, Homo sapiens
tcaaataaatgttt

SEQ ID NO: 6427322 - DNA, 18 bp, Homo sapiens
tcaaataactaaaaggta

SEQ ID NO: 6427323 - DNA, 16 bp, Homo sapiens
tcaaataactaaggaa

SEQ ID NO: 6427324 - DNA, 13 bp, Homo sapiens
tcaaataagaaat

SEQ ID NO: 6427325 - DNA, 17 bp, Homo sapiens
tcaaataagtatttata

SEQ ID NO: 6427326 - DNA, 18 bp, Homo sapiens
tcaaataagtatttataa

SEQ ID NO: 6427327 - DNA, 19 bp, Homo sapiens
tcaaataagtatttataat

SEQ ID NO: 6427328 - DNA, 19 bp, Homo sapiens
tcaaataataaagtaattg

SEQ ID NO: 6427329 - DNA, 14 bp, Homo sapiens
tcaaataataataa

SEQ ID NO: 6427330 - DNA, 11 bp, Homo sapiens
tcaaataatac

SEQ ID NO: 6427331 - DNA, 15 bp, Homo sapiens
tcaaatacaaaaatg

SEQ ID NO: 6427332 - DNA, 17 bp, Homo sapiens
tcaaatacaaagtaaat

SEQ ID NO: 6427333 - DNA, 17 bp, Homo sapiens
tcaaatacacatttgct

SEQ ID NO: 6427334 - DNA, 22 bp, Homo sapiens
tcaaatacagtagtataatgta

SEQ ID NO: 6427335 - DNA, 22 bp, Homo sapiens
tcaaatacatttaaaacattaa

SEQ ID NO: 6427336 - DNA, 21 bp, Homo sapiens
tcaaatacgtgggcattcaaa

SEQ ID NO: 6427337 - DNA, 19 bp, Homo sapiens
tcaaatacttcaaatcata

SEQ ID NO: 6427338 - DNA, 12 bp, Homo sapiens
tcaaatacttta

SEQ ID NO: 6427339 - DNA, 13 bp, Homo sapiens
tcaaatagatttt

SEQ ID NO: 6427340 - DNA, 15 bp, Homo sapiens
tcaaatagatttttg

SEQ ID NO: 6427341 - DNA, 19 bp, Homo sapiens
tcaaatagatttttgattc

SEQ ID NO: 6427342 - DNA, 21 bp, Homo sapiens
tcaaatagatttttgattcag

SEQ ID NO: 6427343 - DNA, 23 bp, Homo sapiens
tcaaatagatttttgattcagct

SEQ ID NO: 6427344 - DNA, 16 bp, Homo sapiens
tcaaatagtatagaaa

SEQ ID NO: 6427345 - DNA, 22 bp, Homo sapiens
tcaaatatagaaagttgatatt

SEQ ID NO: 6427346 - DNA, 21 bp, Homo sapiens
tctactttttaatttttaaga

SEQ ID NO: 6427347 - DNA, 16 bp, Homo sapiens
tctactttttctgtac

SEQ ID NO: 6427348 - DNA, 19 bp, Homo sapiens
tctactttttgtatttagt

SEQ ID NO: 6427349 - DNA, 12 bp, Homo sapiens
tctagaaaacca

SEQ ID NO: 6427350 - DNA, 17 bp, Homo sapiens
tctagaaaagcttccta

SEQ ID NO: 6427351 - DNA, 20 bp, Homo sapiens
tctagaaaagcttcctagct

SEQ ID NO: 6427352 - DNA, 20 bp, Homo sapiens
tctagaaaataatgcaaatg

SEQ ID NO: 6427353 - DNA, 15 bp, Homo sapiens
tctagaaaatgaaaa

SEQ ID NO: 6427354 - DNA, 16 bp, Homo sapiens
tctagaaactctggct

SEQ ID NO: 6427355 - DNA, 11 bp, Homo sapiens
tctagaaagaa

SEQ ID NO: 6427356 - DNA, 22 bp, Homo sapiens
tctagaaagcctgttcccctca

SEQ ID NO: 6427357 - DNA, 21 bp, Homo sapiens
tctagaaataaaatcaccctg

SEQ ID NO: 6427358 - DNA, 22 bp, Homo sapiens
tctagaaataaatgttacctaa

SEQ ID NO: 6427359 - DNA, 13 bp, Homo sapiens
tctagaaatacac

SEQ ID NO: 6427360 - DNA, 22 bp, Homo sapiens
tctagaaatagatttaaagaat

SEQ ID NO: 6427361 - DNA, 16 bp, Homo sapiens
tctagaaataggttaa

SEQ ID NO: 6427362 - DNA, 23 bp, Homo sapiens
tctagaacaattacatgtaaaca

SEQ ID NO: 6427363 - DNA, 14 bp, Homo sapiens
tctagaacacccac

SEQ ID NO: 6427364 - DNA, 15 bp, Homo sapiens
tctagaacacccact

SEQ ID NO: 6427365 - DNA, 16 bp, Homo sapiens
tctagaacacccactg

SEQ ID NO: 6427366 - DNA, 17 bp, Homo sapiens
tctagaacacccactgg

SEQ ID NO: 6427367 - DNA, 19 bp, Homo sapiens
tctagaacacccactggcc

SEQ ID NO: 6427368 - DNA, 19 bp, Homo sapiens
tctagaacatccctgccag

SEQ ID NO: 6427369 - DNA, 17 bp, Homo sapiens
tctagaacatgcacatt

SEQ ID NO: 6427370 - DNA, 22 bp, Homo sapiens
tctagaaccttctagaacctgg

SEQ ID NO: 6427371 - DNA, 17 bp, Homo sapiens
tctagaactatcatttt

SEQ ID NO: 6427372 - DNA, 19 bp, Homo sapiens
tctagaactatcattttta

SEQ ID NO: 6427373 - DNA, 15 bp, Homo sapiens
tctagaagaaatgaa

SEQ ID NO: 6427374 - DNA, 17 bp, Homo sapiens
tctagaagaaatgaaat

SEQ ID NO: 6427375 - DNA, 20 bp, Homo sapiens
tctagaagactgtcagcttc

SEQ ID NO: 6427376 - DNA, 21 bp, Homo sapiens
tctagaagaggggttacttct

SEQ ID NO: 6427377 - DNA, 13 bp, Homo sapiens
tctagaagataac

SEQ ID NO: 6427378 - DNA, 17 bp, Homo sapiens
tctagaagataacattt

SEQ ID NO: 6427379 - DNA, 19 bp, Homo sapiens
tctagaagatgtgtaaaca

SEQ ID NO: 6427380 - DNA, 22 bp, Homo sapiens
tctagaagatgtgtaaacaggt

SEQ ID NO: 6427381 - DNA, 14 bp, Homo sapiens
tctagaagcagaag

SEQ ID NO: 6427382 - DNA, 21 bp, Homo sapiens
tctagaagccaagggaaaggg

SEQ ID NO: 6427383 - DNA, 15 bp, Homo sapiens
tctagaagctcaggt

SEQ ID NO: 6427384 - DNA, 23 bp, Homo sapiens
tctagaagctcaggttccctgcc

SEQ ID NO: 6427385 - DNA, 17 bp, Homo sapiens
tctagaaggccaggcct

SEQ ID NO: 6427386 - DNA, 19 bp, Homo sapiens
tctagaaggccaggcctct

SEQ ID NO: 6427387 - DNA, 16 bp, Homo sapiens
tctagaagttgtttgt

SEQ ID NO: 6427388 - DNA, 13 bp, Homo sapiens
tctagaatactaa

SEQ ID NO: 6427389 - DNA, 14 bp, Homo sapiens
tctagaatactaat

SEQ ID NO: 6427390 - DNA, 21 bp, Homo sapiens
tctagaatactaataaaatac

SEQ ID NO: 6427391 - DNA, 22 bp, Homo sapiens
tctagaatactaataaaataca

SEQ ID NO: 6427392 - DNA, 18 bp, Homo sapiens
tctagaatcccagcagca

SEQ ID NO: 6427393 - DNA, 17 bp, Homo sapiens
tctagaatgtctgaagt

SEQ ID NO: 6427394 - DNA, 16 bp, Homo sapiens
tctagaatgtggattt

SEQ ID NO: 6427395 - DNA, 20 bp, Homo sapiens
tctagaatgtgttttctgaa

SEQ ID NO: 6427396 - DNA, 21 bp, Homo sapiens
tctagaatgttattgtgtata

SEQ ID NO: 6427397 - DNA, 17 bp, Homo sapiens
tctagaattataagtca

SEQ ID NO: 6427398 - DNA, 17 bp, Homo sapiens
tctagaattatttttca

SEQ ID NO: 6427399 - DNA, 15 bp, Homo sapiens
tctagaattcactga

SEQ ID NO: 6427400 - DNA, 13 bp, Homo sapiens
tctagaattccag

SEQ ID NO: 6427401 - DNA, 17 bp, Homo sapiens
tctagaatttagtgata

SEQ ID NO: 6427402 - DNA, 14 bp, Homo sapiens
tctagacaagatat

SEQ ID NO: 6427403 - DNA, 18 bp, Homo sapiens
tctagacaagatattgta

SEQ ID NO: 6427404 - DNA, 23 bp, Homo sapiens
tctagacaagatattgtacataa

SEQ ID NO: 6427405 - DNA, 20 bp, Homo sapiens
tctagacacaatttcatttc

SEQ ID NO: 6427406 - DNA, 18 bp, Homo sapiens
tctagacactccttgaaa

SEQ ID NO: 6427407 - DNA, 22 bp, Homo sapiens
tctagacataactggtttgact

SEQ ID NO: 6427408 - DNA, 23 bp, Homo sapiens
tctagacatcattgtcagccttg

SEQ ID NO: 6427409 - DNA, 19 bp, Homo sapiens
tctagacatggaggttcta

SEQ ID NO: 6427410 - DNA, 17 bp, Homo sapiens
tctagacattcttttaa

SEQ ID NO: 6427411 - DNA, 14 bp, Homo sapiens
tctagaccaataaa

SEQ ID NO: 6427412 - DNA, 15 bp, Homo sapiens
tctagacgcccctcc

SEQ ID NO: 6427413 - DNA, 16 bp, Homo sapiens
tctagactcaaaacct

SEQ ID NO: 6427414 - DNA, 21 bp, Homo sapiens
tctagactgcaagaactgttt

SEQ ID NO: 6427415 - DNA, 14 bp, Homo sapiens
tctagactgtgaag

SEQ ID NO: 6427416 - DNA, 13 bp, Homo sapiens
tctagacttcccc

SEQ ID NO: 6427417 - DNA, 16 bp, Homo sapiens
tctagagaagaggctg

SEQ ID NO: 6427418 - DNA, 17 bp, Homo sapiens
tctagagagagggagaa

SEQ ID NO: 6427419 - DNA, 21 bp, Homo sapiens
tctagagagatgagaagccag

SEQ ID NO: 6427420 - DNA, 23 bp, Homo sapiens
tctagagagatgagaagccagga

SEQ ID NO: 6427421 - DNA, 20 bp, Homo sapiens
tctagagattttcttggcag

SEQ ID NO: 6427422 - DNA, 14 bp, Homo sapiens
tctagagcactgcc

SEQ ID NO: 6427423 - DNA, 12 bp, Homo sapiens
tctagagccttc

SEQ ID NO: 6427424 - DNA, 20 bp, Homo sapiens
tctagagctatgcacaccaa

SEQ ID NO: 6427425 - DNA, 17 bp, Homo sapiens
tctagagcttagcatat

SEQ ID NO: 6427426 - DNA, 17 bp, Homo sapiens
tctagagcttgatgcca

SEQ ID NO: 6427427 - DNA, 13 bp, Homo sapiens
tctagaggagggg

SEQ ID NO: 6427428 - DNA, 9 bp, Homo sapiens
tctagaggc

SEQ ID NO: 6427429 - DNA, 12 bp, Homo sapiens
tctagaggcctc

SEQ ID NO: 6427430 - DNA, 21 bp, Homo sapiens
tctagaggcctgaaatcctgg

SEQ ID NO: 6427431 - DNA, 23 bp, Homo sapiens
tctagaggcctgaaatcctggtt

SEQ ID NO: 6427432 - DNA, 14 bp, Homo sapiens
tctagagggcacta

SEQ ID NO: 6427433 - DNA, 22 bp, Homo sapiens
tctagaggtgagaccaaaggat

SEQ ID NO: 6427434 - DNA, 14 bp, Homo sapiens
tctagagtaattat

SEQ ID NO: 6427435 - DNA, 20 bp, Homo sapiens
tctagagtccaaggtttaaa

SEQ ID NO: 6427436 - DNA, 23 bp, Homo sapiens
tctagagtgagaatctggctcct

SEQ ID NO: 6427437 - DNA, 14 bp, Homo sapiens
tctagagttcagag

SEQ ID NO: 6427438 - DNA, 19 bp, Homo sapiens
tctagagtttatacagtgt

SEQ ID NO: 6427439 - DNA, 20 bp, Homo sapiens
tctagagtttatacagtgta

SEQ ID NO: 6427440 - DNA, 16 bp, Homo sapiens
tctagatacaggactg

SEQ ID NO: 6427441 - DNA, 17 bp, Homo sapiens
tctagatacaggactgg

SEQ ID NO: 6427442 - DNA, 17 bp, Homo sapiens
tctagataggtgctttt

SEQ ID NO: 6427443 - DNA, 17 bp, Homo sapiens
tctagatatgagaaata

SEQ ID NO: 6427444 - DNA, 22 bp, Homo sapiens
tctagatcactgtgcttatttt

SEQ ID NO: 6427445 - DNA, 16 bp, Homo sapiens
tctagatcagatgctc

SEQ ID NO: 6427446 - DNA, 18 bp, Homo sapiens
tctagatcagatgctcca

SEQ ID NO: 6427447 - DNA, 14 bp, Homo sapiens
tctagatcataagg

SEQ ID NO: 6427448 - DNA, 22 bp, Homo sapiens
tctagatcctgcaccccagcat

SEQ ID NO: 6427449 - DNA, 19 bp, Homo sapiens
tctagatgaagttttacat

SEQ ID NO: 6427450 - DNA, 22 bp, Homo sapiens
tctagatgaagttttacattgt

SEQ ID NO: 6427451 - DNA, 19 bp, Homo sapiens
tctagatggcaacattgga

SEQ ID NO: 6427452 - DNA, 23 bp, Homo sapiens
tctagatgtttattcttctagag

SEQ ID NO: 6427453 - DNA, 15 bp, Homo sapiens
tctagattatgtctt

SEQ ID NO: 6427454 - DNA, 13 bp, Homo sapiens
tctagattcaaag

SEQ ID NO: 6427455 - DNA, 19 bp, Homo sapiens
tctagattcaaaggttcta

SEQ ID NO: 6427456 - DNA, 23 bp, Homo sapiens
tctagattcaaaggttctaggtt

SEQ ID NO: 6427457 - DNA, 13 bp, Homo sapiens
tctagattcataa

SEQ ID NO: 6427458 - DNA, 14 bp, Homo sapiens
tctagattcataaa

SEQ ID NO: 6427459 - DNA, 16 bp, Homo sapiens
tctagattcataaata

SEQ ID NO: 6427460 - DNA, 21 bp, Homo sapiens
tctagattccattggtccaag

SEQ ID NO: 6427461 - DNA, 23 bp, Homo sapiens
tctagattccattggtccaagat

SEQ ID NO: 6427462 - DNA, 14 bp, Homo sapiens
tctagattttgaaa

SEQ ID NO: 6427463 - DNA, 23 bp, Homo sapiens
tctagcaactgttggataataac

SEQ ID NO: 6427464 - DNA, 14 bp, Homo sapiens
tctagcaagaagat

SEQ ID NO: 6427465 - DNA, 17 bp, Homo sapiens
tctagcaagaagattct

SEQ ID NO: 6427466 - DNA, 16 bp, Homo sapiens
tctagcaattttcttt

SEQ ID NO: 6427467 - DNA, 15 bp, Homo sapiens
tctagcacagctgtg

SEQ ID NO: 6427468 - DNA, 16 bp, Homo sapiens
tctagcactggcctgc

SEQ ID NO: 6427469 - DNA, 17 bp, Homo sapiens
tctagcactggcctgca

SEQ ID NO: 6427470 - DNA, 17 bp, Homo sapiens
tctagcacttccttgcc

SEQ ID NO: 6427471 - DNA, 16 bp, Homo sapiens
tctagcagctggccta

SEQ ID NO: 6427472 - DNA, 19 bp, Homo sapiens
tctagcagtaaaagataaa

SEQ ID NO: 6427473 - DNA, 17 bp, Homo sapiens
tctagcagtatgtgtgc

SEQ ID NO: 6427474 - DNA, 19 bp, Homo sapiens
tctagcatgccaacaagaa

SEQ ID NO: 6427475 - DNA, 22 bp, Homo sapiens
tctagcatggcatatttttcac

SEQ ID NO: 6427476 - DNA, 14 bp, Homo sapiens
tctagcatgttggg

SEQ ID NO: 6427477 - DNA, 14 bp, Homo sapiens
tctagcatttcttc

SEQ ID NO: 6427478 - DNA, 15 bp, Homo sapiens
tctagccactccctc

SEQ ID NO: 6427479 - DNA, 23 bp, Homo sapiens
tctagccactttggtcccgtgca

SEQ ID NO: 6427480 - DNA, 13 bp, Homo sapiens
tctagccagaggc

SEQ ID NO: 6427481 - DNA, 16 bp, Homo sapiens
tctagccagaggctgg

SEQ ID NO: 6427482 - DNA, 13 bp, Homo sapiens
tctagccaggcct

SEQ ID NO: 6427483 - DNA, 15 bp, Homo sapiens
tctagccaggcctcc

SEQ ID NO: 6427484 - DNA, 22 bp, Homo sapiens
tctagcccaaaggtaagttgct

SEQ ID NO: 6427485 - DNA, 17 bp, Homo sapiens
tctagcccactccctgc

SEQ ID NO: 6427486 - DNA, 13 bp, Homo sapiens
tctagccccagcg

SEQ ID NO: 6427487 - DNA, 15 bp, Homo sapiens
tctagccctctccct

SEQ ID NO: 6427488 - DNA, 16 bp, Homo sapiens
tctagccgctgccctg

SEQ ID NO: 6427489 - DNA, 18 bp, Homo sapiens
tctagccgctgccctggg

SEQ ID NO: 6427490 - DNA, 20 bp, Homo sapiens
tctagccgggccatgctttc

SEQ ID NO: 6427491 - DNA, 14 bp, Homo sapiens
tctagcctctggac

SEQ ID NO: 6427492 - DNA, 20 bp, Homo sapiens
tctagcctctggactggaaa

SEQ ID NO: 6427493 - DNA, 22 bp, Homo sapiens
tctagcctctggactggaaagc

SEQ ID NO: 6427494 - DNA, 15 bp, Homo sapiens
tctagcctctttgtg

SEQ ID NO: 6427495 - DNA, 11 bp, Homo sapiens
tctagcctgca

SEQ ID NO: 6427496 - DNA, 16 bp, Homo sapiens
tctagcctgcactttg

SEQ ID NO: 6427497 - DNA, 20 bp, Homo sapiens
tctagcctgcactttgatgt

SEQ ID NO: 6427498 - DNA, 13 bp, Homo sapiens
tctagcctggcta

SEQ ID NO: 6427499 - DNA, 17 bp, Homo sapiens
tctagcctgggccagag

SEQ ID NO: 6427500 - DNA, 15 bp, Homo sapiens
tctagccttagacaa

SEQ ID NO: 6427501 - DNA, 20 bp, Homo sapiens
tctagccttagtcaataaac

SEQ ID NO: 6427502 - DNA, 22 bp, Homo sapiens
tctagccttgtagctgttactg

SEQ ID NO: 6427503 - DNA, 23 bp, Homo sapiens
tctagcgaacgtatttctccaga

SEQ ID NO: 6427504 - DNA, 14 bp, Homo sapiens
tctagctaaataaa

SEQ ID NO: 6427505 - DNA, 16 bp, Homo sapiens
tctagctaatggaaaa

SEQ ID NO: 6427506 - DNA, 13 bp, Homo sapiens
tctagctctcaca

SEQ ID NO: 6427507 - DNA, 15 bp, Homo sapiens
tctagctctcacaga

SEQ ID NO: 6427508 - DNA, 14 bp, Homo sapiens
tctagctctctagg

SEQ ID NO: 6427509 - DNA, 15 bp, Homo sapiens
tctagctctctaggc

SEQ ID NO: 6427510 - DNA, 16 bp, Homo sapiens
tctagctctctaggcc

SEQ ID NO: 6427511 - DNA, 10 bp, Homo sapiens
tctagctgaa

SEQ ID NO: 6427512 - DNA, 18 bp, Homo sapiens
tctagctgatcagaattt

SEQ ID NO: 6427513 - DNA, 13 bp, Homo sapiens
tctagctgtatga

SEQ ID NO: 6427514 - DNA, 14 bp, Homo sapiens
tctagctgtctgtg

SEQ ID NO: 6427515 - DNA, 15 bp, Homo sapiens
tctagctgtctgtga

SEQ ID NO: 6427516 - DNA, 17 bp, Homo sapiens
tctagctgtctgtgaat

SEQ ID NO: 6427517 - DNA, 17 bp, Homo sapiens
tctagctgttctttttt

SEQ ID NO: 6427518 - DNA, 14 bp, Homo sapiens
tctagcttatctac

SEQ ID NO: 6427519 - DNA, 18 bp, Homo sapiens
tctagcttcatgcctcag

SEQ ID NO: 6427520 - DNA, 22 bp, Homo sapiens
tctagcttcatgcctcagtttc

SEQ ID NO: 6427521 - DNA, 23 bp, Homo sapiens
tctagcttcatgcctcagtttcc

SEQ ID NO: 6427522 - DNA, 12 bp, Homo sapiens
tctagcttggtg

SEQ ID NO: 6427523 - DNA, 22 bp, Homo sapiens
tctaggaaaatattttgatctt

SEQ ID NO: 6427524 - DNA, 22 bp, Homo sapiens
tctaggaaatatacttttacaa

SEQ ID NO: 6427525 - DNA, 20 bp, Homo sapiens
tcaaatatctcagaggctat

SEQ ID NO: 6427526 - DNA, 16 bp, Homo sapiens
tcaaatatgtaaactt

SEQ ID NO: 6427527 - DNA, 18 bp, Homo sapiens
tcaaatatgtaaacttta

SEQ ID NO: 6427528 - DNA, 15 bp, Homo sapiens
tcaaatatgttctgg

SEQ ID NO: 6427529 - DNA, 15 bp, Homo sapiens
tcaaatattaccaaa

SEQ ID NO: 6427530 - DNA, 14 bp, Homo sapiens
tcaaatattgaatg

SEQ ID NO: 6427531 - DNA, 16 bp, Homo sapiens
tcaaatattttttgag

SEQ ID NO: 6427532 - DNA, 20 bp, Homo sapiens
tcaaatcaagaaacttaagg

SEQ ID NO: 6427533 - DNA, 20 bp, Homo sapiens
tcaaatcaatctgtaaaact

SEQ ID NO: 6427534 - DNA, 14 bp, Homo sapiens
tcaaatcagtcagt

SEQ ID NO: 6427535 - DNA, 23 bp, Homo sapiens
tcaaatcagtcttccttgtggaa

SEQ ID NO: 6427536 - DNA, 16 bp, Homo sapiens
tcaaatcagtgataat

SEQ ID NO: 6427537 - DNA, 21 bp, Homo sapiens
tcaaatcatgtacatttgaaa

SEQ ID NO: 6427538 - DNA, 13 bp, Homo sapiens
tcaaatcattcaa

SEQ ID NO: 6427539 - DNA, 15 bp, Homo sapiens
tcaaatccactgaca

SEQ ID NO: 6427540 - DNA, 14 bp, Homo sapiens
tcaaatccaggacc

SEQ ID NO: 6427541 - DNA, 16 bp, Homo sapiens
tcaaatccaggaccct

SEQ ID NO: 6427542 - DNA, 21 bp, Homo sapiens
tcaaatccaggaccctgccag

SEQ ID NO: 6427543 - DNA, 14 bp, Homo sapiens
tcaaatccaggact

SEQ ID NO: 6427544 - DNA, 22 bp, Homo sapiens
tcaaatcccacttactttaatg

SEQ ID NO: 6427545 - DNA, 23 bp, Homo sapiens
tcaaatccccggctgcttccttc

SEQ ID NO: 6427546 - DNA, 16 bp, Homo sapiens
tcaaatccctctccaa

SEQ ID NO: 6427547 - DNA, 13 bp, Homo sapiens
tcaaatcctcacc

SEQ ID NO: 6427548 - DNA, 15 bp, Homo sapiens
tcaaatcctcttttg

SEQ ID NO: 6427549 - DNA, 18 bp, Homo sapiens
tcaaatcctcttttgtat

SEQ ID NO: 6427550 - DNA, 21 bp, Homo sapiens
tcaaatccttccaaaaattat

SEQ ID NO: 6427551 - DNA, 15 bp, Homo sapiens
tcaaatccttgaaga

SEQ ID NO: 6427552 - DNA, 16 bp, Homo sapiens
tcaaatccttgaagat

SEQ ID NO: 6427553 - DNA, 14 bp, Homo sapiens
tcaaatccttgagc

SEQ ID NO: 6427554 - DNA, 22 bp, Homo sapiens
tcaaatcgaatagggaagtaaa

SEQ ID NO: 6427555 - DNA, 19 bp, Homo sapiens
tcaaatcgatggcctggcc

SEQ ID NO: 6427556 - DNA, 15 bp, Homo sapiens
tcaaatctaccactg

SEQ ID NO: 6427557 - DNA, 14 bp, Homo sapiens
tcaaatctattcag

SEQ ID NO: 6427558 - DNA, 17 bp, Homo sapiens
tcaaatctattcagaca

SEQ ID NO: 6427559 - DNA, 15 bp, Homo sapiens
tcaaatctcttgctt

SEQ ID NO: 6427560 - DNA, 17 bp, Homo sapiens
tcaaatctgagccttag

SEQ ID NO: 6427561 - DNA, 18 bp, Homo sapiens
tcaaatctgctttcatcc

SEQ ID NO: 6427562 - DNA, 19 bp, Homo sapiens
tcaaatctgctttcatcca

SEQ ID NO: 6427563 - DNA, 14 bp, Homo sapiens
tcaaatctgggctc

SEQ ID NO: 6427564 - DNA, 12 bp, Homo sapiens
tcaaatctggtc

SEQ ID NO: 6427565 - DNA, 21 bp, Homo sapiens
tcaaatctgtaatcagcaata

SEQ ID NO: 6427566 - DNA, 16 bp, Homo sapiens
tcaaatctgtagcata

SEQ ID NO: 6427567 - DNA, 12 bp, Homo sapiens
tcaaatctgtat

SEQ ID NO: 6427568 - DNA, 17 bp, Homo sapiens
tcaaatcttaagaaata

SEQ ID NO: 6427569 - DNA, 18 bp, Homo sapiens
tcaaatcttaagaaataa

SEQ ID NO: 6427570 - DNA, 15 bp, Homo sapiens
tcaaatcttacaaaa

SEQ ID NO: 6427571 - DNA, 21 bp, Homo sapiens
tcaaatgaaacagggaaaatg

SEQ ID NO: 6427572 - DNA, 23 bp, Homo sapiens
tcaaatgaaacctacaggaatct

SEQ ID NO: 6427573 - DNA, 15 bp, Homo sapiens
tcaaatgaaactctt

SEQ ID NO: 6427574 - DNA, 15 bp, Homo sapiens
tcaaatgaaatgtat

SEQ ID NO: 6427575 - DNA, 21 bp, Homo sapiens
tcaaatgaacttttacagaat

SEQ ID NO: 6427576 - DNA, 12 bp, Homo sapiens
tcaaatgaagat

SEQ ID NO: 6427577 - DNA, 18 bp, Homo sapiens
tcaaatgaatgattaaat

SEQ ID NO: 6427578 - DNA, 23 bp, Homo sapiens
tcaaatgaatggaggaactttcc

SEQ ID NO: 6427579 - DNA, 14 bp, Homo sapiens
tcaaatgaattctt

SEQ ID NO: 6427580 - DNA, 19 bp, Homo sapiens
tcaaatgacccaaagacca

SEQ ID NO: 6427581 - DNA, 21 bp, Homo sapiens
tcaaatgacccaaagaccaat

SEQ ID NO: 6427582 - DNA, 20 bp, Homo sapiens
tcaaatgatccttcctactt

SEQ ID NO: 6427583 - DNA, 22 bp, Homo sapiens
tcaaatgatgtgcctgcttcag

SEQ ID NO: 6427584 - DNA, 13 bp, Homo sapiens
tcaaatgatttca

SEQ ID NO: 6427585 - DNA, 19 bp, Homo sapiens
tcaaatgcagtatatttct

SEQ ID NO: 6427586 - DNA, 15 bp, Homo sapiens
tcaaatgctaaatgc

SEQ ID NO: 6427587 - DNA, 20 bp, Homo sapiens
tcaaatgctactcagtatat

SEQ ID NO: 6427588 - DNA, 14 bp, Homo sapiens
tcaaatgctcagac

SEQ ID NO: 6427589 - DNA, 23 bp, Homo sapiens
tcaaatgctggcaaatccaggct

SEQ ID NO: 6427590 - DNA, 21 bp, Homo sapiens
tcaaatgcttggcttctcata

SEQ ID NO: 6427591 - DNA, 17 bp, Homo sapiens
tcaaatgctttttgttt

SEQ ID NO: 6427592 - DNA, 15 bp, Homo sapiens
tcaaatggaaaggag

SEQ ID NO: 6427593 - DNA, 20 bp, Homo sapiens
tcaaatggaagacacattga

SEQ ID NO: 6427594 - DNA, 21 bp, Homo sapiens
tcaaatggagaaacaggccca

SEQ ID NO: 6427595 - DNA, 16 bp, Homo sapiens
tcaaatggatgtaata

SEQ ID NO: 6427596 - DNA, 17 bp, Homo sapiens
tcaaatgggaaaaaaac

SEQ ID NO: 6427597 - DNA, 18 bp, Homo sapiens
tcaaatgggagactcttt

SEQ ID NO: 6427598 - DNA, 21 bp, Homo sapiens
tcaaatggtaggcatttccta

SEQ ID NO: 6427599 - DNA, 21 bp, Homo sapiens
tcaaatggtattttttgtgaa

SEQ ID NO: 6427600 - DNA, 19 bp, Homo sapiens
tcaaatgtaaactctcttc

SEQ ID NO: 6427601 - DNA, 14 bp, Homo sapiens
tcaaatgtaaatca

SEQ ID NO: 6427602 - DNA, 14 bp, Homo sapiens
tcaaatgtatgtat

SEQ ID NO: 6427603 - DNA, 22 bp, Homo sapiens
tcaaatgtcatttcatacaaat

SEQ ID NO: 6427604 - DNA, 15 bp, Homo sapiens
tcaaatgtgtaactt

SEQ ID NO: 6427605 - DNA, 14 bp, Homo sapiens
tcaaatgttacaaa

SEQ ID NO: 6427606 - DNA, 23 bp, Homo sapiens
tcaaatgttacagtttatattgt

SEQ ID NO: 6427607 - DNA, 18 bp, Homo sapiens
tcaaatgttattcaataa

SEQ ID NO: 6427608 - DNA, 21 bp, Homo sapiens
tcaaatgttctaagtttctaa

SEQ ID NO: 6427609 - DNA, 23 bp, Homo sapiens
tcaaatgttctaagtttctaaga

SEQ ID NO: 6427610 - DNA, 14 bp, Homo sapiens
tcaaatgtttaatc

SEQ ID NO: 6427611 - DNA, 15 bp, Homo sapiens
tcaaatgtttaatca

SEQ ID NO: 6427612 - DNA, 14 bp, Homo sapiens
tcaaatgtttcctt

SEQ ID NO: 6427613 - DNA, 15 bp, Homo sapiens
tcaaatgttttctgc

SEQ ID NO: 6427614 - DNA, 22 bp, Homo sapiens
tcaaatgttttctgcagaaaaa

SEQ ID NO: 6427615 - DNA, 15 bp, Homo sapiens
tcaaattaagattct

SEQ ID NO: 6427616 - DNA, 10 bp, Homo sapiens
tcaaattaat

SEQ ID NO: 6427617 - DNA, 14 bp, Homo sapiens
tcaaattaccgtgt

SEQ ID NO: 6427618 - DNA, 17 bp, Homo sapiens
tcaaattattaatctga

SEQ ID NO: 6427619 - DNA, 20 bp, Homo sapiens
tcaaattattaatctgaaaa

SEQ ID NO: 6427620 - DNA, 17 bp, Homo sapiens
tcaaattcaatgattct

SEQ ID NO: 6427621 - DNA, 21 bp, Homo sapiens
tcaaattcacgttctagtgaa

SEQ ID NO: 6427622 - DNA, 20 bp, Homo sapiens
tcaaattctctatgtacaga

SEQ ID NO: 6427623 - DNA, 13 bp, Homo sapiens
tcaaattctgatt

SEQ ID NO: 6427624 - DNA, 14 bp, Homo sapiens
tcaaattctgatta

SEQ ID NO: 6427625 - DNA, 19 bp, Homo sapiens
tcaaattctgattattaca

SEQ ID NO: 6427626 - DNA, 19 bp, Homo sapiens
tcaaattctttttttatta

SEQ ID NO: 6427627 - DNA, 16 bp, Homo sapiens
tcaaattgcctttctt

SEQ ID NO: 6427628 - DNA, 17 bp, Homo sapiens
tcaaattgctgcttgga

SEQ ID NO: 6427629 - DNA, 12 bp, Homo sapiens
tcaaattgtatc

SEQ ID NO: 6427630 - DNA, 20 bp, Homo sapiens
tcaaattgtcagcaatttaa

SEQ ID NO: 6427631 - DNA, 19 bp, Homo sapiens
tcaaattgtgcaaaatatt

SEQ ID NO: 6427632 - DNA, 20 bp, Homo sapiens
tcaaattgtgcaaaatattg

SEQ ID NO: 6427633 - DNA, 15 bp, Homo sapiens
tcaaattgttaggaa

SEQ ID NO: 6427634 - DNA, 13 bp, Homo sapiens
tcaaatttaaagg

SEQ ID NO: 6427635 - DNA, 15 bp, Homo sapiens
tcaaatttacattta

SEQ ID NO: 6427636 - DNA, 16 bp, Homo sapiens
tcaaatttactttaaa

SEQ ID NO: 6427637 - DNA, 21 bp, Homo sapiens
tcaaatttactttaaaaagaa

SEQ ID NO: 6427638 - DNA, 22 bp, Homo sapiens
tcaaatttagaaactaattgac

SEQ ID NO: 6427639 - DNA, 18 bp, Homo sapiens
tcaaatttatttttttct

SEQ ID NO: 6427640 - DNA, 13 bp, Homo sapiens
tcaaatttctaaa

SEQ ID NO: 6427641 - DNA, 15 bp, Homo sapiens
tcaaatttctaaatc

SEQ ID NO: 6427642 - DNA, 16 bp, Homo sapiens
tcaaatttctaaatct

SEQ ID NO: 6427643 - DNA, 14 bp, Homo sapiens
tcaaatttgtaata

SEQ ID NO: 6427644 - DNA, 18 bp, Homo sapiens
tcaaatttgtaataaaac

SEQ ID NO: 6427645 - DNA, 12 bp, Homo sapiens
tcaaatttgtac

SEQ ID NO: 6427646 - DNA, 20 bp, Homo sapiens
tcaaatttgtagggtttcta

SEQ ID NO: 6427647 - DNA, 23 bp, Homo sapiens
tcaaatttgtagggtttctaggt

SEQ ID NO: 6427648 - DNA, 21 bp, Homo sapiens
tcaaatttttcatctcttcaa

SEQ ID NO: 6427649 - DNA, 16 bp, Homo sapiens
tcaaatttttctggga

SEQ ID NO: 6427650 - DNA, 20 bp, Homo sapiens
tcaaattttttaaaagagac

SEQ ID NO: 6427651 - DNA, 20 bp, Homo sapiens
tcaacaaaagggagaacatg

SEQ ID NO: 6427652 - DNA, 21 bp, Homo sapiens
tcaacaaagaaatattatttg

SEQ ID NO: 6427653 - DNA, 21 bp, Homo sapiens
tcaacaaagaagaaccatctt

SEQ ID NO: 6427654 - DNA, 15 bp, Homo sapiens
tcaacaaatttcatt

SEQ ID NO: 6427655 - DNA, 17 bp, Homo sapiens
tcaacaaatttcattgc

SEQ ID NO: 6427656 - DNA, 18 bp, Homo sapiens
tcaacaaatttcattgca

SEQ ID NO: 6427657 - DNA, 19 bp, Homo sapiens
tcaacaacatcagaaagaa

SEQ ID NO: 6427658 - DNA, 21 bp, Homo sapiens
tcaacaacattcctcaaaatg

SEQ ID NO: 6427659 - DNA, 14 bp, Homo sapiens
tcaacaaccatgcc

SEQ ID NO: 6427660 - DNA, 13 bp, Homo sapiens
tcaacaactttgt

SEQ ID NO: 6427661 - DNA, 16 bp, Homo sapiens
tcaacaactttgtgct

SEQ ID NO: 6427662 - DNA, 17 bp, Homo sapiens
tcaacaagaacgattca

SEQ ID NO: 6427663 - DNA, 15 bp, Homo sapiens
tcaacaagaagaaac

SEQ ID NO: 6427664 - DNA, 20 bp, Homo sapiens
tcaacaagaatattgtatgt

SEQ ID NO: 6427665 - DNA, 13 bp, Homo sapiens
tcaacaagcctga

SEQ ID NO: 6427666 - DNA, 21 bp, Homo sapiens
tcaacaaggatcaggctgctg

SEQ ID NO: 6427667 - DNA, 16 bp, Homo sapiens
tcaacaaggcttgctg

SEQ ID NO: 6427668 - DNA, 22 bp, Homo sapiens
tcaacaagggagagacctcatc

SEQ ID NO: 6427669 - DNA, 19 bp, Homo sapiens
tcaacaaggggtcaatgtc

SEQ ID NO: 6427670 - DNA, 14 bp, Homo sapiens
tcaacaataaaaca

SEQ ID NO: 6427671 - DNA, 15 bp, Homo sapiens
tcaacaataaaacat

SEQ ID NO: 6427672 - DNA, 18 bp, Homo sapiens
tcaacaataaaatttttt

SEQ ID NO: 6427673 - DNA, 14 bp, Homo sapiens
tcaacaataaagac

SEQ ID NO: 6427674 - DNA, 18 bp, Homo sapiens
tcaacaatgattaatcag

SEQ ID NO: 6427675 - DNA, 17 bp, Homo sapiens
tcaacaatgattttctt

SEQ ID NO: 6427676 - DNA, 23 bp, Homo sapiens
tcaacaatggttgaatgaataaa

SEQ ID NO: 6427677 - DNA, 14 bp, Homo sapiens
tcaacaattctaaa

SEQ ID NO: 6427678 - DNA, 15 bp, Homo sapiens
tcaacaattctaaaa

SEQ ID NO: 6427679 - DNA, 16 bp, Homo sapiens
tcaacaattggtgtca

SEQ ID NO: 6427680 - DNA, 18 bp, Homo sapiens
tcaacaatttcaataaaa

SEQ ID NO: 6427681 - DNA, 18 bp, Homo sapiens
tcaacacaaagacacagg

SEQ ID NO: 6427682 - DNA, 20 bp, Homo sapiens
tcaacacaaagacacaggaa

SEQ ID NO: 6427683 - DNA, 21 bp, Homo sapiens
tcaacacaaagacatggaagg

SEQ ID NO: 6427684 - DNA, 18 bp, Homo sapiens
tcaacacacagtatagat

SEQ ID NO: 6427685 - DNA, 14 bp, Homo sapiens
tcaacacattactt

SEQ ID NO: 6427686 - DNA, 21 bp, Homo sapiens
tcaacacattacttgcacaag

SEQ ID NO: 6427687 - DNA, 21 bp, Homo sapiens
tcaacaccaccgagctctgtg

SEQ ID NO: 6427688 - DNA, 20 bp, Homo sapiens
tcaacaccctgcttctcccg

SEQ ID NO: 6427689 - DNA, 22 bp, Homo sapiens
tcaacaccctgcttctcccggg

SEQ ID NO: 6427690 - DNA, 16 bp, Homo sapiens
tcaacactagcatttt

SEQ ID NO: 6427691 - DNA, 17 bp, Homo sapiens
tcaacactatatatttt

SEQ ID NO: 6427692 - DNA, 18 bp, Homo sapiens
tcaacactcccttcccat

SEQ ID NO: 6427693 - DNA, 16 bp, Homo sapiens
tcaacactcttcttga

SEQ ID NO: 6427694 - DNA, 21 bp, Homo sapiens
tcaacactcttcttgagcaga

SEQ ID NO: 6427695 - DNA, 16 bp, Homo sapiens
tcaacacttattttct

SEQ ID NO: 6427696 - DNA, 14 bp, Homo sapiens
tcaacagaacatat

SEQ ID NO: 6427697 - DNA, 21 bp, Homo sapiens
tcaacagaagcatttgtattt

SEQ ID NO: 6427698 - DNA, 12 bp, Homo sapiens
tcaacagaatga

SEQ ID NO: 6427699 - DNA, 19 bp, Homo sapiens
tcaacagacctaagaaata

SEQ ID NO: 6427700 - DNA, 19 bp, Homo sapiens
tcaacagagaaggcaggaa

SEQ ID NO: 6427701 - DNA, 23 bp, Homo sapiens
tcaacagagaggaccaacatcca

SEQ ID NO: 6427702 - DNA, 13 bp, Homo sapiens
tcaacagatgata

SEQ ID NO: 6427703 - DNA, 22 bp, Homo sapiens
tcaacagattattttggaaagt

SEQ ID NO: 6427704 - DNA, 16 bp, Homo sapiens
tctaggaaatatttat

SEQ ID NO: 6427705 - DNA, 13 bp, Homo sapiens
tctaggaaatgta

SEQ ID NO: 6427706 - DNA, 21 bp, Homo sapiens
tctaggaagactttggaaaga

SEQ ID NO: 6427707 - DNA, 18 bp, Homo sapiens
tctaggacgccacccagc

SEQ ID NO: 6427708 - DNA, 23 bp, Homo sapiens
tctaggactgaattatgaaactt

SEQ ID NO: 6427709 - DNA, 16 bp, Homo sapiens
tctaggacttcaaagt

SEQ ID NO: 6427710 - DNA, 23 bp, Homo sapiens
tctaggagaaacttagaggaaaa

SEQ ID NO: 6427711 - DNA, 20 bp, Homo sapiens
tctaggagacagagccaagc

SEQ ID NO: 6427712 - DNA, 21 bp, Homo sapiens
tctaggagcaaggtgagaaat

SEQ ID NO: 6427713 - DNA, 21 bp, Homo sapiens
tctaggagcacaataatttgt

SEQ ID NO: 6427714 - DNA, 21 bp, Homo sapiens
tctaggagctgggaggaaaag

SEQ ID NO: 6427715 - DNA, 23 bp, Homo sapiens
tctaggaggagctagtaggaatg

SEQ ID NO: 6427716 - DNA, 20 bp, Homo sapiens
tctaggagggagccttgtga

SEQ ID NO: 6427717 - DNA, 18 bp, Homo sapiens
tctaggaggtctctaaga

SEQ ID NO: 6427718 - DNA, 14 bp, Homo sapiens
tctaggagtattta

SEQ ID NO: 6427719 - DNA, 23 bp, Homo sapiens
tctaggatagctaactgtaaatc

SEQ ID NO: 6427720 - DNA, 15 bp, Homo sapiens
tctaggatgaacaat

SEQ ID NO: 6427721 - DNA, 19 bp, Homo sapiens
tctaggatgaacaatgtat

SEQ ID NO: 6427722 - DNA, 16 bp, Homo sapiens
tctaggatggggcacg

SEQ ID NO: 6427723 - DNA, 13 bp, Homo sapiens
tctaggatgtgga

SEQ ID NO: 6427724 - DNA, 15 bp, Homo sapiens
tctaggcaaaagaaa

SEQ ID NO: 6427725 - DNA, 22 bp, Homo sapiens
tctaggcaaaattgtgaagcta

SEQ ID NO: 6427726 - DNA, 18 bp, Homo sapiens
tctaggcaagcaggacct

SEQ ID NO: 6427727 - DNA, 19 bp, Homo sapiens
tctaggcaagcaggacctg

SEQ ID NO: 6427728 - DNA, 22 bp, Homo sapiens
tctaggcaagcaggacctggca

SEQ ID NO: 6427729 - DNA, 15 bp, Homo sapiens
tctaggcacaaggtt

SEQ ID NO: 6427730 - DNA, 15 bp, Homo sapiens
tctaggcactgtagt

SEQ ID NO: 6427731 - DNA, 22 bp, Homo sapiens
tctaggcactgtagttctaaga

SEQ ID NO: 6427732 - DNA, 22 bp, Homo sapiens
tctaggcagaagaagctgggag

SEQ ID NO: 6427733 - DNA, 23 bp, Homo sapiens
tctaggcagaagaagctgggagg

SEQ ID NO: 6427734 - DNA, 17 bp, Homo sapiens
tctaggcatattgatca

SEQ ID NO: 6427735 - DNA, 18 bp, Homo sapiens
tctaggcatcccagggga

SEQ ID NO: 6427736 - DNA, 16 bp, Homo sapiens
tctaggcccacaagtg

SEQ ID NO: 6427737 - DNA, 18 bp, Homo sapiens
tctaggcccacaagtgta

SEQ ID NO: 6427738 - DNA, 13 bp, Homo sapiens
tctaggccctgtg

SEQ ID NO: 6427739 - DNA, 23 bp, Homo sapiens
tctaggccctgtgagcacaaaga

SEQ ID NO: 6427740 - DNA, 14 bp, Homo sapiens
tctaggcctctcca

SEQ ID NO: 6427741 - DNA, 15 bp, Homo sapiens
tctaggcctctccag

SEQ ID NO: 6427742 - DNA, 23 bp, Homo sapiens
tctaggcctgaactaggtgctgg

SEQ ID NO: 6427743 - DNA, 20 bp, Homo sapiens
tctaggcctttcctctgcac

SEQ ID NO: 6427744 - DNA, 22 bp, Homo sapiens
tctaggcgaggcgaagctgagc

SEQ ID NO: 6427745 - DNA, 12 bp, Homo sapiens
tctaggctctgc

SEQ ID NO: 6427746 - DNA, 14 bp, Homo sapiens
tctaggctgctgca

SEQ ID NO: 6427747 - DNA, 16 bp, Homo sapiens
tctaggctgctgcaca

SEQ ID NO: 6427748 - DNA, 16 bp, Homo sapiens
tctaggctggaagagc

SEQ ID NO: 6427749 - DNA, 17 bp, Homo sapiens
tctaggctgttctgtag

SEQ ID NO: 6427750 - DNA, 21 bp, Homo sapiens
tctaggcttcaggttgcattg

SEQ ID NO: 6427751 - DNA, 22 bp, Homo sapiens
tctaggcttcaggttgcattgg

SEQ ID NO: 6427752 - DNA, 12 bp, Homo sapiens
tctagggaaaaa

SEQ ID NO: 6427753 - DNA, 19 bp, Homo sapiens
tctagggaaaaaccagcgt

SEQ ID NO: 6427754 - DNA, 22 bp, Homo sapiens
tctagggaaggccacctgcagg

SEQ ID NO: 6427755 - DNA, 22 bp, Homo sapiens
tctagggacatgaaatttacaa

SEQ ID NO: 6427756 - DNA, 17 bp, Homo sapiens
tctagggaccagaacca

SEQ ID NO: 6427757 - DNA, 20 bp, Homo sapiens
tctagggacccctcctccct

SEQ ID NO: 6427758 - DNA, 23 bp, Homo sapiens
tctagggactgccaggctgtttc

SEQ ID NO: 6427759 - DNA, 17 bp, Homo sapiens
tctagggagagaccctt

SEQ ID NO: 6427760 - DNA, 15 bp, Homo sapiens
tctagggcagggtgg

SEQ ID NO: 6427761 - DNA, 16 bp, Homo sapiens
tctagggcctcagtct

SEQ ID NO: 6427762 - DNA, 21 bp, Homo sapiens
tctagggcctcagtctggagt

SEQ ID NO: 6427763 - DNA, 16 bp, Homo sapiens
tctaggggcaggtgaa

SEQ ID NO: 6427764 - DNA, 23 bp, Homo sapiens
tctagggtacatggtgctgggag

SEQ ID NO: 6427765 - DNA, 14 bp, Homo sapiens
tctagggtgttctg

SEQ ID NO: 6427766 - DNA, 16 bp, Homo sapiens
tctagggtgttctgta

SEQ ID NO: 6427767 - DNA, 18 bp, Homo sapiens
tctagggttattgcattt

SEQ ID NO: 6427768 - DNA, 17 bp, Homo sapiens
tctagggttgctggagc

SEQ ID NO: 6427769 - DNA, 21 bp, Homo sapiens
tctagggttgctggagcctga

SEQ ID NO: 6427770 - DNA, 13 bp, Homo sapiens
tctaggtaatttt

SEQ ID NO: 6427771 - DNA, 17 bp, Homo sapiens
tctaggtagtgccctat

SEQ ID NO: 6427772 - DNA, 20 bp, Homo sapiens
tctaggtcagtacccacctg

SEQ ID NO: 6427773 - DNA, 15 bp, Homo sapiens
tctaggtccccatac

SEQ ID NO: 6427774 - DNA, 17 bp, Homo sapiens
tctaggtccccatactc

SEQ ID NO: 6427775 - DNA, 18 bp, Homo sapiens
tctaggtctcctcagggt

SEQ ID NO: 6427776 - DNA, 23 bp, Homo sapiens
tctaggtgcccttggaggccagc

SEQ ID NO: 6427777 - DNA, 20 bp, Homo sapiens
tctaggtggaggttgtgcat

SEQ ID NO: 6427778 - DNA, 15 bp, Homo sapiens
tctaggtggcaggac

SEQ ID NO: 6427779 - DNA, 17 bp, Homo sapiens
tctaggtgtggctgtga

SEQ ID NO: 6427780 - DNA, 16 bp, Homo sapiens
tctaggttaaagctaa

SEQ ID NO: 6427781 - DNA, 13 bp, Homo sapiens
tctaggttataca

SEQ ID NO: 6427782 - DNA, 14 bp, Homo sapiens
tctaggttatacaa

SEQ ID NO: 6427783 - DNA, 18 bp, Homo sapiens
tctaggttatacaataac

SEQ ID NO: 6427784 - DNA, 23 bp, Homo sapiens
tctaggttctaaaaattgtgatc

SEQ ID NO: 6427785 - DNA, 17 bp, Homo sapiens
tctaggttttacagatt

SEQ ID NO: 6427786 - DNA, 17 bp, Homo sapiens
tctagtaataaagactc

SEQ ID NO: 6427787 - DNA, 15 bp, Homo sapiens
tctagtacctgtgac

SEQ ID NO: 6427788 - DNA, 14 bp, Homo sapiens
tctagtactagaaa

SEQ ID NO: 6427789 - DNA, 16 bp, Homo sapiens
tctagtacttattaca

SEQ ID NO: 6427790 - DNA, 22 bp, Homo sapiens
tctagtacttgggagacctgta

SEQ ID NO: 6427791 - DNA, 23 bp, Homo sapiens
tctagtagaaagaaaatgtctgt

SEQ ID NO: 6427792 - DNA, 16 bp, Homo sapiens
tctagtagctgaaatg

SEQ ID NO: 6427793 - DNA, 18 bp, Homo sapiens
tctagtagctgaaatgca

SEQ ID NO: 6427794 - DNA, 16 bp, Homo sapiens
tctagtaggtctgcac

SEQ ID NO: 6427795 - DNA, 16 bp, Homo sapiens
tctagtatacagtgat

SEQ ID NO: 6427796 - DNA, 15 bp, Homo sapiens
tctagtatctattgt

SEQ ID NO: 6427797 - DNA, 14 bp, Homo sapiens
tctagtattcttta

SEQ ID NO: 6427798 - DNA, 17 bp, Homo sapiens
tctagtattttatctgg

SEQ ID NO: 6427799 - DNA, 21 bp, Homo sapiens
tctagtcaactgctgttttat

SEQ ID NO: 6427800 - DNA, 14 bp, Homo sapiens
tctagtcaatgaca

SEQ ID NO: 6427801 - DNA, 20 bp, Homo sapiens
tctagtcaatgacatgaatt

SEQ ID NO: 6427802 - DNA, 22 bp, Homo sapiens
tctagtcaatgacatgaatttt

SEQ ID NO: 6427803 - DNA, 12 bp, Homo sapiens
tctagtcagcac

SEQ ID NO: 6427804 - DNA, 17 bp, Homo sapiens
tctagtcagtatctgta

SEQ ID NO: 6427805 - DNA, 12 bp, Homo sapiens
tctagtcattgt

SEQ ID NO: 6427806 - DNA, 16 bp, Homo sapiens
tctagtcattgtcata

SEQ ID NO: 6427807 - DNA, 14 bp, Homo sapiens
tctagtcatttgtt

SEQ ID NO: 6427808 - DNA, 19 bp, Homo sapiens
tctagtccctgtgttctgc

SEQ ID NO: 6427809 - DNA, 19 bp, Homo sapiens
tctagtcctattctattgc

SEQ ID NO: 6427810 - DNA, 19 bp, Homo sapiens
tctagtccttgtcttgtaa

SEQ ID NO: 6427811 - DNA, 14 bp, Homo sapiens
tctagtctctctgg

SEQ ID NO: 6427812 - DNA, 20 bp, Homo sapiens
tctagtctggaactgctgct

SEQ ID NO: 6427813 - DNA, 17 bp, Homo sapiens
tctagtctgtttcatta

SEQ ID NO: 6427814 - DNA, 13 bp, Homo sapiens
tctagtcttctgg

SEQ ID NO: 6427815 - DNA, 17 bp, Homo sapiens
tctagtcttgacctctc

SEQ ID NO: 6427816 - DNA, 20 bp, Homo sapiens
tctagtcttgacctctccag

SEQ ID NO: 6427817 - DNA, 22 bp, Homo sapiens
tctagtgagcagtcaggaaaga

SEQ ID NO: 6427818 - DNA, 16 bp, Homo sapiens
tctagtgagcctgggc

SEQ ID NO: 6427819 - DNA, 19 bp, Homo sapiens
tctagtgatttcctgtata

SEQ ID NO: 6427820 - DNA, 14 bp, Homo sapiens
tctagtgcagctga

SEQ ID NO: 6427821 - DNA, 22 bp, Homo sapiens
tctagtgcagctgattttaaca

SEQ ID NO: 6427822 - DNA, 23 bp, Homo sapiens
tctagtgcagctgattttaacaa

SEQ ID NO: 6427823 - DNA, 14 bp, Homo sapiens
tctagtgccctcca

SEQ ID NO: 6427824 - DNA, 14 bp, Homo sapiens
tctagtgccttcta

SEQ ID NO: 6427825 - DNA, 17 bp, Homo sapiens
tctagtgctgctgaaga

SEQ ID NO: 6427826 - DNA, 16 bp, Homo sapiens
tctagtgctgtgaaaa

SEQ ID NO: 6427827 - DNA, 19 bp, Homo sapiens
tctagtgctgtgaaaaaaa

SEQ ID NO: 6427828 - DNA, 14 bp, Homo sapiens
tctagtggctgttc

SEQ ID NO: 6427829 - DNA, 22 bp, Homo sapiens
tctagtggctgttcatgctcca

SEQ ID NO: 6427830 - DNA, 15 bp, Homo sapiens
tctagtgggacagcc

SEQ ID NO: 6427831 - DNA, 19 bp, Homo sapiens
tctagtgggacagcccaga

SEQ ID NO: 6427832 - DNA, 17 bp, Homo sapiens
tctagtggtctttgtaa

SEQ ID NO: 6427833 - DNA, 19 bp, Homo sapiens
tctagtgtaccaagtgctt

SEQ ID NO: 6427834 - DNA, 18 bp, Homo sapiens
tctagtgtagctgccaca

SEQ ID NO: 6427835 - DNA, 13 bp, Homo sapiens
tctagtgtatcaa

SEQ ID NO: 6427836 - DNA, 22 bp, Homo sapiens
tctagtgtatcaaaatgctctt

SEQ ID NO: 6427837 - DNA, 19 bp, Homo sapiens
tctagtgtccataaataaa

SEQ ID NO: 6427838 - DNA, 18 bp, Homo sapiens
tctagtgtctaaaacact

SEQ ID NO: 6427839 - DNA, 17 bp, Homo sapiens
tctagtgtgtcctgtga

SEQ ID NO: 6427840 - DNA, 14 bp, Homo sapiens
tctagtgttttcaa

SEQ ID NO: 6427841 - DNA, 18 bp, Homo sapiens
tctagttaactttttcca

SEQ ID NO: 6427842 - DNA, 15 bp, Homo sapiens
tctagttaggccacg

SEQ ID NO: 6427843 - DNA, 22 bp, Homo sapiens
tctagttcagagccaagcctta

SEQ ID NO: 6427844 - DNA, 14 bp, Homo sapiens
tctagttcattgaa

SEQ ID NO: 6427845 - DNA, 14 bp, Homo sapiens
tctagttctagatg

SEQ ID NO: 6427846 - DNA, 20 bp, Homo sapiens
tctagttctcaatcactgct

SEQ ID NO: 6427847 - DNA, 16 bp, Homo sapiens
tctagttctgccagga

SEQ ID NO: 6427848 - DNA, 13 bp, Homo sapiens
tctagttctgttg

SEQ ID NO: 6427849 - DNA, 14 bp, Homo sapiens
tctagttgaggagt

SEQ ID NO: 6427850 - DNA, 21 bp, Homo sapiens
tctagttgcccccattcccag

SEQ ID NO: 6427851 - DNA, 15 bp, Homo sapiens
tctagtttattctaa

SEQ ID NO: 6427852 - DNA, 15 bp, Homo sapiens
tctagtttcagtaaa

SEQ ID NO: 6427853 - DNA, 13 bp, Homo sapiens
tctagtttcccac

SEQ ID NO: 6427854 - DNA, 15 bp, Homo sapiens
tctagtttctagtgt

SEQ ID NO: 6427855 - DNA, 16 bp, Homo sapiens
tctagtttctagtgtc

SEQ ID NO: 6427856 - DNA, 13 bp, Homo sapiens
tctagtttctctt

SEQ ID NO: 6427857 - DNA, 14 bp, Homo sapiens
tctagtttcttgtg

SEQ ID NO: 6427858 - DNA, 14 bp, Homo sapiens
tctagtttcttttg

SEQ ID NO: 6427859 - DNA, 15 bp, Homo sapiens
tctagtttgcaactt

SEQ ID NO: 6427860 - DNA, 18 bp, Homo sapiens
tctagtttgcattcctga

SEQ ID NO: 6427861 - DNA, 22 bp, Homo sapiens
tctagtttggcacatgcaggta

SEQ ID NO: 6427862 - DNA, 14 bp, Homo sapiens
tctagttttatctt

SEQ ID NO: 6427863 - DNA, 12 bp, Homo sapiens
tctagttttcag

SEQ ID NO: 6427864 - DNA, 15 bp, Homo sapiens
tctagttttctagac

SEQ ID NO: 6427865 - DNA, 13 bp, Homo sapiens
tctagttttgtca

SEQ ID NO: 6427866 - DNA, 21 bp, Homo sapiens
tctagtttttggaaaaacctt

SEQ ID NO: 6427867 - DNA, 22 bp, Homo sapiens
tctagttttttacttttgttta

SEQ ID NO: 6427868 - DNA, 22 bp, Homo sapiens
tctagttttttcttccttttca

SEQ ID NO: 6427869 - DNA, 13 bp, Homo sapiens
tctataaaaacca

SEQ ID NO: 6427870 - DNA, 23 bp, Homo sapiens
tctataaaaaccacccacaaaga

SEQ ID NO: 6427871 - DNA, 18 bp, Homo sapiens
tctataaaaatactacaa

SEQ ID NO: 6427872 - DNA, 16 bp, Homo sapiens
tctataaaagaaacac

SEQ ID NO: 6427873 - DNA, 16 bp, Homo sapiens
tctataaaataaactt

SEQ ID NO: 6427874 - DNA, 20 bp, Homo sapiens
aactgatcaaaaataaacta

SEQ ID NO: 6427875 - DNA, 20 bp, Homo sapiens
aactgatcatgtttatgaga

SEQ ID NO: 6427876 - DNA, 21 bp, Homo sapiens
aactgatccagtataagacta

SEQ ID NO: 6427877 - DNA, 22 bp, Homo sapiens
aactgatccatcctgtttttcc

SEQ ID NO: 6427878 - DNA, 20 bp, Homo sapiens
aactgatctcaagtatatgt

SEQ ID NO: 6427879 - DNA, 13 bp, Homo sapiens
aactgatctgtta

SEQ ID NO: 6427880 - DNA, 17 bp, Homo sapiens
aactgatggaccgggtg

SEQ ID NO: 6427881 - DNA, 22 bp, Homo sapiens
aactgatggaccgggtgggcct

SEQ ID NO: 6427882 - DNA, 18 bp, Homo sapiens
aactgatggcaatattaa

SEQ ID NO: 6427883 - DNA, 23 bp, Homo sapiens
aactgatgggtatcatgcttcta

SEQ ID NO: 6427884 - DNA, 13 bp, Homo sapiens
aactgatgtatag

SEQ ID NO: 6427885 - DNA, 18 bp, Homo sapiens
aactgatgtatagcttta

SEQ ID NO: 6427886 - DNA, 22 bp, Homo sapiens
aactgatgtatagctttaacat

SEQ ID NO: 6427887 - DNA, 19 bp, Homo sapiens
aactgatgttactagcctc

SEQ ID NO: 6427888 - DNA, 21 bp, Homo sapiens
aactgatgttactagcctctc

SEQ ID NO: 6427889 - DNA, 14 bp, Homo sapiens
aactgatgtttgaa

SEQ ID NO: 6427890 - DNA, 21 bp, Homo sapiens
tcaataaagaaaaaaatagtt

SEQ ID NO: 6427891 - DNA, 13 bp, Homo sapiens
tcaataaagcaga

SEQ ID NO: 6427892 - DNA, 17 bp, Homo sapiens
tcaataaagcagagcca

SEQ ID NO: 6427893 - DNA, 12 bp, Homo sapiens
tcaataaagtat

SEQ ID NO: 6427894 - DNA, 15 bp, Homo sapiens
tcaataaagtattta

SEQ ID NO: 6427895 - DNA, 15 bp, Homo sapiens
tcaataaagttgttg

SEQ ID NO: 6427896 - DNA, 14 bp, Homo sapiens
tcaataaagtttga

SEQ ID NO: 6427897 - DNA, 19 bp, Homo sapiens
tcaataaagtttgatcttc

SEQ ID NO: 6427898 - DNA, 22 bp, Homo sapiens
tcaataaatagatgagtcctgt

SEQ ID NO: 6427899 - DNA, 23 bp, Homo sapiens
tcaataaatagatgagtcctgtt

SEQ ID NO: 6427900 - DNA, 15 bp, Homo sapiens
tcaataaatctttca

SEQ ID NO: 6427901 - DNA, 19 bp, Homo sapiens
tcaataaatgacacccaga

SEQ ID NO: 6427902 - DNA, 16 bp, Homo sapiens
tcaataaattttttct

SEQ ID NO: 6427903 - DNA, 18 bp, Homo sapiens
tcaataacactgtatttt

SEQ ID NO: 6427904 - DNA, 21 bp, Homo sapiens
tcaataacagatggtgctgct

SEQ ID NO: 6427905 - DNA, 14 bp, Homo sapiens
tcaataacagccgc

SEQ ID NO: 6427906 - DNA, 14 bp, Homo sapiens
tcaataacttagaa

SEQ ID NO: 6427907 - DNA, 13 bp, Homo sapiens
tcaataagaaggt

SEQ ID NO: 6427908 - DNA, 18 bp, Homo sapiens
tcaataagtgttgtacca

SEQ ID NO: 6427909 - DNA, 12 bp, Homo sapiens
tcaataataaaa

SEQ ID NO: 6427910 - DNA, 16 bp, Homo sapiens
tcaataatccatgaaa

SEQ ID NO: 6427911 - DNA, 18 bp, Homo sapiens
tcaatacactagttgttt

SEQ ID NO: 6427912 - DNA, 17 bp, Homo sapiens
tcaatacactcaagtgc

SEQ ID NO: 6427913 - DNA, 13 bp, Homo sapiens
tcaatacagcctg

SEQ ID NO: 6427914 - DNA, 22 bp, Homo sapiens
tcaatacagcctgaataaacca

SEQ ID NO: 6427915 - DNA, 15 bp, Homo sapiens
tcaatacagcttcat

SEQ ID NO: 6427916 - DNA, 17 bp, Homo sapiens
tcaatacagtacaggca

SEQ ID NO: 6427917 - DNA, 19 bp, Homo sapiens
tcaatacagtgaaggtctt

SEQ ID NO: 6427918 - DNA, 21 bp, Homo sapiens
tcaatacagtttataaagcca

SEQ ID NO: 6427919 - DNA, 14 bp, Homo sapiens
tcaatacccttggc

SEQ ID NO: 6427920 - DNA, 20 bp, Homo sapiens
tcaatacccttggcactgat

SEQ ID NO: 6427921 - DNA, 16 bp, Homo sapiens
tcaatacctggcctca

SEQ ID NO: 6427922 - DNA, 17 bp, Homo sapiens
tcaatacttgaatatgg

SEQ ID NO: 6427923 - DNA, 22 bp, Homo sapiens
tcaatacttgaatatggaacat

SEQ ID NO: 6427924 - DNA, 18 bp, Homo sapiens
tcaatactttgaacacaa

SEQ ID NO: 6427925 - DNA, 15 bp, Homo sapiens
tcaatacttttgtgt

SEQ ID NO: 6427926 - DNA, 23 bp, Homo sapiens
tcaatacttttgtgtattctgtg

SEQ ID NO: 6427927 - DNA, 15 bp, Homo sapiens
tcaatagaaagtcat

SEQ ID NO: 6427928 - DNA, 22 bp, Homo sapiens
tcaatagaactgtttcaactgt

SEQ ID NO: 6427929 - DNA, 12 bp, Homo sapiens
tcaatagccact

SEQ ID NO: 6427930 - DNA, 13 bp, Homo sapiens
tcaatagccacta

SEQ ID NO: 6427931 - DNA, 21 bp, Homo sapiens
tcaataggcaaaagtgtaaca

SEQ ID NO: 6427932 - DNA, 19 bp, Homo sapiens
tcaatagtaaaagataaca

SEQ ID NO: 6427933 - DNA, 13 bp, Homo sapiens
tcaatagtaatat

SEQ ID NO: 6427934 - DNA, 23 bp, Homo sapiens
tcaatagtacccaaccaaagatg

SEQ ID NO: 6427935 - DNA, 23 bp, Homo sapiens
tcaatagtggcataccaaatggc

SEQ ID NO: 6427936 - DNA, 18 bp, Homo sapiens
tcaatagttcaaggaact

SEQ ID NO: 6427937 - DNA, 15 bp, Homo sapiens
tcaatataaaaacat

SEQ ID NO: 6427938 - DNA, 16 bp, Homo sapiens
tcaatataagaagcaa

SEQ ID NO: 6427939 - DNA, 13 bp, Homo sapiens
tcaatatatagtt

SEQ ID NO: 6427940 - DNA, 16 bp, Homo sapiens
tcaatatatagttagc

SEQ ID NO: 6427941 - DNA, 20 bp, Homo sapiens
tcaatatattgaacttttgt

SEQ ID NO: 6427942 - DNA, 15 bp, Homo sapiens
tcaatatcccaacat

SEQ ID NO: 6427943 - DNA, 21 bp, Homo sapiens
tcaatatcgtacctgtccctc

SEQ ID NO: 6427944 - DNA, 21 bp, Homo sapiens
tcaatatctaatatatatgaa

SEQ ID NO: 6427945 - DNA, 15 bp, Homo sapiens
tcaatatgaatctat

SEQ ID NO: 6427946 - DNA, 16 bp, Homo sapiens
tcaatatgagtctcaa

SEQ ID NO: 6427947 - DNA, 18 bp, Homo sapiens
tcaatatgcaagcagctt

SEQ ID NO: 6427948 - DNA, 13 bp, Homo sapiens
tcaatatgcttac

SEQ ID NO: 6427949 - DNA, 13 bp, Homo sapiens
tcaatatgtatat

SEQ ID NO: 6427950 - DNA, 19 bp, Homo sapiens
tcaatatgtatatatgtat

SEQ ID NO: 6427951 - DNA, 14 bp, Homo sapiens
tcaatattcctgaa

SEQ ID NO: 6427952 - DNA, 17 bp, Homo sapiens
tcaatattcctgaatga

SEQ ID NO: 6427953 - DNA, 18 bp, Homo sapiens
tcaatattcctgaatgaa

SEQ ID NO: 6427954 - DNA, 22 bp, Homo sapiens
tcaatattcctgaatgaaatat

SEQ ID NO: 6427955 - DNA, 16 bp, Homo sapiens
tcaatattgacatttg

SEQ ID NO: 6427956 - DNA, 17 bp, Homo sapiens
tcaatattgacatttgt

SEQ ID NO: 6427957 - DNA, 18 bp, Homo sapiens
tcaatattgacatttgta

SEQ ID NO: 6427958 - DNA, 20 bp, Homo sapiens
tcaatattgattttaaatat

SEQ ID NO: 6427959 - DNA, 12 bp, Homo sapiens
tcaatatttaag

SEQ ID NO: 6427960 - DNA, 19 bp, Homo sapiens
tcaatatttactgagactt

SEQ ID NO: 6427961 - DNA, 16 bp, Homo sapiens
tcaatatttagaaaat

SEQ ID NO: 6427962 - DNA, 11 bp, Homo sapiens
tcaatatttat

SEQ ID NO: 6427963 - DNA, 12 bp, Homo sapiens
tcaatatttatt

SEQ ID NO: 6427964 - DNA, 15 bp, Homo sapiens
tcaatatttcagata

SEQ ID NO: 6427965 - DNA, 18 bp, Homo sapiens
tcaatattttaacttttt

SEQ ID NO: 6427966 - DNA, 17 bp, Homo sapiens
tcaatattttccatgaa

SEQ ID NO: 6427967 - DNA, 16 bp, Homo sapiens
tcaatatttttagata

SEQ ID NO: 6427968 - DNA, 14 bp, Homo sapiens
tcaatatttttcta

SEQ ID NO: 6427969 - DNA, 14 bp, Homo sapiens
tcaatcaaacaggg

SEQ ID NO: 6427970 - DNA, 17 bp, Homo sapiens
tcaatcaaactttcagc

SEQ ID NO: 6427971 - DNA, 12 bp, Homo sapiens
tcaatcaaagct

SEQ ID NO: 6427972 - DNA, 13 bp, Homo sapiens
tcaatcaacacta

SEQ ID NO: 6427973 - DNA, 16 bp, Homo sapiens
tcaatcaacatctctt

SEQ ID NO: 6427974 - DNA, 15 bp, Homo sapiens
tcaatcaaccaaagt

SEQ ID NO: 6427975 - DNA, 16 bp, Homo sapiens
tcaatcaaccaaagtt

SEQ ID NO: 6427976 - DNA, 20 bp, Homo sapiens
tcaatcaaccaaagttagtt

SEQ ID NO: 6427977 - DNA, 23 bp, Homo sapiens
tcaatcaaccaaagttagttcag

SEQ ID NO: 6427978 - DNA, 16 bp, Homo sapiens
tcaatcaacctgcact

SEQ ID NO: 6427979 - DNA, 23 bp, Homo sapiens
tcaatcaagcaaaatttctgtat

SEQ ID NO: 6427980 - DNA, 18 bp, Homo sapiens
tcaatcactgcactgcat

SEQ ID NO: 6427981 - DNA, 23 bp, Homo sapiens
tcaatcactgcactgcatgcaaa

SEQ ID NO: 6427982 - DNA, 22 bp, Homo sapiens
tcaatcactgtcctccacacaa

SEQ ID NO: 6427983 - DNA, 19 bp, Homo sapiens
tcaatcacttgaaagtgaa

SEQ ID NO: 6427984 - DNA, 12 bp, Homo sapiens
tcaatcagcctt

SEQ ID NO: 6427985 - DNA, 14 bp, Homo sapiens
tcaatcagccttta

SEQ ID NO: 6427986 - DNA, 16 bp, Homo sapiens
tcaatcagtataattc

SEQ ID NO: 6427987 - DNA, 21 bp, Homo sapiens
tcaatcagtataattctgtac

SEQ ID NO: 6427988 - DNA, 19 bp, Homo sapiens
tcaatcagtctcagaatgt

SEQ ID NO: 6427989 - DNA, 21 bp, Homo sapiens
tcaatcatatttaaagggaat

SEQ ID NO: 6427990 - DNA, 20 bp, Homo sapiens
tcaatcatctgtgtgaaaat

SEQ ID NO: 6427991 - DNA, 14 bp, Homo sapiens
tcaatcatgaatga

SEQ ID NO: 6427992 - DNA, 18 bp, Homo sapiens
tcaatcatgggaatttta

SEQ ID NO: 6427993 - DNA, 12 bp, Homo sapiens
tcaatcatttct

SEQ ID NO: 6427994 - DNA, 15 bp, Homo sapiens
tcaatcatttctcac

SEQ ID NO: 6427995 - DNA, 15 bp, Homo sapiens
tcaatcattttggag

SEQ ID NO: 6427996 - DNA, 17 bp, Homo sapiens
tcaatccaaattccctc

SEQ ID NO: 6427997 - DNA, 21 bp, Homo sapiens
tcaatccaaattccctctgga

SEQ ID NO: 6427998 - DNA, 22 bp, Homo sapiens
tcaatccaaattccctctggag

SEQ ID NO: 6427999 - DNA, 16 bp, Homo sapiens
tcaatccacagtattg

SEQ ID NO: 6428000 - DNA, 17 bp, Homo sapiens
tcaatccacagtattgt

SEQ ID NO: 6428001 - DNA, 21 bp, Homo sapiens
tcaatccagagagcttaaatt

SEQ ID NO: 6428002 - DNA, 14 bp, Homo sapiens
tcaatccatcagca

SEQ ID NO: 6428003 - DNA, 16 bp, Homo sapiens
tcaatccatcagcaat

SEQ ID NO: 6428004 - DNA, 20 bp, Homo sapiens
tcaatccatcagcaatgctt

SEQ ID NO: 6428005 - DNA, 19 bp, Homo sapiens
tcaatcccaaaagtcacca

SEQ ID NO: 6428006 - DNA, 15 bp, Homo sapiens
tcaatcccaattctg

SEQ ID NO: 6428007 - DNA, 20 bp, Homo sapiens
tcaatcccaattctgtccca

SEQ ID NO: 6428008 - DNA, 15 bp, Homo sapiens
tcaatcccctcattc

SEQ ID NO: 6428009 - DNA, 17 bp, Homo sapiens
tcaatcccctcattcag

SEQ ID NO: 6428010 - DNA, 20 bp, Homo sapiens
tcaatcccctcattcaggaa

SEQ ID NO: 6428011 - DNA, 15 bp, Homo sapiens
tcaatcctcaaatca

SEQ ID NO: 6428012 - DNA, 20 bp, Homo sapiens
tcaatcctgattcctctcta

SEQ ID NO: 6428013 - DNA, 15 bp, Homo sapiens
tcaatccttgttcag

SEQ ID NO: 6428014 - DNA, 15 bp, Homo sapiens
tcaatctaaattaaa

SEQ ID NO: 6428015 - DNA, 18 bp, Homo sapiens
tcaatctcaatcctgcag

SEQ ID NO: 6428016 - DNA, 18 bp, Homo sapiens
tcaatctcccgctgctgc

SEQ ID NO: 6428017 - DNA, 14 bp, Homo sapiens
tcaatctcctctct

SEQ ID NO: 6428018 - DNA, 17 bp, Homo sapiens
tcaatctcgtatagaag

SEQ ID NO: 6428019 - DNA, 18 bp, Homo sapiens
tcaatctcgtttagtgcc

SEQ ID NO: 6428020 - DNA, 20 bp, Homo sapiens
tcaatctctggaaaaataag

SEQ ID NO: 6428021 - DNA, 19 bp, Homo sapiens
tcaatctctgggggctgag

SEQ ID NO: 6428022 - DNA, 16 bp, Homo sapiens
tcaatctctgttctgc

SEQ ID NO: 6428023 - DNA, 19 bp, Homo sapiens
tcaatctctgttctgctcc

SEQ ID NO: 6428024 - DNA, 21 bp, Homo sapiens
tcaatctgcagccattcttca

SEQ ID NO: 6428025 - DNA, 17 bp, Homo sapiens
tcaatctggcttctgca

SEQ ID NO: 6428026 - DNA, 22 bp, Homo sapiens
tcaatctggcttctgcattact

SEQ ID NO: 6428027 - DNA, 13 bp, Homo sapiens
tcaatctgtaaac

SEQ ID NO: 6428028 - DNA, 16 bp, Homo sapiens
tcaatctgtaaactgt

SEQ ID NO: 6428029 - DNA, 22 bp, Homo sapiens
tcaatctgtgaagcctttatct

SEQ ID NO: 6428030 - DNA, 21 bp, Homo sapiens
tcaatctgtgtaagaaaacaa

SEQ ID NO: 6428031 - DNA, 15 bp, Homo sapiens
tcaatcttgcatgta

SEQ ID NO: 6428032 - DNA, 12 bp, Homo sapiens
tcaatcttgccg

SEQ ID NO: 6428033 - DNA, 18 bp, Homo sapiens
tcaatctttaaaccaatt

SEQ ID NO: 6428034 - DNA, 11 bp, Homo sapiens
tcaatgaaaaa

SEQ ID NO: 6428035 - DNA, 22 bp, Homo sapiens
tcaatgaaaaatagtgtctttg

SEQ ID NO: 6428036 - DNA, 18 bp, Homo sapiens
tcaatgaaacaaagaaag

SEQ ID NO: 6428037 - DNA, 19 bp, Homo sapiens
tcaatgaaacaaagaaaga

SEQ ID NO: 6428038 - DNA, 20 bp, Homo sapiens
tcaatgaaaccttcctcttg

SEQ ID NO: 6428039 - DNA, 23 bp, Homo sapiens
tcaatgaaatatgtgaagcccag

SEQ ID NO: 6428040 - DNA, 19 bp, Homo sapiens
tcaatgaaatatttgctta

SEQ ID NO: 6428041 - DNA, 23 bp, Homo sapiens
tcaatgaaatatttgcttattta

SEQ ID NO: 6428042 - DNA, 16 bp, Homo sapiens
tcaatgaagccagctc

SEQ ID NO: 6428043 - DNA, 21 bp, Homo sapiens
tcaatgaagccagctcacagt

SEQ ID NO: 6428044 - DNA, 23 bp, Homo sapiens
tcaatgaatgaatgaatggctaa

SEQ ID NO: 6428045 - DNA, 19 bp, Homo sapiens
tcaatgacacccctggcct

SEQ ID NO: 6428046 - DNA, 17 bp, Homo sapiens
tcaatgacagagccttc

SEQ ID NO: 6428047 - DNA, 22 bp, Homo sapiens
tcaatgacatgaattttagctt

SEQ ID NO: 6428048 - DNA, 14 bp, Homo sapiens
tcaatgacctgtat

SEQ ID NO: 6428049 - DNA, 19 bp, Homo sapiens
tcaatgagagcataattta

SEQ ID NO: 6428050 - DNA, 12 bp, Homo sapiens
tcaatgagcatg

SEQ ID NO: 6428051 - DNA, 17 bp, Homo sapiens
tcaatgaggttatgaga

SEQ ID NO: 6428052 - DNA, 12 bp, Homo sapiens
tcaatgatctag

SEQ ID NO: 6428053 - DNA, 19 bp, Homo sapiens
tcaatgatctaggtttaac

SEQ ID NO: 6428054 - DNA, 16 bp, Homo sapiens
tcaatgattattttca

SEQ ID NO: 6428055 - DNA, 14 bp, Homo sapiens
tcaatgattcttcc

SEQ ID NO: 6428056 - DNA, 14 bp, Homo sapiens
tcaatgcaatgaaa

SEQ ID NO: 6428057 - DNA, 18 bp, Homo sapiens
tcaatgcaatgaaaacaa

SEQ ID NO: 6428058 - DNA, 22 bp, Homo sapiens
tcaatgcaatgcatctgaaagt

SEQ ID NO: 6428059 - DNA, 15 bp, Homo sapiens
tcaatgcagccagac

SEQ ID NO: 6428060 - DNA, 17 bp, Homo sapiens
tcaatgcagttgtctct

SEQ ID NO: 6428061 - DNA, 18 bp, Homo sapiens
tcaatgcagttgtctctg

SEQ ID NO: 6428062 - DNA, 16 bp, Homo sapiens
tcaatgcatacaataa

SEQ ID NO: 6428063 - DNA, 16 bp, Homo sapiens
tcaatgcattgtcttg

SEQ ID NO: 6428064 - DNA, 15 bp, Homo sapiens
tcaatgcatttaaaa

SEQ ID NO: 6428065 - DNA, 18 bp, Homo sapiens
tcaatgccttgattagac

SEQ ID NO: 6428066 - DNA, 17 bp, Homo sapiens
tcaatgcgcaaaatgca

SEQ ID NO: 6428067 - DNA, 22 bp, Homo sapiens
tcaatgcgttttgttgtagatg

SEQ ID NO: 6428068 - DNA, 15 bp, Homo sapiens
tcaatgctacaaaat

SEQ ID NO: 6428069 - DNA, 18 bp, Homo sapiens
aactgattattacttctg

SEQ ID NO: 6428070 - DNA, 21 bp, Homo sapiens
aactgattgctcccaggatct

SEQ ID NO: 6428071 - DNA, 22 bp, Homo sapiens
aactgattgctcccaggatctc

SEQ ID NO: 6428072 - DNA, 12 bp, Homo sapiens
aactgatttcca

SEQ ID NO: 6428073 - DNA, 16 bp, Homo sapiens
aactgatttccatcca

SEQ ID NO: 6428074 - DNA, 15 bp, Homo sapiens
aactgatttctatgg

SEQ ID NO: 6428075 - DNA, 13 bp, Homo sapiens
aactgatttcttc

SEQ ID NO: 6428076 - DNA, 20 bp, Homo sapiens
aactgattttacaaattaat

SEQ ID NO: 6428077 - DNA, 18 bp, Homo sapiens
aactgattttgtatgtaa

SEQ ID NO: 6428078 - DNA, 17 bp, Homo sapiens
aactgcaaaaaaagcct

SEQ ID NO: 6428079 - DNA, 18 bp, Homo sapiens
aactgcaaaaaaagcctc

SEQ ID NO: 6428080 - DNA, 15 bp, Homo sapiens
aactgcaaacagaaa

SEQ ID NO: 6428081 - DNA, 23 bp, Homo sapiens
aactgcaaattgtagcccagttg

SEQ ID NO: 6428082 - DNA, 15 bp, Homo sapiens
aactgcaacactgga

SEQ ID NO: 6428083 - DNA, 19 bp, Homo sapiens
aactgcaagtcacaaagga

SEQ ID NO: 6428084 - DNA, 14 bp, Homo sapiens
aactgcaagttcat

SEQ ID NO: 6428085 - DNA, 17 bp, Homo sapiens
aactgcaagttcatttt

SEQ ID NO: 6428086 - DNA, 19 bp, Homo sapiens
aactgcaataatatcaaaa

SEQ ID NO: 6428087 - DNA, 13 bp, Homo sapiens
aactgcaatagag

SEQ ID NO: 6428088 - DNA, 14 bp, Homo sapiens
aactgcaatgaaag

SEQ ID NO: 6428089 - DNA, 18 bp, Homo sapiens
aactgcacaatcagttta

SEQ ID NO: 6428090 - DNA, 19 bp, Homo sapiens
aactgcacacacagctcct

SEQ ID NO: 6428091 - DNA, 16 bp, Homo sapiens
aactgcacactcagtg

SEQ ID NO: 6428092 - DNA, 16 bp, Homo sapiens
aactgcacatgatttc

SEQ ID NO: 6428093 - DNA, 12 bp, Homo sapiens
aactgcacctgg

SEQ ID NO: 6428094 - DNA, 15 bp, Homo sapiens
aactgcagaaaaaat

SEQ ID NO: 6428095 - DNA, 22 bp, Homo sapiens
aactgcagaccatgaagtaaat

SEQ ID NO: 6428096 - DNA, 17 bp, Homo sapiens
aactgcagatagcccag

SEQ ID NO: 6428097 - DNA, 20 bp, Homo sapiens
aactgcagatagcccaggag

SEQ ID NO: 6428098 - DNA, 10 bp, Homo sapiens
aactgcagca

SEQ ID NO: 6428099 - DNA, 14 bp, Homo sapiens
aactgcagcctctc

SEQ ID NO: 6428100 - DNA, 16 bp, Homo sapiens
aactgcagcctctctg

SEQ ID NO: 6428101 - DNA, 17 bp, Homo sapiens
aactgcagcctctctgg

SEQ ID NO: 6428102 - DNA, 16 bp, Homo sapiens
aactgcagctgtgagt

SEQ ID NO: 6428103 - DNA, 14 bp, Homo sapiens
aactgcaggagcag

SEQ ID NO: 6428104 - DNA, 17 bp, Homo sapiens
aactgcaggagcagttt

SEQ ID NO: 6428105 - DNA, 14 bp, Homo sapiens
aactgcaggccctg

SEQ ID NO: 6428106 - DNA, 23 bp, Homo sapiens
aactgcaggccctggcctcccct

SEQ ID NO: 6428107 - DNA, 14 bp, Homo sapiens
aactgcagggaaaa

SEQ ID NO: 6428108 - DNA, 16 bp, Homo sapiens
aactgcagtgatgtat

SEQ ID NO: 6428109 - DNA, 20 bp, Homo sapiens
aactgcagttttaacttttt

SEQ ID NO: 6428110 - DNA, 22 bp, Homo sapiens
aactgcatatcggaggtggtgg

SEQ ID NO: 6428111 - DNA, 22 bp, Homo sapiens
aactgcatgcccagagacccag

SEQ ID NO: 6428112 - DNA, 16 bp, Homo sapiens
aactgcatgctgctgg

SEQ ID NO: 6428113 - DNA, 22 bp, Homo sapiens
aactgcattaccgcgttgtaaa

SEQ ID NO: 6428114 - DNA, 16 bp, Homo sapiens
aactgcattagaaatt

SEQ ID NO: 6428115 - DNA, 22 bp, Homo sapiens
aactgcattgactttcagtaaa

SEQ ID NO: 6428116 - DNA, 16 bp, Homo sapiens
aactgcattggctttg

SEQ ID NO: 6428117 - DNA, 10 bp, Homo sapiens
aactgcattt

SEQ ID NO: 6428118 - DNA, 20 bp, Homo sapiens
aactgccaaaaatataattc

SEQ ID NO: 6428119 - DNA, 13 bp, Homo sapiens
aactgccaagaaa

SEQ ID NO: 6428120 - DNA, 16 bp, Homo sapiens
aactgccaagcttgga

SEQ ID NO: 6428121 - DNA, 18 bp, Homo sapiens
aactgccacaagcacaat

SEQ ID NO: 6428122 - DNA, 20 bp, Homo sapiens
aactgccaggcagctgcagt

SEQ ID NO: 6428123 - DNA, 14 bp, Homo sapiens
aactgccaggctct

SEQ ID NO: 6428124 - DNA, 24 bp, Homo sapiens
aactgccaggctgcctcctgccct

SEQ ID NO: 6428125 - DNA, 13 bp, Homo sapiens
aactgccatgtag

SEQ ID NO: 6428126 - DNA, 11 bp, Homo sapiens
aactgccatta

SEQ ID NO: 6428127 - DNA, 12 bp, Homo sapiens
aactgccattat

SEQ ID NO: 6428128 - DNA, 21 bp, Homo sapiens
aactgccattattttctgtca

SEQ ID NO: 6428129 - DNA, 14 bp, Homo sapiens
aactgcccaaagca

SEQ ID NO: 6428130 - DNA, 13 bp, Homo sapiens
aactgcccagcaa

SEQ ID NO: 6428131 - DNA, 19 bp, Homo sapiens
aactgcccagccccttttc

SEQ ID NO: 6428132 - DNA, 18 bp, Homo sapiens
aactgccccctctgccct

SEQ ID NO: 6428133 - DNA, 14 bp, Homo sapiens
aactgccctaagcc

SEQ ID NO: 6428134 - DNA, 15 bp, Homo sapiens
aactgccctaagccc

SEQ ID NO: 6428135 - DNA, 17 bp, Homo sapiens
aactgccctaagccccc

SEQ ID NO: 6428136 - DNA, 14 bp, Homo sapiens
aactgccctgtcta

SEQ ID NO: 6428137 - DNA, 12 bp, Homo sapiens
aactgcccttcc

SEQ ID NO: 6428138 - DNA, 16 bp, Homo sapiens
aactgcccttgctgcc

SEQ ID NO: 6428139 - DNA, 17 bp, Homo sapiens
aactgccgtaatttaac

SEQ ID NO: 6428140 - DNA, 18 bp, Homo sapiens
aactgccgtaatttaact

SEQ ID NO: 6428141 - DNA, 20 bp, Homo sapiens
aactgccgtgggaattttat

SEQ ID NO: 6428142 - DNA, 13 bp, Homo sapiens
aactgcctaaaat

SEQ ID NO: 6428143 - DNA, 20 bp, Homo sapiens
aactgcctactccaaaatgt

SEQ ID NO: 6428144 - DNA, 14 bp, Homo sapiens
aactgcctgttcct

SEQ ID NO: 6428145 - DNA, 19 bp, Homo sapiens
aactgcctgttccttgaat

SEQ ID NO: 6428146 - DNA, 17 bp, Homo sapiens
aactgccttaaaacttt

SEQ ID NO: 6428147 - DNA, 23 bp, Homo sapiens
aactgccttaaccttctggggga

SEQ ID NO: 6428148 - DNA, 16 bp, Homo sapiens
aactgccttggcttca

SEQ ID NO: 6428149 - DNA, 20 bp, Homo sapiens
aactgcgaggacatcaaagt

SEQ ID NO: 6428150 - DNA, 14 bp, Homo sapiens
aactgcgagtggct

SEQ ID NO: 6428151 - DNA, 23 bp, Homo sapiens
aactgcgataactgagaaactct

SEQ ID NO: 6428152 - DNA, 18 bp, Homo sapiens
aactgcggtcagatgtgg

SEQ ID NO: 6428153 - DNA, 14 bp, Homo sapiens
aactgcgtgccagt

SEQ ID NO: 6428154 - DNA, 22 bp, Homo sapiens
aactgcgtgccagtgtccccac

SEQ ID NO: 6428155 - DNA, 15 bp, Homo sapiens
aactgctaaattcta

SEQ ID NO: 6428156 - DNA, 23 bp, Homo sapiens
aactgctaaattctatgttaaat

SEQ ID NO: 6428157 - DNA, 18 bp, Homo sapiens
aactgctcagagctttaa

SEQ ID NO: 6428158 - DNA, 18 bp, Homo sapiens
aactgctccaaatttaac

SEQ ID NO: 6428159 - DNA, 14 bp, Homo sapiens
aactgctctgccca

SEQ ID NO: 6428160 - DNA, 12 bp, Homo sapiens
aactgctcttga

SEQ ID NO: 6428161 - DNA, 19 bp, Homo sapiens
aactgctcttgggcaatat

SEQ ID NO: 6428162 - DNA, 20 bp, Homo sapiens
aactgctcttgggcaatatt

SEQ ID NO: 6428163 - DNA, 21 bp, Homo sapiens
aactgctgactgttttctctt

SEQ ID NO: 6428164 - DNA, 23 bp, Homo sapiens
aactgctgactgttttctcttga

SEQ ID NO: 6428165 - DNA, 13 bp, Homo sapiens
aactgctgagcca

SEQ ID NO: 6428166 - DNA, 16 bp, Homo sapiens
aactgctgagccactc

SEQ ID NO: 6428167 - DNA, 10 bp, Homo sapiens
aactgctgca

SEQ ID NO: 6428168 - DNA, 14 bp, Homo sapiens
aactgctgcatact

SEQ ID NO: 6428169 - DNA, 12 bp, Homo sapiens
aactgctgccaa

SEQ ID NO: 6428170 - DNA, 12 bp, Homo sapiens
aactgctgccac

SEQ ID NO: 6428171 - DNA, 12 bp, Homo sapiens
aactgctgctga

SEQ ID NO: 6428172 - DNA, 18 bp, Homo sapiens
aactgctgctgacccctg

SEQ ID NO: 6428173 - DNA, 20 bp, Homo sapiens
aactgctgctttttgaggtg

SEQ ID NO: 6428174 - DNA, 23 bp, Homo sapiens
aactgctggacgtctttcttttt

SEQ ID NO: 6428175 - DNA, 15 bp, Homo sapiens
aactgctggagtctg

SEQ ID NO: 6428176 - DNA, 15 bp, Homo sapiens
aactgctgttttatg

SEQ ID NO: 6428177 - DNA, 22 bp, Homo sapiens
aactgcttaagtggatctgttt

SEQ ID NO: 6428178 - DNA, 19 bp, Homo sapiens
aactgcttcatctcctttt

SEQ ID NO: 6428179 - DNA, 18 bp, Homo sapiens
aactgcttcatgtgaaca

SEQ ID NO: 6428180 - DNA, 23 bp, Homo sapiens
aactgcttcccttactttgctga

SEQ ID NO: 6428181 - DNA, 20 bp, Homo sapiens
aactgcttgcatttctttat

SEQ ID NO: 6428182 - DNA, 21 bp, Homo sapiens
aactgcttgcatttctttatt

SEQ ID NO: 6428183 - DNA, 17 bp, Homo sapiens
aactgcttgtttcctag

SEQ ID NO: 6428184 - DNA, 11 bp, Homo sapiens
aactgctttat

SEQ ID NO: 6428185 - DNA, 19 bp, Homo sapiens
aactgctttatttttataa

SEQ ID NO: 6428186 - DNA, 17 bp, Homo sapiens
aactgctttcaagtctg

SEQ ID NO: 6428187 - DNA, 17 bp, Homo sapiens
aactgctttctgttcca

SEQ ID NO: 6428188 - DNA, 15 bp, Homo sapiens
aactgctttctttcg

SEQ ID NO: 6428189 - DNA, 22 bp, Homo sapiens
aactgctttgttttggctgctc

SEQ ID NO: 6428190 - DNA, 23 bp, Homo sapiens
aactgctttgttttggctgctct

SEQ ID NO: 6428191 - DNA, 16 bp, Homo sapiens
aactgcttttcctcaa

SEQ ID NO: 6428192 - DNA, 22 bp, Homo sapiens
aactgcttttgcccatataaaa

SEQ ID NO: 6428193 - DNA, 20 bp, Homo sapiens
aactggaaaacagaacactt

SEQ ID NO: 6428194 - DNA, 17 bp, Homo sapiens
aactggaaaatcttcta

SEQ ID NO: 6428195 - DNA, 19 bp, Homo sapiens
aactggaaacatctgattt

SEQ ID NO: 6428196 - DNA, 23 bp, Homo sapiens
aactggaaacatctgatttctga

SEQ ID NO: 6428197 - DNA, 13 bp, Homo sapiens
aactggaaagaag

SEQ ID NO: 6428198 - DNA, 19 bp, Homo sapiens
aactggaaatactagattt

SEQ ID NO: 6428199 - DNA, 15 bp, Homo sapiens
aactggaagaaagca

SEQ ID NO: 6428200 - DNA, 13 bp, Homo sapiens
aactggaagcaca

SEQ ID NO: 6428201 - DNA, 17 bp, Homo sapiens
aactggaagctgttcag

SEQ ID NO: 6428202 - DNA, 16 bp, Homo sapiens
aactggaagctttgta

SEQ ID NO: 6428203 - DNA, 15 bp, Homo sapiens
aactggaagttattt

SEQ ID NO: 6428204 - DNA, 21 bp, Homo sapiens
aactggaataagaagcaaata

SEQ ID NO: 6428205 - DNA, 17 bp, Homo sapiens
aactggacctgtatatt

SEQ ID NO: 6428206 - DNA, 19 bp, Homo sapiens
aactggactggttcaaatg

SEQ ID NO: 6428207 - DNA, 13 bp, Homo sapiens
aactggagaggct

SEQ ID NO: 6428208 - DNA, 20 bp, Homo sapiens
aactggagctgctaagctaa

SEQ ID NO: 6428209 - DNA, 20 bp, Homo sapiens
aactggaggaaccacatata

SEQ ID NO: 6428210 - DNA, 16 bp, Homo sapiens
aactggaggcagtcca

SEQ ID NO: 6428211 - DNA, 16 bp, Homo sapiens
aactggagttccttat

SEQ ID NO: 6428212 - DNA, 15 bp, Homo sapiens
aactggatactgtac

SEQ ID NO: 6428213 - DNA, 17 bp, Homo sapiens
aactggatatttcaatc

SEQ ID NO: 6428214 - DNA, 14 bp, Homo sapiens
aactggattaaaac

SEQ ID NO: 6428215 - DNA, 19 bp, Homo sapiens
aactggcaaaagtgtgtgt

SEQ ID NO: 6428216 - DNA, 19 bp, Homo sapiens
aactggcaattgtctattt

SEQ ID NO: 6428217 - DNA, 23 bp, Homo sapiens
aactggcaggggagacaggagcc

SEQ ID NO: 6428218 - DNA, 16 bp, Homo sapiens
aactggcatgtcattt

SEQ ID NO: 6428219 - DNA, 20 bp, Homo sapiens
aactggcatgtcatttgcac

SEQ ID NO: 6428220 - DNA, 21 bp, Homo sapiens
aactggccactccccagtgct

SEQ ID NO: 6428221 - DNA, 18 bp, Homo sapiens
aactggccctatttagat

SEQ ID NO: 6428222 - DNA, 11 bp, Homo sapiens
aactggccctc

SEQ ID NO: 6428223 - DNA, 12 bp, Homo sapiens
aactggccctcg

SEQ ID NO: 6428224 - DNA, 16 bp, Homo sapiens
aactggccctcgggcc

SEQ ID NO: 6428225 - DNA, 22 bp, Homo sapiens
aactggccctcgggccctctct

SEQ ID NO: 6428226 - DNA, 14 bp, Homo sapiens
aactggccctcttc

SEQ ID NO: 6428227 - DNA, 17 bp, Homo sapiens
aactggccggtctgcaa

SEQ ID NO: 6428228 - DNA, 17 bp, Homo sapiens
aactggcgatctcccag

SEQ ID NO: 6428229 - DNA, 19 bp, Homo sapiens
aactggcgatctcccaggg

SEQ ID NO: 6428230 - DNA, 18 bp, Homo sapiens
aactggctcctttgcctc

SEQ ID NO: 6428231 - DNA, 13 bp, Homo sapiens
aactggctgggac

SEQ ID NO: 6428232 - DNA, 21 bp, Homo sapiens
aactggctgggcccctgggga

SEQ ID NO: 6428233 - DNA, 23 bp, Homo sapiens
aactggctgggcccctggggaca

SEQ ID NO: 6428234 - DNA, 18 bp, Homo sapiens
aactggcttaacttagta

SEQ ID NO: 6428235 - DNA, 19 bp, Homo sapiens
aactggcttcattttagga

SEQ ID NO: 6428236 - DNA, 14 bp, Homo sapiens
aactggcttgtaca

SEQ ID NO: 6428237 - DNA, 16 bp, Homo sapiens
aactggcttgtacatt

SEQ ID NO: 6428238 - DNA, 16 bp, Homo sapiens
aactgggaaaacagtg

SEQ ID NO: 6428239 - DNA, 13 bp, Homo sapiens
aactgggaagaac

SEQ ID NO: 6428240 - DNA, 13 bp, Homo sapiens
aactgggaagatg

SEQ ID NO: 6428241 - DNA, 18 bp, Homo sapiens
aactgggaagatgctggc

SEQ ID NO: 6428242 - DNA, 19 bp, Homo sapiens
aactgggaagatgctggcc

SEQ ID NO: 6428243 - DNA, 17 bp, Homo sapiens
aactgggacaggggaga

SEQ ID NO: 6428244 - DNA, 13 bp, Homo sapiens
aactgggataact

SEQ ID NO: 6428245 - DNA, 17 bp, Homo sapiens
aactgggcacagattga

SEQ ID NO: 6428246 - DNA, 17 bp, Homo sapiens
aactgggcatttcaatc

SEQ ID NO: 6428247 - DNA, 18 bp, Homo sapiens
aactgggcatttcaatcc

SEQ ID NO: 6428248 - DNA, 22 bp, Homo sapiens
aactgggccttgtgtgctggct

SEQ ID NO: 6428249 - DNA, 13 bp, Homo sapiens
tctcaatgtacat

SEQ ID NO: 6428250 - DNA, 13 bp, Homo sapiens
tctcaatgtgaaa

SEQ ID NO: 6428251 - DNA, 22 bp, Homo sapiens
tctcaattaaagtctattcaaa

SEQ ID NO: 6428252 - DNA, 22 bp, Homo sapiens
tctcaattccaacagtttaatg

SEQ ID NO: 6428253 - DNA, 23 bp, Homo sapiens
tctcaattccaacagtttaatga

SEQ ID NO: 6428254 - DNA, 19 bp, Homo sapiens
tctcaattctgaaggggaa

SEQ ID NO: 6428255 - DNA, 18 bp, Homo sapiens
tctcaattgaaagctttt

SEQ ID NO: 6428256 - DNA, 13 bp, Homo sapiens
tctcaattgagtt

SEQ ID NO: 6428257 - DNA, 17 bp, Homo sapiens
tctcaattgagttaaat

SEQ ID NO: 6428258 - DNA, 20 bp, Homo sapiens
tctcaattgagttaaatcag

SEQ ID NO: 6428259 - DNA, 17 bp, Homo sapiens
tctcaattgctttgtaa

SEQ ID NO: 6428260 - DNA, 14 bp, Homo sapiens
tctcaatttaagat

SEQ ID NO: 6428261 - DNA, 16 bp, Homo sapiens
tctcaatttatttggg

SEQ ID NO: 6428262 - DNA, 16 bp, Homo sapiens
tctcaatttgaaacac

SEQ ID NO: 6428263 - DNA, 18 bp, Homo sapiens
tctcaatttgaaacacaa

SEQ ID NO: 6428264 - DNA, 16 bp, Homo sapiens
tctcaattttgtattt

SEQ ID NO: 6428265 - DNA, 12 bp, Homo sapiens
tctcacacacat

SEQ ID NO: 6428266 - DNA, 14 bp, Homo sapiens
tctcacacacatag

SEQ ID NO: 6428267 - DNA, 12 bp, Homo sapiens
tctcacaccagt

SEQ ID NO: 6428268 - DNA, 14 bp, Homo sapiens
tctcacacccaccg

SEQ ID NO: 6428269 - DNA, 24 bp, Homo sapiens
tctcacacgtttaatcccagcact

SEQ ID NO: 6428270 - DNA, 18 bp, Homo sapiens
tctcacactcctcctgcc

SEQ ID NO: 6428271 - DNA, 20 bp, Homo sapiens
tctcacactcctcctgccag

SEQ ID NO: 6428272 - DNA, 21 bp, Homo sapiens
tctcacactcctcctgccagc

SEQ ID NO: 6428273 - DNA, 21 bp, Homo sapiens
tctcacactggttctcaatga

SEQ ID NO: 6428274 - DNA, 14 bp, Homo sapiens
tctcacagacagga

SEQ ID NO: 6428275 - DNA, 22 bp, Homo sapiens
tctcacagacaggacccctgca

SEQ ID NO: 6428276 - DNA, 18 bp, Homo sapiens
tctcacagacatatagaa

SEQ ID NO: 6428277 - DNA, 13 bp, Homo sapiens
tctcacagagaag

SEQ ID NO: 6428278 - DNA, 16 bp, Homo sapiens
tctcacagatgtgact

SEQ ID NO: 6428279 - DNA, 16 bp, Homo sapiens
tctcacagcacatgct

SEQ ID NO: 6428280 - DNA, 17 bp, Homo sapiens
tctcacagcacatgctg

SEQ ID NO: 6428281 - DNA, 23 bp, Homo sapiens
tctcacagcacatgctggccagc

SEQ ID NO: 6428282 - DNA, 14 bp, Homo sapiens
tctcacagctatgc

SEQ ID NO: 6428283 - DNA, 22 bp, Homo sapiens
tctcacagctatgcaaaaagct

SEQ ID NO: 6428284 - DNA, 20 bp, Homo sapiens
tctcacaggcagctctgagc

SEQ ID NO: 6428285 - DNA, 22 bp, Homo sapiens
tctcacaggcagctctgagccg

SEQ ID NO: 6428286 - DNA, 18 bp, Homo sapiens
tctcacaggttcacccag

SEQ ID NO: 6428287 - DNA, 18 bp, Homo sapiens
tctcacagtcaaaaggaa

SEQ ID NO: 6428288 - DNA, 12 bp, Homo sapiens
tctcacagtggg

SEQ ID NO: 6428289 - DNA, 23 bp, Homo sapiens
tctcacagtgggagccagggctg

SEQ ID NO: 6428290 - DNA, 14 bp, Homo sapiens
tctcacagtgtggg

SEQ ID NO: 6428291 - DNA, 14 bp, Homo sapiens
tctcacatgtggca

SEQ ID NO: 6428292 - DNA, 17 bp, Homo sapiens
tctcaccacacataata

SEQ ID NO: 6428293 - DNA, 20 bp, Homo sapiens
tctcaccagcagtcgtgggg

SEQ ID NO: 6428294 - DNA, 21 bp, Homo sapiens
tctcaccagctcagccccggc

SEQ ID NO: 6428295 - DNA, 13 bp, Homo sapiens
tctcaccagctgc

SEQ ID NO: 6428296 - DNA, 16 bp, Homo sapiens
tctcaccagctgcaaa

SEQ ID NO: 6428297 - DNA, 15 bp, Homo sapiens
tctcaccagctgctg

SEQ ID NO: 6428298 - DNA, 15 bp, Homo sapiens
tctcaccaggaaggg

SEQ ID NO: 6428299 - DNA, 13 bp, Homo sapiens
tctcaccaggcag

SEQ ID NO: 6428300 - DNA, 14 bp, Homo sapiens
tctcaccaggcagc

SEQ ID NO: 6428301 - DNA, 13 bp, Homo sapiens
tctcacccaccag

SEQ ID NO: 6428302 - DNA, 14 bp, Homo sapiens
tctcacccagtccc

SEQ ID NO: 6428303 - DNA, 19 bp, Homo sapiens
tctcacccagtccccaccc

SEQ ID NO: 6428304 - DNA, 15 bp, Homo sapiens
tctcacccataaaca

SEQ ID NO: 6428305 - DNA, 22 bp, Homo sapiens
tctcacccataataaaggttgt

SEQ ID NO: 6428306 - DNA, 23 bp, Homo sapiens
tctcacccatgcaagcagaggac

SEQ ID NO: 6428307 - DNA, 20 bp, Homo sapiens
tctcacccattatctggaat

SEQ ID NO: 6428308 - DNA, 16 bp, Homo sapiens
tctcaccccactcctg

SEQ ID NO: 6428309 - DNA, 19 bp, Homo sapiens
tctcaccccactcctgtca

SEQ ID NO: 6428310 - DNA, 19 bp, Homo sapiens
tctcaccccacttcccatc

SEQ ID NO: 6428311 - DNA, 14 bp, Homo sapiens
tctcaccccaggat

SEQ ID NO: 6428312 - DNA, 16 bp, Homo sapiens
tctcaccctctgtcct

SEQ ID NO: 6428313 - DNA, 16 bp, Homo sapiens
tctcaccgcagtcgtc

SEQ ID NO: 6428314 - DNA, 14 bp, Homo sapiens
tctcaccggctctc

SEQ ID NO: 6428315 - DNA, 23 bp, Homo sapiens
tctcacctaaaccctctgtgaaa

SEQ ID NO: 6428316 - DNA, 21 bp, Homo sapiens
tctcacctacttcctcctcct

SEQ ID NO: 6428317 - DNA, 13 bp, Homo sapiens
tctcacctcagcc

SEQ ID NO: 6428318 - DNA, 14 bp, Homo sapiens
tctcacctcctgct

SEQ ID NO: 6428319 - DNA, 16 bp, Homo sapiens
tctcacctcctgctgg

SEQ ID NO: 6428320 - DNA, 17 bp, Homo sapiens
tctcacctcctgctggg

SEQ ID NO: 6428321 - DNA, 19 bp, Homo sapiens
tctcacctctaggcctcag

SEQ ID NO: 6428322 - DNA, 19 bp, Homo sapiens
tctcacctctgtgcctctg

SEQ ID NO: 6428323 - DNA, 17 bp, Homo sapiens
tctcacctgccggctct

SEQ ID NO: 6428324 - DNA, 19 bp, Homo sapiens
tctcacctgccggctctgg

SEQ ID NO: 6428325 - DNA, 15 bp, Homo sapiens
tctcacctgctccag

SEQ ID NO: 6428326 - DNA, 14 bp, Homo sapiens
tctcacctgctccc

SEQ ID NO: 6428327 - DNA, 15 bp, Homo sapiens
tctcacctgtgagac

SEQ ID NO: 6428328 - DNA, 19 bp, Homo sapiens
tctcaccttaactcagcca

SEQ ID NO: 6428329 - DNA, 18 bp, Homo sapiens
tctcacctttcccacctc

SEQ ID NO: 6428330 - DNA, 18 bp, Homo sapiens
tctcacgattccagtgca

SEQ ID NO: 6428331 - DNA, 14 bp, Homo sapiens
tctcacgcagccag

SEQ ID NO: 6428332 - DNA, 21 bp, Homo sapiens
tctcacgcagccagtgcacat

SEQ ID NO: 6428333 - DNA, 14 bp, Homo sapiens
tctcacgccacccc

SEQ ID NO: 6428334 - DNA, 14 bp, Homo sapiens
tctcacgctttgtt

SEQ ID NO: 6428335 - DNA, 15 bp, Homo sapiens
tctcacgctttgttt

SEQ ID NO: 6428336 - DNA, 17 bp, Homo sapiens
tctcacgctttgtttac

SEQ ID NO: 6428337 - DNA, 20 bp, Homo sapiens
tctcacgggcagtagctgtg

SEQ ID NO: 6428338 - DNA, 22 bp, Homo sapiens
tctcacgggcatgggcactccc

SEQ ID NO: 6428339 - DNA, 16 bp, Homo sapiens
tctcacgggccctgcc

SEQ ID NO: 6428340 - DNA, 18 bp, Homo sapiens
tctcacgggccctgcccc

SEQ ID NO: 6428341 - DNA, 19 bp, Homo sapiens
tctcacgggccctgcccca

SEQ ID NO: 6428342 - DNA, 18 bp, Homo sapiens
tctcactaaagcatgaaa

SEQ ID NO: 6428343 - DNA, 16 bp, Homo sapiens
tctcactataccagta

SEQ ID NO: 6428344 - DNA, 17 bp, Homo sapiens
tctcactatatatattt

SEQ ID NO: 6428345 - DNA, 22 bp, Homo sapiens
tctcactatattgctcaggctg

SEQ ID NO: 6428346 - DNA, 20 bp, Homo sapiens
tctcactatgttgcccaggc

SEQ ID NO: 6428347 - DNA, 21 bp, Homo sapiens
tctcactatgttgcccaggca

SEQ ID NO: 6428348 - DNA, 23 bp, Homo sapiens
tctcactatgttgcccaggcagg

SEQ ID NO: 6428349 - DNA, 17 bp, Homo sapiens
tctcactatgtttctca

SEQ ID NO: 6428350 - DNA, 12 bp, Homo sapiens
tctcactcacca

SEQ ID NO: 6428351 - DNA, 19 bp, Homo sapiens
tctcactccagccaaagaa

SEQ ID NO: 6428352 - DNA, 18 bp, Homo sapiens
tctcactccccagcccca

SEQ ID NO: 6428353 - DNA, 21 bp, Homo sapiens
tctcactccccagccccaccc

SEQ ID NO: 6428354 - DNA, 18 bp, Homo sapiens
tctcactccccagcctgg

SEQ ID NO: 6428355 - DNA, 15 bp, Homo sapiens
tctcactccccatgc

SEQ ID NO: 6428356 - DNA, 18 bp, Homo sapiens
tctcactcccttctcctt

SEQ ID NO: 6428357 - DNA, 20 bp, Homo sapiens
tctcactcccttctccttga

SEQ ID NO: 6428358 - DNA, 14 bp, Homo sapiens
tctcactcctgaat

SEQ ID NO: 6428359 - DNA, 19 bp, Homo sapiens
tctcactcctgaattcagt

SEQ ID NO: 6428360 - DNA, 13 bp, Homo sapiens
tctcactcctgag

SEQ ID NO: 6428361 - DNA, 13 bp, Homo sapiens
tctcactcctgcc

SEQ ID NO: 6428362 - DNA, 17 bp, Homo sapiens
tctcactcgttctgtta

SEQ ID NO: 6428363 - DNA, 17 bp, Homo sapiens
tctcactctctggggaa

SEQ ID NO: 6428364 - DNA, 16 bp, Homo sapiens
tctcactctcttcctt

SEQ ID NO: 6428365 - DNA, 15 bp, Homo sapiens
tctcactctggcagc

SEQ ID NO: 6428366 - DNA, 16 bp, Homo sapiens
tctcactctgtcaccc

SEQ ID NO: 6428367 - DNA, 17 bp, Homo sapiens
tctcactctgtcgccca

SEQ ID NO: 6428368 - DNA, 18 bp, Homo sapiens
tctcactctgtcgcccag

SEQ ID NO: 6428369 - DNA, 22 bp, Homo sapiens
tctcactctgtcgcccagtctg

SEQ ID NO: 6428370 - DNA, 15 bp, Homo sapiens
tctcactctgttgac

SEQ ID NO: 6428371 - DNA, 15 bp, Homo sapiens
tctcactcttctgtc

SEQ ID NO: 6428372 - DNA, 18 bp, Homo sapiens
tctcactcttgtcaccca

SEQ ID NO: 6428373 - DNA, 18 bp, Homo sapiens
tctcactgaactccaccg

SEQ ID NO: 6428374 - DNA, 14 bp, Homo sapiens
tctcactgacacag

SEQ ID NO: 6428375 - DNA, 16 bp, Homo sapiens
tctcactgagcactgt

SEQ ID NO: 6428376 - DNA, 17 bp, Homo sapiens
tctcactgagcactgtt

SEQ ID NO: 6428377 - DNA, 11 bp, Homo sapiens
tctcactgcca

SEQ ID NO: 6428378 - DNA, 20 bp, Homo sapiens
tctcactgccatcaaactgt

SEQ ID NO: 6428379 - DNA, 14 bp, Homo sapiens
tctcactgcctctc

SEQ ID NO: 6428380 - DNA, 13 bp, Homo sapiens
tctcactgctgtc

SEQ ID NO: 6428381 - DNA, 17 bp, Homo sapiens
tctcactggatgcaaag

SEQ ID NO: 6428382 - DNA, 21 bp, Homo sapiens
tctcactgtattaaagatgca

SEQ ID NO: 6428383 - DNA, 13 bp, Homo sapiens
tctcactgtgtcc

SEQ ID NO: 6428384 - DNA, 15 bp, Homo sapiens
tctcactgtgtgtct

SEQ ID NO: 6428385 - DNA, 21 bp, Homo sapiens
tctcactgtgttgcccaggct

SEQ ID NO: 6428386 - DNA, 23 bp, Homo sapiens
tctcactgtgttgcccaggctgg

SEQ ID NO: 6428387 - DNA, 17 bp, Homo sapiens
tctcactgttccctctg

SEQ ID NO: 6428388 - DNA, 18 bp, Homo sapiens
tctcactgttccctctgc

SEQ ID NO: 6428389 - DNA, 14 bp, Homo sapiens
tctcactgttctgc

SEQ ID NO: 6428390 - DNA, 15 bp, Homo sapiens
tctcactgttgccca

SEQ ID NO: 6428391 - DNA, 17 bp, Homo sapiens
tctcactgttgcccagg

SEQ ID NO: 6428392 - DNA, 19 bp, Homo sapiens
tctcactgttgcccaggct

SEQ ID NO: 6428393 - DNA, 15 bp, Homo sapiens
tctcacttagtcctt

SEQ ID NO: 6428394 - DNA, 13 bp, Homo sapiens
tctcacttatacc

SEQ ID NO: 6428395 - DNA, 15 bp, Homo sapiens
tctcacttcagttgt

SEQ ID NO: 6428396 - DNA, 16 bp, Homo sapiens
tctcacttccccttgc

SEQ ID NO: 6428397 - DNA, 17 bp, Homo sapiens
tctcactttactttcaa

SEQ ID NO: 6428398 - DNA, 17 bp, Homo sapiens
tctcacttttctccatg

SEQ ID NO: 6428399 - DNA, 19 bp, Homo sapiens
tctcacttttggaaggtga

SEQ ID NO: 6428400 - DNA, 22 bp, Homo sapiens
tctcagaaaacttctcttctga

SEQ ID NO: 6428401 - DNA, 22 bp, Homo sapiens
tctcagaaactcccctgggggt

SEQ ID NO: 6428402 - DNA, 11 bp, Homo sapiens
tctcagaaagt

SEQ ID NO: 6428403 - DNA, 18 bp, Homo sapiens
tctcagaaataaatcaca

SEQ ID NO: 6428404 - DNA, 23 bp, Homo sapiens
tctcagaaataaatcacagatgc

SEQ ID NO: 6428405 - DNA, 19 bp, Homo sapiens
tctcagaacaccaagtaaa

SEQ ID NO: 6428406 - DNA, 20 bp, Homo sapiens
tctcagaacaccaagtaaat

SEQ ID NO: 6428407 - DNA, 11 bp, Homo sapiens
tctcagaacat

SEQ ID NO: 6428408 - DNA, 12 bp, Homo sapiens
tctcagaacctt

SEQ ID NO: 6428409 - DNA, 22 bp, Homo sapiens
tctcagaactcctgtgtgtgga

SEQ ID NO: 6428410 - DNA, 13 bp, Homo sapiens
tctcagaagggag

SEQ ID NO: 6428411 - DNA, 15 bp, Homo sapiens
tctcagaagggaggc

SEQ ID NO: 6428412 - DNA, 17 bp, Homo sapiens
tctcagaatccaaagat

SEQ ID NO: 6428413 - DNA, 24 bp, Homo sapiens
tctcagaatctaaacgtggtcacc

SEQ ID NO: 6428414 - DNA, 20 bp, Homo sapiens
tctcagaatctacccaaagg

SEQ ID NO: 6428415 - DNA, 16 bp, Homo sapiens
tctcagaatgttggca

SEQ ID NO: 6428416 - DNA, 15 bp, Homo sapiens
tctcagaatttatct

SEQ ID NO: 6428417 - DNA, 12 bp, Homo sapiens
tctcagacccag

SEQ ID NO: 6428418 - DNA, 19 bp, Homo sapiens
tctcagacccttgaagatg

SEQ ID NO: 6428419 - DNA, 19 bp, Homo sapiens
tctcagaccgtcttcctcc

SEQ ID NO: 6428420 - DNA, 16 bp, Homo sapiens
tctcagaccttacaca

SEQ ID NO: 6428421 - DNA, 20 bp, Homo sapiens
tctcagacttctcttattct

SEQ ID NO: 6428422 - DNA, 21 bp, Homo sapiens
tctcagacttctcttattctt

SEQ ID NO: 6428423 - DNA, 14 bp, Homo sapiens
tctcagagacaggt

SEQ ID NO: 6428424 - DNA, 15 bp, Homo sapiens
tctcagagaccagca

SEQ ID NO: 6428425 - DNA, 16 bp, Homo sapiens
tctcagagaccagcac

SEQ ID NO: 6428426 - DNA, 17 bp, Homo sapiens
tctcagagaccagcact

SEQ ID NO: 6428427 - DNA, 19 bp, Homo sapiens
tctcagagaccagcactca

SEQ ID NO: 6428428 - DNA, 18 bp, Homo sapiens
tctcagagactcccagga

SEQ ID NO: 6428429 - DNA, 16 bp, Homo sapiens
aactgggctgaacact

SEQ ID NO: 6428430 - DNA, 12 bp, Homo sapiens
aactgggctggc

SEQ ID NO: 6428431 - DNA, 18 bp, Homo sapiens
aactggggaaaaggatga

SEQ ID NO: 6428432 - DNA, 16 bp, Homo sapiens
aactggggctcctcca

SEQ ID NO: 6428433 - DNA, 19 bp, Homo sapiens
aactggggctgtgttttcg

SEQ ID NO: 6428434 - DNA, 15 bp, Homo sapiens
aactggggctttgcc

SEQ ID NO: 6428435 - DNA, 16 bp, Homo sapiens
aactgggggaaaagat

SEQ ID NO: 6428436 - DNA, 19 bp, Homo sapiens
aactggggtattaactttt

SEQ ID NO: 6428437 - DNA, 14 bp, Homo sapiens
aactgggttaaata

SEQ ID NO: 6428438 - DNA, 21 bp, Homo sapiens
aactgggttaaatattttgct

SEQ ID NO: 6428439 - DNA, 22 bp, Homo sapiens
aactgggttaaatattttgcta

SEQ ID NO: 6428440 - DNA, 17 bp, Homo sapiens
aactgggttctttggaa

SEQ ID NO: 6428441 - DNA, 18 bp, Homo sapiens
aactgggtttctcattaa

SEQ ID NO: 6428442 - DNA, 24 bp, Homo sapiens
aactggtaaaaagatccagggatg

SEQ ID NO: 6428443 - DNA, 19 bp, Homo sapiens
aactggtagttcattgtaa

SEQ ID NO: 6428444 - DNA, 21 bp, Homo sapiens
aactggtagttcattgtaaat

SEQ ID NO: 6428445 - DNA, 14 bp, Homo sapiens
aactggtattgttt

SEQ ID NO: 6428446 - DNA, 16 bp, Homo sapiens
aactggtattgtttac

SEQ ID NO: 6428447 - DNA, 20 bp, Homo sapiens
aactggtccactcagggctg

SEQ ID NO: 6428448 - DNA, 15 bp, Homo sapiens
aactggtccaggcca

SEQ ID NO: 6428449 - DNA, 19 bp, Homo sapiens
aactggtgatataaagaat

SEQ ID NO: 6428450 - DNA, 14 bp, Homo sapiens
aactggtgatatat

SEQ ID NO: 6428451 - DNA, 22 bp, Homo sapiens
aactggtggacatggctgttca

SEQ ID NO: 6428452 - DNA, 13 bp, Homo sapiens
aactggttaggta

SEQ ID NO: 6428453 - DNA, 15 bp, Homo sapiens
aactggttagtgtga

SEQ ID NO: 6428454 - DNA, 16 bp, Homo sapiens
aactggttagtgtgaa

SEQ ID NO: 6428455 - DNA, 17 bp, Homo sapiens
aactggttagtgtgaaa

SEQ ID NO: 6428456 - DNA, 18 bp, Homo sapiens
aactggttagtgtgaaat

SEQ ID NO: 6428457 - DNA, 21 bp, Homo sapiens
aactggttctacaaattttta

SEQ ID NO: 6428458 - DNA, 16 bp, Homo sapiens
aactggttgtatattt

SEQ ID NO: 6428459 - DNA, 20 bp, Homo sapiens
aactggtttgactctgtcca

SEQ ID NO: 6428460 - DNA, 20 bp, Homo sapiens
aactgtaaaaaatgtgtgta

SEQ ID NO: 6428461 - DNA, 15 bp, Homo sapiens
aactgtaaagcaaat

SEQ ID NO: 6428462 - DNA, 18 bp, Homo sapiens
aactgtaaataaaatgtg

SEQ ID NO: 6428463 - DNA, 18 bp, Homo sapiens
aactgtaaatatgtttgt

SEQ ID NO: 6428464 - DNA, 23 bp, Homo sapiens
aactgtaaatatttttttaacct

SEQ ID NO: 6428465 - DNA, 12 bp, Homo sapiens
aactgtaaatca

SEQ ID NO: 6428466 - DNA, 14 bp, Homo sapiens
aactgtaaatcact

SEQ ID NO: 6428467 - DNA, 17 bp, Homo sapiens
aactgtaacgttttctt

SEQ ID NO: 6428468 - DNA, 12 bp, Homo sapiens
aactgtaactgc

SEQ ID NO: 6428469 - DNA, 13 bp, Homo sapiens
aactgtaatacaa

SEQ ID NO: 6428470 - DNA, 15 bp, Homo sapiens
aactgtaatgcagga

SEQ ID NO: 6428471 - DNA, 13 bp, Homo sapiens
aactgtacaaatg

SEQ ID NO: 6428472 - DNA, 17 bp, Homo sapiens
aactgtacaaatgaaat

SEQ ID NO: 6428473 - DNA, 11 bp, Homo sapiens
aactgtacatt

SEQ ID NO: 6428474 - DNA, 13 bp, Homo sapiens
aactgtacattgt

SEQ ID NO: 6428475 - DNA, 14 bp, Homo sapiens
aactgtactgggcc

SEQ ID NO: 6428476 - DNA, 17 bp, Homo sapiens
aactgtactttgattca

SEQ ID NO: 6428477 - DNA, 22 bp, Homo sapiens
aactgtactttgattcacatgt

SEQ ID NO: 6428478 - DNA, 19 bp, Homo sapiens
aactgtagaaatgatgatg

SEQ ID NO: 6428479 - DNA, 20 bp, Homo sapiens
aactgtagcgaccccagact

SEQ ID NO: 6428480 - DNA, 19 bp, Homo sapiens
aactgtaggtatgatctct

SEQ ID NO: 6428481 - DNA, 22 bp, Homo sapiens
aactgtagtaattgttacaatt

SEQ ID NO: 6428482 - DNA, 16 bp, Homo sapiens
aactgtatatttgtat

SEQ ID NO: 6428483 - DNA, 19 bp, Homo sapiens
aactgtatcaaatctgtat

SEQ ID NO: 6428484 - DNA, 11 bp, Homo sapiens
aactgtatctt

SEQ ID NO: 6428485 - DNA, 13 bp, Homo sapiens
aactgtatcttga

SEQ ID NO: 6428486 - DNA, 14 bp, Homo sapiens
aactgtatgtcaga

SEQ ID NO: 6428487 - DNA, 19 bp, Homo sapiens
aactgtatgtcttataaga

SEQ ID NO: 6428488 - DNA, 19 bp, Homo sapiens
aactgtatgtgtgtaggtt

SEQ ID NO: 6428489 - DNA, 18 bp, Homo sapiens
aactgtattaaagaaaaa

SEQ ID NO: 6428490 - DNA, 16 bp, Homo sapiens
aactgtattattgcaa

SEQ ID NO: 6428491 - DNA, 15 bp, Homo sapiens
aactgtattgaaaaa

SEQ ID NO: 6428492 - DNA, 11 bp, Homo sapiens
aactgtattta

SEQ ID NO: 6428493 - DNA, 22 bp, Homo sapiens
aactgtatttaaggaatcaaat

SEQ ID NO: 6428494 - DNA, 22 bp, Homo sapiens
aactgtatttacttgttatgtt

SEQ ID NO: 6428495 - DNA, 13 bp, Homo sapiens
aactgtatttgaa

SEQ ID NO: 6428496 - DNA, 22 bp, Homo sapiens
aactgtattttctttcacttta

SEQ ID NO: 6428497 - DNA, 15 bp, Homo sapiens
aactgtcaaattttc

SEQ ID NO: 6428498 - DNA, 23 bp, Homo sapiens
aactgtcaaattttcaaataata

SEQ ID NO: 6428499 - DNA, 17 bp, Homo sapiens
aactgtcaagtcatgat

SEQ ID NO: 6428500 - DNA, 21 bp, Homo sapiens
aactgtcagaataaagaacat

SEQ ID NO: 6428501 - DNA, 21 bp, Homo sapiens
aactgtcaggctgaaaacaat

SEQ ID NO: 6428502 - DNA, 22 bp, Homo sapiens
aactgtcagtgtacacgtctgg

SEQ ID NO: 6428503 - DNA, 14 bp, Homo sapiens
aactgtccagagag

SEQ ID NO: 6428504 - DNA, 20 bp, Homo sapiens
aactgtccagtccagtgatg

SEQ ID NO: 6428505 - DNA, 19 bp, Homo sapiens
aactgtcccaaggaggggg

SEQ ID NO: 6428506 - DNA, 23 bp, Homo sapiens
aactgtcccacaaaatatttcta

SEQ ID NO: 6428507 - DNA, 13 bp, Homo sapiens
aactgtcccagcg

SEQ ID NO: 6428508 - DNA, 16 bp, Homo sapiens
aactgtccctcccttg

SEQ ID NO: 6428509 - DNA, 17 bp, Homo sapiens
aactgtccctcccttgc

SEQ ID NO: 6428510 - DNA, 11 bp, Homo sapiens
aactgtccctg

SEQ ID NO: 6428511 - DNA, 19 bp, Homo sapiens
aactgtccctttgtttgaa

SEQ ID NO: 6428512 - DNA, 18 bp, Homo sapiens
aactgtccgtaagcagta

SEQ ID NO: 6428513 - DNA, 17 bp, Homo sapiens
aactgtcctgtcctgct

SEQ ID NO: 6428514 - DNA, 17 bp, Homo sapiens
aactgtcggaggaaaga

SEQ ID NO: 6428515 - DNA, 15 bp, Homo sapiens
aactgtcgtcttttt

SEQ ID NO: 6428516 - DNA, 19 bp, Homo sapiens
aactgtcgtctttttccaa

SEQ ID NO: 6428517 - DNA, 16 bp, Homo sapiens
aactgtctatttctgc

SEQ ID NO: 6428518 - DNA, 17 bp, Homo sapiens
aactgtctatttctgct

SEQ ID NO: 6428519 - DNA, 21 bp, Homo sapiens
aactgtctcctacctctgctc

SEQ ID NO: 6428520 - DNA, 22 bp, Homo sapiens
aactgtctgaatattctagaac

SEQ ID NO: 6428521 - DNA, 14 bp, Homo sapiens
aactgtcttcctca

SEQ ID NO: 6428522 - DNA, 13 bp, Homo sapiens
aactgtcttctgg

SEQ ID NO: 6428523 - DNA, 15 bp, Homo sapiens
aactgtcttgagaga

SEQ ID NO: 6428524 - DNA, 21 bp, Homo sapiens
aactgtcttgagagaaaagaa

SEQ ID NO: 6428525 - DNA, 23 bp, Homo sapiens
aactgtcttgagagaaaagaaaa

SEQ ID NO: 6428526 - DNA, 18 bp, Homo sapiens
aactgtcttgtttcagtg

SEQ ID NO: 6428527 - DNA, 18 bp, Homo sapiens
aactgtctttaaaagaga

SEQ ID NO: 6428528 - DNA, 17 bp, Homo sapiens
aactgtctttgtcacca

SEQ ID NO: 6428529 - DNA, 10 bp, Homo sapiens
aactgtgaaa

SEQ ID NO: 6428530 - DNA, 17 bp, Homo sapiens
aactgtgaaaatagtgt

SEQ ID NO: 6428531 - DNA, 20 bp, Homo sapiens
aactgtgaaaatagtgtaag

SEQ ID NO: 6428532 - DNA, 15 bp, Homo sapiens
aactgtgaaatacca

SEQ ID NO: 6428533 - DNA, 19 bp, Homo sapiens
aactgtgaaatttacaaat

SEQ ID NO: 6428534 - DNA, 16 bp, Homo sapiens
aactgtgaacaatcag

SEQ ID NO: 6428535 - DNA, 19 bp, Homo sapiens
aactgtgaagtttacattg

SEQ ID NO: 6428536 - DNA, 18 bp, Homo sapiens
aactgtgaatatgtgtaa

SEQ ID NO: 6428537 - DNA, 11 bp, Homo sapiens
aactgtgaatg

SEQ ID NO: 6428538 - DNA, 17 bp, Homo sapiens
aactgtgaatgcttctg

SEQ ID NO: 6428539 - DNA, 13 bp, Homo sapiens
aactgtgagagaa

SEQ ID NO: 6428540 - DNA, 14 bp, Homo sapiens
aactgtgagataaa

SEQ ID NO: 6428541 - DNA, 18 bp, Homo sapiens
aactgtgagataaatatc

SEQ ID NO: 6428542 - DNA, 22 bp, Homo sapiens
aactgtgagccgtccaagtcag

SEQ ID NO: 6428543 - DNA, 23 bp, Homo sapiens
aactgtgatgaaatatgaaactc

SEQ ID NO: 6428544 - DNA, 23 bp, Homo sapiens
aactgtgatggggtgggcagggc

SEQ ID NO: 6428545 - DNA, 16 bp, Homo sapiens
aactgtgcaacttttt

SEQ ID NO: 6428546 - DNA, 19 bp, Homo sapiens
aactgtgcagttttgtttg

SEQ ID NO: 6428547 - DNA, 22 bp, Homo sapiens
aactgtgcatcaaccaggaaga

SEQ ID NO: 6428548 - DNA, 13 bp, Homo sapiens
aactgtgccttcg

SEQ ID NO: 6428549 - DNA, 21 bp, Homo sapiens
aactgtgctgaatgctttaga

SEQ ID NO: 6428550 - DNA, 21 bp, Homo sapiens
aactgtgcttctctatgataa

SEQ ID NO: 6428551 - DNA, 13 bp, Homo sapiens
aactgtggaatat

SEQ ID NO: 6428552 - DNA, 12 bp, Homo sapiens
aactgtggaatt

SEQ ID NO: 6428553 - DNA, 11 bp, Homo sapiens
aactgtggata

SEQ ID NO: 6428554 - DNA, 20 bp, Homo sapiens
aactgtggataaattttgga

SEQ ID NO: 6428555 - DNA, 18 bp, Homo sapiens
aactgtggatattgttac

SEQ ID NO: 6428556 - DNA, 21 bp, Homo sapiens
aactgtggggcttacagaaat

SEQ ID NO: 6428557 - DNA, 23 bp, Homo sapiens
aactgtggttaatccaatcaatt

SEQ ID NO: 6428558 - DNA, 21 bp, Homo sapiens
aactgtgtaaaccacataatt

SEQ ID NO: 6428559 - DNA, 23 bp, Homo sapiens
aactgtgtaaaccacataatttt

SEQ ID NO: 6428560 - DNA, 13 bp, Homo sapiens
aactgtgtaactg

SEQ ID NO: 6428561 - DNA, 20 bp, Homo sapiens
aactgtgtacataactgaaa

SEQ ID NO: 6428562 - DNA, 17 bp, Homo sapiens
aactgtgtatgtacata

SEQ ID NO: 6428563 - DNA, 12 bp, Homo sapiens
aactgtgtattt

SEQ ID NO: 6428564 - DNA, 22 bp, Homo sapiens
aactgtgtatttatttaaaact

SEQ ID NO: 6428565 - DNA, 22 bp, Homo sapiens
aactgtgtcacgcaggctgagt

SEQ ID NO: 6428566 - DNA, 14 bp, Homo sapiens
aactgtgtgaagaa

SEQ ID NO: 6428567 - DNA, 15 bp, Homo sapiens
aactgtgtgaagaaa

SEQ ID NO: 6428568 - DNA, 16 bp, Homo sapiens
aactgtgtgaagaaat

SEQ ID NO: 6428569 - DNA, 18 bp, Homo sapiens
aactgtgtgaagaaatgg

SEQ ID NO: 6428570 - DNA, 18 bp, Homo sapiens
aactgtgtggactgtgat

SEQ ID NO: 6428571 - DNA, 13 bp, Homo sapiens
aactgtgtggcag

SEQ ID NO: 6428572 - DNA, 13 bp, Homo sapiens
aactgtgtgtgaa

SEQ ID NO: 6428573 - DNA, 17 bp, Homo sapiens
aactgtgtgtgaatctg

SEQ ID NO: 6428574 - DNA, 23 bp, Homo sapiens
aactgtgttgtattaacaaaagt

SEQ ID NO: 6428575 - DNA, 13 bp, Homo sapiens
aactgtgtttcaa

SEQ ID NO: 6428576 - DNA, 22 bp, Homo sapiens
aactgtgtttcaaatggactgt

SEQ ID NO: 6428577 - DNA, 19 bp, Homo sapiens
aactgtgtttccatccttt

SEQ ID NO: 6428578 - DNA, 19 bp, Homo sapiens
aactgttaaattgctgtgt

SEQ ID NO: 6428579 - DNA, 15 bp, Homo sapiens
aactgttaacttatt

SEQ ID NO: 6428580 - DNA, 23 bp, Homo sapiens
aactgttacaacttgtatttcca

SEQ ID NO: 6428581 - DNA, 14 bp, Homo sapiens
aactgttacagtaa

SEQ ID NO: 6428582 - DNA, 14 bp, Homo sapiens
aactgttaccattg

SEQ ID NO: 6428583 - DNA, 15 bp, Homo sapiens
aactgttacctaaag

SEQ ID NO: 6428584 - DNA, 14 bp, Homo sapiens
aactgttagaatgt

SEQ ID NO: 6428585 - DNA, 16 bp, Homo sapiens
aactgttagaatgtaa

SEQ ID NO: 6428586 - DNA, 14 bp, Homo sapiens
aactgttagatgct

SEQ ID NO: 6428587 - DNA, 14 bp, Homo sapiens
aactgttagcactg

SEQ ID NO: 6428588 - DNA, 15 bp, Homo sapiens
aactgttatttataa

SEQ ID NO: 6428589 - DNA, 14 bp, Homo sapiens
aactgttcaagtgt

SEQ ID NO: 6428590 - DNA, 13 bp, Homo sapiens
aactgttcccacc

SEQ ID NO: 6428591 - DNA, 15 bp, Homo sapiens
aactgttcccacctg

SEQ ID NO: 6428592 - DNA, 14 bp, Homo sapiens
aactgttcccttat

SEQ ID NO: 6428593 - DNA, 17 bp, Homo sapiens
aactgttcctactttgt

SEQ ID NO: 6428594 - DNA, 14 bp, Homo sapiens
aactgttctttgca

SEQ ID NO: 6428595 - DNA, 16 bp, Homo sapiens
aactgttctttgcagt

SEQ ID NO: 6428596 - DNA, 18 bp, Homo sapiens
aactgttctttgcagtga

SEQ ID NO: 6428597 - DNA, 18 bp, Homo sapiens
aactgttgacatacaaac

SEQ ID NO: 6428598 - DNA, 14 bp, Homo sapiens
aactgttgattgca

SEQ ID NO: 6428599 - DNA, 17 bp, Homo sapiens
aactgttgccagagatg

SEQ ID NO: 6428600 - DNA, 18 bp, Homo sapiens
aactgttgccagagatgg

SEQ ID NO: 6428601 - DNA, 19 bp, Homo sapiens
aactgttggaattcacttt

SEQ ID NO: 6428602 - DNA, 17 bp, Homo sapiens
aactgttggataataac

SEQ ID NO: 6428603 - DNA, 15 bp, Homo sapiens
aactgttggctaaga

SEQ ID NO: 6428604 - DNA, 17 bp, Homo sapiens
aactgttgtagaaattc

SEQ ID NO: 6428605 - DNA, 13 bp, Homo sapiens
aactgttgtataa

SEQ ID NO: 6428606 - DNA, 22 bp, Homo sapiens
aactgttgtcaccattgcacaa

SEQ ID NO: 6428607 - DNA, 14 bp, Homo sapiens
aactgtttaacact

SEQ ID NO: 6428608 - DNA, 19 bp, Homo sapiens
aactgtttatatgtgttga

SEQ ID NO: 6428609 - DNA, 16 bp, Homo sapiens
tctcagagattaaaaa

SEQ ID NO: 6428610 - DNA, 15 bp, Homo sapiens
tctcagagcaagcct

SEQ ID NO: 6428611 - DNA, 23 bp, Homo sapiens
tctcagagcaagcctttgacctg

SEQ ID NO: 6428612 - DNA, 20 bp, Homo sapiens
tctcagagcagcactggggt

SEQ ID NO: 6428613 - DNA, 15 bp, Homo sapiens
tctcagagcatctgg

SEQ ID NO: 6428614 - DNA, 13 bp, Homo sapiens
tctcagagcctca

SEQ ID NO: 6428615 - DNA, 19 bp, Homo sapiens
tctcagagctacttgggcc

SEQ ID NO: 6428616 - DNA, 20 bp, Homo sapiens
tctcagaggaaaaatgggag

SEQ ID NO: 6428617 - DNA, 22 bp, Homo sapiens
tctcagaggagtggatctgtag

SEQ ID NO: 6428618 - DNA, 20 bp, Homo sapiens
tctcagaggctatagctggg

SEQ ID NO: 6428619 - DNA, 14 bp, Homo sapiens
tctcagagtgttta

SEQ ID NO: 6428620 - DNA, 18 bp, Homo sapiens
tctcagataaagtgacca

SEQ ID NO: 6428621 - DNA, 16 bp, Homo sapiens
tctcagataggtgctt

SEQ ID NO: 6428622 - DNA, 22 bp, Homo sapiens
tctcagataggtgcttcccctg

SEQ ID NO: 6428623 - DNA, 17 bp, Homo sapiens
tctcagatatttgcacc

SEQ ID NO: 6428624 - DNA, 14 bp, Homo sapiens
tctcagatcactgc

SEQ ID NO: 6428625 - DNA, 14 bp, Homo sapiens
tctcagatccctcg

SEQ ID NO: 6428626 - DNA, 14 bp, Homo sapiens
tctcagatccttgt

SEQ ID NO: 6428627 - DNA, 19 bp, Homo sapiens
tctcagatccttgtttcaa

SEQ ID NO: 6428628 - DNA, 22 bp, Homo sapiens
tctcagatccttgtttcaaaca

SEQ ID NO: 6428629 - DNA, 18 bp, Homo sapiens
tctcagatctggtttcta

SEQ ID NO: 6428630 - DNA, 15 bp, Homo sapiens
tctcagatcttgaca

SEQ ID NO: 6428631 - DNA, 14 bp, Homo sapiens
tctcagatgggctg

SEQ ID NO: 6428632 - DNA, 16 bp, Homo sapiens
tctcagatttccacag

SEQ ID NO: 6428633 - DNA, 19 bp, Homo sapiens
tctcagattttaaggggga

SEQ ID NO: 6428634 - DNA, 16 bp, Homo sapiens
tctcagattttattat

SEQ ID NO: 6428635 - DNA, 14 bp, Homo sapiens
tctcagcaaagcta

SEQ ID NO: 6428636 - DNA, 23 bp, Homo sapiens
tctcagcaaagctacaggactgg

SEQ ID NO: 6428637 - DNA, 11 bp, Homo sapiens
tctcagcaagt

SEQ ID NO: 6428638 - DNA, 21 bp, Homo sapiens
tctcagcaagtgtacagtatt

SEQ ID NO: 6428639 - DNA, 14 bp, Homo sapiens
tctcagcacagcct

SEQ ID NO: 6428640 - DNA, 13 bp, Homo sapiens
tctcagcactttg

SEQ ID NO: 6428641 - DNA, 14 bp, Homo sapiens
tctcagcagagtgc

SEQ ID NO: 6428642 - DNA, 20 bp, Homo sapiens
tctcagcagccagctcctgg

SEQ ID NO: 6428643 - DNA, 23 bp, Homo sapiens
tctcagcagcgaccacccctgcc

SEQ ID NO: 6428644 - DNA, 19 bp, Homo sapiens
tctcagcataggtatgctt

SEQ ID NO: 6428645 - DNA, 23 bp, Homo sapiens
tctcagcatatatataaaataca

SEQ ID NO: 6428646 - DNA, 21 bp, Homo sapiens
tctcagcattacctctttgga

SEQ ID NO: 6428647 - DNA, 13 bp, Homo sapiens
tctcagccagctg

SEQ ID NO: 6428648 - DNA, 20 bp, Homo sapiens
tctcagccataggtgcagtt

SEQ ID NO: 6428649 - DNA, 21 bp, Homo sapiens
tctcagccataggtgcagttt

SEQ ID NO: 6428650 - DNA, 18 bp, Homo sapiens
tctcagcccagaagaaaa

SEQ ID NO: 6428651 - DNA, 23 bp, Homo sapiens
tctcagcccaggtctcctgggca

SEQ ID NO: 6428652 - DNA, 23 bp, Homo sapiens
tctcagccccgggcctgcctctg

SEQ ID NO: 6428653 - DNA, 17 bp, Homo sapiens
tctcagcccctttccct

SEQ ID NO: 6428654 - DNA, 12 bp, Homo sapiens
tctcagccctca

SEQ ID NO: 6428655 - DNA, 20 bp, Homo sapiens
tctcagccctccatggcctg

SEQ ID NO: 6428656 - DNA, 22 bp, Homo sapiens
tctcagccctccatggcctggc

SEQ ID NO: 6428657 - DNA, 14 bp, Homo sapiens
tctcagccctgcct

SEQ ID NO: 6428658 - DNA, 18 bp, Homo sapiens
tctcagcctacagcagtg

SEQ ID NO: 6428659 - DNA, 11 bp, Homo sapiens
tctcagcctcc

SEQ ID NO: 6428660 - DNA, 12 bp, Homo sapiens
tctcagcctccc

SEQ ID NO: 6428661 - DNA, 14 bp, Homo sapiens
tctcagcctcccaa

SEQ ID NO: 6428662 - DNA, 19 bp, Homo sapiens
tctcagcctcctgagcctg

SEQ ID NO: 6428663 - DNA, 20 bp, Homo sapiens
tctcagcctcctgagcctgt

SEQ ID NO: 6428664 - DNA, 11 bp, Homo sapiens
tctcagcctgg

SEQ ID NO: 6428665 - DNA, 20 bp, Homo sapiens
tctcagcctgggcccctcag

SEQ ID NO: 6428666 - DNA, 21 bp, Homo sapiens
tctcagcctgggcccctcagc

SEQ ID NO: 6428667 - DNA, 19 bp, Homo sapiens
tctcagccttcattaggag

SEQ ID NO: 6428668 - DNA, 19 bp, Homo sapiens
tctcagccttggttcctga

SEQ ID NO: 6428669 - DNA, 14 bp, Homo sapiens
tctcagcgggagtc

SEQ ID NO: 6428670 - DNA, 15 bp, Homo sapiens
tctcagctataattc

SEQ ID NO: 6428671 - DNA, 14 bp, Homo sapiens
tctcagctcactgt

SEQ ID NO: 6428672 - DNA, 16 bp, Homo sapiens
tctcagctcatcttca

SEQ ID NO: 6428673 - DNA, 13 bp, Homo sapiens
tctcagctccact

SEQ ID NO: 6428674 - DNA, 16 bp, Homo sapiens
tctcagctccactctg

SEQ ID NO: 6428675 - DNA, 17 bp, Homo sapiens
tctcagctccactctga

SEQ ID NO: 6428676 - DNA, 11 bp, Homo sapiens
tctcagctccc

SEQ ID NO: 6428677 - DNA, 14 bp, Homo sapiens
tctcagctcccagg

SEQ ID NO: 6428678 - DNA, 14 bp, Homo sapiens
tctcagctgctgaa

SEQ ID NO: 6428679 - DNA, 13 bp, Homo sapiens
tctcagctgctgg

SEQ ID NO: 6428680 - DNA, 18 bp, Homo sapiens
tctcagctgctggatgac

SEQ ID NO: 6428681 - DNA, 20 bp, Homo sapiens
tctcagctgctggatgactt

SEQ ID NO: 6428682 - DNA, 14 bp, Homo sapiens
tctcagctgtgcct

SEQ ID NO: 6428683 - DNA, 20 bp, Homo sapiens
tctcagcttcatttccgtga

SEQ ID NO: 6428684 - DNA, 15 bp, Homo sapiens
tctcagcttctaatt

SEQ ID NO: 6428685 - DNA, 19 bp, Homo sapiens
tctcagcttctaattttgt

SEQ ID NO: 6428686 - DNA, 20 bp, Homo sapiens
tctcagcttgcagctggaag

SEQ ID NO: 6428687 - DNA, 14 bp, Homo sapiens
tctcagcttgtgcc

SEQ ID NO: 6428688 - DNA, 15 bp, Homo sapiens
tctcagcttgtgcct

SEQ ID NO: 6428689 - DNA, 17 bp, Homo sapiens
tctcagctttccctgcc

SEQ ID NO: 6428690 - DNA, 13 bp, Homo sapiens
tctcagctttgag

SEQ ID NO: 6428691 - DNA, 18 bp, Homo sapiens
tctcaggaaaacagctag

SEQ ID NO: 6428692 - DNA, 14 bp, Homo sapiens
tctcaggaaatcaa

SEQ ID NO: 6428693 - DNA, 12 bp, Homo sapiens
tctcaggaagag

SEQ ID NO: 6428694 - DNA, 23 bp, Homo sapiens
tctcaggaatcatctcctttgca

SEQ ID NO: 6428695 - DNA, 17 bp, Homo sapiens
tctcaggacacaggcct

SEQ ID NO: 6428696 - DNA, 16 bp, Homo sapiens
tctcaggaccaccctg

SEQ ID NO: 6428697 - DNA, 17 bp, Homo sapiens
tctcaggaccaccctgc

SEQ ID NO: 6428698 - DNA, 18 bp, Homo sapiens
tctcaggaccaccctgcc

SEQ ID NO: 6428699 - DNA, 19 bp, Homo sapiens
tctcaggaccaccctgcca

SEQ ID NO: 6428700 - DNA, 16 bp, Homo sapiens
tctcaggacctaggga

SEQ ID NO: 6428701 - DNA, 13 bp, Homo sapiens
tctcaggacgacg

SEQ ID NO: 6428702 - DNA, 20 bp, Homo sapiens
tctcaggactctgaaaagga

SEQ ID NO: 6428703 - DNA, 20 bp, Homo sapiens
tctcaggagagtgtgcaact

SEQ ID NO: 6428704 - DNA, 16 bp, Homo sapiens
tctcaggagatttcat

SEQ ID NO: 6428705 - DNA, 19 bp, Homo sapiens
tctcaggagcacaggcagc

SEQ ID NO: 6428706 - DNA, 18 bp, Homo sapiens
tctcaggagcttgcaaga

SEQ ID NO: 6428707 - DNA, 17 bp, Homo sapiens
tctcaggaggggcagcg

SEQ ID NO: 6428708 - DNA, 20 bp, Homo sapiens
tctcaggatcaagaaagtgt

SEQ ID NO: 6428709 - DNA, 22 bp, Homo sapiens
tctcaggatttcaccagaagtt

SEQ ID NO: 6428710 - DNA, 19 bp, Homo sapiens
tctcaggcagcaccacact

SEQ ID NO: 6428711 - DNA, 20 bp, Homo sapiens
tctcaggcatgaacatgtac

SEQ ID NO: 6428712 - DNA, 18 bp, Homo sapiens
tctcaggcatgcctgtgt

SEQ ID NO: 6428713 - DNA, 10 bp, Homo sapiens
tctcaggcca

SEQ ID NO: 6428714 - DNA, 12 bp, Homo sapiens
tctcaggccaaa

SEQ ID NO: 6428715 - DNA, 18 bp, Homo sapiens
tctcaggccaagcccaat

SEQ ID NO: 6428716 - DNA, 17 bp, Homo sapiens
tctcaggccagagccaa

SEQ ID NO: 6428717 - DNA, 20 bp, Homo sapiens
tctcaggccggcagccccag

SEQ ID NO: 6428718 - DNA, 23 bp, Homo sapiens
tctcaggctcaagtttttatagt

SEQ ID NO: 6428719 - DNA, 14 bp, Homo sapiens
tctcaggctgcctg

SEQ ID NO: 6428720 - DNA, 17 bp, Homo sapiens
tctcaggctgcctgagt

SEQ ID NO: 6428721 - DNA, 18 bp, Homo sapiens
tctcaggctgtgcttacc

SEQ ID NO: 6428722 - DNA, 22 bp, Homo sapiens
tctcaggctgtgcttacctgtg

SEQ ID NO: 6428723 - DNA, 18 bp, Homo sapiens
tctcagggaagcccagct

SEQ ID NO: 6428724 - DNA, 11 bp, Homo sapiens
tctcagggagg

SEQ ID NO: 6428725 - DNA, 11 bp, Homo sapiens
tctcagggcag

SEQ ID NO: 6428726 - DNA, 14 bp, Homo sapiens
tctcagggccaggc

SEQ ID NO: 6428727 - DNA, 17 bp, Homo sapiens
tctcagggccaggcctc

SEQ ID NO: 6428728 - DNA, 18 bp, Homo sapiens
tctcagggccgagaggac

SEQ ID NO: 6428729 - DNA, 20 bp, Homo sapiens
tctcagggccgagaggacag

SEQ ID NO: 6428730 - DNA, 13 bp, Homo sapiens
tctcagggcctgg

SEQ ID NO: 6428731 - DNA, 21 bp, Homo sapiens
tctcagggcctggcaggccag

SEQ ID NO: 6428732 - DNA, 15 bp, Homo sapiens
tctcagggcctggtc

SEQ ID NO: 6428733 - DNA, 10 bp, Homo sapiens
tctcagggct

SEQ ID NO: 6428734 - DNA, 11 bp, Homo sapiens
tctcagggctg

SEQ ID NO: 6428735 - DNA, 19 bp, Homo sapiens
tctcaggggtgctggggca

SEQ ID NO: 6428736 - DNA, 18 bp, Homo sapiens
tctcagggtccagaccct

SEQ ID NO: 6428737 - DNA, 17 bp, Homo sapiens
tctcagggtctctgctg

SEQ ID NO: 6428738 - DNA, 19 bp, Homo sapiens
tctcaggtaatcattttaa

SEQ ID NO: 6428739 - DNA, 21 bp, Homo sapiens
tctcaggtcactccagtgtta

SEQ ID NO: 6428740 - DNA, 15 bp, Homo sapiens
tctcaggtccctgca

SEQ ID NO: 6428741 - DNA, 15 bp, Homo sapiens
tctcaggtgagctgg

SEQ ID NO: 6428742 - DNA, 19 bp, Homo sapiens
tctcaggtgagctggtaga

SEQ ID NO: 6428743 - DNA, 16 bp, Homo sapiens
tctcaggtgccactcc

SEQ ID NO: 6428744 - DNA, 19 bp, Homo sapiens
tctcaggttggcggcagac

SEQ ID NO: 6428745 - DNA, 22 bp, Homo sapiens
tctcaggttggcggcagacaca

SEQ ID NO: 6428746 - DNA, 21 bp, Homo sapiens
tctcaggtttgttttgtgaat

SEQ ID NO: 6428747 - DNA, 23 bp, Homo sapiens
tctcagtaataaaaattaagctg

SEQ ID NO: 6428748 - DNA, 19 bp, Homo sapiens
tctcagtacacttcctgtg

SEQ ID NO: 6428749 - DNA, 20 bp, Homo sapiens
tctcagtaccccatggagct

SEQ ID NO: 6428750 - DNA, 16 bp, Homo sapiens
tctcagtacctcccct

SEQ ID NO: 6428751 - DNA, 17 bp, Homo sapiens
tctcagtatcttaaaat

SEQ ID NO: 6428752 - DNA, 15 bp, Homo sapiens
tctcagtcagtaatt

SEQ ID NO: 6428753 - DNA, 15 bp, Homo sapiens
tctcagtcagtgtca

SEQ ID NO: 6428754 - DNA, 14 bp, Homo sapiens
tctcagtcatgcat

SEQ ID NO: 6428755 - DNA, 23 bp, Homo sapiens
tctcagtcatgcataaatatgca

SEQ ID NO: 6428756 - DNA, 20 bp, Homo sapiens
tctcagtccagatgccttcc

SEQ ID NO: 6428757 - DNA, 23 bp, Homo sapiens
tctcagtccatgaagatgtagag

SEQ ID NO: 6428758 - DNA, 19 bp, Homo sapiens
tctcagtcctaatttgaac

SEQ ID NO: 6428759 - DNA, 19 bp, Homo sapiens
tctcagtctgtcacccagg

SEQ ID NO: 6428760 - DNA, 16 bp, Homo sapiens
tctcagtgaagaatac

SEQ ID NO: 6428761 - DNA, 16 bp, Homo sapiens
tctcagtgaagactat

SEQ ID NO: 6428762 - DNA, 14 bp, Homo sapiens
tctcagtgccctcc

SEQ ID NO: 6428763 - DNA, 16 bp, Homo sapiens
tctcagtgccctccag

SEQ ID NO: 6428764 - DNA, 20 bp, Homo sapiens
tctcagtggcttcatctgtc

SEQ ID NO: 6428765 - DNA, 15 bp, Homo sapiens
tctcagtggtgcagg

SEQ ID NO: 6428766 - DNA, 17 bp, Homo sapiens
tctcagtggtgtgtgaa

SEQ ID NO: 6428767 - DNA, 21 bp, Homo sapiens
tctcagtgtcaatgcagcccc

SEQ ID NO: 6428768 - DNA, 11 bp, Homo sapiens
tctcagtgtgc

SEQ ID NO: 6428769 - DNA, 15 bp, Homo sapiens
tctcagtgtgtgtgt

SEQ ID NO: 6428770 - DNA, 22 bp, Homo sapiens
tctcagtgtgtgtgtgtggtcc

SEQ ID NO: 6428771 - DNA, 18 bp, Homo sapiens
tctcagtgttgagccttt

SEQ ID NO: 6428772 - DNA, 13 bp, Homo sapiens
tctcagtgttggt

SEQ ID NO: 6428773 - DNA, 19 bp, Homo sapiens
tctcagtgttttggactcc

SEQ ID NO: 6428774 - DNA, 18 bp, Homo sapiens
tctcagttctcttgcttt

SEQ ID NO: 6428775 - DNA, 18 bp, Homo sapiens
tctcagttgcagaaaatg

SEQ ID NO: 6428776 - DNA, 20 bp, Homo sapiens
tctcagttgcagaaaatgaa

SEQ ID NO: 6428777 - DNA, 18 bp, Homo sapiens
tctcagttgtttgcttct

SEQ ID NO: 6428778 - DNA, 15 bp, Homo sapiens
tctcagtttctgcct

SEQ ID NO: 6428779 - DNA, 16 bp, Homo sapiens
tctcagtttctgcctg

SEQ ID NO: 6428780 - DNA, 17 bp, Homo sapiens
tctcagtttctgcctgg

SEQ ID NO: 6428781 - DNA, 16 bp, Homo sapiens
tctcagtttgtataga

SEQ ID NO: 6428782 - DNA, 16 bp, Homo sapiens
tctcagtttgtgtgtc

SEQ ID NO: 6428783 - DNA, 18 bp, Homo sapiens
tctcagtttgtgtgtctt

SEQ ID NO: 6428784 - DNA, 19 bp, Homo sapiens
tctcagtttgtgtgtctta

SEQ ID NO: 6428785 - DNA, 16 bp, Homo sapiens
tctcagttttcagcta

SEQ ID NO: 6428786 - DNA, 13 bp, Homo sapiens
tctcagtttttct

SEQ ID NO: 6428787 - DNA, 16 bp, Homo sapiens
tctcataaaactgtga

SEQ ID NO: 6428788 - DNA, 15 bp, Homo sapiens
tctcataaacagagt

SEQ ID NO: 6428789 - DNA, 22 bp, Homo sapiens
aactgtttatatgtgttgaaaa

SEQ ID NO: 6428790 - DNA, 16 bp, Homo sapiens
aactgtttttgaagaa

SEQ ID NO: 6428791 - DNA, 17 bp, Homo sapiens
aacttaaaaatgtaaat

SEQ ID NO: 6428792 - DNA, 19 bp, Homo sapiens
aacttaaaaccttgaaggt

SEQ ID NO: 6428793 - DNA, 15 bp, Homo sapiens
aacttaaaagaacat

SEQ ID NO: 6428794 - DNA, 15 bp, Homo sapiens
aacttaaaagcaaga

SEQ ID NO: 6428795 - DNA, 18 bp, Homo sapiens
aacttaaaataaaattat

SEQ ID NO: 6428796 - DNA, 17 bp, Homo sapiens
aacttaaaataattaaa

SEQ ID NO: 6428797 - DNA, 22 bp, Homo sapiens
aacttaaaataattaaataaat

SEQ ID NO: 6428798 - DNA, 16 bp, Homo sapiens
aacttaaaatatttta

SEQ ID NO: 6428799 - DNA, 15 bp, Homo sapiens
aacttaaacaaaaaa

SEQ ID NO: 6428800 - DNA, 17 bp, Homo sapiens
aacttaaacctgtgctt

SEQ ID NO: 6428801 - DNA, 18 bp, Homo sapiens
aacttaaacctgtgcttt

SEQ ID NO: 6428802 - DNA, 15 bp, Homo sapiens
aacttaaagaggaat

SEQ ID NO: 6428803 - DNA, 16 bp, Homo sapiens
aacttaaagcaaaata

SEQ ID NO: 6428804 - DNA, 18 bp, Homo sapiens
aacttaaagctactgtag

SEQ ID NO: 6428805 - DNA, 14 bp, Homo sapiens
aacttaaataattt

SEQ ID NO: 6428806 - DNA, 16 bp, Homo sapiens
aacttaaataatttaa

SEQ ID NO: 6428807 - DNA, 22 bp, Homo sapiens
aacttaaatattgtaatatgac

SEQ ID NO: 6428808 - DNA, 15 bp, Homo sapiens
aacttaaatcactga

SEQ ID NO: 6428809 - DNA, 18 bp, Homo sapiens
aacttaaatgcccccctc

SEQ ID NO: 6428810 - DNA, 21 bp, Homo sapiens
aacttaaatgcccccctccca

SEQ ID NO: 6428811 - DNA, 21 bp, Homo sapiens
aacttaaatgttattatctgg

SEQ ID NO: 6428812 - DNA, 12 bp, Homo sapiens
aacttaacatgc

SEQ ID NO: 6428813 - DNA, 17 bp, Homo sapiens
aacttaacattctgtaa

SEQ ID NO: 6428814 - DNA, 11 bp, Homo sapiens
aacttaactga

SEQ ID NO: 6428815 - DNA, 17 bp, Homo sapiens
aacttaacttaaaattg

SEQ ID NO: 6428816 - DNA, 15 bp, Homo sapiens
aacttaagaattgaa

SEQ ID NO: 6428817 - DNA, 22 bp, Homo sapiens
aacttaagatgggcctgtatga

SEQ ID NO: 6428818 - DNA, 14 bp, Homo sapiens
aacttaagcaaagg

SEQ ID NO: 6428819 - DNA, 16 bp, Homo sapiens
aacttaagcataaaaa

SEQ ID NO: 6428820 - DNA, 13 bp, Homo sapiens
aacttaagccaat

SEQ ID NO: 6428821 - DNA, 21 bp, Homo sapiens
aacttaagggttttttagaaa

SEQ ID NO: 6428822 - DNA, 18 bp, Homo sapiens
aacttaagtggctaaaga

SEQ ID NO: 6428823 - DNA, 15 bp, Homo sapiens
aacttaataaatatt

SEQ ID NO: 6428824 - DNA, 13 bp, Homo sapiens
aacttaataatca

SEQ ID NO: 6428825 - DNA, 18 bp, Homo sapiens
aacttaatagtatttatg

SEQ ID NO: 6428826 - DNA, 17 bp, Homo sapiens
aacttaatgaagaaata

SEQ ID NO: 6428827 - DNA, 12 bp, Homo sapiens
aacttaatgtgc

SEQ ID NO: 6428828 - DNA, 23 bp, Homo sapiens
aacttaatgttcttatgcaaaat

SEQ ID NO: 6428829 - DNA, 20 bp, Homo sapiens
aacttaattcaatgctttct

SEQ ID NO: 6428830 - DNA, 15 bp, Homo sapiens
aacttaattctgtta

SEQ ID NO: 6428831 - DNA, 23 bp, Homo sapiens
aacttaatttgggaatttgttgt

SEQ ID NO: 6428832 - DNA, 13 bp, Homo sapiens
aacttaattttgt

SEQ ID NO: 6428833 - DNA, 19 bp, Homo sapiens
aacttacaaactggtttga

SEQ ID NO: 6428834 - DNA, 14 bp, Homo sapiens
aacttacacctgga

SEQ ID NO: 6428835 - DNA, 23 bp, Homo sapiens
aacttacactgtttcatctcagc

SEQ ID NO: 6428836 - DNA, 19 bp, Homo sapiens
aacttacacttggagcccg

SEQ ID NO: 6428837 - DNA, 22 bp, Homo sapiens
aacttacaggtgattaacttgg

SEQ ID NO: 6428838 - DNA, 20 bp, Homo sapiens
aacttacatatttattttta

SEQ ID NO: 6428839 - DNA, 21 bp, Homo sapiens
aacttacattgttcaattaga

SEQ ID NO: 6428840 - DNA, 21 bp, Homo sapiens
aacttaccaggcaccaaaaga

SEQ ID NO: 6428841 - DNA, 23 bp, Homo sapiens
aacttaccgtgagcgacaaagat

SEQ ID NO: 6428842 - DNA, 18 bp, Homo sapiens
aacttacctctgcttctg

SEQ ID NO: 6428843 - DNA, 23 bp, Homo sapiens
aacttacggatttattatataaa

SEQ ID NO: 6428844 - DNA, 20 bp, Homo sapiens
aacttactatggtatatatt

SEQ ID NO: 6428845 - DNA, 15 bp, Homo sapiens
aacttactgattatt

SEQ ID NO: 6428846 - DNA, 19 bp, Homo sapiens
aacttactgtatatgtatt

SEQ ID NO: 6428847 - DNA, 22 bp, Homo sapiens
aacttactgtccaccagtttat

SEQ ID NO: 6428848 - DNA, 23 bp, Homo sapiens
aacttactgtccaccagtttata

SEQ ID NO: 6428849 - DNA, 14 bp, Homo sapiens
aacttacttagtgt

SEQ ID NO: 6428850 - DNA, 21 bp, Homo sapiens
aacttacttgcataccaagtt

SEQ ID NO: 6428851 - DNA, 11 bp, Homo sapiens
aacttagaaaa

SEQ ID NO: 6428852 - DNA, 21 bp, Homo sapiens
aacttagaaaccaaattacaa

SEQ ID NO: 6428853 - DNA, 20 bp, Homo sapiens
aacttagaactatgctaatt

SEQ ID NO: 6428854 - DNA, 16 bp, Homo sapiens
aacttagaataaaatt

SEQ ID NO: 6428855 - DNA, 21 bp, Homo sapiens
aacttagaataaaattgtaaa

SEQ ID NO: 6428856 - DNA, 17 bp, Homo sapiens
aacttagacccatgctg

SEQ ID NO: 6428857 - DNA, 21 bp, Homo sapiens
aacttagactcctcttcccag

SEQ ID NO: 6428858 - DNA, 15 bp, Homo sapiens
aacttagagcttttt

SEQ ID NO: 6428859 - DNA, 18 bp, Homo sapiens
aacttagatgttaaatgt

SEQ ID NO: 6428860 - DNA, 16 bp, Homo sapiens
aacttagattttacat

SEQ ID NO: 6428861 - DNA, 16 bp, Homo sapiens
aacttagcatgtgttg

SEQ ID NO: 6428862 - DNA, 21 bp, Homo sapiens
aacttagccatttttcaaagc

SEQ ID NO: 6428863 - DNA, 18 bp, Homo sapiens
aacttaggatggctagga

SEQ ID NO: 6428864 - DNA, 22 bp, Homo sapiens
aacttagtttttaaaatttatt

SEQ ID NO: 6428865 - DNA, 20 bp, Homo sapiens
aacttagtttttatctttga

SEQ ID NO: 6428866 - DNA, 14 bp, Homo sapiens
aacttataaatcat

SEQ ID NO: 6428867 - DNA, 16 bp, Homo sapiens
aacttataaatttcat

SEQ ID NO: 6428868 - DNA, 16 bp, Homo sapiens
aacttataatgattaa

SEQ ID NO: 6428869 - DNA, 17 bp, Homo sapiens
aacttataatttccaaa

SEQ ID NO: 6428870 - DNA, 21 bp, Homo sapiens
aacttatattgtaagaaatac

SEQ ID NO: 6428871 - DNA, 19 bp, Homo sapiens
aacttatcctaaaacaaat

SEQ ID NO: 6428872 - DNA, 21 bp, Homo sapiens
aacttatctagaaagaaaaga

SEQ ID NO: 6428873 - DNA, 16 bp, Homo sapiens
aacttatctccagcca

SEQ ID NO: 6428874 - DNA, 17 bp, Homo sapiens
aacttatcttacaaagt

SEQ ID NO: 6428875 - DNA, 19 bp, Homo sapiens
aacttatcttacaaagtgt

SEQ ID NO: 6428876 - DNA, 22 bp, Homo sapiens
aacttatgaagtaaagtttctg

SEQ ID NO: 6428877 - DNA, 15 bp, Homo sapiens
aacttatgaatgttt

SEQ ID NO: 6428878 - DNA, 16 bp, Homo sapiens
aacttatgaatgtttc

SEQ ID NO: 6428879 - DNA, 21 bp, Homo sapiens
aacttatgacctcttccttta

SEQ ID NO: 6428880 - DNA, 22 bp, Homo sapiens
aacttatgtagatatttggctt

SEQ ID NO: 6428881 - DNA, 13 bp, Homo sapiens
aacttatgtatgt

SEQ ID NO: 6428882 - DNA, 12 bp, Homo sapiens
aacttatgtttt

SEQ ID NO: 6428883 - DNA, 15 bp, Homo sapiens
aacttattacctcag

SEQ ID NO: 6428884 - DNA, 22 bp, Homo sapiens
aacttattacctcaggtgccaa

SEQ ID NO: 6428885 - DNA, 14 bp, Homo sapiens
aacttattcaaaga

SEQ ID NO: 6428886 - DNA, 17 bp, Homo sapiens
aacttattgctgatttt

SEQ ID NO: 6428887 - DNA, 20 bp, Homo sapiens
aacttatttcataattgcct

SEQ ID NO: 6428888 - DNA, 18 bp, Homo sapiens
aacttatttctgaaaaag

SEQ ID NO: 6428889 - DNA, 19 bp, Homo sapiens
aacttatttctgaaaaaga

SEQ ID NO: 6428890 - DNA, 19 bp, Homo sapiens
aacttattttaaatatgcc

SEQ ID NO: 6428891 - DNA, 14 bp, Homo sapiens
aacttattttatcc

SEQ ID NO: 6428892 - DNA, 14 bp, Homo sapiens
aacttattttgctt

SEQ ID NO: 6428893 - DNA, 19 bp, Homo sapiens
aacttatttttttctgatt

SEQ ID NO: 6428894 - DNA, 19 bp, Homo sapiens
aacttcaagatgagcctgg

SEQ ID NO: 6428895 - DNA, 17 bp, Homo sapiens
aacttcaaggaaaataa

SEQ ID NO: 6428896 - DNA, 22 bp, Homo sapiens
aacttcaagtgcatgctctctg

SEQ ID NO: 6428897 - DNA, 13 bp, Homo sapiens
aacttcacatatt

SEQ ID NO: 6428898 - DNA, 22 bp, Homo sapiens
aacttcacatattgatttccgt

SEQ ID NO: 6428899 - DNA, 21 bp, Homo sapiens
aacttcaccaccccctgtccc

SEQ ID NO: 6428900 - DNA, 23 bp, Homo sapiens
aacttcaccaccccctgtcccat

SEQ ID NO: 6428901 - DNA, 13 bp, Homo sapiens
aacttcactctgg

SEQ ID NO: 6428902 - DNA, 14 bp, Homo sapiens
aacttcagaaagac

SEQ ID NO: 6428903 - DNA, 15 bp, Homo sapiens
aacttcagacacaaa

SEQ ID NO: 6428904 - DNA, 13 bp, Homo sapiens
aacttcagacata

SEQ ID NO: 6428905 - DNA, 11 bp, Homo sapiens
aacttcagaga

SEQ ID NO: 6428906 - DNA, 13 bp, Homo sapiens
aacttcagagaag

SEQ ID NO: 6428907 - DNA, 14 bp, Homo sapiens
aacttcagagaagt

SEQ ID NO: 6428908 - DNA, 22 bp, Homo sapiens
aacttcagagggaaagtaaata

SEQ ID NO: 6428909 - DNA, 12 bp, Homo sapiens
aacttcagcaac

SEQ ID NO: 6428910 - DNA, 12 bp, Homo sapiens
aacttcagcacc

SEQ ID NO: 6428911 - DNA, 18 bp, Homo sapiens
aacttcagcggtttatat

SEQ ID NO: 6428912 - DNA, 17 bp, Homo sapiens
aacttcagctgtacttc

SEQ ID NO: 6428913 - DNA, 19 bp, Homo sapiens
aacttcaggtaaaaacttc

SEQ ID NO: 6428914 - DNA, 14 bp, Homo sapiens
aacttcagtaggat

SEQ ID NO: 6428915 - DNA, 20 bp, Homo sapiens
aacttcagtaggatttatgt

SEQ ID NO: 6428916 - DNA, 21 bp, Homo sapiens
aacttcagtaggatttatgta

SEQ ID NO: 6428917 - DNA, 19 bp, Homo sapiens
aacttcagttttactgcat

SEQ ID NO: 6428918 - DNA, 23 bp, Homo sapiens
aacttcagttttatttttgccaa

SEQ ID NO: 6428919 - DNA, 13 bp, Homo sapiens
aacttcatataac

SEQ ID NO: 6428920 - DNA, 17 bp, Homo sapiens
aacttcatatgtaatct

SEQ ID NO: 6428921 - DNA, 14 bp, Homo sapiens
aacttcatctgcca

SEQ ID NO: 6428922 - DNA, 16 bp, Homo sapiens
aacttcatctggaagt

SEQ ID NO: 6428923 - DNA, 17 bp, Homo sapiens
aacttcattctaaacca

SEQ ID NO: 6428924 - DNA, 21 bp, Homo sapiens
aacttcattctaaaccaaaac

SEQ ID NO: 6428925 - DNA, 22 bp, Homo sapiens
aacttcattctaaaccaaaaca

SEQ ID NO: 6428926 - DNA, 12 bp, Homo sapiens
aacttcattctc

SEQ ID NO: 6428927 - DNA, 12 bp, Homo sapiens
aacttcatttga

SEQ ID NO: 6428928 - DNA, 14 bp, Homo sapiens
aacttcatttgaca

SEQ ID NO: 6428929 - DNA, 21 bp, Homo sapiens
aacttcatttgacacaaagct

SEQ ID NO: 6428930 - DNA, 13 bp, Homo sapiens
aacttccaaagaa

SEQ ID NO: 6428931 - DNA, 20 bp, Homo sapiens
aacttccaagacctgactca

SEQ ID NO: 6428932 - DNA, 22 bp, Homo sapiens
aacttccaaggccctgcttttt

SEQ ID NO: 6428933 - DNA, 14 bp, Homo sapiens
aacttccactttgt

SEQ ID NO: 6428934 - DNA, 16 bp, Homo sapiens
aacttccactttgtat

SEQ ID NO: 6428935 - DNA, 23 bp, Homo sapiens
aacttccactttgtataaatttt

SEQ ID NO: 6428936 - DNA, 21 bp, Homo sapiens
aacttccagaggacagctctg

SEQ ID NO: 6428937 - DNA, 18 bp, Homo sapiens
aacttccagtatcatttt

SEQ ID NO: 6428938 - DNA, 22 bp, Homo sapiens
aacttcccacacggcagccccc

SEQ ID NO: 6428939 - DNA, 18 bp, Homo sapiens
aacttcccagtgaattct

SEQ ID NO: 6428940 - DNA, 23 bp, Homo sapiens
aacttccccatacaaataagcat

SEQ ID NO: 6428941 - DNA, 23 bp, Homo sapiens
aacttcccctctaactggacagc

SEQ ID NO: 6428942 - DNA, 11 bp, Homo sapiens
aacttccctga

SEQ ID NO: 6428943 - DNA, 16 bp, Homo sapiens
aacttccgcctcctgt

SEQ ID NO: 6428944 - DNA, 15 bp, Homo sapiens
aacttccgctgaggg

SEQ ID NO: 6428945 - DNA, 22 bp, Homo sapiens
aacttcctataccggagctcca

SEQ ID NO: 6428946 - DNA, 11 bp, Homo sapiens
aacttcctctt

SEQ ID NO: 6428947 - DNA, 23 bp, Homo sapiens
aacttcctgcaggtaaacagttc

SEQ ID NO: 6428948 - DNA, 12 bp, Homo sapiens
aacttcctgctg

SEQ ID NO: 6428949 - DNA, 13 bp, Homo sapiens
aacttcctgctgc

SEQ ID NO: 6428950 - DNA, 17 bp, Homo sapiens
aacttcctgctgcaccc

SEQ ID NO: 6428951 - DNA, 16 bp, Homo sapiens
aacttcctgtggcctg

SEQ ID NO: 6428952 - DNA, 23 bp, Homo sapiens
aacttccttattgggacttttct

SEQ ID NO: 6428953 - DNA, 18 bp, Homo sapiens
aacttccttgcccctgct

SEQ ID NO: 6428954 - DNA, 23 bp, Homo sapiens
aacttccttggactcattttaaa

SEQ ID NO: 6428955 - DNA, 10 bp, Homo sapiens
aacttccttt

SEQ ID NO: 6428956 - DNA, 11 bp, Homo sapiens
aacttccttta

SEQ ID NO: 6428957 - DNA, 12 bp, Homo sapiens
aacttcctttac

SEQ ID NO: 6428958 - DNA, 17 bp, Homo sapiens
aacttcgaatatatctg

SEQ ID NO: 6428959 - DNA, 17 bp, Homo sapiens
aacttcgcatcaaaaga

SEQ ID NO: 6428960 - DNA, 23 bp, Homo sapiens
aacttcgcatcaaaagacaattc

SEQ ID NO: 6428961 - DNA, 15 bp, Homo sapiens
aacttcgtatttttt

SEQ ID NO: 6428962 - DNA, 13 bp, Homo sapiens
aacttctaaaact

SEQ ID NO: 6428963 - DNA, 13 bp, Homo sapiens
aacttctaaagaa

SEQ ID NO: 6428964 - DNA, 15 bp, Homo sapiens
aacttctaattgcca

SEQ ID NO: 6428965 - DNA, 21 bp, Homo sapiens
aacttctagttgctcttgctt

SEQ ID NO: 6428966 - DNA, 22 bp, Homo sapiens
aacttctatattttaatagaaa

SEQ ID NO: 6428967 - DNA, 20 bp, Homo sapiens
tctcataacccctctatttc

SEQ ID NO: 6428968 - DNA, 21 bp, Homo sapiens
tctcataatccttctgcaact

SEQ ID NO: 6428969 - DNA, 17 bp, Homo sapiens
tctcataatgaagacat

SEQ ID NO: 6428970 - DNA, 15 bp, Homo sapiens
tctcataatgctttg

SEQ ID NO: 6428971 - DNA, 18 bp, Homo sapiens
tctcataattcctacagc

SEQ ID NO: 6428972 - DNA, 16 bp, Homo sapiens
tctcataattttgcaa

SEQ ID NO: 6428973 - DNA, 17 bp, Homo sapiens
tctcataattttgcaaa

SEQ ID NO: 6428974 - DNA, 14 bp, Homo sapiens
tctcatacgtccac

SEQ ID NO: 6428975 - DNA, 21 bp, Homo sapiens
tctcatactcccccacagttt

SEQ ID NO: 6428976 - DNA, 15 bp, Homo sapiens
tctcatactgtctgg

SEQ ID NO: 6428977 - DNA, 18 bp, Homo sapiens
tctcatactgtctgggat

SEQ ID NO: 6428978 - DNA, 16 bp, Homo sapiens
tctcataggaaaagta

SEQ ID NO: 6428979 - DNA, 23 bp, Homo sapiens
tctcataggaaaagtacatttaa

SEQ ID NO: 6428980 - DNA, 19 bp, Homo sapiens
tctcataggaattaaatgt

SEQ ID NO: 6428981 - DNA, 14 bp, Homo sapiens
tctcataggagact

SEQ ID NO: 6428982 - DNA, 14 bp, Homo sapiens
tctcataggagtta

SEQ ID NO: 6428983 - DNA, 21 bp, Homo sapiens
tctcatagggatgctgtgagc

SEQ ID NO: 6428984 - DNA, 19 bp, Homo sapiens
tctcatatgtagccctcat

SEQ ID NO: 6428985 - DNA, 12 bp, Homo sapiens
tctcatcacaca

SEQ ID NO: 6428986 - DNA, 20 bp, Homo sapiens
tctcatcacagtgggaagaa

SEQ ID NO: 6428987 - DNA, 22 bp, Homo sapiens
tctcatcacatttgtaaatgtc

SEQ ID NO: 6428988 - DNA, 15 bp, Homo sapiens
tctcatcagcccagg

SEQ ID NO: 6428989 - DNA, 21 bp, Homo sapiens
tctcatcagtgtcctcttgct

SEQ ID NO: 6428990 - DNA, 15 bp, Homo sapiens
tctcatcatattgta

SEQ ID NO: 6428991 - DNA, 22 bp, Homo sapiens
tctcatcatttgcattgggcat

SEQ ID NO: 6428992 - DNA, 12 bp, Homo sapiens
tctcatccacat

SEQ ID NO: 6428993 - DNA, 14 bp, Homo sapiens
tctcatccatcatc

SEQ ID NO: 6428994 - DNA, 16 bp, Homo sapiens
tctcatcccagtctga

SEQ ID NO: 6428995 - DNA, 22 bp, Homo sapiens
tctcatcccagtctgatattca

SEQ ID NO: 6428996 - DNA, 18 bp, Homo sapiens
tctcatccccaaactgta

SEQ ID NO: 6428997 - DNA, 14 bp, Homo sapiens
tctcatccccaggg

SEQ ID NO: 6428998 - DNA, 15 bp, Homo sapiens
tctcatccccagggg

SEQ ID NO: 6428999 - DNA, 22 bp, Homo sapiens
tctcatccccaggggtcccagc

SEQ ID NO: 6429000 - DNA, 13 bp, Homo sapiens
tctcatcccccca

SEQ ID NO: 6429001 - DNA, 16 bp, Homo sapiens
tctcatccccccaccc

SEQ ID NO: 6429002 - DNA, 13 bp, Homo sapiens
tctcatcctccca

SEQ ID NO: 6429003 - DNA, 15 bp, Homo sapiens
tctcatcctcccatt

SEQ ID NO: 6429004 - DNA, 18 bp, Homo sapiens
tctcatcctcctggaacc

SEQ ID NO: 6429005 - DNA, 13 bp, Homo sapiens
tctcatcctgcag

SEQ ID NO: 6429006 - DNA, 21 bp, Homo sapiens
tctcatccttttctcctatct

SEQ ID NO: 6429007 - DNA, 16 bp, Homo sapiens
tctcatccttttggat

SEQ ID NO: 6429008 - DNA, 19 bp, Homo sapiens
tctcatcgccagacaactg

SEQ ID NO: 6429009 - DNA, 16 bp, Homo sapiens
tctcatcggaggccca

SEQ ID NO: 6429010 - DNA, 19 bp, Homo sapiens
tctcatcgtcttttagttc

SEQ ID NO: 6429011 - DNA, 13 bp, Homo sapiens
tctcatctactca

SEQ ID NO: 6429012 - DNA, 19 bp, Homo sapiens
tctcatctcagtgaagaat

SEQ ID NO: 6429013 - DNA, 18 bp, Homo sapiens
tctcatctccccacgccc

SEQ ID NO: 6429014 - DNA, 17 bp, Homo sapiens
tctcatctcttagctcc

SEQ ID NO: 6429015 - DNA, 20 bp, Homo sapiens
tctcatctcttagctcccct

SEQ ID NO: 6429016 - DNA, 13 bp, Homo sapiens
tctcatctcttca

SEQ ID NO: 6429017 - DNA, 20 bp, Homo sapiens
tctcatctgatcacttcatg

SEQ ID NO: 6429018 - DNA, 14 bp, Homo sapiens
tctcatctgccggc

SEQ ID NO: 6429019 - DNA, 22 bp, Homo sapiens
tctcatctgtaaaaccaggctg

SEQ ID NO: 6429020 - DNA, 17 bp, Homo sapiens
tctcatctgtgattccc

SEQ ID NO: 6429021 - DNA, 16 bp, Homo sapiens
tctcatcttaaaaata

SEQ ID NO: 6429022 - DNA, 13 bp, Homo sapiens
tctcatcttctct

SEQ ID NO: 6429023 - DNA, 15 bp, Homo sapiens
tctcatcttctctca

SEQ ID NO: 6429024 - DNA, 13 bp, Homo sapiens
tctcatcttgcct

SEQ ID NO: 6429025 - DNA, 15 bp, Homo sapiens
tctcatcttgttctt

SEQ ID NO: 6429026 - DNA, 13 bp, Homo sapiens
tctcatctttctt

SEQ ID NO: 6429027 - DNA, 14 bp, Homo sapiens
tctcatgaagcagg

SEQ ID NO: 6429028 - DNA, 15 bp, Homo sapiens
tctcatgaagccctt

SEQ ID NO: 6429029 - DNA, 17 bp, Homo sapiens
tctcatgaaggagagga

SEQ ID NO: 6429030 - DNA, 16 bp, Homo sapiens
tctcatgagaagccaa

SEQ ID NO: 6429031 - DNA, 20 bp, Homo sapiens
tctcatgaggggagaggaga

SEQ ID NO: 6429032 - DNA, 20 bp, Homo sapiens
tctcatgcactgcaaatact

SEQ ID NO: 6429033 - DNA, 21 bp, Homo sapiens
tctcatgcactgcaaatactt

SEQ ID NO: 6429034 - DNA, 18 bp, Homo sapiens
tctcatgcatagacaagt

SEQ ID NO: 6429035 - DNA, 15 bp, Homo sapiens
tctcatgccagcagc

SEQ ID NO: 6429036 - DNA, 16 bp, Homo sapiens
tctcatgcccactccc

SEQ ID NO: 6429037 - DNA, 13 bp, Homo sapiens
tctcatgcctcag

SEQ ID NO: 6429038 - DNA, 14 bp, Homo sapiens
tctcatgcctcagc

SEQ ID NO: 6429039 - DNA, 19 bp, Homo sapiens
tctcatgcctcagcctcct

SEQ ID NO: 6429040 - DNA, 20 bp, Homo sapiens
tctcatgcctcagcctcctg

SEQ ID NO: 6429041 - DNA, 11 bp, Homo sapiens
tctcatgcctg

SEQ ID NO: 6429042 - DNA, 15 bp, Homo sapiens
tctcatgctatttct

SEQ ID NO: 6429043 - DNA, 16 bp, Homo sapiens
tctcatgctccttaat

SEQ ID NO: 6429044 - DNA, 21 bp, Homo sapiens
tctcatggagaagacttcttt

SEQ ID NO: 6429045 - DNA, 13 bp, Homo sapiens
tctcatggctttg

SEQ ID NO: 6429046 - DNA, 16 bp, Homo sapiens
tctcatggctttgtta

SEQ ID NO: 6429047 - DNA, 16 bp, Homo sapiens
tctcatgggaagggga

SEQ ID NO: 6429048 - DNA, 21 bp, Homo sapiens
tctcatggtgaaatctgctct

SEQ ID NO: 6429049 - DNA, 20 bp, Homo sapiens
tctcatgtaacacataaaca

SEQ ID NO: 6429050 - DNA, 13 bp, Homo sapiens
tctcatgtaattt

SEQ ID NO: 6429051 - DNA, 13 bp, Homo sapiens
tctcatgtatctt

SEQ ID NO: 6429052 - DNA, 23 bp, Homo sapiens
tctcatgtccccttcctgttctt

SEQ ID NO: 6429053 - DNA, 14 bp, Homo sapiens
tctcatgtccctcc

SEQ ID NO: 6429054 - DNA, 15 bp, Homo sapiens
tctcatgtccctcca

SEQ ID NO: 6429055 - DNA, 16 bp, Homo sapiens
tctcatgtccctccag

SEQ ID NO: 6429056 - DNA, 17 bp, Homo sapiens
tctcatgtccctccagg

SEQ ID NO: 6429057 - DNA, 12 bp, Homo sapiens
tctcatgtcctg

SEQ ID NO: 6429058 - DNA, 16 bp, Homo sapiens
tctcatgtcctgctgg

SEQ ID NO: 6429059 - DNA, 21 bp, Homo sapiens
tctcatgtcctgctggcttcc

SEQ ID NO: 6429060 - DNA, 14 bp, Homo sapiens
tctcatgtctcccc

SEQ ID NO: 6429061 - DNA, 15 bp, Homo sapiens
tctcatgtctcccca

SEQ ID NO: 6429062 - DNA, 18 bp, Homo sapiens
tctcatgtgatcctttta

SEQ ID NO: 6429063 - DNA, 23 bp, Homo sapiens
tctcatgtgatccttttatgtta

SEQ ID NO: 6429064 - DNA, 17 bp, Homo sapiens
tctcatgtgctttgtag

SEQ ID NO: 6429065 - DNA, 18 bp, Homo sapiens
tctcatgtgctttgtagc

SEQ ID NO: 6429066 - DNA, 23 bp, Homo sapiens
tctcatgtggggatgtttgtgct

SEQ ID NO: 6429067 - DNA, 19 bp, Homo sapiens
tctcatgttccttttgaaa

SEQ ID NO: 6429068 - DNA, 22 bp, Homo sapiens
tctcatgttccttttgaaattg

SEQ ID NO: 6429069 - DNA, 18 bp, Homo sapiens
tctcatgttttcaactgc

SEQ ID NO: 6429070 - DNA, 19 bp, Homo sapiens
tctcatgttttcaactgcc

SEQ ID NO: 6429071 - DNA, 15 bp, Homo sapiens
tctcattaaaagaat

SEQ ID NO: 6429072 - DNA, 17 bp, Homo sapiens
tctcattaaaatccagt

SEQ ID NO: 6429073 - DNA, 17 bp, Homo sapiens
tctcattacccttttct

SEQ ID NO: 6429074 - DNA, 14 bp, Homo sapiens
tctcattagaaagg

SEQ ID NO: 6429075 - DNA, 14 bp, Homo sapiens
tctcattatgaaga

SEQ ID NO: 6429076 - DNA, 15 bp, Homo sapiens
tctcattatgaagat

SEQ ID NO: 6429077 - DNA, 18 bp, Homo sapiens
tctcattatgaagatgtt

SEQ ID NO: 6429078 - DNA, 21 bp, Homo sapiens
tctcattatgaagatgttttt

SEQ ID NO: 6429079 - DNA, 12 bp, Homo sapiens
tctcattatttc

SEQ ID NO: 6429080 - DNA, 15 bp, Homo sapiens
tctcattatttcaaa

SEQ ID NO: 6429081 - DNA, 13 bp, Homo sapiens
tctcattcagtat

SEQ ID NO: 6429082 - DNA, 14 bp, Homo sapiens
tctcattcatcctt

SEQ ID NO: 6429083 - DNA, 16 bp, Homo sapiens
tctcattcatccttat

SEQ ID NO: 6429084 - DNA, 11 bp, Homo sapiens
tctcattccca

SEQ ID NO: 6429085 - DNA, 21 bp, Homo sapiens
tctcattcccagagtcagagg

SEQ ID NO: 6429086 - DNA, 20 bp, Homo sapiens
tctcattccgttgtctgtgg

SEQ ID NO: 6429087 - DNA, 13 bp, Homo sapiens
tctcattcctctg

SEQ ID NO: 6429088 - DNA, 16 bp, Homo sapiens
tctcattcttctaaaa

SEQ ID NO: 6429089 - DNA, 13 bp, Homo sapiens
tctcattcttgtt

SEQ ID NO: 6429090 - DNA, 14 bp, Homo sapiens
tctcattctttgaa

SEQ ID NO: 6429091 - DNA, 16 bp, Homo sapiens
tctcattctttgaaca

SEQ ID NO: 6429092 - DNA, 20 bp, Homo sapiens
tctcattctttgaacatgaa

SEQ ID NO: 6429093 - DNA, 20 bp, Homo sapiens
tctcattgaattataaaagc

SEQ ID NO: 6429094 - DNA, 18 bp, Homo sapiens
tctcattgatcacagatg

SEQ ID NO: 6429095 - DNA, 19 bp, Homo sapiens
tctcattgccaaggcatcc

SEQ ID NO: 6429096 - DNA, 13 bp, Homo sapiens
tctcattgccagt

SEQ ID NO: 6429097 - DNA, 14 bp, Homo sapiens
tctcattgctctga

SEQ ID NO: 6429098 - DNA, 15 bp, Homo sapiens
tctcattgctgcccg

SEQ ID NO: 6429099 - DNA, 19 bp, Homo sapiens
tctcattggaaatttagca

SEQ ID NO: 6429100 - DNA, 24 bp, Homo sapiens
tctcattggaaatttagcattgta

SEQ ID NO: 6429101 - DNA, 16 bp, Homo sapiens
tctcattgtcacctct

SEQ ID NO: 6429102 - DNA, 12 bp, Homo sapiens
tctcattgtctt

SEQ ID NO: 6429103 - DNA, 14 bp, Homo sapiens
tctcattgtcttgt

SEQ ID NO: 6429104 - DNA, 22 bp, Homo sapiens
tctcattgtcttgttatgtaca

SEQ ID NO: 6429105 - DNA, 16 bp, Homo sapiens
tctcatttaagggaaa

SEQ ID NO: 6429106 - DNA, 19 bp, Homo sapiens
tctcatttaagggaaaaat

SEQ ID NO: 6429107 - DNA, 23 bp, Homo sapiens
tctcatttaagggaaaaatatat

SEQ ID NO: 6429108 - DNA, 17 bp, Homo sapiens
tctcatttaatttgtta

SEQ ID NO: 6429109 - DNA, 18 bp, Homo sapiens
tctcatttaatttgttat

SEQ ID NO: 6429110 - DNA, 17 bp, Homo sapiens
tctcatttatgttattt

SEQ ID NO: 6429111 - DNA, 18 bp, Homo sapiens
tctcatttatttttagcc

SEQ ID NO: 6429112 - DNA, 18 bp, Homo sapiens
tctcatttcaatttataa

SEQ ID NO: 6429113 - DNA, 22 bp, Homo sapiens
tctcatttcacccctccctttc

SEQ ID NO: 6429114 - DNA, 14 bp, Homo sapiens
tctcatttccagct

SEQ ID NO: 6429115 - DNA, 14 bp, Homo sapiens
tctcatttctcagg

SEQ ID NO: 6429116 - DNA, 15 bp, Homo sapiens
tctcatttctcaggt

SEQ ID NO: 6429117 - DNA, 15 bp, Homo sapiens
tctcatttgaaatgt

SEQ ID NO: 6429118 - DNA, 14 bp, Homo sapiens
tctcatttgccagg

SEQ ID NO: 6429119 - DNA, 15 bp, Homo sapiens
tctcatttgccagga

SEQ ID NO: 6429120 - DNA, 17 bp, Homo sapiens
tctcatttgccaggaag

SEQ ID NO: 6429121 - DNA, 20 bp, Homo sapiens
tctcatttggggaggggggt

SEQ ID NO: 6429122 - DNA, 21 bp, Homo sapiens
tctcatttggtctgccagaat

SEQ ID NO: 6429123 - DNA, 14 bp, Homo sapiens
tctcatttgtcaca

SEQ ID NO: 6429124 - DNA, 15 bp, Homo sapiens
tctcatttgtggctt

SEQ ID NO: 6429125 - DNA, 22 bp, Homo sapiens
tctcattttaatgtaaagattt

SEQ ID NO: 6429126 - DNA, 20 bp, Homo sapiens
tctcattttgcttttctcta

SEQ ID NO: 6429127 - DNA, 17 bp, Homo sapiens
tctcattttgtatgtat

SEQ ID NO: 6429128 - DNA, 14 bp, Homo sapiens
tctcattttgtcca

SEQ ID NO: 6429129 - DNA, 17 bp, Homo sapiens
tctcatttttccgtaaa

SEQ ID NO: 6429130 - DNA, 20 bp, Homo sapiens
tctcattttttaaaaaagct

SEQ ID NO: 6429131 - DNA, 14 bp, Homo sapiens
tctcattttttcct

SEQ ID NO: 6429132 - DNA, 22 bp, Homo sapiens
tctccaaaaatctgcctgggtt

SEQ ID NO: 6429133 - DNA, 17 bp, Homo sapiens
tctccaaaataaaactt

SEQ ID NO: 6429134 - DNA, 22 bp, Homo sapiens
tctccaaaataaaactttttaa

SEQ ID NO: 6429135 - DNA, 21 bp, Homo sapiens
tctccaaacaccggcagaaaa

SEQ ID NO: 6429136 - DNA, 14 bp, Homo sapiens
tctccaaagaagat

SEQ ID NO: 6429137 - DNA, 15 bp, Homo sapiens
tctccaaagaagata

SEQ ID NO: 6429138 - DNA, 22 bp, Homo sapiens
tctccaaagaggaagcaggcat

SEQ ID NO: 6429139 - DNA, 17 bp, Homo sapiens
tctccaaaggggctgct

SEQ ID NO: 6429140 - DNA, 18 bp, Homo sapiens
tctccaaaggggctgctg

SEQ ID NO: 6429141 - DNA, 20 bp, Homo sapiens
tctccaaaggggctgctggg

SEQ ID NO: 6429142 - DNA, 17 bp, Homo sapiens
tctccaaagttggagct

SEQ ID NO: 6429143 - DNA, 15 bp, Homo sapiens
tctccaaataaaaat

SEQ ID NO: 6429144 - DNA, 18 bp, Homo sapiens
tctccaaatacaagtact

SEQ ID NO: 6429145 - DNA, 20 bp, Homo sapiens
tctccaaatattattcaagt

SEQ ID NO: 6429146 - DNA, 24 bp, Homo sapiens
tctccaaatgagatctaagccttt

SEQ ID NO: 6429147 - DNA, 17 bp, Homo sapiens
tcaatgctataactatg

SEQ ID NO: 6429148 - DNA, 18 bp, Homo sapiens
tcaatgctgggccctctt

SEQ ID NO: 6429149 - DNA, 17 bp, Homo sapiens
tcaatgcttaggagaca

SEQ ID NO: 6429150 - DNA, 17 bp, Homo sapiens
tcaatgctttatttgta

SEQ ID NO: 6429151 - DNA, 19 bp, Homo sapiens
tcaatgctttatttgtaaa

SEQ ID NO: 6429152 - DNA, 20 bp, Homo sapiens
tcaatgctttatttgtaaat

SEQ ID NO: 6429153 - DNA, 23 bp, Homo sapiens
tcaatggaaacagggcagtgaca

SEQ ID NO: 6429154 - DNA, 18 bp, Homo sapiens
tcaatggaagaaaccctt

SEQ ID NO: 6429155 - DNA, 15 bp, Homo sapiens
tcaatggacttcaaa

SEQ ID NO: 6429156 - DNA, 21 bp, Homo sapiens
tcaatggcctaaaactggcct

SEQ ID NO: 6429157 - DNA, 22 bp, Homo sapiens
tcaatggctgctgaagctgcct

SEQ ID NO: 6429158 - DNA, 14 bp, Homo sapiens
tcaatgggaaatac

SEQ ID NO: 6429159 - DNA, 16 bp, Homo sapiens
tcaatgggacctgtgg

SEQ ID NO: 6429160 - DNA, 19 bp, Homo sapiens
tcaatgggagaatcagcag

SEQ ID NO: 6429161 - DNA, 14 bp, Homo sapiens
tcaatgggcaatga

SEQ ID NO: 6429162 - DNA, 23 bp, Homo sapiens
tcaatgggggtgtagtatttttg

SEQ ID NO: 6429163 - DNA, 11 bp, Homo sapiens
tcaatgggtaa

SEQ ID NO: 6429164 - DNA, 19 bp, Homo sapiens
tcaatgggtaaataaatgc

SEQ ID NO: 6429165 - DNA, 21 bp, Homo sapiens
tcaatgggtaaataaatgctg

SEQ ID NO: 6429166 - DNA, 22 bp, Homo sapiens
tcaatgggtaaataaatgctgc

SEQ ID NO: 6429167 - DNA, 16 bp, Homo sapiens
tcaatggtgcaaaaaa

SEQ ID NO: 6429168 - DNA, 22 bp, Homo sapiens
tcaatggtgcaaaaaaaaactt

SEQ ID NO: 6429169 - DNA, 14 bp, Homo sapiens
tcaatggttcaagt

SEQ ID NO: 6429170 - DNA, 20 bp, Homo sapiens
tcaatggttgggacaatggc

SEQ ID NO: 6429171 - DNA, 21 bp, Homo sapiens
tcaatggttgggacaatggca

SEQ ID NO: 6429172 - DNA, 22 bp, Homo sapiens
tcaatgtactaggatactgctg

SEQ ID NO: 6429173 - DNA, 12 bp, Homo sapiens
tcaatgtactgt

SEQ ID NO: 6429174 - DNA, 13 bp, Homo sapiens
tcaatgtactgta

SEQ ID NO: 6429175 - DNA, 16 bp, Homo sapiens
tcaatgtactgtattg

SEQ ID NO: 6429176 - DNA, 19 bp, Homo sapiens
tcaatgtacttgtttgaat

SEQ ID NO: 6429177 - DNA, 20 bp, Homo sapiens
tcaatgtacttgtttgaata

SEQ ID NO: 6429178 - DNA, 15 bp, Homo sapiens
tcaatgtagtctgta

SEQ ID NO: 6429179 - DNA, 11 bp, Homo sapiens
tcaatgtcact

SEQ ID NO: 6429180 - DNA, 15 bp, Homo sapiens
tcaatgtcataaatg

SEQ ID NO: 6429181 - DNA, 13 bp, Homo sapiens
tcaatgtcattac

SEQ ID NO: 6429182 - DNA, 15 bp, Homo sapiens
tcaatgtcattacat

SEQ ID NO: 6429183 - DNA, 22 bp, Homo sapiens
tcaatgtccacctgtgagaaag

SEQ ID NO: 6429184 - DNA, 18 bp, Homo sapiens
tcaatgtctaaaaacatt

SEQ ID NO: 6429185 - DNA, 20 bp, Homo sapiens
tcaatgtctaaaaacatttg

SEQ ID NO: 6429186 - DNA, 15 bp, Homo sapiens
tcaatgtcttcccac

SEQ ID NO: 6429187 - DNA, 10 bp, Homo sapiens
tcaatgtgaa

SEQ ID NO: 6429188 - DNA, 12 bp, Homo sapiens
tcaatgtgaaac

SEQ ID NO: 6429189 - DNA, 17 bp, Homo sapiens
tcaatgtgaaactgaga

SEQ ID NO: 6429190 - DNA, 12 bp, Homo sapiens
tcaatgtgaaat

SEQ ID NO: 6429191 - DNA, 21 bp, Homo sapiens
tcaatgtgattctaatgtctt

SEQ ID NO: 6429192 - DNA, 16 bp, Homo sapiens
tcaatgtgtataaatt

SEQ ID NO: 6429193 - DNA, 20 bp, Homo sapiens
tcaatgtgtctttctaagaa

SEQ ID NO: 6429194 - DNA, 12 bp, Homo sapiens
tcaatgtgtgca

SEQ ID NO: 6429195 - DNA, 13 bp, Homo sapiens
tcaatgtgttctt

SEQ ID NO: 6429196 - DNA, 17 bp, Homo sapiens
tcaatgtgttggaaact

SEQ ID NO: 6429197 - DNA, 14 bp, Homo sapiens
tcaatgttaaatct

SEQ ID NO: 6429198 - DNA, 11 bp, Homo sapiens
tcaatgttcat

SEQ ID NO: 6429199 - DNA, 16 bp, Homo sapiens
tcaatgttcattgtaa

SEQ ID NO: 6429200 - DNA, 24 bp, Homo sapiens
tcaatgttcattgtaatgttactg

SEQ ID NO: 6429201 - DNA, 22 bp, Homo sapiens
tcaatgtttatgcaaggaagga

SEQ ID NO: 6429202 - DNA, 22 bp, Homo sapiens
tcaatgtttctggacattctct

SEQ ID NO: 6429203 - DNA, 14 bp, Homo sapiens
tcaatgttttgagt

SEQ ID NO: 6429204 - DNA, 14 bp, Homo sapiens
tcaatgtttttaaa

SEQ ID NO: 6429205 - DNA, 16 bp, Homo sapiens
tcaattaaaaccatta

SEQ ID NO: 6429206 - DNA, 20 bp, Homo sapiens
tcaattaaacagctggtcct

SEQ ID NO: 6429207 - DNA, 11 bp, Homo sapiens
tcaattaaacg

SEQ ID NO: 6429208 - DNA, 13 bp, Homo sapiens
tcaattaaacgga

SEQ ID NO: 6429209 - DNA, 18 bp, Homo sapiens
tcaattaaacggattatt

SEQ ID NO: 6429210 - DNA, 20 bp, Homo sapiens
tcaattaaacggattatttt

SEQ ID NO: 6429211 - DNA, 12 bp, Homo sapiens
tcaattaaatgt

SEQ ID NO: 6429212 - DNA, 16 bp, Homo sapiens
tcaattaactctccag

SEQ ID NO: 6429213 - DNA, 15 bp, Homo sapiens
tcaattaatggaaaa

SEQ ID NO: 6429214 - DNA, 20 bp, Homo sapiens
tcaattaatggaaaactgtt

SEQ ID NO: 6429215 - DNA, 21 bp, Homo sapiens
tcaattaatggaaaactgtta

SEQ ID NO: 6429216 - DNA, 13 bp, Homo sapiens
tcaattaattctt

SEQ ID NO: 6429217 - DNA, 17 bp, Homo sapiens
tcaattaattgattcct

SEQ ID NO: 6429218 - DNA, 12 bp, Homo sapiens
tcaattacagag

SEQ ID NO: 6429219 - DNA, 18 bp, Homo sapiens
tcaattacaggaagtact

SEQ ID NO: 6429220 - DNA, 19 bp, Homo sapiens
tcaattacaggaagtactg

SEQ ID NO: 6429221 - DNA, 14 bp, Homo sapiens
tcaattacatgttt

SEQ ID NO: 6429222 - DNA, 13 bp, Homo sapiens
tcaattaccacac

SEQ ID NO: 6429223 - DNA, 20 bp, Homo sapiens
tcaattagtaacattcatgt

SEQ ID NO: 6429224 - DNA, 16 bp, Homo sapiens
tcaattagtacagtag

SEQ ID NO: 6429225 - DNA, 20 bp, Homo sapiens
tcaattagtggtcataaaat

SEQ ID NO: 6429226 - DNA, 21 bp, Homo sapiens
tcaattagtggtcataaaata

SEQ ID NO: 6429227 - DNA, 14 bp, Homo sapiens
tcaattatagtttc

SEQ ID NO: 6429228 - DNA, 19 bp, Homo sapiens
tcaattatagtttctgagg

SEQ ID NO: 6429229 - DNA, 19 bp, Homo sapiens
tcaattatattatgtttaa

SEQ ID NO: 6429230 - DNA, 21 bp, Homo sapiens
tcaattattacatttatacat

SEQ ID NO: 6429231 - DNA, 15 bp, Homo sapiens
tcaattatttcaatg

SEQ ID NO: 6429232 - DNA, 17 bp, Homo sapiens
tcaattatttcccccat

SEQ ID NO: 6429233 - DNA, 14 bp, Homo sapiens
tcaattcaaaagct

SEQ ID NO: 6429234 - DNA, 24 bp, Homo sapiens
tcaattcaacacattacttgcaca

SEQ ID NO: 6429235 - DNA, 16 bp, Homo sapiens
tcaattcacattcatc

SEQ ID NO: 6429236 - DNA, 18 bp, Homo sapiens
tcaattcatagaataaca

SEQ ID NO: 6429237 - DNA, 14 bp, Homo sapiens
tcaattcatcaata

SEQ ID NO: 6429238 - DNA, 12 bp, Homo sapiens
tcaattcattgt

SEQ ID NO: 6429239 - DNA, 13 bp, Homo sapiens
tcaattcattgtg

SEQ ID NO: 6429240 - DNA, 14 bp, Homo sapiens
tcaattccaccagg

SEQ ID NO: 6429241 - DNA, 17 bp, Homo sapiens
tcaattccaccagggcc

SEQ ID NO: 6429242 - DNA, 19 bp, Homo sapiens
tcaattccacccctcctcg

SEQ ID NO: 6429243 - DNA, 17 bp, Homo sapiens
tcaattcctgggcccca

SEQ ID NO: 6429244 - DNA, 13 bp, Homo sapiens
tcaattccttagt

SEQ ID NO: 6429245 - DNA, 21 bp, Homo sapiens
tcaattctgatgttactgaga

SEQ ID NO: 6429246 - DNA, 23 bp, Homo sapiens
tcaattctgtaggttaaaaaaat

SEQ ID NO: 6429247 - DNA, 12 bp, Homo sapiens
tcaattctgtgt

SEQ ID NO: 6429248 - DNA, 13 bp, Homo sapiens
tcaattctgtgtg

SEQ ID NO: 6429249 - DNA, 12 bp, Homo sapiens
tcaattgacaaa

SEQ ID NO: 6429250 - DNA, 20 bp, Homo sapiens
tcaattgacattcctttgaa

SEQ ID NO: 6429251 - DNA, 20 bp, Homo sapiens
tcaattgatatttctgtgta

SEQ ID NO: 6429252 - DNA, 16 bp, Homo sapiens
tcaattgcatctccca

SEQ ID NO: 6429253 - DNA, 21 bp, Homo sapiens
tcaattgctttgtgacttctt

SEQ ID NO: 6429254 - DNA, 17 bp, Homo sapiens
tcaattggcagtgactt

SEQ ID NO: 6429255 - DNA, 23 bp, Homo sapiens
tcaattggcagtgactttgtata

SEQ ID NO: 6429256 - DNA, 14 bp, Homo sapiens
tcaattgtaaattg

SEQ ID NO: 6429257 - DNA, 13 bp, Homo sapiens
tcaattgtaatat

SEQ ID NO: 6429258 - DNA, 22 bp, Homo sapiens
tcaattgtagatgaacatctct

SEQ ID NO: 6429259 - DNA, 13 bp, Homo sapiens
tcaattgtatttt

SEQ ID NO: 6429260 - DNA, 17 bp, Homo sapiens
tcaattgtattttatat

SEQ ID NO: 6429261 - DNA, 14 bp, Homo sapiens
tcaattgtcacttt

SEQ ID NO: 6429262 - DNA, 17 bp, Homo sapiens
tcaattgtcacttttta

SEQ ID NO: 6429263 - DNA, 20 bp, Homo sapiens
tcaattgtgaaaaaatttac

SEQ ID NO: 6429264 - DNA, 16 bp, Homo sapiens
tcaattgtgtctgtgg

SEQ ID NO: 6429265 - DNA, 13 bp, Homo sapiens
tcaatttaaaaaa

SEQ ID NO: 6429266 - DNA, 17 bp, Homo sapiens
tcaatttaaaggaaagt

SEQ ID NO: 6429267 - DNA, 19 bp, Homo sapiens
tcaatttaaatgtttacta

SEQ ID NO: 6429268 - DNA, 21 bp, Homo sapiens
tcaatttaagtgttggaaaaa

SEQ ID NO: 6429269 - DNA, 23 bp, Homo sapiens
tcaatttaattcttatttctgtg

SEQ ID NO: 6429270 - DNA, 19 bp, Homo sapiens
tcaatttatacctcaattt

SEQ ID NO: 6429271 - DNA, 16 bp, Homo sapiens
tcaatttattgcacaa

SEQ ID NO: 6429272 - DNA, 16 bp, Homo sapiens
tcaatttatttgaatg

SEQ ID NO: 6429273 - DNA, 21 bp, Homo sapiens
tcaatttcagaaactaagaat

SEQ ID NO: 6429274 - DNA, 12 bp, Homo sapiens
tcaatttcagca

SEQ ID NO: 6429275 - DNA, 17 bp, Homo sapiens
tcaatttcagtagtttg

SEQ ID NO: 6429276 - DNA, 12 bp, Homo sapiens
tcaatttcatgt

SEQ ID NO: 6429277 - DNA, 20 bp, Homo sapiens
tcaatttccaagagctgagg

SEQ ID NO: 6429278 - DNA, 14 bp, Homo sapiens
tcaatttcccagaa

SEQ ID NO: 6429279 - DNA, 12 bp, Homo sapiens
tcaatttctaat

SEQ ID NO: 6429280 - DNA, 17 bp, Homo sapiens
tcaatttctaatgttta

SEQ ID NO: 6429281 - DNA, 19 bp, Homo sapiens
tcaatttctaatgtttact

SEQ ID NO: 6429282 - DNA, 19 bp, Homo sapiens
tcaatttctcccaaggcca

SEQ ID NO: 6429283 - DNA, 22 bp, Homo sapiens
tcaatttctctgctctcttgga

SEQ ID NO: 6429284 - DNA, 15 bp, Homo sapiens
tcaatttctgaacac

SEQ ID NO: 6429285 - DNA, 15 bp, Homo sapiens
tcaatttgattctat

SEQ ID NO: 6429286 - DNA, 19 bp, Homo sapiens
tcaatttgctatttacaaa

SEQ ID NO: 6429287 - DNA, 12 bp, Homo sapiens
tcaatttggagc

SEQ ID NO: 6429288 - DNA, 13 bp, Homo sapiens
tcaatttgtaatt

SEQ ID NO: 6429289 - DNA, 22 bp, Homo sapiens
tcaatttgtaattttagtatta

SEQ ID NO: 6429290 - DNA, 14 bp, Homo sapiens
tcaatttgtcatgt

SEQ ID NO: 6429291 - DNA, 15 bp, Homo sapiens
tcaatttgtcatttt

SEQ ID NO: 6429292 - DNA, 21 bp, Homo sapiens
tcaatttgttcagtctttcat

SEQ ID NO: 6429293 - DNA, 14 bp, Homo sapiens
tcaattttaaacat

SEQ ID NO: 6429294 - DNA, 13 bp, Homo sapiens
tcaattttaacaa

SEQ ID NO: 6429295 - DNA, 15 bp, Homo sapiens
tcaattttcactgtg

SEQ ID NO: 6429296 - DNA, 14 bp, Homo sapiens
tcaattttcattaa

SEQ ID NO: 6429297 - DNA, 14 bp, Homo sapiens
tcaattttctttaa

SEQ ID NO: 6429298 - DNA, 13 bp, Homo sapiens
tcaattttgactt

SEQ ID NO: 6429299 - DNA, 15 bp, Homo sapiens
tcaattttgtattta

SEQ ID NO: 6429300 - DNA, 15 bp, Homo sapiens
tcaatttttaactta

SEQ ID NO: 6429301 - DNA, 18 bp, Homo sapiens
tcaatttttaccacttct

SEQ ID NO: 6429302 - DNA, 22 bp, Homo sapiens
tcaatttttaccacttctgttt

SEQ ID NO: 6429303 - DNA, 13 bp, Homo sapiens
tcaatttttatac

SEQ ID NO: 6429304 - DNA, 15 bp, Homo sapiens
tcaatttttatacat

SEQ ID NO: 6429305 - DNA, 21 bp, Homo sapiens
tcaatttttatacatatcaga

SEQ ID NO: 6429306 - DNA, 12 bp, Homo sapiens
tcaatttttccc

SEQ ID NO: 6429307 - DNA, 15 bp, Homo sapiens
tcaatttttcccagt

SEQ ID NO: 6429308 - DNA, 19 bp, Homo sapiens
tcaatttttcccagtattt

SEQ ID NO: 6429309 - DNA, 16 bp, Homo sapiens
tcaatttttctttaaa

SEQ ID NO: 6429310 - DNA, 21 bp, Homo sapiens
tcaattttttaaaccactaat

SEQ ID NO: 6429311 - DNA, 13 bp, Homo sapiens
tcaattttttgct

SEQ ID NO: 6429312 - DNA, 21 bp, Homo sapiens
tcacaaaaaaatgttcattgt

SEQ ID NO: 6429313 - DNA, 23 bp, Homo sapiens
tcacaaaaaaatgttcattgtag

SEQ ID NO: 6429314 - DNA, 20 bp, Homo sapiens
tcacaaaaaggcaaatattg

SEQ ID NO: 6429315 - DNA, 22 bp, Homo sapiens
tcacaaaacagcctttgggaaa

SEQ ID NO: 6429316 - DNA, 20 bp, Homo sapiens
tcacaaaacatattttacat

SEQ ID NO: 6429317 - DNA, 19 bp, Homo sapiens
tcacaaaagaaaaaaaact

SEQ ID NO: 6429318 - DNA, 14 bp, Homo sapiens
tcacaaaagctgtg

SEQ ID NO: 6429319 - DNA, 18 bp, Homo sapiens
tcacaaaagctgtgtctc

SEQ ID NO: 6429320 - DNA, 13 bp, Homo sapiens
tcacaaaataaag

SEQ ID NO: 6429321 - DNA, 15 bp, Homo sapiens
tcacaaaatatcacc

SEQ ID NO: 6429322 - DNA, 19 bp, Homo sapiens
tcacaaaatgcacttctat

SEQ ID NO: 6429323 - DNA, 16 bp, Homo sapiens
tcacaaacaaatggct

SEQ ID NO: 6429324 - DNA, 23 bp, Homo sapiens
tcacaaacaaatggctgtaaaac

SEQ ID NO: 6429325 - DNA, 16 bp, Homo sapiens
tcacaaaccagcctgg

SEQ ID NO: 6429326 - DNA, 18 bp, Homo sapiens
tcacaaaccagcctgggg

SEQ ID NO: 6429327 - DNA, 23 bp, Homo sapiens
tcacaaaccttctttaaggcata

SEQ ID NO: 6429328 - DNA, 11 bp, Homo sapiens
aacttctcatt

SEQ ID NO: 6429329 - DNA, 15 bp, Homo sapiens
aacttctcccacccc

SEQ ID NO: 6429330 - DNA, 20 bp, Homo sapiens
aacttctcgtagatgctgcc

SEQ ID NO: 6429331 - DNA, 15 bp, Homo sapiens
aacttctctggaaag

SEQ ID NO: 6429332 - DNA, 15 bp, Homo sapiens
aacttctcttctgag

SEQ ID NO: 6429333 - DNA, 14 bp, Homo sapiens
aacttctgaagact

SEQ ID NO: 6429334 - DNA, 20 bp, Homo sapiens
aacttctgaatattggacat

SEQ ID NO: 6429335 - DNA, 22 bp, Homo sapiens
aacttctgcaacaagcatgcag

SEQ ID NO: 6429336 - DNA, 18 bp, Homo sapiens
aacttctgtaaggggcag

SEQ ID NO: 6429337 - DNA, 23 bp, Homo sapiens
aacttctgtcccttgtttttgat

SEQ ID NO: 6429338 - DNA, 20 bp, Homo sapiens
aacttctgtttcttctcttg

SEQ ID NO: 6429339 - DNA, 16 bp, Homo sapiens
aacttcttaaaccatt

SEQ ID NO: 6429340 - DNA, 19 bp, Homo sapiens
aacttcttacccgaaagca

SEQ ID NO: 6429341 - DNA, 18 bp, Homo sapiens
aacttcttagaaaattaa

SEQ ID NO: 6429342 - DNA, 15 bp, Homo sapiens
aacttcttatggaat

SEQ ID NO: 6429343 - DNA, 16 bp, Homo sapiens
aacttcttatggaatt

SEQ ID NO: 6429344 - DNA, 24 bp, Homo sapiens
aacttcttatggaattgatttgca

SEQ ID NO: 6429345 - DNA, 19 bp, Homo sapiens
aacttcttcagagctgaca

SEQ ID NO: 6429346 - DNA, 12 bp, Homo sapiens
aacttcttcata

SEQ ID NO: 6429347 - DNA, 18 bp, Homo sapiens
aacttcttcctgtgaagt

SEQ ID NO: 6429348 - DNA, 17 bp, Homo sapiens
aacttcttgaaaaagat

SEQ ID NO: 6429349 - DNA, 22 bp, Homo sapiens
aacttcttgaaaaagatggctt

SEQ ID NO: 6429350 - DNA, 20 bp, Homo sapiens
aacttcttgcttctttctag

SEQ ID NO: 6429351 - DNA, 13 bp, Homo sapiens
aacttcttgtcag

SEQ ID NO: 6429352 - DNA, 17 bp, Homo sapiens
aacttcttgtcagacat

SEQ ID NO: 6429353 - DNA, 18 bp, Homo sapiens
aacttcttgtcagacata

SEQ ID NO: 6429354 - DNA, 22 bp, Homo sapiens
aacttcttgtcagacataaagc

SEQ ID NO: 6429355 - DNA, 15 bp, Homo sapiens
aacttctttgaagtt

SEQ ID NO: 6429356 - DNA, 24 bp, Homo sapiens
aacttctttgtaatcgttatgtgt

SEQ ID NO: 6429357 - DNA, 19 bp, Homo sapiens
aacttgaaaagattgcaaa

SEQ ID NO: 6429358 - DNA, 22 bp, Homo sapiens
aacttgaaaatatatgatggct

SEQ ID NO: 6429359 - DNA, 22 bp, Homo sapiens
aacttgaaaattttttatactg

SEQ ID NO: 6429360 - DNA, 24 bp, Homo sapiens
aacttgaaacagattcaggccagc

SEQ ID NO: 6429361 - DNA, 15 bp, Homo sapiens
aacttgaaatatata

SEQ ID NO: 6429362 - DNA, 19 bp, Homo sapiens
aacttgaaattatatctgt

SEQ ID NO: 6429363 - DNA, 18 bp, Homo sapiens
aacttgaaatttgaattt

SEQ ID NO: 6429364 - DNA, 21 bp, Homo sapiens
aacttgaactgattcacatct

SEQ ID NO: 6429365 - DNA, 14 bp, Homo sapiens
aacttgaagaaacg

SEQ ID NO: 6429366 - DNA, 14 bp, Homo sapiens
aacttgaagctaac

SEQ ID NO: 6429367 - DNA, 20 bp, Homo sapiens
aacttgacatgtagcttctt

SEQ ID NO: 6429368 - DNA, 18 bp, Homo sapiens
aacttgaccctgagctga

SEQ ID NO: 6429369 - DNA, 22 bp, Homo sapiens
aacttgaccctgagcttaaata

SEQ ID NO: 6429370 - DNA, 16 bp, Homo sapiens
aacttgactccatttc

SEQ ID NO: 6429371 - DNA, 21 bp, Homo sapiens
aacttgactgggtgagaccca

SEQ ID NO: 6429372 - DNA, 21 bp, Homo sapiens
aacttgagaactttatttcca

SEQ ID NO: 6429373 - DNA, 22 bp, Homo sapiens
aacttgagaactttatttccaa

SEQ ID NO: 6429374 - DNA, 15 bp, Homo sapiens
aacttgagatgtatg

SEQ ID NO: 6429375 - DNA, 14 bp, Homo sapiens
aacttgagattcaa

SEQ ID NO: 6429376 - DNA, 16 bp, Homo sapiens
aacttgagattcaaga

SEQ ID NO: 6429377 - DNA, 18 bp, Homo sapiens
aacttgagattcaagaca

SEQ ID NO: 6429378 - DNA, 23 bp, Homo sapiens
aacttgagattcaagacaagagc

SEQ ID NO: 6429379 - DNA, 22 bp, Homo sapiens
aacttgagcgtgaatctgtatc

SEQ ID NO: 6429380 - DNA, 20 bp, Homo sapiens
aacttgagctctgtaactta

SEQ ID NO: 6429381 - DNA, 18 bp, Homo sapiens
aacttgaggttctctttt

SEQ ID NO: 6429382 - DNA, 14 bp, Homo sapiens
aacttgagtttgtt

SEQ ID NO: 6429383 - DNA, 14 bp, Homo sapiens
aacttgatactttt

SEQ ID NO: 6429384 - DNA, 15 bp, Homo sapiens
aacttgatcacatgc

SEQ ID NO: 6429385 - DNA, 12 bp, Homo sapiens
aacttgatgcat

SEQ ID NO: 6429386 - DNA, 14 bp, Homo sapiens
aacttgatgtgaaa

SEQ ID NO: 6429387 - DNA, 23 bp, Homo sapiens
aacttgatgttccacctgccaca

SEQ ID NO: 6429388 - DNA, 20 bp, Homo sapiens
aacttgatttgcatggattt

SEQ ID NO: 6429389 - DNA, 14 bp, Homo sapiens
aacttgattttaaa

SEQ ID NO: 6429390 - DNA, 20 bp, Homo sapiens
aacttgcaaaaagtagactt

SEQ ID NO: 6429391 - DNA, 14 bp, Homo sapiens
aacttgcaaaatca

SEQ ID NO: 6429392 - DNA, 23 bp, Homo sapiens
aacttgcaagggcggcctttccc

SEQ ID NO: 6429393 - DNA, 19 bp, Homo sapiens
aacttgcaatgaaaagaaa

SEQ ID NO: 6429394 - DNA, 16 bp, Homo sapiens
aacttgcagtgtcttt

SEQ ID NO: 6429395 - DNA, 15 bp, Homo sapiens
aacttgcatggagca

SEQ ID NO: 6429396 - DNA, 18 bp, Homo sapiens
aacttgccccaagggttt

SEQ ID NO: 6429397 - DNA, 18 bp, Homo sapiens
aacttgcctccatctttt

SEQ ID NO: 6429398 - DNA, 15 bp, Homo sapiens
aacttgcctttgaag

SEQ ID NO: 6429399 - DNA, 23 bp, Homo sapiens
aacttgctacttatcatttttgt

SEQ ID NO: 6429400 - DNA, 17 bp, Homo sapiens
aacttgctcctttccat

SEQ ID NO: 6429401 - DNA, 22 bp, Homo sapiens
aacttgctcttgcttgtaaatc

SEQ ID NO: 6429402 - DNA, 14 bp, Homo sapiens
aacttgctgcctcg

SEQ ID NO: 6429403 - DNA, 14 bp, Homo sapiens
aacttgctgctgcc

SEQ ID NO: 6429404 - DNA, 12 bp, Homo sapiens
aacttgctgggt

SEQ ID NO: 6429405 - DNA, 12 bp, Homo sapiens
aacttgcttaaa

SEQ ID NO: 6429406 - DNA, 15 bp, Homo sapiens
aacttgcttaaatgt

SEQ ID NO: 6429407 - DNA, 15 bp, Homo sapiens
aacttgcttaaattt

SEQ ID NO: 6429408 - DNA, 19 bp, Homo sapiens
aacttgcttaaatttctta

SEQ ID NO: 6429409 - DNA, 20 bp, Homo sapiens
aacttgcttaaatttcttat

SEQ ID NO: 6429410 - DNA, 14 bp, Homo sapiens
aacttgctttcttc

SEQ ID NO: 6429411 - DNA, 19 bp, Homo sapiens
aacttgctttcttctttcc

SEQ ID NO: 6429412 - DNA, 14 bp, Homo sapiens
aacttggaaatagt

SEQ ID NO: 6429413 - DNA, 23 bp, Homo sapiens
aacttggaatttgtaacctcagc

SEQ ID NO: 6429414 - DNA, 18 bp, Homo sapiens
aacttggacccttggaaa

SEQ ID NO: 6429415 - DNA, 17 bp, Homo sapiens
aacttggatacttggat

SEQ ID NO: 6429416 - DNA, 20 bp, Homo sapiens
aacttggatattcaagcctt

SEQ ID NO: 6429417 - DNA, 13 bp, Homo sapiens
aacttggattctc

SEQ ID NO: 6429418 - DNA, 14 bp, Homo sapiens
aacttggattctct

SEQ ID NO: 6429419 - DNA, 11 bp, Homo sapiens
aacttggcact

SEQ ID NO: 6429420 - DNA, 19 bp, Homo sapiens
aacttggcagctttttctg

SEQ ID NO: 6429421 - DNA, 16 bp, Homo sapiens
aacttggccagtttgt

SEQ ID NO: 6429422 - DNA, 21 bp, Homo sapiens
aacttggctcgaatctctgtg

SEQ ID NO: 6429423 - DNA, 18 bp, Homo sapiens
aacttggctgcaggaatc

SEQ ID NO: 6429424 - DNA, 12 bp, Homo sapiens
aacttggctttc

SEQ ID NO: 6429425 - DNA, 12 bp, Homo sapiens
aacttgggaact

SEQ ID NO: 6429426 - DNA, 19 bp, Homo sapiens
aacttgggaatcattctgg

SEQ ID NO: 6429427 - DNA, 22 bp, Homo sapiens
aacttgggagtgtggtttcttt

SEQ ID NO: 6429428 - DNA, 22 bp, Homo sapiens
aacttgggcaccagcttctttc

SEQ ID NO: 6429429 - DNA, 17 bp, Homo sapiens
aacttgggctgtaaagc

SEQ ID NO: 6429430 - DNA, 18 bp, Homo sapiens
aacttgggctgtaaagca

SEQ ID NO: 6429431 - DNA, 13 bp, Homo sapiens
aacttggggaaca

SEQ ID NO: 6429432 - DNA, 13 bp, Homo sapiens
aacttggggaggc

SEQ ID NO: 6429433 - DNA, 17 bp, Homo sapiens
aacttggtatttttcag

SEQ ID NO: 6429434 - DNA, 22 bp, Homo sapiens
aacttggtccagattgaaaagt

SEQ ID NO: 6429435 - DNA, 20 bp, Homo sapiens
aacttggtgcttattgatat

SEQ ID NO: 6429436 - DNA, 20 bp, Homo sapiens
aacttggttctcagactctt

SEQ ID NO: 6429437 - DNA, 21 bp, Homo sapiens
aacttgtaaaaagggggctgc

SEQ ID NO: 6429438 - DNA, 12 bp, Homo sapiens
aacttgtaaata

SEQ ID NO: 6429439 - DNA, 15 bp, Homo sapiens
aacttgtaaatgtgg

SEQ ID NO: 6429440 - DNA, 15 bp, Homo sapiens
aacttgtaactaaag

SEQ ID NO: 6429441 - DNA, 20 bp, Homo sapiens
aacttgtaatttttttaatt

SEQ ID NO: 6429442 - DNA, 15 bp, Homo sapiens
aacttgtactatgtt

SEQ ID NO: 6429443 - DNA, 15 bp, Homo sapiens
aacttgtagccagaa

SEQ ID NO: 6429444 - DNA, 13 bp, Homo sapiens
aacttgtagctgt

SEQ ID NO: 6429445 - DNA, 17 bp, Homo sapiens
aacttgtagctgtaaaa

SEQ ID NO: 6429446 - DNA, 13 bp, Homo sapiens
aacttgtatattc

SEQ ID NO: 6429447 - DNA, 19 bp, Homo sapiens
aacttgtatattccaccat

SEQ ID NO: 6429448 - DNA, 12 bp, Homo sapiens
aacttgtcactt

SEQ ID NO: 6429449 - DNA, 17 bp, Homo sapiens
aacttgtcacttgcatg

SEQ ID NO: 6429450 - DNA, 21 bp, Homo sapiens
aacttgtctctgtagaagctc

SEQ ID NO: 6429451 - DNA, 15 bp, Homo sapiens
aacttgtctcttcat

SEQ ID NO: 6429452 - DNA, 21 bp, Homo sapiens
aacttgtctgggaattgtgtg

SEQ ID NO: 6429453 - DNA, 17 bp, Homo sapiens
aacttgtcttaaataaa

SEQ ID NO: 6429454 - DNA, 18 bp, Homo sapiens
aacttgtctttggaccct

SEQ ID NO: 6429455 - DNA, 14 bp, Homo sapiens
aacttgtcttttca

SEQ ID NO: 6429456 - DNA, 22 bp, Homo sapiens
aacttgtgaactccatcattca

SEQ ID NO: 6429457 - DNA, 23 bp, Homo sapiens
aacttgtgaactccatcattcat

SEQ ID NO: 6429458 - DNA, 19 bp, Homo sapiens
aacttgtgaagacaatgaa

SEQ ID NO: 6429459 - DNA, 15 bp, Homo sapiens
aacttgtgctatagt

SEQ ID NO: 6429460 - DNA, 19 bp, Homo sapiens
aacttgtgcttttgcaaaa

SEQ ID NO: 6429461 - DNA, 14 bp, Homo sapiens
aacttgtgtaaata

SEQ ID NO: 6429462 - DNA, 18 bp, Homo sapiens
aacttgttactaaagaaa

SEQ ID NO: 6429463 - DNA, 11 bp, Homo sapiens
aacttgttcat

SEQ ID NO: 6429464 - DNA, 20 bp, Homo sapiens
aacttgttcttccaaagcag

SEQ ID NO: 6429465 - DNA, 16 bp, Homo sapiens
aacttgttgctgattt

SEQ ID NO: 6429466 - DNA, 16 bp, Homo sapiens
aacttgttgtggctct

SEQ ID NO: 6429467 - DNA, 20 bp, Homo sapiens
aacttgtttacatagcattt

SEQ ID NO: 6429468 - DNA, 20 bp, Homo sapiens
aacttgtttgctgtgaacaa

SEQ ID NO: 6429469 - DNA, 17 bp, Homo sapiens
aactttaaaaaatattt

SEQ ID NO: 6429470 - DNA, 19 bp, Homo sapiens
aactttaaaaaatatttat

SEQ ID NO: 6429471 - DNA, 22 bp, Homo sapiens
aactttaaaaattattatatat

SEQ ID NO: 6429472 - DNA, 12 bp, Homo sapiens
aactttaaaagg

SEQ ID NO: 6429473 - DNA, 13 bp, Homo sapiens
aactttaaaatgc

SEQ ID NO: 6429474 - DNA, 13 bp, Homo sapiens
aactttaaacctg

SEQ ID NO: 6429475 - DNA, 19 bp, Homo sapiens
aactttaaagcgtttgcac

SEQ ID NO: 6429476 - DNA, 23 bp, Homo sapiens
aactttaacaggttttcttctaa

SEQ ID NO: 6429477 - DNA, 15 bp, Homo sapiens
aactttaagaggaca

SEQ ID NO: 6429478 - DNA, 14 bp, Homo sapiens
aactttaatgtttt

SEQ ID NO: 6429479 - DNA, 15 bp, Homo sapiens
aactttaccataaag

SEQ ID NO: 6429480 - DNA, 20 bp, Homo sapiens
aactttaccataaagccttt

SEQ ID NO: 6429481 - DNA, 16 bp, Homo sapiens
aactttactctgtgtt

SEQ ID NO: 6429482 - DNA, 12 bp, Homo sapiens
aactttactgta

SEQ ID NO: 6429483 - DNA, 15 bp, Homo sapiens
aactttactttcagc

SEQ ID NO: 6429484 - DNA, 17 bp, Homo sapiens
aactttagaaagaaatt

SEQ ID NO: 6429485 - DNA, 20 bp, Homo sapiens
aactttagaaataaacctta

SEQ ID NO: 6429486 - DNA, 14 bp, Homo sapiens
aactttagacttcc

SEQ ID NO: 6429487 - DNA, 22 bp, Homo sapiens
aactttagagtagcatgagaga

SEQ ID NO: 6429488 - DNA, 21 bp, Homo sapiens
aactttagcagaatcaaaatg

SEQ ID NO: 6429489 - DNA, 14 bp, Homo sapiens
aactttataaattc

SEQ ID NO: 6429490 - DNA, 22 bp, Homo sapiens
aactttatacccagaaagttat

SEQ ID NO: 6429491 - DNA, 23 bp, Homo sapiens
aactttatacccagaaagttatt

SEQ ID NO: 6429492 - DNA, 14 bp, Homo sapiens
aactttatatgaag

SEQ ID NO: 6429493 - DNA, 19 bp, Homo sapiens
aactttattaaatacaaaa

SEQ ID NO: 6429494 - DNA, 20 bp, Homo sapiens
aactttattacaatttgtat

SEQ ID NO: 6429495 - DNA, 15 bp, Homo sapiens
aactttattgcatat

SEQ ID NO: 6429496 - DNA, 19 bp, Homo sapiens
aactttatttaaaatgatt

SEQ ID NO: 6429497 - DNA, 14 bp, Homo sapiens
aactttatttacac

SEQ ID NO: 6429498 - DNA, 13 bp, Homo sapiens
aactttattttga

SEQ ID NO: 6429499 - DNA, 15 bp, Homo sapiens
aactttattttgaat

SEQ ID NO: 6429500 - DNA, 16 bp, Homo sapiens
aactttatttttctat

SEQ ID NO: 6429501 - DNA, 21 bp, Homo sapiens
aactttattttttaaaaatga

SEQ ID NO: 6429502 - DNA, 23 bp, Homo sapiens
aactttcaaaagggaagagtttt

SEQ ID NO: 6429503 - DNA, 19 bp, Homo sapiens
aactttcaagaacttgttt

SEQ ID NO: 6429504 - DNA, 21 bp, Homo sapiens
aactttcaagaacttgtttaa

SEQ ID NO: 6429505 - DNA, 20 bp, Homo sapiens
aactttcaagtattatattt

SEQ ID NO: 6429506 - DNA, 21 bp, Homo sapiens
tcacaaactacctctggacag

SEQ ID NO: 6429507 - DNA, 20 bp, Homo sapiens
tcacaaactgatctaaaatg

SEQ ID NO: 6429508 - DNA, 14 bp, Homo sapiens
tcacaaactgtgaa

SEQ ID NO: 6429509 - DNA, 14 bp, Homo sapiens
tcacaaactgtggt

SEQ ID NO: 6429510 - DNA, 17 bp, Homo sapiens
tcacaaacttttatact

SEQ ID NO: 6429511 - DNA, 18 bp, Homo sapiens
tcacaaagagttctggaa

SEQ ID NO: 6429512 - DNA, 16 bp, Homo sapiens
tcacaaagcccaaggg

SEQ ID NO: 6429513 - DNA, 15 bp, Homo sapiens
tcacaaagctattta

SEQ ID NO: 6429514 - DNA, 16 bp, Homo sapiens
tcacaaagctatttaa

SEQ ID NO: 6429515 - DNA, 17 bp, Homo sapiens
tcacaaagctgtgaaat

SEQ ID NO: 6429516 - DNA, 21 bp, Homo sapiens
tcacaaaggaatggaggctct

SEQ ID NO: 6429517 - DNA, 19 bp, Homo sapiens
tcacaaaggctgatgtctt

SEQ ID NO: 6429518 - DNA, 22 bp, Homo sapiens
tcacaaagtgagaaattatgaa

SEQ ID NO: 6429519 - DNA, 19 bp, Homo sapiens
tcacaaagttgtttaacta

SEQ ID NO: 6429520 - DNA, 13 bp, Homo sapiens
tcacaaataatag

SEQ ID NO: 6429521 - DNA, 21 bp, Homo sapiens
tcacaaatagtgttgatcaga

SEQ ID NO: 6429522 - DNA, 18 bp, Homo sapiens
tcacaaatattaaaaagt

SEQ ID NO: 6429523 - DNA, 11 bp, Homo sapiens
tcacaaatgac

SEQ ID NO: 6429524 - DNA, 20 bp, Homo sapiens
tcacaaatgactttattatt

SEQ ID NO: 6429525 - DNA, 21 bp, Homo sapiens
tcacaaatgtcattgtctact

SEQ ID NO: 6429526 - DNA, 18 bp, Homo sapiens
tcacaaattgatcaagat

SEQ ID NO: 6429527 - DNA, 14 bp, Homo sapiens
tcacaaatttctct

SEQ ID NO: 6429528 - DNA, 19 bp, Homo sapiens
tcacaacaattaaatatac

SEQ ID NO: 6429529 - DNA, 14 bp, Homo sapiens
tcacaacacaatca

SEQ ID NO: 6429530 - DNA, 13 bp, Homo sapiens
tcacaacaggcat

SEQ ID NO: 6429531 - DNA, 17 bp, Homo sapiens
tcacaacagtcacctca

SEQ ID NO: 6429532 - DNA, 16 bp, Homo sapiens
tcacaaccagccacac

SEQ ID NO: 6429533 - DNA, 17 bp, Homo sapiens
tcacaaccagccacaca

SEQ ID NO: 6429534 - DNA, 19 bp, Homo sapiens
tcacaaccagccacacaga

SEQ ID NO: 6429535 - DNA, 21 bp, Homo sapiens
tcacaaccagccacacagagc

SEQ ID NO: 6429536 - DNA, 13 bp, Homo sapiens
tcacaacccatct

SEQ ID NO: 6429537 - DNA, 18 bp, Homo sapiens
tcacaacctcaccaaact

SEQ ID NO: 6429538 - DNA, 22 bp, Homo sapiens
tcacaacctcaccaaactagta

SEQ ID NO: 6429539 - DNA, 13 bp, Homo sapiens
tcacaacctccgt

SEQ ID NO: 6429540 - DNA, 20 bp, Homo sapiens
tcacaacctccgtgctgggc

SEQ ID NO: 6429541 - DNA, 20 bp, Homo sapiens
tcacaacgtgcattgtgctt

SEQ ID NO: 6429542 - DNA, 21 bp, Homo sapiens
tcacaacgtgcattgtgcttc

SEQ ID NO: 6429543 - DNA, 18 bp, Homo sapiens
tcacaactaggacctcat

SEQ ID NO: 6429544 - DNA, 11 bp, Homo sapiens
tcacaactcct

SEQ ID NO: 6429545 - DNA, 12 bp, Homo sapiens
tcacaactcctt

SEQ ID NO: 6429546 - DNA, 19 bp, Homo sapiens
tcacaactccttccatcct

SEQ ID NO: 6429547 - DNA, 19 bp, Homo sapiens
tcacaactgtttttgaaga

SEQ ID NO: 6429548 - DNA, 22 bp, Homo sapiens
tcacaactttgacgtaattaaa

SEQ ID NO: 6429549 - DNA, 12 bp, Homo sapiens
tcacaagaacac

SEQ ID NO: 6429550 - DNA, 22 bp, Homo sapiens
tcacaagacccaaaaggcagaa

SEQ ID NO: 6429551 - DNA, 15 bp, Homo sapiens
tcacaagcaacagac

SEQ ID NO: 6429552 - DNA, 15 bp, Homo sapiens
tcacaagcaataatt

SEQ ID NO: 6429553 - DNA, 14 bp, Homo sapiens
tcacaagcacaaag

SEQ ID NO: 6429554 - DNA, 14 bp, Homo sapiens
tcacaagcctcctg

SEQ ID NO: 6429555 - DNA, 23 bp, Homo sapiens
tcacaagcctcctgtacctcagt

SEQ ID NO: 6429556 - DNA, 19 bp, Homo sapiens
tcacaagcgctcccagcct

SEQ ID NO: 6429557 - DNA, 20 bp, Homo sapiens
tcacaagcgctcccagcctg

SEQ ID NO: 6429558 - DNA, 21 bp, Homo sapiens
tcacaagcgctcccagcctgc

SEQ ID NO: 6429559 - DNA, 14 bp, Homo sapiens
tcacaagctgcctc

SEQ ID NO: 6429560 - DNA, 15 bp, Homo sapiens
tcacaagctgcctcc

SEQ ID NO: 6429561 - DNA, 16 bp, Homo sapiens
tcacaagctgcctccc

SEQ ID NO: 6429562 - DNA, 20 bp, Homo sapiens
tcacaagctgcctccctgtc

SEQ ID NO: 6429563 - DNA, 23 bp, Homo sapiens
tcacaagctgcctccctgtccac

SEQ ID NO: 6429564 - DNA, 22 bp, Homo sapiens
tcacaaggcattcaagtgtaca

SEQ ID NO: 6429565 - DNA, 14 bp, Homo sapiens
tcacaaggcccagg

SEQ ID NO: 6429566 - DNA, 20 bp, Homo sapiens
tcacaagggacgctttggga

SEQ ID NO: 6429567 - DNA, 22 bp, Homo sapiens
tcacaagggcaaactttttcct

SEQ ID NO: 6429568 - DNA, 19 bp, Homo sapiens
tcacaaggtacaaaatctt

SEQ ID NO: 6429569 - DNA, 16 bp, Homo sapiens
tcacaaggtcaggagt

SEQ ID NO: 6429570 - DNA, 18 bp, Homo sapiens
tcacaaggttatcagaaa

SEQ ID NO: 6429571 - DNA, 16 bp, Homo sapiens
tcacaagtaaaggaga

SEQ ID NO: 6429572 - DNA, 17 bp, Homo sapiens
tcacaagtaggagacac

SEQ ID NO: 6429573 - DNA, 18 bp, Homo sapiens
tcacaagtaggagacaca

SEQ ID NO: 6429574 - DNA, 21 bp, Homo sapiens
tcacaagtctaaacaatgaat

SEQ ID NO: 6429575 - DNA, 22 bp, Homo sapiens
tcacaagtgaaaaacatccaga

SEQ ID NO: 6429576 - DNA, 17 bp, Homo sapiens
tcacaagtgaaaactga

SEQ ID NO: 6429577 - DNA, 22 bp, Homo sapiens
tcacaagttaagattcttggta

SEQ ID NO: 6429578 - DNA, 18 bp, Homo sapiens
tcacaagttctatttctt

SEQ ID NO: 6429579 - DNA, 20 bp, Homo sapiens
tcacaagttgtgtttgatat

SEQ ID NO: 6429580 - DNA, 15 bp, Homo sapiens
tcacaataaagtgta

SEQ ID NO: 6429581 - DNA, 12 bp, Homo sapiens
tcacaataaatg

SEQ ID NO: 6429582 - DNA, 22 bp, Homo sapiens
tcacaataaatggccagtgctg

SEQ ID NO: 6429583 - DNA, 15 bp, Homo sapiens
tcacaataattttct

SEQ ID NO: 6429584 - DNA, 15 bp, Homo sapiens
tcacaatacagataa

SEQ ID NO: 6429585 - DNA, 21 bp, Homo sapiens
tcacaatagccgatatcagaa

SEQ ID NO: 6429586 - DNA, 14 bp, Homo sapiens
tcacaatattcagt

SEQ ID NO: 6429587 - DNA, 18 bp, Homo sapiens
tcacaatcatcttctccc

SEQ ID NO: 6429588 - DNA, 19 bp, Homo sapiens
tcacaatcatcttctccca

SEQ ID NO: 6429589 - DNA, 23 bp, Homo sapiens
tcacaatcttggggctgatgaag

SEQ ID NO: 6429590 - DNA, 18 bp, Homo sapiens
tcacaatgagaaaaataa

SEQ ID NO: 6429591 - DNA, 21 bp, Homo sapiens
tcacaatggtgctcatttcat

SEQ ID NO: 6429592 - DNA, 17 bp, Homo sapiens
tcacaatgtcagtattt

SEQ ID NO: 6429593 - DNA, 19 bp, Homo sapiens
tcacaatgtcagtatttca

SEQ ID NO: 6429594 - DNA, 14 bp, Homo sapiens
tcacaatgtgaaac

SEQ ID NO: 6429595 - DNA, 14 bp, Homo sapiens
tcacaatgttcttt

SEQ ID NO: 6429596 - DNA, 19 bp, Homo sapiens
tcacaatgttgctagtttt

SEQ ID NO: 6429597 - DNA, 20 bp, Homo sapiens
tcacaatgttggcctgtcag

SEQ ID NO: 6429598 - DNA, 22 bp, Homo sapiens
tcacaattccatttccagttca

SEQ ID NO: 6429599 - DNA, 18 bp, Homo sapiens
tcacaattcttagatctg

SEQ ID NO: 6429600 - DNA, 13 bp, Homo sapiens
tcacaatttcaat

SEQ ID NO: 6429601 - DNA, 15 bp, Homo sapiens
tcacaatttcaatgc

SEQ ID NO: 6429602 - DNA, 19 bp, Homo sapiens
tcacaattttcctgtggaa

SEQ ID NO: 6429603 - DNA, 23 bp, Homo sapiens
tcacacaaagactccttgtggac

SEQ ID NO: 6429604 - DNA, 13 bp, Homo sapiens
tcacacaaaggca

SEQ ID NO: 6429605 - DNA, 22 bp, Homo sapiens
tcacacaaaggcatgctggagt

SEQ ID NO: 6429606 - DNA, 21 bp, Homo sapiens
tcacacaacactgatgtgact

SEQ ID NO: 6429607 - DNA, 20 bp, Homo sapiens
tcacacaactgtggataaat

SEQ ID NO: 6429608 - DNA, 14 bp, Homo sapiens
tcacacaagatttg

SEQ ID NO: 6429609 - DNA, 14 bp, Homo sapiens
tcacacaagctcct

SEQ ID NO: 6429610 - DNA, 22 bp, Homo sapiens
tcacacacacacaatggcaagc

SEQ ID NO: 6429611 - DNA, 14 bp, Homo sapiens
tcacacacacacac

SEQ ID NO: 6429612 - DNA, 14 bp, Homo sapiens
tcacacacacagct

SEQ ID NO: 6429613 - DNA, 15 bp, Homo sapiens
tcacacacacagctg

SEQ ID NO: 6429614 - DNA, 18 bp, Homo sapiens
tcacacacacagctgggc

SEQ ID NO: 6429615 - DNA, 23 bp, Homo sapiens
tcacacacagactcatattactg

SEQ ID NO: 6429616 - DNA, 22 bp, Homo sapiens
tcacacacagactgttgtccct

SEQ ID NO: 6429617 - DNA, 20 bp, Homo sapiens
tcacacacaggcaactgagg

SEQ ID NO: 6429618 - DNA, 14 bp, Homo sapiens
tcacacacatagat

SEQ ID NO: 6429619 - DNA, 13 bp, Homo sapiens
tcacacacccctc

SEQ ID NO: 6429620 - DNA, 14 bp, Homo sapiens
tcacacacccctca

SEQ ID NO: 6429621 - DNA, 14 bp, Homo sapiens
tcacacacctctgc

SEQ ID NO: 6429622 - DNA, 17 bp, Homo sapiens
tcacacacctctgcccc

SEQ ID NO: 6429623 - DNA, 19 bp, Homo sapiens
tcacacacggaggccagac

SEQ ID NO: 6429624 - DNA, 17 bp, Homo sapiens
tcacacactcacaattt

SEQ ID NO: 6429625 - DNA, 17 bp, Homo sapiens
tcacacactttctcttc

SEQ ID NO: 6429626 - DNA, 15 bp, Homo sapiens
tcacacactttggct

SEQ ID NO: 6429627 - DNA, 15 bp, Homo sapiens
tcacacagacacaca

SEQ ID NO: 6429628 - DNA, 14 bp, Homo sapiens
tcacacagacacta

SEQ ID NO: 6429629 - DNA, 19 bp, Homo sapiens
tcacacagattcacctttt

SEQ ID NO: 6429630 - DNA, 21 bp, Homo sapiens
tcacacagcacctcctctctg

SEQ ID NO: 6429631 - DNA, 19 bp, Homo sapiens
tcacacagccaggtgcctt

SEQ ID NO: 6429632 - DNA, 22 bp, Homo sapiens
tcacacagccaggtgccttgga

SEQ ID NO: 6429633 - DNA, 23 bp, Homo sapiens
tcacacagccaggtgccttggag

SEQ ID NO: 6429634 - DNA, 14 bp, Homo sapiens
tcacacagcctgtg

SEQ ID NO: 6429635 - DNA, 21 bp, Homo sapiens
tcacacagcctgtgtgcagtg

SEQ ID NO: 6429636 - DNA, 20 bp, Homo sapiens
tcacacagctaacaagtagc

SEQ ID NO: 6429637 - DNA, 22 bp, Homo sapiens
tcacacagctaataaaagtcag

SEQ ID NO: 6429638 - DNA, 15 bp, Homo sapiens
tcacacagctggggc

SEQ ID NO: 6429639 - DNA, 22 bp, Homo sapiens
tcacacaggacccccttcccct

SEQ ID NO: 6429640 - DNA, 21 bp, Homo sapiens
tcacacaggcatttcctgggt

SEQ ID NO: 6429641 - DNA, 23 bp, Homo sapiens
tcacacaggcatttcctgggtgg

SEQ ID NO: 6429642 - DNA, 11 bp, Homo sapiens
tcacacagtgt

SEQ ID NO: 6429643 - DNA, 13 bp, Homo sapiens
tcacacagtgtta

SEQ ID NO: 6429644 - DNA, 20 bp, Homo sapiens
tcacacagtttaaaaaatca

SEQ ID NO: 6429645 - DNA, 16 bp, Homo sapiens
tcacacatcacattcc

SEQ ID NO: 6429646 - DNA, 19 bp, Homo sapiens
tcacacatccagacatcat

SEQ ID NO: 6429647 - DNA, 15 bp, Homo sapiens
tcacacatcctgtca

SEQ ID NO: 6429648 - DNA, 21 bp, Homo sapiens
tcacacatcctgtcagtgtca

SEQ ID NO: 6429649 - DNA, 19 bp, Homo sapiens
tcacacatctgggtgccct

SEQ ID NO: 6429650 - DNA, 20 bp, Homo sapiens
tcacacatctgggtgccctg

SEQ ID NO: 6429651 - DNA, 22 bp, Homo sapiens
tcacacatgagcatcaggccag

SEQ ID NO: 6429652 - DNA, 15 bp, Homo sapiens
tcacacatgcatcat

SEQ ID NO: 6429653 - DNA, 15 bp, Homo sapiens
tcacacattacaaca

SEQ ID NO: 6429654 - DNA, 17 bp, Homo sapiens
tcacacattacaacagt

SEQ ID NO: 6429655 - DNA, 21 bp, Homo sapiens
tcacacattatagaaattact

SEQ ID NO: 6429656 - DNA, 11 bp, Homo sapiens
tcacacattca

SEQ ID NO: 6429657 - DNA, 17 bp, Homo sapiens
tcacaccactgccattt

SEQ ID NO: 6429658 - DNA, 15 bp, Homo sapiens
tcacaccactgtact

SEQ ID NO: 6429659 - DNA, 11 bp, Homo sapiens
tcacaccagcc

SEQ ID NO: 6429660 - DNA, 12 bp, Homo sapiens
tcacaccagcca

SEQ ID NO: 6429661 - DNA, 15 bp, Homo sapiens
tcacaccagccctgg

SEQ ID NO: 6429662 - DNA, 21 bp, Homo sapiens
tcacaccattctcctgcctca

SEQ ID NO: 6429663 - DNA, 12 bp, Homo sapiens
tcacacccaccc

SEQ ID NO: 6429664 - DNA, 22 bp, Homo sapiens
tcacacccaccccctgcctggt

SEQ ID NO: 6429665 - DNA, 23 bp, Homo sapiens
tcacacccaccgtccgccctgct

SEQ ID NO: 6429666 - DNA, 15 bp, Homo sapiens
tcacacccacctgct

SEQ ID NO: 6429667 - DNA, 19 bp, Homo sapiens
tcacacccacctgctgctg

SEQ ID NO: 6429668 - DNA, 20 bp, Homo sapiens
tcacacccacctgctgctgt

SEQ ID NO: 6429669 - DNA, 14 bp, Homo sapiens
tcacaccccacctg

SEQ ID NO: 6429670 - DNA, 17 bp, Homo sapiens
tcacaccccacctgcgc

SEQ ID NO: 6429671 - DNA, 12 bp, Homo sapiens
tcacaccccagg

SEQ ID NO: 6429672 - DNA, 13 bp, Homo sapiens
tcacaccccaggc

SEQ ID NO: 6429673 - DNA, 15 bp, Homo sapiens
tcacacccctgcccc

SEQ ID NO: 6429674 - DNA, 12 bp, Homo sapiens
tcacaccctgca

SEQ ID NO: 6429675 - DNA, 14 bp, Homo sapiens
tcacaccctggacg

SEQ ID NO: 6429676 - DNA, 14 bp, Homo sapiens
tcacaccggcactg

SEQ ID NO: 6429677 - DNA, 17 bp, Homo sapiens
tcacaccggcactgtgc

SEQ ID NO: 6429678 - DNA, 19 bp, Homo sapiens
tcacacctcacgctctgga

SEQ ID NO: 6429679 - DNA, 17 bp, Homo sapiens
tcacacctcactgtcat

SEQ ID NO: 6429680 - DNA, 20 bp, Homo sapiens
tcacacctcccttcatccca

SEQ ID NO: 6429681 - DNA, 17 bp, Homo sapiens
tcacacctccttttctt

SEQ ID NO: 6429682 - DNA, 22 bp, Homo sapiens
tcacacctccttttcttctagc

SEQ ID NO: 6429683 - DNA, 12 bp, Homo sapiens
tcacacctctgg

SEQ ID NO: 6429684 - DNA, 17 bp, Homo sapiens
tcacacctctgggcttc

SEQ ID NO: 6429685 - DNA, 21 bp, Homo sapiens
tcacacctgaaaatgttagtg

SEQ ID NO: 6429686 - DNA, 17 bp, Homo sapiens
tcacacctgacaaatgg

SEQ ID NO: 6429687 - DNA, 13 bp, Homo sapiens
tcacacctgactc

SEQ ID NO: 6429688 - DNA, 17 bp, Homo sapiens
tcacacctgccctaaac

SEQ ID NO: 6429689 - DNA, 19 bp, Homo sapiens
tcacacctgtaatcccaac

SEQ ID NO: 6429690 - DNA, 20 bp, Homo sapiens
tcacacctgtaatcccagca

SEQ ID NO: 6429691 - DNA, 14 bp, Homo sapiens
tcacacggccaccc

SEQ ID NO: 6429692 - DNA, 15 bp, Homo sapiens
tcacacggccacccg

SEQ ID NO: 6429693 - DNA, 17 bp, Homo sapiens
tcacacgggggcagctg

SEQ ID NO: 6429694 - DNA, 23 bp, Homo sapiens
tcacacgtttaatcccagcactt

SEQ ID NO: 6429695 - DNA, 14 bp, Homo sapiens
tcacactactgtat

SEQ ID NO: 6429696 - DNA, 23 bp, Homo sapiens
tcacactactgtatttcattatc

SEQ ID NO: 6429697 - DNA, 18 bp, Homo sapiens
tcacactcaaggacagga

SEQ ID NO: 6429698 - DNA, 23 bp, Homo sapiens
tcacactcagaaagaggtctccc

SEQ ID NO: 6429699 - DNA, 15 bp, Homo sapiens
tcacactcatccaca

SEQ ID NO: 6429700 - DNA, 13 bp, Homo sapiens
tcacactccccgc

SEQ ID NO: 6429701 - DNA, 20 bp, Homo sapiens
tcacactcctcctgccagct

SEQ ID NO: 6429702 - DNA, 15 bp, Homo sapiens
tcacactcctgggct

SEQ ID NO: 6429703 - DNA, 16 bp, Homo sapiens
tcacactcgacatgaa

SEQ ID NO: 6429704 - DNA, 21 bp, Homo sapiens
tcacactctaactgtatattt

SEQ ID NO: 6429705 - DNA, 17 bp, Homo sapiens
tcacactctcacatgtt

SEQ ID NO: 6429706 - DNA, 16 bp, Homo sapiens
tcacactctctgcagc

SEQ ID NO: 6429707 - DNA, 17 bp, Homo sapiens
tcacactctctgcagcc

SEQ ID NO: 6429708 - DNA, 23 bp, Homo sapiens
tcacactctctgcagcccagcct

SEQ ID NO: 6429709 - DNA, 18 bp, Homo sapiens
tcacactctcttcttact

SEQ ID NO: 6429710 - DNA, 13 bp, Homo sapiens
tcacactcttcag

SEQ ID NO: 6429711 - DNA, 20 bp, Homo sapiens
tcacactgaatcagctgctg

SEQ ID NO: 6429712 - DNA, 12 bp, Homo sapiens
tcacactgagaa

SEQ ID NO: 6429713 - DNA, 21 bp, Homo sapiens
tcacactgagaatgtaagaac

SEQ ID NO: 6429714 - DNA, 16 bp, Homo sapiens
tcacactgatgggctg

SEQ ID NO: 6429715 - DNA, 22 bp, Homo sapiens
tcacactgatgggctggggcag

SEQ ID NO: 6429716 - DNA, 22 bp, Homo sapiens
tcacactgcgcaggtctcttct

SEQ ID NO: 6429717 - DNA, 12 bp, Homo sapiens
tcacactgctgg

SEQ ID NO: 6429718 - DNA, 14 bp, Homo sapiens
tcacactgctggga

SEQ ID NO: 6429719 - DNA, 18 bp, Homo sapiens
tcacactgctgtcctctc

SEQ ID NO: 6429720 - DNA, 20 bp, Homo sapiens
tcacactgctgtcctctccc

SEQ ID NO: 6429721 - DNA, 21 bp, Homo sapiens
tcacactgctgtcctctcccc

SEQ ID NO: 6429722 - DNA, 13 bp, Homo sapiens
tcacactggccac

SEQ ID NO: 6429723 - DNA, 21 bp, Homo sapiens
tcacactggcgtctggactgt

SEQ ID NO: 6429724 - DNA, 21 bp, Homo sapiens
tcacactgggtggtggcctgg

SEQ ID NO: 6429725 - DNA, 23 bp, Homo sapiens
tcacactgggtggtggcctggtc

SEQ ID NO: 6429726 - DNA, 17 bp, Homo sapiens
tcacactggtctgctgt

SEQ ID NO: 6429727 - DNA, 15 bp, Homo sapiens
tcacactggttctca

SEQ ID NO: 6429728 - DNA, 17 bp, Homo sapiens
tcacactggttctcaat

SEQ ID NO: 6429729 - DNA, 19 bp, Homo sapiens
tcacactggttctcaatga

SEQ ID NO: 6429730 - DNA, 15 bp, Homo sapiens
tcacactgtcttccc

SEQ ID NO: 6429731 - DNA, 18 bp, Homo sapiens
tcacactgtggaacacta

SEQ ID NO: 6429732 - DNA, 22 bp, Homo sapiens
tcacactgtggaacactaaaga

SEQ ID NO: 6429733 - DNA, 21 bp, Homo sapiens
tcacactgttactccacagcg

SEQ ID NO: 6429734 - DNA, 16 bp, Homo sapiens
tcacactgtttttcat

SEQ ID NO: 6429735 - DNA, 22 bp, Homo sapiens
tcacacttactgtaagacatta

SEQ ID NO: 6429736 - DNA, 18 bp, Homo sapiens
tcacacttatattttatg

SEQ ID NO: 6429737 - DNA, 20 bp, Homo sapiens
tcacacttatattttatgaa

SEQ ID NO: 6429738 - DNA, 20 bp, Homo sapiens
tcacacttcattgtaaatca

SEQ ID NO: 6429739 - DNA, 19 bp, Homo sapiens
tcacacttccaccagcctg

SEQ ID NO: 6429740 - DNA, 20 bp, Homo sapiens
tcacacttccaccagcctgc

SEQ ID NO: 6429741 - DNA, 16 bp, Homo sapiens
tcacacttgcaaatga

SEQ ID NO: 6429742 - DNA, 12 bp, Homo sapiens
tcacacttgggc

SEQ ID NO: 6429743 - DNA, 19 bp, Homo sapiens
tcacacttgggctggcacc

SEQ ID NO: 6429744 - DNA, 14 bp, Homo sapiens
tcacagaaaaagca

SEQ ID NO: 6429745 - DNA, 16 bp, Homo sapiens
tcacagaaaaagcatg

SEQ ID NO: 6429746 - DNA, 23 bp, Homo sapiens
tcacagaaaaagcatgatgggaa

SEQ ID NO: 6429747 - DNA, 14 bp, Homo sapiens
tcacagaaatcaga

SEQ ID NO: 6429748 - DNA, 16 bp, Homo sapiens
tcacagaaatcagagg

SEQ ID NO: 6429749 - DNA, 23 bp, Homo sapiens
tcacagaaatgagatcaggctct

SEQ ID NO: 6429750 - DNA, 21 bp, Homo sapiens
tcacagaacccttggagccaa

SEQ ID NO: 6429751 - DNA, 23 bp, Homo sapiens
tcacagaacctactgttcctttc

SEQ ID NO: 6429752 - DNA, 11 bp, Homo sapiens
tcacagaagaa

SEQ ID NO: 6429753 - DNA, 13 bp, Homo sapiens
tcacagaaggatc

SEQ ID NO: 6429754 - DNA, 23 bp, Homo sapiens
tcacagaagtgttaacttttcta

SEQ ID NO: 6429755 - DNA, 22 bp, Homo sapiens
tcacagaatcatatgattctgc

SEQ ID NO: 6429756 - DNA, 18 bp, Homo sapiens
tcacagaatctccatttc

SEQ ID NO: 6429757 - DNA, 11 bp, Homo sapiens
tcacagacagg

SEQ ID NO: 6429758 - DNA, 15 bp, Homo sapiens
tcacagacaggaccc

SEQ ID NO: 6429759 - DNA, 20 bp, Homo sapiens
tcacagacaggacccctgca

SEQ ID NO: 6429760 - DNA, 21 bp, Homo sapiens
tcacagacaggacccctgcag

SEQ ID NO: 6429761 - DNA, 18 bp, Homo sapiens
tcacagaccacaggaaga

SEQ ID NO: 6429762 - DNA, 17 bp, Homo sapiens
tcacagacctctgcttg

SEQ ID NO: 6429763 - DNA, 17 bp, Homo sapiens
tcacagacctggagccc

SEQ ID NO: 6429764 - DNA, 20 bp, Homo sapiens
tcacagacgctcctgaagtt

SEQ ID NO: 6429765 - DNA, 19 bp, Homo sapiens
tcacagactctgctagtga

SEQ ID NO: 6429766 - DNA, 16 bp, Homo sapiens
tcacagactcttccac

SEQ ID NO: 6429767 - DNA, 20 bp, Homo sapiens
tcacagactcttccaccaga

SEQ ID NO: 6429768 - DNA, 16 bp, Homo sapiens
tcacagactgctgtct

SEQ ID NO: 6429769 - DNA, 14 bp, Homo sapiens
tcacagactggaga

SEQ ID NO: 6429770 - DNA, 17 bp, Homo sapiens
tcacagacttctggcct

SEQ ID NO: 6429771 - DNA, 18 bp, Homo sapiens
tcacagagaagctcctgc

SEQ ID NO: 6429772 - DNA, 22 bp, Homo sapiens
tcacagagacacagggcatcca

SEQ ID NO: 6429773 - DNA, 18 bp, Homo sapiens
tcacagagcacgcctgcc

SEQ ID NO: 6429774 - DNA, 20 bp, Homo sapiens
tcacagagcacgcctgccat

SEQ ID NO: 6429775 - DNA, 16 bp, Homo sapiens
tcacagaggcagtggc

SEQ ID NO: 6429776 - DNA, 20 bp, Homo sapiens
tcacagaggcagtggcagca

SEQ ID NO: 6429777 - DNA, 22 bp, Homo sapiens
tcacagaggcggttgtaagagg

SEQ ID NO: 6429778 - DNA, 12 bp, Homo sapiens
tcacagaggctt

SEQ ID NO: 6429779 - DNA, 20 bp, Homo sapiens
tcacagagtacaaaatagtt

SEQ ID NO: 6429780 - DNA, 21 bp, Homo sapiens
tcacagagtcaaggcctgctc

SEQ ID NO: 6429781 - DNA, 13 bp, Homo sapiens
tcacagagtgaga

SEQ ID NO: 6429782 - DNA, 17 bp, Homo sapiens
tcacagagtgtgctgct

SEQ ID NO: 6429783 - DNA, 19 bp, Homo sapiens
tcacagatcgcatttccta

SEQ ID NO: 6429784 - DNA, 21 bp, Homo sapiens
tcacagatcgcatttcctaag

SEQ ID NO: 6429785 - DNA, 19 bp, Homo sapiens
tcacagatgcatatagaca

SEQ ID NO: 6429786 - DNA, 19 bp, Homo sapiens
tcacagatgcctacttttg

SEQ ID NO: 6429787 - DNA, 13 bp, Homo sapiens
tcacagatgctgg

SEQ ID NO: 6429788 - DNA, 15 bp, Homo sapiens
tcacagatgctggcc

SEQ ID NO: 6429789 - DNA, 21 bp, Homo sapiens
tcacagatgctggcctcttgg

SEQ ID NO: 6429790 - DNA, 22 bp, Homo sapiens
tcacagatgctggcctcttggc

SEQ ID NO: 6429791 - DNA, 23 bp, Homo sapiens
tcacagatgctggcctcttggca

SEQ ID NO: 6429792 - DNA, 22 bp, Homo sapiens
tcacagatgggtattaaacttg

SEQ ID NO: 6429793 - DNA, 20 bp, Homo sapiens
tcacagatgggtgcttggag

SEQ ID NO: 6429794 - DNA, 20 bp, Homo sapiens
tcacagatttccaaaagtac

SEQ ID NO: 6429795 - DNA, 15 bp, Homo sapiens
tcacagattttttct

SEQ ID NO: 6429796 - DNA, 14 bp, Homo sapiens
tcacagcaacactc

SEQ ID NO: 6429797 - DNA, 23 bp, Homo sapiens
tcacagcaagtcactggccagtg

SEQ ID NO: 6429798 - DNA, 14 bp, Homo sapiens
tcacagcacagtac

SEQ ID NO: 6429799 - DNA, 21 bp, Homo sapiens
tcacagcacagtacacacaaa

SEQ ID NO: 6429800 - DNA, 17 bp, Homo sapiens
tcacagcacatgctggc

SEQ ID NO: 6429801 - DNA, 15 bp, Homo sapiens
tcacagcacttgttt

SEQ ID NO: 6429802 - DNA, 22 bp, Homo sapiens
tcacagcagaatgaagacctaa

SEQ ID NO: 6429803 - DNA, 17 bp, Homo sapiens
tcacagcagcctccaac

SEQ ID NO: 6429804 - DNA, 13 bp, Homo sapiens
tcacagcagcttt

SEQ ID NO: 6429805 - DNA, 23 bp, Homo sapiens
tcacagcagggccttctgcctgc

SEQ ID NO: 6429806 - DNA, 15 bp, Homo sapiens
tcacagcagtacttg

SEQ ID NO: 6429807 - DNA, 17 bp, Homo sapiens
tcacagcagtacttgct

SEQ ID NO: 6429808 - DNA, 23 bp, Homo sapiens
tcacagcagtgagactggggcca

SEQ ID NO: 6429809 - DNA, 16 bp, Homo sapiens
tcacagcatggaggag

SEQ ID NO: 6429810 - DNA, 16 bp, Homo sapiens
tcacagcatggcctct

SEQ ID NO: 6429811 - DNA, 17 bp, Homo sapiens
tcacagccaccacctgg

SEQ ID NO: 6429812 - DNA, 16 bp, Homo sapiens
tcacagccacccctga

SEQ ID NO: 6429813 - DNA, 23 bp, Homo sapiens
tcacagccagactggcacagttt

SEQ ID NO: 6429814 - DNA, 11 bp, Homo sapiens
tcacagccagc

SEQ ID NO: 6429815 - DNA, 14 bp, Homo sapiens
tcacagccagccca

SEQ ID NO: 6429816 - DNA, 15 bp, Homo sapiens
tcacagccatttcaa

SEQ ID NO: 6429817 - DNA, 16 bp, Homo sapiens
tcacagccccatggac

SEQ ID NO: 6429818 - DNA, 23 bp, Homo sapiens
tcacagcccgggtgtgcctgccc

SEQ ID NO: 6429819 - DNA, 20 bp, Homo sapiens
tcacagcctaggaccagttt

SEQ ID NO: 6429820 - DNA, 16 bp, Homo sapiens
tcacagcctcacccct

SEQ ID NO: 6429821 - DNA, 12 bp, Homo sapiens
tcacagcctcca

SEQ ID NO: 6429822 - DNA, 18 bp, Homo sapiens
tcacagcctccagggccc

SEQ ID NO: 6429823 - DNA, 15 bp, Homo sapiens
tcacagcctcctctg

SEQ ID NO: 6429824 - DNA, 22 bp, Homo sapiens
tcacagcctcctctgtctgccc

SEQ ID NO: 6429825 - DNA, 15 bp, Homo sapiens
tcacagcctctccct

SEQ ID NO: 6429826 - DNA, 22 bp, Homo sapiens
tcacagcctctgacccctcctc

SEQ ID NO: 6429827 - DNA, 17 bp, Homo sapiens
tcacagccttggctcct

SEQ ID NO: 6429828 - DNA, 14 bp, Homo sapiens
tcacagcgcctcct

SEQ ID NO: 6429829 - DNA, 16 bp, Homo sapiens
tcacagcgtctgctca

SEQ ID NO: 6429830 - DNA, 18 bp, Homo sapiens
tcacagctacgtgtgccc

SEQ ID NO: 6429831 - DNA, 16 bp, Homo sapiens
tcacagctactcagtg

SEQ ID NO: 6429832 - DNA, 20 bp, Homo sapiens
tcacagctatgcaaaaagct

SEQ ID NO: 6429833 - DNA, 15 bp, Homo sapiens
tcacagctcactgca

SEQ ID NO: 6429834 - DNA, 19 bp, Homo sapiens
tcacagctccaagaatttc

SEQ ID NO: 6429835 - DNA, 11 bp, Homo sapiens
tcacagctcct

SEQ ID NO: 6429836 - DNA, 13 bp, Homo sapiens
tcacagctctgta

SEQ ID NO: 6429837 - DNA, 12 bp, Homo sapiens
tcacagctgcag

SEQ ID NO: 6429838 - DNA, 13 bp, Homo sapiens
tcacagctgcagc

SEQ ID NO: 6429839 - DNA, 17 bp, Homo sapiens
tcacagctgcagctggg

SEQ ID NO: 6429840 - DNA, 22 bp, Homo sapiens
tcacagctgcaggccacgccca

SEQ ID NO: 6429841 - DNA, 13 bp, Homo sapiens
tcacagctgcttt

SEQ ID NO: 6429842 - DNA, 23 bp, Homo sapiens
tcacagctggaccctgcttcacc

SEQ ID NO: 6429843 - DNA, 12 bp, Homo sapiens
tcacagctggat

SEQ ID NO: 6429844 - DNA, 18 bp, Homo sapiens
tcacagcttctccaagca

SEQ ID NO: 6429845 - DNA, 13 bp, Homo sapiens
tcacagcttttct

SEQ ID NO: 6429846 - DNA, 14 bp, Homo sapiens
tcacagcttttctt

SEQ ID NO: 6429847 - DNA, 15 bp, Homo sapiens
tcacaggaaggaaac

SEQ ID NO: 6429848 - DNA, 23 bp, Homo sapiens
tcacaggacagcccttctttcca

SEQ ID NO: 6429849 - DNA, 23 bp, Homo sapiens
tcacaggacgttgctttttcact

SEQ ID NO: 6429850 - DNA, 16 bp, Homo sapiens
tcacaggactctgcag

SEQ ID NO: 6429851 - DNA, 18 bp, Homo sapiens
tcacaggactctgcagat

SEQ ID NO: 6429852 - DNA, 17 bp, Homo sapiens
tcacaggactctgcctc

SEQ ID NO: 6429853 - DNA, 18 bp, Homo sapiens
tcacaggactctgcctcc

SEQ ID NO: 6429854 - DNA, 19 bp, Homo sapiens
tcacaggagcaatcacagg

SEQ ID NO: 6429855 - DNA, 20 bp, Homo sapiens
tcacaggagcaatcacagga

SEQ ID NO: 6429856 - DNA, 21 bp, Homo sapiens
tcacaggagcagacagagaaa

SEQ ID NO: 6429857 - DNA, 11 bp, Homo sapiens
tcacaggaggc

SEQ ID NO: 6429858 - DNA, 14 bp, Homo sapiens
tcacaggaggccag

SEQ ID NO: 6429859 - DNA, 16 bp, Homo sapiens
tcacaggaggccagtg

SEQ ID NO: 6429860 - DNA, 15 bp, Homo sapiens
tcacaggatgccagc

SEQ ID NO: 6429861 - DNA, 20 bp, Homo sapiens
tcacaggatgccagcccctg

SEQ ID NO: 6429862 - DNA, 17 bp, Homo sapiens
aactttcaatattttaa

SEQ ID NO: 6429863 - DNA, 22 bp, Homo sapiens
aactttcacagtgaagtgcctt

SEQ ID NO: 6429864 - DNA, 15 bp, Homo sapiens
aactttcacctcaga

SEQ ID NO: 6429865 - DNA, 12 bp, Homo sapiens
aactttcacttt

SEQ ID NO: 6429866 - DNA, 20 bp, Homo sapiens
aactttcagaagtgccactt

SEQ ID NO: 6429867 - DNA, 13 bp, Homo sapiens
aactttcattttt

SEQ ID NO: 6429868 - DNA, 16 bp, Homo sapiens
aactttccaaacacca

SEQ ID NO: 6429869 - DNA, 16 bp, Homo sapiens
aactttccatgacagt

SEQ ID NO: 6429870 - DNA, 17 bp, Homo sapiens
aactttccatgacagta

SEQ ID NO: 6429871 - DNA, 17 bp, Homo sapiens
aactttccccccaaccc

SEQ ID NO: 6429872 - DNA, 23 bp, Homo sapiens
aactttctaagagggttcttgct

SEQ ID NO: 6429873 - DNA, 16 bp, Homo sapiens
aactttctcagcatat

SEQ ID NO: 6429874 - DNA, 17 bp, Homo sapiens
aactttctcagcatata

SEQ ID NO: 6429875 - DNA, 21 bp, Homo sapiens
aactttctcagcatatatata

SEQ ID NO: 6429876 - DNA, 22 bp, Homo sapiens
aactttctccatttaagacaca

SEQ ID NO: 6429877 - DNA, 16 bp, Homo sapiens
aactttctccctcatc

SEQ ID NO: 6429878 - DNA, 17 bp, Homo sapiens
aactttctctgtgaaag

SEQ ID NO: 6429879 - DNA, 21 bp, Homo sapiens
aactttctctgtgaaagcttt

SEQ ID NO: 6429880 - DNA, 14 bp, Homo sapiens
aactttctcttgta

SEQ ID NO: 6429881 - DNA, 15 bp, Homo sapiens
aactttctctttgcc

SEQ ID NO: 6429882 - DNA, 16 bp, Homo sapiens
aactttctgaattatt

SEQ ID NO: 6429883 - DNA, 23 bp, Homo sapiens
aactttctgagtttttcagatgt

SEQ ID NO: 6429884 - DNA, 13 bp, Homo sapiens
aactttgaagcca

SEQ ID NO: 6429885 - DNA, 15 bp, Homo sapiens
aactttgaataaaga

SEQ ID NO: 6429886 - DNA, 20 bp, Homo sapiens
aactttgaataaagaatact

SEQ ID NO: 6429887 - DNA, 14 bp, Homo sapiens
aactttgacctctg

SEQ ID NO: 6429888 - DNA, 17 bp, Homo sapiens
aactttgacctctgcag

SEQ ID NO: 6429889 - DNA, 22 bp, Homo sapiens
aactttgaggaggaagcagaat

SEQ ID NO: 6429890 - DNA, 21 bp, Homo sapiens
aactttgaggcagcgcattgt

SEQ ID NO: 6429891 - DNA, 18 bp, Homo sapiens
aactttgagtacagatac

SEQ ID NO: 6429892 - DNA, 12 bp, Homo sapiens
aactttgatctc

SEQ ID NO: 6429893 - DNA, 19 bp, Homo sapiens
aactttgcaggcggccctc

SEQ ID NO: 6429894 - DNA, 12 bp, Homo sapiens
aactttgcatgt

SEQ ID NO: 6429895 - DNA, 16 bp, Homo sapiens
aactttgcatgttctt

SEQ ID NO: 6429896 - DNA, 17 bp, Homo sapiens
aactttgcatgttcttg

SEQ ID NO: 6429897 - DNA, 20 bp, Homo sapiens
aactttgcgggatatttagg

SEQ ID NO: 6429898 - DNA, 21 bp, Homo sapiens
aactttgcgggatatttaggg

SEQ ID NO: 6429899 - DNA, 15 bp, Homo sapiens
aactttgctggaaaa

SEQ ID NO: 6429900 - DNA, 16 bp, Homo sapiens
aactttgctggaaaat

SEQ ID NO: 6429901 - DNA, 13 bp, Homo sapiens
aactttgcttctc

SEQ ID NO: 6429902 - DNA, 22 bp, Homo sapiens
aactttgcttctccaaatacaa

SEQ ID NO: 6429903 - DNA, 15 bp, Homo sapiens
aactttgcttgatta

SEQ ID NO: 6429904 - DNA, 21 bp, Homo sapiens
aactttgcttgcagtagattt

SEQ ID NO: 6429905 - DNA, 15 bp, Homo sapiens
aactttggaaccaga

SEQ ID NO: 6429906 - DNA, 11 bp, Homo sapiens
aactttggaag

SEQ ID NO: 6429907 - DNA, 22 bp, Homo sapiens
aactttggaagcactttttctg

SEQ ID NO: 6429908 - DNA, 21 bp, Homo sapiens
aactttggagaactcatttca

SEQ ID NO: 6429909 - DNA, 16 bp, Homo sapiens
aactttggaggcaaat

SEQ ID NO: 6429910 - DNA, 18 bp, Homo sapiens
aactttggagtcccctca

SEQ ID NO: 6429911 - DNA, 17 bp, Homo sapiens
aactttggcaacatctt

SEQ ID NO: 6429912 - DNA, 14 bp, Homo sapiens
aactttggtgcatt

SEQ ID NO: 6429913 - DNA, 15 bp, Homo sapiens
aactttgtagacatt

SEQ ID NO: 6429914 - DNA, 14 bp, Homo sapiens
aactttgtatagtt

SEQ ID NO: 6429915 - DNA, 13 bp, Homo sapiens
aactttgtatttt

SEQ ID NO: 6429916 - DNA, 15 bp, Homo sapiens
aactttgtcagtgtt

SEQ ID NO: 6429917 - DNA, 18 bp, Homo sapiens
aactttgtcgtggttctt

SEQ ID NO: 6429918 - DNA, 21 bp, Homo sapiens
aactttgtctcgttcctgttg

SEQ ID NO: 6429919 - DNA, 18 bp, Homo sapiens
aactttgtgccagcgctg

SEQ ID NO: 6429920 - DNA, 22 bp, Homo sapiens
aactttgtggtaacttctttga

SEQ ID NO: 6429921 - DNA, 15 bp, Homo sapiens
aactttgtggtctaa

SEQ ID NO: 6429922 - DNA, 22 bp, Homo sapiens
aactttgtggtctaaagtgttt

SEQ ID NO: 6429923 - DNA, 13 bp, Homo sapiens
aactttgtttcca

SEQ ID NO: 6429924 - DNA, 15 bp, Homo sapiens
aactttgtttccaga

SEQ ID NO: 6429925 - DNA, 23 bp, Homo sapiens
aactttgtttccagaaattcttc

SEQ ID NO: 6429926 - DNA, 12 bp, Homo sapiens
aactttgtttta

SEQ ID NO: 6429927 - DNA, 15 bp, Homo sapiens
aacttttaaactaca

SEQ ID NO: 6429928 - DNA, 18 bp, Homo sapiens
aacttttaatgccttcca

SEQ ID NO: 6429929 - DNA, 21 bp, Homo sapiens
aacttttaatgccttccacat

SEQ ID NO: 6429930 - DNA, 12 bp, Homo sapiens
aacttttaatgg

SEQ ID NO: 6429931 - DNA, 12 bp, Homo sapiens
aacttttacaga

SEQ ID NO: 6429932 - DNA, 18 bp, Homo sapiens
aacttttaggttgttacc

SEQ ID NO: 6429933 - DNA, 12 bp, Homo sapiens
aacttttataaa

SEQ ID NO: 6429934 - DNA, 16 bp, Homo sapiens
aacttttataaacttt

SEQ ID NO: 6429935 - DNA, 14 bp, Homo sapiens
aacttttatctatt

SEQ ID NO: 6429936 - DNA, 15 bp, Homo sapiens
aacttttcaaaataa

SEQ ID NO: 6429937 - DNA, 18 bp, Homo sapiens
aacttttcaaaataaagc

SEQ ID NO: 6429938 - DNA, 20 bp, Homo sapiens
aacttttcaaggcttatatt

SEQ ID NO: 6429939 - DNA, 17 bp, Homo sapiens
aacttttcaatgacatt

SEQ ID NO: 6429940 - DNA, 22 bp, Homo sapiens
aacttttcaatgtgattcttct

SEQ ID NO: 6429941 - DNA, 23 bp, Homo sapiens
aacttttcatttcagattttaaa

SEQ ID NO: 6429942 - DNA, 20 bp, Homo sapiens
aacttttccaacatacaatt

SEQ ID NO: 6429943 - DNA, 21 bp, Homo sapiens
aacttttccaacatacaattt

SEQ ID NO: 6429944 - DNA, 13 bp, Homo sapiens
aacttttctaaag

SEQ ID NO: 6429945 - DNA, 13 bp, Homo sapiens
aacttttctaaga

SEQ ID NO: 6429946 - DNA, 12 bp, Homo sapiens
aacttttctaga

SEQ ID NO: 6429947 - DNA, 12 bp, Homo sapiens
aacttttctcag

SEQ ID NO: 6429948 - DNA, 21 bp, Homo sapiens
aacttttctcctgcatgtgta

SEQ ID NO: 6429949 - DNA, 22 bp, Homo sapiens
aacttttctcctgcatgtgtat

SEQ ID NO: 6429950 - DNA, 13 bp, Homo sapiens
aacttttctgata

SEQ ID NO: 6429951 - DNA, 14 bp, Homo sapiens
aacttttctgatag

SEQ ID NO: 6429952 - DNA, 15 bp, Homo sapiens
aacttttgaaagatg

SEQ ID NO: 6429953 - DNA, 22 bp, Homo sapiens
aacttttgactaagaattttgt

SEQ ID NO: 6429954 - DNA, 23 bp, Homo sapiens
aacttttgactaagaattttgtt

SEQ ID NO: 6429955 - DNA, 13 bp, Homo sapiens
aacttttgcaatc

SEQ ID NO: 6429956 - DNA, 21 bp, Homo sapiens
aacttttgtaatttgaattgg

SEQ ID NO: 6429957 - DNA, 17 bp, Homo sapiens
aacttttgtactgaatt

SEQ ID NO: 6429958 - DNA, 13 bp, Homo sapiens
aacttttgtggac

SEQ ID NO: 6429959 - DNA, 20 bp, Homo sapiens
aacttttgtgtaatgaaaat

SEQ ID NO: 6429960 - DNA, 14 bp, Homo sapiens
aacttttgtttttt

SEQ ID NO: 6429961 - DNA, 18 bp, Homo sapiens
aacttttgttttttgggg

SEQ ID NO: 6429962 - DNA, 14 bp, Homo sapiens
aactttttaaaata

SEQ ID NO: 6429963 - DNA, 23 bp, Homo sapiens
aactttttaaccaagttgtttat

SEQ ID NO: 6429964 - DNA, 17 bp, Homo sapiens
aactttttaataaagta

SEQ ID NO: 6429965 - DNA, 21 bp, Homo sapiens
aactttttaataaagtatatt

SEQ ID NO: 6429966 - DNA, 14 bp, Homo sapiens
aactttttacatta

SEQ ID NO: 6429967 - DNA, 16 bp, Homo sapiens
aactttttatattctc

SEQ ID NO: 6429968 - DNA, 20 bp, Homo sapiens
aactttttattgatttttgg

SEQ ID NO: 6429969 - DNA, 16 bp, Homo sapiens
aactttttattgcctt

SEQ ID NO: 6429970 - DNA, 20 bp, Homo sapiens
aactttttattgccttctca

SEQ ID NO: 6429971 - DNA, 15 bp, Homo sapiens
aactttttatttcta

SEQ ID NO: 6429972 - DNA, 21 bp, Homo sapiens
aactttttatttctaaatgag

SEQ ID NO: 6429973 - DNA, 13 bp, Homo sapiens
aactttttccaag

SEQ ID NO: 6429974 - DNA, 14 bp, Homo sapiens
aactttttcctggc

SEQ ID NO: 6429975 - DNA, 21 bp, Homo sapiens
aactttttctaagctgtttct

SEQ ID NO: 6429976 - DNA, 22 bp, Homo sapiens
aactttttggtttgcagatgac

SEQ ID NO: 6429977 - DNA, 23 bp, Homo sapiens
aactttttgttaacagacactgt

SEQ ID NO: 6429978 - DNA, 21 bp, Homo sapiens
aactttttgtttttatttctt

SEQ ID NO: 6429979 - DNA, 15 bp, Homo sapiens
aacttttttaaataa

SEQ ID NO: 6429980 - DNA, 16 bp, Homo sapiens
aacttttttaaataaa

SEQ ID NO: 6429981 - DNA, 17 bp, Homo sapiens
aacttttttaaataaac

SEQ ID NO: 6429982 - DNA, 22 bp, Homo sapiens
aacttttttaaataaacttttt

SEQ ID NO: 6429983 - DNA, 21 bp, Homo sapiens
aacttttttaaattaagacaa

SEQ ID NO: 6429984 - DNA, 14 bp, Homo sapiens
aacttttttatgtc

SEQ ID NO: 6429985 - DNA, 17 bp, Homo sapiens
aacttttttattttaag

SEQ ID NO: 6429986 - DNA, 13 bp, Homo sapiens
aacttttttggaa

SEQ ID NO: 6429987 - DNA, 16 bp, Homo sapiens
aacttttttgtgtatg

SEQ ID NO: 6429988 - DNA, 20 bp, Homo sapiens
aacttttttgtgtatgtact

SEQ ID NO: 6429989 - DNA, 22 bp, Homo sapiens
aacttttttgtgtatgtactta

SEQ ID NO: 6429990 - DNA, 14 bp, Homo sapiens
aactttttttaagg

SEQ ID NO: 6429991 - DNA, 16 bp, Homo sapiens
aactttttttcaatgt

SEQ ID NO: 6429992 - DNA, 15 bp, Homo sapiens
aactttttttcagtt

SEQ ID NO: 6429993 - DNA, 22 bp, Homo sapiens
aactttttttctgtaccagtta

SEQ ID NO: 6429994 - DNA, 21 bp, Homo sapiens
aacttttttttagtatttgcc

SEQ ID NO: 6429995 - DNA, 15 bp, Homo sapiens
aacttttttttccta

SEQ ID NO: 6429996 - DNA, 18 bp, Homo sapiens
aacttttttttctctctt

SEQ ID NO: 6429997 - DNA, 16 bp, Homo sapiens
aacttttttttgagaa

SEQ ID NO: 6429998 - DNA, 21 bp, Homo sapiens
aagaaaaaaaaaaagaaagaa

SEQ ID NO: 6429999 - DNA, 19 bp, Homo sapiens
aagaaaaaaaaaagaagaa

SEQ ID NO: 6430000 - DNA, 22 bp, Homo sapiens
aagaaaaaaaaaaggtgtttat

SEQ ID NO: 6430001 - DNA, 16 bp, Homo sapiens
aagaaaaaaaaaatat

SEQ ID NO: 6430002 - DNA, 17 bp, Homo sapiens
aagaaaaaaaaagaaaa

SEQ ID NO: 6430003 - DNA, 19 bp, Homo sapiens
aagaaaaaaaaagaaaaaa

SEQ ID NO: 6430004 - DNA, 14 bp, Homo sapiens
aagaaaaaaaaatg

SEQ ID NO: 6430005 - DNA, 20 bp, Homo sapiens
aagaaaaaaaataacacaga

SEQ ID NO: 6430006 - DNA, 14 bp, Homo sapiens
aagaaaaaaaccaa

SEQ ID NO: 6430007 - DNA, 12 bp, Homo sapiens
aagaaaaaaaga

SEQ ID NO: 6430008 - DNA, 14 bp, Homo sapiens
aagaaaaaaagaaa

SEQ ID NO: 6430009 - DNA, 23 bp, Homo sapiens
aagaaaaaaataattttatgaac

SEQ ID NO: 6430010 - DNA, 15 bp, Homo sapiens
aagaaaaaaatgatt

SEQ ID NO: 6430011 - DNA, 22 bp, Homo sapiens
aagaaaaaaatgtattttatgt

SEQ ID NO: 6430012 - DNA, 23 bp, Homo sapiens
aagaaaaaaatgtattttatgtt

SEQ ID NO: 6430013 - DNA, 20 bp, Homo sapiens
aagaaaaaaatgtcaaaagt

SEQ ID NO: 6430014 - DNA, 18 bp, Homo sapiens
aagaaaaaaattgaaatg

SEQ ID NO: 6430015 - DNA, 19 bp, Homo sapiens
aagaaaaaaattgaaatgt

SEQ ID NO: 6430016 - DNA, 23 bp, Homo sapiens
aagaaaaaaccgtgtttgtctct

SEQ ID NO: 6430017 - DNA, 18 bp, Homo sapiens
aagaaaaaagagaaaaga

SEQ ID NO: 6430018 - DNA, 20 bp, Homo sapiens
aagaaaaaagagaaaagaaa

SEQ ID NO: 6430019 - DNA, 17 bp, Homo sapiens
aagaaaaaagtccttca

SEQ ID NO: 6430020 - DNA, 21 bp, Homo sapiens
aagaaaaaagtgcaacttgag

SEQ ID NO: 6430021 - DNA, 12 bp, Homo sapiens
aagaaaaaatac

SEQ ID NO: 6430022 - DNA, 14 bp, Homo sapiens
aagaaaaaatacat

SEQ ID NO: 6430023 - DNA, 16 bp, Homo sapiens
aagaaaaaatacattt

SEQ ID NO: 6430024 - DNA, 14 bp, Homo sapiens
aagaaaaaatggca

SEQ ID NO: 6430025 - DNA, 18 bp, Homo sapiens
aagaaaaaatggcaagag

SEQ ID NO: 6430026 - DNA, 13 bp, Homo sapiens
aagaaaaaatttt

SEQ ID NO: 6430027 - DNA, 16 bp, Homo sapiens
aagaaaaaattttaaa

SEQ ID NO: 6430028 - DNA, 9 bp, Homo sapiens
aagaaaaac

SEQ ID NO: 6430029 - DNA, 15 bp, Homo sapiens
aagaaaaacatctgg

SEQ ID NO: 6430030 - DNA, 13 bp, Homo sapiens
aagaaaaagaaaa

SEQ ID NO: 6430031 - DNA, 18 bp, Homo sapiens
aagaaaaagaaaaagaaa

SEQ ID NO: 6430032 - DNA, 14 bp, Homo sapiens
aagaaaaagaagag

SEQ ID NO: 6430033 - DNA, 12 bp, Homo sapiens
aagaaaaagaat

SEQ ID NO: 6430034 - DNA, 12 bp, Homo sapiens
aagaaaaagata

SEQ ID NO: 6430035 - DNA, 14 bp, Homo sapiens
aagaaaaaggaaaa

SEQ ID NO: 6430036 - DNA, 18 bp, Homo sapiens
aagaaaaaggaaacaagc

SEQ ID NO: 6430037 - DNA, 14 bp, Homo sapiens
aagaaaaaggaaat

SEQ ID NO: 6430038 - DNA, 21 bp, Homo sapiens
aagaaaaaggacaaataaaac

SEQ ID NO: 6430039 - DNA, 15 bp, Homo sapiens
aagaaaaaggatgca

SEQ ID NO: 6430040 - DNA, 19 bp, Homo sapiens
aagaaaaaggatgcacaga

SEQ ID NO: 6430041 - DNA, 13 bp, Homo sapiens
aagaaaaagtaca

SEQ ID NO: 6430042 - DNA, 12 bp, Homo sapiens
tcacaggcagcc

SEQ ID NO: 6430043 - DNA, 14 bp, Homo sapiens
tcacaggcagccag

SEQ ID NO: 6430044 - DNA, 15 bp, Homo sapiens
tcacaggcagccagt

SEQ ID NO: 6430045 - DNA, 19 bp, Homo sapiens
tcacaggcagccagtgccc

SEQ ID NO: 6430046 - DNA, 20 bp, Homo sapiens
tcacaggcagctctgagccg

SEQ ID NO: 6430047 - DNA, 13 bp, Homo sapiens
tcacaggcagtgc

SEQ ID NO: 6430048 - DNA, 16 bp, Homo sapiens
tcacaggcatcaggaa

SEQ ID NO: 6430049 - DNA, 14 bp, Homo sapiens
tcacaggcccagaa

SEQ ID NO: 6430050 - DNA, 19 bp, Homo sapiens
tcacaggccccaggaaagg

SEQ ID NO: 6430051 - DNA, 17 bp, Homo sapiens
tcacaggccttgctttt

SEQ ID NO: 6430052 - DNA, 18 bp, Homo sapiens
tcacaggcgaggcctgga

SEQ ID NO: 6430053 - DNA, 16 bp, Homo sapiens
tcacaggctgagaact

SEQ ID NO: 6430054 - DNA, 14 bp, Homo sapiens
tcacaggctgggct

SEQ ID NO: 6430055 - DNA, 20 bp, Homo sapiens
tcacaggctgggctgggcac

SEQ ID NO: 6430056 - DNA, 13 bp, Homo sapiens
tcacaggctgtgc

SEQ ID NO: 6430057 - DNA, 15 bp, Homo sapiens
tcacaggctgtgcct

SEQ ID NO: 6430058 - DNA, 15 bp, Homo sapiens
tcacagggactctcc

SEQ ID NO: 6430059 - DNA, 15 bp, Homo sapiens
tcacagggagctggc

SEQ ID NO: 6430060 - DNA, 19 bp, Homo sapiens
tcacagggatgctggtggc

SEQ ID NO: 6430061 - DNA, 18 bp, Homo sapiens
tcacagggcagagccggg

SEQ ID NO: 6430062 - DNA, 13 bp, Homo sapiens
tcacagggcaggc

SEQ ID NO: 6430063 - DNA, 14 bp, Homo sapiens
tcacagggcaggcc

SEQ ID NO: 6430064 - DNA, 15 bp, Homo sapiens
tcacagggcaggcct

SEQ ID NO: 6430065 - DNA, 22 bp, Homo sapiens
tcacagggcaggccttgctggg

SEQ ID NO: 6430066 - DNA, 12 bp, Homo sapiens
tcacagggcagt

SEQ ID NO: 6430067 - DNA, 18 bp, Homo sapiens
tcacagggcagtacctga

SEQ ID NO: 6430068 - DNA, 20 bp, Homo sapiens
tcacagggcatgccccggcc

SEQ ID NO: 6430069 - DNA, 22 bp, Homo sapiens
tcacagggccaacttgagggcc

SEQ ID NO: 6430070 - DNA, 17 bp, Homo sapiens
tcacagggccccagaag

SEQ ID NO: 6430071 - DNA, 23 bp, Homo sapiens
tcacagggccccagaaggcaggg

SEQ ID NO: 6430072 - DNA, 12 bp, Homo sapiens
tcacagggtggg

SEQ ID NO: 6430073 - DNA, 17 bp, Homo sapiens
tcacagggtgggcctcg

SEQ ID NO: 6430074 - DNA, 14 bp, Homo sapiens
tcacagggttgggc

SEQ ID NO: 6430075 - DNA, 16 bp, Homo sapiens
tcacagggttgggccc

SEQ ID NO: 6430076 - DNA, 15 bp, Homo sapiens
tcacaggtcccaaat

SEQ ID NO: 6430077 - DNA, 20 bp, Homo sapiens
tcacaggtggacaaatgttg

SEQ ID NO: 6430078 - DNA, 20 bp, Homo sapiens
tcacaggtgtcagccattgc

SEQ ID NO: 6430079 - DNA, 14 bp, Homo sapiens
tcacaggtgtggga

SEQ ID NO: 6430080 - DNA, 18 bp, Homo sapiens
tcacaggtgtggtgtaat

SEQ ID NO: 6430081 - DNA, 19 bp, Homo sapiens
tcacaggttttcagagaat

SEQ ID NO: 6430082 - DNA, 17 bp, Homo sapiens
tcacagtacagcatgtg

SEQ ID NO: 6430083 - DNA, 18 bp, Homo sapiens
tcacagtacctatgactt

SEQ ID NO: 6430084 - DNA, 14 bp, Homo sapiens
tcacagtagagcca

SEQ ID NO: 6430085 - DNA, 15 bp, Homo sapiens
tcacagtagagccag

SEQ ID NO: 6430086 - DNA, 17 bp, Homo sapiens
tcacagtagagccagct

SEQ ID NO: 6430087 - DNA, 19 bp, Homo sapiens
tcacagtatcagtattttc

SEQ ID NO: 6430088 - DNA, 16 bp, Homo sapiens
tcacagtcacattcca

SEQ ID NO: 6430089 - DNA, 12 bp, Homo sapiens
tcacagtcccag

SEQ ID NO: 6430090 - DNA, 17 bp, Homo sapiens
tcacagtcctatgtaca

SEQ ID NO: 6430091 - DNA, 21 bp, Homo sapiens
tcacagtcctatgtacagagc

SEQ ID NO: 6430092 - DNA, 14 bp, Homo sapiens
tcacagtcctgagt

SEQ ID NO: 6430093 - DNA, 15 bp, Homo sapiens
tcacagtctaatttt

SEQ ID NO: 6430094 - DNA, 20 bp, Homo sapiens
tcacagtctcagttctcttg

SEQ ID NO: 6430095 - DNA, 15 bp, Homo sapiens
tcacagtctctggaa

SEQ ID NO: 6430096 - DNA, 18 bp, Homo sapiens
tcacagtctctttaatct

SEQ ID NO: 6430097 - DNA, 16 bp, Homo sapiens
tcacagtctggtgctt

SEQ ID NO: 6430098 - DNA, 15 bp, Homo sapiens
tcacagtcttgtgaa

SEQ ID NO: 6430099 - DNA, 17 bp, Homo sapiens
tcacagtgacccttccc

SEQ ID NO: 6430100 - DNA, 17 bp, Homo sapiens
tcacagtgctcttttct

SEQ ID NO: 6430101 - DNA, 17 bp, Homo sapiens
tcacagtgctgtgtgcc

SEQ ID NO: 6430102 - DNA, 18 bp, Homo sapiens
tcacagtggccacggcca

SEQ ID NO: 6430103 - DNA, 20 bp, Homo sapiens
tcacagtggcgagaggagag

SEQ ID NO: 6430104 - DNA, 15 bp, Homo sapiens
tcacagtgggaagaa

SEQ ID NO: 6430105 - DNA, 18 bp, Homo sapiens
tcacagtgggagccaggg

SEQ ID NO: 6430106 - DNA, 14 bp, Homo sapiens
tcacagtgtactct

SEQ ID NO: 6430107 - DNA, 16 bp, Homo sapiens
tcacagtgtctgtaaa

SEQ ID NO: 6430108 - DNA, 20 bp, Homo sapiens
tcacagtgtggggaagccca

SEQ ID NO: 6430109 - DNA, 17 bp, Homo sapiens
tcacagtgttgcccagg

SEQ ID NO: 6430110 - DNA, 23 bp, Homo sapiens
tcacagttcaaaattctaaatgt

SEQ ID NO: 6430111 - DNA, 17 bp, Homo sapiens
tcacagttcctcgccct

SEQ ID NO: 6430112 - DNA, 20 bp, Homo sapiens
tcacagttctttgggccaga

SEQ ID NO: 6430113 - DNA, 22 bp, Homo sapiens
tcacagttctttgggccagaca

SEQ ID NO: 6430114 - DNA, 22 bp, Homo sapiens
tcacagttggctggatgaaatt

SEQ ID NO: 6430115 - DNA, 15 bp, Homo sapiens
tcacagtttgaaata

SEQ ID NO: 6430116 - DNA, 20 bp, Homo sapiens
tcacagttttggttgcttta

SEQ ID NO: 6430117 - DNA, 21 bp, Homo sapiens
tcacagtttttggttcctctt

SEQ ID NO: 6430118 - DNA, 14 bp, Homo sapiens
tcacataaaagtct

SEQ ID NO: 6430119 - DNA, 16 bp, Homo sapiens
tcacataaaagtctgt

SEQ ID NO: 6430120 - DNA, 13 bp, Homo sapiens
tcacataaaatgc

SEQ ID NO: 6430121 - DNA, 20 bp, Homo sapiens
tcacataaactttataaatt

SEQ ID NO: 6430122 - DNA, 17 bp, Homo sapiens
tcacataaatgcagccc

SEQ ID NO: 6430123 - DNA, 19 bp, Homo sapiens
tcacataagagagatgaga

SEQ ID NO: 6430124 - DNA, 19 bp, Homo sapiens
tcacataagctcagaatcc

SEQ ID NO: 6430125 - DNA, 12 bp, Homo sapiens
tcacataataaa

SEQ ID NO: 6430126 - DNA, 13 bp, Homo sapiens
tcacatacaattt

SEQ ID NO: 6430127 - DNA, 17 bp, Homo sapiens
tcacatacaatttgcac

SEQ ID NO: 6430128 - DNA, 13 bp, Homo sapiens
tcacatacactca

SEQ ID NO: 6430129 - DNA, 13 bp, Homo sapiens
tcacataccagag

SEQ ID NO: 6430130 - DNA, 14 bp, Homo sapiens
tcacataccctccc

SEQ ID NO: 6430131 - DNA, 13 bp, Homo sapiens
tcacatactgact

SEQ ID NO: 6430132 - DNA, 20 bp, Homo sapiens
tcacatactgacttcagtgg

SEQ ID NO: 6430133 - DNA, 16 bp, Homo sapiens
tcacatagatgtccct

SEQ ID NO: 6430134 - DNA, 20 bp, Homo sapiens
tcacatagcccacttacatt

SEQ ID NO: 6430135 - DNA, 23 bp, Homo sapiens
tcacataggttagattctcattc

SEQ ID NO: 6430136 - DNA, 21 bp, Homo sapiens
tcacatagtcctcagggctca

SEQ ID NO: 6430137 - DNA, 16 bp, Homo sapiens
tcacatagtgaaagtt

SEQ ID NO: 6430138 - DNA, 16 bp, Homo sapiens
tcacatagtttttcct

SEQ ID NO: 6430139 - DNA, 22 bp, Homo sapiens
tcacatataaaagttaaactac

SEQ ID NO: 6430140 - DNA, 16 bp, Homo sapiens
tcacatataacatgca

SEQ ID NO: 6430141 - DNA, 20 bp, Homo sapiens
tcacatatacaaaagcaaga

SEQ ID NO: 6430142 - DNA, 19 bp, Homo sapiens
tcacatatcaagtcccgag

SEQ ID NO: 6430143 - DNA, 14 bp, Homo sapiens
tcacatatgattct

SEQ ID NO: 6430144 - DNA, 17 bp, Homo sapiens
tcacatatgattctctt

SEQ ID NO: 6430145 - DNA, 16 bp, Homo sapiens
tcacatatgtcttact

SEQ ID NO: 6430146 - DNA, 17 bp, Homo sapiens
tcacatatgtcttacta

SEQ ID NO: 6430147 - DNA, 16 bp, Homo sapiens
tcacatattgatttcc

SEQ ID NO: 6430148 - DNA, 12 bp, Homo sapiens
tcacatcaagca

SEQ ID NO: 6430149 - DNA, 19 bp, Homo sapiens
tcacatcaagcatgcaata

SEQ ID NO: 6430150 - DNA, 22 bp, Homo sapiens
tcacatcacgaaggaaaactgc

SEQ ID NO: 6430151 - DNA, 16 bp, Homo sapiens
tcacatcagataagac

SEQ ID NO: 6430152 - DNA, 18 bp, Homo sapiens
tcacatcagataagacat

SEQ ID NO: 6430153 - DNA, 16 bp, Homo sapiens
tcacatcagcaatttc

SEQ ID NO: 6430154 - DNA, 24 bp, Homo sapiens
tcacatcagtgaggagggatgtgg

SEQ ID NO: 6430155 - DNA, 22 bp, Homo sapiens
tcacatcatgctgttttatcct

SEQ ID NO: 6430156 - DNA, 13 bp, Homo sapiens
tcacatcatgtaa

SEQ ID NO: 6430157 - DNA, 17 bp, Homo sapiens
tcacatcatgtaatagt

SEQ ID NO: 6430158 - DNA, 17 bp, Homo sapiens
tcacatccaatgcatag

SEQ ID NO: 6430159 - DNA, 18 bp, Homo sapiens
tcacatccagttgtctaa

SEQ ID NO: 6430160 - DNA, 14 bp, Homo sapiens
tcacatccatccct

SEQ ID NO: 6430161 - DNA, 16 bp, Homo sapiens
tcacatccatctactt

SEQ ID NO: 6430162 - DNA, 22 bp, Homo sapiens
tcacatccattgtctcttcatg

SEQ ID NO: 6430163 - DNA, 18 bp, Homo sapiens
tcacatccccaaaggtca

SEQ ID NO: 6430164 - DNA, 13 bp, Homo sapiens
tcacatccctcta

SEQ ID NO: 6430165 - DNA, 15 bp, Homo sapiens
tcacatcctaataga

SEQ ID NO: 6430166 - DNA, 14 bp, Homo sapiens
tcacatcctcctgc

SEQ ID NO: 6430167 - DNA, 15 bp, Homo sapiens
tcacatcctggcctg

SEQ ID NO: 6430168 - DNA, 16 bp, Homo sapiens
tcacatccttgacttt

SEQ ID NO: 6430169 - DNA, 19 bp, Homo sapiens
tcacatccttgacttttta

SEQ ID NO: 6430170 - DNA, 21 bp, Homo sapiens
tcacatcgcttctgtgtatct

SEQ ID NO: 6430171 - DNA, 14 bp, Homo sapiens
tcacatctaaagct

SEQ ID NO: 6430172 - DNA, 19 bp, Homo sapiens
tcacatctaaagctttatc

SEQ ID NO: 6430173 - DNA, 22 bp, Homo sapiens
tcacatctaaagctttatcttt

SEQ ID NO: 6430174 - DNA, 13 bp, Homo sapiens
tcacatctcaggg

SEQ ID NO: 6430175 - DNA, 14 bp, Homo sapiens
tcacatctcaggga

SEQ ID NO: 6430176 - DNA, 22 bp, Homo sapiens
tcacatctcagggaactgaccc

SEQ ID NO: 6430177 - DNA, 22 bp, Homo sapiens
tcacatctcccttccacctcac

SEQ ID NO: 6430178 - DNA, 14 bp, Homo sapiens
tcacatctctgcct

SEQ ID NO: 6430179 - DNA, 17 bp, Homo sapiens
tcacatctctggaaatt

SEQ ID NO: 6430180 - DNA, 13 bp, Homo sapiens
tcacatctctgta

SEQ ID NO: 6430181 - DNA, 15 bp, Homo sapiens
tcacatctctgtaga

SEQ ID NO: 6430182 - DNA, 22 bp, Homo sapiens
tcacatctgaatctccttgttg

SEQ ID NO: 6430183 - DNA, 17 bp, Homo sapiens
tcacatctgcacactct

SEQ ID NO: 6430184 - DNA, 14 bp, Homo sapiens
tcacatctgtatat

SEQ ID NO: 6430185 - DNA, 22 bp, Homo sapiens
tcacatctgtatatcagctcta

SEQ ID NO: 6430186 - DNA, 14 bp, Homo sapiens
tcacatcttatgct

SEQ ID NO: 6430187 - DNA, 13 bp, Homo sapiens
tcacatcttattt

SEQ ID NO: 6430188 - DNA, 14 bp, Homo sapiens
tcacatcttattta

SEQ ID NO: 6430189 - DNA, 22 bp, Homo sapiens
tcacatctttcacacttccacc

SEQ ID NO: 6430190 - DNA, 18 bp, Homo sapiens
tcacatcttttaagacaa

SEQ ID NO: 6430191 - DNA, 19 bp, Homo sapiens
tcacatcttttaagacaaa

SEQ ID NO: 6430192 - DNA, 16 bp, Homo sapiens
tcacatctttttcact

SEQ ID NO: 6430193 - DNA, 21 bp, Homo sapiens
tcacatgaacatactggctgg

SEQ ID NO: 6430194 - DNA, 15 bp, Homo sapiens
tcacatgaattatta

SEQ ID NO: 6430195 - DNA, 16 bp, Homo sapiens
tcacatgaattattac

SEQ ID NO: 6430196 - DNA, 16 bp, Homo sapiens
tcacatgacatccaca

SEQ ID NO: 6430197 - DNA, 13 bp, Homo sapiens
tcacatgaccaca

SEQ ID NO: 6430198 - DNA, 18 bp, Homo sapiens
tcacatgaccacatagca

SEQ ID NO: 6430199 - DNA, 20 bp, Homo sapiens
tcacatgaccacatagcatg

SEQ ID NO: 6430200 - DNA, 17 bp, Homo sapiens
tcacatgagttcttgaa

SEQ ID NO: 6430201 - DNA, 21 bp, Homo sapiens
tcacatgatctgtttttcacc

SEQ ID NO: 6430202 - DNA, 16 bp, Homo sapiens
tcacatgatgaaaaat

SEQ ID NO: 6430203 - DNA, 17 bp, Homo sapiens
tcacatgattccagcca

SEQ ID NO: 6430204 - DNA, 19 bp, Homo sapiens
tcacatgattccagccatc

SEQ ID NO: 6430205 - DNA, 15 bp, Homo sapiens
tcacatgattctcct

SEQ ID NO: 6430206 - DNA, 23 bp, Homo sapiens
tcacatgcacatttcaaaacaag

SEQ ID NO: 6430207 - DNA, 19 bp, Homo sapiens
tcacatgctaaagccagga

SEQ ID NO: 6430208 - DNA, 20 bp, Homo sapiens
tcacatgctccttgcctctg

SEQ ID NO: 6430209 - DNA, 12 bp, Homo sapiens
tcacatgctgga

SEQ ID NO: 6430210 - DNA, 13 bp, Homo sapiens
tcacatgctggac

SEQ ID NO: 6430211 - DNA, 14 bp, Homo sapiens
tcacatgctggaca

SEQ ID NO: 6430212 - DNA, 16 bp, Homo sapiens
tcacatggcctatgca

SEQ ID NO: 6430213 - DNA, 17 bp, Homo sapiens
tcacatggctctcatgt

SEQ ID NO: 6430214 - DNA, 16 bp, Homo sapiens
tcacatggtttacatc

SEQ ID NO: 6430215 - DNA, 15 bp, Homo sapiens
tcacatgtgaaaagc

SEQ ID NO: 6430216 - DNA, 16 bp, Homo sapiens
tcacatgtgaaaagct

SEQ ID NO: 6430217 - DNA, 19 bp, Homo sapiens
tcacatgtgaaaagcttaa

SEQ ID NO: 6430218 - DNA, 23 bp, Homo sapiens
tcacatgtgaaaagcttaataaa

SEQ ID NO: 6430219 - DNA, 14 bp, Homo sapiens
tcacatgtgccctg

SEQ ID NO: 6430220 - DNA, 18 bp, Homo sapiens
tcacatgtgccctgcctt

SEQ ID NO: 6430221 - DNA, 19 bp, Homo sapiens
tcacatgtgccctgccttg

SEQ ID NO: 6430222 - DNA, 14 bp, Homo sapiens
aagaaaaagtagaa

SEQ ID NO: 6430223 - DNA, 19 bp, Homo sapiens
aagaaaaataatcttagaa

SEQ ID NO: 6430224 - DNA, 23 bp, Homo sapiens
aagaaaaataatcttagaacaga

SEQ ID NO: 6430225 - DNA, 20 bp, Homo sapiens
aagaaaaatataaaaacaac

SEQ ID NO: 6430226 - DNA, 14 bp, Homo sapiens
aagaaaaatatgag

SEQ ID NO: 6430227 - DNA, 12 bp, Homo sapiens
aagaaaaatatt

SEQ ID NO: 6430228 - DNA, 13 bp, Homo sapiens
aagaaaaatattt

SEQ ID NO: 6430229 - DNA, 14 bp, Homo sapiens
aagaaaaatcatgt

SEQ ID NO: 6430230 - DNA, 16 bp, Homo sapiens
aagaaaaatgaaaact

SEQ ID NO: 6430231 - DNA, 17 bp, Homo sapiens
aagaaaaatgagcctgg

SEQ ID NO: 6430232 - DNA, 19 bp, Homo sapiens
aagaaaaattaattaggaa

SEQ ID NO: 6430233 - DNA, 21 bp, Homo sapiens
aagaaaaattaattaggaatt

SEQ ID NO: 6430234 - DNA, 19 bp, Homo sapiens
aagaaaacaaagttctatt

SEQ ID NO: 6430235 - DNA, 21 bp, Homo sapiens
aagaaaacaaagttctatttt

SEQ ID NO: 6430236 - DNA, 15 bp, Homo sapiens
aagaaaacaccctta

SEQ ID NO: 6430237 - DNA, 15 bp, Homo sapiens
aagaaaacactgtta

SEQ ID NO: 6430238 - DNA, 12 bp, Homo sapiens
aagaaaacatat

SEQ ID NO: 6430239 - DNA, 15 bp, Homo sapiens
aagaaaacatatatt

SEQ ID NO: 6430240 - DNA, 16 bp, Homo sapiens
aagaaaacatctattc

SEQ ID NO: 6430241 - DNA, 17 bp, Homo sapiens
aagaaaacatctttaag

SEQ ID NO: 6430242 - DNA, 13 bp, Homo sapiens
aagaaaacatgta

SEQ ID NO: 6430243 - DNA, 12 bp, Homo sapiens
aagaaaaccatt

SEQ ID NO: 6430244 - DNA, 16 bp, Homo sapiens
aagaaaacccgaggga

SEQ ID NO: 6430245 - DNA, 17 bp, Homo sapiens
aagaaaacctcatggag

SEQ ID NO: 6430246 - DNA, 13 bp, Homo sapiens
aagaaaactacag

SEQ ID NO: 6430247 - DNA, 15 bp, Homo sapiens
aagaaaactacatgt

SEQ ID NO: 6430248 - DNA, 9 bp, Homo sapiens
aagaaaaga

SEQ ID NO: 6430249 - DNA, 12 bp, Homo sapiens
aagaaaagaatc

SEQ ID NO: 6430250 - DNA, 12 bp, Homo sapiens
aagaaaagactt

SEQ ID NO: 6430251 - DNA, 13 bp, Homo sapiens
aagaaaagagaaa

SEQ ID NO: 6430252 - DNA, 14 bp, Homo sapiens
aagaaaagagaaaa

SEQ ID NO: 6430253 - DNA, 12 bp, Homo sapiens
aagaaaagagag

SEQ ID NO: 6430254 - DNA, 14 bp, Homo sapiens
aagaaaagatgaaa

SEQ ID NO: 6430255 - DNA, 11 bp, Homo sapiens
aagaaaagatt

SEQ ID NO: 6430256 - DNA, 17 bp, Homo sapiens
aagaaaagattcttctt

SEQ ID NO: 6430257 - DNA, 24 bp, Homo sapiens
aagaaaagcattttcagtcttgta

SEQ ID NO: 6430258 - DNA, 19 bp, Homo sapiens
aagaaaagcctcagctcat

SEQ ID NO: 6430259 - DNA, 19 bp, Homo sapiens
aagaaaaggaatgcaagag

SEQ ID NO: 6430260 - DNA, 17 bp, Homo sapiens
aagaaaaggatttaagc

SEQ ID NO: 6430261 - DNA, 23 bp, Homo sapiens
aagaaaaggcaaaagactggttt

SEQ ID NO: 6430262 - DNA, 14 bp, Homo sapiens
aagaaaagtatttt

SEQ ID NO: 6430263 - DNA, 16 bp, Homo sapiens
aagaaaagtattttga

SEQ ID NO: 6430264 - DNA, 15 bp, Homo sapiens
aagaaaagtgggcca

SEQ ID NO: 6430265 - DNA, 16 bp, Homo sapiens
aagaaaagtgggccag

SEQ ID NO: 6430266 - DNA, 18 bp, Homo sapiens
aagaaaagttcttaaaac

SEQ ID NO: 6430267 - DNA, 21 bp, Homo sapiens
aagaaaagttttgtaaatttc

SEQ ID NO: 6430268 - DNA, 22 bp, Homo sapiens
aagaaaagttttgtaaatttct

SEQ ID NO: 6430269 - DNA, 18 bp, Homo sapiens
aagaaaataaaaaaaaga

SEQ ID NO: 6430270 - DNA, 22 bp, Homo sapiens
aagaaaataaaaaaaagaaaaa

SEQ ID NO: 6430271 - DNA, 17 bp, Homo sapiens
aagaaaatacaataaac

SEQ ID NO: 6430272 - DNA, 19 bp, Homo sapiens
aagaaaatacataagacca

SEQ ID NO: 6430273 - DNA, 16 bp, Homo sapiens
aagaaaatacttaaat

SEQ ID NO: 6430274 - DNA, 22 bp, Homo sapiens
aagaaaatagtggtgtgatttg

SEQ ID NO: 6430275 - DNA, 13 bp, Homo sapiens
aagaaaatatgca

SEQ ID NO: 6430276 - DNA, 14 bp, Homo sapiens
aagaaaatattcta

SEQ ID NO: 6430277 - DNA, 15 bp, Homo sapiens
aagaaaatattttgt

SEQ ID NO: 6430278 - DNA, 15 bp, Homo sapiens
aagaaaatcaatgaa

SEQ ID NO: 6430279 - DNA, 23 bp, Homo sapiens
aagaaaatcagatggagcatgaa

SEQ ID NO: 6430280 - DNA, 15 bp, Homo sapiens
aagaaaatcatattg

SEQ ID NO: 6430281 - DNA, 13 bp, Homo sapiens
aagaaaatctttg

SEQ ID NO: 6430282 - DNA, 16 bp, Homo sapiens
aagaaaatgaagggat

SEQ ID NO: 6430283 - DNA, 12 bp, Homo sapiens
aagaaaatgaat

SEQ ID NO: 6430284 - DNA, 19 bp, Homo sapiens
aagaaaatgaatttgactg

SEQ ID NO: 6430285 - DNA, 15 bp, Homo sapiens
aagaaaatgcctaga

SEQ ID NO: 6430286 - DNA, 23 bp, Homo sapiens
aagaaaatgcctagagatatttc

SEQ ID NO: 6430287 - DNA, 16 bp, Homo sapiens
aagaaaatggctaata

SEQ ID NO: 6430288 - DNA, 21 bp, Homo sapiens
aagaaaatgtctgttttccaa

SEQ ID NO: 6430289 - DNA, 21 bp, Homo sapiens
aagaaaatgtgtaacagagtt

SEQ ID NO: 6430290 - DNA, 14 bp, Homo sapiens
aagaaaattatatt

SEQ ID NO: 6430291 - DNA, 14 bp, Homo sapiens
aagaaaattctcaa

SEQ ID NO: 6430292 - DNA, 22 bp, Homo sapiens
aagaaaattctcaagtgatagt

SEQ ID NO: 6430293 - DNA, 15 bp, Homo sapiens
aagaaaattctctca

SEQ ID NO: 6430294 - DNA, 13 bp, Homo sapiens
aagaaaattgcat

SEQ ID NO: 6430295 - DNA, 14 bp, Homo sapiens
aagaaaattgcatg

SEQ ID NO: 6430296 - DNA, 15 bp, Homo sapiens
aagaaaattgcatga

SEQ ID NO: 6430297 - DNA, 21 bp, Homo sapiens
aagaaaattgcatgaaactag

SEQ ID NO: 6430298 - DNA, 14 bp, Homo sapiens
aagaaaattgccaa

SEQ ID NO: 6430299 - DNA, 16 bp, Homo sapiens
aagaaaattgctgtgc

SEQ ID NO: 6430300 - DNA, 21 bp, Homo sapiens
aagaaaattggactggtgaaa

SEQ ID NO: 6430301 - DNA, 18 bp, Homo sapiens
aagaaaatttgccaatct

SEQ ID NO: 6430302 - DNA, 13 bp, Homo sapiens
aagaaaattttcc

SEQ ID NO: 6430303 - DNA, 12 bp, Homo sapiens
aagaaaattttt

SEQ ID NO: 6430304 - DNA, 14 bp, Homo sapiens
aagaaacaaaaatc

SEQ ID NO: 6430305 - DNA, 13 bp, Homo sapiens
aagaaacaaaccc

SEQ ID NO: 6430306 - DNA, 16 bp, Homo sapiens
aagaaacaaacccgtt

SEQ ID NO: 6430307 - DNA, 17 bp, Homo sapiens
aagaaacaagctgtgca

SEQ ID NO: 6430308 - DNA, 14 bp, Homo sapiens
aagaaacaaggcat

SEQ ID NO: 6430309 - DNA, 14 bp, Homo sapiens
aagaaacaatttaa

SEQ ID NO: 6430310 - DNA, 12 bp, Homo sapiens
aagaaacacagc

SEQ ID NO: 6430311 - DNA, 20 bp, Homo sapiens
aagaaacacagcatgcattt

SEQ ID NO: 6430312 - DNA, 24 bp, Homo sapiens
aagaaacacagcatgcatttagca

SEQ ID NO: 6430313 - DNA, 17 bp, Homo sapiens
aagaaacaccagtgtta

SEQ ID NO: 6430314 - DNA, 20 bp, Homo sapiens
aagaaacactaagctctctg

SEQ ID NO: 6430315 - DNA, 16 bp, Homo sapiens
aagaaacactgcctgc

SEQ ID NO: 6430316 - DNA, 16 bp, Homo sapiens
aagaaacagataccat

SEQ ID NO: 6430317 - DNA, 14 bp, Homo sapiens
aagaaacagccagc

SEQ ID NO: 6430318 - DNA, 19 bp, Homo sapiens
aagaaacagctatgagagg

SEQ ID NO: 6430319 - DNA, 18 bp, Homo sapiens
aagaaacaggggatcaaa

SEQ ID NO: 6430320 - DNA, 19 bp, Homo sapiens
aagaaacaggggatcaaag

SEQ ID NO: 6430321 - DNA, 21 bp, Homo sapiens
aagaaacaggggatcaaagtt

SEQ ID NO: 6430322 - DNA, 14 bp, Homo sapiens
aagaaacattggaa

SEQ ID NO: 6430323 - DNA, 17 bp, Homo sapiens
aagaaacattggaagca

SEQ ID NO: 6430324 - DNA, 14 bp, Homo sapiens
aagaaacatttata

SEQ ID NO: 6430325 - DNA, 16 bp, Homo sapiens
aagaaacatttatctt

SEQ ID NO: 6430326 - DNA, 20 bp, Homo sapiens
aagaaaccaagtgggctggt

SEQ ID NO: 6430327 - DNA, 14 bp, Homo sapiens
aagaaaccatgaca

SEQ ID NO: 6430328 - DNA, 16 bp, Homo sapiens
aagaaacccgacagag

SEQ ID NO: 6430329 - DNA, 21 bp, Homo sapiens
aagaaacccttccacgtgtat

SEQ ID NO: 6430330 - DNA, 18 bp, Homo sapiens
aagaaacccttgctgctt

SEQ ID NO: 6430331 - DNA, 21 bp, Homo sapiens
aagaaacctactgcccaggca

SEQ ID NO: 6430332 - DNA, 15 bp, Homo sapiens
aagaaacctggaacc

SEQ ID NO: 6430333 - DNA, 15 bp, Homo sapiens
aagaaaccttgctct

SEQ ID NO: 6430334 - DNA, 13 bp, Homo sapiens
aagaaacggtatg

SEQ ID NO: 6430335 - DNA, 22 bp, Homo sapiens
aagaaacgtacttaactgtgtg

SEQ ID NO: 6430336 - DNA, 17 bp, Homo sapiens
aagaaacgtctacgtat

SEQ ID NO: 6430337 - DNA, 22 bp, Homo sapiens
aagaaactagtatctctggcct

SEQ ID NO: 6430338 - DNA, 15 bp, Homo sapiens
aagaaactatttttg

SEQ ID NO: 6430339 - DNA, 21 bp, Homo sapiens
aagaaactctatggtcttata

SEQ ID NO: 6430340 - DNA, 21 bp, Homo sapiens
aagaaactgacatgccctccc

SEQ ID NO: 6430341 - DNA, 22 bp, Homo sapiens
aagaaactgacatgccctccct

SEQ ID NO: 6430342 - DNA, 18 bp, Homo sapiens
aagaaactgcttacagtt

SEQ ID NO: 6430343 - DNA, 15 bp, Homo sapiens
aagaaactggtccat

SEQ ID NO: 6430344 - DNA, 14 bp, Homo sapiens
aagaaacttgtaaa

SEQ ID NO: 6430345 - DNA, 15 bp, Homo sapiens
aagaaacttgtaaat

SEQ ID NO: 6430346 - DNA, 23 bp, Homo sapiens
aagaaacttgtaaatatcttttt

SEQ ID NO: 6430347 - DNA, 17 bp, Homo sapiens
aagaaacttgtgcttta

SEQ ID NO: 6430348 - DNA, 23 bp, Homo sapiens
aagaaactttctttctcactaaa

SEQ ID NO: 6430349 - DNA, 12 bp, Homo sapiens
aagaaacttttg

SEQ ID NO: 6430350 - DNA, 13 bp, Homo sapiens
aagaaacttttgt

SEQ ID NO: 6430351 - DNA, 16 bp, Homo sapiens
aagaaacttttgtaaa

SEQ ID NO: 6430352 - DNA, 19 bp, Homo sapiens
aagaaacttttgtaaagaa

SEQ ID NO: 6430353 - DNA, 23 bp, Homo sapiens
aagaaactttttaataaagtata

SEQ ID NO: 6430354 - DNA, 16 bp, Homo sapiens
aagaaacttttttatt

SEQ ID NO: 6430355 - DNA, 19 bp, Homo sapiens
aagaaacttttttattttt

SEQ ID NO: 6430356 - DNA, 11 bp, Homo sapiens
aagaaagaaaa

SEQ ID NO: 6430357 - DNA, 12 bp, Homo sapiens
aagaaagaaaaa

SEQ ID NO: 6430358 - DNA, 14 bp, Homo sapiens
aagaaagaaacact

SEQ ID NO: 6430359 - DNA, 12 bp, Homo sapiens
aagaaagaaaga

SEQ ID NO: 6430360 - DNA, 15 bp, Homo sapiens
aagaaagaaaggaaa

SEQ ID NO: 6430361 - DNA, 16 bp, Homo sapiens
aagaaagaaaggaaag

SEQ ID NO: 6430362 - DNA, 21 bp, Homo sapiens
aagaaagaacgttccctttgg

SEQ ID NO: 6430363 - DNA, 14 bp, Homo sapiens
aagaaagaagcact

SEQ ID NO: 6430364 - DNA, 12 bp, Homo sapiens
aagaaagaatgt

SEQ ID NO: 6430365 - DNA, 16 bp, Homo sapiens
aagaaagacgcacttt

SEQ ID NO: 6430366 - DNA, 16 bp, Homo sapiens
aagaaagactctattc

SEQ ID NO: 6430367 - DNA, 17 bp, Homo sapiens
aagaaagagaagtcaca

SEQ ID NO: 6430368 - DNA, 16 bp, Homo sapiens
aagaaagagactgtgg

SEQ ID NO: 6430369 - DNA, 18 bp, Homo sapiens
aagaaagagagaaaataa

SEQ ID NO: 6430370 - DNA, 20 bp, Homo sapiens
aagaaagagagaaaataaaa

SEQ ID NO: 6430371 - DNA, 13 bp, Homo sapiens
aagaaagatacta

SEQ ID NO: 6430372 - DNA, 20 bp, Homo sapiens
aagaaagattgtaaactaaa

SEQ ID NO: 6430373 - DNA, 14 bp, Homo sapiens
aagaaagattttat

SEQ ID NO: 6430374 - DNA, 19 bp, Homo sapiens
aagaaagcaaaaaataaaa

SEQ ID NO: 6430375 - DNA, 21 bp, Homo sapiens
aagaaagcaaaaaataaaata

SEQ ID NO: 6430376 - DNA, 23 bp, Homo sapiens
aagaaagcaaaaaataaaataag

SEQ ID NO: 6430377 - DNA, 13 bp, Homo sapiens
aagaaagcagaat

SEQ ID NO: 6430378 - DNA, 16 bp, Homo sapiens
aagaaagccagtctta

SEQ ID NO: 6430379 - DNA, 20 bp, Homo sapiens
aagaaagccgtactgtctat

SEQ ID NO: 6430380 - DNA, 17 bp, Homo sapiens
aagaaagcctaaaattg

SEQ ID NO: 6430381 - DNA, 20 bp, Homo sapiens
aagaaagcctcagtgaaaca

SEQ ID NO: 6430382 - DNA, 12 bp, Homo sapiens
aagaaagcctga

SEQ ID NO: 6430383 - DNA, 19 bp, Homo sapiens
aagaaagctatatatgaat

SEQ ID NO: 6430384 - DNA, 14 bp, Homo sapiens
aagaaagctgcttt

SEQ ID NO: 6430385 - DNA, 16 bp, Homo sapiens
aagaaagcttttaaaa

SEQ ID NO: 6430386 - DNA, 16 bp, Homo sapiens
aagaaaggaaaagaaa

SEQ ID NO: 6430387 - DNA, 12 bp, Homo sapiens
aagaaaggaaag

SEQ ID NO: 6430388 - DNA, 18 bp, Homo sapiens
aagaaaggaaagaaggag

SEQ ID NO: 6430389 - DNA, 13 bp, Homo sapiens
aagaaaggaagca

SEQ ID NO: 6430390 - DNA, 23 bp, Homo sapiens
aagaaaggaagcattgtaaaata

SEQ ID NO: 6430391 - DNA, 15 bp, Homo sapiens
aagaaaggagataca

SEQ ID NO: 6430392 - DNA, 11 bp, Homo sapiens
aagaaaggagg

SEQ ID NO: 6430393 - DNA, 20 bp, Homo sapiens
aagaaaggatataaaaggat

SEQ ID NO: 6430394 - DNA, 21 bp, Homo sapiens
aagaaaggcaaatctgacttt

SEQ ID NO: 6430395 - DNA, 23 bp, Homo sapiens
aagaaaggcattgcacagagtga

SEQ ID NO: 6430396 - DNA, 19 bp, Homo sapiens
aagaaagggaaaagggaga

SEQ ID NO: 6430397 - DNA, 17 bp, Homo sapiens
aagaaagggacccacct

SEQ ID NO: 6430398 - DNA, 19 bp, Homo sapiens
aagaaagggacccacctgc

SEQ ID NO: 6430399 - DNA, 18 bp, Homo sapiens
aagaaaggggcaggagct

SEQ ID NO: 6430400 - DNA, 17 bp, Homo sapiens
aagaaagtaaaaagaac

SEQ ID NO: 6430401 - DNA, 14 bp, Homo sapiens
aagaaagtctatgc

SEQ ID NO: 6430402 - DNA, 18 bp, Homo sapiens
aagaaagtgcagaatcaa

SEQ ID NO: 6430403 - DNA, 22 bp, Homo sapiens
aagaaagtggtcttaagaaatg

SEQ ID NO: 6430404 - DNA, 20 bp, Homo sapiens
tcacatgtgccctgccttga

SEQ ID NO: 6430405 - DNA, 13 bp, Homo sapiens
tcacatgtgctct

SEQ ID NO: 6430406 - DNA, 13 bp, Homo sapiens
tcacatgtggcaa

SEQ ID NO: 6430407 - DNA, 19 bp, Homo sapiens
tcacatgtggcaaaatatg

SEQ ID NO: 6430408 - DNA, 23 bp, Homo sapiens
tcacatgtggggaggttaatcta

SEQ ID NO: 6430409 - DNA, 15 bp, Homo sapiens
tcacatgttttcaaa

SEQ ID NO: 6430410 - DNA, 19 bp, Homo sapiens
tcacattaatatttgctga

SEQ ID NO: 6430411 - DNA, 20 bp, Homo sapiens
tcacattaatctcaaagaga

SEQ ID NO: 6430412 - DNA, 16 bp, Homo sapiens
tcacattaatggtcta

SEQ ID NO: 6430413 - DNA, 15 bp, Homo sapiens
tcacattaatttaat

SEQ ID NO: 6430414 - DNA, 20 bp, Homo sapiens
tcacattaatttaattacta

SEQ ID NO: 6430415 - DNA, 14 bp, Homo sapiens
tcacattagaagac

SEQ ID NO: 6430416 - DNA, 17 bp, Homo sapiens
tcacattagataaatta

SEQ ID NO: 6430417 - DNA, 20 bp, Homo sapiens
tcacattagataaattacta

SEQ ID NO: 6430418 - DNA, 13 bp, Homo sapiens
tcacattagatct

SEQ ID NO: 6430419 - DNA, 20 bp, Homo sapiens
tcacattatttatttttcat

SEQ ID NO: 6430420 - DNA, 17 bp, Homo sapiens
tcacattccatttctct

SEQ ID NO: 6430421 - DNA, 18 bp, Homo sapiens
tcacattcccctggggac

SEQ ID NO: 6430422 - DNA, 21 bp, Homo sapiens
tcacattcccctggggaccca

SEQ ID NO: 6430423 - DNA, 16 bp, Homo sapiens
tcacattccctctcat

SEQ ID NO: 6430424 - DNA, 13 bp, Homo sapiens
tcacattcctgaa

SEQ ID NO: 6430425 - DNA, 15 bp, Homo sapiens
tcacattctgaagtt

SEQ ID NO: 6430426 - DNA, 13 bp, Homo sapiens
tcacattctgctt

SEQ ID NO: 6430427 - DNA, 15 bp, Homo sapiens
tcacattctgcttaa

SEQ ID NO: 6430428 - DNA, 13 bp, Homo sapiens
tcacattcttata

SEQ ID NO: 6430429 - DNA, 17 bp, Homo sapiens
tcacattcttataaata

SEQ ID NO: 6430430 - DNA, 19 bp, Homo sapiens
tcacattcttataaatatg

SEQ ID NO: 6430431 - DNA, 21 bp, Homo sapiens
tcacattcttataaatatgaa

SEQ ID NO: 6430432 - DNA, 23 bp, Homo sapiens
tcacattgaccgcaactcacaca

SEQ ID NO: 6430433 - DNA, 20 bp, Homo sapiens
tcacattgagagtaagcacg

SEQ ID NO: 6430434 - DNA, 21 bp, Homo sapiens
tcacattgagctgatataaat

SEQ ID NO: 6430435 - DNA, 20 bp, Homo sapiens
tcacattgcattctattgcc

SEQ ID NO: 6430436 - DNA, 16 bp, Homo sapiens
tcacattgccttgagc

SEQ ID NO: 6430437 - DNA, 18 bp, Homo sapiens
tcacattgttaagaaaaa

SEQ ID NO: 6430438 - DNA, 11 bp, Homo sapiens
tcacattgttt

SEQ ID NO: 6430439 - DNA, 18 bp, Homo sapiens
tcacattgtttgctgcta

SEQ ID NO: 6430440 - DNA, 18 bp, Homo sapiens
tcacatttactagctgtg

SEQ ID NO: 6430441 - DNA, 14 bp, Homo sapiens
tcacatttattctg

SEQ ID NO: 6430442 - DNA, 17 bp, Homo sapiens
tcacatttattctgctc

SEQ ID NO: 6430443 - DNA, 18 bp, Homo sapiens
tcacatttattctgctca

SEQ ID NO: 6430444 - DNA, 16 bp, Homo sapiens
tcacatttgatgtaca

SEQ ID NO: 6430445 - DNA, 17 bp, Homo sapiens
tcacatttgatgtacat

SEQ ID NO: 6430446 - DNA, 22 bp, Homo sapiens
tcacatttgatgtacatgtgta

SEQ ID NO: 6430447 - DNA, 17 bp, Homo sapiens
tcacatttgtaaatgtc

SEQ ID NO: 6430448 - DNA, 14 bp, Homo sapiens
tcacattttaagtg

SEQ ID NO: 6430449 - DNA, 15 bp, Homo sapiens
tcacattttaagtgc

SEQ ID NO: 6430450 - DNA, 15 bp, Homo sapiens
tcacattttattaaa

SEQ ID NO: 6430451 - DNA, 11 bp, Homo sapiens
tcacattttcc

SEQ ID NO: 6430452 - DNA, 19 bp, Homo sapiens
tcacattttctcagtgtgc

SEQ ID NO: 6430453 - DNA, 17 bp, Homo sapiens
tcacattttgcctttct

SEQ ID NO: 6430454 - DNA, 19 bp, Homo sapiens
tcacattttgcctttctcg

SEQ ID NO: 6430455 - DNA, 13 bp, Homo sapiens
tcacattttgtat

SEQ ID NO: 6430456 - DNA, 16 bp, Homo sapiens
tcacattttgtatgga

SEQ ID NO: 6430457 - DNA, 20 bp, Homo sapiens
tcacatttttaaaagaacaa

SEQ ID NO: 6430458 - DNA, 21 bp, Homo sapiens
tcacatttttaaaagaacaat

SEQ ID NO: 6430459 - DNA, 22 bp, Homo sapiens
tcacatttttatacctgtttaa

SEQ ID NO: 6430460 - DNA, 13 bp, Homo sapiens
tcacatttttgta

SEQ ID NO: 6430461 - DNA, 15 bp, Homo sapiens
tcacatttttgtaat

SEQ ID NO: 6430462 - DNA, 18 bp, Homo sapiens
tcaccaaaagacactgca

SEQ ID NO: 6430463 - DNA, 16 bp, Homo sapiens
tcaccaaaagacgagg

SEQ ID NO: 6430464 - DNA, 19 bp, Homo sapiens
tcaccaaatcagctgctac

SEQ ID NO: 6430465 - DNA, 20 bp, Homo sapiens
tcaccaaatcagctgctact

SEQ ID NO: 6430466 - DNA, 19 bp, Homo sapiens
tcaccaacaacagtcagcc

SEQ ID NO: 6430467 - DNA, 20 bp, Homo sapiens
tcaccaacaacagtcagcca

SEQ ID NO: 6430468 - DNA, 21 bp, Homo sapiens
tcaccaactgaattaaactta

SEQ ID NO: 6430469 - DNA, 19 bp, Homo sapiens
tcaccaacttgccacatgt

SEQ ID NO: 6430470 - DNA, 18 bp, Homo sapiens
tcaccaagaacagcgggt

SEQ ID NO: 6430471 - DNA, 13 bp, Homo sapiens
tcaccaagaagca

SEQ ID NO: 6430472 - DNA, 23 bp, Homo sapiens
tcaccaagcaagtcccttcagac

SEQ ID NO: 6430473 - DNA, 12 bp, Homo sapiens
tcaccaagctca

SEQ ID NO: 6430474 - DNA, 22 bp, Homo sapiens
tcaccaagctcacagttcctcg

SEQ ID NO: 6430475 - DNA, 11 bp, Homo sapiens
tcaccaaggaa

SEQ ID NO: 6430476 - DNA, 13 bp, Homo sapiens
tcaccaaggaaac

SEQ ID NO: 6430477 - DNA, 22 bp, Homo sapiens
tcaccaaggatcggactctgcc

SEQ ID NO: 6430478 - DNA, 17 bp, Homo sapiens
tcaccaaggcagtgcat

SEQ ID NO: 6430479 - DNA, 22 bp, Homo sapiens
tcaccaaggcagtgcatgcatg

SEQ ID NO: 6430480 - DNA, 14 bp, Homo sapiens
tcaccaaggctgat

SEQ ID NO: 6430481 - DNA, 16 bp, Homo sapiens
tcaccaaggtggcttc

SEQ ID NO: 6430482 - DNA, 16 bp, Homo sapiens
tcaccaagtaaatttg

SEQ ID NO: 6430483 - DNA, 18 bp, Homo sapiens
tcaccaagtgtattgtaa

SEQ ID NO: 6430484 - DNA, 12 bp, Homo sapiens
tcaccaataact

SEQ ID NO: 6430485 - DNA, 15 bp, Homo sapiens
tcaccaataacttca

SEQ ID NO: 6430486 - DNA, 19 bp, Homo sapiens
tcaccaataacttcagaga

SEQ ID NO: 6430487 - DNA, 15 bp, Homo sapiens
tcaccaatgtaccca

SEQ ID NO: 6430488 - DNA, 20 bp, Homo sapiens
tcaccaattccacttcctgc

SEQ ID NO: 6430489 - DNA, 20 bp, Homo sapiens
tcaccacaaccctgttgcta

SEQ ID NO: 6430490 - DNA, 19 bp, Homo sapiens
tcaccacacccaggtctct

SEQ ID NO: 6430491 - DNA, 21 bp, Homo sapiens
tcaccacacccaggtctcttc

SEQ ID NO: 6430492 - DNA, 12 bp, Homo sapiens
tcaccacagctg

SEQ ID NO: 6430493 - DNA, 14 bp, Homo sapiens
tcaccacagctgca

SEQ ID NO: 6430494 - DNA, 21 bp, Homo sapiens
tcaccacagtttattgatttc

SEQ ID NO: 6430495 - DNA, 14 bp, Homo sapiens
tcaccacatcttgt

SEQ ID NO: 6430496 - DNA, 19 bp, Homo sapiens
tcaccacatcttgtctttt

SEQ ID NO: 6430497 - DNA, 15 bp, Homo sapiens
tcaccacatctttta

SEQ ID NO: 6430498 - DNA, 20 bp, Homo sapiens
tcaccacatgcggagaacaa

SEQ ID NO: 6430499 - DNA, 24 bp, Homo sapiens
tcaccaccaataaatcagaccatg

SEQ ID NO: 6430500 - DNA, 17 bp, Homo sapiens
tcaccaccacacccctg

SEQ ID NO: 6430501 - DNA, 18 bp, Homo sapiens
tcaccaccacacccctgc

SEQ ID NO: 6430502 - DNA, 16 bp, Homo sapiens
tcaccaccacactaca

SEQ ID NO: 6430503 - DNA, 11 bp, Homo sapiens
tcaccacccag

SEQ ID NO: 6430504 - DNA, 11 bp, Homo sapiens
tcaccaccccc

SEQ ID NO: 6430505 - DNA, 18 bp, Homo sapiens
tcaccaccccctgtccca

SEQ ID NO: 6430506 - DNA, 22 bp, Homo sapiens
tcaccaccccctgtcccattct

SEQ ID NO: 6430507 - DNA, 20 bp, Homo sapiens
tcaccaccctgggacccccc

SEQ ID NO: 6430508 - DNA, 15 bp, Homo sapiens
tcaccaccgcctctg

SEQ ID NO: 6430509 - DNA, 18 bp, Homo sapiens
tcaccacgactggccagg

SEQ ID NO: 6430510 - DNA, 20 bp, Homo sapiens
tcaccacgactggccagggc

SEQ ID NO: 6430511 - DNA, 22 bp, Homo sapiens
tcaccacgatgacgcctctgga

SEQ ID NO: 6430512 - DNA, 16 bp, Homo sapiens
tcaccacgcagagagg

SEQ ID NO: 6430513 - DNA, 16 bp, Homo sapiens
tcaccacgtggggcca

SEQ ID NO: 6430514 - DNA, 19 bp, Homo sapiens
tcaccacgtggggccatgc

SEQ ID NO: 6430515 - DNA, 19 bp, Homo sapiens
tcaccactaccagccagcc

SEQ ID NO: 6430516 - DNA, 22 bp, Homo sapiens
tcaccactcaaaggccagacct

SEQ ID NO: 6430517 - DNA, 21 bp, Homo sapiens
tcaccactcctctcccttgag

SEQ ID NO: 6430518 - DNA, 16 bp, Homo sapiens
tcaccactgacagatg

SEQ ID NO: 6430519 - DNA, 16 bp, Homo sapiens
tcaccactgccccctg

SEQ ID NO: 6430520 - DNA, 21 bp, Homo sapiens
tcaccacttcaatagatcaaa

SEQ ID NO: 6430521 - DNA, 17 bp, Homo sapiens
tcaccagaaatgatagc

SEQ ID NO: 6430522 - DNA, 21 bp, Homo sapiens
tcaccagaattagtcctcaca

SEQ ID NO: 6430523 - DNA, 22 bp, Homo sapiens
tcaccagaattagtcctcacag

SEQ ID NO: 6430524 - DNA, 18 bp, Homo sapiens
tcaccagaattgtgcaaa

SEQ ID NO: 6430525 - DNA, 19 bp, Homo sapiens
tcaccagacggggctggag

SEQ ID NO: 6430526 - DNA, 14 bp, Homo sapiens
tcaccagagacttt

SEQ ID NO: 6430527 - DNA, 13 bp, Homo sapiens
tcaccagagccca

SEQ ID NO: 6430528 - DNA, 18 bp, Homo sapiens
tcaccagagcccatgctc

SEQ ID NO: 6430529 - DNA, 21 bp, Homo sapiens
tcaccagagcttctctgggct

SEQ ID NO: 6430530 - DNA, 19 bp, Homo sapiens
tcaccagaggaatcactct

SEQ ID NO: 6430531 - DNA, 18 bp, Homo sapiens
tcaccagatctgatttgt

SEQ ID NO: 6430532 - DNA, 15 bp, Homo sapiens
tcaccagatttgcta

SEQ ID NO: 6430533 - DNA, 15 bp, Homo sapiens
tcaccagcaacatct

SEQ ID NO: 6430534 - DNA, 12 bp, Homo sapiens
tcaccagcagca

SEQ ID NO: 6430535 - DNA, 21 bp, Homo sapiens
tcaccagcccatcgccacaaa

SEQ ID NO: 6430536 - DNA, 22 bp, Homo sapiens
tcaccagccccagtgcccacag

SEQ ID NO: 6430537 - DNA, 20 bp, Homo sapiens
tcaccagccccccgcgcgcc

SEQ ID NO: 6430538 - DNA, 16 bp, Homo sapiens
tcaccagccctgagcc

SEQ ID NO: 6430539 - DNA, 15 bp, Homo sapiens
tcaccagcctctgct

SEQ ID NO: 6430540 - DNA, 12 bp, Homo sapiens
tcaccagcctgt

SEQ ID NO: 6430541 - DNA, 12 bp, Homo sapiens
tcaccagccttg

SEQ ID NO: 6430542 - DNA, 18 bp, Homo sapiens
tcaccagctatctgtcat

SEQ ID NO: 6430543 - DNA, 15 bp, Homo sapiens
tcaccagctcagccc

SEQ ID NO: 6430544 - DNA, 22 bp, Homo sapiens
tcaccagctcagccccggccac

SEQ ID NO: 6430545 - DNA, 11 bp, Homo sapiens
tcaccagctgc

SEQ ID NO: 6430546 - DNA, 15 bp, Homo sapiens
tcaccagctgcaaag

SEQ ID NO: 6430547 - DNA, 17 bp, Homo sapiens
tcaccagctgcaaagtg

SEQ ID NO: 6430548 - DNA, 18 bp, Homo sapiens
tcaccagctgcaaagtgt

SEQ ID NO: 6430549 - DNA, 14 bp, Homo sapiens
tcaccagctgcctc

SEQ ID NO: 6430550 - DNA, 20 bp, Homo sapiens
tcaccagctgcctcttctgt

SEQ ID NO: 6430551 - DNA, 12 bp, Homo sapiens
tcaccagctgct

SEQ ID NO: 6430552 - DNA, 15 bp, Homo sapiens
tcaccaggatttata

SEQ ID NO: 6430553 - DNA, 17 bp, Homo sapiens
tcaccaggcagcctctg

SEQ ID NO: 6430554 - DNA, 12 bp, Homo sapiens
tcaccaggcctg

SEQ ID NO: 6430555 - DNA, 20 bp, Homo sapiens
tcaccaggcctggcctctgg

SEQ ID NO: 6430556 - DNA, 21 bp, Homo sapiens
tcaccaggctggagtgcagtg

SEQ ID NO: 6430557 - DNA, 18 bp, Homo sapiens
tcaccaggggaggagcct

SEQ ID NO: 6430558 - DNA, 15 bp, Homo sapiens
tcaccaggtgcatct

SEQ ID NO: 6430559 - DNA, 17 bp, Homo sapiens
tcaccaggtgcatgcat

SEQ ID NO: 6430560 - DNA, 18 bp, Homo sapiens
tcaccaggtgcatgcatg

SEQ ID NO: 6430561 - DNA, 21 bp, Homo sapiens
tcaccaggttaaaattttaat

SEQ ID NO: 6430562 - DNA, 17 bp, Homo sapiens
tcaccagtacattctca

SEQ ID NO: 6430563 - DNA, 19 bp, Homo sapiens
tcaccagtacattctcagt

SEQ ID NO: 6430564 - DNA, 23 bp, Homo sapiens
tcaccagtgcatcacatctgcac

SEQ ID NO: 6430565 - DNA, 19 bp, Homo sapiens
tcaccagtgcatccttcat

SEQ ID NO: 6430566 - DNA, 12 bp, Homo sapiens
tcaccagtgcca

SEQ ID NO: 6430567 - DNA, 14 bp, Homo sapiens
tcaccagtggcctt

SEQ ID NO: 6430568 - DNA, 22 bp, Homo sapiens
tcaccagtggccttacccctgc

SEQ ID NO: 6430569 - DNA, 15 bp, Homo sapiens
tcaccagtggccttt

SEQ ID NO: 6430570 - DNA, 17 bp, Homo sapiens
tcaccagtggcctttca

SEQ ID NO: 6430571 - DNA, 21 bp, Homo sapiens
tcaccagtgtcccctccactg

SEQ ID NO: 6430572 - DNA, 13 bp, Homo sapiens
tcaccagtgttcc

SEQ ID NO: 6430573 - DNA, 17 bp, Homo sapiens
tcaccagtgttcctgaa

SEQ ID NO: 6430574 - DNA, 23 bp, Homo sapiens
tcaccagtgttcctgaagctgct

SEQ ID NO: 6430575 - DNA, 14 bp, Homo sapiens
tcaccataacctct

SEQ ID NO: 6430576 - DNA, 17 bp, Homo sapiens
tcaccatagttttgttt

SEQ ID NO: 6430577 - DNA, 17 bp, Homo sapiens
tcaccatatttgaattg

SEQ ID NO: 6430578 - DNA, 18 bp, Homo sapiens
tcaccatccaccttccct

SEQ ID NO: 6430579 - DNA, 14 bp, Homo sapiens
tcaccatccagtgg

SEQ ID NO: 6430580 - DNA, 18 bp, Homo sapiens
tcaccatccagtgggccc

SEQ ID NO: 6430581 - DNA, 12 bp, Homo sapiens
tcaccatcctca

SEQ ID NO: 6430582 - DNA, 15 bp, Homo sapiens
tcaccatcctcagag

SEQ ID NO: 6430583 - DNA, 18 bp, Homo sapiens
aagaaagtgtatttggaa

SEQ ID NO: 6430584 - DNA, 21 bp, Homo sapiens
aagaaagtgttttattttcaa

SEQ ID NO: 6430585 - DNA, 22 bp, Homo sapiens
aagaaagtgttttattttcaaa

SEQ ID NO: 6430586 - DNA, 21 bp, Homo sapiens
aagaaagttaggttataagaa

SEQ ID NO: 6430587 - DNA, 19 bp, Homo sapiens
aagaaagttattcttggta

SEQ ID NO: 6430588 - DNA, 16 bp, Homo sapiens
aagaaagttctacagt

SEQ ID NO: 6430589 - DNA, 23 bp, Homo sapiens
aagaaagtttccccaccagtgaa

SEQ ID NO: 6430590 - DNA, 13 bp, Homo sapiens
aagaaataaaaat

SEQ ID NO: 6430591 - DNA, 21 bp, Homo sapiens
aagaaataaaaggaagccaaa

SEQ ID NO: 6430592 - DNA, 13 bp, Homo sapiens
aagaaataaatca

SEQ ID NO: 6430593 - DNA, 14 bp, Homo sapiens
aagaaataaatcag

SEQ ID NO: 6430594 - DNA, 13 bp, Homo sapiens
aagaaataaatga

SEQ ID NO: 6430595 - DNA, 12 bp, Homo sapiens
aagaaataataa

SEQ ID NO: 6430596 - DNA, 13 bp, Homo sapiens
aagaaataataat

SEQ ID NO: 6430597 - DNA, 19 bp, Homo sapiens
aagaaataatgctacaatt

SEQ ID NO: 6430598 - DNA, 15 bp, Homo sapiens
aagaaataatttttc

SEQ ID NO: 6430599 - DNA, 17 bp, Homo sapiens
aagaaatactaatgtaa

SEQ ID NO: 6430600 - DNA, 13 bp, Homo sapiens
aagaaatactgta

SEQ ID NO: 6430601 - DNA, 14 bp, Homo sapiens
aagaaatagaacaa

SEQ ID NO: 6430602 - DNA, 12 bp, Homo sapiens
aagaaatagaat

SEQ ID NO: 6430603 - DNA, 22 bp, Homo sapiens
aagaaatataaacacaaatata

SEQ ID NO: 6430604 - DNA, 15 bp, Homo sapiens
aagaaatatattttt

SEQ ID NO: 6430605 - DNA, 15 bp, Homo sapiens
aagaaatatctgtga

SEQ ID NO: 6430606 - DNA, 18 bp, Homo sapiens
aagaaatatctgtgaaat

SEQ ID NO: 6430607 - DNA, 11 bp, Homo sapiens
aagaaatatgt

SEQ ID NO: 6430608 - DNA, 13 bp, Homo sapiens
aagaaatattaac

SEQ ID NO: 6430609 - DNA, 20 bp, Homo sapiens
aagaaatattaatatgtact

SEQ ID NO: 6430610 - DNA, 15 bp, Homo sapiens
aagaaatcaattttt

SEQ ID NO: 6430611 - DNA, 12 bp, Homo sapiens
aagaaatcatgt

SEQ ID NO: 6430612 - DNA, 16 bp, Homo sapiens
aagaaatcatgtccat

SEQ ID NO: 6430613 - DNA, 21 bp, Homo sapiens
aagaaatcatgttatgataaa

SEQ ID NO: 6430614 - DNA, 14 bp, Homo sapiens
aagaaatccctgtt

SEQ ID NO: 6430615 - DNA, 23 bp, Homo sapiens
aagaaatccctgtttaatattta

SEQ ID NO: 6430616 - DNA, 17 bp, Homo sapiens
aagaaatcgccttatga

SEQ ID NO: 6430617 - DNA, 20 bp, Homo sapiens
aagaaatctcctaacaaaag

SEQ ID NO: 6430618 - DNA, 20 bp, Homo sapiens
aagaaatctggcccagggtg

SEQ ID NO: 6430619 - DNA, 15 bp, Homo sapiens
aagaaatcttgtctt

SEQ ID NO: 6430620 - DNA, 19 bp, Homo sapiens
aagaaatcttgtcttacca

SEQ ID NO: 6430621 - DNA, 16 bp, Homo sapiens
aagaaatgaaacatcc

SEQ ID NO: 6430622 - DNA, 20 bp, Homo sapiens
aagaaatgaaattttaccaa

SEQ ID NO: 6430623 - DNA, 14 bp, Homo sapiens
aagaaatgaacatt

SEQ ID NO: 6430624 - DNA, 16 bp, Homo sapiens
aagaaatgaacattcc

SEQ ID NO: 6430625 - DNA, 12 bp, Homo sapiens
aagaaatgagaa

SEQ ID NO: 6430626 - DNA, 15 bp, Homo sapiens
aagaaatgagaaatt

SEQ ID NO: 6430627 - DNA, 22 bp, Homo sapiens
aagaaatgagaaattgtgccaa

SEQ ID NO: 6430628 - DNA, 11 bp, Homo sapiens
aagaaatgatt

SEQ ID NO: 6430629 - DNA, 13 bp, Homo sapiens
aagaaatgcacaa

SEQ ID NO: 6430630 - DNA, 14 bp, Homo sapiens
aagaaatgcacaat

SEQ ID NO: 6430631 - DNA, 19 bp, Homo sapiens
aagaaatggaatgaatctc

SEQ ID NO: 6430632 - DNA, 20 bp, Homo sapiens
aagaaatggcgtctgctctg

SEQ ID NO: 6430633 - DNA, 17 bp, Homo sapiens
aagaaatggctttccac

SEQ ID NO: 6430634 - DNA, 17 bp, Homo sapiens
aagaaatgggactctga

SEQ ID NO: 6430635 - DNA, 18 bp, Homo sapiens
aagaaatgggactctgaa

SEQ ID NO: 6430636 - DNA, 16 bp, Homo sapiens
aagaaatgggcctgcc

SEQ ID NO: 6430637 - DNA, 13 bp, Homo sapiens
aagaaatgtaagg

SEQ ID NO: 6430638 - DNA, 16 bp, Homo sapiens
aagaaatgtagctgaa

SEQ ID NO: 6430639 - DNA, 20 bp, Homo sapiens
aagaaatgtattcctgaaaa

SEQ ID NO: 6430640 - DNA, 14 bp, Homo sapiens
aagaaatgttataa

SEQ ID NO: 6430641 - DNA, 22 bp, Homo sapiens
aagaaatgtttatacaataatt

SEQ ID NO: 6430642 - DNA, 13 bp, Homo sapiens
aagaaattaactt

SEQ ID NO: 6430643 - DNA, 17 bp, Homo sapiens
aagaaattataaagata

SEQ ID NO: 6430644 - DNA, 19 bp, Homo sapiens
aagaaattcaagaagtatt

SEQ ID NO: 6430645 - DNA, 21 bp, Homo sapiens
aagaaattcaggtacagaaaa

SEQ ID NO: 6430646 - DNA, 15 bp, Homo sapiens
aagaaattccctgga

SEQ ID NO: 6430647 - DNA, 15 bp, Homo sapiens
aagaaattcctagtg

SEQ ID NO: 6430648 - DNA, 17 bp, Homo sapiens
aagaaattcctgtagca

SEQ ID NO: 6430649 - DNA, 23 bp, Homo sapiens
aagaaattcgcatgtttaatgtg

SEQ ID NO: 6430650 - DNA, 22 bp, Homo sapiens
aagaaattgaatactttgaatg

SEQ ID NO: 6430651 - DNA, 20 bp, Homo sapiens
aagaaattgtccttgaagct

SEQ ID NO: 6430652 - DNA, 17 bp, Homo sapiens
aagaaatttaaaagaca

SEQ ID NO: 6430653 - DNA, 16 bp, Homo sapiens
aagaaatttactatat

SEQ ID NO: 6430654 - DNA, 21 bp, Homo sapiens
aagaaatttccactcaggtct

SEQ ID NO: 6430655 - DNA, 21 bp, Homo sapiens
aagaaatttccggaagtaaat

SEQ ID NO: 6430656 - DNA, 14 bp, Homo sapiens
aagaaatttgaaaa

SEQ ID NO: 6430657 - DNA, 11 bp, Homo sapiens
aagaaatttta

SEQ ID NO: 6430658 - DNA, 14 bp, Homo sapiens
aagaaattttagta

SEQ ID NO: 6430659 - DNA, 12 bp, Homo sapiens
aagaaattttat

SEQ ID NO: 6430660 - DNA, 12 bp, Homo sapiens
aagaacaaaact

SEQ ID NO: 6430661 - DNA, 21 bp, Homo sapiens
aagaacaaagagaaaaaatac

SEQ ID NO: 6430662 - DNA, 12 bp, Homo sapiens
aagaacaaagta

SEQ ID NO: 6430663 - DNA, 18 bp, Homo sapiens
aagaacaacaaagacatg

SEQ ID NO: 6430664 - DNA, 14 bp, Homo sapiens
aagaacaacaacaa

SEQ ID NO: 6430665 - DNA, 13 bp, Homo sapiens
aagaacaacactt

SEQ ID NO: 6430666 - DNA, 21 bp, Homo sapiens
aagaacaataatgagagcaaa

SEQ ID NO: 6430667 - DNA, 16 bp, Homo sapiens
aagaacaatagaactg

SEQ ID NO: 6430668 - DNA, 21 bp, Homo sapiens
aagaacaatattgactttgtc

SEQ ID NO: 6430669 - DNA, 12 bp, Homo sapiens
aagaacacaaga

SEQ ID NO: 6430670 - DNA, 15 bp, Homo sapiens
aagaacacacacata

SEQ ID NO: 6430671 - DNA, 15 bp, Homo sapiens
aagaacacagcatgt

SEQ ID NO: 6430672 - DNA, 13 bp, Homo sapiens
aagaacacatttt

SEQ ID NO: 6430673 - DNA, 16 bp, Homo sapiens
aagaacagaacagcaa

SEQ ID NO: 6430674 - DNA, 13 bp, Homo sapiens
aagaacagccccg

SEQ ID NO: 6430675 - DNA, 20 bp, Homo sapiens
aagaacagctaacaataaag

SEQ ID NO: 6430676 - DNA, 15 bp, Homo sapiens
aagaacagctcatct

SEQ ID NO: 6430677 - DNA, 12 bp, Homo sapiens
aagaacaggcct

SEQ ID NO: 6430678 - DNA, 13 bp, Homo sapiens
aagaacaggcctc

SEQ ID NO: 6430679 - DNA, 13 bp, Homo sapiens
aagaacagtgttg

SEQ ID NO: 6430680 - DNA, 18 bp, Homo sapiens
aagaacatacatgataca

SEQ ID NO: 6430681 - DNA, 16 bp, Homo sapiens
aagaacatagaactct

SEQ ID NO: 6430682 - DNA, 16 bp, Homo sapiens
aagaacatgaatctct

SEQ ID NO: 6430683 - DNA, 21 bp, Homo sapiens
aagaacatggacttgtatatt

SEQ ID NO: 6430684 - DNA, 12 bp, Homo sapiens
aagaacatgtta

SEQ ID NO: 6430685 - DNA, 11 bp, Homo sapiens
aagaacattta

SEQ ID NO: 6430686 - DNA, 12 bp, Homo sapiens
aagaacatttaa

SEQ ID NO: 6430687 - DNA, 22 bp, Homo sapiens
aagaacatttaaaattaaataa

SEQ ID NO: 6430688 - DNA, 14 bp, Homo sapiens
aagaacattttata

SEQ ID NO: 6430689 - DNA, 17 bp, Homo sapiens
aagaaccaaaacttcca

SEQ ID NO: 6430690 - DNA, 19 bp, Homo sapiens
aagaaccaaactcctattt

SEQ ID NO: 6430691 - DNA, 21 bp, Homo sapiens
aagaaccaaactcctatttca

SEQ ID NO: 6430692 - DNA, 15 bp, Homo sapiens
aagaaccaaatacct

SEQ ID NO: 6430693 - DNA, 17 bp, Homo sapiens
aagaaccaaatacctca

SEQ ID NO: 6430694 - DNA, 14 bp, Homo sapiens
aagaaccagcccag

SEQ ID NO: 6430695 - DNA, 17 bp, Homo sapiens
aagaaccagtcccccca

SEQ ID NO: 6430696 - DNA, 12 bp, Homo sapiens
aagaaccatctt

SEQ ID NO: 6430697 - DNA, 24 bp, Homo sapiens
aagaaccatgcaggaaggaaaact

SEQ ID NO: 6430698 - DNA, 18 bp, Homo sapiens
aagaacccccctccccaa

SEQ ID NO: 6430699 - DNA, 21 bp, Homo sapiens
aagaacccctcgttagccttc

SEQ ID NO: 6430700 - DNA, 13 bp, Homo sapiens
aagaacccctctg

SEQ ID NO: 6430701 - DNA, 16 bp, Homo sapiens
aagaacccctctgtct

SEQ ID NO: 6430702 - DNA, 19 bp, Homo sapiens
aagaaccctatttaaaact

SEQ ID NO: 6430703 - DNA, 15 bp, Homo sapiens
aagaacctatatctt

SEQ ID NO: 6430704 - DNA, 21 bp, Homo sapiens
aagaacctgtagaagatgacc

SEQ ID NO: 6430705 - DNA, 23 bp, Homo sapiens
aagaacgaacacaagaaaaagat

SEQ ID NO: 6430706 - DNA, 14 bp, Homo sapiens
aagaacggaagaag

SEQ ID NO: 6430707 - DNA, 17 bp, Homo sapiens
aagaacggggctcttct

SEQ ID NO: 6430708 - DNA, 18 bp, Homo sapiens
aagaacggggctcttctc

SEQ ID NO: 6430709 - DNA, 22 bp, Homo sapiens
aagaacggggctcttctcattt

SEQ ID NO: 6430710 - DNA, 22 bp, Homo sapiens
aagaactaaggatttttccatg

SEQ ID NO: 6430711 - DNA, 14 bp, Homo sapiens
aagaactaataaat

SEQ ID NO: 6430712 - DNA, 15 bp, Homo sapiens
aagaactaataaatg

SEQ ID NO: 6430713 - DNA, 22 bp, Homo sapiens
aagaactataaacttaaagcta

SEQ ID NO: 6430714 - DNA, 14 bp, Homo sapiens
aagaactatattta

SEQ ID NO: 6430715 - DNA, 14 bp, Homo sapiens
aagaactatcttca

SEQ ID NO: 6430716 - DNA, 23 bp, Homo sapiens
aagaactattgtgctcagagaca

SEQ ID NO: 6430717 - DNA, 14 bp, Homo sapiens
aagaactattgtgt

SEQ ID NO: 6430718 - DNA, 18 bp, Homo sapiens
aagaactattgtgttttt

SEQ ID NO: 6430719 - DNA, 14 bp, Homo sapiens
aagaactcattatt

SEQ ID NO: 6430720 - DNA, 15 bp, Homo sapiens
aagaactccagagtc

SEQ ID NO: 6430721 - DNA, 11 bp, Homo sapiens
aagaactctaa

SEQ ID NO: 6430722 - DNA, 17 bp, Homo sapiens
aagaactctaaccagtg

SEQ ID NO: 6430723 - DNA, 23 bp, Homo sapiens
aagaactctaaccagtgtacagg

SEQ ID NO: 6430724 - DNA, 16 bp, Homo sapiens
aagaactgaaaacata

SEQ ID NO: 6430725 - DNA, 13 bp, Homo sapiens
aagaactgaaatc

SEQ ID NO: 6430726 - DNA, 15 bp, Homo sapiens
aagaactgaaatcat

SEQ ID NO: 6430727 - DNA, 19 bp, Homo sapiens
aagaactgcacatgaagaa

SEQ ID NO: 6430728 - DNA, 18 bp, Homo sapiens
aagaactgcatggaccta

SEQ ID NO: 6430729 - DNA, 18 bp, Homo sapiens
aagaactgccccatctcc

SEQ ID NO: 6430730 - DNA, 14 bp, Homo sapiens
aagaactgtacatt

SEQ ID NO: 6430731 - DNA, 20 bp, Homo sapiens
aagaactgtcatgtaaacat

SEQ ID NO: 6430732 - DNA, 12 bp, Homo sapiens
aagaactgtgtc

SEQ ID NO: 6430733 - DNA, 15 bp, Homo sapiens
aagaacttaagtctc

SEQ ID NO: 6430734 - DNA, 12 bp, Homo sapiens
aagaacttcatt

SEQ ID NO: 6430735 - DNA, 17 bp, Homo sapiens
aagaacttcatttttaa

SEQ ID NO: 6430736 - DNA, 17 bp, Homo sapiens
aagaacttctataattg

SEQ ID NO: 6430737 - DNA, 16 bp, Homo sapiens
aagaacttgaagtgaa

SEQ ID NO: 6430738 - DNA, 20 bp, Homo sapiens
aagaacttgatatatttcat

SEQ ID NO: 6430739 - DNA, 22 bp, Homo sapiens
aagaacttgatttgcatggatt

SEQ ID NO: 6430740 - DNA, 14 bp, Homo sapiens
aagaacttgctgct

SEQ ID NO: 6430741 - DNA, 17 bp, Homo sapiens
aagaacttgctgctgcc

SEQ ID NO: 6430742 - DNA, 19 bp, Homo sapiens
aagaacttgctgctgcctt

SEQ ID NO: 6430743 - DNA, 15 bp, Homo sapiens
aagaacttgtttaat

SEQ ID NO: 6430744 - DNA, 15 bp, Homo sapiens
aagaacttgtttaca

SEQ ID NO: 6430745 - DNA, 13 bp, Homo sapiens
aagaactttgagc

SEQ ID NO: 6430746 - DNA, 20 bp, Homo sapiens
aagaactttgagctactgcc

SEQ ID NO: 6430747 - DNA, 20 bp, Homo sapiens
aagaactttgccttaagttt

SEQ ID NO: 6430748 - DNA, 12 bp, Homo sapiens
aagaagaaaaag

SEQ ID NO: 6430749 - DNA, 21 bp, Homo sapiens
aagaagaaaagagaagaagaa

SEQ ID NO: 6430750 - DNA, 14 bp, Homo sapiens
aagaagaaactatt

SEQ ID NO: 6430751 - DNA, 15 bp, Homo sapiens
aagaagaaactattt

SEQ ID NO: 6430752 - DNA, 22 bp, Homo sapiens
aagaagaaactattttttaaaa

SEQ ID NO: 6430753 - DNA, 23 bp, Homo sapiens
aagaagaaactccgaagaaaaga

SEQ ID NO: 6430754 - DNA, 13 bp, Homo sapiens
aagaagaaagcaa

SEQ ID NO: 6430755 - DNA, 11 bp, Homo sapiens
aagaagaaata

SEQ ID NO: 6430756 - DNA, 17 bp, Homo sapiens
aagaagaaccagcccag

SEQ ID NO: 6430757 - DNA, 21 bp, Homo sapiens
aagaagaaccagcccagcctg

SEQ ID NO: 6430758 - DNA, 21 bp, Homo sapiens
aagaagaactcaccagggttt

SEQ ID NO: 6430759 - DNA, 15 bp, Homo sapiens
aagaagaagaaaaga

SEQ ID NO: 6430760 - DNA, 15 bp, Homo sapiens
aagaagaaggccaga

SEQ ID NO: 6430761 - DNA, 13 bp, Homo sapiens
aagaagaatgtta

SEQ ID NO: 6430762 - DNA, 15 bp, Homo sapiens
aagaagacaaacttt

SEQ ID NO: 6430763 - DNA, 16 bp, Homo sapiens
aagaagacaaactttg

SEQ ID NO: 6430764 - DNA, 21 bp, Homo sapiens
aagaagacaaagtctaaggaa

SEQ ID NO: 6430765 - DNA, 19 bp, Homo sapiens
tcaccatcctcagaggctg

SEQ ID NO: 6430766 - DNA, 16 bp, Homo sapiens
tcaccatcggactcat

SEQ ID NO: 6430767 - DNA, 15 bp, Homo sapiens
tcaccatctcaggcc

SEQ ID NO: 6430768 - DNA, 16 bp, Homo sapiens
tcaccatctcaggcca

SEQ ID NO: 6430769 - DNA, 20 bp, Homo sapiens
tcaccatctcttcattcaaa

SEQ ID NO: 6430770 - DNA, 22 bp, Homo sapiens
tcaccatctcttcattcaaact

SEQ ID NO: 6430771 - DNA, 14 bp, Homo sapiens
tcaccatctgtgca

SEQ ID NO: 6430772 - DNA, 13 bp, Homo sapiens
tcaccatcttgaa

SEQ ID NO: 6430773 - DNA, 16 bp, Homo sapiens
tcaccatcttggccag

SEQ ID NO: 6430774 - DNA, 20 bp, Homo sapiens
tcaccatcttggccaggctg

SEQ ID NO: 6430775 - DNA, 15 bp, Homo sapiens
tcaccatctttctaa

SEQ ID NO: 6430776 - DNA, 16 bp, Homo sapiens
tcaccatctttctaat

SEQ ID NO: 6430777 - DNA, 17 bp, Homo sapiens
tcaccatctttgtcaaa

SEQ ID NO: 6430778 - DNA, 19 bp, Homo sapiens
tcaccatctttgtcaaact

SEQ ID NO: 6430779 - DNA, 14 bp, Homo sapiens
tcaccatgatgggg

SEQ ID NO: 6430780 - DNA, 11 bp, Homo sapiens
tcaccatgcaa

SEQ ID NO: 6430781 - DNA, 21 bp, Homo sapiens
tcaccatgcaagggtgacatc

SEQ ID NO: 6430782 - DNA, 16 bp, Homo sapiens
tcaccatgcaggcaac

SEQ ID NO: 6430783 - DNA, 16 bp, Homo sapiens
tcaccatgcttccagc

SEQ ID NO: 6430784 - DNA, 11 bp, Homo sapiens
tcaccatggcc

SEQ ID NO: 6430785 - DNA, 22 bp, Homo sapiens
tcaccatgggaggtggggcctc

SEQ ID NO: 6430786 - DNA, 13 bp, Homo sapiens
tcaccatgtattt

SEQ ID NO: 6430787 - DNA, 18 bp, Homo sapiens
tcaccatgtgagctcttc

SEQ ID NO: 6430788 - DNA, 14 bp, Homo sapiens
tcaccatgttagcc

SEQ ID NO: 6430789 - DNA, 19 bp, Homo sapiens
tcaccatgttgcccaggag

SEQ ID NO: 6430790 - DNA, 21 bp, Homo sapiens
tcaccatgttggccaggctgt

SEQ ID NO: 6430791 - DNA, 17 bp, Homo sapiens
tcaccattatgctggtg

SEQ ID NO: 6430792 - DNA, 22 bp, Homo sapiens
tcaccattcaaacaggtcgagc

SEQ ID NO: 6430793 - DNA, 15 bp, Homo sapiens
tcaccattctgcatt

SEQ ID NO: 6430794 - DNA, 20 bp, Homo sapiens
tcaccattctgcatttagct

SEQ ID NO: 6430795 - DNA, 22 bp, Homo sapiens
tcaccattgtgaagcacctact

SEQ ID NO: 6430796 - DNA, 15 bp, Homo sapiens
tcaccatttaatcat

SEQ ID NO: 6430797 - DNA, 21 bp, Homo sapiens
tcaccatttaatcatttccag

SEQ ID NO: 6430798 - DNA, 12 bp, Homo sapiens
tcaccatttcat

SEQ ID NO: 6430799 - DNA, 21 bp, Homo sapiens
tcaccatttcatccatatttc

SEQ ID NO: 6430800 - DNA, 17 bp, Homo sapiens
tcaccatttccccaggg

SEQ ID NO: 6430801 - DNA, 20 bp, Homo sapiens
tcaccatttccccagggcac

SEQ ID NO: 6430802 - DNA, 14 bp, Homo sapiens
tcaccatttcttgg

SEQ ID NO: 6430803 - DNA, 15 bp, Homo sapiens
tcacccaaaagcaca

SEQ ID NO: 6430804 - DNA, 16 bp, Homo sapiens
tcacccaaaagcacaa

SEQ ID NO: 6430805 - DNA, 20 bp, Homo sapiens
tcacccaaacacttctgctt

SEQ ID NO: 6430806 - DNA, 19 bp, Homo sapiens
tcacccaagagattgttgt

SEQ ID NO: 6430807 - DNA, 19 bp, Homo sapiens
tcacccaagcaaggccaaa

SEQ ID NO: 6430808 - DNA, 16 bp, Homo sapiens
tcacccaagccacaag

SEQ ID NO: 6430809 - DNA, 19 bp, Homo sapiens
tcacccaagccacaagctg

SEQ ID NO: 6430810 - DNA, 20 bp, Homo sapiens
tcacccacaaccctctggaa

SEQ ID NO: 6430811 - DNA, 16 bp, Homo sapiens
tcacccacagaaagag

SEQ ID NO: 6430812 - DNA, 17 bp, Homo sapiens
tcacccacagaaagaga

SEQ ID NO: 6430813 - DNA, 14 bp, Homo sapiens
tcacccacagggct

SEQ ID NO: 6430814 - DNA, 21 bp, Homo sapiens
tcacccaccacccccatcatc

SEQ ID NO: 6430815 - DNA, 20 bp, Homo sapiens
tcacccaccaggccagctca

SEQ ID NO: 6430816 - DNA, 14 bp, Homo sapiens
tcacccaccatgga

SEQ ID NO: 6430817 - DNA, 14 bp, Homo sapiens
tcacccacccctgc

SEQ ID NO: 6430818 - DNA, 13 bp, Homo sapiens
tcacccactctgc

SEQ ID NO: 6430819 - DNA, 17 bp, Homo sapiens
tcacccactctggtggc

SEQ ID NO: 6430820 - DNA, 23 bp, Homo sapiens
tcacccactctggtggccacttc

SEQ ID NO: 6430821 - DNA, 18 bp, Homo sapiens
tcacccactgctgcacct

SEQ ID NO: 6430822 - DNA, 12 bp, Homo sapiens
tcacccagaatc

SEQ ID NO: 6430823 - DNA, 20 bp, Homo sapiens
tcacccagaatccctctaac

SEQ ID NO: 6430824 - DNA, 19 bp, Homo sapiens
tcacccagacataaaggaa

SEQ ID NO: 6430825 - DNA, 13 bp, Homo sapiens
tcacccagactag

SEQ ID NO: 6430826 - DNA, 13 bp, Homo sapiens
tcacccagcaccc

SEQ ID NO: 6430827 - DNA, 23 bp, Homo sapiens
tcacccaggctctggagccagag

SEQ ID NO: 6430828 - DNA, 14 bp, Homo sapiens
tcacccaggctgga

SEQ ID NO: 6430829 - DNA, 19 bp, Homo sapiens
tcacccaggctggagtgca

SEQ ID NO: 6430830 - DNA, 21 bp, Homo sapiens
tcacccagggacactccaact

SEQ ID NO: 6430831 - DNA, 16 bp, Homo sapiens
tcacccagtccccacc

SEQ ID NO: 6430832 - DNA, 23 bp, Homo sapiens
tcacccagtccccacccgcctgc

SEQ ID NO: 6430833 - DNA, 15 bp, Homo sapiens
tcacccagtcctggc

SEQ ID NO: 6430834 - DNA, 13 bp, Homo sapiens
tcacccataaaca

SEQ ID NO: 6430835 - DNA, 22 bp, Homo sapiens
tcacccataaacagtaatgact

SEQ ID NO: 6430836 - DNA, 14 bp, Homo sapiens
tcacccatcctagg

SEQ ID NO: 6430837 - DNA, 23 bp, Homo sapiens
tcacccatcctaggaaccagcca

SEQ ID NO: 6430838 - DNA, 21 bp, Homo sapiens
tcacccatgcaagcagaggac

SEQ ID NO: 6430839 - DNA, 22 bp, Homo sapiens
tcacccatgcatcttccactgg

SEQ ID NO: 6430840 - DNA, 15 bp, Homo sapiens
tcacccattatctgg

SEQ ID NO: 6430841 - DNA, 18 bp, Homo sapiens
tcacccattgtctcattg

SEQ ID NO: 6430842 - DNA, 21 bp, Homo sapiens
tcaccccaaacccagaacatg

SEQ ID NO: 6430843 - DNA, 13 bp, Homo sapiens
tcaccccaatccc

SEQ ID NO: 6430844 - DNA, 20 bp, Homo sapiens
tcaccccaatccctgccact

SEQ ID NO: 6430845 - DNA, 13 bp, Homo sapiens
tcaccccagagcc

SEQ ID NO: 6430846 - DNA, 14 bp, Homo sapiens
tcaccccagagcca

SEQ ID NO: 6430847 - DNA, 14 bp, Homo sapiens
tcaccccagcccca

SEQ ID NO: 6430848 - DNA, 20 bp, Homo sapiens
tcaccccagccccaaaactc

SEQ ID NO: 6430849 - DNA, 16 bp, Homo sapiens
tcaccccagcccccac

SEQ ID NO: 6430850 - DNA, 12 bp, Homo sapiens
tcaccccagctc

SEQ ID NO: 6430851 - DNA, 13 bp, Homo sapiens
tcaccccagctcc

SEQ ID NO: 6430852 - DNA, 18 bp, Homo sapiens
tcaccccatccacatggg

SEQ ID NO: 6430853 - DNA, 19 bp, Homo sapiens
tcaccccatcccacaccct

SEQ ID NO: 6430854 - DNA, 12 bp, Homo sapiens
tcacccccaact

SEQ ID NO: 6430855 - DNA, 22 bp, Homo sapiens
tcacccccaacttcaccacccc

SEQ ID NO: 6430856 - DNA, 13 bp, Homo sapiens
tcacccccacccc

SEQ ID NO: 6430857 - DNA, 18 bp, Homo sapiens
tcacccccacccctgtac

SEQ ID NO: 6430858 - DNA, 23 bp, Homo sapiens
tcacccccacccctgtacccagc

SEQ ID NO: 6430859 - DNA, 15 bp, Homo sapiens
tcacccccactcccg

SEQ ID NO: 6430860 - DNA, 17 bp, Homo sapiens
tcacccccactcccgcc

SEQ ID NO: 6430861 - DNA, 13 bp, Homo sapiens
tcacccccagctt

SEQ ID NO: 6430862 - DNA, 18 bp, Homo sapiens
tcacccccagctttgcta

SEQ ID NO: 6430863 - DNA, 12 bp, Homo sapiens
tcacccccagga

SEQ ID NO: 6430864 - DNA, 13 bp, Homo sapiens
tcacccccaggac

SEQ ID NO: 6430865 - DNA, 12 bp, Homo sapiens
tcacccccatcc

SEQ ID NO: 6430866 - DNA, 14 bp, Homo sapiens
tcacccccatccac

SEQ ID NO: 6430867 - DNA, 22 bp, Homo sapiens
tcacccccatggccccaggccc

SEQ ID NO: 6430868 - DNA, 14 bp, Homo sapiens
tcacccccccaggc

SEQ ID NO: 6430869 - DNA, 15 bp, Homo sapiens
tcacccccccaggcc

SEQ ID NO: 6430870 - DNA, 20 bp, Homo sapiens
tcacccccccaggcctccag

SEQ ID NO: 6430871 - DNA, 15 bp, Homo sapiens
tcaccccccgacctg

SEQ ID NO: 6430872 - DNA, 21 bp, Homo sapiens
tcaccccctccctacacacac

SEQ ID NO: 6430873 - DNA, 22 bp, Homo sapiens
tcaccccctccctacacacaca

SEQ ID NO: 6430874 - DNA, 13 bp, Homo sapiens
tcaccccctcctg

SEQ ID NO: 6430875 - DNA, 15 bp, Homo sapiens
tcaccccctcctggc

SEQ ID NO: 6430876 - DNA, 16 bp, Homo sapiens
tcaccccctcctggca

SEQ ID NO: 6430877 - DNA, 14 bp, Homo sapiens
tcaccccctcgggt

SEQ ID NO: 6430878 - DNA, 22 bp, Homo sapiens
tcacccccttctccatccacat

SEQ ID NO: 6430879 - DNA, 16 bp, Homo sapiens
tcaccccgaggccctg

SEQ ID NO: 6430880 - DNA, 17 bp, Homo sapiens
tcaccccgaggccctgc

SEQ ID NO: 6430881 - DNA, 16 bp, Homo sapiens
tcaccccgccagccta

SEQ ID NO: 6430882 - DNA, 17 bp, Homo sapiens
tcaccccgccagcctac

SEQ ID NO: 6430883 - DNA, 23 bp, Homo sapiens
tcaccccgctgtaagctcctttg

SEQ ID NO: 6430884 - DNA, 17 bp, Homo sapiens
tcaccccggcaggccct

SEQ ID NO: 6430885 - DNA, 17 bp, Homo sapiens
tcaccccggccacctgc

SEQ ID NO: 6430886 - DNA, 17 bp, Homo sapiens
tcacccctagccctggt

SEQ ID NO: 6430887 - DNA, 14 bp, Homo sapiens
tcacccctcccctg

SEQ ID NO: 6430888 - DNA, 20 bp, Homo sapiens
tcacccctccctttctcccc

SEQ ID NO: 6430889 - DNA, 11 bp, Homo sapiens
tcacccctctg

SEQ ID NO: 6430890 - DNA, 13 bp, Homo sapiens
tcacccctctgcc

SEQ ID NO: 6430891 - DNA, 17 bp, Homo sapiens
tcacccctctgcccctg

SEQ ID NO: 6430892 - DNA, 14 bp, Homo sapiens
tcacccctcttccc

SEQ ID NO: 6430893 - DNA, 12 bp, Homo sapiens
tcacccctgccc

SEQ ID NO: 6430894 - DNA, 22 bp, Homo sapiens
tcacccctgcccctgtgggact

SEQ ID NO: 6430895 - DNA, 16 bp, Homo sapiens
tcacccctgccctggg

SEQ ID NO: 6430896 - DNA, 15 bp, Homo sapiens
tcacccctgggcagg

SEQ ID NO: 6430897 - DNA, 17 bp, Homo sapiens
tcacccctggtggctgc

SEQ ID NO: 6430898 - DNA, 16 bp, Homo sapiens
tcacccctgtcctcac

SEQ ID NO: 6430899 - DNA, 16 bp, Homo sapiens
tcaccccttatcctga

SEQ ID NO: 6430900 - DNA, 12 bp, Homo sapiens
tcaccccttccc

SEQ ID NO: 6430901 - DNA, 14 bp, Homo sapiens
tcaccccttccttt

SEQ ID NO: 6430902 - DNA, 19 bp, Homo sapiens
tcacccctttctgtcccac

SEQ ID NO: 6430903 - DNA, 21 bp, Homo sapiens
tcacccgatcgccagcaaaac

SEQ ID NO: 6430904 - DNA, 19 bp, Homo sapiens
tcacccgctaagagggagg

SEQ ID NO: 6430905 - DNA, 14 bp, Homo sapiens
tcacccgctgccca

SEQ ID NO: 6430906 - DNA, 13 bp, Homo sapiens
tcacccggcctct

SEQ ID NO: 6430907 - DNA, 22 bp, Homo sapiens
tcacccggcctcttcgcctttc

SEQ ID NO: 6430908 - DNA, 16 bp, Homo sapiens
tcacccggtgacctct

SEQ ID NO: 6430909 - DNA, 19 bp, Homo sapiens
tcaccctaccaactttact

SEQ ID NO: 6430910 - DNA, 15 bp, Homo sapiens
tcaccctacctgtgc

SEQ ID NO: 6430911 - DNA, 17 bp, Homo sapiens
tcaccctacctgtgcct

SEQ ID NO: 6430912 - DNA, 18 bp, Homo sapiens
tcaccctactctggatgg

SEQ ID NO: 6430913 - DNA, 21 bp, Homo sapiens
tcaccctagccctctccctct

SEQ ID NO: 6430914 - DNA, 16 bp, Homo sapiens
tcaccctcacccactc

SEQ ID NO: 6430915 - DNA, 12 bp, Homo sapiens
tcaccctcagga

SEQ ID NO: 6430916 - DNA, 19 bp, Homo sapiens
tcaccctcataccatctgc

SEQ ID NO: 6430917 - DNA, 20 bp, Homo sapiens
tcaccctcataccatctgct

SEQ ID NO: 6430918 - DNA, 13 bp, Homo sapiens
tcaccctccacct

SEQ ID NO: 6430919 - DNA, 14 bp, Homo sapiens
tcaccctccacctc

SEQ ID NO: 6430920 - DNA, 21 bp, Homo sapiens
tcaccctcctagcctgctctg

SEQ ID NO: 6430921 - DNA, 22 bp, Homo sapiens
tcaccctcctagcctgctctgc

SEQ ID NO: 6430922 - DNA, 16 bp, Homo sapiens
tcaccctcctgagcct

SEQ ID NO: 6430923 - DNA, 18 bp, Homo sapiens
tcaccctcctgagcctca

SEQ ID NO: 6430924 - DNA, 21 bp, Homo sapiens
tcaccctcctgagcctcacct

SEQ ID NO: 6430925 - DNA, 18 bp, Homo sapiens
tcaccctcgtttccagtg

SEQ ID NO: 6430926 - DNA, 15 bp, Homo sapiens
tcaccctctgtcccc

SEQ ID NO: 6430927 - DNA, 21 bp, Homo sapiens
tcaccctgaattcattgtctc

SEQ ID NO: 6430928 - DNA, 15 bp, Homo sapiens
tcaccctgcagagct

SEQ ID NO: 6430929 - DNA, 17 bp, Homo sapiens
tcaccctggccaccacc

SEQ ID NO: 6430930 - DNA, 19 bp, Homo sapiens
tcaccctggccaccaccca

SEQ ID NO: 6430931 - DNA, 14 bp, Homo sapiens
tcaccctggcccca

SEQ ID NO: 6430932 - DNA, 16 bp, Homo sapiens
tcaccctggccccaac

SEQ ID NO: 6430933 - DNA, 17 bp, Homo sapiens
tcaccctggccccaact

SEQ ID NO: 6430934 - DNA, 17 bp, Homo sapiens
tcaccctgggagcagtc

SEQ ID NO: 6430935 - DNA, 21 bp, Homo sapiens
tcaccctgggagtttcctgag

SEQ ID NO: 6430936 - DNA, 21 bp, Homo sapiens
tcaccctgtccaaactgccta

SEQ ID NO: 6430937 - DNA, 13 bp, Homo sapiens
tcaccctgtccct

SEQ ID NO: 6430938 - DNA, 14 bp, Homo sapiens
tcaccctgtgaaac

SEQ ID NO: 6430939 - DNA, 12 bp, Homo sapiens
tcaccctgtggg

SEQ ID NO: 6430940 - DNA, 13 bp, Homo sapiens
tcaccctgtggga

SEQ ID NO: 6430941 - DNA, 15 bp, Homo sapiens
tcaccctgtgggacc

SEQ ID NO: 6430942 - DNA, 16 bp, Homo sapiens
tcaccctgtgggaccg

SEQ ID NO: 6430943 - DNA, 19 bp, Homo sapiens
tcacccttaccatgtgcct

SEQ ID NO: 6430944 - DNA, 22 bp, Homo sapiens
tcacccttatagtctaagacta

SEQ ID NO: 6430945 - DNA, 22 bp, Homo sapiens
tcacccttcccggcccccggcc

SEQ ID NO: 6430946 - DNA, 17 bp, Homo sapiens
tctccaacatcacagcc

SEQ ID NO: 6430947 - DNA, 19 bp, Homo sapiens
tctccaacatcacagccca

SEQ ID NO: 6430948 - DNA, 20 bp, Homo sapiens
tctccaaccccccagcactg

SEQ ID NO: 6430949 - DNA, 21 bp, Homo sapiens
tctccaactgcctaaggccct

SEQ ID NO: 6430950 - DNA, 20 bp, Homo sapiens
tctccaactttattttgaat

SEQ ID NO: 6430951 - DNA, 15 bp, Homo sapiens
tctccaagaatgctg

SEQ ID NO: 6430952 - DNA, 17 bp, Homo sapiens
tctccaagaatgctgaa

SEQ ID NO: 6430953 - DNA, 21 bp, Homo sapiens
tctccaagacagcagcagcct

SEQ ID NO: 6430954 - DNA, 17 bp, Homo sapiens
tctccaagcactagcct

SEQ ID NO: 6430955 - DNA, 15 bp, Homo sapiens
tctccaagcaggaca

SEQ ID NO: 6430956 - DNA, 19 bp, Homo sapiens
tctccaagcaggacatgga

SEQ ID NO: 6430957 - DNA, 16 bp, Homo sapiens
tctccaagcgcctggc

SEQ ID NO: 6430958 - DNA, 14 bp, Homo sapiens
tctccaaggaccag

SEQ ID NO: 6430959 - DNA, 22 bp, Homo sapiens
tctccaaggatcctctccactc

SEQ ID NO: 6430960 - DNA, 22 bp, Homo sapiens
tctccaagggcttctgcaccct

SEQ ID NO: 6430961 - DNA, 22 bp, Homo sapiens
tctccaagtagtccaccttcat

SEQ ID NO: 6430962 - DNA, 17 bp, Homo sapiens
tctccaagtctcagtgg

SEQ ID NO: 6430963 - DNA, 20 bp, Homo sapiens
tctccaagtctctctgtgaa

SEQ ID NO: 6430964 - DNA, 22 bp, Homo sapiens
tctccaagtctctctgtgaata

SEQ ID NO: 6430965 - DNA, 18 bp, Homo sapiens
tctccaatatcagtgctc

SEQ ID NO: 6430966 - DNA, 16 bp, Homo sapiens
tctccaatgctctgga

SEQ ID NO: 6430967 - DNA, 20 bp, Homo sapiens
tctccaatggaaagcttttc

SEQ ID NO: 6430968 - DNA, 16 bp, Homo sapiens
tctccaattctgaaat

SEQ ID NO: 6430969 - DNA, 19 bp, Homo sapiens
tctccaattctgaaatact

SEQ ID NO: 6430970 - DNA, 17 bp, Homo sapiens
tctccaattgtaaaaaa

SEQ ID NO: 6430971 - DNA, 17 bp, Homo sapiens
tctccacaacactgtgt

SEQ ID NO: 6430972 - DNA, 22 bp, Homo sapiens
tctccacacaggtgttccgtgg

SEQ ID NO: 6430973 - DNA, 19 bp, Homo sapiens
tctccacacccagcctgtc

SEQ ID NO: 6430974 - DNA, 16 bp, Homo sapiens
tctccacactccactg

SEQ ID NO: 6430975 - DNA, 22 bp, Homo sapiens
tctccacagggacacagtctgg

SEQ ID NO: 6430976 - DNA, 22 bp, Homo sapiens
tctccacagtgttgtgcccctt

SEQ ID NO: 6430977 - DNA, 21 bp, Homo sapiens
tctccaccaactggagcactg

SEQ ID NO: 6430978 - DNA, 23 bp, Homo sapiens
tctccaccagacgccttcctctc

SEQ ID NO: 6430979 - DNA, 22 bp, Homo sapiens
tctccaccagtcatttttcaga

SEQ ID NO: 6430980 - DNA, 13 bp, Homo sapiens
tctccacccagag

SEQ ID NO: 6430981 - DNA, 12 bp, Homo sapiens
tctccacccctc

SEQ ID NO: 6430982 - DNA, 16 bp, Homo sapiens
tctccaccctgagcct

SEQ ID NO: 6430983 - DNA, 19 bp, Homo sapiens
tctccaccctgagcctgac

SEQ ID NO: 6430984 - DNA, 13 bp, Homo sapiens
tctccaccctgct

SEQ ID NO: 6430985 - DNA, 16 bp, Homo sapiens
tctccaccctggctgg

SEQ ID NO: 6430986 - DNA, 18 bp, Homo sapiens
tctccaccctggctggga

SEQ ID NO: 6430987 - DNA, 19 bp, Homo sapiens
tctccaccctggctgggat

SEQ ID NO: 6430988 - DNA, 22 bp, Homo sapiens
tctccacctacacccctgtgct

SEQ ID NO: 6430989 - DNA, 14 bp, Homo sapiens
tctccacctcacta

SEQ ID NO: 6430990 - DNA, 12 bp, Homo sapiens
tctccacctcag

SEQ ID NO: 6430991 - DNA, 20 bp, Homo sapiens
tctccacctcccccaaaccc

SEQ ID NO: 6430992 - DNA, 22 bp, Homo sapiens
tctccacctcccccaaaccctg

SEQ ID NO: 6430993 - DNA, 16 bp, Homo sapiens
tctccacctgaagtga

SEQ ID NO: 6430994 - DNA, 15 bp, Homo sapiens
tctccacctgccagg

SEQ ID NO: 6430995 - DNA, 16 bp, Homo sapiens
tctccacctgccaggg

SEQ ID NO: 6430996 - DNA, 17 bp, Homo sapiens
tctccacctgccaggga

SEQ ID NO: 6430997 - DNA, 16 bp, Homo sapiens
tctccacctgctccca

SEQ ID NO: 6430998 - DNA, 13 bp, Homo sapiens
tctccaccttcca

SEQ ID NO: 6430999 - DNA, 14 bp, Homo sapiens
tctccaccttccaa

SEQ ID NO: 6431000 - DNA, 22 bp, Homo sapiens
tctccactaaatgagctcctgc

SEQ ID NO: 6431001 - DNA, 16 bp, Homo sapiens
tctccactaccccaca

SEQ ID NO: 6431002 - DNA, 22 bp, Homo sapiens
tctccactaccccacaccagcc

SEQ ID NO: 6431003 - DNA, 23 bp, Homo sapiens
tctccactccatgtttgcaatgc

SEQ ID NO: 6431004 - DNA, 15 bp, Homo sapiens
tctccactcttctct

SEQ ID NO: 6431005 - DNA, 16 bp, Homo sapiens
tctccactcttctctc

SEQ ID NO: 6431006 - DNA, 18 bp, Homo sapiens
tctccactcttctctcct

SEQ ID NO: 6431007 - DNA, 14 bp, Homo sapiens
tctccactgccttc

SEQ ID NO: 6431008 - DNA, 18 bp, Homo sapiens
tctccactgctctcagcc

SEQ ID NO: 6431009 - DNA, 16 bp, Homo sapiens
tctccacttttttcat

SEQ ID NO: 6431010 - DNA, 13 bp, Homo sapiens
tctccagaaaaat

SEQ ID NO: 6431011 - DNA, 20 bp, Homo sapiens
tctccagaaaaatcaatcat

SEQ ID NO: 6431012 - DNA, 21 bp, Homo sapiens
tctccagaaaaatcaatcatt

SEQ ID NO: 6431013 - DNA, 18 bp, Homo sapiens
tctccagaaacagctgct

SEQ ID NO: 6431014 - DNA, 22 bp, Homo sapiens
tctccagaaacagctgcttctc

SEQ ID NO: 6431015 - DNA, 15 bp, Homo sapiens
tctccagaagaaaat

SEQ ID NO: 6431016 - DNA, 20 bp, Homo sapiens
tctccagaatgtaagaaaac

SEQ ID NO: 6431017 - DNA, 12 bp, Homo sapiens
tctccagacaca

SEQ ID NO: 6431018 - DNA, 12 bp, Homo sapiens
tctccagaccca

SEQ ID NO: 6431019 - DNA, 15 bp, Homo sapiens
tctccagacccagag

SEQ ID NO: 6431020 - DNA, 20 bp, Homo sapiens
tctccagacccagaggccct

SEQ ID NO: 6431021 - DNA, 18 bp, Homo sapiens
tctccagaccccagaact

SEQ ID NO: 6431022 - DNA, 15 bp, Homo sapiens
tctccagacccccac

SEQ ID NO: 6431023 - DNA, 15 bp, Homo sapiens
tctccagacctgagc

SEQ ID NO: 6431024 - DNA, 14 bp, Homo sapiens
tctccagatgtttc

SEQ ID NO: 6431025 - DNA, 15 bp, Homo sapiens
tctccagatgtttcc

SEQ ID NO: 6431026 - DNA, 18 bp, Homo sapiens
tctccagcaagcagtgcc

SEQ ID NO: 6431027 - DNA, 14 bp, Homo sapiens
tctccagcaggccc

SEQ ID NO: 6431028 - DNA, 15 bp, Homo sapiens
tctccagcagttagg

SEQ ID NO: 6431029 - DNA, 17 bp, Homo sapiens
tctccagcatcccagcc

SEQ ID NO: 6431030 - DNA, 16 bp, Homo sapiens
tctccagccaatttca

SEQ ID NO: 6431031 - DNA, 14 bp, Homo sapiens
tctccagcccacac

SEQ ID NO: 6431032 - DNA, 16 bp, Homo sapiens
tctccagcccacaccc

SEQ ID NO: 6431033 - DNA, 19 bp, Homo sapiens
tctccagcccacacccctc

SEQ ID NO: 6431034 - DNA, 14 bp, Homo sapiens
tctccagcccatgc

SEQ ID NO: 6431035 - DNA, 18 bp, Homo sapiens
tctccagcccatgctggc

SEQ ID NO: 6431036 - DNA, 19 bp, Homo sapiens
tctccagcccatgctggct

SEQ ID NO: 6431037 - DNA, 16 bp, Homo sapiens
tctccagcccctggat

SEQ ID NO: 6431038 - DNA, 22 bp, Homo sapiens
tctccagccccttctcagaatc

SEQ ID NO: 6431039 - DNA, 13 bp, Homo sapiens
tctccagccctat

SEQ ID NO: 6431040 - DNA, 15 bp, Homo sapiens
tctccagccctgact

SEQ ID NO: 6431041 - DNA, 17 bp, Homo sapiens
tctccagccctgactaa

SEQ ID NO: 6431042 - DNA, 19 bp, Homo sapiens
tctccagccgaagctgcag

SEQ ID NO: 6431043 - DNA, 22 bp, Homo sapiens
tctccagcctcagccccctgct

SEQ ID NO: 6431044 - DNA, 23 bp, Homo sapiens
tctccagcctcagccccctgctt

SEQ ID NO: 6431045 - DNA, 15 bp, Homo sapiens
tctccagcctggacc

SEQ ID NO: 6431046 - DNA, 19 bp, Homo sapiens
tctccagcctggaccccca

SEQ ID NO: 6431047 - DNA, 20 bp, Homo sapiens
tctccagccttctctctctg

SEQ ID NO: 6431048 - DNA, 21 bp, Homo sapiens
tctccagccttctctctctgg

SEQ ID NO: 6431049 - DNA, 16 bp, Homo sapiens
tctccagcggccctgt

SEQ ID NO: 6431050 - DNA, 18 bp, Homo sapiens
tctccagcggccctgtca

SEQ ID NO: 6431051 - DNA, 20 bp, Homo sapiens
tctccagctaactgtggaga

SEQ ID NO: 6431052 - DNA, 17 bp, Homo sapiens
tctccagctcagaaccc

SEQ ID NO: 6431053 - DNA, 23 bp, Homo sapiens
tctccagctcagaacccagggct

SEQ ID NO: 6431054 - DNA, 12 bp, Homo sapiens
tctccagctgat

SEQ ID NO: 6431055 - DNA, 18 bp, Homo sapiens
tctccagctgcctgggcc

SEQ ID NO: 6431056 - DNA, 15 bp, Homo sapiens
tctccagctgctgag

SEQ ID NO: 6431057 - DNA, 21 bp, Homo sapiens
tctccagctgggctctgcaat

SEQ ID NO: 6431058 - DNA, 23 bp, Homo sapiens
tctccagcttactataaatgata

SEQ ID NO: 6431059 - DNA, 15 bp, Homo sapiens
tctccagcttcagct

SEQ ID NO: 6431060 - DNA, 19 bp, Homo sapiens
tctccaggaagcccagggc

SEQ ID NO: 6431061 - DNA, 21 bp, Homo sapiens
tctccaggaaggtagcccagc

SEQ ID NO: 6431062 - DNA, 22 bp, Homo sapiens
tctccaggaaggtagcccagca

SEQ ID NO: 6431063 - DNA, 13 bp, Homo sapiens
tctccaggaccaa

SEQ ID NO: 6431064 - DNA, 14 bp, Homo sapiens
tctccaggaccaat

SEQ ID NO: 6431065 - DNA, 16 bp, Homo sapiens
tctccaggattccaaa

SEQ ID NO: 6431066 - DNA, 19 bp, Homo sapiens
tctccaggattttaatttc

SEQ ID NO: 6431067 - DNA, 17 bp, Homo sapiens
tctccaggcacccttct

SEQ ID NO: 6431068 - DNA, 15 bp, Homo sapiens
tctccaggcaccgcc

SEQ ID NO: 6431069 - DNA, 19 bp, Homo sapiens
tctccaggcaccgcctgcc

SEQ ID NO: 6431070 - DNA, 20 bp, Homo sapiens
tctccaggcaccgcctgccc

SEQ ID NO: 6431071 - DNA, 15 bp, Homo sapiens
tctccaggcaggtct

SEQ ID NO: 6431072 - DNA, 16 bp, Homo sapiens
tctccaggccaggtgg

SEQ ID NO: 6431073 - DNA, 13 bp, Homo sapiens
tctccaggcccag

SEQ ID NO: 6431074 - DNA, 16 bp, Homo sapiens
tctccaggcccagcct

SEQ ID NO: 6431075 - DNA, 18 bp, Homo sapiens
tctccaggcccagcctgg

SEQ ID NO: 6431076 - DNA, 23 bp, Homo sapiens
tctccaggcccagcctggcccca

SEQ ID NO: 6431077 - DNA, 19 bp, Homo sapiens
tctccaggccctcagatgg

SEQ ID NO: 6431078 - DNA, 18 bp, Homo sapiens
tctccaggcttcacagtc

SEQ ID NO: 6431079 - DNA, 20 bp, Homo sapiens
tctccagggaggcgatgcca

SEQ ID NO: 6431080 - DNA, 21 bp, Homo sapiens
tctccagggagtcccctcccc

SEQ ID NO: 6431081 - DNA, 14 bp, Homo sapiens
tctccagggctcca

SEQ ID NO: 6431082 - DNA, 17 bp, Homo sapiens
tctccagggctgcccct

SEQ ID NO: 6431083 - DNA, 24 bp, Homo sapiens
tctccagggctgcccctgtaggtt

SEQ ID NO: 6431084 - DNA, 18 bp, Homo sapiens
tctccagggtcagaaaca

SEQ ID NO: 6431085 - DNA, 15 bp, Homo sapiens
tctccaggtcagcct

SEQ ID NO: 6431086 - DNA, 14 bp, Homo sapiens
tctccagtccctgg

SEQ ID NO: 6431087 - DNA, 21 bp, Homo sapiens
tctccagtgctgtccatgctt

SEQ ID NO: 6431088 - DNA, 20 bp, Homo sapiens
tctccagtggttgctgttga

SEQ ID NO: 6431089 - DNA, 15 bp, Homo sapiens
tctccagtgtgccag

SEQ ID NO: 6431090 - DNA, 20 bp, Homo sapiens
tctccagttgtatcctctga

SEQ ID NO: 6431091 - DNA, 18 bp, Homo sapiens
tctccagtttgcacctgt

SEQ ID NO: 6431092 - DNA, 22 bp, Homo sapiens
tctccagttttatcccctgcct

SEQ ID NO: 6431093 - DNA, 17 bp, Homo sapiens
tctccagtttttgagga

SEQ ID NO: 6431094 - DNA, 17 bp, Homo sapiens
tctccataaccccaccc

SEQ ID NO: 6431095 - DNA, 21 bp, Homo sapiens
tctccataaccccacccttgc

SEQ ID NO: 6431096 - DNA, 22 bp, Homo sapiens
tctccatacccacaatctgagc

SEQ ID NO: 6431097 - DNA, 13 bp, Homo sapiens
tctccatactttg

SEQ ID NO: 6431098 - DNA, 14 bp, Homo sapiens
tctccatactttgg

SEQ ID NO: 6431099 - DNA, 15 bp, Homo sapiens
tctccatatgttaca

SEQ ID NO: 6431100 - DNA, 17 bp, Homo sapiens
tctccatcagctgtaag

SEQ ID NO: 6431101 - DNA, 14 bp, Homo sapiens
tctccatcatatgc

SEQ ID NO: 6431102 - DNA, 18 bp, Homo sapiens
tctccatcatatgcctga

SEQ ID NO: 6431103 - DNA, 19 bp, Homo sapiens
tctccatccacatgggagc

SEQ ID NO: 6431104 - DNA, 13 bp, Homo sapiens
tctccatccccat

SEQ ID NO: 6431105 - DNA, 15 bp, Homo sapiens
tctccatcccctccc

SEQ ID NO: 6431106 - DNA, 19 bp, Homo sapiens
tctccatcccctccctgcc

SEQ ID NO: 6431107 - DNA, 20 bp, Homo sapiens
tctccatcccctccctgcct

SEQ ID NO: 6431108 - DNA, 20 bp, Homo sapiens
tctccatccctctcctctgc

SEQ ID NO: 6431109 - DNA, 15 bp, Homo sapiens
tctccatcctgcaga

SEQ ID NO: 6431110 - DNA, 18 bp, Homo sapiens
tctccatccttaactgtc

SEQ ID NO: 6431111 - DNA, 18 bp, Homo sapiens
tctccatcgtctcatcct

SEQ ID NO: 6431112 - DNA, 22 bp, Homo sapiens
tctccatcgtctcatcctcctt

SEQ ID NO: 6431113 - DNA, 20 bp, Homo sapiens
tctccatctcccaaggctgc

SEQ ID NO: 6431114 - DNA, 14 bp, Homo sapiens
tctccatctctggt

SEQ ID NO: 6431115 - DNA, 13 bp, Homo sapiens
tctccatctgtca

SEQ ID NO: 6431116 - DNA, 12 bp, Homo sapiens
tctccatgaaga

SEQ ID NO: 6431117 - DNA, 21 bp, Homo sapiens
tctccatgaggtactggtccc

SEQ ID NO: 6431118 - DNA, 13 bp, Homo sapiens
tctccatgcaagt

SEQ ID NO: 6431119 - DNA, 17 bp, Homo sapiens
tctccatgcaagtgctg

SEQ ID NO: 6431120 - DNA, 13 bp, Homo sapiens
tctccatgctctt

SEQ ID NO: 6431121 - DNA, 23 bp, Homo sapiens
tctccatgctctttcaccctgcc

SEQ ID NO: 6431122 - DNA, 15 bp, Homo sapiens
tctccatgctgcaaa

SEQ ID NO: 6431123 - DNA, 14 bp, Homo sapiens
tctccatggagcct

SEQ ID NO: 6431124 - DNA, 12 bp, Homo sapiens
tcacccttccct

SEQ ID NO: 6431125 - DNA, 13 bp, Homo sapiens
tcacccttccctg

SEQ ID NO: 6431126 - DNA, 14 bp, Homo sapiens
tcacccttccctgc

SEQ ID NO: 6431127 - DNA, 17 bp, Homo sapiens
tcacccttgaaaactct

SEQ ID NO: 6431128 - DNA, 21 bp, Homo sapiens
tcacccttgaaaactctcagt

SEQ ID NO: 6431129 - DNA, 23 bp, Homo sapiens
tcaccctttccggcacactgcca

SEQ ID NO: 6431130 - DNA, 20 bp, Homo sapiens
tcaccgacccgacactctca

SEQ ID NO: 6431131 - DNA, 21 bp, Homo sapiens
tcaccgacccgacactctcac

SEQ ID NO: 6431132 - DNA, 18 bp, Homo sapiens
tcaccgagacggctggac

SEQ ID NO: 6431133 - DNA, 14 bp, Homo sapiens
tcaccgagactcag

SEQ ID NO: 6431134 - DNA, 23 bp, Homo sapiens
tcaccgagagtagccgagagcct

SEQ ID NO: 6431135 - DNA, 22 bp, Homo sapiens
tcaccgagcgggtgcaagcact

SEQ ID NO: 6431136 - DNA, 15 bp, Homo sapiens
tcaccgattcttcct

SEQ ID NO: 6431137 - DNA, 16 bp, Homo sapiens
tcaccgattcttcctt

SEQ ID NO: 6431138 - DNA, 19 bp, Homo sapiens
tcaccgcagtcgtcgcaca

SEQ ID NO: 6431139 - DNA, 15 bp, Homo sapiens
tcaccgccgtggggt

SEQ ID NO: 6431140 - DNA, 22 bp, Homo sapiens
tcaccgcctgctacacaggcag

SEQ ID NO: 6431141 - DNA, 19 bp, Homo sapiens
tcaccgcggacgtgctggc

SEQ ID NO: 6431142 - DNA, 19 bp, Homo sapiens
tcaccgcggctggatgggg

SEQ ID NO: 6431143 - DNA, 17 bp, Homo sapiens
tcaccgctgggtggttt

SEQ ID NO: 6431144 - DNA, 12 bp, Homo sapiens
tcaccggcatgc

SEQ ID NO: 6431145 - DNA, 14 bp, Homo sapiens
tcaccggcatgctg

SEQ ID NO: 6431146 - DNA, 22 bp, Homo sapiens
tcaccggcatgctggcctgtgg

SEQ ID NO: 6431147 - DNA, 21 bp, Homo sapiens
tcaccggccttgtgacattca

SEQ ID NO: 6431148 - DNA, 22 bp, Homo sapiens
tcaccggctctcacctggccct

SEQ ID NO: 6431149 - DNA, 16 bp, Homo sapiens
tcaccggtcagtgcct

SEQ ID NO: 6431150 - DNA, 18 bp, Homo sapiens
tcaccgtattagccagga

SEQ ID NO: 6431151 - DNA, 23 bp, Homo sapiens
tcaccgtcattgatggagcctga

SEQ ID NO: 6431152 - DNA, 19 bp, Homo sapiens
tcaccgtcccgcacagtgg

SEQ ID NO: 6431153 - DNA, 15 bp, Homo sapiens
tcaccgtgcagagct

SEQ ID NO: 6431154 - DNA, 21 bp, Homo sapiens
tcaccgtgctgtcttctggtc

SEQ ID NO: 6431155 - DNA, 17 bp, Homo sapiens
tcaccgtggaccttcct

SEQ ID NO: 6431156 - DNA, 19 bp, Homo sapiens
tcaccgtggaccttcctgc

SEQ ID NO: 6431157 - DNA, 18 bp, Homo sapiens
tcaccgtgttagccagga

SEQ ID NO: 6431158 - DNA, 22 bp, Homo sapiens
tcacctaaaccctctgtgaaat

SEQ ID NO: 6431159 - DNA, 20 bp, Homo sapiens
tcacctaacagaatattaaa

SEQ ID NO: 6431160 - DNA, 15 bp, Homo sapiens
tcacctaaccctctg

SEQ ID NO: 6431161 - DNA, 18 bp, Homo sapiens
tcacctaaccctctgtca

SEQ ID NO: 6431162 - DNA, 20 bp, Homo sapiens
tcacctaaccctctgtcacc

SEQ ID NO: 6431163 - DNA, 19 bp, Homo sapiens
tcacctaagcaatcactgg

SEQ ID NO: 6431164 - DNA, 18 bp, Homo sapiens
tcacctaagcacttctag

SEQ ID NO: 6431165 - DNA, 20 bp, Homo sapiens
tcacctaagcacttctagaa

SEQ ID NO: 6431166 - DNA, 22 bp, Homo sapiens
tcacctaatgtttatgagccag

SEQ ID NO: 6431167 - DNA, 16 bp, Homo sapiens
tcacctaattaatttc

SEQ ID NO: 6431168 - DNA, 20 bp, Homo sapiens
tcacctacaggactgggccg

SEQ ID NO: 6431169 - DNA, 17 bp, Homo sapiens
tcacctagaacgtgcat

SEQ ID NO: 6431170 - DNA, 13 bp, Homo sapiens
tcacctagagcca

SEQ ID NO: 6431171 - DNA, 15 bp, Homo sapiens
tcacctagagccaga

SEQ ID NO: 6431172 - DNA, 23 bp, Homo sapiens
tcacctagctgaatgtttttcta

SEQ ID NO: 6431173 - DNA, 17 bp, Homo sapiens
tcacctaggaagcctca

SEQ ID NO: 6431174 - DNA, 23 bp, Homo sapiens
tcacctaggaagcctcagattcc

SEQ ID NO: 6431175 - DNA, 18 bp, Homo sapiens
tcacctaggactgactcg

SEQ ID NO: 6431176 - DNA, 16 bp, Homo sapiens
tcacctatgttatttt

SEQ ID NO: 6431177 - DNA, 23 bp, Homo sapiens
tcacctatgttattttgtgtaca

SEQ ID NO: 6431178 - DNA, 16 bp, Homo sapiens
tcacctcactcagcac

SEQ ID NO: 6431179 - DNA, 15 bp, Homo sapiens
tcacctcacttgtgg

SEQ ID NO: 6431180 - DNA, 13 bp, Homo sapiens
tcacctcagagca

SEQ ID NO: 6431181 - DNA, 22 bp, Homo sapiens
tcacctcagagtggagttgaaa

SEQ ID NO: 6431182 - DNA, 16 bp, Homo sapiens
tcacctcagatggcag

SEQ ID NO: 6431183 - DNA, 10 bp, Homo sapiens
tcacctcagc

SEQ ID NO: 6431184 - DNA, 19 bp, Homo sapiens
tcacctcagcctggagagg

SEQ ID NO: 6431185 - DNA, 16 bp, Homo sapiens
tcacctcaggacccca

SEQ ID NO: 6431186 - DNA, 19 bp, Homo sapiens
tcacctcaggaccccagag

SEQ ID NO: 6431187 - DNA, 20 bp, Homo sapiens
tcacctcaggaccccagagg

SEQ ID NO: 6431188 - DNA, 23 bp, Homo sapiens
tcacctcatgcccaccccctgcc

SEQ ID NO: 6431189 - DNA, 15 bp, Homo sapiens
tcacctcattctgaa

SEQ ID NO: 6431190 - DNA, 12 bp, Homo sapiens
tcacctccaccc

SEQ ID NO: 6431191 - DNA, 19 bp, Homo sapiens
tcacctccatatcagaagt

SEQ ID NO: 6431192 - DNA, 23 bp, Homo sapiens
tcacctccattaaccaagaaaac

SEQ ID NO: 6431193 - DNA, 11 bp, Homo sapiens
tcacctcccat

SEQ ID NO: 6431194 - DNA, 13 bp, Homo sapiens
tcacctcccatcc

SEQ ID NO: 6431195 - DNA, 23 bp, Homo sapiens
tcacctccccatcatccacgcca

SEQ ID NO: 6431196 - DNA, 13 bp, Homo sapiens
tcacctcccccat

SEQ ID NO: 6431197 - DNA, 14 bp, Homo sapiens
tcacctcccctcct

SEQ ID NO: 6431198 - DNA, 13 bp, Homo sapiens
tcacctccctgct

SEQ ID NO: 6431199 - DNA, 19 bp, Homo sapiens
tcacctccggcctccacat

SEQ ID NO: 6431200 - DNA, 21 bp, Homo sapiens
tcacctccggtcgtgtctctg

SEQ ID NO: 6431201 - DNA, 14 bp, Homo sapiens
tcacctcctccact

SEQ ID NO: 6431202 - DNA, 19 bp, Homo sapiens
tcacctcctccactcactc

SEQ ID NO: 6431203 - DNA, 22 bp, Homo sapiens
tcacctcctcgaacccactccg

SEQ ID NO: 6431204 - DNA, 14 bp, Homo sapiens
tcacctcctgctgg

SEQ ID NO: 6431205 - DNA, 17 bp, Homo sapiens
tcacctcctgctgggca

SEQ ID NO: 6431206 - DNA, 15 bp, Homo sapiens
tcacctccttcaatt

SEQ ID NO: 6431207 - DNA, 19 bp, Homo sapiens
tcacctccttccccagctc

SEQ ID NO: 6431208 - DNA, 12 bp, Homo sapiens
tcacctccttct

SEQ ID NO: 6431209 - DNA, 16 bp, Homo sapiens
tcacctccttctgcag

SEQ ID NO: 6431210 - DNA, 21 bp, Homo sapiens
tcacctctactgtctcctccc

SEQ ID NO: 6431211 - DNA, 15 bp, Homo sapiens
tcacctctagcctta

SEQ ID NO: 6431212 - DNA, 20 bp, Homo sapiens
tcacctctaggcctcagtgt

SEQ ID NO: 6431213 - DNA, 12 bp, Homo sapiens
tcacctctatcc

SEQ ID NO: 6431214 - DNA, 17 bp, Homo sapiens
tcacctctatccaaaga

SEQ ID NO: 6431215 - DNA, 19 bp, Homo sapiens
tcacctctcagctgctgga

SEQ ID NO: 6431216 - DNA, 22 bp, Homo sapiens
tcacctctcagctgctggatga

SEQ ID NO: 6431217 - DNA, 17 bp, Homo sapiens
tcacctctccaggtgct

SEQ ID NO: 6431218 - DNA, 13 bp, Homo sapiens
tcacctctcccac

SEQ ID NO: 6431219 - DNA, 19 bp, Homo sapiens
tcacctctccctcctcagc

SEQ ID NO: 6431220 - DNA, 20 bp, Homo sapiens
tcacctctctcagagcatct

SEQ ID NO: 6431221 - DNA, 13 bp, Homo sapiens
tcacctctctcta

SEQ ID NO: 6431222 - DNA, 23 bp, Homo sapiens
tcacctctctctaagtttagaag

SEQ ID NO: 6431223 - DNA, 17 bp, Homo sapiens
tcacctctctctgagga

SEQ ID NO: 6431224 - DNA, 14 bp, Homo sapiens
tcacctctcttcag

SEQ ID NO: 6431225 - DNA, 16 bp, Homo sapiens
tcacctctgaggacag

SEQ ID NO: 6431226 - DNA, 17 bp, Homo sapiens
tcacctctgaggacaga

SEQ ID NO: 6431227 - DNA, 22 bp, Homo sapiens
tcacctctgatagactttgtga

SEQ ID NO: 6431228 - DNA, 15 bp, Homo sapiens
tcacctctgtacaga

SEQ ID NO: 6431229 - DNA, 23 bp, Homo sapiens
tcacctcttatgcacacctccca

SEQ ID NO: 6431230 - DNA, 17 bp, Homo sapiens
tcacctcttccactcct

SEQ ID NO: 6431231 - DNA, 15 bp, Homo sapiens
tcacctcttcctctg

SEQ ID NO: 6431232 - DNA, 13 bp, Homo sapiens
tcacctcttgggg

SEQ ID NO: 6431233 - DNA, 16 bp, Homo sapiens
tcacctctttaaccac

SEQ ID NO: 6431234 - DNA, 17 bp, Homo sapiens
tcacctctttgctccct

SEQ ID NO: 6431235 - DNA, 15 bp, Homo sapiens
tcacctgaaaatgtg

SEQ ID NO: 6431236 - DNA, 16 bp, Homo sapiens
tcacctgaaaatgtgg

SEQ ID NO: 6431237 - DNA, 17 bp, Homo sapiens
tcacctgaaacactgga

SEQ ID NO: 6431238 - DNA, 18 bp, Homo sapiens
tcacctgaaacactggac

SEQ ID NO: 6431239 - DNA, 21 bp, Homo sapiens
tcacctgaaacactggacctg

SEQ ID NO: 6431240 - DNA, 18 bp, Homo sapiens
tcacctgaaccccagagg

SEQ ID NO: 6431241 - DNA, 20 bp, Homo sapiens
tcacctgaaccccagaggca

SEQ ID NO: 6431242 - DNA, 16 bp, Homo sapiens
tcacctgaagactcat

SEQ ID NO: 6431243 - DNA, 23 bp, Homo sapiens
tcacctgaagactcattcttctg

SEQ ID NO: 6431244 - DNA, 18 bp, Homo sapiens
tcacctgacctctgaaga

SEQ ID NO: 6431245 - DNA, 21 bp, Homo sapiens
tcacctgagcccggatgcttc

SEQ ID NO: 6431246 - DNA, 22 bp, Homo sapiens
tcacctgagcccggatgcttct

SEQ ID NO: 6431247 - DNA, 15 bp, Homo sapiens
tcacctgaggtcagg

SEQ ID NO: 6431248 - DNA, 15 bp, Homo sapiens
tcacctgaggtcggg

SEQ ID NO: 6431249 - DNA, 15 bp, Homo sapiens
tcacctgatcatata

SEQ ID NO: 6431250 - DNA, 11 bp, Homo sapiens
tcacctgcaaa

SEQ ID NO: 6431251 - DNA, 21 bp, Homo sapiens
tcacctgcaaagctctgtggc

SEQ ID NO: 6431252 - DNA, 14 bp, Homo sapiens
tcacctgcaagccc

SEQ ID NO: 6431253 - DNA, 20 bp, Homo sapiens
tcacctgcaagccccagggc

SEQ ID NO: 6431254 - DNA, 22 bp, Homo sapiens
tcacctgcaagccccagggcct

SEQ ID NO: 6431255 - DNA, 12 bp, Homo sapiens
tcacctgcagcc

SEQ ID NO: 6431256 - DNA, 18 bp, Homo sapiens
tcacctgcatcctctccc

SEQ ID NO: 6431257 - DNA, 23 bp, Homo sapiens
tcacctgcccagatcccagaagg

SEQ ID NO: 6431258 - DNA, 20 bp, Homo sapiens
tcacctgccccgtagagaat

SEQ ID NO: 6431259 - DNA, 13 bp, Homo sapiens
tcacctgcccctc

SEQ ID NO: 6431260 - DNA, 19 bp, Homo sapiens
tcacctgcccctctgttct

SEQ ID NO: 6431261 - DNA, 16 bp, Homo sapiens
tcacctgccggctctg

SEQ ID NO: 6431262 - DNA, 20 bp, Homo sapiens
tcacctgccggctctgggct

SEQ ID NO: 6431263 - DNA, 16 bp, Homo sapiens
tcacctgcctgccctc

SEQ ID NO: 6431264 - DNA, 19 bp, Homo sapiens
tcacctgcgcaagtgcctg

SEQ ID NO: 6431265 - DNA, 20 bp, Homo sapiens
tcacctgcgcaagtgcctgg

SEQ ID NO: 6431266 - DNA, 21 bp, Homo sapiens
tcacctgcgcagggccctctg

SEQ ID NO: 6431267 - DNA, 14 bp, Homo sapiens
tcacctgctcacag

SEQ ID NO: 6431268 - DNA, 18 bp, Homo sapiens
tcacctgctcacagggat

SEQ ID NO: 6431269 - DNA, 21 bp, Homo sapiens
tcacctgctccagaagatgcc

SEQ ID NO: 6431270 - DNA, 17 bp, Homo sapiens
tcacctgctcccagtcc

SEQ ID NO: 6431271 - DNA, 23 bp, Homo sapiens
tcacctgctcccagtcctgcctg

SEQ ID NO: 6431272 - DNA, 20 bp, Homo sapiens
tcacctgctggcccctcacc

SEQ ID NO: 6431273 - DNA, 21 bp, Homo sapiens
tcacctgctggcccctcacct

SEQ ID NO: 6431274 - DNA, 22 bp, Homo sapiens
tcacctgctggttgttgccagg

SEQ ID NO: 6431275 - DNA, 23 bp, Homo sapiens
tcacctgcttctctgcccagctt

SEQ ID NO: 6431276 - DNA, 23 bp, Homo sapiens
tcacctggaggcaagagggaggg

SEQ ID NO: 6431277 - DNA, 16 bp, Homo sapiens
tcacctggctgagcag

SEQ ID NO: 6431278 - DNA, 17 bp, Homo sapiens
tcacctggctgagcagt

SEQ ID NO: 6431279 - DNA, 22 bp, Homo sapiens
tcacctggctgagcagttcccc

SEQ ID NO: 6431280 - DNA, 23 bp, Homo sapiens
tcacctggctgctaggccagagc

SEQ ID NO: 6431281 - DNA, 19 bp, Homo sapiens
tcacctggcttcccaggac

SEQ ID NO: 6431282 - DNA, 20 bp, Homo sapiens
tcacctggcttcccaggacc

SEQ ID NO: 6431283 - DNA, 21 bp, Homo sapiens
tcacctggcttcccaggaccc

SEQ ID NO: 6431284 - DNA, 15 bp, Homo sapiens
tcacctgggccctgg

SEQ ID NO: 6431285 - DNA, 13 bp, Homo sapiens
tcacctgggcctt

SEQ ID NO: 6431286 - DNA, 16 bp, Homo sapiens
tcacctggggctgctg

SEQ ID NO: 6431287 - DNA, 20 bp, Homo sapiens
tcacctggggctgctggcct

SEQ ID NO: 6431288 - DNA, 16 bp, Homo sapiens
tcacctggtacctgga

SEQ ID NO: 6431289 - DNA, 13 bp, Homo sapiens
tcacctgtaaaac

SEQ ID NO: 6431290 - DNA, 17 bp, Homo sapiens
tcacctgtaaaacttta

SEQ ID NO: 6431291 - DNA, 19 bp, Homo sapiens
tcacctgtaaacctgagtc

SEQ ID NO: 6431292 - DNA, 16 bp, Homo sapiens
tcacctgtactcttcc

SEQ ID NO: 6431293 - DNA, 17 bp, Homo sapiens
tcacctgtcaggcctga

SEQ ID NO: 6431294 - DNA, 12 bp, Homo sapiens
tcacctgtcatc

SEQ ID NO: 6431295 - DNA, 13 bp, Homo sapiens
tcacctgtcatca

SEQ ID NO: 6431296 - DNA, 15 bp, Homo sapiens
tcacctgtgactcct

SEQ ID NO: 6431297 - DNA, 21 bp, Homo sapiens
tcacctgtgcagggccctctg

SEQ ID NO: 6431298 - DNA, 18 bp, Homo sapiens
tcacctgtgctacctcta

SEQ ID NO: 6431299 - DNA, 18 bp, Homo sapiens
tcacctgttgcttacaat

SEQ ID NO: 6431300 - DNA, 19 bp, Homo sapiens
tcacctgttgcttacaatt

SEQ ID NO: 6431301 - DNA, 15 bp, Homo sapiens
tctccatggagccta

SEQ ID NO: 6431302 - DNA, 13 bp, Homo sapiens
tctccatggagtt

SEQ ID NO: 6431303 - DNA, 15 bp, Homo sapiens
tctccatggagttgc

SEQ ID NO: 6431304 - DNA, 13 bp, Homo sapiens
tctccatggccct

SEQ ID NO: 6431305 - DNA, 15 bp, Homo sapiens
tctccatggccctgc

SEQ ID NO: 6431306 - DNA, 18 bp, Homo sapiens
tctccatggccctgtccc

SEQ ID NO: 6431307 - DNA, 21 bp, Homo sapiens
tctccatggccctgtcccagg

SEQ ID NO: 6431308 - DNA, 17 bp, Homo sapiens
tctccatgtagaataaa

SEQ ID NO: 6431309 - DNA, 23 bp, Homo sapiens
tctccatgtagaataaatgaaga

SEQ ID NO: 6431310 - DNA, 20 bp, Homo sapiens
tctccatgttggcctgtcac

SEQ ID NO: 6431311 - DNA, 16 bp, Homo sapiens
tctccatgtttgatgt

SEQ ID NO: 6431312 - DNA, 16 bp, Homo sapiens
tctccattaaacttct

SEQ ID NO: 6431313 - DNA, 22 bp, Homo sapiens
tctccattaaacttctactgag

SEQ ID NO: 6431314 - DNA, 15 bp, Homo sapiens
tctccattaataccc

SEQ ID NO: 6431315 - DNA, 23 bp, Homo sapiens
tctccattagaaaattttgtaaa

SEQ ID NO: 6431316 - DNA, 14 bp, Homo sapiens
tctccattccctag

SEQ ID NO: 6431317 - DNA, 17 bp, Homo sapiens
tctccattccctagcag

SEQ ID NO: 6431318 - DNA, 22 bp, Homo sapiens
tctccattccctccacccactt

SEQ ID NO: 6431319 - DNA, 21 bp, Homo sapiens
tctccattctgctccttcccc

SEQ ID NO: 6431320 - DNA, 17 bp, Homo sapiens
tctccattcttttaaat

SEQ ID NO: 6431321 - DNA, 19 bp, Homo sapiens
tctccatttcacacaggtc

SEQ ID NO: 6431322 - DNA, 22 bp, Homo sapiens
tctccatttcacacaggtcctg

SEQ ID NO: 6431323 - DNA, 17 bp, Homo sapiens
tctccatttcacgggca

SEQ ID NO: 6431324 - DNA, 16 bp, Homo sapiens
tctccatttgctcttc

SEQ ID NO: 6431325 - DNA, 23 bp, Homo sapiens
tctccatttgctcttcagatgcc

SEQ ID NO: 6431326 - DNA, 19 bp, Homo sapiens
tctccatttggaattacaa

SEQ ID NO: 6431327 - DNA, 16 bp, Homo sapiens
tctccatttgtcatcg

SEQ ID NO: 6431328 - DNA, 15 bp, Homo sapiens
tctccattttagccc

SEQ ID NO: 6431329 - DNA, 17 bp, Homo sapiens
tctccattttcaagctg

SEQ ID NO: 6431330 - DNA, 19 bp, Homo sapiens
tctccatttttcccaggac

SEQ ID NO: 6431331 - DNA, 18 bp, Homo sapiens
tctcccaaaaaactactt

SEQ ID NO: 6431332 - DNA, 23 bp, Homo sapiens
tctcccaaacacataatttctgt

SEQ ID NO: 6431333 - DNA, 20 bp, Homo sapiens
tctcccaaagggcacacccc

SEQ ID NO: 6431334 - DNA, 12 bp, Homo sapiens
tctcccaacatg

SEQ ID NO: 6431335 - DNA, 17 bp, Homo sapiens
tctcccaacatgggagg

SEQ ID NO: 6431336 - DNA, 15 bp, Homo sapiens
tctcccaactcagcc

SEQ ID NO: 6431337 - DNA, 17 bp, Homo sapiens
tctcccaactcagcctg

SEQ ID NO: 6431338 - DNA, 19 bp, Homo sapiens
tctcccaactcttgcacag

SEQ ID NO: 6431339 - DNA, 19 bp, Homo sapiens
tctcccaactgctgcttaa

SEQ ID NO: 6431340 - DNA, 14 bp, Homo sapiens
tctcccaagaaacc

SEQ ID NO: 6431341 - DNA, 19 bp, Homo sapiens
tctcccaagaaacctgact

SEQ ID NO: 6431342 - DNA, 19 bp, Homo sapiens
tctcccaaggctgcgtctg

SEQ ID NO: 6431343 - DNA, 15 bp, Homo sapiens
tctcccaattttctt

SEQ ID NO: 6431344 - DNA, 18 bp, Homo sapiens
tctcccacacccaccctt

SEQ ID NO: 6431345 - DNA, 19 bp, Homo sapiens
tctcccacacccacccttt

SEQ ID NO: 6431346 - DNA, 19 bp, Homo sapiens
tctcccacagagtgctgga

SEQ ID NO: 6431347 - DNA, 14 bp, Homo sapiens
tctcccacatgagg

SEQ ID NO: 6431348 - DNA, 24 bp, Homo sapiens
tctcccacatgaggccatctcagg

SEQ ID NO: 6431349 - DNA, 21 bp, Homo sapiens
tctcccacccagccctgcccc

SEQ ID NO: 6431350 - DNA, 17 bp, Homo sapiens
tctcccaccccctcccc

SEQ ID NO: 6431351 - DNA, 12 bp, Homo sapiens
tctcccacccct

SEQ ID NO: 6431352 - DNA, 15 bp, Homo sapiens
tctcccacccctgcc

SEQ ID NO: 6431353 - DNA, 22 bp, Homo sapiens
tctcccacccggccacagctgc

SEQ ID NO: 6431354 - DNA, 24 bp, Homo sapiens
tctcccacccggccacagctgctg

SEQ ID NO: 6431355 - DNA, 16 bp, Homo sapiens
tctcccaccctcttcc

SEQ ID NO: 6431356 - DNA, 12 bp, Homo sapiens
tctcccaccctg

SEQ ID NO: 6431357 - DNA, 14 bp, Homo sapiens
tctcccaccctgta

SEQ ID NO: 6431358 - DNA, 21 bp, Homo sapiens
tctcccacgtgcacagcttcc

SEQ ID NO: 6431359 - DNA, 15 bp, Homo sapiens
tctcccacttcctcc

SEQ ID NO: 6431360 - DNA, 18 bp, Homo sapiens
tctcccacttcctcctac

SEQ ID NO: 6431361 - DNA, 13 bp, Homo sapiens
tctcccactttct

SEQ ID NO: 6431362 - DNA, 14 bp, Homo sapiens
tctcccagaactat

SEQ ID NO: 6431363 - DNA, 21 bp, Homo sapiens
tctcccagaactattctgggg

SEQ ID NO: 6431364 - DNA, 15 bp, Homo sapiens
tctcccagaatccca

SEQ ID NO: 6431365 - DNA, 18 bp, Homo sapiens
tctcccagaatcccagcc

SEQ ID NO: 6431366 - DNA, 19 bp, Homo sapiens
tctcccagaatcccagccg

SEQ ID NO: 6431367 - DNA, 17 bp, Homo sapiens
tctcccagacctaggga

SEQ ID NO: 6431368 - DNA, 14 bp, Homo sapiens
tctcccagaggctc

SEQ ID NO: 6431369 - DNA, 21 bp, Homo sapiens
tctcccagaggctcctggagc

SEQ ID NO: 6431370 - DNA, 21 bp, Homo sapiens
tctcccagataatgtgaaaat

SEQ ID NO: 6431371 - DNA, 23 bp, Homo sapiens
tctcccagataatgtgaaaatgg

SEQ ID NO: 6431372 - DNA, 15 bp, Homo sapiens
tctcccagatcctgg

SEQ ID NO: 6431373 - DNA, 22 bp, Homo sapiens
tctcccagatcgctcccttggc

SEQ ID NO: 6431374 - DNA, 17 bp, Homo sapiens
tctcccagcactgcctc

SEQ ID NO: 6431375 - DNA, 18 bp, Homo sapiens
tctcccagcccacctcaa

SEQ ID NO: 6431376 - DNA, 14 bp, Homo sapiens
tctcccagctctag

SEQ ID NO: 6431377 - DNA, 19 bp, Homo sapiens
tctcccaggcaaggctgtg

SEQ ID NO: 6431378 - DNA, 13 bp, Homo sapiens
tctcccaggcccc

SEQ ID NO: 6431379 - DNA, 20 bp, Homo sapiens
tctcccaggccccatgacct

SEQ ID NO: 6431380 - DNA, 15 bp, Homo sapiens
tctcccaggccccct

SEQ ID NO: 6431381 - DNA, 12 bp, Homo sapiens
tctcccaggcct

SEQ ID NO: 6431382 - DNA, 16 bp, Homo sapiens
tctcccaggcctgcct

SEQ ID NO: 6431383 - DNA, 18 bp, Homo sapiens
tctcccaggcctgcctgc

SEQ ID NO: 6431384 - DNA, 14 bp, Homo sapiens
tctcccaggctgtc

SEQ ID NO: 6431385 - DNA, 10 bp, Homo sapiens
tctcccaggt

SEQ ID NO: 6431386 - DNA, 17 bp, Homo sapiens
tctcccaggtaccagct

SEQ ID NO: 6431387 - DNA, 18 bp, Homo sapiens
tctcccaggtaccagctg

SEQ ID NO: 6431388 - DNA, 16 bp, Homo sapiens
tctcccagtatgtttt

SEQ ID NO: 6431389 - DNA, 21 bp, Homo sapiens
tctcccagtgtgagaccccaa

SEQ ID NO: 6431390 - DNA, 23 bp, Homo sapiens
tctcccatccagtgtctcacagc

SEQ ID NO: 6431391 - DNA, 14 bp, Homo sapiens
tctcccatccccct

SEQ ID NO: 6431392 - DNA, 20 bp, Homo sapiens
tctcccatccccctgccctc

SEQ ID NO: 6431393 - DNA, 20 bp, Homo sapiens
tctcccatcctgatcccaga

SEQ ID NO: 6431394 - DNA, 22 bp, Homo sapiens
tctcccatcctgatcccagacc

SEQ ID NO: 6431395 - DNA, 15 bp, Homo sapiens
tctcccatcttaact

SEQ ID NO: 6431396 - DNA, 21 bp, Homo sapiens
tctcccatggagccccagccc

SEQ ID NO: 6431397 - DNA, 22 bp, Homo sapiens
tctcccatggcttaatgcttct

SEQ ID NO: 6431398 - DNA, 13 bp, Homo sapiens
tctcccatggggg

SEQ ID NO: 6431399 - DNA, 19 bp, Homo sapiens
tctcccattgtccctctgc

SEQ ID NO: 6431400 - DNA, 19 bp, Homo sapiens
tctccccaaagctttatct

SEQ ID NO: 6431401 - DNA, 22 bp, Homo sapiens
tctccccaaccctaggttccct

SEQ ID NO: 6431402 - DNA, 18 bp, Homo sapiens
tctccccaatccatgctt

SEQ ID NO: 6431403 - DNA, 22 bp, Homo sapiens
tctccccaatccatgcttcact

SEQ ID NO: 6431404 - DNA, 18 bp, Homo sapiens
tctccccacaccctggag

SEQ ID NO: 6431405 - DNA, 13 bp, Homo sapiens
tctccccacacta

SEQ ID NO: 6431406 - DNA, 22 bp, Homo sapiens
tctccccacactaacctgggtt

SEQ ID NO: 6431407 - DNA, 14 bp, Homo sapiens
tctccccacagcct

SEQ ID NO: 6431408 - DNA, 23 bp, Homo sapiens
tctccccacccagacctgcctgt

SEQ ID NO: 6431409 - DNA, 17 bp, Homo sapiens
tctccccacccctaccc

SEQ ID NO: 6431410 - DNA, 20 bp, Homo sapiens
tctccccagaagacacagga

SEQ ID NO: 6431411 - DNA, 12 bp, Homo sapiens
tctccccagaat

SEQ ID NO: 6431412 - DNA, 23 bp, Homo sapiens
tctccccagcaagtgagagctgg

SEQ ID NO: 6431413 - DNA, 18 bp, Homo sapiens
tctccccagccagaggtg

SEQ ID NO: 6431414 - DNA, 14 bp, Homo sapiens
tctccccagcccag

SEQ ID NO: 6431415 - DNA, 18 bp, Homo sapiens
tctccccagcccagagac

SEQ ID NO: 6431416 - DNA, 19 bp, Homo sapiens
tctccccagcccagagaca

SEQ ID NO: 6431417 - DNA, 21 bp, Homo sapiens
tctccccagccccctcccacc

SEQ ID NO: 6431418 - DNA, 14 bp, Homo sapiens
tctccccagctccc

SEQ ID NO: 6431419 - DNA, 15 bp, Homo sapiens
tctccccagctccca

SEQ ID NO: 6431420 - DNA, 18 bp, Homo sapiens
tctccccagctcccagga

SEQ ID NO: 6431421 - DNA, 16 bp, Homo sapiens
tctccccaggcctcca

SEQ ID NO: 6431422 - DNA, 19 bp, Homo sapiens
tctccccaggcctccagcc

SEQ ID NO: 6431423 - DNA, 20 bp, Homo sapiens
tctccccagggttcagtcct

SEQ ID NO: 6431424 - DNA, 12 bp, Homo sapiens
tctcccccaaca

SEQ ID NO: 6431425 - DNA, 13 bp, Homo sapiens
tctcccccaaccc

SEQ ID NO: 6431426 - DNA, 22 bp, Homo sapiens
tctcccccaacccacctctggc

SEQ ID NO: 6431427 - DNA, 19 bp, Homo sapiens
tctcccccaaccccctgca

SEQ ID NO: 6431428 - DNA, 12 bp, Homo sapiens
tctcccccaccc

SEQ ID NO: 6431429 - DNA, 17 bp, Homo sapiens
tctcccccaccctgtgc

SEQ ID NO: 6431430 - DNA, 20 bp, Homo sapiens
tctcccccacccttgttcca

SEQ ID NO: 6431431 - DNA, 16 bp, Homo sapiens
tctcccccactccact

SEQ ID NO: 6431432 - DNA, 22 bp, Homo sapiens
tctcccccagagtgctgtcggg

SEQ ID NO: 6431433 - DNA, 17 bp, Homo sapiens
tctcccccagccccatc

SEQ ID NO: 6431434 - DNA, 18 bp, Homo sapiens
tctcccccagccccatcc

SEQ ID NO: 6431435 - DNA, 19 bp, Homo sapiens
tctcccccatagcaccctg

SEQ ID NO: 6431436 - DNA, 16 bp, Homo sapiens
tctcccccccccctcc

SEQ ID NO: 6431437 - DNA, 21 bp, Homo sapiens
tctcccccccggggctgggtt

SEQ ID NO: 6431438 - DNA, 14 bp, Homo sapiens
tctcccccgccctg

SEQ ID NO: 6431439 - DNA, 20 bp, Homo sapiens
tctcccccgccctgccccgc

SEQ ID NO: 6431440 - DNA, 15 bp, Homo sapiens
tctccccctcctcca

SEQ ID NO: 6431441 - DNA, 13 bp, Homo sapiens
tctccccctctgt

SEQ ID NO: 6431442 - DNA, 16 bp, Homo sapiens
tctccccctctgtctt

SEQ ID NO: 6431443 - DNA, 13 bp, Homo sapiens
tctccccctgcag

SEQ ID NO: 6431444 - DNA, 14 bp, Homo sapiens
tctccccctgcagc

SEQ ID NO: 6431445 - DNA, 18 bp, Homo sapiens
tctcccccttaccccaca

SEQ ID NO: 6431446 - DNA, 15 bp, Homo sapiens
tctcccccttcagct

SEQ ID NO: 6431447 - DNA, 17 bp, Homo sapiens
tctcccccttcagctcc

SEQ ID NO: 6431448 - DNA, 18 bp, Homo sapiens
tctcccccttcagctcct

SEQ ID NO: 6431449 - DNA, 20 bp, Homo sapiens
tctcccccttcagctcctga

SEQ ID NO: 6431450 - DNA, 22 bp, Homo sapiens
tctcccccttcagctcctgagt

SEQ ID NO: 6431451 - DNA, 19 bp, Homo sapiens
tctcccccttgtcttcccc

SEQ ID NO: 6431452 - DNA, 20 bp, Homo sapiens
tctccccgcagcccgcctgc

SEQ ID NO: 6431453 - DNA, 22 bp, Homo sapiens
tctccccgcagcccgcctgccg

SEQ ID NO: 6431454 - DNA, 19 bp, Homo sapiens
tctccccgcagccctctcc

SEQ ID NO: 6431455 - DNA, 15 bp, Homo sapiens
tctccccgctcaggg

SEQ ID NO: 6431456 - DNA, 12 bp, Homo sapiens
tctccccgctct

SEQ ID NO: 6431457 - DNA, 18 bp, Homo sapiens
tctccccggcaggcctga

SEQ ID NO: 6431458 - DNA, 23 bp, Homo sapiens
tctcccctaccaggctgtaaatg

SEQ ID NO: 6431459 - DNA, 20 bp, Homo sapiens
tctcccctagagccctctcc

SEQ ID NO: 6431460 - DNA, 23 bp, Homo sapiens
tctcccctagctcaccaggcctg

SEQ ID NO: 6431461 - DNA, 19 bp, Homo sapiens
tctcccctattttttggta

SEQ ID NO: 6431462 - DNA, 11 bp, Homo sapiens
tctcccctcaa

SEQ ID NO: 6431463 - DNA, 14 bp, Homo sapiens
tctcccctccagcc

SEQ ID NO: 6431464 - DNA, 21 bp, Homo sapiens
tctcccctccccatctgtgtt

SEQ ID NO: 6431465 - DNA, 22 bp, Homo sapiens
tctcccctccccatctgtgttc

SEQ ID NO: 6431466 - DNA, 20 bp, Homo sapiens
tctcccctccccgcctggcc

SEQ ID NO: 6431467 - DNA, 15 bp, Homo sapiens
tctcccctccctctt

SEQ ID NO: 6431468 - DNA, 17 bp, Homo sapiens
tctcccctccctcttcc

SEQ ID NO: 6431469 - DNA, 17 bp, Homo sapiens
tctcccctcctgctggg

SEQ ID NO: 6431470 - DNA, 22 bp, Homo sapiens
tctcccctcgttaacacatggc

SEQ ID NO: 6431471 - DNA, 23 bp, Homo sapiens
tctcccctcgttaacacatggct

SEQ ID NO: 6431472 - DNA, 12 bp, Homo sapiens
tctcccctctcg

SEQ ID NO: 6431473 - DNA, 14 bp, Homo sapiens
tctcccctctcgcc

SEQ ID NO: 6431474 - DNA, 18 bp, Homo sapiens
tctcccctctgcaacccc

SEQ ID NO: 6431475 - DNA, 13 bp, Homo sapiens
tctcccctctgcc

SEQ ID NO: 6431476 - DNA, 16 bp, Homo sapiens
tctcccctctgccctg

SEQ ID NO: 6431477 - DNA, 17 bp, Homo sapiens
tctcccctctgccctgt

SEQ ID NO: 6431478 - DNA, 16 bp, Homo sapiens
tctcccctctgctggc

SEQ ID NO: 6431479 - DNA, 18 bp, Homo sapiens
tcacctgtttttaagctg

SEQ ID NO: 6431480 - DNA, 16 bp, Homo sapiens
tcaccttagaccacca

SEQ ID NO: 6431481 - DNA, 20 bp, Homo sapiens
tcaccttagaccaccaagcc

SEQ ID NO: 6431482 - DNA, 16 bp, Homo sapiens
tcaccttatgtattat

SEQ ID NO: 6431483 - DNA, 21 bp, Homo sapiens
tcaccttcaaaatgttctatt

SEQ ID NO: 6431484 - DNA, 22 bp, Homo sapiens
tcaccttcaaaatgttctattt

SEQ ID NO: 6431485 - DNA, 14 bp, Homo sapiens
tcaccttccatgtc

SEQ ID NO: 6431486 - DNA, 21 bp, Homo sapiens
tcaccttccatgtcaggccag

SEQ ID NO: 6431487 - DNA, 19 bp, Homo sapiens
tcaccttccctagttcttt

SEQ ID NO: 6431488 - DNA, 13 bp, Homo sapiens
tcaccttccctcg

SEQ ID NO: 6431489 - DNA, 13 bp, Homo sapiens
tcaccttcccttg

SEQ ID NO: 6431490 - DNA, 13 bp, Homo sapiens
tcaccttcctagt

SEQ ID NO: 6431491 - DNA, 17 bp, Homo sapiens
tcaccttcctagttctt

SEQ ID NO: 6431492 - DNA, 17 bp, Homo sapiens
tcaccttcctgggcagc

SEQ ID NO: 6431493 - DNA, 23 bp, Homo sapiens
tcaccttcctgggcagcccagag

SEQ ID NO: 6431494 - DNA, 17 bp, Homo sapiens
tcaccttccttgaaatt

SEQ ID NO: 6431495 - DNA, 12 bp, Homo sapiens
tcaccttcgagt

SEQ ID NO: 6431496 - DNA, 17 bp, Homo sapiens
tcaccttcgagtagaga

SEQ ID NO: 6431497 - DNA, 22 bp, Homo sapiens
tcaccttcgtttactatgcctg

SEQ ID NO: 6431498 - DNA, 20 bp, Homo sapiens
tcaccttctagtcttggcca

SEQ ID NO: 6431499 - DNA, 14 bp, Homo sapiens
tcaccttctgtttt

SEQ ID NO: 6431500 - DNA, 12 bp, Homo sapiens
tcaccttctttg

SEQ ID NO: 6431501 - DNA, 21 bp, Homo sapiens
tcaccttgcaacacacagaca

SEQ ID NO: 6431502 - DNA, 20 bp, Homo sapiens
tcaccttgcactcctcacac

SEQ ID NO: 6431503 - DNA, 21 bp, Homo sapiens
tcaccttgcactcctcacaca

SEQ ID NO: 6431504 - DNA, 20 bp, Homo sapiens
tcaccttggagcctgaacat

SEQ ID NO: 6431505 - DNA, 21 bp, Homo sapiens
tcaccttggagcctgaacatg

SEQ ID NO: 6431506 - DNA, 23 bp, Homo sapiens
tcaccttggcaccagacacccag

SEQ ID NO: 6431507 - DNA, 18 bp, Homo sapiens
tcaccttgggctggggga

SEQ ID NO: 6431508 - DNA, 21 bp, Homo sapiens
tcacctttatatatgtactag

SEQ ID NO: 6431509 - DNA, 16 bp, Homo sapiens
tcacctttccaaggcc

SEQ ID NO: 6431510 - DNA, 12 bp, Homo sapiens
tcacctttccca

SEQ ID NO: 6431511 - DNA, 19 bp, Homo sapiens
tcacctttcccactttctt

SEQ ID NO: 6431512 - DNA, 15 bp, Homo sapiens
tcacctttcccagat

SEQ ID NO: 6431513 - DNA, 14 bp, Homo sapiens
tcacctttcccatc

SEQ ID NO: 6431514 - DNA, 16 bp, Homo sapiens
tcacctttccccactc

SEQ ID NO: 6431515 - DNA, 21 bp, Homo sapiens
tcacctttcctctccctcagg

SEQ ID NO: 6431516 - DNA, 11 bp, Homo sapiens
tcacctttctg

SEQ ID NO: 6431517 - DNA, 13 bp, Homo sapiens
tcacctttctggg

SEQ ID NO: 6431518 - DNA, 18 bp, Homo sapiens
tcacctttctgggctttc

SEQ ID NO: 6431519 - DNA, 16 bp, Homo sapiens
tcacctttggtgcaga

SEQ ID NO: 6431520 - DNA, 14 bp, Homo sapiens
tcacctttgtcccc

SEQ ID NO: 6431521 - DNA, 15 bp, Homo sapiens
tcacctttgtcccca

SEQ ID NO: 6431522 - DNA, 18 bp, Homo sapiens
tcacctttgtccccaccg

SEQ ID NO: 6431523 - DNA, 22 bp, Homo sapiens
tcacctttgtccccaccgcaga

SEQ ID NO: 6431524 - DNA, 16 bp, Homo sapiens
tcaccttttaaatcct

SEQ ID NO: 6431525 - DNA, 18 bp, Homo sapiens
tcaccttttaaatcctgt

SEQ ID NO: 6431526 - DNA, 19 bp, Homo sapiens
tcaccttttaaatcctgtt

SEQ ID NO: 6431527 - DNA, 23 bp, Homo sapiens
tcaccttttaaatcctgttgaaa

SEQ ID NO: 6431528 - DNA, 15 bp, Homo sapiens
tcaccttttcaggaa

SEQ ID NO: 6431529 - DNA, 22 bp, Homo sapiens
tcaccttttctaaaaagtcaat

SEQ ID NO: 6431530 - DNA, 17 bp, Homo sapiens
tcaccttttctgtggct

SEQ ID NO: 6431531 - DNA, 17 bp, Homo sapiens
tcacctttttaataaaa

SEQ ID NO: 6431532 - DNA, 21 bp, Homo sapiens
tcacctttttaataaaaatac

SEQ ID NO: 6431533 - DNA, 21 bp, Homo sapiens
tcacctttttgacttttccaa

SEQ ID NO: 6431534 - DNA, 18 bp, Homo sapiens
tcacgaactcattaacaa

SEQ ID NO: 6431535 - DNA, 13 bp, Homo sapiens
tcacgaactgttc

SEQ ID NO: 6431536 - DNA, 16 bp, Homo sapiens
tcacgagatcttcctt

SEQ ID NO: 6431537 - DNA, 13 bp, Homo sapiens
tcacgagcccatt

SEQ ID NO: 6431538 - DNA, 19 bp, Homo sapiens
tcacgaggaatctgggcct

SEQ ID NO: 6431539 - DNA, 16 bp, Homo sapiens
tcacgatcacaggcct

SEQ ID NO: 6431540 - DNA, 23 bp, Homo sapiens
tcacgatgaaattgaacctggtt

SEQ ID NO: 6431541 - DNA, 20 bp, Homo sapiens
tcacgattatgactaaagta

SEQ ID NO: 6431542 - DNA, 21 bp, Homo sapiens
tcacgattgtcatcaggagaa

SEQ ID NO: 6431543 - DNA, 23 bp, Homo sapiens
tcacgatttgcaggattcccttc

SEQ ID NO: 6431544 - DNA, 15 bp, Homo sapiens
tcacgcaacttgaaa

SEQ ID NO: 6431545 - DNA, 15 bp, Homo sapiens
tcacgcacctcccat

SEQ ID NO: 6431546 - DNA, 15 bp, Homo sapiens
tcacgcaggctgagt

SEQ ID NO: 6431547 - DNA, 20 bp, Homo sapiens
tcacgccacccccgccccca

SEQ ID NO: 6431548 - DNA, 14 bp, Homo sapiens
tcacgccactgcac

SEQ ID NO: 6431549 - DNA, 17 bp, Homo sapiens
tcacgccattctcctgc

SEQ ID NO: 6431550 - DNA, 18 bp, Homo sapiens
tcacgccattctcctgcc

SEQ ID NO: 6431551 - DNA, 22 bp, Homo sapiens
tcacgccattctcctgcctcag

SEQ ID NO: 6431552 - DNA, 23 bp, Homo sapiens
tcacgccattctcctgcctcagc

SEQ ID NO: 6431553 - DNA, 23 bp, Homo sapiens
tcacgccattgtactccagcctg

SEQ ID NO: 6431554 - DNA, 17 bp, Homo sapiens
tcacgcccagcctcctc

SEQ ID NO: 6431555 - DNA, 14 bp, Homo sapiens
tcacgccccacact

SEQ ID NO: 6431556 - DNA, 16 bp, Homo sapiens
tcacgcccccaggaat

SEQ ID NO: 6431557 - DNA, 22 bp, Homo sapiens
tcacgccgggagaagccacctt

SEQ ID NO: 6431558 - DNA, 20 bp, Homo sapiens
tcacgccgtaattctttctg

SEQ ID NO: 6431559 - DNA, 18 bp, Homo sapiens
tcacgcctataatcccag

SEQ ID NO: 6431560 - DNA, 20 bp, Homo sapiens
tcacgcctgtaatcccagca

SEQ ID NO: 6431561 - DNA, 20 bp, Homo sapiens
tcacgcctgtaatcctagca

SEQ ID NO: 6431562 - DNA, 16 bp, Homo sapiens
tcacgcctgtgcagtg

SEQ ID NO: 6431563 - DNA, 16 bp, Homo sapiens
tcacgcgttctgggag

SEQ ID NO: 6431564 - DNA, 17 bp, Homo sapiens
tcacgctcacccagtca

SEQ ID NO: 6431565 - DNA, 16 bp, Homo sapiens
tcacgctcatgtcctg

SEQ ID NO: 6431566 - DNA, 20 bp, Homo sapiens
tcacgctcccccgcagtccc

SEQ ID NO: 6431567 - DNA, 21 bp, Homo sapiens
tcacgctcccccgcagtcccc

SEQ ID NO: 6431568 - DNA, 20 bp, Homo sapiens
tcacgctccctgacttctcc

SEQ ID NO: 6431569 - DNA, 14 bp, Homo sapiens
tcacgctcgcatct

SEQ ID NO: 6431570 - DNA, 15 bp, Homo sapiens
tcacgctctccatca

SEQ ID NO: 6431571 - DNA, 20 bp, Homo sapiens
tcacgctgacagcctcctag

SEQ ID NO: 6431572 - DNA, 22 bp, Homo sapiens
tcacgctgacagcctcctaggc

SEQ ID NO: 6431573 - DNA, 20 bp, Homo sapiens
tcacgctggggctctctgag

SEQ ID NO: 6431574 - DNA, 21 bp, Homo sapiens
tcacgctggggctctctgaga

SEQ ID NO: 6431575 - DNA, 18 bp, Homo sapiens
tcacgcttattgcccagg

SEQ ID NO: 6431576 - DNA, 14 bp, Homo sapiens
tcacgctttcatga

SEQ ID NO: 6431577 - DNA, 16 bp, Homo sapiens
tcacgctttcctgaat

SEQ ID NO: 6431578 - DNA, 15 bp, Homo sapiens
tcacgctttgtttac

SEQ ID NO: 6431579 - DNA, 16 bp, Homo sapiens
tcacggaagagccttg

SEQ ID NO: 6431580 - DNA, 17 bp, Homo sapiens
tcacggaagagccttgc

SEQ ID NO: 6431581 - DNA, 17 bp, Homo sapiens
tcacggacaggaagcac

SEQ ID NO: 6431582 - DNA, 13 bp, Homo sapiens
tcacggagacagc

SEQ ID NO: 6431583 - DNA, 13 bp, Homo sapiens
tcacggcctggca

SEQ ID NO: 6431584 - DNA, 19 bp, Homo sapiens
tcacggcctggcatgcagc

SEQ ID NO: 6431585 - DNA, 15 bp, Homo sapiens
tcacggctcactgca

SEQ ID NO: 6431586 - DNA, 19 bp, Homo sapiens
tcacggctgcgcactgtgt

SEQ ID NO: 6431587 - DNA, 23 bp, Homo sapiens
tcacgggaccgtcagcatgggct

SEQ ID NO: 6431588 - DNA, 17 bp, Homo sapiens
tcacgggactatttcca

SEQ ID NO: 6431589 - DNA, 19 bp, Homo sapiens
tcacgggcatgggcactcc

SEQ ID NO: 6431590 - DNA, 23 bp, Homo sapiens
tcacgggccctgccccagcccct

SEQ ID NO: 6431591 - DNA, 19 bp, Homo sapiens
tcacgggcggtcctgcaca

SEQ ID NO: 6431592 - DNA, 18 bp, Homo sapiens
tcacggggcccttacctg

SEQ ID NO: 6431593 - DNA, 20 bp, Homo sapiens
tcacggggttccctcctagc

SEQ ID NO: 6431594 - DNA, 19 bp, Homo sapiens
tcacggtgacacaggtcag

SEQ ID NO: 6431595 - DNA, 21 bp, Homo sapiens
tcacggtgacacaggtcaggg

SEQ ID NO: 6431596 - DNA, 18 bp, Homo sapiens
tcacggtttcacttttaa

SEQ ID NO: 6431597 - DNA, 19 bp, Homo sapiens
tcacgtaaagctagaaatg

SEQ ID NO: 6431598 - DNA, 15 bp, Homo sapiens
tcacgtaaatattca

SEQ ID NO: 6431599 - DNA, 17 bp, Homo sapiens
tcacgtaagatacaagt

SEQ ID NO: 6431600 - DNA, 17 bp, Homo sapiens
tcacgtaatcctcctga

SEQ ID NO: 6431601 - DNA, 17 bp, Homo sapiens
tcacgtaccccactggg

SEQ ID NO: 6431602 - DNA, 18 bp, Homo sapiens
tcacgtaccccactgggc

SEQ ID NO: 6431603 - DNA, 21 bp, Homo sapiens
tcacgtaccccactgggccag

SEQ ID NO: 6431604 - DNA, 17 bp, Homo sapiens
tcacgtactgtctgatt

SEQ ID NO: 6431605 - DNA, 24 bp, Homo sapiens
tcacgtatttcacagagcacgcct

SEQ ID NO: 6431606 - DNA, 13 bp, Homo sapiens
tcacgtcacactt

SEQ ID NO: 6431607 - DNA, 14 bp, Homo sapiens
tcacgtcataggaa

SEQ ID NO: 6431608 - DNA, 16 bp, Homo sapiens
tcacgtcataggaagt

SEQ ID NO: 6431609 - DNA, 16 bp, Homo sapiens
tcacgtctgtgagtct

SEQ ID NO: 6431610 - DNA, 22 bp, Homo sapiens
tcacgtgaaatatttaagtata

SEQ ID NO: 6431611 - DNA, 14 bp, Homo sapiens
tcacgtgaccctgt

SEQ ID NO: 6431612 - DNA, 19 bp, Homo sapiens
tcacgtgaggcccctgtgc

SEQ ID NO: 6431613 - DNA, 14 bp, Homo sapiens
tcacgtgcaaagcc

SEQ ID NO: 6431614 - DNA, 19 bp, Homo sapiens
tcacgtgcaggacagctct

SEQ ID NO: 6431615 - DNA, 23 bp, Homo sapiens
tcacgtgcaggacagctcttgat

SEQ ID NO: 6431616 - DNA, 17 bp, Homo sapiens
tcacgtgcgctgggcac

SEQ ID NO: 6431617 - DNA, 23 bp, Homo sapiens
tcacgtggcctccgcagtgtctc

SEQ ID NO: 6431618 - DNA, 21 bp, Homo sapiens
tcacgtggctcgactatagaa

SEQ ID NO: 6431619 - DNA, 23 bp, Homo sapiens
tcacgtgtcttaggctgatgcca

SEQ ID NO: 6431620 - DNA, 12 bp, Homo sapiens
tcacgtgtgtga

SEQ ID NO: 6431621 - DNA, 17 bp, Homo sapiens
tcacgttagaggaaaaa

SEQ ID NO: 6431622 - DNA, 20 bp, Homo sapiens
tcactaaaagcatgaattgg

SEQ ID NO: 6431623 - DNA, 17 bp, Homo sapiens
tcactaaactttatttg

SEQ ID NO: 6431624 - DNA, 16 bp, Homo sapiens
tcactaaagcatgaaa

SEQ ID NO: 6431625 - DNA, 21 bp, Homo sapiens
tcactaaagggcttcatttta

SEQ ID NO: 6431626 - DNA, 16 bp, Homo sapiens
tcactaaagggtgccc

SEQ ID NO: 6431627 - DNA, 21 bp, Homo sapiens
tcactaaataaacacgatttt

SEQ ID NO: 6431628 - DNA, 12 bp, Homo sapiens
tcactaaatctt

SEQ ID NO: 6431629 - DNA, 17 bp, Homo sapiens
tcactaaatttctcagt

SEQ ID NO: 6431630 - DNA, 17 bp, Homo sapiens
tcactaacagggagaag

SEQ ID NO: 6431631 - DNA, 19 bp, Homo sapiens
tcactaacattatattgca

SEQ ID NO: 6431632 - DNA, 22 bp, Homo sapiens
tcactaacattatattgcaatg

SEQ ID NO: 6431633 - DNA, 15 bp, Homo sapiens
tcactaagaaagaaa

SEQ ID NO: 6431634 - DNA, 14 bp, Homo sapiens
tcactaagccatgc

SEQ ID NO: 6431635 - DNA, 12 bp, Homo sapiens
tcactaaggact

SEQ ID NO: 6431636 - DNA, 19 bp, Homo sapiens
tcactaatactaattcatt

SEQ ID NO: 6431637 - DNA, 12 bp, Homo sapiens
tcactaatactt

SEQ ID NO: 6431638 - DNA, 12 bp, Homo sapiens
tcactacaaaaa

SEQ ID NO: 6431639 - DNA, 14 bp, Homo sapiens
tcactacaaaaaga

SEQ ID NO: 6431640 - DNA, 16 bp, Homo sapiens
tcactacaaaaataca

SEQ ID NO: 6431641 - DNA, 20 bp, Homo sapiens
tcactacaacattagaatat

SEQ ID NO: 6431642 - DNA, 18 bp, Homo sapiens
tcactacaagtcagctcc

SEQ ID NO: 6431643 - DNA, 19 bp, Homo sapiens
tcactacagcatcaataga

SEQ ID NO: 6431644 - DNA, 23 bp, Homo sapiens
tcactacagcatcaatagaaagt

SEQ ID NO: 6431645 - DNA, 19 bp, Homo sapiens
tcactacagggagaaaatc

SEQ ID NO: 6431646 - DNA, 18 bp, Homo sapiens
tcactacatgggccagcc

SEQ ID NO: 6431647 - DNA, 20 bp, Homo sapiens
tcactacatgggccagccct

SEQ ID NO: 6431648 - DNA, 21 bp, Homo sapiens
tcactacatgggccagccctt

SEQ ID NO: 6431649 - DNA, 19 bp, Homo sapiens
tcactaccctattctctct

SEQ ID NO: 6431650 - DNA, 13 bp, Homo sapiens
tcactaccctgat

SEQ ID NO: 6431651 - DNA, 14 bp, Homo sapiens
tcactacctcctca

SEQ ID NO: 6431652 - DNA, 18 bp, Homo sapiens
tcactacctcctcaggga

SEQ ID NO: 6431653 - DNA, 19 bp, Homo sapiens
tcactacctcctcagggat

SEQ ID NO: 6431654 - DNA, 22 bp, Homo sapiens
tcactacgggggggagaaggaa

SEQ ID NO: 6431655 - DNA, 16 bp, Homo sapiens
tcactactcgagccca

SEQ ID NO: 6431656 - DNA, 15 bp, Homo sapiens
tctcccctcttatgt

SEQ ID NO: 6431657 - DNA, 11 bp, Homo sapiens
tctcccctgcc

SEQ ID NO: 6431658 - DNA, 15 bp, Homo sapiens
tctcccctgccccca

SEQ ID NO: 6431659 - DNA, 16 bp, Homo sapiens
tctcccctgcccccag

SEQ ID NO: 6431660 - DNA, 20 bp, Homo sapiens
tctcccctgcccccaggact

SEQ ID NO: 6431661 - DNA, 21 bp, Homo sapiens
tctcccctgcccccaggactg

SEQ ID NO: 6431662 - DNA, 24 bp, Homo sapiens
tctcccctgccggtgcacaggcct

SEQ ID NO: 6431663 - DNA, 17 bp, Homo sapiens
tctccccttcacgtttg

SEQ ID NO: 6431664 - DNA, 14 bp, Homo sapiens
tctccccttcctgg

SEQ ID NO: 6431665 - DNA, 17 bp, Homo sapiens
tctccccttctctgcct

SEQ ID NO: 6431666 - DNA, 16 bp, Homo sapiens
tctcccgaatcctgag

SEQ ID NO: 6431667 - DNA, 17 bp, Homo sapiens
tctcccgaatcctgagg

SEQ ID NO: 6431668 - DNA, 15 bp, Homo sapiens
tctcccgccattggc

SEQ ID NO: 6431669 - DNA, 15 bp, Homo sapiens
tctcccgcctcagcc

SEQ ID NO: 6431670 - DNA, 16 bp, Homo sapiens
tctcccgctgctgctg

SEQ ID NO: 6431671 - DNA, 19 bp, Homo sapiens
tctcccgcttcctggcctc

SEQ ID NO: 6431672 - DNA, 22 bp, Homo sapiens
tctcccgcttcctggcctccct

SEQ ID NO: 6431673 - DNA, 18 bp, Homo sapiens
tctcccggacctggacta

SEQ ID NO: 6431674 - DNA, 14 bp, Homo sapiens
tctcccggccctca

SEQ ID NO: 6431675 - DNA, 20 bp, Homo sapiens
tctcccgggaagccaccctc

SEQ ID NO: 6431676 - DNA, 20 bp, Homo sapiens
tctcccgtcagggcccaagt

SEQ ID NO: 6431677 - DNA, 14 bp, Homo sapiens
tctcccgtctcgcc

SEQ ID NO: 6431678 - DNA, 17 bp, Homo sapiens
tctcccgtctcgcctgc

SEQ ID NO: 6431679 - DNA, 14 bp, Homo sapiens
tctccctaaaataa

SEQ ID NO: 6431680 - DNA, 16 bp, Homo sapiens
tctccctaaaataaaa

SEQ ID NO: 6431681 - DNA, 18 bp, Homo sapiens
tctccctaaaataaaaac

SEQ ID NO: 6431682 - DNA, 19 bp, Homo sapiens
tctccctaaaataaaaacc

SEQ ID NO: 6431683 - DNA, 19 bp, Homo sapiens
tctccctaaggaatctgaa

SEQ ID NO: 6431684 - DNA, 15 bp, Homo sapiens
tctccctacctccct

SEQ ID NO: 6431685 - DNA, 14 bp, Homo sapiens
tctccctaccttgc

SEQ ID NO: 6431686 - DNA, 17 bp, Homo sapiens
tctccctaccttgcctc

SEQ ID NO: 6431687 - DNA, 19 bp, Homo sapiens
tctccctaccttgcctcct

SEQ ID NO: 6431688 - DNA, 14 bp, Homo sapiens
tctccctagaaaca

SEQ ID NO: 6431689 - DNA, 14 bp, Homo sapiens
tctccctagccctt

SEQ ID NO: 6431690 - DNA, 16 bp, Homo sapiens
tctccctagctcctcc

SEQ ID NO: 6431691 - DNA, 18 bp, Homo sapiens
tctccctataatgctgga

SEQ ID NO: 6431692 - DNA, 23 bp, Homo sapiens
tctccctcaacaagggagagacc

SEQ ID NO: 6431693 - DNA, 23 bp, Homo sapiens
tctccctcaactgaaggggtgca

SEQ ID NO: 6431694 - DNA, 15 bp, Homo sapiens
tctccctccactcct

SEQ ID NO: 6431695 - DNA, 16 bp, Homo sapiens
tctccctccactcctc

SEQ ID NO: 6431696 - DNA, 19 bp, Homo sapiens
tctccctccactcctccca

SEQ ID NO: 6431697 - DNA, 16 bp, Homo sapiens
tctccctccagctgga

SEQ ID NO: 6431698 - DNA, 23 bp, Homo sapiens
tctccctccccaaatggctgctt

SEQ ID NO: 6431699 - DNA, 19 bp, Homo sapiens
tctccctccccagaaacag

SEQ ID NO: 6431700 - DNA, 14 bp, Homo sapiens
tctccctcccccag

SEQ ID NO: 6431701 - DNA, 17 bp, Homo sapiens
tctccctcccctctcag

SEQ ID NO: 6431702 - DNA, 18 bp, Homo sapiens
tctccctcccctctcaga

SEQ ID NO: 6431703 - DNA, 23 bp, Homo sapiens
tctccctcccctctcagaacata

SEQ ID NO: 6431704 - DNA, 19 bp, Homo sapiens
tctccctcccttctttcct

SEQ ID NO: 6431705 - DNA, 21 bp, Homo sapiens
tctccctcctccaggaagcct

SEQ ID NO: 6431706 - DNA, 17 bp, Homo sapiens
tctccctctcatgtccc

SEQ ID NO: 6431707 - DNA, 21 bp, Homo sapiens
tctccctctcatgtccctcca

SEQ ID NO: 6431708 - DNA, 17 bp, Homo sapiens
tctccctctcctgccta

SEQ ID NO: 6431709 - DNA, 18 bp, Homo sapiens
tctccctctcctgcctac

SEQ ID NO: 6431710 - DNA, 21 bp, Homo sapiens
tctccctctcctgcctactca

SEQ ID NO: 6431711 - DNA, 14 bp, Homo sapiens
tctccctctctctg

SEQ ID NO: 6431712 - DNA, 13 bp, Homo sapiens
tctccctctctgc

SEQ ID NO: 6431713 - DNA, 12 bp, Homo sapiens
tctccctctgat

SEQ ID NO: 6431714 - DNA, 14 bp, Homo sapiens
tctccctctggccc

SEQ ID NO: 6431715 - DNA, 16 bp, Homo sapiens
tctccctctggccctg

SEQ ID NO: 6431716 - DNA, 16 bp, Homo sapiens
tctccctctggtccca

SEQ ID NO: 6431717 - DNA, 15 bp, Homo sapiens
tctccctcttctcaa

SEQ ID NO: 6431718 - DNA, 17 bp, Homo sapiens
tctccctctttctagcc

SEQ ID NO: 6431719 - DNA, 21 bp, Homo sapiens
tctccctctttctagcctggg

SEQ ID NO: 6431720 - DNA, 24 bp, Homo sapiens
tctccctgacatttctaacatatg

SEQ ID NO: 6431721 - DNA, 20 bp, Homo sapiens
tctccctgaccttctccagg

SEQ ID NO: 6431722 - DNA, 21 bp, Homo sapiens
tctccctgaccttctccaggg

SEQ ID NO: 6431723 - DNA, 22 bp, Homo sapiens
tctccctgagatgggcttccca

SEQ ID NO: 6431724 - DNA, 23 bp, Homo sapiens
tctccctgagcctgccccagctg

SEQ ID NO: 6431725 - DNA, 12 bp, Homo sapiens
tctccctgcaca

SEQ ID NO: 6431726 - DNA, 18 bp, Homo sapiens
tctccctgcacagcctct

SEQ ID NO: 6431727 - DNA, 24 bp, Homo sapiens
tctccctgcacgcattttctctgt

SEQ ID NO: 6431728 - DNA, 21 bp, Homo sapiens
tctccctgcactccctcctgg

SEQ ID NO: 6431729 - DNA, 15 bp, Homo sapiens
tctccctgccagagg

SEQ ID NO: 6431730 - DNA, 15 bp, Homo sapiens
tctccctgccatccc

SEQ ID NO: 6431731 - DNA, 14 bp, Homo sapiens
tctccctgccgcct

SEQ ID NO: 6431732 - DNA, 12 bp, Homo sapiens
tctccctgcctc

SEQ ID NO: 6431733 - DNA, 21 bp, Homo sapiens
tctccctgcctcactcctccg

SEQ ID NO: 6431734 - DNA, 13 bp, Homo sapiens
tctccctgccttt

SEQ ID NO: 6431735 - DNA, 13 bp, Homo sapiens
tctccctgcttca

SEQ ID NO: 6431736 - DNA, 16 bp, Homo sapiens
tctccctgctttggtc

SEQ ID NO: 6431737 - DNA, 10 bp, Homo sapiens
tctccctgga

SEQ ID NO: 6431738 - DNA, 15 bp, Homo sapiens
tctccctggagaagc

SEQ ID NO: 6431739 - DNA, 19 bp, Homo sapiens
tctccctggccacccttgg

SEQ ID NO: 6431740 - DNA, 13 bp, Homo sapiens
tctccctggccct

SEQ ID NO: 6431741 - DNA, 15 bp, Homo sapiens
tctccctggctccct

SEQ ID NO: 6431742 - DNA, 21 bp, Homo sapiens
tctccctggggacggggctcc

SEQ ID NO: 6431743 - DNA, 16 bp, Homo sapiens
tctccctggtgcttat

SEQ ID NO: 6431744 - DNA, 14 bp, Homo sapiens
tctccctgtacagt

SEQ ID NO: 6431745 - DNA, 20 bp, Homo sapiens
tctccctgtcacacactgga

SEQ ID NO: 6431746 - DNA, 22 bp, Homo sapiens
tctccctgtcacacactggacc

SEQ ID NO: 6431747 - DNA, 13 bp, Homo sapiens
tctccctgtgttc

SEQ ID NO: 6431748 - DNA, 20 bp, Homo sapiens
tctccctgtgttctgggctg

SEQ ID NO: 6431749 - DNA, 12 bp, Homo sapiens
tctcccttaccc

SEQ ID NO: 6431750 - DNA, 12 bp, Homo sapiens
tctcccttacta

SEQ ID NO: 6431751 - DNA, 15 bp, Homo sapiens
tctcccttactattc

SEQ ID NO: 6431752 - DNA, 16 bp, Homo sapiens
tctcccttccacctca

SEQ ID NO: 6431753 - DNA, 17 bp, Homo sapiens
tctcccttccctcctcc

SEQ ID NO: 6431754 - DNA, 19 bp, Homo sapiens
tctcccttccgtccatccc

SEQ ID NO: 6431755 - DNA, 22 bp, Homo sapiens
tctcccttcggtggaagagctc

SEQ ID NO: 6431756 - DNA, 12 bp, Homo sapiens
tctcccttctca

SEQ ID NO: 6431757 - DNA, 20 bp, Homo sapiens
tctcccttctcatctcccca

SEQ ID NO: 6431758 - DNA, 18 bp, Homo sapiens
tctcccttctcccatgag

SEQ ID NO: 6431759 - DNA, 18 bp, Homo sapiens
tctcccttctcctgacct

SEQ ID NO: 6431760 - DNA, 13 bp, Homo sapiens
tctcccttctctc

SEQ ID NO: 6431761 - DNA, 14 bp, Homo sapiens
tctcccttctttta

SEQ ID NO: 6431762 - DNA, 12 bp, Homo sapiens
tctcccttggcc

SEQ ID NO: 6431763 - DNA, 15 bp, Homo sapiens
tctcccttgggctct

SEQ ID NO: 6431764 - DNA, 18 bp, Homo sapiens
tctcccttgggctctgat

SEQ ID NO: 6431765 - DNA, 17 bp, Homo sapiens
tctccgactgctaggga

SEQ ID NO: 6431766 - DNA, 19 bp, Homo sapiens
tctccgacttcccctgggc

SEQ ID NO: 6431767 - DNA, 18 bp, Homo sapiens
tctccgagctctggtgct

SEQ ID NO: 6431768 - DNA, 22 bp, Homo sapiens
tctccgcacacctctggctgtc

SEQ ID NO: 6431769 - DNA, 17 bp, Homo sapiens
tctccgcattggaagag

SEQ ID NO: 6431770 - DNA, 19 bp, Homo sapiens
tctccgcattggaagagcc

SEQ ID NO: 6431771 - DNA, 17 bp, Homo sapiens
tctccgcccctgagccc

SEQ ID NO: 6431772 - DNA, 18 bp, Homo sapiens
tctccgcccctgagccca

SEQ ID NO: 6431773 - DNA, 13 bp, Homo sapiens
tctccgcgcctac

SEQ ID NO: 6431774 - DNA, 21 bp, Homo sapiens
tctccggccccgcctctgccc

SEQ ID NO: 6431775 - DNA, 14 bp, Homo sapiens
tctccggcctctcc

SEQ ID NO: 6431776 - DNA, 16 bp, Homo sapiens
tctccggggtctgtgc

SEQ ID NO: 6431777 - DNA, 16 bp, Homo sapiens
tctccgggtcctccta

SEQ ID NO: 6431778 - DNA, 23 bp, Homo sapiens
tctccgggtcctcctaagtccct

SEQ ID NO: 6431779 - DNA, 21 bp, Homo sapiens
tctccgggtgtggcctcagcc

SEQ ID NO: 6431780 - DNA, 14 bp, Homo sapiens
tctccgtcactcca

SEQ ID NO: 6431781 - DNA, 18 bp, Homo sapiens
tctccgtggcacttgtaa

SEQ ID NO: 6431782 - DNA, 18 bp, Homo sapiens
tctccgttagctcctgtg

SEQ ID NO: 6431783 - DNA, 20 bp, Homo sapiens
tctccgttccatctgggctt

SEQ ID NO: 6431784 - DNA, 22 bp, Homo sapiens
tctcctaaaataaacatgaagc

SEQ ID NO: 6431785 - DNA, 15 bp, Homo sapiens
tctcctaacaaaaga

SEQ ID NO: 6431786 - DNA, 19 bp, Homo sapiens
tctcctaagtttaattaca

SEQ ID NO: 6431787 - DNA, 20 bp, Homo sapiens
tctcctaccctcttattgtt

SEQ ID NO: 6431788 - DNA, 16 bp, Homo sapiens
tctcctacctgctgct

SEQ ID NO: 6431789 - DNA, 14 bp, Homo sapiens
tctcctactgagga

SEQ ID NO: 6431790 - DNA, 19 bp, Homo sapiens
tctcctagcccctctctca

SEQ ID NO: 6431791 - DNA, 14 bp, Homo sapiens
tctcctagcccctg

SEQ ID NO: 6431792 - DNA, 13 bp, Homo sapiens
tctcctagccctc

SEQ ID NO: 6431793 - DNA, 17 bp, Homo sapiens
tctcctagccctcctga

SEQ ID NO: 6431794 - DNA, 15 bp, Homo sapiens
tctcctaggcattct

SEQ ID NO: 6431795 - DNA, 21 bp, Homo sapiens
tctcctaggcattctggacct

SEQ ID NO: 6431796 - DNA, 16 bp, Homo sapiens
tctcctagggctatgg

SEQ ID NO: 6431797 - DNA, 20 bp, Homo sapiens
tctcctaggggcttggtcct

SEQ ID NO: 6431798 - DNA, 16 bp, Homo sapiens
tctcctataatctgtc

SEQ ID NO: 6431799 - DNA, 18 bp, Homo sapiens
tctcctataatctgtcaa

SEQ ID NO: 6431800 - DNA, 21 bp, Homo sapiens
tctcctatcttctccattcta

SEQ ID NO: 6431801 - DNA, 17 bp, Homo sapiens
tctcctatgtggcagct

SEQ ID NO: 6431802 - DNA, 15 bp, Homo sapiens
tctcctatgtgtaag

SEQ ID NO: 6431803 - DNA, 15 bp, Homo sapiens
tctcctcaagcctgt

SEQ ID NO: 6431804 - DNA, 18 bp, Homo sapiens
tctcctcaagcctgtggg

SEQ ID NO: 6431805 - DNA, 20 bp, Homo sapiens
tctcctcaagcctgtgggca

SEQ ID NO: 6431806 - DNA, 20 bp, Homo sapiens
tctcctcaagtccccaagat

SEQ ID NO: 6431807 - DNA, 14 bp, Homo sapiens
tctcctcaccccag

SEQ ID NO: 6431808 - DNA, 17 bp, Homo sapiens
tctcctcactctgtccc

SEQ ID NO: 6431809 - DNA, 19 bp, Homo sapiens
tctcctcactctgtccctg

SEQ ID NO: 6431810 - DNA, 20 bp, Homo sapiens
tctcctcactctgtccctgt

SEQ ID NO: 6431811 - DNA, 12 bp, Homo sapiens
tctcctcactga

SEQ ID NO: 6431812 - DNA, 12 bp, Homo sapiens
tctcctcactgc

SEQ ID NO: 6431813 - DNA, 14 bp, Homo sapiens
tctcctcactgcca

SEQ ID NO: 6431814 - DNA, 18 bp, Homo sapiens
tctcctcactgccactaa

SEQ ID NO: 6431815 - DNA, 13 bp, Homo sapiens
tctcctcagcctc

SEQ ID NO: 6431816 - DNA, 20 bp, Homo sapiens
tctcctcagcctcctcatct

SEQ ID NO: 6431817 - DNA, 22 bp, Homo sapiens
tctcctcagcctcctcatctgg

SEQ ID NO: 6431818 - DNA, 10 bp, Homo sapiens
tctcctcagg

SEQ ID NO: 6431819 - DNA, 12 bp, Homo sapiens
tctcctcaggac

SEQ ID NO: 6431820 - DNA, 13 bp, Homo sapiens
tctcctcaggaca

SEQ ID NO: 6431821 - DNA, 16 bp, Homo sapiens
tctcctcaggaccctc

SEQ ID NO: 6431822 - DNA, 19 bp, Homo sapiens
tctcctcaggaccctcagc

SEQ ID NO: 6431823 - DNA, 21 bp, Homo sapiens
tctcctcaggaccctcagccc

SEQ ID NO: 6431824 - DNA, 13 bp, Homo sapiens
tctcctcagtggc

SEQ ID NO: 6431825 - DNA, 15 bp, Homo sapiens
tctcctcagtttctc

SEQ ID NO: 6431826 - DNA, 15 bp, Homo sapiens
tctcctcatctctaa

SEQ ID NO: 6431827 - DNA, 18 bp, Homo sapiens
tctcctccaaatgctgtc

SEQ ID NO: 6431828 - DNA, 18 bp, Homo sapiens
tctcctccaatgtcctga

SEQ ID NO: 6431829 - DNA, 20 bp, Homo sapiens
tctcctccaccgccatggct

SEQ ID NO: 6431830 - DNA, 19 bp, Homo sapiens
tctcctccagccctgggca

SEQ ID NO: 6431831 - DNA, 16 bp, Homo sapiens
tctcctccatgggaga

SEQ ID NO: 6431832 - DNA, 13 bp, Homo sapiens
tctcctcccagcg

SEQ ID NO: 6431833 - DNA, 20 bp, Homo sapiens
tctcctcccagcggcctccg

SEQ ID NO: 6431834 - DNA, 13 bp, Homo sapiens
tctcctcccagct

SEQ ID NO: 6431835 - DNA, 14 bp, Homo sapiens
tctcctcccagctg

SEQ ID NO: 6431836 - DNA, 17 bp, Homo sapiens
tcactactcgagcccac

SEQ ID NO: 6431837 - DNA, 20 bp, Homo sapiens
tcactactgaacacatgtgt

SEQ ID NO: 6431838 - DNA, 14 bp, Homo sapiens
tcactactgcagtc

SEQ ID NO: 6431839 - DNA, 12 bp, Homo sapiens
tcactactgtat

SEQ ID NO: 6431840 - DNA, 16 bp, Homo sapiens
tcactagaagaaaagc

SEQ ID NO: 6431841 - DNA, 17 bp, Homo sapiens
tcactagaatggataaa

SEQ ID NO: 6431842 - DNA, 12 bp, Homo sapiens
tcactagcagct

SEQ ID NO: 6431843 - DNA, 13 bp, Homo sapiens
tcactagcagctg

SEQ ID NO: 6431844 - DNA, 15 bp, Homo sapiens
tcactagcagctgca

SEQ ID NO: 6431845 - DNA, 24 bp, Homo sapiens
tcactagcatagaatagcgacagg

SEQ ID NO: 6431846 - DNA, 14 bp, Homo sapiens
tcactagccatgat

SEQ ID NO: 6431847 - DNA, 18 bp, Homo sapiens
tcactagctgtctcagga

SEQ ID NO: 6431848 - DNA, 15 bp, Homo sapiens
tcactagctttgcct

SEQ ID NO: 6431849 - DNA, 16 bp, Homo sapiens
tcactaggcattgtga

SEQ ID NO: 6431850 - DNA, 23 bp, Homo sapiens
tcactaggcattgtgatgtttag

SEQ ID NO: 6431851 - DNA, 15 bp, Homo sapiens
tcactagtcaagaaa

SEQ ID NO: 6431852 - DNA, 20 bp, Homo sapiens
tcactagtcaagaaaaatat

SEQ ID NO: 6431853 - DNA, 17 bp, Homo sapiens
tcactagtgtcaggccc

SEQ ID NO: 6431854 - DNA, 21 bp, Homo sapiens
tcactagtgtcaggcccccag

SEQ ID NO: 6431855 - DNA, 21 bp, Homo sapiens
tcactataatgatctaagaag

SEQ ID NO: 6431856 - DNA, 19 bp, Homo sapiens
tcactataatgtgaaatgt

SEQ ID NO: 6431857 - DNA, 23 bp, Homo sapiens
tcactataggtcatacaatccat

SEQ ID NO: 6431858 - DNA, 21 bp, Homo sapiens
tcactatatatatttctagaa

SEQ ID NO: 6431859 - DNA, 14 bp, Homo sapiens
tcactatccatgca

SEQ ID NO: 6431860 - DNA, 16 bp, Homo sapiens
tcactatcttcttcaa

SEQ ID NO: 6431861 - DNA, 21 bp, Homo sapiens
tcactatcttcttcaaataca

SEQ ID NO: 6431862 - DNA, 22 bp, Homo sapiens
tcactatcttcttcaaatacaa

SEQ ID NO: 6431863 - DNA, 19 bp, Homo sapiens
tcactatgacactgagcaa

SEQ ID NO: 6431864 - DNA, 15 bp, Homo sapiens
tcactatgatttctg

SEQ ID NO: 6431865 - DNA, 13 bp, Homo sapiens
tcactatgcattt

SEQ ID NO: 6431866 - DNA, 24 bp, Homo sapiens
tcactatgctatttctggcctcag

SEQ ID NO: 6431867 - DNA, 20 bp, Homo sapiens
tcactatggtatgctggcca

SEQ ID NO: 6431868 - DNA, 21 bp, Homo sapiens
tcactatggtatgctggccag

SEQ ID NO: 6431869 - DNA, 23 bp, Homo sapiens
tcactatggtgccaatggaacct

SEQ ID NO: 6431870 - DNA, 13 bp, Homo sapiens
tcactatgtccat

SEQ ID NO: 6431871 - DNA, 20 bp, Homo sapiens
tcactatgttgcccaggcag

SEQ ID NO: 6431872 - DNA, 13 bp, Homo sapiens
tcactatgtttct

SEQ ID NO: 6431873 - DNA, 16 bp, Homo sapiens
tcactattacttgaac

SEQ ID NO: 6431874 - DNA, 18 bp, Homo sapiens
tcactattcaagtattag

SEQ ID NO: 6431875 - DNA, 13 bp, Homo sapiens
tcactattcatca

SEQ ID NO: 6431876 - DNA, 16 bp, Homo sapiens
tcactattcttaagca

SEQ ID NO: 6431877 - DNA, 18 bp, Homo sapiens
tcactattcttaagcact

SEQ ID NO: 6431878 - DNA, 17 bp, Homo sapiens
tcactatttcctttata

SEQ ID NO: 6431879 - DNA, 22 bp, Homo sapiens
tcactcaagagttcagtgctca

SEQ ID NO: 6431880 - DNA, 12 bp, Homo sapiens
tcactcaaggcg

SEQ ID NO: 6431881 - DNA, 20 bp, Homo sapiens
tcactcaaggcggtgcttga

SEQ ID NO: 6431882 - DNA, 17 bp, Homo sapiens
tcactcaagttcaagga

SEQ ID NO: 6431883 - DNA, 14 bp, Homo sapiens
tcactcaattgttt

SEQ ID NO: 6431884 - DNA, 18 bp, Homo sapiens
tcactcacaagcaatcca

SEQ ID NO: 6431885 - DNA, 14 bp, Homo sapiens
tcactcacactggc

SEQ ID NO: 6431886 - DNA, 13 bp, Homo sapiens
tcactcacatctt

SEQ ID NO: 6431887 - DNA, 13 bp, Homo sapiens
tcactcacatttt

SEQ ID NO: 6431888 - DNA, 14 bp, Homo sapiens
tcactcacattttc

SEQ ID NO: 6431889 - DNA, 17 bp, Homo sapiens
tcactcacattttctca

SEQ ID NO: 6431890 - DNA, 18 bp, Homo sapiens
tcactcactcactcccca

SEQ ID NO: 6431891 - DNA, 17 bp, Homo sapiens
tcactcactctgggtgc

SEQ ID NO: 6431892 - DNA, 17 bp, Homo sapiens
tcactcactgaggccat

SEQ ID NO: 6431893 - DNA, 12 bp, Homo sapiens
tcactcactgtt

SEQ ID NO: 6431894 - DNA, 20 bp, Homo sapiens
tcactcactgtttataaatg

SEQ ID NO: 6431895 - DNA, 16 bp, Homo sapiens
tcactcagcaccactc

SEQ ID NO: 6431896 - DNA, 16 bp, Homo sapiens
tcactcagcccctacc

SEQ ID NO: 6431897 - DNA, 20 bp, Homo sapiens
tcactcagcccctacccctg

SEQ ID NO: 6431898 - DNA, 22 bp, Homo sapiens
tcactcagcccctacccctgcc

SEQ ID NO: 6431899 - DNA, 15 bp, Homo sapiens
tcactcagccccttc

SEQ ID NO: 6431900 - DNA, 18 bp, Homo sapiens
tcactcaggaaccctgga

SEQ ID NO: 6431901 - DNA, 23 bp, Homo sapiens
tcactcaggaaccctggagacag

SEQ ID NO: 6431902 - DNA, 13 bp, Homo sapiens
tcactcaggctgg

SEQ ID NO: 6431903 - DNA, 14 bp, Homo sapiens
tcactcaggctgga

SEQ ID NO: 6431904 - DNA, 21 bp, Homo sapiens
tcactcaggctggagtacagt

SEQ ID NO: 6431905 - DNA, 12 bp, Homo sapiens
tcactcataaag

SEQ ID NO: 6431906 - DNA, 21 bp, Homo sapiens
tcactcatcaatggggccagt

SEQ ID NO: 6431907 - DNA, 18 bp, Homo sapiens
tcactcatggaacactca

SEQ ID NO: 6431908 - DNA, 14 bp, Homo sapiens
tcactcattaatta

SEQ ID NO: 6431909 - DNA, 13 bp, Homo sapiens
tcactcattgctg

SEQ ID NO: 6431910 - DNA, 20 bp, Homo sapiens
tcactcattgctgagcctct

SEQ ID NO: 6431911 - DNA, 20 bp, Homo sapiens
tcactcatttacgtaaaaag

SEQ ID NO: 6431912 - DNA, 14 bp, Homo sapiens
tcactccaaaaaca

SEQ ID NO: 6431913 - DNA, 11 bp, Homo sapiens
tcactccaaag

SEQ ID NO: 6431914 - DNA, 17 bp, Homo sapiens
tcactccaaagagaaac

SEQ ID NO: 6431915 - DNA, 15 bp, Homo sapiens
tcactccaagaccac

SEQ ID NO: 6431916 - DNA, 14 bp, Homo sapiens
tcactccaccaccc

SEQ ID NO: 6431917 - DNA, 16 bp, Homo sapiens
tcactccaccacccaa

SEQ ID NO: 6431918 - DNA, 14 bp, Homo sapiens
tcactccaccatcc

SEQ ID NO: 6431919 - DNA, 15 bp, Homo sapiens
tcactccaccatccc

SEQ ID NO: 6431920 - DNA, 21 bp, Homo sapiens
tcactccaccatccccacccc

SEQ ID NO: 6431921 - DNA, 17 bp, Homo sapiens
tcactccactcccctca

SEQ ID NO: 6431922 - DNA, 21 bp, Homo sapiens
tcactccaggaaggggctgga

SEQ ID NO: 6431923 - DNA, 17 bp, Homo sapiens
tcactccaggttcgtat

SEQ ID NO: 6431924 - DNA, 15 bp, Homo sapiens
tcactccagtagctc

SEQ ID NO: 6431925 - DNA, 12 bp, Homo sapiens
tcactccagtgc

SEQ ID NO: 6431926 - DNA, 21 bp, Homo sapiens
tcactccagtgctcagctgtg

SEQ ID NO: 6431927 - DNA, 15 bp, Homo sapiens
tcactccagtgttac

SEQ ID NO: 6431928 - DNA, 14 bp, Homo sapiens
tcactccataaaaa

SEQ ID NO: 6431929 - DNA, 19 bp, Homo sapiens
tcactccatttcccacttc

SEQ ID NO: 6431930 - DNA, 20 bp, Homo sapiens
tcactccatttcccacttcc

SEQ ID NO: 6431931 - DNA, 19 bp, Homo sapiens
tcactcccacctgcatctg

SEQ ID NO: 6431932 - DNA, 23 bp, Homo sapiens
tcactcccacctgcatctggggc

SEQ ID NO: 6431933 - DNA, 18 bp, Homo sapiens
tcactcccagaccacctc

SEQ ID NO: 6431934 - DNA, 19 bp, Homo sapiens
tcactcccagaccacctcc

SEQ ID NO: 6431935 - DNA, 15 bp, Homo sapiens
tcactcccagcactc

SEQ ID NO: 6431936 - DNA, 20 bp, Homo sapiens
tcactcccagcactcccctt

SEQ ID NO: 6431937 - DNA, 14 bp, Homo sapiens
tcactcccagtcca

SEQ ID NO: 6431938 - DNA, 18 bp, Homo sapiens
tcactcccatttttactt

SEQ ID NO: 6431939 - DNA, 14 bp, Homo sapiens
tcactccccaagga

SEQ ID NO: 6431940 - DNA, 11 bp, Homo sapiens
tcactccccag

SEQ ID NO: 6431941 - DNA, 16 bp, Homo sapiens
tcactccccagcctgg

SEQ ID NO: 6431942 - DNA, 20 bp, Homo sapiens
tcactccccagggagctctg

SEQ ID NO: 6431943 - DNA, 13 bp, Homo sapiens
tcactcccctcca

SEQ ID NO: 6431944 - DNA, 21 bp, Homo sapiens
tcactcccctctcctcccctt

SEQ ID NO: 6431945 - DNA, 22 bp, Homo sapiens
tcactcccgaggatgtgtccta

SEQ ID NO: 6431946 - DNA, 21 bp, Homo sapiens
tcactcccgctgagcccactc

SEQ ID NO: 6431947 - DNA, 22 bp, Homo sapiens
tcactcccgctgagcccactct

SEQ ID NO: 6431948 - DNA, 13 bp, Homo sapiens
tcactccctaggc

SEQ ID NO: 6431949 - DNA, 24 bp, Homo sapiens
tcactccctccctggctctgccag

SEQ ID NO: 6431950 - DNA, 14 bp, Homo sapiens
tcactccctctgca

SEQ ID NO: 6431951 - DNA, 15 bp, Homo sapiens
tcactccctctgcag

SEQ ID NO: 6431952 - DNA, 20 bp, Homo sapiens
tcactccctctgcagaatcc

SEQ ID NO: 6431953 - DNA, 23 bp, Homo sapiens
tcactccctttgtggactttatt

SEQ ID NO: 6431954 - DNA, 14 bp, Homo sapiens
tcactccggtgtgc

SEQ ID NO: 6431955 - DNA, 18 bp, Homo sapiens
tcactcctaggagagcca

SEQ ID NO: 6431956 - DNA, 16 bp, Homo sapiens
tcactcctccgtgagc

SEQ ID NO: 6431957 - DNA, 13 bp, Homo sapiens
tcactcctgcctc

SEQ ID NO: 6431958 - DNA, 14 bp, Homo sapiens
tcactcctgcctcc

SEQ ID NO: 6431959 - DNA, 16 bp, Homo sapiens
tcactcctgcctccgc

SEQ ID NO: 6431960 - DNA, 20 bp, Homo sapiens
tcactcctgcctccgctggc

SEQ ID NO: 6431961 - DNA, 23 bp, Homo sapiens
tcactcctgcctccgctggcttt

SEQ ID NO: 6431962 - DNA, 13 bp, Homo sapiens
tcactcctgcttc

SEQ ID NO: 6431963 - DNA, 22 bp, Homo sapiens
tcactcctgcttctctcagcca

SEQ ID NO: 6431964 - DNA, 10 bp, Homo sapiens
tcactcctgt

SEQ ID NO: 6431965 - DNA, 13 bp, Homo sapiens
tcactccttgaaa

SEQ ID NO: 6431966 - DNA, 14 bp, Homo sapiens
tcactcggcaccct

SEQ ID NO: 6431967 - DNA, 17 bp, Homo sapiens
tcactctaaaaaacatt

SEQ ID NO: 6431968 - DNA, 14 bp, Homo sapiens
tcactctaagatgt

SEQ ID NO: 6431969 - DNA, 21 bp, Homo sapiens
tcactctaagatgttatattt

SEQ ID NO: 6431970 - DNA, 16 bp, Homo sapiens
tcactctaagtcatgt

SEQ ID NO: 6431971 - DNA, 19 bp, Homo sapiens
tcactctacttagcatgtc

SEQ ID NO: 6431972 - DNA, 17 bp, Homo sapiens
tcactctaggttttaca

SEQ ID NO: 6431973 - DNA, 18 bp, Homo sapiens
tcactctagtcaatgaca

SEQ ID NO: 6431974 - DNA, 11 bp, Homo sapiens
tcactctcagg

SEQ ID NO: 6431975 - DNA, 12 bp, Homo sapiens
tcactctcagga

SEQ ID NO: 6431976 - DNA, 13 bp, Homo sapiens
tcactctcagtgc

SEQ ID NO: 6431977 - DNA, 22 bp, Homo sapiens
tcactctcccagaggctcctgg

SEQ ID NO: 6431978 - DNA, 12 bp, Homo sapiens
tcactctccttg

SEQ ID NO: 6431979 - DNA, 16 bp, Homo sapiens
tcactctcttcctttc

SEQ ID NO: 6431980 - DNA, 17 bp, Homo sapiens
tcactctcttcctttca

SEQ ID NO: 6431981 - DNA, 12 bp, Homo sapiens
tcactctgacag

SEQ ID NO: 6431982 - DNA, 20 bp, Homo sapiens
tcactctgagtgttttatga

SEQ ID NO: 6431983 - DNA, 21 bp, Homo sapiens
tcactctgccagggcagtgct

SEQ ID NO: 6431984 - DNA, 17 bp, Homo sapiens
tcactctgccctctgct

SEQ ID NO: 6431985 - DNA, 23 bp, Homo sapiens
tcactctgccctctgctgctgcc

SEQ ID NO: 6431986 - DNA, 12 bp, Homo sapiens
tcactctgcctc

SEQ ID NO: 6431987 - DNA, 14 bp, Homo sapiens
tcactctgcctcta

SEQ ID NO: 6431988 - DNA, 13 bp, Homo sapiens
tcactctgctgct

SEQ ID NO: 6431989 - DNA, 14 bp, Homo sapiens
tcactctggcagct

SEQ ID NO: 6431990 - DNA, 13 bp, Homo sapiens
tcactctggcctc

SEQ ID NO: 6431991 - DNA, 14 bp, Homo sapiens
tcactctggcttca

SEQ ID NO: 6431992 - DNA, 17 bp, Homo sapiens
tcactctgtcagccagc

SEQ ID NO: 6431993 - DNA, 18 bp, Homo sapiens
tcactctgtcagccagcc

SEQ ID NO: 6431994 - DNA, 16 bp, Homo sapiens
tcactctgtcatcttt

SEQ ID NO: 6431995 - DNA, 16 bp, Homo sapiens
tcactctgtcgcccag

SEQ ID NO: 6431996 - DNA, 20 bp, Homo sapiens
tcactctgtcgctcaggctg

SEQ ID NO: 6431997 - DNA, 20 bp, Homo sapiens
tcactctgtggtccagagtc

SEQ ID NO: 6431998 - DNA, 21 bp, Homo sapiens
tcactctgttgaccaggctgg

SEQ ID NO: 6431999 - DNA, 14 bp, Homo sapiens
tcactcttatgaaa

SEQ ID NO: 6432000 - DNA, 23 bp, Homo sapiens
tcactcttattgcccacgctgga

SEQ ID NO: 6432001 - DNA, 15 bp, Homo sapiens
tcactcttccagaat

SEQ ID NO: 6432002 - DNA, 17 bp, Homo sapiens
tcactcttccagaatcc

SEQ ID NO: 6432003 - DNA, 21 bp, Homo sapiens
tcactcttccagaatcccaag

SEQ ID NO: 6432004 - DNA, 22 bp, Homo sapiens
tcactcttcctgcgtagaagat

SEQ ID NO: 6432005 - DNA, 22 bp, Homo sapiens
tcactcttctgtcttgtcccca

SEQ ID NO: 6432006 - DNA, 19 bp, Homo sapiens
tcactcttgaagtccagga

SEQ ID NO: 6432007 - DNA, 11 bp, Homo sapiens
tcactcttggt

SEQ ID NO: 6432008 - DNA, 22 bp, Homo sapiens
tcactcttggtccctggaagct

SEQ ID NO: 6432009 - DNA, 15 bp, Homo sapiens
tcactctttacatgg

SEQ ID NO: 6432010 - DNA, 16 bp, Homo sapiens
tcactctttacatggt

SEQ ID NO: 6432011 - DNA, 21 bp, Homo sapiens
tcactctttagatatttacat

SEQ ID NO: 6432012 - DNA, 21 bp, Homo sapiens
tcactctttatagtgcacaaa

SEQ ID NO: 6432013 - DNA, 21 bp, Homo sapiens
tcactcttttgggatctaact

SEQ ID NO: 6432014 - DNA, 22 bp, Homo sapiens
tcactcttttgggatctaactg

SEQ ID NO: 6432015 - DNA, 20 bp, Homo sapiens
tcactgaaaaaatgtagctt

SEQ ID NO: 6432016 - DNA, 12 bp, Homo sapiens
tctcctcccagg

SEQ ID NO: 6432017 - DNA, 21 bp, Homo sapiens
tctcctcccatggccttccct

SEQ ID NO: 6432018 - DNA, 18 bp, Homo sapiens
tctcctccccacccgccc

SEQ ID NO: 6432019 - DNA, 15 bp, Homo sapiens
tctcctccccacctg

SEQ ID NO: 6432020 - DNA, 19 bp, Homo sapiens
tctcctccccacctgtagc

SEQ ID NO: 6432021 - DNA, 14 bp, Homo sapiens
tctcctccccttcc

SEQ ID NO: 6432022 - DNA, 17 bp, Homo sapiens
tctcctccccttcctgt

SEQ ID NO: 6432023 - DNA, 16 bp, Homo sapiens
tctcctccccttgaat

SEQ ID NO: 6432024 - DNA, 22 bp, Homo sapiens
tctcctcccgcccttccatgtg

SEQ ID NO: 6432025 - DNA, 11 bp, Homo sapiens
tctcctccctc

SEQ ID NO: 6432026 - DNA, 15 bp, Homo sapiens
tctcctccctgggct

SEQ ID NO: 6432027 - DNA, 23 bp, Homo sapiens
tctcctcccttaccctcctctgc

SEQ ID NO: 6432028 - DNA, 12 bp, Homo sapiens
tctcctccgcca

SEQ ID NO: 6432029 - DNA, 13 bp, Homo sapiens
tctcctcctcccc

SEQ ID NO: 6432030 - DNA, 16 bp, Homo sapiens
tctcctcctcccctcc

SEQ ID NO: 6432031 - DNA, 14 bp, Homo sapiens
tctcctcctcctcc

SEQ ID NO: 6432032 - DNA, 15 bp, Homo sapiens
tctcctcctcctccc

SEQ ID NO: 6432033 - DNA, 21 bp, Homo sapiens
tctcctcctcctccctcctca

SEQ ID NO: 6432034 - DNA, 14 bp, Homo sapiens
tctcctcctctgtg

SEQ ID NO: 6432035 - DNA, 21 bp, Homo sapiens
tctcctcctctgtgctcctgt

SEQ ID NO: 6432036 - DNA, 14 bp, Homo sapiens
tctcctcctgccca

SEQ ID NO: 6432037 - DNA, 16 bp, Homo sapiens
tctcctcctgcccacc

SEQ ID NO: 6432038 - DNA, 17 bp, Homo sapiens
tctcctccttgggcagg

SEQ ID NO: 6432039 - DNA, 13 bp, Homo sapiens
tctcctcgagccc

SEQ ID NO: 6432040 - DNA, 18 bp, Homo sapiens
tctcctcgagccctcccc

SEQ ID NO: 6432041 - DNA, 20 bp, Homo sapiens
tctcctcgagccctccccca

SEQ ID NO: 6432042 - DNA, 17 bp, Homo sapiens
tctcctcgggccctgtg

SEQ ID NO: 6432043 - DNA, 20 bp, Homo sapiens
tctcctcgggccctgtggtg

SEQ ID NO: 6432044 - DNA, 19 bp, Homo sapiens
tctcctcgttcttatttaa

SEQ ID NO: 6432045 - DNA, 22 bp, Homo sapiens
tctcctcgttggttcatgtgtt

SEQ ID NO: 6432046 - DNA, 14 bp, Homo sapiens
tctcctctccattt

SEQ ID NO: 6432047 - DNA, 22 bp, Homo sapiens
tctcctctccattttagcccag

SEQ ID NO: 6432048 - DNA, 18 bp, Homo sapiens
tctcctctcctcctctgt

SEQ ID NO: 6432049 - DNA, 16 bp, Homo sapiens
tctcctctctctccct

SEQ ID NO: 6432050 - DNA, 13 bp, Homo sapiens
tctcctctctgag

SEQ ID NO: 6432051 - DNA, 15 bp, Homo sapiens
tctcctctctgagac

SEQ ID NO: 6432052 - DNA, 13 bp, Homo sapiens
tctcctctctgct

SEQ ID NO: 6432053 - DNA, 14 bp, Homo sapiens
tctcctctctgctt

SEQ ID NO: 6432054 - DNA, 16 bp, Homo sapiens
tctcctctctgggcct

SEQ ID NO: 6432055 - DNA, 23 bp, Homo sapiens
tctcctctctggtggctgggctg

SEQ ID NO: 6432056 - DNA, 16 bp, Homo sapiens
tctcctctcttggcat

SEQ ID NO: 6432057 - DNA, 18 bp, Homo sapiens
tctcctctgccctctgct

SEQ ID NO: 6432058 - DNA, 13 bp, Homo sapiens
tctcctctgctag

SEQ ID NO: 6432059 - DNA, 14 bp, Homo sapiens
tctcctctgctatg

SEQ ID NO: 6432060 - DNA, 14 bp, Homo sapiens
tctcctctgctcat

SEQ ID NO: 6432061 - DNA, 21 bp, Homo sapiens
tctcctctgctcattaaactg

SEQ ID NO: 6432062 - DNA, 23 bp, Homo sapiens
tctcctctgctccaacagacacc

SEQ ID NO: 6432063 - DNA, 13 bp, Homo sapiens
tctcctctgctgc

SEQ ID NO: 6432064 - DNA, 20 bp, Homo sapiens
tctcctctgctgctggctgg

SEQ ID NO: 6432065 - DNA, 13 bp, Homo sapiens
tctcctctgcttc

SEQ ID NO: 6432066 - DNA, 15 bp, Homo sapiens
tctcctctggcttcc

SEQ ID NO: 6432067 - DNA, 22 bp, Homo sapiens
tctcctctgtcagtttgtgaag

SEQ ID NO: 6432068 - DNA, 22 bp, Homo sapiens
tctcctcttcgtggttgtgttt

SEQ ID NO: 6432069 - DNA, 16 bp, Homo sapiens
tctcctcttgccactg

SEQ ID NO: 6432070 - DNA, 22 bp, Homo sapiens
tctcctcttgccactgcctctt

SEQ ID NO: 6432071 - DNA, 20 bp, Homo sapiens
tctcctctttaaaacaaaac

SEQ ID NO: 6432072 - DNA, 23 bp, Homo sapiens
tctcctgaaacccaaagccctgg

SEQ ID NO: 6432073 - DNA, 20 bp, Homo sapiens
tctcctgaaatctacaggcc

SEQ ID NO: 6432074 - DNA, 17 bp, Homo sapiens
tctcctgaagatactta

SEQ ID NO: 6432075 - DNA, 12 bp, Homo sapiens
tctcctgacctc

SEQ ID NO: 6432076 - DNA, 16 bp, Homo sapiens
tctcctgacctcatga

SEQ ID NO: 6432077 - DNA, 13 bp, Homo sapiens
tctcctgactggt

SEQ ID NO: 6432078 - DNA, 15 bp, Homo sapiens
tctcctgagaggtgc

SEQ ID NO: 6432079 - DNA, 22 bp, Homo sapiens
tctcctgagaggtgctgcaggc

SEQ ID NO: 6432080 - DNA, 15 bp, Homo sapiens
tctcctgagcctgtc

SEQ ID NO: 6432081 - DNA, 17 bp, Homo sapiens
tctcctgagcctgtctc

SEQ ID NO: 6432082 - DNA, 18 bp, Homo sapiens
tctcctgagcctgtctct

SEQ ID NO: 6432083 - DNA, 19 bp, Homo sapiens
tctcctgagcctgtctctc

SEQ ID NO: 6432084 - DNA, 14 bp, Homo sapiens
tctcctgagctagg

SEQ ID NO: 6432085 - DNA, 23 bp, Homo sapiens
tctcctgagttgtataaaagttg

SEQ ID NO: 6432086 - DNA, 23 bp, Homo sapiens
tctcctgatagtcacctgctggt

SEQ ID NO: 6432087 - DNA, 16 bp, Homo sapiens
tctcctgattatttat

SEQ ID NO: 6432088 - DNA, 18 bp, Homo sapiens
tctcctgatttctctgaa

SEQ ID NO: 6432089 - DNA, 14 bp, Homo sapiens
tctcctgcaaattt

SEQ ID NO: 6432090 - DNA, 15 bp, Homo sapiens
tctcctgcagtctgt

SEQ ID NO: 6432091 - DNA, 15 bp, Homo sapiens
tctcctgcagtggat

SEQ ID NO: 6432092 - DNA, 18 bp, Homo sapiens
tctcctgcatagcttttc

SEQ ID NO: 6432093 - DNA, 15 bp, Homo sapiens
tctcctgcatccctc

SEQ ID NO: 6432094 - DNA, 13 bp, Homo sapiens
tctcctgcatgca

SEQ ID NO: 6432095 - DNA, 22 bp, Homo sapiens
tctcctgccacattagaacttc

SEQ ID NO: 6432096 - DNA, 13 bp, Homo sapiens
tctcctgccagcc

SEQ ID NO: 6432097 - DNA, 16 bp, Homo sapiens
tctcctgcccactctg

SEQ ID NO: 6432098 - DNA, 17 bp, Homo sapiens
tctcctgcccagctctg

SEQ ID NO: 6432099 - DNA, 21 bp, Homo sapiens
tctcctgcccccacacctggc

SEQ ID NO: 6432100 - DNA, 13 bp, Homo sapiens
tctcctgccctct

SEQ ID NO: 6432101 - DNA, 23 bp, Homo sapiens
tctcctgccctgccctcctgccc

SEQ ID NO: 6432102 - DNA, 17 bp, Homo sapiens
tctcctgcctactcacg

SEQ ID NO: 6432103 - DNA, 12 bp, Homo sapiens
tctcctgcctca

SEQ ID NO: 6432104 - DNA, 19 bp, Homo sapiens
tctcctgcctcagcctccc

SEQ ID NO: 6432105 - DNA, 20 bp, Homo sapiens
tctcctgcctcagcctccca

SEQ ID NO: 6432106 - DNA, 23 bp, Homo sapiens
tctcctgcctcagcctcctgagt

SEQ ID NO: 6432107 - DNA, 21 bp, Homo sapiens
tctcctgcctgccctgcctca

SEQ ID NO: 6432108 - DNA, 16 bp, Homo sapiens
tctcctgccttgaaaa

SEQ ID NO: 6432109 - DNA, 16 bp, Homo sapiens
tctcctgccttggcct

SEQ ID NO: 6432110 - DNA, 12 bp, Homo sapiens
tctcctgccttt

SEQ ID NO: 6432111 - DNA, 21 bp, Homo sapiens
tctcctgcgccccgcccacac

SEQ ID NO: 6432112 - DNA, 21 bp, Homo sapiens
tctcctgctcaccacctgcct

SEQ ID NO: 6432113 - DNA, 18 bp, Homo sapiens
tctcctgctctttctaca

SEQ ID NO: 6432114 - DNA, 16 bp, Homo sapiens
tctcctgctgatttca

SEQ ID NO: 6432115 - DNA, 22 bp, Homo sapiens
tctcctgctgatttcactttgg

SEQ ID NO: 6432116 - DNA, 13 bp, Homo sapiens
tctcctgctgcct

SEQ ID NO: 6432117 - DNA, 21 bp, Homo sapiens
tctcctgctgccttttctgga

SEQ ID NO: 6432118 - DNA, 13 bp, Homo sapiens
tctcctgctgcgt

SEQ ID NO: 6432119 - DNA, 15 bp, Homo sapiens
tctcctgctgcgtga

SEQ ID NO: 6432120 - DNA, 19 bp, Homo sapiens
tctcctgctgctccctcag

SEQ ID NO: 6432121 - DNA, 14 bp, Homo sapiens
tctcctgcttgtac

SEQ ID NO: 6432122 - DNA, 22 bp, Homo sapiens
tctcctgcttgtactaagccag

SEQ ID NO: 6432123 - DNA, 21 bp, Homo sapiens
tctcctggaagtgctaatttt

SEQ ID NO: 6432124 - DNA, 12 bp, Homo sapiens
tctcctggacct

SEQ ID NO: 6432125 - DNA, 22 bp, Homo sapiens
tctcctggactggttatcttgt

SEQ ID NO: 6432126 - DNA, 19 bp, Homo sapiens
tctcctggagatagctggg

SEQ ID NO: 6432127 - DNA, 20 bp, Homo sapiens
tctcctggagatagctgggg

SEQ ID NO: 6432128 - DNA, 11 bp, Homo sapiens
tctcctggagg

SEQ ID NO: 6432129 - DNA, 12 bp, Homo sapiens
tctcctggaggg

SEQ ID NO: 6432130 - DNA, 18 bp, Homo sapiens
tctcctggagtctgaagc

SEQ ID NO: 6432131 - DNA, 17 bp, Homo sapiens
tctcctggcccctgcct

SEQ ID NO: 6432132 - DNA, 21 bp, Homo sapiens
tctcctggcccctgcctgctg

SEQ ID NO: 6432133 - DNA, 21 bp, Homo sapiens
tctcctggcctatccgctgcc

SEQ ID NO: 6432134 - DNA, 16 bp, Homo sapiens
tctcctggcctggcca

SEQ ID NO: 6432135 - DNA, 21 bp, Homo sapiens
tctcctggctaagcctctgct

SEQ ID NO: 6432136 - DNA, 15 bp, Homo sapiens
tctcctggctgggcc

SEQ ID NO: 6432137 - DNA, 16 bp, Homo sapiens
tctcctggctgggcca

SEQ ID NO: 6432138 - DNA, 16 bp, Homo sapiens
tctcctggctgtccta

SEQ ID NO: 6432139 - DNA, 18 bp, Homo sapiens
tctcctggcttcccatcc

SEQ ID NO: 6432140 - DNA, 16 bp, Homo sapiens
tctcctgggcagctgc

SEQ ID NO: 6432141 - DNA, 19 bp, Homo sapiens
tctcctgggcagctgcctc

SEQ ID NO: 6432142 - DNA, 20 bp, Homo sapiens
tctcctgggcatctggccct

SEQ ID NO: 6432143 - DNA, 12 bp, Homo sapiens
tctcctgggcca

SEQ ID NO: 6432144 - DNA, 15 bp, Homo sapiens
tctcctgggcccctc

SEQ ID NO: 6432145 - DNA, 20 bp, Homo sapiens
tctcctgggcccctccctac

SEQ ID NO: 6432146 - DNA, 22 bp, Homo sapiens
tctcctgggcccgctttgcctg

SEQ ID NO: 6432147 - DNA, 18 bp, Homo sapiens
tctcctgggccgttacat

SEQ ID NO: 6432148 - DNA, 19 bp, Homo sapiens
tctcctgggggtggcaggc

SEQ ID NO: 6432149 - DNA, 17 bp, Homo sapiens
tctcctggtagcatgac

SEQ ID NO: 6432150 - DNA, 19 bp, Homo sapiens
tctcctggtagcatgacct

SEQ ID NO: 6432151 - DNA, 20 bp, Homo sapiens
tctcctggtctgtgctgccc

SEQ ID NO: 6432152 - DNA, 12 bp, Homo sapiens
tctcctggtgac

SEQ ID NO: 6432153 - DNA, 15 bp, Homo sapiens
tctcctggtgttctg

SEQ ID NO: 6432154 - DNA, 13 bp, Homo sapiens
tctcctgtacctc

SEQ ID NO: 6432155 - DNA, 16 bp, Homo sapiens
tctcctgtacctcttg

SEQ ID NO: 6432156 - DNA, 17 bp, Homo sapiens
tctcctgtacctcttga

SEQ ID NO: 6432157 - DNA, 22 bp, Homo sapiens
tctcctgtcagagatctgggag

SEQ ID NO: 6432158 - DNA, 16 bp, Homo sapiens
tctcctgtccaaccta

SEQ ID NO: 6432159 - DNA, 15 bp, Homo sapiens
tctcctgtccctcca

SEQ ID NO: 6432160 - DNA, 15 bp, Homo sapiens
tctcctgtcctccct

SEQ ID NO: 6432161 - DNA, 17 bp, Homo sapiens
tctcctgtcctccctca

SEQ ID NO: 6432162 - DNA, 20 bp, Homo sapiens
tctcctgtctcagcctcctg

SEQ ID NO: 6432163 - DNA, 23 bp, Homo sapiens
tctcctgtgaatggaggcagaga

SEQ ID NO: 6432164 - DNA, 18 bp, Homo sapiens
tctcctgtgatgtcccag

SEQ ID NO: 6432165 - DNA, 23 bp, Homo sapiens
tctcctgtgcatgggtgaaggga

SEQ ID NO: 6432166 - DNA, 15 bp, Homo sapiens
tctcctgtgcccaca

SEQ ID NO: 6432167 - DNA, 18 bp, Homo sapiens
tctcctgtgcccacatcc

SEQ ID NO: 6432168 - DNA, 19 bp, Homo sapiens
tctcctgtgcccctcagag

SEQ ID NO: 6432169 - DNA, 12 bp, Homo sapiens
tctcctgtggag

SEQ ID NO: 6432170 - DNA, 15 bp, Homo sapiens
tctcctgtgggaaaa

SEQ ID NO: 6432171 - DNA, 12 bp, Homo sapiens
tctcctgtggtt

SEQ ID NO: 6432172 - DNA, 16 bp, Homo sapiens
tctcctgtgtgcttgt

SEQ ID NO: 6432173 - DNA, 13 bp, Homo sapiens
tctcctgtttgtt

SEQ ID NO: 6432174 - DNA, 17 bp, Homo sapiens
tctcctgtttttctggg

SEQ ID NO: 6432175 - DNA, 18 bp, Homo sapiens
tctccttaagagacaatt

SEQ ID NO: 6432176 - DNA, 12 bp, Homo sapiens
tctccttaagct

SEQ ID NO: 6432177 - DNA, 17 bp, Homo sapiens
tctccttacctctggaa

SEQ ID NO: 6432178 - DNA, 18 bp, Homo sapiens
tctccttacctctggaac

SEQ ID NO: 6432179 - DNA, 20 bp, Homo sapiens
tctccttactctgagcccag

SEQ ID NO: 6432180 - DNA, 18 bp, Homo sapiens
tctccttagtcttctcat

SEQ ID NO: 6432181 - DNA, 19 bp, Homo sapiens
tctccttagtcttctcata

SEQ ID NO: 6432182 - DNA, 20 bp, Homo sapiens
tctccttatagacacttgct

SEQ ID NO: 6432183 - DNA, 16 bp, Homo sapiens
tctccttccaactgct

SEQ ID NO: 6432184 - DNA, 21 bp, Homo sapiens
tctccttcccaaggcagctgg

SEQ ID NO: 6432185 - DNA, 16 bp, Homo sapiens
tctccttcccactgtc

SEQ ID NO: 6432186 - DNA, 21 bp, Homo sapiens
tctccttcccatttctctaca

SEQ ID NO: 6432187 - DNA, 14 bp, Homo sapiens
tctccttccccagg

SEQ ID NO: 6432188 - DNA, 18 bp, Homo sapiens
tctccttccccatttcca

SEQ ID NO: 6432189 - DNA, 19 bp, Homo sapiens
tctccttccccatttccac

SEQ ID NO: 6432190 - DNA, 17 bp, Homo sapiens
tctccttcctcagaata

SEQ ID NO: 6432191 - DNA, 19 bp, Homo sapiens
tctccttcctcttggctga

SEQ ID NO: 6432192 - DNA, 13 bp, Homo sapiens
tctccttcctgtg

SEQ ID NO: 6432193 - DNA, 18 bp, Homo sapiens
tctccttccttacccaaa

SEQ ID NO: 6432194 - DNA, 12 bp, Homo sapiens
tctccttccttc

SEQ ID NO: 6432195 - DNA, 13 bp, Homo sapiens
tctccttccttcc

SEQ ID NO: 6432196 - DNA, 17 bp, Homo sapiens
tcactgaaaacatctgg

SEQ ID NO: 6432197 - DNA, 18 bp, Homo sapiens
tcactgaaaacatctgga

SEQ ID NO: 6432198 - DNA, 15 bp, Homo sapiens
tcactgaaaactatg

SEQ ID NO: 6432199 - DNA, 12 bp, Homo sapiens
tcactgaaacaa

SEQ ID NO: 6432200 - DNA, 20 bp, Homo sapiens
tcactgaaacctctgccttc

SEQ ID NO: 6432201 - DNA, 14 bp, Homo sapiens
tcactgaaataaaa

SEQ ID NO: 6432202 - DNA, 17 bp, Homo sapiens
tcactgaaatgtttgga

SEQ ID NO: 6432203 - DNA, 12 bp, Homo sapiens
tcactgaacatg

SEQ ID NO: 6432204 - DNA, 15 bp, Homo sapiens
tcactgaacatgcct

SEQ ID NO: 6432205 - DNA, 22 bp, Homo sapiens
tcactgaacatgcctagtccaa

SEQ ID NO: 6432206 - DNA, 18 bp, Homo sapiens
tcactgaaccactgcttc

SEQ ID NO: 6432207 - DNA, 19 bp, Homo sapiens
tcactgaaccactgcttct

SEQ ID NO: 6432208 - DNA, 21 bp, Homo sapiens
tcactgaaccactgcttctct

SEQ ID NO: 6432209 - DNA, 22 bp, Homo sapiens
tcactgaaccactgcttctctt

SEQ ID NO: 6432210 - DNA, 14 bp, Homo sapiens
tcactgaactccac

SEQ ID NO: 6432211 - DNA, 14 bp, Homo sapiens
tcactgaagattgg

SEQ ID NO: 6432212 - DNA, 15 bp, Homo sapiens
tcactgaagcccaga

SEQ ID NO: 6432213 - DNA, 19 bp, Homo sapiens
tcactgaagtgaatacatg

SEQ ID NO: 6432214 - DNA, 22 bp, Homo sapiens
tcactgaatatcaactctgaaa

SEQ ID NO: 6432215 - DNA, 17 bp, Homo sapiens
tcactgacacatcagca

SEQ ID NO: 6432216 - DNA, 18 bp, Homo sapiens
tcactgacacatcagcat

SEQ ID NO: 6432217 - DNA, 22 bp, Homo sapiens
tcactgaccagcggctgctcaa

SEQ ID NO: 6432218 - DNA, 16 bp, Homo sapiens
tcactgaccctggagc

SEQ ID NO: 6432219 - DNA, 17 bp, Homo sapiens
tcactgagaagatggca

SEQ ID NO: 6432220 - DNA, 20 bp, Homo sapiens
tcactgagaagatggcactg

SEQ ID NO: 6432221 - DNA, 19 bp, Homo sapiens
tcactgagaaggccccagg

SEQ ID NO: 6432222 - DNA, 20 bp, Homo sapiens
tcactgagaaggccccaggg

SEQ ID NO: 6432223 - DNA, 16 bp, Homo sapiens
tcactgagacagcccg

SEQ ID NO: 6432224 - DNA, 23 bp, Homo sapiens
tcactgagacagcccgggctctg

SEQ ID NO: 6432225 - DNA, 16 bp, Homo sapiens
tcactgagagctgcct

SEQ ID NO: 6432226 - DNA, 23 bp, Homo sapiens
tcactgagcacagtcaggggctg

SEQ ID NO: 6432227 - DNA, 15 bp, Homo sapiens
tcactgagcactgtt

SEQ ID NO: 6432228 - DNA, 18 bp, Homo sapiens
tcactgagcactgttttc

SEQ ID NO: 6432229 - DNA, 11 bp, Homo sapiens
tcactgagcct

SEQ ID NO: 6432230 - DNA, 14 bp, Homo sapiens
tcactgagctcccc

SEQ ID NO: 6432231 - DNA, 22 bp, Homo sapiens
tcactgagctccccagatctcc

SEQ ID NO: 6432232 - DNA, 21 bp, Homo sapiens
tcactgagctgggtgtaggag

SEQ ID NO: 6432233 - DNA, 13 bp, Homo sapiens
tcactgagctgtg

SEQ ID NO: 6432234 - DNA, 23 bp, Homo sapiens
tcactgaggccatcagggccctg

SEQ ID NO: 6432235 - DNA, 16 bp, Homo sapiens
tcactgaggcctgaga

SEQ ID NO: 6432236 - DNA, 23 bp, Homo sapiens
tcactgaggcctgagacccagga

SEQ ID NO: 6432237 - DNA, 22 bp, Homo sapiens
tcactgagtgatactttaagtt

SEQ ID NO: 6432238 - DNA, 22 bp, Homo sapiens
tcactgagtgcctactctttgc

SEQ ID NO: 6432239 - DNA, 15 bp, Homo sapiens
tcactgagtttgtgg

SEQ ID NO: 6432240 - DNA, 17 bp, Homo sapiens
tcactgagttttccatg

SEQ ID NO: 6432241 - DNA, 21 bp, Homo sapiens
tcactgagttttccatggcag

SEQ ID NO: 6432242 - DNA, 23 bp, Homo sapiens
tcactgagttttccatggcagga

SEQ ID NO: 6432243 - DNA, 16 bp, Homo sapiens
tcactgatgggaataa

SEQ ID NO: 6432244 - DNA, 17 bp, Homo sapiens
tcactgatgtacaatta

SEQ ID NO: 6432245 - DNA, 21 bp, Homo sapiens
tcactgatgtacaattaaaaa

SEQ ID NO: 6432246 - DNA, 13 bp, Homo sapiens
tcactgattccct

SEQ ID NO: 6432247 - DNA, 14 bp, Homo sapiens
tcactgattccctc

SEQ ID NO: 6432248 - DNA, 16 bp, Homo sapiens
tcactgattccctctc

SEQ ID NO: 6432249 - DNA, 23 bp, Homo sapiens
tcactgattccctctcccaccca

SEQ ID NO: 6432250 - DNA, 15 bp, Homo sapiens
tcactgattgggtgc

SEQ ID NO: 6432251 - DNA, 24 bp, Homo sapiens
tcactgattgggtgccatgtggag

SEQ ID NO: 6432252 - DNA, 19 bp, Homo sapiens
tcactgcaaatctccgcct

SEQ ID NO: 6432253 - DNA, 15 bp, Homo sapiens
tcactgcaacctcca

SEQ ID NO: 6432254 - DNA, 19 bp, Homo sapiens
tcactgcaacctccacctc

SEQ ID NO: 6432255 - DNA, 17 bp, Homo sapiens
tcactgcaacctccgcc

SEQ ID NO: 6432256 - DNA, 18 bp, Homo sapiens
tcactgcaacctctgcct

SEQ ID NO: 6432257 - DNA, 20 bp, Homo sapiens
tcactgcaacctctgcctcc

SEQ ID NO: 6432258 - DNA, 21 bp, Homo sapiens
tcactgcaacctctgcctccc

SEQ ID NO: 6432259 - DNA, 23 bp, Homo sapiens
tcactgcaacctctgcctcctgg

SEQ ID NO: 6432260 - DNA, 18 bp, Homo sapiens
tcactgcaacctcttcct

SEQ ID NO: 6432261 - DNA, 20 bp, Homo sapiens
tcactgcaaccttcacctcc

SEQ ID NO: 6432262 - DNA, 17 bp, Homo sapiens
tcactgcaacttctgcc

SEQ ID NO: 6432263 - DNA, 18 bp, Homo sapiens
tcactgcaagctccaact

SEQ ID NO: 6432264 - DNA, 18 bp, Homo sapiens
tcactgcaatctctgcct

SEQ ID NO: 6432265 - DNA, 15 bp, Homo sapiens
tcactgcacaagata

SEQ ID NO: 6432266 - DNA, 15 bp, Homo sapiens
tcactgcacagtgca

SEQ ID NO: 6432267 - DNA, 20 bp, Homo sapiens
tcactgcacagtgcatctca

SEQ ID NO: 6432268 - DNA, 22 bp, Homo sapiens
tcactgcacagtgcatctcagc

SEQ ID NO: 6432269 - DNA, 18 bp, Homo sapiens
tcactgcactgcatgcaa

SEQ ID NO: 6432270 - DNA, 22 bp, Homo sapiens
tcactgcagcccaggaggcaga

SEQ ID NO: 6432271 - DNA, 14 bp, Homo sapiens
tcactgcagcctcc

SEQ ID NO: 6432272 - DNA, 19 bp, Homo sapiens
tcactgcagcctccgcctc

SEQ ID NO: 6432273 - DNA, 15 bp, Homo sapiens
tcactgcagcctcga

SEQ ID NO: 6432274 - DNA, 23 bp, Homo sapiens
tcactgcagccttgtcctcccag

SEQ ID NO: 6432275 - DNA, 22 bp, Homo sapiens
tcactgcagtcacctcttctac

SEQ ID NO: 6432276 - DNA, 18 bp, Homo sapiens
tcactgcatcctccgcct

SEQ ID NO: 6432277 - DNA, 17 bp, Homo sapiens
tcactgcatctttctct

SEQ ID NO: 6432278 - DNA, 11 bp, Homo sapiens
tcactgcatta

SEQ ID NO: 6432279 - DNA, 19 bp, Homo sapiens
tcactgcattatcttgctc

SEQ ID NO: 6432280 - DNA, 20 bp, Homo sapiens
tcactgcattcattctgagc

SEQ ID NO: 6432281 - DNA, 17 bp, Homo sapiens
tcactgcatttgcctgc

SEQ ID NO: 6432282 - DNA, 21 bp, Homo sapiens
tcactgcatttgcctgcttct

SEQ ID NO: 6432283 - DNA, 23 bp, Homo sapiens
tcactgcatttggggcctttccc

SEQ ID NO: 6432284 - DNA, 16 bp, Homo sapiens
tcactgcattttgttt

SEQ ID NO: 6432285 - DNA, 12 bp, Homo sapiens
tcactgccaaag

SEQ ID NO: 6432286 - DNA, 11 bp, Homo sapiens
tcactgccact

SEQ ID NO: 6432287 - DNA, 22 bp, Homo sapiens
tcactgccactaaaatccaccc

SEQ ID NO: 6432288 - DNA, 22 bp, Homo sapiens
tcactgccactttgcacatttt

SEQ ID NO: 6432289 - DNA, 23 bp, Homo sapiens
tcactgccactttgcacattttg

SEQ ID NO: 6432290 - DNA, 14 bp, Homo sapiens
tcactgccaggcca

SEQ ID NO: 6432291 - DNA, 19 bp, Homo sapiens
tcactgccaggccagcctc

SEQ ID NO: 6432292 - DNA, 18 bp, Homo sapiens
tcactgccatcaaactgt

SEQ ID NO: 6432293 - DNA, 11 bp, Homo sapiens
tcactgccatg

SEQ ID NO: 6432294 - DNA, 14 bp, Homo sapiens
tcactgccatgcct

SEQ ID NO: 6432295 - DNA, 17 bp, Homo sapiens
tcactgccatgcctcaa

SEQ ID NO: 6432296 - DNA, 16 bp, Homo sapiens
tcactgcccaccaaag

SEQ ID NO: 6432297 - DNA, 17 bp, Homo sapiens
tcactgcccaccaaagg

SEQ ID NO: 6432298 - DNA, 18 bp, Homo sapiens
tcactgcccaccaaaggt

SEQ ID NO: 6432299 - DNA, 19 bp, Homo sapiens
tcactgccccaccagccac

SEQ ID NO: 6432300 - DNA, 22 bp, Homo sapiens
tcactgccccacttctggcatg

SEQ ID NO: 6432301 - DNA, 12 bp, Homo sapiens
tcactgcccgca

SEQ ID NO: 6432302 - DNA, 20 bp, Homo sapiens
tcactgcccgcacaccctca

SEQ ID NO: 6432303 - DNA, 22 bp, Homo sapiens
tcactgccctccctcggcccca

SEQ ID NO: 6432304 - DNA, 18 bp, Homo sapiens
tcactgccctttttgaaa

SEQ ID NO: 6432305 - DNA, 18 bp, Homo sapiens
tcactgcctaaaatttta

SEQ ID NO: 6432306 - DNA, 17 bp, Homo sapiens
tcactgcctatacccct

SEQ ID NO: 6432307 - DNA, 13 bp, Homo sapiens
tcactgcctcccc

SEQ ID NO: 6432308 - DNA, 11 bp, Homo sapiens
tcactgcctct

SEQ ID NO: 6432309 - DNA, 19 bp, Homo sapiens
tcactgcctctccctggcc

SEQ ID NO: 6432310 - DNA, 15 bp, Homo sapiens
tcactgcctggtaaa

SEQ ID NO: 6432311 - DNA, 16 bp, Homo sapiens
tcactgcctggtaaaa

SEQ ID NO: 6432312 - DNA, 14 bp, Homo sapiens
tcactgcctgtaga

SEQ ID NO: 6432313 - DNA, 15 bp, Homo sapiens
tcactgcctgtagag

SEQ ID NO: 6432314 - DNA, 12 bp, Homo sapiens
tcactgccttcc

SEQ ID NO: 6432315 - DNA, 15 bp, Homo sapiens
tcactgccttccagg

SEQ ID NO: 6432316 - DNA, 18 bp, Homo sapiens
tcactgccttcgtttata

SEQ ID NO: 6432317 - DNA, 14 bp, Homo sapiens
tcactgcctttgct

SEQ ID NO: 6432318 - DNA, 17 bp, Homo sapiens
tcactgcctttttttct

SEQ ID NO: 6432319 - DNA, 19 bp, Homo sapiens
tcactgctaagaatatttg

SEQ ID NO: 6432320 - DNA, 17 bp, Homo sapiens
tcactgctagagacgct

SEQ ID NO: 6432321 - DNA, 14 bp, Homo sapiens
tcactgctccctga

SEQ ID NO: 6432322 - DNA, 15 bp, Homo sapiens
tcactgctccttgct

SEQ ID NO: 6432323 - DNA, 16 bp, Homo sapiens
tcactgctccttgctg

SEQ ID NO: 6432324 - DNA, 13 bp, Homo sapiens
tcactgctctgcc

SEQ ID NO: 6432325 - DNA, 19 bp, Homo sapiens
tcactgctgagtttctgtt

SEQ ID NO: 6432326 - DNA, 14 bp, Homo sapiens
tcactgctgcaagg

SEQ ID NO: 6432327 - DNA, 17 bp, Homo sapiens
tcactgctgcaaggcct

SEQ ID NO: 6432328 - DNA, 17 bp, Homo sapiens
tcactgctgctactgcc

SEQ ID NO: 6432329 - DNA, 14 bp, Homo sapiens
tcactgctgctcct

SEQ ID NO: 6432330 - DNA, 13 bp, Homo sapiens
tcactgctggctg

SEQ ID NO: 6432331 - DNA, 15 bp, Homo sapiens
tcactgctggctgcc

SEQ ID NO: 6432332 - DNA, 16 bp, Homo sapiens
tcactgctgtaaagca

SEQ ID NO: 6432333 - DNA, 17 bp, Homo sapiens
tcactgctgtccctcct

SEQ ID NO: 6432334 - DNA, 20 bp, Homo sapiens
tcactgcttaacttcacata

SEQ ID NO: 6432335 - DNA, 19 bp, Homo sapiens
tcactgctttgcaccgtgg

SEQ ID NO: 6432336 - DNA, 16 bp, Homo sapiens
tcactgcttttggcct

SEQ ID NO: 6432337 - DNA, 18 bp, Homo sapiens
tcactgcttttggcctgg

SEQ ID NO: 6432338 - DNA, 20 bp, Homo sapiens
tcactgctttttccttagct

SEQ ID NO: 6432339 - DNA, 23 bp, Homo sapiens
tcactggaaattgaggtccatgg

SEQ ID NO: 6432340 - DNA, 16 bp, Homo sapiens
tcactggaacctccct

SEQ ID NO: 6432341 - DNA, 19 bp, Homo sapiens
tcactggaacctccctggg

SEQ ID NO: 6432342 - DNA, 21 bp, Homo sapiens
tcactggaacctccctgggcc

SEQ ID NO: 6432343 - DNA, 14 bp, Homo sapiens
tcactggaactcag

SEQ ID NO: 6432344 - DNA, 22 bp, Homo sapiens
tcactggaagatttatgaacag

SEQ ID NO: 6432345 - DNA, 16 bp, Homo sapiens
tcactggactgcatgg

SEQ ID NO: 6432346 - DNA, 15 bp, Homo sapiens
tcactggagcacaat

SEQ ID NO: 6432347 - DNA, 16 bp, Homo sapiens
tcactggagcacaata

SEQ ID NO: 6432348 - DNA, 17 bp, Homo sapiens
tcactggagcaccaggc

SEQ ID NO: 6432349 - DNA, 22 bp, Homo sapiens
tcactggagcaccaggcacgaa

SEQ ID NO: 6432350 - DNA, 11 bp, Homo sapiens
tcactggagcc

SEQ ID NO: 6432351 - DNA, 15 bp, Homo sapiens
tcactggagcccagg

SEQ ID NO: 6432352 - DNA, 19 bp, Homo sapiens
tcactggaggagcagcttc

SEQ ID NO: 6432353 - DNA, 20 bp, Homo sapiens
tcactggagtagttgctact

SEQ ID NO: 6432354 - DNA, 22 bp, Homo sapiens
tcactggagttacattaatgtt

SEQ ID NO: 6432355 - DNA, 19 bp, Homo sapiens
tcactggatgaagattctc

SEQ ID NO: 6432356 - DNA, 19 bp, Homo sapiens
tcactggattggtcattta

SEQ ID NO: 6432357 - DNA, 13 bp, Homo sapiens
tcactggcagagc

SEQ ID NO: 6432358 - DNA, 20 bp, Homo sapiens
tcactggcagagcacagccc

SEQ ID NO: 6432359 - DNA, 14 bp, Homo sapiens
tcactggcagcctg

SEQ ID NO: 6432360 - DNA, 15 bp, Homo sapiens
tcactggcagcctgc

SEQ ID NO: 6432361 - DNA, 16 bp, Homo sapiens
tcactggcagcctgca

SEQ ID NO: 6432362 - DNA, 18 bp, Homo sapiens
tcactggcaggtgtggga

SEQ ID NO: 6432363 - DNA, 16 bp, Homo sapiens
tcactggcatctttgc

SEQ ID NO: 6432364 - DNA, 15 bp, Homo sapiens
tcactggccatccct

SEQ ID NO: 6432365 - DNA, 18 bp, Homo sapiens
tcactggcccaaccagaa

SEQ ID NO: 6432366 - DNA, 19 bp, Homo sapiens
tcactggcgccttctcgga

SEQ ID NO: 6432367 - DNA, 19 bp, Homo sapiens
tcactggctctccaagtgc

SEQ ID NO: 6432368 - DNA, 18 bp, Homo sapiens
tcactggctctcctggcc

SEQ ID NO: 6432369 - DNA, 17 bp, Homo sapiens
tcactggctgcctccac

SEQ ID NO: 6432370 - DNA, 14 bp, Homo sapiens
tcactggctggact

SEQ ID NO: 6432371 - DNA, 14 bp, Homo sapiens
tcactggctggctc

SEQ ID NO: 6432372 - DNA, 16 bp, Homo sapiens
tcactggctggctcct

SEQ ID NO: 6432373 - DNA, 19 bp, Homo sapiens
tcactggctggctcctagg

SEQ ID NO: 6432374 - DNA, 18 bp, Homo sapiens
tctccttcgctttcctga

SEQ ID NO: 6432375 - DNA, 20 bp, Homo sapiens
tctccttcgtgtctctccca

SEQ ID NO: 6432376 - DNA, 13 bp, Homo sapiens
tctccttctcctt

SEQ ID NO: 6432377 - DNA, 17 bp, Homo sapiens
tctccttctccttccca

SEQ ID NO: 6432378 - DNA, 17 bp, Homo sapiens
tctccttctcttctctt

SEQ ID NO: 6432379 - DNA, 18 bp, Homo sapiens
tctccttctcttctcttc

SEQ ID NO: 6432380 - DNA, 21 bp, Homo sapiens
tctccttctcttctcttcttt

SEQ ID NO: 6432381 - DNA, 14 bp, Homo sapiens
tctccttcttagct

SEQ ID NO: 6432382 - DNA, 15 bp, Homo sapiens
tctccttcttccctg

SEQ ID NO: 6432383 - DNA, 13 bp, Homo sapiens
tctccttgaaatg

SEQ ID NO: 6432384 - DNA, 17 bp, Homo sapiens
tctccttgccccagtcc

SEQ ID NO: 6432385 - DNA, 19 bp, Homo sapiens
tctccttgccctagatgag

SEQ ID NO: 6432386 - DNA, 13 bp, Homo sapiens
tctccttgccctg

SEQ ID NO: 6432387 - DNA, 23 bp, Homo sapiens
tctccttgctcctggccttgctg

SEQ ID NO: 6432388 - DNA, 13 bp, Homo sapiens
tctccttggaagg

SEQ ID NO: 6432389 - DNA, 16 bp, Homo sapiens
tctccttggccacaga

SEQ ID NO: 6432390 - DNA, 20 bp, Homo sapiens
tctccttggccacagactga

SEQ ID NO: 6432391 - DNA, 13 bp, Homo sapiens
tctccttggctga

SEQ ID NO: 6432392 - DNA, 16 bp, Homo sapiens
tctccttgggctcctg

SEQ ID NO: 6432393 - DNA, 16 bp, Homo sapiens
tctccttgggctggga

SEQ ID NO: 6432394 - DNA, 16 bp, Homo sapiens
tctccttgtacttgaa

SEQ ID NO: 6432395 - DNA, 14 bp, Homo sapiens
tctcctttaaagag

SEQ ID NO: 6432396 - DNA, 23 bp, Homo sapiens
tctcctttaatatactccttaaa

SEQ ID NO: 6432397 - DNA, 12 bp, Homo sapiens
tctcctttacca

SEQ ID NO: 6432398 - DNA, 17 bp, Homo sapiens
tctcctttattgctcct

SEQ ID NO: 6432399 - DNA, 16 bp, Homo sapiens
tctcctttcacaacct

SEQ ID NO: 6432400 - DNA, 12 bp, Homo sapiens
tctcctttcact

SEQ ID NO: 6432401 - DNA, 12 bp, Homo sapiens
tctcctttcctt

SEQ ID NO: 6432402 - DNA, 14 bp, Homo sapiens
tctcctttccttcc

SEQ ID NO: 6432403 - DNA, 15 bp, Homo sapiens
tctcctttccttccc

SEQ ID NO: 6432404 - DNA, 16 bp, Homo sapiens
tctcctttctaagccc

SEQ ID NO: 6432405 - DNA, 15 bp, Homo sapiens
tctcctttctccctg

SEQ ID NO: 6432406 - DNA, 16 bp, Homo sapiens
tctcctttctccctgc

SEQ ID NO: 6432407 - DNA, 14 bp, Homo sapiens
tctcctttctgtgc

SEQ ID NO: 6432408 - DNA, 12 bp, Homo sapiens
tctcctttgaaa

SEQ ID NO: 6432409 - DNA, 22 bp, Homo sapiens
tctcctttgaagtgggaaagca

SEQ ID NO: 6432410 - DNA, 17 bp, Homo sapiens
tctcctttgataaaata

SEQ ID NO: 6432411 - DNA, 13 bp, Homo sapiens
tctcctttgatat

SEQ ID NO: 6432412 - DNA, 18 bp, Homo sapiens
tctcctttgatattatgt

SEQ ID NO: 6432413 - DNA, 12 bp, Homo sapiens
tctcctttgcaa

SEQ ID NO: 6432414 - DNA, 16 bp, Homo sapiens
tctcctttgcactgag

SEQ ID NO: 6432415 - DNA, 19 bp, Homo sapiens
tctcctttgcactgagggc

SEQ ID NO: 6432416 - DNA, 17 bp, Homo sapiens
tctcctttgcaggctca

SEQ ID NO: 6432417 - DNA, 12 bp, Homo sapiens
tctcctttgctc

SEQ ID NO: 6432418 - DNA, 16 bp, Homo sapiens
tctcctttgctcttgc

SEQ ID NO: 6432419 - DNA, 19 bp, Homo sapiens
tctcctttggcatgtttaa

SEQ ID NO: 6432420 - DNA, 23 bp, Homo sapiens
tctcctttggcatgtttaattgt

SEQ ID NO: 6432421 - DNA, 19 bp, Homo sapiens
tctcctttgtactttgtgc

SEQ ID NO: 6432422 - DNA, 22 bp, Homo sapiens
tctcctttgtattctgtcttca

SEQ ID NO: 6432423 - DNA, 17 bp, Homo sapiens
tctcctttgtcaaatgg

SEQ ID NO: 6432424 - DNA, 19 bp, Homo sapiens
tctcctttgtcaaatggta

SEQ ID NO: 6432425 - DNA, 15 bp, Homo sapiens
tctcctttgtccatt

SEQ ID NO: 6432426 - DNA, 23 bp, Homo sapiens
tctccttttgaggcttctccttc

SEQ ID NO: 6432427 - DNA, 22 bp, Homo sapiens
tctccttttgcgcttatttgga

SEQ ID NO: 6432428 - DNA, 17 bp, Homo sapiens
tctccttttttcccagc

SEQ ID NO: 6432429 - DNA, 15 bp, Homo sapiens
tctcgaactcctgac

SEQ ID NO: 6432430 - DNA, 18 bp, Homo sapiens
tctcgaactcctgacctc

SEQ ID NO: 6432431 - DNA, 15 bp, Homo sapiens
tctcgaactcctggc

SEQ ID NO: 6432432 - DNA, 17 bp, Homo sapiens
tctcgaagcagtattct

SEQ ID NO: 6432433 - DNA, 16 bp, Homo sapiens
tctcgaatttgaagag

SEQ ID NO: 6432434 - DNA, 13 bp, Homo sapiens
tctcgaccctgtc

SEQ ID NO: 6432435 - DNA, 21 bp, Homo sapiens
tctcgacggcacgcacttgcc

SEQ ID NO: 6432436 - DNA, 14 bp, Homo sapiens
tctcgactgctttt

SEQ ID NO: 6432437 - DNA, 18 bp, Homo sapiens
tctcgagacttctctgtg

SEQ ID NO: 6432438 - DNA, 13 bp, Homo sapiens
tctcgagcccaga

SEQ ID NO: 6432439 - DNA, 23 bp, Homo sapiens
tctcgagccccctggatgtcccc

SEQ ID NO: 6432440 - DNA, 19 bp, Homo sapiens
tctcgaggggcgtgtgttc

SEQ ID NO: 6432441 - DNA, 19 bp, Homo sapiens
tctcgagtccaaaatcatt

SEQ ID NO: 6432442 - DNA, 14 bp, Homo sapiens
tctcgatgcaatga

SEQ ID NO: 6432443 - DNA, 23 bp, Homo sapiens
tctcgatgcaggtggatctcctt

SEQ ID NO: 6432444 - DNA, 14 bp, Homo sapiens
tctcgattctttga

SEQ ID NO: 6432445 - DNA, 14 bp, Homo sapiens
tctcgcaactgaag

SEQ ID NO: 6432446 - DNA, 18 bp, Homo sapiens
tctcgcagcctgaagcct

SEQ ID NO: 6432447 - DNA, 22 bp, Homo sapiens
tctcgcagcctgaagcctggat

SEQ ID NO: 6432448 - DNA, 23 bp, Homo sapiens
tctcgcataggacctttccacca

SEQ ID NO: 6432449 - DNA, 19 bp, Homo sapiens
tctcgcattttctctagct

SEQ ID NO: 6432450 - DNA, 13 bp, Homo sapiens
tctcgccaagcag

SEQ ID NO: 6432451 - DNA, 15 bp, Homo sapiens
tctcgccctggccag

SEQ ID NO: 6432452 - DNA, 17 bp, Homo sapiens
tctcgcctcactttcca

SEQ ID NO: 6432453 - DNA, 12 bp, Homo sapiens
tctcgcctcatt

SEQ ID NO: 6432454 - DNA, 19 bp, Homo sapiens
tctcgccttcctgcagtct

SEQ ID NO: 6432455 - DNA, 22 bp, Homo sapiens
tctcgcgcccagcatttggttt

SEQ ID NO: 6432456 - DNA, 16 bp, Homo sapiens
tctcgctcccctctgc

SEQ ID NO: 6432457 - DNA, 15 bp, Homo sapiens
tctcgctccctccca

SEQ ID NO: 6432458 - DNA, 16 bp, Homo sapiens
tctcgctccctcccag

SEQ ID NO: 6432459 - DNA, 15 bp, Homo sapiens
tctcgctctcgctct

SEQ ID NO: 6432460 - DNA, 16 bp, Homo sapiens
tctcgctctcgctctc

SEQ ID NO: 6432461 - DNA, 19 bp, Homo sapiens
tctcgctctcgctctctct

SEQ ID NO: 6432462 - DNA, 12 bp, Homo sapiens
tctcgctctgct

SEQ ID NO: 6432463 - DNA, 15 bp, Homo sapiens
tctcgctctgtcacc

SEQ ID NO: 6432464 - DNA, 18 bp, Homo sapiens
tctcgctctgttgcccag

SEQ ID NO: 6432465 - DNA, 19 bp, Homo sapiens
tctcgctctgttgcccagg

SEQ ID NO: 6432466 - DNA, 22 bp, Homo sapiens
tctcgctgatgctgggctgggt

SEQ ID NO: 6432467 - DNA, 18 bp, Homo sapiens
tctcgctgcgtcctcatt

SEQ ID NO: 6432468 - DNA, 21 bp, Homo sapiens
tctcgctgcgtcctcatttcc

SEQ ID NO: 6432469 - DNA, 14 bp, Homo sapiens
tctcgctgtcactg

SEQ ID NO: 6432470 - DNA, 19 bp, Homo sapiens
tctcgctgtcactggctgg

SEQ ID NO: 6432471 - DNA, 20 bp, Homo sapiens
tctcgcttcctcagcctcca

SEQ ID NO: 6432472 - DNA, 21 bp, Homo sapiens
tctcgcttcctcagcctccaa

SEQ ID NO: 6432473 - DNA, 15 bp, Homo sapiens
tctcggaactcccgc

SEQ ID NO: 6432474 - DNA, 20 bp, Homo sapiens
tctcggagcatcccggagga

SEQ ID NO: 6432475 - DNA, 17 bp, Homo sapiens
tctcggaggccaggccc

SEQ ID NO: 6432476 - DNA, 19 bp, Homo sapiens
tctcggatgacaccctggc

SEQ ID NO: 6432477 - DNA, 17 bp, Homo sapiens
tctcggcaccagtgcct

SEQ ID NO: 6432478 - DNA, 19 bp, Homo sapiens
tctcggcaccagtgcctca

SEQ ID NO: 6432479 - DNA, 13 bp, Homo sapiens
tctcggccccatc

SEQ ID NO: 6432480 - DNA, 17 bp, Homo sapiens
tctcggccccatcgccc

SEQ ID NO: 6432481 - DNA, 15 bp, Homo sapiens
tctcggcccctgtct

SEQ ID NO: 6432482 - DNA, 14 bp, Homo sapiens
tctcggccctgaac

SEQ ID NO: 6432483 - DNA, 15 bp, Homo sapiens
tctcggccctgaacc

SEQ ID NO: 6432484 - DNA, 18 bp, Homo sapiens
tctcggccttcacaatct

SEQ ID NO: 6432485 - DNA, 18 bp, Homo sapiens
tctcggctgccaggggct

SEQ ID NO: 6432486 - DNA, 23 bp, Homo sapiens
tctcggctgccaggggctctgtg

SEQ ID NO: 6432487 - DNA, 22 bp, Homo sapiens
tctcggctggaagaacatcaag

SEQ ID NO: 6432488 - DNA, 22 bp, Homo sapiens
tctcggggcgacccctcagtgc

SEQ ID NO: 6432489 - DNA, 13 bp, Homo sapiens
tctcggggcttgc

SEQ ID NO: 6432490 - DNA, 17 bp, Homo sapiens
tctcggtccactcttgt

SEQ ID NO: 6432491 - DNA, 12 bp, Homo sapiens
tctcgtaatagc

SEQ ID NO: 6432492 - DNA, 16 bp, Homo sapiens
tctcgtaatagcttct

SEQ ID NO: 6432493 - DNA, 18 bp, Homo sapiens
tctcgtaatagcttctgt

SEQ ID NO: 6432494 - DNA, 21 bp, Homo sapiens
tctcgtaatagcttctgtgtg

SEQ ID NO: 6432495 - DNA, 21 bp, Homo sapiens
tctcgtactttcacatctctg

SEQ ID NO: 6432496 - DNA, 15 bp, Homo sapiens
tctcgtagaacctgc

SEQ ID NO: 6432497 - DNA, 19 bp, Homo sapiens
tctcgtagaacctgcgcac

SEQ ID NO: 6432498 - DNA, 15 bp, Homo sapiens
tctcgtatttaatat

SEQ ID NO: 6432499 - DNA, 16 bp, Homo sapiens
tctcgtcaggctgcca

SEQ ID NO: 6432500 - DNA, 20 bp, Homo sapiens
tctcgtcaggctgccagaga

SEQ ID NO: 6432501 - DNA, 14 bp, Homo sapiens
tctcgtccccctcc

SEQ ID NO: 6432502 - DNA, 18 bp, Homo sapiens
tctcgtccccctccctgc

SEQ ID NO: 6432503 - DNA, 12 bp, Homo sapiens
tctcgtctcctg

SEQ ID NO: 6432504 - DNA, 14 bp, Homo sapiens
tctcgtctctttta

SEQ ID NO: 6432505 - DNA, 19 bp, Homo sapiens
tctcgtcttccgtctcccc

SEQ ID NO: 6432506 - DNA, 21 bp, Homo sapiens
tctcgtcttggtttggttcat

SEQ ID NO: 6432507 - DNA, 12 bp, Homo sapiens
tctcgtgaccca

SEQ ID NO: 6432508 - DNA, 22 bp, Homo sapiens
tctcgtgattgataagaacctt

SEQ ID NO: 6432509 - DNA, 18 bp, Homo sapiens
tctcgtgcatttcaactt

SEQ ID NO: 6432510 - DNA, 18 bp, Homo sapiens
tctcgtgctgcatccctg

SEQ ID NO: 6432511 - DNA, 21 bp, Homo sapiens
tctcgtggtaggactgtagaa

SEQ ID NO: 6432512 - DNA, 19 bp, Homo sapiens
tctcgtgtcagtaatttat

SEQ ID NO: 6432513 - DNA, 19 bp, Homo sapiens
tctcgtgttcgctggctga

SEQ ID NO: 6432514 - DNA, 22 bp, Homo sapiens
tctcgttaatcatcagttcctt

SEQ ID NO: 6432515 - DNA, 15 bp, Homo sapiens
tctcgtttcaaaaac

SEQ ID NO: 6432516 - DNA, 17 bp, Homo sapiens
tctctaaaaataaaatg

SEQ ID NO: 6432517 - DNA, 20 bp, Homo sapiens
tctctaaaaataaaatgatg

SEQ ID NO: 6432518 - DNA, 16 bp, Homo sapiens
tctctaaaatgctgtt

SEQ ID NO: 6432519 - DNA, 19 bp, Homo sapiens
tctctaaaatgctgttctc

SEQ ID NO: 6432520 - DNA, 16 bp, Homo sapiens
tctctaaaattctagt

SEQ ID NO: 6432521 - DNA, 15 bp, Homo sapiens
tctctaaactgtttc

SEQ ID NO: 6432522 - DNA, 17 bp, Homo sapiens
tctctaaacttccctct

SEQ ID NO: 6432523 - DNA, 14 bp, Homo sapiens
tctctaaagtcact

SEQ ID NO: 6432524 - DNA, 13 bp, Homo sapiens
tctctaacaatgt

SEQ ID NO: 6432525 - DNA, 17 bp, Homo sapiens
tctctaacagctcagga

SEQ ID NO: 6432526 - DNA, 13 bp, Homo sapiens
tctctaacatatg

SEQ ID NO: 6432527 - DNA, 18 bp, Homo sapiens
tctctaacccacaggtgt

SEQ ID NO: 6432528 - DNA, 15 bp, Homo sapiens
tctctaacctccttt

SEQ ID NO: 6432529 - DNA, 12 bp, Homo sapiens
tctctaacttca

SEQ ID NO: 6432530 - DNA, 22 bp, Homo sapiens
tctctaacttcaaggcccatat

SEQ ID NO: 6432531 - DNA, 13 bp, Homo sapiens
tctctaagaattc

SEQ ID NO: 6432532 - DNA, 13 bp, Homo sapiens
tctctaagccaca

SEQ ID NO: 6432533 - DNA, 21 bp, Homo sapiens
tctctaagccacagcttcttc

SEQ ID NO: 6432534 - DNA, 15 bp, Homo sapiens
tctctaaggctaagg

SEQ ID NO: 6432535 - DNA, 16 bp, Homo sapiens
tctctaaggctaagga

SEQ ID NO: 6432536 - DNA, 22 bp, Homo sapiens
tctctaaggctaaggataggga

SEQ ID NO: 6432537 - DNA, 17 bp, Homo sapiens
tctctaagtgtaaaagt

SEQ ID NO: 6432538 - DNA, 18 bp, Homo sapiens
tctctaagttccactgag

SEQ ID NO: 6432539 - DNA, 16 bp, Homo sapiens
tctctaataagaaaac

SEQ ID NO: 6432540 - DNA, 11 bp, Homo sapiens
tctctaataat

SEQ ID NO: 6432541 - DNA, 14 bp, Homo sapiens
tctctaataataaa

SEQ ID NO: 6432542 - DNA, 18 bp, Homo sapiens
tctctaataataaatagt

SEQ ID NO: 6432543 - DNA, 23 bp, Homo sapiens
tctctaatagaaaagtctccacc

SEQ ID NO: 6432544 - DNA, 23 bp, Homo sapiens
tctctaatgagctagtgtcttat

SEQ ID NO: 6432545 - DNA, 15 bp, Homo sapiens
tctctaattagaaat

SEQ ID NO: 6432546 - DNA, 19 bp, Homo sapiens
tctctaattccatccataa

SEQ ID NO: 6432547 - DNA, 20 bp, Homo sapiens
tctctacagacttctccaga

SEQ ID NO: 6432548 - DNA, 22 bp, Homo sapiens
tctctacaggcctcttcctgtt

SEQ ID NO: 6432549 - DNA, 18 bp, Homo sapiens
tctctacaggtttgggta

SEQ ID NO: 6432550 - DNA, 18 bp, Homo sapiens
tctctaccagtctatttc

SEQ ID NO: 6432551 - DNA, 12 bp, Homo sapiens
tctctacccagc

SEQ ID NO: 6432552 - DNA, 15 bp, Homo sapiens
tctctacccatctcc

SEQ ID NO: 6432553 - DNA, 19 bp, Homo sapiens
tctctacccatcttaaaaa

SEQ ID NO: 6432554 - DNA, 14 bp, Homo sapiens
tcactggctgggag

SEQ ID NO: 6432555 - DNA, 18 bp, Homo sapiens
tcactgggaagctcccac

SEQ ID NO: 6432556 - DNA, 21 bp, Homo sapiens
tcactgggaagctcccacccc

SEQ ID NO: 6432557 - DNA, 16 bp, Homo sapiens
tcactgggactttgta

SEQ ID NO: 6432558 - DNA, 15 bp, Homo sapiens
tcactgggagaggtt

SEQ ID NO: 6432559 - DNA, 20 bp, Homo sapiens
tcactgggccaattcaatac

SEQ ID NO: 6432560 - DNA, 16 bp, Homo sapiens
tcactgggcccagagg

SEQ ID NO: 6432561 - DNA, 17 bp, Homo sapiens
tcactgggcccagagga

SEQ ID NO: 6432562 - DNA, 18 bp, Homo sapiens
tcactgggcccagaggag

SEQ ID NO: 6432563 - DNA, 17 bp, Homo sapiens
tcactggggagtctgct

SEQ ID NO: 6432564 - DNA, 20 bp, Homo sapiens
tcactggggatggtggcaca

SEQ ID NO: 6432565 - DNA, 23 bp, Homo sapiens
tcactggggatggtggcacaggc

SEQ ID NO: 6432566 - DNA, 20 bp, Homo sapiens
tcactgggggacactgtggc

SEQ ID NO: 6432567 - DNA, 21 bp, Homo sapiens
tcactgggggacactgtggca

SEQ ID NO: 6432568 - DNA, 16 bp, Homo sapiens
tcactgggggctttgg

SEQ ID NO: 6432569 - DNA, 16 bp, Homo sapiens
tcactggggtcctggg

SEQ ID NO: 6432570 - DNA, 17 bp, Homo sapiens
tcactggggtcctgggg

SEQ ID NO: 6432571 - DNA, 19 bp, Homo sapiens
tcactggggtcctggggcc

SEQ ID NO: 6432572 - DNA, 22 bp, Homo sapiens
tcactgggtgttgatcttacaa

SEQ ID NO: 6432573 - DNA, 17 bp, Homo sapiens
tcactggtactctgcca

SEQ ID NO: 6432574 - DNA, 20 bp, Homo sapiens
tcactggtagaccaaaataa

SEQ ID NO: 6432575 - DNA, 15 bp, Homo sapiens
tcactggtatacaca

SEQ ID NO: 6432576 - DNA, 20 bp, Homo sapiens
tcactggtcagggcagtggc

SEQ ID NO: 6432577 - DNA, 19 bp, Homo sapiens
tcactggtccaggtcttca

SEQ ID NO: 6432578 - DNA, 20 bp, Homo sapiens
tcactggtccatttctcagt

SEQ ID NO: 6432579 - DNA, 17 bp, Homo sapiens
tcactggtgagacaatg

SEQ ID NO: 6432580 - DNA, 22 bp, Homo sapiens
tcactggtgagacaatgaaaca

SEQ ID NO: 6432581 - DNA, 16 bp, Homo sapiens
tcactggttttactta

SEQ ID NO: 6432582 - DNA, 23 bp, Homo sapiens
tcactgtaaagacaaataaatga

SEQ ID NO: 6432583 - DNA, 16 bp, Homo sapiens
tcactgtaagtttatt

SEQ ID NO: 6432584 - DNA, 13 bp, Homo sapiens
tcactgtactgca

SEQ ID NO: 6432585 - DNA, 17 bp, Homo sapiens
tcactgtactgcatgtg

SEQ ID NO: 6432586 - DNA, 20 bp, Homo sapiens
tcactgtactgcatgtgact

SEQ ID NO: 6432587 - DNA, 21 bp, Homo sapiens
tcactgtactgcatgtgactt

SEQ ID NO: 6432588 - DNA, 19 bp, Homo sapiens
tcactgtaggtatagaaga

SEQ ID NO: 6432589 - DNA, 15 bp, Homo sapiens
tcactgtataaatag

SEQ ID NO: 6432590 - DNA, 16 bp, Homo sapiens
tcactgtataaatagg

SEQ ID NO: 6432591 - DNA, 18 bp, Homo sapiens
tcactgtatagacatgct

SEQ ID NO: 6432592 - DNA, 19 bp, Homo sapiens
tcactgtatagtaatcatt

SEQ ID NO: 6432593 - DNA, 12 bp, Homo sapiens
tcactgtatata

SEQ ID NO: 6432594 - DNA, 18 bp, Homo sapiens
tcactgtatcattttctt

SEQ ID NO: 6432595 - DNA, 17 bp, Homo sapiens
tcactgtcagtcccact

SEQ ID NO: 6432596 - DNA, 17 bp, Homo sapiens
tcactgtcatctgccag

SEQ ID NO: 6432597 - DNA, 12 bp, Homo sapiens
tcactgtccaat

SEQ ID NO: 6432598 - DNA, 20 bp, Homo sapiens
tcactgtccaatatgaaaac

SEQ ID NO: 6432599 - DNA, 22 bp, Homo sapiens
tcactgtccaggtaggaaacaa

SEQ ID NO: 6432600 - DNA, 16 bp, Homo sapiens
tcactgtccctcctgg

SEQ ID NO: 6432601 - DNA, 17 bp, Homo sapiens
tcactgtccctcctggt

SEQ ID NO: 6432602 - DNA, 14 bp, Homo sapiens
tcactgtcctgtga

SEQ ID NO: 6432603 - DNA, 15 bp, Homo sapiens
tcactgtcctgtgaa

SEQ ID NO: 6432604 - DNA, 19 bp, Homo sapiens
tcactgtctatttaagtgc

SEQ ID NO: 6432605 - DNA, 17 bp, Homo sapiens
tcactgtctgctggcaa

SEQ ID NO: 6432606 - DNA, 14 bp, Homo sapiens
tcactgtctgttgt

SEQ ID NO: 6432607 - DNA, 17 bp, Homo sapiens
tcactgtcttactcaag

SEQ ID NO: 6432608 - DNA, 18 bp, Homo sapiens
tcactgtcttactcaaga

SEQ ID NO: 6432609 - DNA, 20 bp, Homo sapiens
tcactgtctttaattctgta

SEQ ID NO: 6432610 - DNA, 12 bp, Homo sapiens
tcactgtctttc

SEQ ID NO: 6432611 - DNA, 13 bp, Homo sapiens
tcactgtctttga

SEQ ID NO: 6432612 - DNA, 14 bp, Homo sapiens
tcactgtgaaattt

SEQ ID NO: 6432613 - DNA, 16 bp, Homo sapiens
tcactgtgaaatttca

SEQ ID NO: 6432614 - DNA, 18 bp, Homo sapiens
tcactgtgacctccgcct

SEQ ID NO: 6432615 - DNA, 18 bp, Homo sapiens
tcactgtgacctgctcct

SEQ ID NO: 6432616 - DNA, 21 bp, Homo sapiens
tcactgtgacctgctcctgcc

SEQ ID NO: 6432617 - DNA, 22 bp, Homo sapiens
tcactgtgacctgctcctgccc

SEQ ID NO: 6432618 - DNA, 23 bp, Homo sapiens
tcactgtgacctgctcctgccca

SEQ ID NO: 6432619 - DNA, 16 bp, Homo sapiens
tcactgtgagctccca

SEQ ID NO: 6432620 - DNA, 22 bp, Homo sapiens
tcactgtgagttctgatgtctt

SEQ ID NO: 6432621 - DNA, 21 bp, Homo sapiens
tcactgtgatcaatattttta

SEQ ID NO: 6432622 - DNA, 18 bp, Homo sapiens
tcactgtgcactgccctg

SEQ ID NO: 6432623 - DNA, 14 bp, Homo sapiens
tcactgtgctcagc

SEQ ID NO: 6432624 - DNA, 15 bp, Homo sapiens
tcactgtgctcagcc

SEQ ID NO: 6432625 - DNA, 16 bp, Homo sapiens
tcactgtgctcagcca

SEQ ID NO: 6432626 - DNA, 14 bp, Homo sapiens
tcactgtgctccta

SEQ ID NO: 6432627 - DNA, 11 bp, Homo sapiens
tcactgtgctg

SEQ ID NO: 6432628 - DNA, 11 bp, Homo sapiens
tcactgtgctt

SEQ ID NO: 6432629 - DNA, 21 bp, Homo sapiens
tcactgtgcttaatttaaata

SEQ ID NO: 6432630 - DNA, 13 bp, Homo sapiens
tcactgtgcttcg

SEQ ID NO: 6432631 - DNA, 20 bp, Homo sapiens
tcactgtggccacagccccc

SEQ ID NO: 6432632 - DNA, 15 bp, Homo sapiens
tcactgtggctgtct

SEQ ID NO: 6432633 - DNA, 17 bp, Homo sapiens
tcactgtggggaaacaa

SEQ ID NO: 6432634 - DNA, 15 bp, Homo sapiens
tcactgtgtacataa

SEQ ID NO: 6432635 - DNA, 12 bp, Homo sapiens
tcactgtgtata

SEQ ID NO: 6432636 - DNA, 22 bp, Homo sapiens
tcactgtgtataggaatttgta

SEQ ID NO: 6432637 - DNA, 14 bp, Homo sapiens
tcactgtgtatatt

SEQ ID NO: 6432638 - DNA, 17 bp, Homo sapiens
tcactgtgtatatttga

SEQ ID NO: 6432639 - DNA, 18 bp, Homo sapiens
tcactgtgtatatttgat

SEQ ID NO: 6432640 - DNA, 19 bp, Homo sapiens
tcactgtgtcacccagact

SEQ ID NO: 6432641 - DNA, 17 bp, Homo sapiens
tcactgtgtcacccagg

SEQ ID NO: 6432642 - DNA, 12 bp, Homo sapiens
tcactgtgtctc

SEQ ID NO: 6432643 - DNA, 14 bp, Homo sapiens
tcactgtgttactg

SEQ ID NO: 6432644 - DNA, 16 bp, Homo sapiens
tcactgtgttactgct

SEQ ID NO: 6432645 - DNA, 18 bp, Homo sapiens
tcactgtgttactgcttt

SEQ ID NO: 6432646 - DNA, 19 bp, Homo sapiens
tcactgtgttactgctttg

SEQ ID NO: 6432647 - DNA, 18 bp, Homo sapiens
tcactgtgttgcccaggc

SEQ ID NO: 6432648 - DNA, 19 bp, Homo sapiens
tcactgtgttgcccaggct

SEQ ID NO: 6432649 - DNA, 20 bp, Homo sapiens
tcactgtgttgcccaggctg

SEQ ID NO: 6432650 - DNA, 15 bp, Homo sapiens
tcactgttataaatt

SEQ ID NO: 6432651 - DNA, 21 bp, Homo sapiens
tcactgttataaattttgtac

SEQ ID NO: 6432652 - DNA, 17 bp, Homo sapiens
tcactgttccctctgct

SEQ ID NO: 6432653 - DNA, 22 bp, Homo sapiens
tcactgttccctctgctcctgg

SEQ ID NO: 6432654 - DNA, 22 bp, Homo sapiens
tcactgttcgtcactcaaatga

SEQ ID NO: 6432655 - DNA, 13 bp, Homo sapiens
tcactgttctgca

SEQ ID NO: 6432656 - DNA, 20 bp, Homo sapiens
tcactgttgaaaattatttt

SEQ ID NO: 6432657 - DNA, 18 bp, Homo sapiens
tcactgttgcagtggcct

SEQ ID NO: 6432658 - DNA, 18 bp, Homo sapiens
tcactgttgcccaggctg

SEQ ID NO: 6432659 - DNA, 16 bp, Homo sapiens
tcactgttgtacacag

SEQ ID NO: 6432660 - DNA, 11 bp, Homo sapiens
tcactgttgtg

SEQ ID NO: 6432661 - DNA, 20 bp, Homo sapiens
tcactgtttagaacacacac

SEQ ID NO: 6432662 - DNA, 15 bp, Homo sapiens
tcactgtttataaat

SEQ ID NO: 6432663 - DNA, 21 bp, Homo sapiens
tcactgtttataaatgttctg

SEQ ID NO: 6432664 - DNA, 18 bp, Homo sapiens
tcactgtttattgaagaa

SEQ ID NO: 6432665 - DNA, 14 bp, Homo sapiens
tcactgtttcatct

SEQ ID NO: 6432666 - DNA, 14 bp, Homo sapiens
tcactgtttttaga

SEQ ID NO: 6432667 - DNA, 22 bp, Homo sapiens
tcactgtttttattccttccat

SEQ ID NO: 6432668 - DNA, 16 bp, Homo sapiens
tcacttaaaaaaatgc

SEQ ID NO: 6432669 - DNA, 23 bp, Homo sapiens
tcacttaaaatcaaatttttctg

SEQ ID NO: 6432670 - DNA, 18 bp, Homo sapiens
tcacttaaattcttttga

SEQ ID NO: 6432671 - DNA, 22 bp, Homo sapiens
tcacttaaggggggatgtcttg

SEQ ID NO: 6432672 - DNA, 21 bp, Homo sapiens
tcacttaataatttttaccta

SEQ ID NO: 6432673 - DNA, 23 bp, Homo sapiens
tcacttaataatttttacctaat

SEQ ID NO: 6432674 - DNA, 13 bp, Homo sapiens
tcacttaatgttt

SEQ ID NO: 6432675 - DNA, 16 bp, Homo sapiens
tcacttaattgctaca

SEQ ID NO: 6432676 - DNA, 17 bp, Homo sapiens
tcacttaattttcccaa

SEQ ID NO: 6432677 - DNA, 20 bp, Homo sapiens
tcacttacataaagctccct

SEQ ID NO: 6432678 - DNA, 13 bp, Homo sapiens
tcacttacatttt

SEQ ID NO: 6432679 - DNA, 20 bp, Homo sapiens
tcacttacccattagccagg

SEQ ID NO: 6432680 - DNA, 20 bp, Homo sapiens
tcacttaccccgagacctca

SEQ ID NO: 6432681 - DNA, 22 bp, Homo sapiens
tcacttaccccgagacctcact

SEQ ID NO: 6432682 - DNA, 18 bp, Homo sapiens
tcacttacgtttgtcctt

SEQ ID NO: 6432683 - DNA, 19 bp, Homo sapiens
tcacttagaacctttctgt

SEQ ID NO: 6432684 - DNA, 22 bp, Homo sapiens
tcacttatgaatgatttgcata

SEQ ID NO: 6432685 - DNA, 17 bp, Homo sapiens
tcacttcaaacatgccc

SEQ ID NO: 6432686 - DNA, 18 bp, Homo sapiens
tcacttcaaacatgccct

SEQ ID NO: 6432687 - DNA, 23 bp, Homo sapiens
tcacttcaaacatgccctcaggc

SEQ ID NO: 6432688 - DNA, 22 bp, Homo sapiens
tcacttcaagctcaccctgctc

SEQ ID NO: 6432689 - DNA, 17 bp, Homo sapiens
tcacttcacgctttcag

SEQ ID NO: 6432690 - DNA, 12 bp, Homo sapiens
tcacttcactgt

SEQ ID NO: 6432691 - DNA, 15 bp, Homo sapiens
tcacttcactgtgct

SEQ ID NO: 6432692 - DNA, 19 bp, Homo sapiens
tcacttcaggagaaactgc

SEQ ID NO: 6432693 - DNA, 17 bp, Homo sapiens
tcacttcagttgtggcc

SEQ ID NO: 6432694 - DNA, 20 bp, Homo sapiens
tcacttcagttgtggcctca

SEQ ID NO: 6432695 - DNA, 20 bp, Homo sapiens
tcacttcatcttctcagctc

SEQ ID NO: 6432696 - DNA, 14 bp, Homo sapiens
tcacttcatgtttt

SEQ ID NO: 6432697 - DNA, 17 bp, Homo sapiens
tcacttccagatatcca

SEQ ID NO: 6432698 - DNA, 13 bp, Homo sapiens
tcacttccagtgt

SEQ ID NO: 6432699 - DNA, 15 bp, Homo sapiens
tcacttccagtgttg

SEQ ID NO: 6432700 - DNA, 17 bp, Homo sapiens
tcacttccccttccaac

SEQ ID NO: 6432701 - DNA, 19 bp, Homo sapiens
tcacttccctgggaactca

SEQ ID NO: 6432702 - DNA, 20 bp, Homo sapiens
tcacttcctaagttcccttc

SEQ ID NO: 6432703 - DNA, 21 bp, Homo sapiens
tcacttcctaagttcccttct

SEQ ID NO: 6432704 - DNA, 19 bp, Homo sapiens
tcacttcctagagcatctg

SEQ ID NO: 6432705 - DNA, 17 bp, Homo sapiens
tcacttcctccagaagc

SEQ ID NO: 6432706 - DNA, 15 bp, Homo sapiens
tcacttcctgtttta

SEQ ID NO: 6432707 - DNA, 14 bp, Homo sapiens
tcacttccttgccc

SEQ ID NO: 6432708 - DNA, 12 bp, Homo sapiens
tcacttcctttg

SEQ ID NO: 6432709 - DNA, 20 bp, Homo sapiens
tcacttcctttgcccttcct

SEQ ID NO: 6432710 - DNA, 22 bp, Homo sapiens
tcacttcgcgtgccctcgctgc

SEQ ID NO: 6432711 - DNA, 18 bp, Homo sapiens
tcacttcggccagagctg

SEQ ID NO: 6432712 - DNA, 19 bp, Homo sapiens
tcacttcggccagagctga

SEQ ID NO: 6432713 - DNA, 16 bp, Homo sapiens
tcacttcgtggctaag

SEQ ID NO: 6432714 - DNA, 12 bp, Homo sapiens
tcacttctaaat

SEQ ID NO: 6432715 - DNA, 13 bp, Homo sapiens
tcacttctaaatt

SEQ ID NO: 6432716 - DNA, 20 bp, Homo sapiens
tcacttctagggtatgggaa

SEQ ID NO: 6432717 - DNA, 22 bp, Homo sapiens
tcacttctgcattcctgtaact

SEQ ID NO: 6432718 - DNA, 14 bp, Homo sapiens
tcacttctgctgta

SEQ ID NO: 6432719 - DNA, 14 bp, Homo sapiens
tcacttctgggaaa

SEQ ID NO: 6432720 - DNA, 15 bp, Homo sapiens
tcacttcttaaggac

SEQ ID NO: 6432721 - DNA, 21 bp, Homo sapiens
tcacttcttaaggacagtgtt

SEQ ID NO: 6432722 - DNA, 15 bp, Homo sapiens
tcacttcttccactg

SEQ ID NO: 6432723 - DNA, 13 bp, Homo sapiens
tcacttcttctgt

SEQ ID NO: 6432724 - DNA, 21 bp, Homo sapiens
tcacttcttctgtccaagcag

SEQ ID NO: 6432725 - DNA, 19 bp, Homo sapiens
tcacttctttcccttcctc

SEQ ID NO: 6432726 - DNA, 22 bp, Homo sapiens
tcacttgaaacttggttcccag

SEQ ID NO: 6432727 - DNA, 21 bp, Homo sapiens
tcacttgaatcctagggcctg

SEQ ID NO: 6432728 - DNA, 13 bp, Homo sapiens
tcacttgaatgtg

SEQ ID NO: 6432729 - DNA, 15 bp, Homo sapiens
tcacttgactcttga

SEQ ID NO: 6432730 - DNA, 12 bp, Homo sapiens
tcacttgagacc

SEQ ID NO: 6432731 - DNA, 16 bp, Homo sapiens
tcacttgagcccagga

SEQ ID NO: 6432732 - DNA, 15 bp, Homo sapiens
tctctacccctttct

SEQ ID NO: 6432733 - DNA, 18 bp, Homo sapiens
tctctacccggcccagag

SEQ ID NO: 6432734 - DNA, 13 bp, Homo sapiens
tctctacctccac

SEQ ID NO: 6432735 - DNA, 13 bp, Homo sapiens
tctctaccttcaa

SEQ ID NO: 6432736 - DNA, 14 bp, Homo sapiens
tctctaccttctcc

SEQ ID NO: 6432737 - DNA, 19 bp, Homo sapiens
tctctaccttctccccagc

SEQ ID NO: 6432738 - DNA, 23 bp, Homo sapiens
tctctaccttctccccagctccc

SEQ ID NO: 6432739 - DNA, 16 bp, Homo sapiens
tctctaccttttaaaa

SEQ ID NO: 6432740 - DNA, 19 bp, Homo sapiens
tctctaccttttaaaattg

SEQ ID NO: 6432741 - DNA, 22 bp, Homo sapiens
tctctaccttttaaaattgaat

SEQ ID NO: 6432742 - DNA, 22 bp, Homo sapiens
tctctactaaaaatacaaacaa

SEQ ID NO: 6432743 - DNA, 15 bp, Homo sapiens
tctctactaaaaatg

SEQ ID NO: 6432744 - DNA, 16 bp, Homo sapiens
tctctactccctcttg

SEQ ID NO: 6432745 - DNA, 13 bp, Homo sapiens
tctctactggtag

SEQ ID NO: 6432746 - DNA, 14 bp, Homo sapiens
tctctactttcctg

SEQ ID NO: 6432747 - DNA, 20 bp, Homo sapiens
tctctagaagtgccatctca

SEQ ID NO: 6432748 - DNA, 22 bp, Homo sapiens
tctctagaattttaagtgcttt

SEQ ID NO: 6432749 - DNA, 12 bp, Homo sapiens
tctctagagaac

SEQ ID NO: 6432750 - DNA, 13 bp, Homo sapiens
tctctagagaaca

SEQ ID NO: 6432751 - DNA, 14 bp, Homo sapiens
tctctagaggctgg

SEQ ID NO: 6432752 - DNA, 18 bp, Homo sapiens
tctctagaggctggcaag

SEQ ID NO: 6432753 - DNA, 20 bp, Homo sapiens
tctctagagggttgctgcct

SEQ ID NO: 6432754 - DNA, 20 bp, Homo sapiens
tctctagagtttagtcctta

SEQ ID NO: 6432755 - DNA, 13 bp, Homo sapiens
tctctagcacaat

SEQ ID NO: 6432756 - DNA, 15 bp, Homo sapiens
tctctagcctctttg

SEQ ID NO: 6432757 - DNA, 20 bp, Homo sapiens
tctctagctgatcagaattt

SEQ ID NO: 6432758 - DNA, 23 bp, Homo sapiens
tctctagctggtggtttcacggt

SEQ ID NO: 6432759 - DNA, 24 bp, Homo sapiens
tctctagctggtggtttcacggtg

SEQ ID NO: 6432760 - DNA, 14 bp, Homo sapiens
tctctagctgttct

SEQ ID NO: 6432761 - DNA, 22 bp, Homo sapiens
tctctagctttaggggaccatg

SEQ ID NO: 6432762 - DNA, 13 bp, Homo sapiens
tctctagctttgt

SEQ ID NO: 6432763 - DNA, 19 bp, Homo sapiens
tctctaggcctctccagtt

SEQ ID NO: 6432764 - DNA, 16 bp, Homo sapiens
tctctaggctgttttc

SEQ ID NO: 6432765 - DNA, 21 bp, Homo sapiens
tctctagggaaggccacctgc

SEQ ID NO: 6432766 - DNA, 18 bp, Homo sapiens
tctctagtagtgtggcct

SEQ ID NO: 6432767 - DNA, 12 bp, Homo sapiens
tctctagtagtt

SEQ ID NO: 6432768 - DNA, 20 bp, Homo sapiens
tctctagtccctgtgttctg

SEQ ID NO: 6432769 - DNA, 19 bp, Homo sapiens
tctctagtgctgtgaaaaa

SEQ ID NO: 6432770 - DNA, 15 bp, Homo sapiens
tctctagtgtagctg

SEQ ID NO: 6432771 - DNA, 17 bp, Homo sapiens
tctctagttccctcagt

SEQ ID NO: 6432772 - DNA, 19 bp, Homo sapiens
tctctagtttgattaaatt

SEQ ID NO: 6432773 - DNA, 17 bp, Homo sapiens
tctctagttttatctta

SEQ ID NO: 6432774 - DNA, 20 bp, Homo sapiens
tctctataaagggtcaggcc

SEQ ID NO: 6432775 - DNA, 23 bp, Homo sapiens
tctctataagtgttcagtgttga

SEQ ID NO: 6432776 - DNA, 14 bp, Homo sapiens
tctctataccaata

SEQ ID NO: 6432777 - DNA, 17 bp, Homo sapiens
tctctataccaataaag

SEQ ID NO: 6432778 - DNA, 19 bp, Homo sapiens
tctctataccaataaagtg

SEQ ID NO: 6432779 - DNA, 13 bp, Homo sapiens
tctctatataaaa

SEQ ID NO: 6432780 - DNA, 14 bp, Homo sapiens
tctctatataaaaa

SEQ ID NO: 6432781 - DNA, 15 bp, Homo sapiens
tctctatataaaaaa

SEQ ID NO: 6432782 - DNA, 21 bp, Homo sapiens
tctctatataaaaaatatatg

SEQ ID NO: 6432783 - DNA, 19 bp, Homo sapiens
tctctatatatacatgtat

SEQ ID NO: 6432784 - DNA, 21 bp, Homo sapiens
tctctatatatacatgtatag

SEQ ID NO: 6432785 - DNA, 14 bp, Homo sapiens
tctctatattatgt

SEQ ID NO: 6432786 - DNA, 15 bp, Homo sapiens
tctctatcattaaag

SEQ ID NO: 6432787 - DNA, 17 bp, Homo sapiens
tctctatcatttaataa

SEQ ID NO: 6432788 - DNA, 21 bp, Homo sapiens
tctctatctctttatatatgt

SEQ ID NO: 6432789 - DNA, 22 bp, Homo sapiens
tctctatggtaaagatattatt

SEQ ID NO: 6432790 - DNA, 22 bp, Homo sapiens
tctctatgtacagatgatgtaa

SEQ ID NO: 6432791 - DNA, 14 bp, Homo sapiens
tctctatgtactat

SEQ ID NO: 6432792 - DNA, 13 bp, Homo sapiens
tctctatgtgaat

SEQ ID NO: 6432793 - DNA, 19 bp, Homo sapiens
tctctatgtttattctagt

SEQ ID NO: 6432794 - DNA, 21 bp, Homo sapiens
tctctattaccactgaagata

SEQ ID NO: 6432795 - DNA, 14 bp, Homo sapiens
tctctattagctgg

SEQ ID NO: 6432796 - DNA, 15 bp, Homo sapiens
tctctattagctggg

SEQ ID NO: 6432797 - DNA, 16 bp, Homo sapiens
tctctattagctgggt

SEQ ID NO: 6432798 - DNA, 23 bp, Homo sapiens
tctctattccaataaagcagagt

SEQ ID NO: 6432799 - DNA, 14 bp, Homo sapiens
tctctattccccac

SEQ ID NO: 6432800 - DNA, 18 bp, Homo sapiens
tctctattccctcagcct

SEQ ID NO: 6432801 - DNA, 14 bp, Homo sapiens
tctctatttaaatt

SEQ ID NO: 6432802 - DNA, 14 bp, Homo sapiens
tctctatttaatat

SEQ ID NO: 6432803 - DNA, 19 bp, Homo sapiens
tctctattttacttttctg

SEQ ID NO: 6432804 - DNA, 15 bp, Homo sapiens
tctctatttttgtta

SEQ ID NO: 6432805 - DNA, 13 bp, Homo sapiens
tctctcaaaacaa

SEQ ID NO: 6432806 - DNA, 22 bp, Homo sapiens
tctctcaaacggcaacattcct

SEQ ID NO: 6432807 - DNA, 14 bp, Homo sapiens
tctctcaaattgtc

SEQ ID NO: 6432808 - DNA, 15 bp, Homo sapiens
tctctcaaattgtca

SEQ ID NO: 6432809 - DNA, 13 bp, Homo sapiens
tctctcaaccttg

SEQ ID NO: 6432810 - DNA, 20 bp, Homo sapiens
tctctcaaccttggccttct

SEQ ID NO: 6432811 - DNA, 19 bp, Homo sapiens
tctctcaagagtgctgaga

SEQ ID NO: 6432812 - DNA, 13 bp, Homo sapiens
tctctcaagtgat

SEQ ID NO: 6432813 - DNA, 16 bp, Homo sapiens
tctctcaatatgctta

SEQ ID NO: 6432814 - DNA, 20 bp, Homo sapiens
tctctcaatatgcttacaaa

SEQ ID NO: 6432815 - DNA, 21 bp, Homo sapiens
tctctcaatttgggtcccagc

SEQ ID NO: 6432816 - DNA, 15 bp, Homo sapiens
tctctcacagacagg

SEQ ID NO: 6432817 - DNA, 19 bp, Homo sapiens
tctctcacagacaggaccc

SEQ ID NO: 6432818 - DNA, 15 bp, Homo sapiens
tctctcacccaccag

SEQ ID NO: 6432819 - DNA, 16 bp, Homo sapiens
tctctcacctagacct

SEQ ID NO: 6432820 - DNA, 19 bp, Homo sapiens
tctctcactcccctctcct

SEQ ID NO: 6432821 - DNA, 15 bp, Homo sapiens
tctctcactccttga

SEQ ID NO: 6432822 - DNA, 17 bp, Homo sapiens
tctctcagaagggaggc

SEQ ID NO: 6432823 - DNA, 14 bp, Homo sapiens
tctctcagagcatc

SEQ ID NO: 6432824 - DNA, 17 bp, Homo sapiens
tctctcagagcatctgg

SEQ ID NO: 6432825 - DNA, 15 bp, Homo sapiens
tctctcagcacagcc

SEQ ID NO: 6432826 - DNA, 15 bp, Homo sapiens
tctctcagcccaggt

SEQ ID NO: 6432827 - DNA, 12 bp, Homo sapiens
tctctcagcccc

SEQ ID NO: 6432828 - DNA, 14 bp, Homo sapiens
tctctcagccccat

SEQ ID NO: 6432829 - DNA, 19 bp, Homo sapiens
tctctcagccccatcgccc

SEQ ID NO: 6432830 - DNA, 12 bp, Homo sapiens
tctctcagcctc

SEQ ID NO: 6432831 - DNA, 14 bp, Homo sapiens
tctctcagcctcca

SEQ ID NO: 6432832 - DNA, 22 bp, Homo sapiens
tctctcagcctccactccctgt

SEQ ID NO: 6432833 - DNA, 15 bp, Homo sapiens
tctctcagctcccag

SEQ ID NO: 6432834 - DNA, 18 bp, Homo sapiens
tctctcagctcccaggcc

SEQ ID NO: 6432835 - DNA, 23 bp, Homo sapiens
tctctcaggaatcatctcctttg

SEQ ID NO: 6432836 - DNA, 13 bp, Homo sapiens
tctctcaggagca

SEQ ID NO: 6432837 - DNA, 14 bp, Homo sapiens
tctctcaggagcac

SEQ ID NO: 6432838 - DNA, 12 bp, Homo sapiens
tctctcaggcca

SEQ ID NO: 6432839 - DNA, 13 bp, Homo sapiens
tctctcaggtgaa

SEQ ID NO: 6432840 - DNA, 16 bp, Homo sapiens
tctctcatagaacatt

SEQ ID NO: 6432841 - DNA, 19 bp, Homo sapiens
tctctcatagaacattgat

SEQ ID NO: 6432842 - DNA, 17 bp, Homo sapiens
tctctcatctaactgat

SEQ ID NO: 6432843 - DNA, 19 bp, Homo sapiens
tctctcatctcttagctcc

SEQ ID NO: 6432844 - DNA, 22 bp, Homo sapiens
tctctcatctcttagctcccct

SEQ ID NO: 6432845 - DNA, 23 bp, Homo sapiens
tctctcatctcttagctcccctc

SEQ ID NO: 6432846 - DNA, 12 bp, Homo sapiens
tctctcatgaac

SEQ ID NO: 6432847 - DNA, 23 bp, Homo sapiens
tctctccaccccccacgtctgtc

SEQ ID NO: 6432848 - DNA, 19 bp, Homo sapiens
tctctccaccttccaaaga

SEQ ID NO: 6432849 - DNA, 18 bp, Homo sapiens
tctctccactaccccaca

SEQ ID NO: 6432850 - DNA, 17 bp, Homo sapiens
tctctccactttcagct

SEQ ID NO: 6432851 - DNA, 18 bp, Homo sapiens
tctctccagaaacagctg

SEQ ID NO: 6432852 - DNA, 12 bp, Homo sapiens
tctctccagagc

SEQ ID NO: 6432853 - DNA, 13 bp, Homo sapiens
tctctccagatgt

SEQ ID NO: 6432854 - DNA, 16 bp, Homo sapiens
tctctccagatgtttc

SEQ ID NO: 6432855 - DNA, 15 bp, Homo sapiens
tctctccagcccctg

SEQ ID NO: 6432856 - DNA, 18 bp, Homo sapiens
tctctccagcccctggat

SEQ ID NO: 6432857 - DNA, 16 bp, Homo sapiens
tctctccagcctcaca

SEQ ID NO: 6432858 - DNA, 21 bp, Homo sapiens
tctctccagcctcacagatgc

SEQ ID NO: 6432859 - DNA, 15 bp, Homo sapiens
tctctccagctgact

SEQ ID NO: 6432860 - DNA, 24 bp, Homo sapiens
tctctccaggaaggtagcccagca

SEQ ID NO: 6432861 - DNA, 13 bp, Homo sapiens
tctctccaggagg

SEQ ID NO: 6432862 - DNA, 13 bp, Homo sapiens
tctctccaggatc

SEQ ID NO: 6432863 - DNA, 18 bp, Homo sapiens
tctctccaggtcagcctg

SEQ ID NO: 6432864 - DNA, 22 bp, Homo sapiens
tctctccaggtcagcctggaag

SEQ ID NO: 6432865 - DNA, 20 bp, Homo sapiens
tctctccagtgtgtgtaaca

SEQ ID NO: 6432866 - DNA, 16 bp, Homo sapiens
tctctccatcctcaaa

SEQ ID NO: 6432867 - DNA, 21 bp, Homo sapiens
tctctccatgttggcctgtca

SEQ ID NO: 6432868 - DNA, 14 bp, Homo sapiens
tctctccattcccg

SEQ ID NO: 6432869 - DNA, 21 bp, Homo sapiens
tctctcccacacaagcagtct

SEQ ID NO: 6432870 - DNA, 22 bp, Homo sapiens
tctctcccaccctaagggcagc

SEQ ID NO: 6432871 - DNA, 15 bp, Homo sapiens
tctctcccacttcct

SEQ ID NO: 6432872 - DNA, 14 bp, Homo sapiens
tctctcccaggggc

SEQ ID NO: 6432873 - DNA, 21 bp, Homo sapiens
tctctcccagtctacccagag

SEQ ID NO: 6432874 - DNA, 22 bp, Homo sapiens
tctctcccagtctacccagaga

SEQ ID NO: 6432875 - DNA, 23 bp, Homo sapiens
tctctcccagtctacccagagaa

SEQ ID NO: 6432876 - DNA, 20 bp, Homo sapiens
tctctcccatggagccccag

SEQ ID NO: 6432877 - DNA, 21 bp, Homo sapiens
tctctcccatggagccccagc

SEQ ID NO: 6432878 - DNA, 20 bp, Homo sapiens
tctctccccaatgctctcct

SEQ ID NO: 6432879 - DNA, 16 bp, Homo sapiens
tctctccccatatata

SEQ ID NO: 6432880 - DNA, 19 bp, Homo sapiens
tctctccccatatataaat

SEQ ID NO: 6432881 - DNA, 19 bp, Homo sapiens
tctctccccctctgtcttc

SEQ ID NO: 6432882 - DNA, 13 bp, Homo sapiens
tctctcccctcaa

SEQ ID NO: 6432883 - DNA, 14 bp, Homo sapiens
tctctcccctcaca

SEQ ID NO: 6432884 - DNA, 21 bp, Homo sapiens
tctctcccctcacatcctcct

SEQ ID NO: 6432885 - DNA, 19 bp, Homo sapiens
tctctcccctcctctgaat

SEQ ID NO: 6432886 - DNA, 21 bp, Homo sapiens
tctctccccttttccttcaga

SEQ ID NO: 6432887 - DNA, 18 bp, Homo sapiens
tctctccctaccctcttc

SEQ ID NO: 6432888 - DNA, 19 bp, Homo sapiens
tctctccctacctccctcc

SEQ ID NO: 6432889 - DNA, 13 bp, Homo sapiens
tctctccctccac

SEQ ID NO: 6432890 - DNA, 20 bp, Homo sapiens
tctctccctcccccagagcc

SEQ ID NO: 6432891 - DNA, 22 bp, Homo sapiens
tctctccctcccccagagcccc

SEQ ID NO: 6432892 - DNA, 15 bp, Homo sapiens
tctctccctccctct

SEQ ID NO: 6432893 - DNA, 19 bp, Homo sapiens
tctctccctccctctctca

SEQ ID NO: 6432894 - DNA, 20 bp, Homo sapiens
tctctccctccctttgaaat

SEQ ID NO: 6432895 - DNA, 23 bp, Homo sapiens
tctctccctctgtcttttctcct

SEQ ID NO: 6432896 - DNA, 12 bp, Homo sapiens
tctctccctgcc

SEQ ID NO: 6432897 - DNA, 15 bp, Homo sapiens
tctctccctgccaga

SEQ ID NO: 6432898 - DNA, 21 bp, Homo sapiens
tctctccctgtcacacactgg

SEQ ID NO: 6432899 - DNA, 13 bp, Homo sapiens
tctctcccttact

SEQ ID NO: 6432900 - DNA, 17 bp, Homo sapiens
tctctccgccattgaga

SEQ ID NO: 6432901 - DNA, 19 bp, Homo sapiens
tctctccgccattgagaat

SEQ ID NO: 6432902 - DNA, 15 bp, Homo sapiens
tctctccgccccgga

SEQ ID NO: 6432903 - DNA, 16 bp, Homo sapiens
tctctcctaatgatga

SEQ ID NO: 6432904 - DNA, 17 bp, Homo sapiens
tctctcctagcccctct

SEQ ID NO: 6432905 - DNA, 21 bp, Homo sapiens
tctctcctcaggaccctcagc

SEQ ID NO: 6432906 - DNA, 11 bp, Homo sapiens
tctctcctcct

SEQ ID NO: 6432907 - DNA, 12 bp, Homo sapiens
tctctcctctct

SEQ ID NO: 6432908 - DNA, 15 bp, Homo sapiens
tctctcctctctgct

SEQ ID NO: 6432909 - DNA, 14 bp, Homo sapiens
tctctcctggactg

SEQ ID NO: 6432910 - DNA, 12 bp, Homo sapiens
tctctcctggct

SEQ ID NO: 6432911 - DNA, 13 bp, Homo sapiens
tctctcctggctc

SEQ ID NO: 6432912 - DNA, 20 bp, Homo sapiens
tcacttgaggaggagctggc

SEQ ID NO: 6432913 - DNA, 18 bp, Homo sapiens
tcacttgagttggctgtg

SEQ ID NO: 6432914 - DNA, 19 bp, Homo sapiens
tcacttgatgtttgttaga

SEQ ID NO: 6432915 - DNA, 19 bp, Homo sapiens
tcacttgattcatctctgg

SEQ ID NO: 6432916 - DNA, 21 bp, Homo sapiens
tcacttgattcatctctggtt

SEQ ID NO: 6432917 - DNA, 15 bp, Homo sapiens
tcacttgcacagagg

SEQ ID NO: 6432918 - DNA, 13 bp, Homo sapiens
tcacttgcacatc

SEQ ID NO: 6432919 - DNA, 13 bp, Homo sapiens
tcacttgccacat

SEQ ID NO: 6432920 - DNA, 13 bp, Homo sapiens
tcacttgccatgc

SEQ ID NO: 6432921 - DNA, 16 bp, Homo sapiens
tcacttgccatgcagg

SEQ ID NO: 6432922 - DNA, 15 bp, Homo sapiens
tcacttgccgtgtca

SEQ ID NO: 6432923 - DNA, 15 bp, Homo sapiens
tcacttgctctttga

SEQ ID NO: 6432924 - DNA, 19 bp, Homo sapiens
tcacttgcttcttatcctt

SEQ ID NO: 6432925 - DNA, 19 bp, Homo sapiens
tcacttggctgtctgacca

SEQ ID NO: 6432926 - DNA, 18 bp, Homo sapiens
tcacttgggagctgctgg

SEQ ID NO: 6432927 - DNA, 21 bp, Homo sapiens
tcacttgggagctgctgggct

SEQ ID NO: 6432928 - DNA, 23 bp, Homo sapiens
tcacttgggagctgctgggctag

SEQ ID NO: 6432929 - DNA, 18 bp, Homo sapiens
tcacttgtaaataaatag

SEQ ID NO: 6432930 - DNA, 22 bp, Homo sapiens
tcacttgtaaataaatagattt

SEQ ID NO: 6432931 - DNA, 13 bp, Homo sapiens
tcacttgtacaaa

SEQ ID NO: 6432932 - DNA, 14 bp, Homo sapiens
tcacttgtacaaaa

SEQ ID NO: 6432933 - DNA, 15 bp, Homo sapiens
tcacttgtacaaaat

SEQ ID NO: 6432934 - DNA, 21 bp, Homo sapiens
tcacttgtaggtttctctgcc

SEQ ID NO: 6432935 - DNA, 18 bp, Homo sapiens
tcacttgtattgacttta

SEQ ID NO: 6432936 - DNA, 22 bp, Homo sapiens
tcacttgtcctcagtttttcct

SEQ ID NO: 6432937 - DNA, 14 bp, Homo sapiens
tcacttgtctcctt

SEQ ID NO: 6432938 - DNA, 19 bp, Homo sapiens
tcacttgtgctttgctctt

SEQ ID NO: 6432939 - DNA, 23 bp, Homo sapiens
tcacttgtgctttgctcttgtcc

SEQ ID NO: 6432940 - DNA, 18 bp, Homo sapiens
tcacttgtggcagcttcc

SEQ ID NO: 6432941 - DNA, 23 bp, Homo sapiens
tcacttgtgtttgtatataaatg

SEQ ID NO: 6432942 - DNA, 13 bp, Homo sapiens
tcacttgtgtttt

SEQ ID NO: 6432943 - DNA, 22 bp, Homo sapiens
tcacttgttgttttactaaaga

SEQ ID NO: 6432944 - DNA, 23 bp, Homo sapiens
tcacttgttgttttactaaagaa

SEQ ID NO: 6432945 - DNA, 20 bp, Homo sapiens
tcacttgttttatttaacct

SEQ ID NO: 6432946 - DNA, 13 bp, Homo sapiens
tcactttaaacct

SEQ ID NO: 6432947 - DNA, 15 bp, Homo sapiens
tcactttaagatctt

SEQ ID NO: 6432948 - DNA, 13 bp, Homo sapiens
tcactttaagttt

SEQ ID NO: 6432949 - DNA, 18 bp, Homo sapiens
tcactttaattctcatgt

SEQ ID NO: 6432950 - DNA, 20 bp, Homo sapiens
tcactttaatttagaagata

SEQ ID NO: 6432951 - DNA, 20 bp, Homo sapiens
tcactttacctgcaggctcc

SEQ ID NO: 6432952 - DNA, 24 bp, Homo sapiens
tcactttacctgcaggctccatgc

SEQ ID NO: 6432953 - DNA, 15 bp, Homo sapiens
tcactttactttcaa

SEQ ID NO: 6432954 - DNA, 14 bp, Homo sapiens
tcactttatttcat

SEQ ID NO: 6432955 - DNA, 18 bp, Homo sapiens
tcactttcacatagatgt

SEQ ID NO: 6432956 - DNA, 14 bp, Homo sapiens
tcactttcattttt

SEQ ID NO: 6432957 - DNA, 23 bp, Homo sapiens
tcactttccttttcttgtctctg

SEQ ID NO: 6432958 - DNA, 21 bp, Homo sapiens
tcactttctcttttgttttaa

SEQ ID NO: 6432959 - DNA, 13 bp, Homo sapiens
tcactttcttcaa

SEQ ID NO: 6432960 - DNA, 11 bp, Homo sapiens
tcactttgaaa

SEQ ID NO: 6432961 - DNA, 19 bp, Homo sapiens
tcactttgccttctggtta

SEQ ID NO: 6432962 - DNA, 16 bp, Homo sapiens
tcactttgctctgggt

SEQ ID NO: 6432963 - DNA, 15 bp, Homo sapiens
tcactttggttttgg

SEQ ID NO: 6432964 - DNA, 21 bp, Homo sapiens
tcactttgtaaataaaaacac

SEQ ID NO: 6432965 - DNA, 19 bp, Homo sapiens
tcactttgtctaactcaga

SEQ ID NO: 6432966 - DNA, 23 bp, Homo sapiens
tcactttgtgtattaaatggttt

SEQ ID NO: 6432967 - DNA, 16 bp, Homo sapiens
tcacttttattgtata

SEQ ID NO: 6432968 - DNA, 12 bp, Homo sapiens
tcacttttattt

SEQ ID NO: 6432969 - DNA, 14 bp, Homo sapiens
tcacttttcatcct

SEQ ID NO: 6432970 - DNA, 22 bp, Homo sapiens
tcacttttcatccttccccaac

SEQ ID NO: 6432971 - DNA, 13 bp, Homo sapiens
tcacttttcatct

SEQ ID NO: 6432972 - DNA, 14 bp, Homo sapiens
tcacttttcccact

SEQ ID NO: 6432973 - DNA, 15 bp, Homo sapiens
tcacttttcccactc

SEQ ID NO: 6432974 - DNA, 11 bp, Homo sapiens
tcacttttcct

SEQ ID NO: 6432975 - DNA, 20 bp, Homo sapiens
tcacttttccttttcttaaa

SEQ ID NO: 6432976 - DNA, 16 bp, Homo sapiens
tcacttttctcatctg

SEQ ID NO: 6432977 - DNA, 13 bp, Homo sapiens
tcacttttctgag

SEQ ID NO: 6432978 - DNA, 18 bp, Homo sapiens
tcacttttctgagttctt

SEQ ID NO: 6432979 - DNA, 21 bp, Homo sapiens
tcacttttctgtaacgcctgc

SEQ ID NO: 6432980 - DNA, 20 bp, Homo sapiens
tcacttttgaatctataaaa

SEQ ID NO: 6432981 - DNA, 22 bp, Homo sapiens
tcacttttgaatctataaaaga

SEQ ID NO: 6432982 - DNA, 18 bp, Homo sapiens
tcacttttgacaaaggca

SEQ ID NO: 6432983 - DNA, 13 bp, Homo sapiens
tcacttttgcaag

SEQ ID NO: 6432984 - DNA, 21 bp, Homo sapiens
tcacttttgcaaggttccaca

SEQ ID NO: 6432985 - DNA, 21 bp, Homo sapiens
tcacttttgctccgaagctac

SEQ ID NO: 6432986 - DNA, 13 bp, Homo sapiens
tcacttttgtgaa

SEQ ID NO: 6432987 - DNA, 15 bp, Homo sapiens
tcacttttgttctgc

SEQ ID NO: 6432988 - DNA, 17 bp, Homo sapiens
tcacttttgttctgctt

SEQ ID NO: 6432989 - DNA, 18 bp, Homo sapiens
tcacttttgttgcccagg

SEQ ID NO: 6432990 - DNA, 21 bp, Homo sapiens
tcacttttgttgcccaggctg

SEQ ID NO: 6432991 - DNA, 22 bp, Homo sapiens
tcacttttgttgcccaggctgg

SEQ ID NO: 6432992 - DNA, 13 bp, Homo sapiens
tcactttttaata

SEQ ID NO: 6432993 - DNA, 21 bp, Homo sapiens
tcactttttatgctatttctg

SEQ ID NO: 6432994 - DNA, 19 bp, Homo sapiens
tcactttttcccctgcaat

SEQ ID NO: 6432995 - DNA, 14 bp, Homo sapiens
tcactttttctgat

SEQ ID NO: 6432996 - DNA, 21 bp, Homo sapiens
tcactttttgaactaagaaac

SEQ ID NO: 6432997 - DNA, 19 bp, Homo sapiens
tcacttttttcctgtcaat

SEQ ID NO: 6432998 - DNA, 13 bp, Homo sapiens
tcactttttttct

SEQ ID NO: 6432999 - DNA, 18 bp, Homo sapiens
tcactttttttctttttc

SEQ ID NO: 6433000 - DNA, 19 bp, Homo sapiens
tcactttttttctttttct

SEQ ID NO: 6433001 - DNA, 16 bp, Homo sapiens
tcactttttttgttct

SEQ ID NO: 6433002 - DNA, 17 bp, Homo sapiens
tcactttttttttccaa

SEQ ID NO: 6433003 - DNA, 20 bp, Homo sapiens
tcactttttttttttttccc

SEQ ID NO: 6433004 - DNA, 17 bp, Homo sapiens
tcagaaaaaaataaatg

SEQ ID NO: 6433005 - DNA, 16 bp, Homo sapiens
tcagaaaaaaattcat

SEQ ID NO: 6433006 - DNA, 16 bp, Homo sapiens
tcagaaaaacaataag

SEQ ID NO: 6433007 - DNA, 12 bp, Homo sapiens
tcagaaaacaga

SEQ ID NO: 6433008 - DNA, 14 bp, Homo sapiens
tcagaaaacagaga

SEQ ID NO: 6433009 - DNA, 13 bp, Homo sapiens
tcagaaaacataa

SEQ ID NO: 6433010 - DNA, 19 bp, Homo sapiens
tcagaaaacataatataag

SEQ ID NO: 6433011 - DNA, 15 bp, Homo sapiens
tcagaaaaccaaagg

SEQ ID NO: 6433012 - DNA, 22 bp, Homo sapiens
tcagaaaactttaaaaaatatt

SEQ ID NO: 6433013 - DNA, 15 bp, Homo sapiens
tcagaaaagaaaacc

SEQ ID NO: 6433014 - DNA, 17 bp, Homo sapiens
tcagaaaagaaaaccat

SEQ ID NO: 6433015 - DNA, 13 bp, Homo sapiens
tcagaaaagacac

SEQ ID NO: 6433016 - DNA, 14 bp, Homo sapiens
tcagaaaagcacct

SEQ ID NO: 6433017 - DNA, 21 bp, Homo sapiens
tcagaaaagcacctcttgaag

SEQ ID NO: 6433018 - DNA, 21 bp, Homo sapiens
tcagaaaagtaattttgtcac

SEQ ID NO: 6433019 - DNA, 22 bp, Homo sapiens
tcagaaaagtaattttgtcaca

SEQ ID NO: 6433020 - DNA, 23 bp, Homo sapiens
tcagaaaataaaatattcactct

SEQ ID NO: 6433021 - DNA, 16 bp, Homo sapiens
tcagaaaattccctgg

SEQ ID NO: 6433022 - DNA, 19 bp, Homo sapiens
tcagaaaattccctggggt

SEQ ID NO: 6433023 - DNA, 22 bp, Homo sapiens
tcagaaacaaagcatttgactt

SEQ ID NO: 6433024 - DNA, 16 bp, Homo sapiens
tcagaaacaatttctg

SEQ ID NO: 6433025 - DNA, 19 bp, Homo sapiens
tcagaaacaccctcacact

SEQ ID NO: 6433026 - DNA, 22 bp, Homo sapiens
tcagaaacaccctcacactggg

SEQ ID NO: 6433027 - DNA, 21 bp, Homo sapiens
tcagaaacagggcagcagtgg

SEQ ID NO: 6433028 - DNA, 15 bp, Homo sapiens
tcagaaacagtattt

SEQ ID NO: 6433029 - DNA, 18 bp, Homo sapiens
tcagaaacatcagttact

SEQ ID NO: 6433030 - DNA, 22 bp, Homo sapiens
tcagaaacatcagttactctga

SEQ ID NO: 6433031 - DNA, 18 bp, Homo sapiens
tcagaaaccccacttcca

SEQ ID NO: 6433032 - DNA, 19 bp, Homo sapiens
tcagaaacccggcttcctg

SEQ ID NO: 6433033 - DNA, 16 bp, Homo sapiens
tcagaaactagaaatg

SEQ ID NO: 6433034 - DNA, 12 bp, Homo sapiens
tcagaaactgtt

SEQ ID NO: 6433035 - DNA, 23 bp, Homo sapiens
tcagaaagagcaagtctggatct

SEQ ID NO: 6433036 - DNA, 18 bp, Homo sapiens
tcagaaagcatctattcc

SEQ ID NO: 6433037 - DNA, 17 bp, Homo sapiens
tcagaaagcattacatt

SEQ ID NO: 6433038 - DNA, 19 bp, Homo sapiens
tcagaaagctttattttga

SEQ ID NO: 6433039 - DNA, 14 bp, Homo sapiens
tcagaaaggatttt

SEQ ID NO: 6433040 - DNA, 14 bp, Homo sapiens
tcagaaagggaggg

SEQ ID NO: 6433041 - DNA, 20 bp, Homo sapiens
tcagaaagggcagaagtagg

SEQ ID NO: 6433042 - DNA, 19 bp, Homo sapiens
tcagaaagggcagcccctc

SEQ ID NO: 6433043 - DNA, 22 bp, Homo sapiens
tcagaaaggggcattttgtact

SEQ ID NO: 6433044 - DNA, 18 bp, Homo sapiens
tcagaaaggggctcttct

SEQ ID NO: 6433045 - DNA, 20 bp, Homo sapiens
tcagaaaggggctcttctga

SEQ ID NO: 6433046 - DNA, 22 bp, Homo sapiens
tcagaaagtttgaagcaccatg

SEQ ID NO: 6433047 - DNA, 14 bp, Homo sapiens
tcagaaataaatca

SEQ ID NO: 6433048 - DNA, 22 bp, Homo sapiens
tcagaaataataaaaaatttca

SEQ ID NO: 6433049 - DNA, 15 bp, Homo sapiens
tcagaaatagaatca

SEQ ID NO: 6433050 - DNA, 15 bp, Homo sapiens
tcagaaatagatttc

SEQ ID NO: 6433051 - DNA, 20 bp, Homo sapiens
tcagaaatataacacatttt

SEQ ID NO: 6433052 - DNA, 16 bp, Homo sapiens
tcagaaatcaaactgc

SEQ ID NO: 6433053 - DNA, 15 bp, Homo sapiens
tcagaaatgattcag

SEQ ID NO: 6433054 - DNA, 15 bp, Homo sapiens
tcagaaatgctgcct

SEQ ID NO: 6433055 - DNA, 17 bp, Homo sapiens
tcagaaatggacaaaga

SEQ ID NO: 6433056 - DNA, 16 bp, Homo sapiens
tcagaaattaaaatat

SEQ ID NO: 6433057 - DNA, 15 bp, Homo sapiens
tcagaaattctcaaa

SEQ ID NO: 6433058 - DNA, 22 bp, Homo sapiens
tcagaaattctcaaaatacgtg

SEQ ID NO: 6433059 - DNA, 13 bp, Homo sapiens
tcagaaattgaaa

SEQ ID NO: 6433060 - DNA, 18 bp, Homo sapiens
tcagaaatttaaaagcag

SEQ ID NO: 6433061 - DNA, 23 bp, Homo sapiens
tcagaaatttaaaagcagagcat

SEQ ID NO: 6433062 - DNA, 14 bp, Homo sapiens
tcagaaatttaatt

SEQ ID NO: 6433063 - DNA, 21 bp, Homo sapiens
tcagaaatttaattcatgttt

SEQ ID NO: 6433064 - DNA, 16 bp, Homo sapiens
tcagaaattttctaca

SEQ ID NO: 6433065 - DNA, 14 bp, Homo sapiens
tcagaacaaaatca

SEQ ID NO: 6433066 - DNA, 14 bp, Homo sapiens
tcagaacaaattca

SEQ ID NO: 6433067 - DNA, 12 bp, Homo sapiens
tcagaacaactt

SEQ ID NO: 6433068 - DNA, 16 bp, Homo sapiens
tcagaacaatccgatt

SEQ ID NO: 6433069 - DNA, 14 bp, Homo sapiens
tcagaacacacaga

SEQ ID NO: 6433070 - DNA, 22 bp, Homo sapiens
tcagaacacacagactttctgt

SEQ ID NO: 6433071 - DNA, 15 bp, Homo sapiens
tcagaacacattctt

SEQ ID NO: 6433072 - DNA, 12 bp, Homo sapiens
tcagaacagctg

SEQ ID NO: 6433073 - DNA, 16 bp, Homo sapiens
tcagaacagtctgaaa

SEQ ID NO: 6433074 - DNA, 22 bp, Homo sapiens
tcagaacagtgtttgattttta

SEQ ID NO: 6433075 - DNA, 20 bp, Homo sapiens
tcagaacatactgattggga

SEQ ID NO: 6433076 - DNA, 18 bp, Homo sapiens
tcagaacattcagctctg

SEQ ID NO: 6433077 - DNA, 19 bp, Homo sapiens
tcagaacattcagctctgg

SEQ ID NO: 6433078 - DNA, 22 bp, Homo sapiens
tcagaaccatccatagtagtat

SEQ ID NO: 6433079 - DNA, 23 bp, Homo sapiens
tcagaaccatttaagagactctt

SEQ ID NO: 6433080 - DNA, 14 bp, Homo sapiens
tcagaacccagggc

SEQ ID NO: 6433081 - DNA, 22 bp, Homo sapiens
tcagaacccagggctctgcccc

SEQ ID NO: 6433082 - DNA, 13 bp, Homo sapiens
tcagaaccctgcc

SEQ ID NO: 6433083 - DNA, 21 bp, Homo sapiens
tcagaaccctgccatggaact

SEQ ID NO: 6433084 - DNA, 15 bp, Homo sapiens
tcagaacctcttccc

SEQ ID NO: 6433085 - DNA, 18 bp, Homo sapiens
tcagaacctcttccccag

SEQ ID NO: 6433086 - DNA, 14 bp, Homo sapiens
tcagaacctgagct

SEQ ID NO: 6433087 - DNA, 12 bp, Homo sapiens
tcagaaccttgt

SEQ ID NO: 6433088 - DNA, 14 bp, Homo sapiens
tcagaactaacttt

SEQ ID NO: 6433089 - DNA, 15 bp, Homo sapiens
tcagaactagaattt

SEQ ID NO: 6433090 - DNA, 14 bp, Homo sapiens
tctctcctggctcg

SEQ ID NO: 6433091 - DNA, 11 bp, Homo sapiens
tctctcctggt

SEQ ID NO: 6433092 - DNA, 14 bp, Homo sapiens
tctctcctgtacct

SEQ ID NO: 6433093 - DNA, 16 bp, Homo sapiens
tctctcctgtacctct

SEQ ID NO: 6433094 - DNA, 14 bp, Homo sapiens
tctctcctgtactt

SEQ ID NO: 6433095 - DNA, 14 bp, Homo sapiens
tctctcctgtccaa

SEQ ID NO: 6433096 - DNA, 15 bp, Homo sapiens
tctctccttgttctg

SEQ ID NO: 6433097 - DNA, 19 bp, Homo sapiens
tctctccttgttctgataa

SEQ ID NO: 6433098 - DNA, 10 bp, Homo sapiens
tctctccttt

SEQ ID NO: 6433099 - DNA, 14 bp, Homo sapiens
tctctcctttgctg

SEQ ID NO: 6433100 - DNA, 12 bp, Homo sapiens
tctctccttttc

SEQ ID NO: 6433101 - DNA, 16 bp, Homo sapiens
tctctcgctgcgtcct

SEQ ID NO: 6433102 - DNA, 18 bp, Homo sapiens
tctctcggagccctcaga

SEQ ID NO: 6433103 - DNA, 18 bp, Homo sapiens
tctctcggccccctcacc

SEQ ID NO: 6433104 - DNA, 14 bp, Homo sapiens
tctctcggcccctg

SEQ ID NO: 6433105 - DNA, 15 bp, Homo sapiens
tctctcggctcccca

SEQ ID NO: 6433106 - DNA, 19 bp, Homo sapiens
tctctcgggagccctagcc

SEQ ID NO: 6433107 - DNA, 23 bp, Homo sapiens
tctctcgggagccctagccctgc

SEQ ID NO: 6433108 - DNA, 16 bp, Homo sapiens
tctctcgggcccccca

SEQ ID NO: 6433109 - DNA, 19 bp, Homo sapiens
tctctcgggccccccacac

SEQ ID NO: 6433110 - DNA, 21 bp, Homo sapiens
tctctcggggcgacccctcag

SEQ ID NO: 6433111 - DNA, 18 bp, Homo sapiens
tctctcgtactctctctc

SEQ ID NO: 6433112 - DNA, 15 bp, Homo sapiens
tctctcgtgagtata

SEQ ID NO: 6433113 - DNA, 18 bp, Homo sapiens
tctctcgttcgctcgctc

SEQ ID NO: 6433114 - DNA, 14 bp, Homo sapiens
tctctctaaaaata

SEQ ID NO: 6433115 - DNA, 17 bp, Homo sapiens
tctctctaagacaaatg

SEQ ID NO: 6433116 - DNA, 15 bp, Homo sapiens
tctctctacagtgcc

SEQ ID NO: 6433117 - DNA, 22 bp, Homo sapiens
tctctctaggagggagccttgt

SEQ ID NO: 6433118 - DNA, 13 bp, Homo sapiens
tctctctatctgg

SEQ ID NO: 6433119 - DNA, 13 bp, Homo sapiens
tctctctatgcaa

SEQ ID NO: 6433120 - DNA, 16 bp, Homo sapiens
tctctctattaccact

SEQ ID NO: 6433121 - DNA, 21 bp, Homo sapiens
tctctctatttccccctttct

SEQ ID NO: 6433122 - DNA, 11 bp, Homo sapiens
tctctctcacc

SEQ ID NO: 6433123 - DNA, 12 bp, Homo sapiens
tctctctcactc

SEQ ID NO: 6433124 - DNA, 22 bp, Homo sapiens
tctctctcactccctccctttc

SEQ ID NO: 6433125 - DNA, 22 bp, Homo sapiens
tctctctcactctcttcctttc

SEQ ID NO: 6433126 - DNA, 13 bp, Homo sapiens
tctctctccagaa

SEQ ID NO: 6433127 - DNA, 21 bp, Homo sapiens
tctctctccagaaacagctgc

SEQ ID NO: 6433128 - DNA, 12 bp, Homo sapiens
tctctctccatt

SEQ ID NO: 6433129 - DNA, 22 bp, Homo sapiens
tctctctcccaactgctgctta

SEQ ID NO: 6433130 - DNA, 22 bp, Homo sapiens
tctctctccctacctccctcct

SEQ ID NO: 6433131 - DNA, 16 bp, Homo sapiens
tctctctccctccact

SEQ ID NO: 6433132 - DNA, 13 bp, Homo sapiens
tctctctccctct

SEQ ID NO: 6433133 - DNA, 14 bp, Homo sapiens
tctctctccctgcc

SEQ ID NO: 6433134 - DNA, 17 bp, Homo sapiens
tctctctccctgccttt

SEQ ID NO: 6433135 - DNA, 11 bp, Homo sapiens
tctctctcctc

SEQ ID NO: 6433136 - DNA, 15 bp, Homo sapiens
tctctctcctcagga

SEQ ID NO: 6433137 - DNA, 12 bp, Homo sapiens
tctctctcctgg

SEQ ID NO: 6433138 - DNA, 13 bp, Homo sapiens
tctctctcctggt

SEQ ID NO: 6433139 - DNA, 13 bp, Homo sapiens
tctctctcctgtc

SEQ ID NO: 6433140 - DNA, 17 bp, Homo sapiens
tctctctcgaccttctg

SEQ ID NO: 6433141 - DNA, 13 bp, Homo sapiens
tctctctctccat

SEQ ID NO: 6433142 - DNA, 16 bp, Homo sapiens
tctctctctctcaaaa

SEQ ID NO: 6433143 - DNA, 15 bp, Homo sapiens
tctctctctctcaca

SEQ ID NO: 6433144 - DNA, 16 bp, Homo sapiens
tctctctctctctctg

SEQ ID NO: 6433145 - DNA, 14 bp, Homo sapiens
tctctctctctctg

SEQ ID NO: 6433146 - DNA, 13 bp, Homo sapiens
tctctctctctgt

SEQ ID NO: 6433147 - DNA, 13 bp, Homo sapiens
tctctctctgttc

SEQ ID NO: 6433148 - DNA, 10 bp, Homo sapiens
tctctctctt

SEQ ID NO: 6433149 - DNA, 15 bp, Homo sapiens
tctctctcttagcat

SEQ ID NO: 6433150 - DNA, 14 bp, Homo sapiens
tctctctcttgcct

SEQ ID NO: 6433151 - DNA, 20 bp, Homo sapiens
tctctctgactctcaaatct

SEQ ID NO: 6433152 - DNA, 11 bp, Homo sapiens
tctctctgccc

SEQ ID NO: 6433153 - DNA, 14 bp, Homo sapiens
tctctctgccccca

SEQ ID NO: 6433154 - DNA, 21 bp, Homo sapiens
tctctctgcccccaaaagtgt

SEQ ID NO: 6433155 - DNA, 12 bp, Homo sapiens
tctctctgcctg

SEQ ID NO: 6433156 - DNA, 19 bp, Homo sapiens
tctctctgcctgctgggct

SEQ ID NO: 6433157 - DNA, 14 bp, Homo sapiens
tctctctgctcctc

SEQ ID NO: 6433158 - DNA, 15 bp, Homo sapiens
tctctctgctcctca

SEQ ID NO: 6433159 - DNA, 19 bp, Homo sapiens
tctctctgctgagctgggc

SEQ ID NO: 6433160 - DNA, 12 bp, Homo sapiens
tctctctggaaa

SEQ ID NO: 6433161 - DNA, 17 bp, Homo sapiens
tctctctggagcccctc

SEQ ID NO: 6433162 - DNA, 12 bp, Homo sapiens
tctctctggccc

SEQ ID NO: 6433163 - DNA, 11 bp, Homo sapiens
tctctctggct

SEQ ID NO: 6433164 - DNA, 14 bp, Homo sapiens
tctctctggctcag

SEQ ID NO: 6433165 - DNA, 14 bp, Homo sapiens
tctctctggcttct

SEQ ID NO: 6433166 - DNA, 17 bp, Homo sapiens
tctctctgggcccaggg

SEQ ID NO: 6433167 - DNA, 9 bp, Homo sapiens
tctctctgt

SEQ ID NO: 6433168 - DNA, 23 bp, Homo sapiens
tctctctgtgaatacaattaaag

SEQ ID NO: 6433169 - DNA, 17 bp, Homo sapiens
tctctctgtgctgtgga

SEQ ID NO: 6433170 - DNA, 12 bp, Homo sapiens
tctctctgtggt

SEQ ID NO: 6433171 - DNA, 15 bp, Homo sapiens
tctctctgtgtggca

SEQ ID NO: 6433172 - DNA, 14 bp, Homo sapiens
tctctctgttacac

SEQ ID NO: 6433173 - DNA, 16 bp, Homo sapiens
tctctcttaaagttgg

SEQ ID NO: 6433174 - DNA, 13 bp, Homo sapiens
tctctcttaccct

SEQ ID NO: 6433175 - DNA, 21 bp, Homo sapiens
tctctcttattgttctttcat

SEQ ID NO: 6433176 - DNA, 12 bp, Homo sapiens
tctctcttcaat

SEQ ID NO: 6433177 - DNA, 17 bp, Homo sapiens
tctctcttcccttctcc

SEQ ID NO: 6433178 - DNA, 19 bp, Homo sapiens
tctctcttcctgcagtgtt

SEQ ID NO: 6433179 - DNA, 16 bp, Homo sapiens
tctctcttctcagagt

SEQ ID NO: 6433180 - DNA, 12 bp, Homo sapiens
tctctcttgctt

SEQ ID NO: 6433181 - DNA, 14 bp, Homo sapiens
tctctcttgcttga

SEQ ID NO: 6433182 - DNA, 14 bp, Homo sapiens
tctctcttggaatt

SEQ ID NO: 6433183 - DNA, 13 bp, Homo sapiens
tctctcttggacc

SEQ ID NO: 6433184 - DNA, 22 bp, Homo sapiens
tctctcttgggccaagccagct

SEQ ID NO: 6433185 - DNA, 23 bp, Homo sapiens
tctctcttgggccaagccagctg

SEQ ID NO: 6433186 - DNA, 14 bp, Homo sapiens
tctctcttggtctc

SEQ ID NO: 6433187 - DNA, 17 bp, Homo sapiens
tctctcttggtctcttt

SEQ ID NO: 6433188 - DNA, 22 bp, Homo sapiens
tctctcttggtctctttctttc

SEQ ID NO: 6433189 - DNA, 16 bp, Homo sapiens
tctctcttgtcctctt

SEQ ID NO: 6433190 - DNA, 18 bp, Homo sapiens
tctctcttgtcctcttct

SEQ ID NO: 6433191 - DNA, 19 bp, Homo sapiens
tctctcttgtcctcttctg

SEQ ID NO: 6433192 - DNA, 18 bp, Homo sapiens
tctctctttaaccctccc

SEQ ID NO: 6433193 - DNA, 15 bp, Homo sapiens
tctctctttccatct

SEQ ID NO: 6433194 - DNA, 15 bp, Homo sapiens
tctctctttcctcca

SEQ ID NO: 6433195 - DNA, 15 bp, Homo sapiens
tctctctttctaagg

SEQ ID NO: 6433196 - DNA, 13 bp, Homo sapiens
tctctctttggac

SEQ ID NO: 6433197 - DNA, 13 bp, Homo sapiens
tctctcttttcct

SEQ ID NO: 6433198 - DNA, 16 bp, Homo sapiens
tctctcttttcctcct

SEQ ID NO: 6433199 - DNA, 14 bp, Homo sapiens
tctctgaaaacaag

SEQ ID NO: 6433200 - DNA, 17 bp, Homo sapiens
tctctgaaaacaagaga

SEQ ID NO: 6433201 - DNA, 14 bp, Homo sapiens
tctctgaaacatat

SEQ ID NO: 6433202 - DNA, 12 bp, Homo sapiens
tctctgaacaca

SEQ ID NO: 6433203 - DNA, 18 bp, Homo sapiens
tctctgaacacaggcagc

SEQ ID NO: 6433204 - DNA, 16 bp, Homo sapiens
tctctgaacagaaggt

SEQ ID NO: 6433205 - DNA, 11 bp, Homo sapiens
tctctgaaccc

SEQ ID NO: 6433206 - DNA, 22 bp, Homo sapiens
tctctgaactggtagaaaaaca

SEQ ID NO: 6433207 - DNA, 13 bp, Homo sapiens
tctctgaagatga

SEQ ID NO: 6433208 - DNA, 18 bp, Homo sapiens
tctctgaagggacccccc

SEQ ID NO: 6433209 - DNA, 13 bp, Homo sapiens
tctctgaagggag

SEQ ID NO: 6433210 - DNA, 16 bp, Homo sapiens
tctctgaagggaggtg

SEQ ID NO: 6433211 - DNA, 15 bp, Homo sapiens
tctctgaatacacag

SEQ ID NO: 6433212 - DNA, 16 bp, Homo sapiens
tctctgaatacacagt

SEQ ID NO: 6433213 - DNA, 15 bp, Homo sapiens
tctctgaatcagaaa

SEQ ID NO: 6433214 - DNA, 15 bp, Homo sapiens
tctctgaatgctgag

SEQ ID NO: 6433215 - DNA, 22 bp, Homo sapiens
tctctgaattcctgtcttccaa

SEQ ID NO: 6433216 - DNA, 15 bp, Homo sapiens
tctctgaattttcag

SEQ ID NO: 6433217 - DNA, 19 bp, Homo sapiens
tctctgacccggttgcagt

SEQ ID NO: 6433218 - DNA, 12 bp, Homo sapiens
tctctgacctac

SEQ ID NO: 6433219 - DNA, 23 bp, Homo sapiens
tctctgacgcttgtgacagtgcc

SEQ ID NO: 6433220 - DNA, 16 bp, Homo sapiens
tctctgactaaaaata

SEQ ID NO: 6433221 - DNA, 17 bp, Homo sapiens
tctctgactctcaaatc

SEQ ID NO: 6433222 - DNA, 16 bp, Homo sapiens
tctctgactcttgcct

SEQ ID NO: 6433223 - DNA, 14 bp, Homo sapiens
tctctgacttctgc

SEQ ID NO: 6433224 - DNA, 16 bp, Homo sapiens
tctctgacttctgcct

SEQ ID NO: 6433225 - DNA, 19 bp, Homo sapiens
tctctgacttctgcctgga

SEQ ID NO: 6433226 - DNA, 17 bp, Homo sapiens
tctctgagaaccaaaag

SEQ ID NO: 6433227 - DNA, 12 bp, Homo sapiens
tctctgagactc

SEQ ID NO: 6433228 - DNA, 13 bp, Homo sapiens
tctctgagatttt

SEQ ID NO: 6433229 - DNA, 15 bp, Homo sapiens
tctctgagcagtggg

SEQ ID NO: 6433230 - DNA, 14 bp, Homo sapiens
tctctgagccccct

SEQ ID NO: 6433231 - DNA, 23 bp, Homo sapiens
tctctgagctccagtggaagaag

SEQ ID NO: 6433232 - DNA, 16 bp, Homo sapiens
tctctgagctctgcat

SEQ ID NO: 6433233 - DNA, 18 bp, Homo sapiens
tctctgagctggggaggt

SEQ ID NO: 6433234 - DNA, 16 bp, Homo sapiens
tctctgagctgtgcag

SEQ ID NO: 6433235 - DNA, 18 bp, Homo sapiens
tctctgaggaagctgggg

SEQ ID NO: 6433236 - DNA, 19 bp, Homo sapiens
tctctgaggcaaggcccag

SEQ ID NO: 6433237 - DNA, 23 bp, Homo sapiens
tctctgaggcaaggcccagacct

SEQ ID NO: 6433238 - DNA, 14 bp, Homo sapiens
tctctgaggctctc

SEQ ID NO: 6433239 - DNA, 19 bp, Homo sapiens
tctctgagggagaggctgt

SEQ ID NO: 6433240 - DNA, 20 bp, Homo sapiens
tctctgagggcttcctttgg

SEQ ID NO: 6433241 - DNA, 16 bp, Homo sapiens
tctctgagtacattgt

SEQ ID NO: 6433242 - DNA, 17 bp, Homo sapiens
tctctgagtacattgtg

SEQ ID NO: 6433243 - DNA, 16 bp, Homo sapiens
tctctgagtcaaatcc

SEQ ID NO: 6433244 - DNA, 17 bp, Homo sapiens
tctctgagtcaaatcca

SEQ ID NO: 6433245 - DNA, 18 bp, Homo sapiens
tctctgagtcaaatccag

SEQ ID NO: 6433246 - DNA, 20 bp, Homo sapiens
tctctgagtcaaatccagtg

SEQ ID NO: 6433247 - DNA, 21 bp, Homo sapiens
tctctgagtcaaatccagtgg

SEQ ID NO: 6433248 - DNA, 21 bp, Homo sapiens
tctctgagtggaggaagccca

SEQ ID NO: 6433249 - DNA, 22 bp, Homo sapiens
tctctgagtggtggttcctttg

SEQ ID NO: 6433250 - DNA, 23 bp, Homo sapiens
tctctgagtggtggttcctttgc

SEQ ID NO: 6433251 - DNA, 24 bp, Homo sapiens
tctctgagtggtggttcctttgca

SEQ ID NO: 6433252 - DNA, 19 bp, Homo sapiens
tctctgagtgtctctgcct

SEQ ID NO: 6433253 - DNA, 22 bp, Homo sapiens
tctctgagtgtctctgcctgga

SEQ ID NO: 6433254 - DNA, 16 bp, Homo sapiens
tctctgatacacagta

SEQ ID NO: 6433255 - DNA, 15 bp, Homo sapiens
tctctgatacagaaa

SEQ ID NO: 6433256 - DNA, 14 bp, Homo sapiens
tctctgatcttgtg

SEQ ID NO: 6433257 - DNA, 13 bp, Homo sapiens
tctctgatgcaga

SEQ ID NO: 6433258 - DNA, 14 bp, Homo sapiens
tctctgatgcagaa

SEQ ID NO: 6433259 - DNA, 16 bp, Homo sapiens
tctctgatgcagaaat

SEQ ID NO: 6433260 - DNA, 19 bp, Homo sapiens
tctctgatggcacttttga

SEQ ID NO: 6433261 - DNA, 17 bp, Homo sapiens
tctctgatgtcccagtg

SEQ ID NO: 6433262 - DNA, 14 bp, Homo sapiens
tctctgattaaatt

SEQ ID NO: 6433263 - DNA, 22 bp, Homo sapiens
tctctgattagttgacagtatt

SEQ ID NO: 6433264 - DNA, 19 bp, Homo sapiens
tctctgattgggtcagctg

SEQ ID NO: 6433265 - DNA, 17 bp, Homo sapiens
tctctgcaaactgcctt

SEQ ID NO: 6433266 - DNA, 13 bp, Homo sapiens
tctctgcaacact

SEQ ID NO: 6433267 - DNA, 12 bp, Homo sapiens
tctctgcaatgc

SEQ ID NO: 6433268 - DNA, 19 bp, Homo sapiens
tctctgcaatgcttctgta

SEQ ID NO: 6433269 - DNA, 24 bp, Homo sapiens
tctctgcaatgcttctgtagcttc

SEQ ID NO: 6433270 - DNA, 22 bp, Homo sapiens
tctctgcaattttactgtgaaa

SEQ ID NO: 6433271 - DNA, 11 bp, Homo sapiens
tctctgcaccc

SEQ ID NO: 6433272 - DNA, 20 bp, Homo sapiens
tctctgcacccagtgaacac

SEQ ID NO: 6433273 - DNA, 19 bp, Homo sapiens
tctctgcaccggacagtcg

SEQ ID NO: 6433274 - DNA, 19 bp, Homo sapiens
tcagaactatttaaaataa

SEQ ID NO: 6433275 - DNA, 14 bp, Homo sapiens
tcagaactcctgtg

SEQ ID NO: 6433276 - DNA, 20 bp, Homo sapiens
tcagaactcctgtgtgtgga

SEQ ID NO: 6433277 - DNA, 20 bp, Homo sapiens
tcagaactcctttctaagga

SEQ ID NO: 6433278 - DNA, 14 bp, Homo sapiens
tcagaactctcaga

SEQ ID NO: 6433279 - DNA, 22 bp, Homo sapiens
tcagaactctcagactctaaac

SEQ ID NO: 6433280 - DNA, 12 bp, Homo sapiens
tcagaactgccc

SEQ ID NO: 6433281 - DNA, 20 bp, Homo sapiens
tcagaactgctaccatgaag

SEQ ID NO: 6433282 - DNA, 14 bp, Homo sapiens
tcagaactgggaaa

SEQ ID NO: 6433283 - DNA, 18 bp, Homo sapiens
tcagaactgtcccatccc

SEQ ID NO: 6433284 - DNA, 14 bp, Homo sapiens
tcagaactgtgcca

SEQ ID NO: 6433285 - DNA, 22 bp, Homo sapiens
tcagaactgttggctgctcccc

SEQ ID NO: 6433286 - DNA, 17 bp, Homo sapiens
tcagaacttgctgctgt

SEQ ID NO: 6433287 - DNA, 16 bp, Homo sapiens
tcagaagaaaaagaag

SEQ ID NO: 6433288 - DNA, 18 bp, Homo sapiens
tcagaagaaaaagaagca

SEQ ID NO: 6433289 - DNA, 23 bp, Homo sapiens
tcagaagaaaaagaagctgagga

SEQ ID NO: 6433290 - DNA, 18 bp, Homo sapiens
tcagaagaaaacaaagtt

SEQ ID NO: 6433291 - DNA, 14 bp, Homo sapiens
tcagaagaaaatta

SEQ ID NO: 6433292 - DNA, 12 bp, Homo sapiens
tcagaagaaaga

SEQ ID NO: 6433293 - DNA, 18 bp, Homo sapiens
tcagaagaacatgatttt

SEQ ID NO: 6433294 - DNA, 15 bp, Homo sapiens
tcagaagaagtggga

SEQ ID NO: 6433295 - DNA, 16 bp, Homo sapiens
tcagaagaagtgggag

SEQ ID NO: 6433296 - DNA, 17 bp, Homo sapiens
tcagaagaagtgggagc

SEQ ID NO: 6433297 - DNA, 20 bp, Homo sapiens
tcagaagaagtgggagcagc

SEQ ID NO: 6433298 - DNA, 18 bp, Homo sapiens
tcagaagaatcttcctgg

SEQ ID NO: 6433299 - DNA, 23 bp, Homo sapiens
tcagaagacactaattccttaaa

SEQ ID NO: 6433300 - DNA, 12 bp, Homo sapiens
tcagaagagact

SEQ ID NO: 6433301 - DNA, 19 bp, Homo sapiens
tcagaagaggaaatgactc

SEQ ID NO: 6433302 - DNA, 21 bp, Homo sapiens
tcagaagagtcccggagctca

SEQ ID NO: 6433303 - DNA, 14 bp, Homo sapiens
tcagaagataactt

SEQ ID NO: 6433304 - DNA, 13 bp, Homo sapiens
tcagaagatagtc

SEQ ID NO: 6433305 - DNA, 18 bp, Homo sapiens
tcagaagatctttcttaa

SEQ ID NO: 6433306 - DNA, 22 bp, Homo sapiens
tcagaagatgggtgttgttttc

SEQ ID NO: 6433307 - DNA, 14 bp, Homo sapiens
tcagaagatggtga

SEQ ID NO: 6433308 - DNA, 15 bp, Homo sapiens
tcagaagatggtgaa

SEQ ID NO: 6433309 - DNA, 16 bp, Homo sapiens
tcagaagcaagccaga

SEQ ID NO: 6433310 - DNA, 17 bp, Homo sapiens
tcagaagcaagccagac

SEQ ID NO: 6433311 - DNA, 12 bp, Homo sapiens
tcagaagcacaa

SEQ ID NO: 6433312 - DNA, 13 bp, Homo sapiens
tcagaagcacaaa

SEQ ID NO: 6433313 - DNA, 15 bp, Homo sapiens
tcagaagcacaaagg

SEQ ID NO: 6433314 - DNA, 22 bp, Homo sapiens
tcagaagcaggcagggcaaagg

SEQ ID NO: 6433315 - DNA, 12 bp, Homo sapiens
tcagaagcaggt

SEQ ID NO: 6433316 - DNA, 19 bp, Homo sapiens
tcagaagcccattaaaata

SEQ ID NO: 6433317 - DNA, 20 bp, Homo sapiens
tcagaagccccatttgcaca

SEQ ID NO: 6433318 - DNA, 13 bp, Homo sapiens
tcagaagcctgag

SEQ ID NO: 6433319 - DNA, 13 bp, Homo sapiens
tcagaagcctggg

SEQ ID NO: 6433320 - DNA, 20 bp, Homo sapiens
tcagaagcctgggggcctgg

SEQ ID NO: 6433321 - DNA, 13 bp, Homo sapiens
tcagaagccttct

SEQ ID NO: 6433322 - DNA, 17 bp, Homo sapiens
tcagaagccttcttgct

SEQ ID NO: 6433323 - DNA, 17 bp, Homo sapiens
tcagaaggaataagcat

SEQ ID NO: 6433324 - DNA, 17 bp, Homo sapiens
tcagaaggacggcagga

SEQ ID NO: 6433325 - DNA, 16 bp, Homo sapiens
tcagaaggagaaggaa

SEQ ID NO: 6433326 - DNA, 23 bp, Homo sapiens
tcagaaggagaaggaaggagact

SEQ ID NO: 6433327 - DNA, 18 bp, Homo sapiens
tcagaaggagacagaatg

SEQ ID NO: 6433328 - DNA, 18 bp, Homo sapiens
tcagaaggcaaatgactt

SEQ ID NO: 6433329 - DNA, 22 bp, Homo sapiens
tcagaaggcaaatgactttgga

SEQ ID NO: 6433330 - DNA, 15 bp, Homo sapiens
tcagaaggccccaga

SEQ ID NO: 6433331 - DNA, 22 bp, Homo sapiens
tcagaaggcctcactcaagcct

SEQ ID NO: 6433332 - DNA, 12 bp, Homo sapiens
tcagaaggctct

SEQ ID NO: 6433333 - DNA, 20 bp, Homo sapiens
tcagaaggctcttctgacta

SEQ ID NO: 6433334 - DNA, 18 bp, Homo sapiens
tcagaaggctggggccag

SEQ ID NO: 6433335 - DNA, 14 bp, Homo sapiens
tcagaaggctttgg

SEQ ID NO: 6433336 - DNA, 21 bp, Homo sapiens
tcagaagggagctagccagag

SEQ ID NO: 6433337 - DNA, 13 bp, Homo sapiens
tcagaagggaggc

SEQ ID NO: 6433338 - DNA, 15 bp, Homo sapiens
tcagaaggggacctg

SEQ ID NO: 6433339 - DNA, 23 bp, Homo sapiens
tcagaaggggatggtgttgtcac

SEQ ID NO: 6433340 - DNA, 21 bp, Homo sapiens
tcagaaggtaggggccgtgtc

SEQ ID NO: 6433341 - DNA, 22 bp, Homo sapiens
tcagaaggtatcagttatatga

SEQ ID NO: 6433342 - DNA, 19 bp, Homo sapiens
tcagaaggtctgttttgag

SEQ ID NO: 6433343 - DNA, 17 bp, Homo sapiens
tcagaagtaactcccac

SEQ ID NO: 6433344 - DNA, 22 bp, Homo sapiens
tcagaagtaactcccactccta

SEQ ID NO: 6433345 - DNA, 16 bp, Homo sapiens
tcagaagtatatctgt

SEQ ID NO: 6433346 - DNA, 17 bp, Homo sapiens
tcagaagtatatctgta

SEQ ID NO: 6433347 - DNA, 18 bp, Homo sapiens
tcagaagtcatcttgcta

SEQ ID NO: 6433348 - DNA, 16 bp, Homo sapiens
tcagaagtccctgttt

SEQ ID NO: 6433349 - DNA, 18 bp, Homo sapiens
tcagaagtctttcagcaa

SEQ ID NO: 6433350 - DNA, 18 bp, Homo sapiens
tcagaagtgaaaaagact

SEQ ID NO: 6433351 - DNA, 15 bp, Homo sapiens
tcagaagtgagcttt

SEQ ID NO: 6433352 - DNA, 19 bp, Homo sapiens
tcagaagtgagctttgctg

SEQ ID NO: 6433353 - DNA, 21 bp, Homo sapiens
tcagaagtgagctttgctgct

SEQ ID NO: 6433354 - DNA, 17 bp, Homo sapiens
tcagaagtgatttagtt

SEQ ID NO: 6433355 - DNA, 23 bp, Homo sapiens
tcagaagtgatttagttgtggaa

SEQ ID NO: 6433356 - DNA, 16 bp, Homo sapiens
tcagaagttctgggtg

SEQ ID NO: 6433357 - DNA, 16 bp, Homo sapiens
tcagaagtttcctgga

SEQ ID NO: 6433358 - DNA, 19 bp, Homo sapiens
tcagaagtttctgccgcag

SEQ ID NO: 6433359 - DNA, 23 bp, Homo sapiens
tcagaagtttctgccgcagccct

SEQ ID NO: 6433360 - DNA, 14 bp, Homo sapiens
tcagaataaagttg

SEQ ID NO: 6433361 - DNA, 19 bp, Homo sapiens
tcagaataaagttgtattt

SEQ ID NO: 6433362 - DNA, 23 bp, Homo sapiens
tcagaataaagttgtatttcaaa

SEQ ID NO: 6433363 - DNA, 23 bp, Homo sapiens
tcagaataaatgggtaacactga

SEQ ID NO: 6433364 - DNA, 19 bp, Homo sapiens
tcagaataaattgatcctt

SEQ ID NO: 6433365 - DNA, 22 bp, Homo sapiens
tcagaataactacctcctcact

SEQ ID NO: 6433366 - DNA, 20 bp, Homo sapiens
tcagaataaggcaggcattg

SEQ ID NO: 6433367 - DNA, 16 bp, Homo sapiens
tcagaatagaaattag

SEQ ID NO: 6433368 - DNA, 21 bp, Homo sapiens
tcagaatagccacatttggaa

SEQ ID NO: 6433369 - DNA, 22 bp, Homo sapiens
tcagaatagccacatttggaat

SEQ ID NO: 6433370 - DNA, 22 bp, Homo sapiens
tcagaatagttattctctaaga

SEQ ID NO: 6433371 - DNA, 22 bp, Homo sapiens
tcagaatatgattcactattta

SEQ ID NO: 6433372 - DNA, 19 bp, Homo sapiens
tcagaatatggacaaagaa

SEQ ID NO: 6433373 - DNA, 14 bp, Homo sapiens
tcagaatatgtatg

SEQ ID NO: 6433374 - DNA, 17 bp, Homo sapiens
tcagaatattaagcaca

SEQ ID NO: 6433375 - DNA, 18 bp, Homo sapiens
tcagaatattgtctgcct

SEQ ID NO: 6433376 - DNA, 16 bp, Homo sapiens
tcagaatattttcaaa

SEQ ID NO: 6433377 - DNA, 19 bp, Homo sapiens
tcagaatattttgtaagct

SEQ ID NO: 6433378 - DNA, 15 bp, Homo sapiens
tcagaatcaaacctt

SEQ ID NO: 6433379 - DNA, 16 bp, Homo sapiens
tcagaatcatggagaa

SEQ ID NO: 6433380 - DNA, 12 bp, Homo sapiens
tcagaatccaaa

SEQ ID NO: 6433381 - DNA, 17 bp, Homo sapiens
tcagaatctgaatgtaa

SEQ ID NO: 6433382 - DNA, 17 bp, Homo sapiens
tcagaatctttgttaag

SEQ ID NO: 6433383 - DNA, 21 bp, Homo sapiens
tcagaatgaaccctcctcctt

SEQ ID NO: 6433384 - DNA, 22 bp, Homo sapiens
tcagaatgaaccctcctccttt

SEQ ID NO: 6433385 - DNA, 23 bp, Homo sapiens
tcagaatgaaccctcctcctttt

SEQ ID NO: 6433386 - DNA, 15 bp, Homo sapiens
tcagaatggaaattt

SEQ ID NO: 6433387 - DNA, 19 bp, Homo sapiens
tcagaatggaatccatctg

SEQ ID NO: 6433388 - DNA, 20 bp, Homo sapiens
tcagaatggaatccatctgt

SEQ ID NO: 6433389 - DNA, 22 bp, Homo sapiens
tcagaatggaatccatctgtct

SEQ ID NO: 6433390 - DNA, 18 bp, Homo sapiens
tcagaatggaatgctctg

SEQ ID NO: 6433391 - DNA, 22 bp, Homo sapiens
tcagaatggcagtcctggaggc

SEQ ID NO: 6433392 - DNA, 14 bp, Homo sapiens
tcagaatgtcattt

SEQ ID NO: 6433393 - DNA, 18 bp, Homo sapiens
tcagaatgtgaaaaagga

SEQ ID NO: 6433394 - DNA, 21 bp, Homo sapiens
tcagaattaatgcattcaaag

SEQ ID NO: 6433395 - DNA, 21 bp, Homo sapiens
tcagaattacaggaaatgcaa

SEQ ID NO: 6433396 - DNA, 19 bp, Homo sapiens
tcagaattatccattacgt

SEQ ID NO: 6433397 - DNA, 22 bp, Homo sapiens
tcagaattatccattacgtgca

SEQ ID NO: 6433398 - DNA, 18 bp, Homo sapiens
tcagaattcggtgtgctg

SEQ ID NO: 6433399 - DNA, 12 bp, Homo sapiens
tcagaattctca

SEQ ID NO: 6433400 - DNA, 20 bp, Homo sapiens
tcagaattctcagaatctca

SEQ ID NO: 6433401 - DNA, 16 bp, Homo sapiens
tcagaattctctagtt

SEQ ID NO: 6433402 - DNA, 17 bp, Homo sapiens
tcagaattgaaacactt

SEQ ID NO: 6433403 - DNA, 21 bp, Homo sapiens
tcagaattgatcattttcccc

SEQ ID NO: 6433404 - DNA, 17 bp, Homo sapiens
tcagaattgcacatcta

SEQ ID NO: 6433405 - DNA, 17 bp, Homo sapiens
tcagaattgtttttaga

SEQ ID NO: 6433406 - DNA, 14 bp, Homo sapiens
tcagaatttagtgt

SEQ ID NO: 6433407 - DNA, 21 bp, Homo sapiens
tcagaatttagtgtatccata

SEQ ID NO: 6433408 - DNA, 23 bp, Homo sapiens
tcagaatttctttgtcattcaag

SEQ ID NO: 6433409 - DNA, 15 bp, Homo sapiens
tcagaattttaccaa

SEQ ID NO: 6433410 - DNA, 22 bp, Homo sapiens
tcagaattttatactttcccta

SEQ ID NO: 6433411 - DNA, 16 bp, Homo sapiens
tcagaattttggaaaa

SEQ ID NO: 6433412 - DNA, 17 bp, Homo sapiens
tcagaattttggaaaaa

SEQ ID NO: 6433413 - DNA, 21 bp, Homo sapiens
tcagaattttggaaaaatgtc

SEQ ID NO: 6433414 - DNA, 22 bp, Homo sapiens
tcagaattttggaaaaatgtca

SEQ ID NO: 6433415 - DNA, 16 bp, Homo sapiens
tcagaatttttaactg

SEQ ID NO: 6433416 - DNA, 12 bp, Homo sapiens
tcagacaacatt

SEQ ID NO: 6433417 - DNA, 17 bp, Homo sapiens
tcagacaacattatgat

SEQ ID NO: 6433418 - DNA, 18 bp, Homo sapiens
tcagacaagcactatttt

SEQ ID NO: 6433419 - DNA, 13 bp, Homo sapiens
tcagacaatccac

SEQ ID NO: 6433420 - DNA, 17 bp, Homo sapiens
tcagacaattcagaagc

SEQ ID NO: 6433421 - DNA, 19 bp, Homo sapiens
tcagacacaaacaaacaag

SEQ ID NO: 6433422 - DNA, 18 bp, Homo sapiens
tcagacacaattagagaa

SEQ ID NO: 6433423 - DNA, 23 bp, Homo sapiens
tcagacacacggggcacccagcc

SEQ ID NO: 6433424 - DNA, 13 bp, Homo sapiens
tcagacacagatt

SEQ ID NO: 6433425 - DNA, 12 bp, Homo sapiens
tcagacacagct

SEQ ID NO: 6433426 - DNA, 19 bp, Homo sapiens
tcagacacctagactctaa

SEQ ID NO: 6433427 - DNA, 20 bp, Homo sapiens
tcagacacctagactctaaa

SEQ ID NO: 6433428 - DNA, 20 bp, Homo sapiens
tcagacactagggaaaggta

SEQ ID NO: 6433429 - DNA, 23 bp, Homo sapiens
tcagacactgccgacatcagcat

SEQ ID NO: 6433430 - DNA, 18 bp, Homo sapiens
tcagacagaacccctaca

SEQ ID NO: 6433431 - DNA, 15 bp, Homo sapiens
tcagacagaacttga

SEQ ID NO: 6433432 - DNA, 23 bp, Homo sapiens
tcagacagaacttgaatgtgtca

SEQ ID NO: 6433433 - DNA, 23 bp, Homo sapiens
tcagacagacttatacacccctg

SEQ ID NO: 6433434 - DNA, 20 bp, Homo sapiens
tcagacagatgtcagcttcc

SEQ ID NO: 6433435 - DNA, 14 bp, Homo sapiens
tcagacagccccct

SEQ ID NO: 6433436 - DNA, 15 bp, Homo sapiens
tcagacagctgcctg

SEQ ID NO: 6433437 - DNA, 16 bp, Homo sapiens
tcagacagctgcctgg

SEQ ID NO: 6433438 - DNA, 17 bp, Homo sapiens
tcagacagctgcctggg

SEQ ID NO: 6433439 - DNA, 22 bp, Homo sapiens
tcagacagggtctgaaggactg

SEQ ID NO: 6433440 - DNA, 23 bp, Homo sapiens
tcagacaggtaaatgggcagtgc

SEQ ID NO: 6433441 - DNA, 12 bp, Homo sapiens
tcagacataaag

SEQ ID NO: 6433442 - DNA, 13 bp, Homo sapiens
tcagacataaagc

SEQ ID NO: 6433443 - DNA, 18 bp, Homo sapiens
tcagacatacagctgcct

SEQ ID NO: 6433444 - DNA, 21 bp, Homo sapiens
tcagacatccatgtttgtaaa

SEQ ID NO: 6433445 - DNA, 22 bp, Homo sapiens
tcagacatccatgtttgtaaaa

SEQ ID NO: 6433446 - DNA, 22 bp, Homo sapiens
tcagacatctccagtgtgccag

SEQ ID NO: 6433447 - DNA, 19 bp, Homo sapiens
tcagacatctgaggtttta

SEQ ID NO: 6433448 - DNA, 20 bp, Homo sapiens
tcagacatgaaaactatttt

SEQ ID NO: 6433449 - DNA, 14 bp, Homo sapiens
tcagacatgttttc

SEQ ID NO: 6433450 - DNA, 18 bp, Homo sapiens
tctctgcaccgtactgtg

SEQ ID NO: 6433451 - DNA, 20 bp, Homo sapiens
tctctgcagacttcccagct

SEQ ID NO: 6433452 - DNA, 14 bp, Homo sapiens
tctctgcagcccat

SEQ ID NO: 6433453 - DNA, 13 bp, Homo sapiens
tctctgcaggtcc

SEQ ID NO: 6433454 - DNA, 18 bp, Homo sapiens
tctctgcaggtccctaat

SEQ ID NO: 6433455 - DNA, 21 bp, Homo sapiens
tctctgcaggtccctaataaa

SEQ ID NO: 6433456 - DNA, 10 bp, Homo sapiens
tctctgcagt

SEQ ID NO: 6433457 - DNA, 21 bp, Homo sapiens
tctctgcagtaaaacacattt

SEQ ID NO: 6433458 - DNA, 14 bp, Homo sapiens
tctctgcatcttca

SEQ ID NO: 6433459 - DNA, 21 bp, Homo sapiens
tctctgcatttttctgcagaa

SEQ ID NO: 6433460 - DNA, 20 bp, Homo sapiens
tctctgccaacatgaggaca

SEQ ID NO: 6433461 - DNA, 21 bp, Homo sapiens
tctctgccaacatgaggacag

SEQ ID NO: 6433462 - DNA, 22 bp, Homo sapiens
tctctgccaacatgaggacaga

SEQ ID NO: 6433463 - DNA, 12 bp, Homo sapiens
tctctgccaccc

SEQ ID NO: 6433464 - DNA, 15 bp, Homo sapiens
tctctgccacccact

SEQ ID NO: 6433465 - DNA, 18 bp, Homo sapiens
tctctgccacccactcag

SEQ ID NO: 6433466 - DNA, 15 bp, Homo sapiens
tctctgccagctcca

SEQ ID NO: 6433467 - DNA, 14 bp, Homo sapiens
tctctgccagtgac

SEQ ID NO: 6433468 - DNA, 21 bp, Homo sapiens
tctctgccagtgacagacagg

SEQ ID NO: 6433469 - DNA, 21 bp, Homo sapiens
tctctgccagttacttgggct

SEQ ID NO: 6433470 - DNA, 18 bp, Homo sapiens
tctctgccatatcagtga

SEQ ID NO: 6433471 - DNA, 19 bp, Homo sapiens
tctctgccatccaaaaggg

SEQ ID NO: 6433472 - DNA, 18 bp, Homo sapiens
tctctgccattctgtgca

SEQ ID NO: 6433473 - DNA, 9 bp, Homo sapiens
tctctgccc

SEQ ID NO: 6433474 - DNA, 19 bp, Homo sapiens
tctctgcccaagttgctct

SEQ ID NO: 6433475 - DNA, 20 bp, Homo sapiens
tctctgcccaagttgctctg

SEQ ID NO: 6433476 - DNA, 17 bp, Homo sapiens
tctctgcccacagtctt

SEQ ID NO: 6433477 - DNA, 15 bp, Homo sapiens
tctctgcccagccgg

SEQ ID NO: 6433478 - DNA, 18 bp, Homo sapiens
tctctgcccagccgggca

SEQ ID NO: 6433479 - DNA, 12 bp, Homo sapiens
tctctgcccatt

SEQ ID NO: 6433480 - DNA, 19 bp, Homo sapiens
tctctgcccattccccagc

SEQ ID NO: 6433481 - DNA, 15 bp, Homo sapiens
tctctgccccaccca

SEQ ID NO: 6433482 - DNA, 16 bp, Homo sapiens
tctctgccccacccaa

SEQ ID NO: 6433483 - DNA, 15 bp, Homo sapiens
tctctgccctccaag

SEQ ID NO: 6433484 - DNA, 18 bp, Homo sapiens
tctctgccctgggctcct

SEQ ID NO: 6433485 - DNA, 19 bp, Homo sapiens
tctctgccctgggctcctc

SEQ ID NO: 6433486 - DNA, 16 bp, Homo sapiens
tctctgccgctacctc

SEQ ID NO: 6433487 - DNA, 17 bp, Homo sapiens
tctctgccgtctctcct

SEQ ID NO: 6433488 - DNA, 21 bp, Homo sapiens
tctctgccgtctctcctgctc

SEQ ID NO: 6433489 - DNA, 11 bp, Homo sapiens
tctctgcctcc

SEQ ID NO: 6433490 - DNA, 17 bp, Homo sapiens
tctctgcctcctcctca

SEQ ID NO: 6433491 - DNA, 12 bp, Homo sapiens
tctctgcctctc

SEQ ID NO: 6433492 - DNA, 14 bp, Homo sapiens
tctctgcctctggg

SEQ ID NO: 6433493 - DNA, 15 bp, Homo sapiens
tctctgcctctgggc

SEQ ID NO: 6433494 - DNA, 17 bp, Homo sapiens
tctctgcctctgggcag

SEQ ID NO: 6433495 - DNA, 21 bp, Homo sapiens
tctctgcctctgggcagcctg

SEQ ID NO: 6433496 - DNA, 18 bp, Homo sapiens
tctctgcctgctgggctc

SEQ ID NO: 6433497 - DNA, 17 bp, Homo sapiens
tctctgcctggagcagg

SEQ ID NO: 6433498 - DNA, 18 bp, Homo sapiens
tctctgcctggagcaggg

SEQ ID NO: 6433499 - DNA, 12 bp, Homo sapiens
tctctgcctggc

SEQ ID NO: 6433500 - DNA, 14 bp, Homo sapiens
tctctgcctggcaa

SEQ ID NO: 6433501 - DNA, 23 bp, Homo sapiens
tctctgcctggtggtcagatgca

SEQ ID NO: 6433502 - DNA, 18 bp, Homo sapiens
tctctgcctgtgagccag

SEQ ID NO: 6433503 - DNA, 15 bp, Homo sapiens
tctctgccttgcctt

SEQ ID NO: 6433504 - DNA, 21 bp, Homo sapiens
tctctgcgtgcagggacaaag

SEQ ID NO: 6433505 - DNA, 23 bp, Homo sapiens
tctctgctagatttctacattaa

SEQ ID NO: 6433506 - DNA, 14 bp, Homo sapiens
tctctgctcagtga

SEQ ID NO: 6433507 - DNA, 18 bp, Homo sapiens
tctctgctcatgggtggc

SEQ ID NO: 6433508 - DNA, 12 bp, Homo sapiens
tctctgctccac

SEQ ID NO: 6433509 - DNA, 13 bp, Homo sapiens
tctctgctccaga

SEQ ID NO: 6433510 - DNA, 14 bp, Homo sapiens
tctctgctccagag

SEQ ID NO: 6433511 - DNA, 13 bp, Homo sapiens
tctctgctccagc

SEQ ID NO: 6433512 - DNA, 15 bp, Homo sapiens
tctctgctcctacat

SEQ ID NO: 6433513 - DNA, 22 bp, Homo sapiens
tctctgctccttcactgttccc

SEQ ID NO: 6433514 - DNA, 17 bp, Homo sapiens
tctctgctcgccctcct

SEQ ID NO: 6433515 - DNA, 21 bp, Homo sapiens
tctctgctctgcgtgtcacct

SEQ ID NO: 6433516 - DNA, 13 bp, Homo sapiens
tctctgctctgct

SEQ ID NO: 6433517 - DNA, 15 bp, Homo sapiens
tctctgctcttgcct

SEQ ID NO: 6433518 - DNA, 16 bp, Homo sapiens
tctctgctcttgcctg

SEQ ID NO: 6433519 - DNA, 13 bp, Homo sapiens
tctctgctgagca

SEQ ID NO: 6433520 - DNA, 19 bp, Homo sapiens
tctctgctgagcagcccag

SEQ ID NO: 6433521 - DNA, 15 bp, Homo sapiens
tctctgctgagggcc

SEQ ID NO: 6433522 - DNA, 11 bp, Homo sapiens
tctctgctgcc

SEQ ID NO: 6433523 - DNA, 15 bp, Homo sapiens
tctctgctggcccag

SEQ ID NO: 6433524 - DNA, 12 bp, Homo sapiens
tctctgctgtcc

SEQ ID NO: 6433525 - DNA, 15 bp, Homo sapiens
tctctgcttaccctt

SEQ ID NO: 6433526 - DNA, 17 bp, Homo sapiens
tctctgcttacccttca

SEQ ID NO: 6433527 - DNA, 14 bp, Homo sapiens
tctctgcttcagct

SEQ ID NO: 6433528 - DNA, 13 bp, Homo sapiens
tctctgcttccat

SEQ ID NO: 6433529 - DNA, 13 bp, Homo sapiens
tctctgctttcct

SEQ ID NO: 6433530 - DNA, 17 bp, Homo sapiens
tctctgctttccttttc

SEQ ID NO: 6433531 - DNA, 17 bp, Homo sapiens
tctctggaaaagctggg

SEQ ID NO: 6433532 - DNA, 18 bp, Homo sapiens
tctctggaaaagctgggg

SEQ ID NO: 6433533 - DNA, 22 bp, Homo sapiens
tctctggaaaggggggagctgg

SEQ ID NO: 6433534 - DNA, 19 bp, Homo sapiens
tctctggaagcccctgggc

SEQ ID NO: 6433535 - DNA, 20 bp, Homo sapiens
tctctggaaggggcagccct

SEQ ID NO: 6433536 - DNA, 22 bp, Homo sapiens
tctctggaaggggcagccctga

SEQ ID NO: 6433537 - DNA, 16 bp, Homo sapiens
tctctggacactgcca

SEQ ID NO: 6433538 - DNA, 16 bp, Homo sapiens
tctctggacctcagtt

SEQ ID NO: 6433539 - DNA, 16 bp, Homo sapiens
tctctggacctgacca

SEQ ID NO: 6433540 - DNA, 18 bp, Homo sapiens
tctctggagccaagtcca

SEQ ID NO: 6433541 - DNA, 13 bp, Homo sapiens
tctctggagccag

SEQ ID NO: 6433542 - DNA, 14 bp, Homo sapiens
tctctggagcccct

SEQ ID NO: 6433543 - DNA, 20 bp, Homo sapiens
tctctggagcccctcctccc

SEQ ID NO: 6433544 - DNA, 23 bp, Homo sapiens
tctctggaggtactgagacaggg

SEQ ID NO: 6433545 - DNA, 20 bp, Homo sapiens
tctctggcaatcttgccctt

SEQ ID NO: 6433546 - DNA, 17 bp, Homo sapiens
tctctggcagctggcct

SEQ ID NO: 6433547 - DNA, 13 bp, Homo sapiens
tctctggcccaga

SEQ ID NO: 6433548 - DNA, 18 bp, Homo sapiens
tctctggcccagaaagcc

SEQ ID NO: 6433549 - DNA, 11 bp, Homo sapiens
tctctggcccc

SEQ ID NO: 6433550 - DNA, 17 bp, Homo sapiens
tctctggcctcccaccc

SEQ ID NO: 6433551 - DNA, 13 bp, Homo sapiens
tctctggccttcg

SEQ ID NO: 6433552 - DNA, 22 bp, Homo sapiens
tctctggctactccctggacca

SEQ ID NO: 6433553 - DNA, 18 bp, Homo sapiens
tctctggctcagcccggg

SEQ ID NO: 6433554 - DNA, 15 bp, Homo sapiens
tctctggctcagctg

SEQ ID NO: 6433555 - DNA, 17 bp, Homo sapiens
tctctggctcagctgtg

SEQ ID NO: 6433556 - DNA, 19 bp, Homo sapiens
tctctggctcagctgtggt

SEQ ID NO: 6433557 - DNA, 23 bp, Homo sapiens
tctctggctcagctgtggtccca

SEQ ID NO: 6433558 - DNA, 14 bp, Homo sapiens
tctctggctcaggt

SEQ ID NO: 6433559 - DNA, 14 bp, Homo sapiens
tctctggctccaga

SEQ ID NO: 6433560 - DNA, 15 bp, Homo sapiens
tctctggctccagaa

SEQ ID NO: 6433561 - DNA, 14 bp, Homo sapiens
tctctggctgggga

SEQ ID NO: 6433562 - DNA, 14 bp, Homo sapiens
tctctggcttctct

SEQ ID NO: 6433563 - DNA, 16 bp, Homo sapiens
tctctggcttctctct

SEQ ID NO: 6433564 - DNA, 17 bp, Homo sapiens
tctctgggaccactggg

SEQ ID NO: 6433565 - DNA, 17 bp, Homo sapiens
tctctgggaccaggctc

SEQ ID NO: 6433566 - DNA, 19 bp, Homo sapiens
tctctgggaccaggctcca

SEQ ID NO: 6433567 - DNA, 17 bp, Homo sapiens
tctctgggacctcctta

SEQ ID NO: 6433568 - DNA, 17 bp, Homo sapiens
tctctgggagcccagaa

SEQ ID NO: 6433569 - DNA, 16 bp, Homo sapiens
tctctgggcccagaga

SEQ ID NO: 6433570 - DNA, 11 bp, Homo sapiens
tctctgggcct

SEQ ID NO: 6433571 - DNA, 16 bp, Homo sapiens
tctctgggctgaggaa

SEQ ID NO: 6433572 - DNA, 12 bp, Homo sapiens
tctctgggctgc

SEQ ID NO: 6433573 - DNA, 14 bp, Homo sapiens
tctctgggcttagg

SEQ ID NO: 6433574 - DNA, 11 bp, Homo sapiens
tctctggggac

SEQ ID NO: 6433575 - DNA, 21 bp, Homo sapiens
tctctggggaccctccagagg

SEQ ID NO: 6433576 - DNA, 18 bp, Homo sapiens
tctctggggccacacaga

SEQ ID NO: 6433577 - DNA, 18 bp, Homo sapiens
tctctggggccctgggcc

SEQ ID NO: 6433578 - DNA, 23 bp, Homo sapiens
tctctggggccctgggcctcagt

SEQ ID NO: 6433579 - DNA, 14 bp, Homo sapiens
tctctgggggaggc

SEQ ID NO: 6433580 - DNA, 21 bp, Homo sapiens
tctctgggggctgaggagcag

SEQ ID NO: 6433581 - DNA, 13 bp, Homo sapiens
tctctggtccgga

SEQ ID NO: 6433582 - DNA, 20 bp, Homo sapiens
tctctggtccggacactcct

SEQ ID NO: 6433583 - DNA, 13 bp, Homo sapiens
tctctggtctcct

SEQ ID NO: 6433584 - DNA, 15 bp, Homo sapiens
tctctggtggctggg

SEQ ID NO: 6433585 - DNA, 17 bp, Homo sapiens
tctctggtggctgggct

SEQ ID NO: 6433586 - DNA, 19 bp, Homo sapiens
tctctggtgttctctggct

SEQ ID NO: 6433587 - DNA, 15 bp, Homo sapiens
tctctggtttcacca

SEQ ID NO: 6433588 - DNA, 18 bp, Homo sapiens
tctctggttttcttgcca

SEQ ID NO: 6433589 - DNA, 15 bp, Homo sapiens
tctctgtaaaaagca

SEQ ID NO: 6433590 - DNA, 20 bp, Homo sapiens
tctctgtaaaaagcaggtga

SEQ ID NO: 6433591 - DNA, 18 bp, Homo sapiens
tctctgtaaaatgaactg

SEQ ID NO: 6433592 - DNA, 12 bp, Homo sapiens
tctctgtaaagc

SEQ ID NO: 6433593 - DNA, 14 bp, Homo sapiens
tctctgtaaagcta

SEQ ID NO: 6433594 - DNA, 19 bp, Homo sapiens
tctctgtaaccgcttctgg

SEQ ID NO: 6433595 - DNA, 21 bp, Homo sapiens
tctctgtaagtgtagctcaaa

SEQ ID NO: 6433596 - DNA, 12 bp, Homo sapiens
tctctgtaatta

SEQ ID NO: 6433597 - DNA, 13 bp, Homo sapiens
tctctgtacaaaa

SEQ ID NO: 6433598 - DNA, 23 bp, Homo sapiens
tctctgtagaaggagtagctgcc

SEQ ID NO: 6433599 - DNA, 12 bp, Homo sapiens
tctctgtagctg

SEQ ID NO: 6433600 - DNA, 18 bp, Homo sapiens
tctctgtaggatcgtaaa

SEQ ID NO: 6433601 - DNA, 16 bp, Homo sapiens
tctctgtataatctat

SEQ ID NO: 6433602 - DNA, 17 bp, Homo sapiens
tctctgtatatttatga

SEQ ID NO: 6433603 - DNA, 12 bp, Homo sapiens
tctctgtcacat

SEQ ID NO: 6433604 - DNA, 15 bp, Homo sapiens
tctctgtccagggct

SEQ ID NO: 6433605 - DNA, 20 bp, Homo sapiens
tctctgtcccattccctggg

SEQ ID NO: 6433606 - DNA, 16 bp, Homo sapiens
tctctgtccctcactg

SEQ ID NO: 6433607 - DNA, 20 bp, Homo sapiens
tctctgtcccttgctgtatg

SEQ ID NO: 6433608 - DNA, 18 bp, Homo sapiens
tctctgtcctctgctttg

SEQ ID NO: 6433609 - DNA, 22 bp, Homo sapiens
tctctgtcctctgctttgctgt

SEQ ID NO: 6433610 - DNA, 15 bp, Homo sapiens
tctctgtcgtggagc

SEQ ID NO: 6433611 - DNA, 13 bp, Homo sapiens
tctctgtctactc

SEQ ID NO: 6433612 - DNA, 12 bp, Homo sapiens
tctctgtctcat

SEQ ID NO: 6433613 - DNA, 16 bp, Homo sapiens
tctctgtctcatccat

SEQ ID NO: 6433614 - DNA, 16 bp, Homo sapiens
tctctgtctccaggca

SEQ ID NO: 6433615 - DNA, 17 bp, Homo sapiens
tctctgtctctctgtct

SEQ ID NO: 6433616 - DNA, 13 bp, Homo sapiens
tctctgtctgggg

SEQ ID NO: 6433617 - DNA, 16 bp, Homo sapiens
tctctgtgaaagcttt

SEQ ID NO: 6433618 - DNA, 23 bp, Homo sapiens
tctctgtgaatcttgaataactt

SEQ ID NO: 6433619 - DNA, 13 bp, Homo sapiens
tctctgtgaccca

SEQ ID NO: 6433620 - DNA, 18 bp, Homo sapiens
tctctgtgacctgccccg

SEQ ID NO: 6433621 - DNA, 19 bp, Homo sapiens
tctctgtgagactcgagaa

SEQ ID NO: 6433622 - DNA, 15 bp, Homo sapiens
tctctgtgcaggagc

SEQ ID NO: 6433623 - DNA, 18 bp, Homo sapiens
tctctgtgcccctgtaaa

SEQ ID NO: 6433624 - DNA, 17 bp, Homo sapiens
tctctgtgccttcgtct

SEQ ID NO: 6433625 - DNA, 14 bp, Homo sapiens
tctctgtgctctga

SEQ ID NO: 6433626 - DNA, 19 bp, Homo sapiens
tctctgtgcttcaattaat

SEQ ID NO: 6433627 - DNA, 22 bp, Homo sapiens
tctctgtgctttgactcacctg

SEQ ID NO: 6433628 - DNA, 14 bp, Homo sapiens
tctctgtggctcca

SEQ ID NO: 6433629 - DNA, 17 bp, Homo sapiens
tctctgtggctccaacc

SEQ ID NO: 6433630 - DNA, 22 bp, Homo sapiens
tctctgtgtatgagtgtgaatg

SEQ ID NO: 6433631 - DNA, 21 bp, Homo sapiens
tctctgtgtggcaaacattta

SEQ ID NO: 6433632 - DNA, 20 bp, Homo sapiens
tcagacatgttttccgtgaa

SEQ ID NO: 6433633 - DNA, 14 bp, Homo sapiens
tcagacatttatgt

SEQ ID NO: 6433634 - DNA, 16 bp, Homo sapiens
tcagacatttctttgg

SEQ ID NO: 6433635 - DNA, 20 bp, Homo sapiens
tcagacattttcttttttta

SEQ ID NO: 6433636 - DNA, 20 bp, Homo sapiens
tcagaccaactctctcctgt

SEQ ID NO: 6433637 - DNA, 20 bp, Homo sapiens
tcagaccaaggaacaagacc

SEQ ID NO: 6433638 - DNA, 13 bp, Homo sapiens
tcagaccagagaa

SEQ ID NO: 6433639 - DNA, 14 bp, Homo sapiens
tcagaccagctctt

SEQ ID NO: 6433640 - DNA, 13 bp, Homo sapiens
tcagacccagaga

SEQ ID NO: 6433641 - DNA, 14 bp, Homo sapiens
tcagacccagagaa

SEQ ID NO: 6433642 - DNA, 19 bp, Homo sapiens
tcagacccaggagtccaga

SEQ ID NO: 6433643 - DNA, 18 bp, Homo sapiens
tcagacccaggggtccag

SEQ ID NO: 6433644 - DNA, 14 bp, Homo sapiens
tcagacccatctct

SEQ ID NO: 6433645 - DNA, 17 bp, Homo sapiens
tcagacccatctctccc

SEQ ID NO: 6433646 - DNA, 15 bp, Homo sapiens
tcagaccccacccta

SEQ ID NO: 6433647 - DNA, 12 bp, Homo sapiens
tcagaccccagc

SEQ ID NO: 6433648 - DNA, 22 bp, Homo sapiens
tcagaccccagttctaggggag

SEQ ID NO: 6433649 - DNA, 15 bp, Homo sapiens
tcagacccccccatt

SEQ ID NO: 6433650 - DNA, 19 bp, Homo sapiens
tcagaccccctcagccttg

SEQ ID NO: 6433651 - DNA, 14 bp, Homo sapiens
tcagaccctacccc

SEQ ID NO: 6433652 - DNA, 18 bp, Homo sapiens
tcagaccctaccccacca

SEQ ID NO: 6433653 - DNA, 15 bp, Homo sapiens
tcagaccctgcttag

SEQ ID NO: 6433654 - DNA, 12 bp, Homo sapiens
tcagaccctgga

SEQ ID NO: 6433655 - DNA, 14 bp, Homo sapiens
tcagaccctggagg

SEQ ID NO: 6433656 - DNA, 15 bp, Homo sapiens
tcagacctccagtga

SEQ ID NO: 6433657 - DNA, 17 bp, Homo sapiens
tcagacctctgatccct

SEQ ID NO: 6433658 - DNA, 12 bp, Homo sapiens
tcagacctgggt

SEQ ID NO: 6433659 - DNA, 13 bp, Homo sapiens
tcagacctgtctt

SEQ ID NO: 6433660 - DNA, 21 bp, Homo sapiens
tcagaccttggatcagatgaa

SEQ ID NO: 6433661 - DNA, 18 bp, Homo sapiens
tcagaccttttaactcct

SEQ ID NO: 6433662 - DNA, 17 bp, Homo sapiens
tcagacgacagcccctg

SEQ ID NO: 6433663 - DNA, 18 bp, Homo sapiens
tcagacgcactcgcattg

SEQ ID NO: 6433664 - DNA, 14 bp, Homo sapiens
tcagacggcggcca

SEQ ID NO: 6433665 - DNA, 20 bp, Homo sapiens
tcagacggcggccaggcaca

SEQ ID NO: 6433666 - DNA, 17 bp, Homo sapiens
tcagactagagaataat

SEQ ID NO: 6433667 - DNA, 20 bp, Homo sapiens
tcagactagccactcctgcc

SEQ ID NO: 6433668 - DNA, 22 bp, Homo sapiens
tcagactagccactcctgccag

SEQ ID NO: 6433669 - DNA, 14 bp, Homo sapiens
tcagactagtgaca

SEQ ID NO: 6433670 - DNA, 17 bp, Homo sapiens
tcagactcagaggtcca

SEQ ID NO: 6433671 - DNA, 14 bp, Homo sapiens
tcagactcagtttt

SEQ ID NO: 6433672 - DNA, 22 bp, Homo sapiens
tcagactcagttttttgtaact

SEQ ID NO: 6433673 - DNA, 19 bp, Homo sapiens
tcagactcccattcctgaa

SEQ ID NO: 6433674 - DNA, 21 bp, Homo sapiens
tcagactcccattcctgaaga

SEQ ID NO: 6433675 - DNA, 14 bp, Homo sapiens
tcagactcctggct

SEQ ID NO: 6433676 - DNA, 20 bp, Homo sapiens
tcagactcctggcttcatgt

SEQ ID NO: 6433677 - DNA, 15 bp, Homo sapiens
tcagactctgggtcc

SEQ ID NO: 6433678 - DNA, 14 bp, Homo sapiens
tcagactgaacatg

SEQ ID NO: 6433679 - DNA, 16 bp, Homo sapiens
tcagactgacactact

SEQ ID NO: 6433680 - DNA, 16 bp, Homo sapiens
tcagactgaccccaga

SEQ ID NO: 6433681 - DNA, 20 bp, Homo sapiens
tcagactgatagacaccata

SEQ ID NO: 6433682 - DNA, 16 bp, Homo sapiens
tcagactgcacccagg

SEQ ID NO: 6433683 - DNA, 19 bp, Homo sapiens
tcagactgcacccaggagg

SEQ ID NO: 6433684 - DNA, 20 bp, Homo sapiens
tcagactgcacccaggaggg

SEQ ID NO: 6433685 - DNA, 13 bp, Homo sapiens
tcagactgcagag

SEQ ID NO: 6433686 - DNA, 16 bp, Homo sapiens
tcagactgctgggact

SEQ ID NO: 6433687 - DNA, 17 bp, Homo sapiens
tcagactgctgggactg

SEQ ID NO: 6433688 - DNA, 21 bp, Homo sapiens
tcagactgctgggactggcca

SEQ ID NO: 6433689 - DNA, 15 bp, Homo sapiens
tcagactgctttaaa

SEQ ID NO: 6433690 - DNA, 22 bp, Homo sapiens
tcagactggaggtcgaagcaat

SEQ ID NO: 6433691 - DNA, 13 bp, Homo sapiens
tcagactggccct

SEQ ID NO: 6433692 - DNA, 21 bp, Homo sapiens
tcagactgggcactggggcct

SEQ ID NO: 6433693 - DNA, 15 bp, Homo sapiens
tcagacttaccagga

SEQ ID NO: 6433694 - DNA, 15 bp, Homo sapiens
tcagacttacttact

SEQ ID NO: 6433695 - DNA, 21 bp, Homo sapiens
tcagacttagtttttataaaa

SEQ ID NO: 6433696 - DNA, 23 bp, Homo sapiens
tcagacttccaaatcctggaagg

SEQ ID NO: 6433697 - DNA, 20 bp, Homo sapiens
tcagacttgatttacaagca

SEQ ID NO: 6433698 - DNA, 15 bp, Homo sapiens
tcagacttgcggcca

SEQ ID NO: 6433699 - DNA, 23 bp, Homo sapiens
tcagactttgtgttcatttcatt

SEQ ID NO: 6433700 - DNA, 15 bp, Homo sapiens
tcagacttttatcaa

SEQ ID NO: 6433701 - DNA, 15 bp, Homo sapiens
tcagacttttgtaca

SEQ ID NO: 6433702 - DNA, 15 bp, Homo sapiens
tcagagaaaacactt

SEQ ID NO: 6433703 - DNA, 19 bp, Homo sapiens
tcagagaaaacactttcct

SEQ ID NO: 6433704 - DNA, 12 bp, Homo sapiens
tcagagaaaact

SEQ ID NO: 6433705 - DNA, 14 bp, Homo sapiens
tcagagaaggaaca

SEQ ID NO: 6433706 - DNA, 22 bp, Homo sapiens
tcagagaaggccttacagaaaa

SEQ ID NO: 6433707 - DNA, 18 bp, Homo sapiens
tcagagaattatctcaag

SEQ ID NO: 6433708 - DNA, 20 bp, Homo sapiens
tcagagaattatctcaagta

SEQ ID NO: 6433709 - DNA, 23 bp, Homo sapiens
tcagagaatttctaccatttcag

SEQ ID NO: 6433710 - DNA, 10 bp, Homo sapiens
tcagagacac

SEQ ID NO: 6433711 - DNA, 21 bp, Homo sapiens
tcagagacagcgcgagtagca

SEQ ID NO: 6433712 - DNA, 23 bp, Homo sapiens
tcagagacaggaagtcttcaggg

SEQ ID NO: 6433713 - DNA, 15 bp, Homo sapiens
tcagagacatgcaga

SEQ ID NO: 6433714 - DNA, 15 bp, Homo sapiens
tcagagaccagcact

SEQ ID NO: 6433715 - DNA, 18 bp, Homo sapiens
tcagagaccaggccctgg

SEQ ID NO: 6433716 - DNA, 15 bp, Homo sapiens
tcagagaccagggct

SEQ ID NO: 6433717 - DNA, 20 bp, Homo sapiens
tcagagaccagggctccagc

SEQ ID NO: 6433718 - DNA, 19 bp, Homo sapiens
tcagagaccttaatttata

SEQ ID NO: 6433719 - DNA, 20 bp, Homo sapiens
tcagagaccttaatttatat

SEQ ID NO: 6433720 - DNA, 15 bp, Homo sapiens
tcagagacggcagaa

SEQ ID NO: 6433721 - DNA, 14 bp, Homo sapiens
tcagagactcaggg

SEQ ID NO: 6433722 - DNA, 22 bp, Homo sapiens
tcagagactgcaagctgcttgc

SEQ ID NO: 6433723 - DNA, 12 bp, Homo sapiens
tcagagactgcc

SEQ ID NO: 6433724 - DNA, 15 bp, Homo sapiens
tcagagactgctgtg

SEQ ID NO: 6433725 - DNA, 22 bp, Homo sapiens
tcagagactggcagccagggag

SEQ ID NO: 6433726 - DNA, 19 bp, Homo sapiens
tcagagagaatggctttgg

SEQ ID NO: 6433727 - DNA, 19 bp, Homo sapiens
tcagagagacccgggaagg

SEQ ID NO: 6433728 - DNA, 20 bp, Homo sapiens
tcagagagacccgggaagga

SEQ ID NO: 6433729 - DNA, 21 bp, Homo sapiens
tcagagagacccgggaaggaa

SEQ ID NO: 6433730 - DNA, 14 bp, Homo sapiens
tcagagagacctca

SEQ ID NO: 6433731 - DNA, 20 bp, Homo sapiens
tcagagagacctcatcctgc

SEQ ID NO: 6433732 - DNA, 16 bp, Homo sapiens
tcagagagcaagaaaa

SEQ ID NO: 6433733 - DNA, 23 bp, Homo sapiens
tcagagagcaagaaaaaagtaca

SEQ ID NO: 6433734 - DNA, 12 bp, Homo sapiens
tcagagagcagc

SEQ ID NO: 6433735 - DNA, 15 bp, Homo sapiens
tcagagagcagtgct

SEQ ID NO: 6433736 - DNA, 20 bp, Homo sapiens
tcagagagcatcttttcctc

SEQ ID NO: 6433737 - DNA, 14 bp, Homo sapiens
tcagagagcctaga

SEQ ID NO: 6433738 - DNA, 13 bp, Homo sapiens
tcagagagctggt

SEQ ID NO: 6433739 - DNA, 14 bp, Homo sapiens
tcagagagctggta

SEQ ID NO: 6433740 - DNA, 15 bp, Homo sapiens
tcagagaggacaaaa

SEQ ID NO: 6433741 - DNA, 21 bp, Homo sapiens
tcagagaggacaaaataaagt

SEQ ID NO: 6433742 - DNA, 22 bp, Homo sapiens
tcagagaggccttttggaatgt

SEQ ID NO: 6433743 - DNA, 19 bp, Homo sapiens
tcagagagggaagctgagg

SEQ ID NO: 6433744 - DNA, 23 bp, Homo sapiens
tcagagagggaagctgaggccca

SEQ ID NO: 6433745 - DNA, 21 bp, Homo sapiens
tcagagagggtgggagtgggc

SEQ ID NO: 6433746 - DNA, 22 bp, Homo sapiens
tcagagaggtagcactctcaga

SEQ ID NO: 6433747 - DNA, 19 bp, Homo sapiens
tcagagagtcaatgtcatt

SEQ ID NO: 6433748 - DNA, 16 bp, Homo sapiens
tcagagataggcctgt

SEQ ID NO: 6433749 - DNA, 15 bp, Homo sapiens
tcagagatataataa

SEQ ID NO: 6433750 - DNA, 20 bp, Homo sapiens
tcagagatataataagccca

SEQ ID NO: 6433751 - DNA, 18 bp, Homo sapiens
tcagagatcaggatcagc

SEQ ID NO: 6433752 - DNA, 21 bp, Homo sapiens
tcagagatcgtgtattgagat

SEQ ID NO: 6433753 - DNA, 18 bp, Homo sapiens
tcagagatgaacatctaa

SEQ ID NO: 6433754 - DNA, 20 bp, Homo sapiens
tcagagatgcatttggaaca

SEQ ID NO: 6433755 - DNA, 14 bp, Homo sapiens
tcagagatggacag

SEQ ID NO: 6433756 - DNA, 17 bp, Homo sapiens
tcagagatggacagaga

SEQ ID NO: 6433757 - DNA, 20 bp, Homo sapiens
tcagagatggacagagaact

SEQ ID NO: 6433758 - DNA, 15 bp, Homo sapiens
tcagagatttttgtt

SEQ ID NO: 6433759 - DNA, 15 bp, Homo sapiens
tcagagcaagccttt

SEQ ID NO: 6433760 - DNA, 18 bp, Homo sapiens
tcagagcacagccaatct

SEQ ID NO: 6433761 - DNA, 20 bp, Homo sapiens
tcagagcactttaaaaacag

SEQ ID NO: 6433762 - DNA, 15 bp, Homo sapiens
tcagagcagcactgg

SEQ ID NO: 6433763 - DNA, 16 bp, Homo sapiens
tcagagcagcactggg

SEQ ID NO: 6433764 - DNA, 17 bp, Homo sapiens
tcagagcagcagtgaaa

SEQ ID NO: 6433765 - DNA, 21 bp, Homo sapiens
tcagagcagcagtgaaaacaa

SEQ ID NO: 6433766 - DNA, 14 bp, Homo sapiens
tcagagcagcctct

SEQ ID NO: 6433767 - DNA, 14 bp, Homo sapiens
tcagagcaggctca

SEQ ID NO: 6433768 - DNA, 16 bp, Homo sapiens
tcagagcatctggctg

SEQ ID NO: 6433769 - DNA, 16 bp, Homo sapiens
tcagagcatgatggga

SEQ ID NO: 6433770 - DNA, 14 bp, Homo sapiens
tcagagcatgtgtc

SEQ ID NO: 6433771 - DNA, 15 bp, Homo sapiens
tcagagcatgtgtca

SEQ ID NO: 6433772 - DNA, 22 bp, Homo sapiens
tcagagccaagccttaaactgt

SEQ ID NO: 6433773 - DNA, 21 bp, Homo sapiens
tcagagccaagggggcagagg

SEQ ID NO: 6433774 - DNA, 12 bp, Homo sapiens
tcagagccaagt

SEQ ID NO: 6433775 - DNA, 18 bp, Homo sapiens
tcagagccactctatgag

SEQ ID NO: 6433776 - DNA, 14 bp, Homo sapiens
tcagagccaggctc

SEQ ID NO: 6433777 - DNA, 17 bp, Homo sapiens
tcagagccaggctctgc

SEQ ID NO: 6433778 - DNA, 19 bp, Homo sapiens
tcagagccaggctctgcct

SEQ ID NO: 6433779 - DNA, 12 bp, Homo sapiens
tcagagcccagc

SEQ ID NO: 6433780 - DNA, 19 bp, Homo sapiens
tcagagcccagcccaggag

SEQ ID NO: 6433781 - DNA, 18 bp, Homo sapiens
tcagagcccaggggagaa

SEQ ID NO: 6433782 - DNA, 16 bp, Homo sapiens
tcagagcccccagccc

SEQ ID NO: 6433783 - DNA, 21 bp, Homo sapiens
tcagagccccgccccaccccg

SEQ ID NO: 6433784 - DNA, 12 bp, Homo sapiens
tcagagcctagc

SEQ ID NO: 6433785 - DNA, 17 bp, Homo sapiens
tcagagcctagccacct

SEQ ID NO: 6433786 - DNA, 19 bp, Homo sapiens
tcagagcctagccacctcc

SEQ ID NO: 6433787 - DNA, 21 bp, Homo sapiens
tcagagcctagccacctccca

SEQ ID NO: 6433788 - DNA, 12 bp, Homo sapiens
tcagagcctgca

SEQ ID NO: 6433789 - DNA, 13 bp, Homo sapiens
tcagagcctgcag

SEQ ID NO: 6433790 - DNA, 18 bp, Homo sapiens
tcagagcctgcagttatt

SEQ ID NO: 6433791 - DNA, 18 bp, Homo sapiens
tcagagccttaacaccag

SEQ ID NO: 6433792 - DNA, 19 bp, Homo sapiens
tcagagccttccatgacct

SEQ ID NO: 6433793 - DNA, 22 bp, Homo sapiens
tcagagccttccatgacctccc

SEQ ID NO: 6433794 - DNA, 17 bp, Homo sapiens
tcagagcctttcctcaa

SEQ ID NO: 6433795 - DNA, 14 bp, Homo sapiens
tcagagcgcacagg

SEQ ID NO: 6433796 - DNA, 19 bp, Homo sapiens
tcagagcgccaggaagcca

SEQ ID NO: 6433797 - DNA, 21 bp, Homo sapiens
tcagagctaagggtgggtgct

SEQ ID NO: 6433798 - DNA, 17 bp, Homo sapiens
tcagagctcttcaagct

SEQ ID NO: 6433799 - DNA, 19 bp, Homo sapiens
tcagagctcttcaagctgt

SEQ ID NO: 6433800 - DNA, 21 bp, Homo sapiens
tcagagctcttcaagctgtcc

SEQ ID NO: 6433801 - DNA, 23 bp, Homo sapiens
tcagagctcttcaagctgtcccc

SEQ ID NO: 6433802 - DNA, 13 bp, Homo sapiens
tcagagctgcagc

SEQ ID NO: 6433803 - DNA, 14 bp, Homo sapiens
tcagagctgcagcc

SEQ ID NO: 6433804 - DNA, 16 bp, Homo sapiens
tcagagctgcagccag

SEQ ID NO: 6433805 - DNA, 14 bp, Homo sapiens
tcagagctgccctc

SEQ ID NO: 6433806 - DNA, 18 bp, Homo sapiens
tcagagctgccctctcct

SEQ ID NO: 6433807 - DNA, 19 bp, Homo sapiens
tcagagctgccctctcctg

SEQ ID NO: 6433808 - DNA, 13 bp, Homo sapiens
tcagagctgcggg

SEQ ID NO: 6433809 - DNA, 23 bp, Homo sapiens
tcagagctgcgggctgagggcat

SEQ ID NO: 6433810 - DNA, 14 bp, Homo sapiens
tcagagctgctgag

SEQ ID NO: 6433811 - DNA, 15 bp, Homo sapiens
tctctgttaacatct

SEQ ID NO: 6433812 - DNA, 16 bp, Homo sapiens
tctctgttacaaaaga

SEQ ID NO: 6433813 - DNA, 23 bp, Homo sapiens
tctctgttactccattactgtga

SEQ ID NO: 6433814 - DNA, 21 bp, Homo sapiens
tctctgttcagatgtgcattt

SEQ ID NO: 6433815 - DNA, 14 bp, Homo sapiens
tctctgttcatttc

SEQ ID NO: 6433816 - DNA, 14 bp, Homo sapiens
tctctgttccatag

SEQ ID NO: 6433817 - DNA, 14 bp, Homo sapiens
tctctgttccatgt

SEQ ID NO: 6433818 - DNA, 12 bp, Homo sapiens
tctctgttccct

SEQ ID NO: 6433819 - DNA, 16 bp, Homo sapiens
tctctgttcccttcct

SEQ ID NO: 6433820 - DNA, 23 bp, Homo sapiens
tctctgttctacccgttccaaaa

SEQ ID NO: 6433821 - DNA, 17 bp, Homo sapiens
tctctgttctcttgctt

SEQ ID NO: 6433822 - DNA, 15 bp, Homo sapiens
tctctgttcttcatc

SEQ ID NO: 6433823 - DNA, 16 bp, Homo sapiens
tctctgttcttcatct

SEQ ID NO: 6433824 - DNA, 23 bp, Homo sapiens
tctctgttcttcatctgctatta

SEQ ID NO: 6433825 - DNA, 19 bp, Homo sapiens
tctctgttggtccactgtg

SEQ ID NO: 6433826 - DNA, 16 bp, Homo sapiens
tctctgttggtctgcc

SEQ ID NO: 6433827 - DNA, 22 bp, Homo sapiens
tctctgttggtctgccttctgc

SEQ ID NO: 6433828 - DNA, 18 bp, Homo sapiens
tctctgttgtcgtaaaga

SEQ ID NO: 6433829 - DNA, 17 bp, Homo sapiens
tctctgtttaccctccc

SEQ ID NO: 6433830 - DNA, 17 bp, Homo sapiens
tctctgtttgcttttga

SEQ ID NO: 6433831 - DNA, 18 bp, Homo sapiens
tctcttaaacttgtgaat

SEQ ID NO: 6433832 - DNA, 13 bp, Homo sapiens
tctcttaaagttg

SEQ ID NO: 6433833 - DNA, 16 bp, Homo sapiens
tctcttaaataaaaat

SEQ ID NO: 6433834 - DNA, 19 bp, Homo sapiens
tctcttaaataaaaataat

SEQ ID NO: 6433835 - DNA, 14 bp, Homo sapiens
tctcttaaatctct

SEQ ID NO: 6433836 - DNA, 20 bp, Homo sapiens
tctcttaaatctcttaaact

SEQ ID NO: 6433837 - DNA, 22 bp, Homo sapiens
tctcttaaatgaagtgcccact

SEQ ID NO: 6433838 - DNA, 18 bp, Homo sapiens
tctcttaatttaatcttt

SEQ ID NO: 6433839 - DNA, 16 bp, Homo sapiens
tctcttacatggccac

SEQ ID NO: 6433840 - DNA, 22 bp, Homo sapiens
tctcttacattttcgtcctgta

SEQ ID NO: 6433841 - DNA, 14 bp, Homo sapiens
tctcttaccccgtc

SEQ ID NO: 6433842 - DNA, 20 bp, Homo sapiens
tctcttaccccgtccctttc

SEQ ID NO: 6433843 - DNA, 21 bp, Homo sapiens
tctcttaccccgtccctttcc

SEQ ID NO: 6433844 - DNA, 13 bp, Homo sapiens
tctcttacctgtt

SEQ ID NO: 6433845 - DNA, 14 bp, Homo sapiens
tctcttacctgtta

SEQ ID NO: 6433846 - DNA, 13 bp, Homo sapiens
tctcttactgcaa

SEQ ID NO: 6433847 - DNA, 19 bp, Homo sapiens
tctcttactgcaaatgtca

SEQ ID NO: 6433848 - DNA, 20 bp, Homo sapiens
tctcttacttgatagactta

SEQ ID NO: 6433849 - DNA, 13 bp, Homo sapiens
tctcttagaaata

SEQ ID NO: 6433850 - DNA, 16 bp, Homo sapiens
tctcttagaaatactt

SEQ ID NO: 6433851 - DNA, 13 bp, Homo sapiens
tctcttagaattt

SEQ ID NO: 6433852 - DNA, 22 bp, Homo sapiens
tctcttagctactgtatgcaaa

SEQ ID NO: 6433853 - DNA, 18 bp, Homo sapiens
tctcttagctcccctcca

SEQ ID NO: 6433854 - DNA, 16 bp, Homo sapiens
tctcttaggtctaatg

SEQ ID NO: 6433855 - DNA, 21 bp, Homo sapiens
tctcttaggtgagacagttgc

SEQ ID NO: 6433856 - DNA, 15 bp, Homo sapiens
tctcttatagaatat

SEQ ID NO: 6433857 - DNA, 17 bp, Homo sapiens
tctcttatagaatattt

SEQ ID NO: 6433858 - DNA, 20 bp, Homo sapiens
tctcttatagaatatttatt

SEQ ID NO: 6433859 - DNA, 13 bp, Homo sapiens
tctcttatgcatt

SEQ ID NO: 6433860 - DNA, 17 bp, Homo sapiens
tctcttatgcattagta

SEQ ID NO: 6433861 - DNA, 22 bp, Homo sapiens
tctcttatggtattatatctct

SEQ ID NO: 6433862 - DNA, 14 bp, Homo sapiens
tctcttattctaat

SEQ ID NO: 6433863 - DNA, 22 bp, Homo sapiens
tctcttattgcctcacttcagg

SEQ ID NO: 6433864 - DNA, 13 bp, Homo sapiens
tctcttcaataaa

SEQ ID NO: 6433865 - DNA, 23 bp, Homo sapiens
tctcttcacccctacactgtgaa

SEQ ID NO: 6433866 - DNA, 17 bp, Homo sapiens
tctcttcactcccaata

SEQ ID NO: 6433867 - DNA, 17 bp, Homo sapiens
tctcttcagactctcag

SEQ ID NO: 6433868 - DNA, 13 bp, Homo sapiens
tctcttcagcccc

SEQ ID NO: 6433869 - DNA, 16 bp, Homo sapiens
tctcttcaggttctta

SEQ ID NO: 6433870 - DNA, 23 bp, Homo sapiens
tctcttcaggttcttagtgtcac

SEQ ID NO: 6433871 - DNA, 17 bp, Homo sapiens
tctcttcagtctctata

SEQ ID NO: 6433872 - DNA, 14 bp, Homo sapiens
tctcttcatacttt

SEQ ID NO: 6433873 - DNA, 17 bp, Homo sapiens
tctcttcattcccactg

SEQ ID NO: 6433874 - DNA, 22 bp, Homo sapiens
tctcttcattcccactgcactt

SEQ ID NO: 6433875 - DNA, 19 bp, Homo sapiens
tctcttcatttttttttca

SEQ ID NO: 6433876 - DNA, 16 bp, Homo sapiens
tctcttccacatgtta

SEQ ID NO: 6433877 - DNA, 10 bp, Homo sapiens
tctcttccat

SEQ ID NO: 6433878 - DNA, 17 bp, Homo sapiens
tctcttccatatgacct

SEQ ID NO: 6433879 - DNA, 14 bp, Homo sapiens
tctcttcccaggcc

SEQ ID NO: 6433880 - DNA, 16 bp, Homo sapiens
tctcttcccaggcctt

SEQ ID NO: 6433881 - DNA, 19 bp, Homo sapiens
tctcttcccaggcctttgg

SEQ ID NO: 6433882 - DNA, 17 bp, Homo sapiens
tctcttccccttagaaa

SEQ ID NO: 6433883 - DNA, 18 bp, Homo sapiens
tctcttccccttagaaac

SEQ ID NO: 6433884 - DNA, 22 bp, Homo sapiens
tctcttccctccggactctaaa

SEQ ID NO: 6433885 - DNA, 15 bp, Homo sapiens
tctcttcccttctcc

SEQ ID NO: 6433886 - DNA, 12 bp, Homo sapiens
tctcttcccttt

SEQ ID NO: 6433887 - DNA, 19 bp, Homo sapiens
tctcttccctttccccagc

SEQ ID NO: 6433888 - DNA, 18 bp, Homo sapiens
tctcttccctttgtgtat

SEQ ID NO: 6433889 - DNA, 13 bp, Homo sapiens
tctcttccgggag

SEQ ID NO: 6433890 - DNA, 14 bp, Homo sapiens
tctcttccgggagc

SEQ ID NO: 6433891 - DNA, 11 bp, Homo sapiens
tctcttcctac

SEQ ID NO: 6433892 - DNA, 15 bp, Homo sapiens
tctcttcctatccca

SEQ ID NO: 6433893 - DNA, 23 bp, Homo sapiens
tctcttcctctcttttttggggg

SEQ ID NO: 6433894 - DNA, 11 bp, Homo sapiens
tctcttcctgc

SEQ ID NO: 6433895 - DNA, 13 bp, Homo sapiens
tctcttcctgccc

SEQ ID NO: 6433896 - DNA, 16 bp, Homo sapiens
tctcttcctgcccctc

SEQ ID NO: 6433897 - DNA, 16 bp, Homo sapiens
tctcttccttacaggt

SEQ ID NO: 6433898 - DNA, 19 bp, Homo sapiens
tctcttccttgctttctct

SEQ ID NO: 6433899 - DNA, 13 bp, Homo sapiens
tctcttcctttca

SEQ ID NO: 6433900 - DNA, 18 bp, Homo sapiens
tctcttcctttcattcta

SEQ ID NO: 6433901 - DNA, 20 bp, Homo sapiens
tctcttccttttatcagtag

SEQ ID NO: 6433902 - DNA, 13 bp, Homo sapiens
tctcttcgctgtg

SEQ ID NO: 6433903 - DNA, 15 bp, Homo sapiens
tctcttcgctgtgat

SEQ ID NO: 6433904 - DNA, 15 bp, Homo sapiens
tctcttcggtggcct

SEQ ID NO: 6433905 - DNA, 17 bp, Homo sapiens
tctcttcggtggccttg

SEQ ID NO: 6433906 - DNA, 19 bp, Homo sapiens
tctcttcgtcctgatccct

SEQ ID NO: 6433907 - DNA, 22 bp, Homo sapiens
tctcttctaacatgaaatatat

SEQ ID NO: 6433908 - DNA, 17 bp, Homo sapiens
tctcttctacccttttc

SEQ ID NO: 6433909 - DNA, 17 bp, Homo sapiens
tctcttctatcctgcaa

SEQ ID NO: 6433910 - DNA, 18 bp, Homo sapiens
tctcttctatcctgcaat

SEQ ID NO: 6433911 - DNA, 19 bp, Homo sapiens
tctcttctcagagtggtgg

SEQ ID NO: 6433912 - DNA, 11 bp, Homo sapiens
tctcttctcca

SEQ ID NO: 6433913 - DNA, 13 bp, Homo sapiens
tctcttctcccag

SEQ ID NO: 6433914 - DNA, 14 bp, Homo sapiens
tctcttctcccaga

SEQ ID NO: 6433915 - DNA, 18 bp, Homo sapiens
tctcttctccccttccat

SEQ ID NO: 6433916 - DNA, 22 bp, Homo sapiens
tctcttctctattcctgaccct

SEQ ID NO: 6433917 - DNA, 15 bp, Homo sapiens
tctcttctctccagc

SEQ ID NO: 6433918 - DNA, 14 bp, Homo sapiens
tctcttctctgcca

SEQ ID NO: 6433919 - DNA, 13 bp, Homo sapiens
tctcttctctgtt

SEQ ID NO: 6433920 - DNA, 16 bp, Homo sapiens
tctcttctcttctttg

SEQ ID NO: 6433921 - DNA, 19 bp, Homo sapiens
tctcttctgaataaagcaa

SEQ ID NO: 6433922 - DNA, 20 bp, Homo sapiens
tctcttctgaataaagcaat

SEQ ID NO: 6433923 - DNA, 16 bp, Homo sapiens
tctcttctgctccacc

SEQ ID NO: 6433924 - DNA, 17 bp, Homo sapiens
tctcttctgctccaccc

SEQ ID NO: 6433925 - DNA, 19 bp, Homo sapiens
tctcttctgggcgtctgag

SEQ ID NO: 6433926 - DNA, 18 bp, Homo sapiens
tctcttctgggttccttc

SEQ ID NO: 6433927 - DNA, 20 bp, Homo sapiens
tctcttctgggttccttcct

SEQ ID NO: 6433928 - DNA, 13 bp, Homo sapiens
tctcttctgtcca

SEQ ID NO: 6433929 - DNA, 14 bp, Homo sapiens
tctcttctgtgttt

SEQ ID NO: 6433930 - DNA, 22 bp, Homo sapiens
tctcttcttaaccctgaacaag

SEQ ID NO: 6433931 - DNA, 21 bp, Homo sapiens
tctcttcttactcattactgc

SEQ ID NO: 6433932 - DNA, 22 bp, Homo sapiens
tctcttcttactcattactgca

SEQ ID NO: 6433933 - DNA, 22 bp, Homo sapiens
tctcttcttccctgtcagcctg

SEQ ID NO: 6433934 - DNA, 13 bp, Homo sapiens
tctcttcttgaac

SEQ ID NO: 6433935 - DNA, 18 bp, Homo sapiens
tctcttctttattgcact

SEQ ID NO: 6433936 - DNA, 16 bp, Homo sapiens
tctcttgaaggtgctg

SEQ ID NO: 6433937 - DNA, 22 bp, Homo sapiens
tctcttgaaggtgctgccaccc

SEQ ID NO: 6433938 - DNA, 18 bp, Homo sapiens
tctcttgaccctgtcact

SEQ ID NO: 6433939 - DNA, 21 bp, Homo sapiens
tctcttgactccactacttta

SEQ ID NO: 6433940 - DNA, 16 bp, Homo sapiens
tctcttgagcatcaat

SEQ ID NO: 6433941 - DNA, 17 bp, Homo sapiens
tctcttgagcctgggag

SEQ ID NO: 6433942 - DNA, 15 bp, Homo sapiens
tctcttgagctggcc

SEQ ID NO: 6433943 - DNA, 18 bp, Homo sapiens
tctcttgaggccaggagt

SEQ ID NO: 6433944 - DNA, 16 bp, Homo sapiens
tctcttgattcataat

SEQ ID NO: 6433945 - DNA, 17 bp, Homo sapiens
tctcttgattgattttt

SEQ ID NO: 6433946 - DNA, 22 bp, Homo sapiens
tctcttgcaccaaattatcttg

SEQ ID NO: 6433947 - DNA, 13 bp, Homo sapiens
tctcttgcacccg

SEQ ID NO: 6433948 - DNA, 13 bp, Homo sapiens
tctcttgccagca

SEQ ID NO: 6433949 - DNA, 21 bp, Homo sapiens
tctcttgccatttgtagcttt

SEQ ID NO: 6433950 - DNA, 21 bp, Homo sapiens
tctcttgccccaaatcacaaa

SEQ ID NO: 6433951 - DNA, 12 bp, Homo sapiens
tctcttgcctca

SEQ ID NO: 6433952 - DNA, 15 bp, Homo sapiens
tctcttgcctgccac

SEQ ID NO: 6433953 - DNA, 17 bp, Homo sapiens
tctcttgcctgccactg

SEQ ID NO: 6433954 - DNA, 19 bp, Homo sapiens
tctcttgcctgccactgtg

SEQ ID NO: 6433955 - DNA, 16 bp, Homo sapiens
tctcttgcctttctta

SEQ ID NO: 6433956 - DNA, 23 bp, Homo sapiens
tctcttgctgtttaccgcccacc

SEQ ID NO: 6433957 - DNA, 21 bp, Homo sapiens
tctcttgctttatactactca

SEQ ID NO: 6433958 - DNA, 20 bp, Homo sapiens
tctcttgctttcacattgta

SEQ ID NO: 6433959 - DNA, 13 bp, Homo sapiens
tctcttgctttct

SEQ ID NO: 6433960 - DNA, 12 bp, Homo sapiens
tctcttggaaaa

SEQ ID NO: 6433961 - DNA, 19 bp, Homo sapiens
tctcttggaaaataagaca

SEQ ID NO: 6433962 - DNA, 21 bp, Homo sapiens
tctcttggaaaataagacaat

SEQ ID NO: 6433963 - DNA, 18 bp, Homo sapiens
tctcttggaactgcacca

SEQ ID NO: 6433964 - DNA, 19 bp, Homo sapiens
tctcttggaattagatgtt

SEQ ID NO: 6433965 - DNA, 16 bp, Homo sapiens
tctcttggacattgta

SEQ ID NO: 6433966 - DNA, 13 bp, Homo sapiens
tctcttggaccca

SEQ ID NO: 6433967 - DNA, 16 bp, Homo sapiens
tctcttggactccctc

SEQ ID NO: 6433968 - DNA, 16 bp, Homo sapiens
tctcttgggaactgaa

SEQ ID NO: 6433969 - DNA, 15 bp, Homo sapiens
tctcttgggaagcag

SEQ ID NO: 6433970 - DNA, 20 bp, Homo sapiens
tctcttgggaagcagtttca

SEQ ID NO: 6433971 - DNA, 20 bp, Homo sapiens
tctcttgggaagtgtgttta

SEQ ID NO: 6433972 - DNA, 16 bp, Homo sapiens
tctcttgggcaggcag

SEQ ID NO: 6433973 - DNA, 22 bp, Homo sapiens
tctcttgggccaagccagctgc

SEQ ID NO: 6433974 - DNA, 19 bp, Homo sapiens
tctcttgggtgggacaggg

SEQ ID NO: 6433975 - DNA, 18 bp, Homo sapiens
tctcttggtcctgctgca

SEQ ID NO: 6433976 - DNA, 16 bp, Homo sapiens
tctcttggtgaaataa

SEQ ID NO: 6433977 - DNA, 21 bp, Homo sapiens
tctcttggtgaaataataaaa

SEQ ID NO: 6433978 - DNA, 19 bp, Homo sapiens
tctcttggtttccttcctt

SEQ ID NO: 6433979 - DNA, 18 bp, Homo sapiens
tctcttgtaatttggatc

SEQ ID NO: 6433980 - DNA, 15 bp, Homo sapiens
tctcttgtaccagcc

SEQ ID NO: 6433981 - DNA, 14 bp, Homo sapiens
tctcttgtaccata

SEQ ID NO: 6433982 - DNA, 18 bp, Homo sapiens
tctcttgtcattctcatc

SEQ ID NO: 6433983 - DNA, 21 bp, Homo sapiens
tctcttgtcattctcatccaa

SEQ ID NO: 6433984 - DNA, 18 bp, Homo sapiens
tctcttgtcctcttctgc

SEQ ID NO: 6433985 - DNA, 16 bp, Homo sapiens
tctcttgtcctgtgat

SEQ ID NO: 6433986 - DNA, 17 bp, Homo sapiens
tctcttgtgatttggtt

SEQ ID NO: 6433987 - DNA, 20 bp, Homo sapiens
tctcttgttgatttccgtga

SEQ ID NO: 6433988 - DNA, 21 bp, Homo sapiens
tctcttgtttaaaaaaagaaa

SEQ ID NO: 6433989 - DNA, 22 bp, Homo sapiens
tctcttgtttaaaaaaagaaaa

SEQ ID NO: 6433990 - DNA, 22 bp, Homo sapiens
tcagagctggcagcctccagtg

SEQ ID NO: 6433991 - DNA, 14 bp, Homo sapiens
tcagagctgggagt

SEQ ID NO: 6433992 - DNA, 23 bp, Homo sapiens
tcagagcttcctggggaccaaga

SEQ ID NO: 6433993 - DNA, 21 bp, Homo sapiens
tcagagcttgattagaagcca

SEQ ID NO: 6433994 - DNA, 10 bp, Homo sapiens
tcagagcttt

SEQ ID NO: 6433995 - DNA, 16 bp, Homo sapiens
tcagagctttaaaagt

SEQ ID NO: 6433996 - DNA, 22 bp, Homo sapiens
tcagagcttttcgaactgtgct

SEQ ID NO: 6433997 - DNA, 22 bp, Homo sapiens
tcagaggaaaaatgggagccag

SEQ ID NO: 6433998 - DNA, 17 bp, Homo sapiens
tcagaggaccccagggt

SEQ ID NO: 6433999 - DNA, 19 bp, Homo sapiens
tcagaggaccccagggtgg

SEQ ID NO: 6434000 - DNA, 14 bp, Homo sapiens
tcagaggacctgta

SEQ ID NO: 6434001 - DNA, 18 bp, Homo sapiens
tcagaggacctgtattta

SEQ ID NO: 6434002 - DNA, 23 bp, Homo sapiens
tcagaggacctgtatttaagcaa

SEQ ID NO: 6434003 - DNA, 14 bp, Homo sapiens
tcagaggagaagag

SEQ ID NO: 6434004 - DNA, 22 bp, Homo sapiens
tcagaggagagatagcctgtgg

SEQ ID NO: 6434005 - DNA, 19 bp, Homo sapiens
tcagaggagcatcagctgt

SEQ ID NO: 6434006 - DNA, 13 bp, Homo sapiens
tcagaggagctct

SEQ ID NO: 6434007 - DNA, 15 bp, Homo sapiens
tcagaggcagcacca

SEQ ID NO: 6434008 - DNA, 14 bp, Homo sapiens
tcagaggcagcagg

SEQ ID NO: 6434009 - DNA, 22 bp, Homo sapiens
tcagaggcagcttcaagtgcct

SEQ ID NO: 6434010 - DNA, 22 bp, Homo sapiens
tcagaggccccaataccccatg

SEQ ID NO: 6434011 - DNA, 13 bp, Homo sapiens
tcagaggccccca

SEQ ID NO: 6434012 - DNA, 16 bp, Homo sapiens
tcagaggcccccagtg

SEQ ID NO: 6434013 - DNA, 23 bp, Homo sapiens
tcagaggcccccagtggggacag

SEQ ID NO: 6434014 - DNA, 24 bp, Homo sapiens
tcagaggcccccagtggggacagg

SEQ ID NO: 6434015 - DNA, 15 bp, Homo sapiens
tcagaggccccttgc

SEQ ID NO: 6434016 - DNA, 19 bp, Homo sapiens
tcagaggccccttgctgct

SEQ ID NO: 6434017 - DNA, 21 bp, Homo sapiens
tcagaggccctcgctgccagc

SEQ ID NO: 6434018 - DNA, 22 bp, Homo sapiens
tcagaggccctcgctgccagct

SEQ ID NO: 6434019 - DNA, 13 bp, Homo sapiens
tcagaggccgctc

SEQ ID NO: 6434020 - DNA, 14 bp, Homo sapiens
tcagaggccgctct

SEQ ID NO: 6434021 - DNA, 20 bp, Homo sapiens
tcagaggcctataatgaagc

SEQ ID NO: 6434022 - DNA, 18 bp, Homo sapiens
tcagaggcctgctgccag

SEQ ID NO: 6434023 - DNA, 23 bp, Homo sapiens
tcagaggcctggcatcttctgga

SEQ ID NO: 6434024 - DNA, 22 bp, Homo sapiens
tcagaggccttatgagggtcct

SEQ ID NO: 6434025 - DNA, 13 bp, Homo sapiens
tcagaggccttgc

SEQ ID NO: 6434026 - DNA, 16 bp, Homo sapiens
tcagaggcgtgctggt

SEQ ID NO: 6434027 - DNA, 11 bp, Homo sapiens
tcagaggctga

SEQ ID NO: 6434028 - DNA, 16 bp, Homo sapiens
tcagaggctgagccct

SEQ ID NO: 6434029 - DNA, 15 bp, Homo sapiens
tcagaggctgaggtg

SEQ ID NO: 6434030 - DNA, 21 bp, Homo sapiens
tcagagggaaagtaaatattt

SEQ ID NO: 6434031 - DNA, 20 bp, Homo sapiens
tcagagggaaggctctctgg

SEQ ID NO: 6434032 - DNA, 23 bp, Homo sapiens
tcagagggactgtcagctgagct

SEQ ID NO: 6434033 - DNA, 14 bp, Homo sapiens
tcagagggaggaat

SEQ ID NO: 6434034 - DNA, 21 bp, Homo sapiens
tcagagggaggagtttttctt

SEQ ID NO: 6434035 - DNA, 15 bp, Homo sapiens
tcagagggtccctag

SEQ ID NO: 6434036 - DNA, 18 bp, Homo sapiens
tcagaggtagggctgcca

SEQ ID NO: 6434037 - DNA, 17 bp, Homo sapiens
tcagaggtcatcccttc

SEQ ID NO: 6434038 - DNA, 15 bp, Homo sapiens
tcagaggtccaggcc

SEQ ID NO: 6434039 - DNA, 23 bp, Homo sapiens
tcagaggtgaaagctatatcaat

SEQ ID NO: 6434040 - DNA, 16 bp, Homo sapiens
tcagaggtgaattaat

SEQ ID NO: 6434041 - DNA, 17 bp, Homo sapiens
tcagaggtggctctgga

SEQ ID NO: 6434042 - DNA, 18 bp, Homo sapiens
tcagagtaagctgctttt

SEQ ID NO: 6434043 - DNA, 13 bp, Homo sapiens
tcagagtagaaat

SEQ ID NO: 6434044 - DNA, 21 bp, Homo sapiens
tcagagtagagggcttgggaa

SEQ ID NO: 6434045 - DNA, 17 bp, Homo sapiens
tcagagtaggtgggtag

SEQ ID NO: 6434046 - DNA, 21 bp, Homo sapiens
tcagagtcatttatgagcaga

SEQ ID NO: 6434047 - DNA, 16 bp, Homo sapiens
tcagagtccactgtgg

SEQ ID NO: 6434048 - DNA, 19 bp, Homo sapiens
tcagagtccactgtggcac

SEQ ID NO: 6434049 - DNA, 13 bp, Homo sapiens
tcagagtccaggc

SEQ ID NO: 6434050 - DNA, 16 bp, Homo sapiens
tcagagtccaggcccc

SEQ ID NO: 6434051 - DNA, 17 bp, Homo sapiens
tcagagtccaggcccca

SEQ ID NO: 6434052 - DNA, 21 bp, Homo sapiens
tcagagtccagtgctctgcct

SEQ ID NO: 6434053 - DNA, 17 bp, Homo sapiens
tcagagtccttaaaatg

SEQ ID NO: 6434054 - DNA, 23 bp, Homo sapiens
tcagagtccttgcaaaattgtct

SEQ ID NO: 6434055 - DNA, 16 bp, Homo sapiens
tcagagtctataacag

SEQ ID NO: 6434056 - DNA, 14 bp, Homo sapiens
tcagagtgaagaat

SEQ ID NO: 6434057 - DNA, 14 bp, Homo sapiens
tcagagtgaagagt

SEQ ID NO: 6434058 - DNA, 19 bp, Homo sapiens
tcagagtgaagagtgaaga

SEQ ID NO: 6434059 - DNA, 23 bp, Homo sapiens
tcagagtgaagagtgaagagcat

SEQ ID NO: 6434060 - DNA, 16 bp, Homo sapiens
tcagagtgacagtcat

SEQ ID NO: 6434061 - DNA, 18 bp, Homo sapiens
tcagagtgaccctcagct

SEQ ID NO: 6434062 - DNA, 20 bp, Homo sapiens
tcagagtgaccctcagctgt

SEQ ID NO: 6434063 - DNA, 21 bp, Homo sapiens
tcagagtgaccctcagctgtc

SEQ ID NO: 6434064 - DNA, 20 bp, Homo sapiens
tcagagtgactacacacagt

SEQ ID NO: 6434065 - DNA, 23 bp, Homo sapiens
tcagagtggagttgaaactgcta

SEQ ID NO: 6434066 - DNA, 19 bp, Homo sapiens
tcagagtggcgtgagctgc

SEQ ID NO: 6434067 - DNA, 20 bp, Homo sapiens
tcagagtggctcactggctg

SEQ ID NO: 6434068 - DNA, 22 bp, Homo sapiens
tcagagtggtttcattgccttc

SEQ ID NO: 6434069 - DNA, 19 bp, Homo sapiens
tcagagtgtatttttgtaa

SEQ ID NO: 6434070 - DNA, 20 bp, Homo sapiens
tcagagtgtatttttgtaat

SEQ ID NO: 6434071 - DNA, 23 bp, Homo sapiens
tcagagtgtccctttttgcaggg

SEQ ID NO: 6434072 - DNA, 23 bp, Homo sapiens
tcagagttaccattatttaattt

SEQ ID NO: 6434073 - DNA, 20 bp, Homo sapiens
tcagagttctatactgtaaa

SEQ ID NO: 6434074 - DNA, 19 bp, Homo sapiens
tcagagttctttttgaagt

SEQ ID NO: 6434075 - DNA, 23 bp, Homo sapiens
tcagagttgactttcctcccatt

SEQ ID NO: 6434076 - DNA, 22 bp, Homo sapiens
tcagagttgatggttgtacata

SEQ ID NO: 6434077 - DNA, 17 bp, Homo sapiens
tcagagttgcttttcta

SEQ ID NO: 6434078 - DNA, 19 bp, Homo sapiens
tcagagttgcttttctaat

SEQ ID NO: 6434079 - DNA, 19 bp, Homo sapiens
tcagagtttcagctttctt

SEQ ID NO: 6434080 - DNA, 15 bp, Homo sapiens
tcagagtttgtgtgt

SEQ ID NO: 6434081 - DNA, 16 bp, Homo sapiens
tcagagtttgtgtgta

SEQ ID NO: 6434082 - DNA, 17 bp, Homo sapiens
tcagagtttgtgtgtat

SEQ ID NO: 6434083 - DNA, 23 bp, Homo sapiens
tcagagtttgtgtgtatttgtat

SEQ ID NO: 6434084 - DNA, 13 bp, Homo sapiens
tcagagttttact

SEQ ID NO: 6434085 - DNA, 18 bp, Homo sapiens
tcagagttttactaagat

SEQ ID NO: 6434086 - DNA, 15 bp, Homo sapiens
tcagagttttctggg

SEQ ID NO: 6434087 - DNA, 17 bp, Homo sapiens
tcagataaatcatgggc

SEQ ID NO: 6434088 - DNA, 22 bp, Homo sapiens
tcagataactgttatttataat

SEQ ID NO: 6434089 - DNA, 23 bp, Homo sapiens
tcagataaggtaaaatgccatga

SEQ ID NO: 6434090 - DNA, 17 bp, Homo sapiens
tcagataatatgtttag

SEQ ID NO: 6434091 - DNA, 22 bp, Homo sapiens
tcagatacccagtggaattcca

SEQ ID NO: 6434092 - DNA, 14 bp, Homo sapiens
tcagatactggatt

SEQ ID NO: 6434093 - DNA, 20 bp, Homo sapiens
tcagatactggattgtactt

SEQ ID NO: 6434094 - DNA, 15 bp, Homo sapiens
tcagatacttatgaa

SEQ ID NO: 6434095 - DNA, 20 bp, Homo sapiens
tcagatacttatgaaatctc

SEQ ID NO: 6434096 - DNA, 17 bp, Homo sapiens
tcagatagaatgacagt

SEQ ID NO: 6434097 - DNA, 15 bp, Homo sapiens
tcagataggtgcttc

SEQ ID NO: 6434098 - DNA, 17 bp, Homo sapiens
tcagatataaaagactg

SEQ ID NO: 6434099 - DNA, 16 bp, Homo sapiens
tcagatatatttttca

SEQ ID NO: 6434100 - DNA, 21 bp, Homo sapiens
tcagatatttatatttttatt

SEQ ID NO: 6434101 - DNA, 21 bp, Homo sapiens
tcagatattttttcagaaata

SEQ ID NO: 6434102 - DNA, 21 bp, Homo sapiens
tcagatcaccccagcctcact

SEQ ID NO: 6434103 - DNA, 13 bp, Homo sapiens
tcagatcatggca

SEQ ID NO: 6434104 - DNA, 20 bp, Homo sapiens
tcagatcattatcagcctgt

SEQ ID NO: 6434105 - DNA, 16 bp, Homo sapiens
tcagatccagggacag

SEQ ID NO: 6434106 - DNA, 15 bp, Homo sapiens
tcagatccagtgtaa

SEQ ID NO: 6434107 - DNA, 18 bp, Homo sapiens
tcagatccagtgtaaact

SEQ ID NO: 6434108 - DNA, 12 bp, Homo sapiens
tcagatcccagg

SEQ ID NO: 6434109 - DNA, 13 bp, Homo sapiens
tcagatcccaggg

SEQ ID NO: 6434110 - DNA, 14 bp, Homo sapiens
tcagatccccctcc

SEQ ID NO: 6434111 - DNA, 12 bp, Homo sapiens
tcagatcctacc

SEQ ID NO: 6434112 - DNA, 14 bp, Homo sapiens
tcagatcctacccc

SEQ ID NO: 6434113 - DNA, 14 bp, Homo sapiens
tcagatcctcctca

SEQ ID NO: 6434114 - DNA, 13 bp, Homo sapiens
tcagatcctgggc

SEQ ID NO: 6434115 - DNA, 13 bp, Homo sapiens
tcagatcctgtta

SEQ ID NO: 6434116 - DNA, 17 bp, Homo sapiens
tcagatcctgttacttg

SEQ ID NO: 6434117 - DNA, 18 bp, Homo sapiens
tcagatcctgttacttgc

SEQ ID NO: 6434118 - DNA, 16 bp, Homo sapiens
tcagatccttccaaac

SEQ ID NO: 6434119 - DNA, 19 bp, Homo sapiens
tcagatccttgtttcaaac

SEQ ID NO: 6434120 - DNA, 18 bp, Homo sapiens
tcagatcggccacagggc

SEQ ID NO: 6434121 - DNA, 18 bp, Homo sapiens
tcagatcgtattaattat

SEQ ID NO: 6434122 - DNA, 22 bp, Homo sapiens
tcagatcgtattaattatctga

SEQ ID NO: 6434123 - DNA, 16 bp, Homo sapiens
tcagatcgttcattgc

SEQ ID NO: 6434124 - DNA, 19 bp, Homo sapiens
tcagatcgttcattgcctt

SEQ ID NO: 6434125 - DNA, 20 bp, Homo sapiens
tcagatctgaacacagttta

SEQ ID NO: 6434126 - DNA, 14 bp, Homo sapiens
tcagatctgaagta

SEQ ID NO: 6434127 - DNA, 13 bp, Homo sapiens
tcagatctgaggt

SEQ ID NO: 6434128 - DNA, 18 bp, Homo sapiens
tcagatctgcctaaggac

SEQ ID NO: 6434129 - DNA, 13 bp, Homo sapiens
tcagatctgtctg

SEQ ID NO: 6434130 - DNA, 14 bp, Homo sapiens
tcagatctgtctga

SEQ ID NO: 6434131 - DNA, 19 bp, Homo sapiens
tcagatcttaatataaatt

SEQ ID NO: 6434132 - DNA, 15 bp, Homo sapiens
tcagatcttcttttg

SEQ ID NO: 6434133 - DNA, 22 bp, Homo sapiens
tcagatctttgcaccagatact

SEQ ID NO: 6434134 - DNA, 23 bp, Homo sapiens
tcagatctttgcaccagatactc

SEQ ID NO: 6434135 - DNA, 13 bp, Homo sapiens
tcagatgaattga

SEQ ID NO: 6434136 - DNA, 13 bp, Homo sapiens
tcagatgaattta

SEQ ID NO: 6434137 - DNA, 17 bp, Homo sapiens
tcagatgactctctcca

SEQ ID NO: 6434138 - DNA, 14 bp, Homo sapiens
tcagatgagaacaa

SEQ ID NO: 6434139 - DNA, 23 bp, Homo sapiens
tcagatgagcaaggacattgccc

SEQ ID NO: 6434140 - DNA, 14 bp, Homo sapiens
tcagatgaggccct

SEQ ID NO: 6434141 - DNA, 23 bp, Homo sapiens
tcagatgaggtcaacacaggtag

SEQ ID NO: 6434142 - DNA, 19 bp, Homo sapiens
tcagatgatggccatttct

SEQ ID NO: 6434143 - DNA, 22 bp, Homo sapiens
tcagatgatggccatttctaaa

SEQ ID NO: 6434144 - DNA, 18 bp, Homo sapiens
tcagatgcacatgagctg

SEQ ID NO: 6434145 - DNA, 23 bp, Homo sapiens
tcagatgcagttttcaaattata

SEQ ID NO: 6434146 - DNA, 14 bp, Homo sapiens
tcagatgcccagag

SEQ ID NO: 6434147 - DNA, 18 bp, Homo sapiens
tcagatgcccagtatcat

SEQ ID NO: 6434148 - DNA, 16 bp, Homo sapiens
tcagatgcctcagagg

SEQ ID NO: 6434149 - DNA, 20 bp, Homo sapiens
tcagatgcgtgcccagctct

SEQ ID NO: 6434150 - DNA, 18 bp, Homo sapiens
tcagatgcgttcgcctct

SEQ ID NO: 6434151 - DNA, 13 bp, Homo sapiens
tcagatgctcaaa

SEQ ID NO: 6434152 - DNA, 22 bp, Homo sapiens
tcagatgctcattgctttctaa

SEQ ID NO: 6434153 - DNA, 14 bp, Homo sapiens
tcagatgctccaag

SEQ ID NO: 6434154 - DNA, 18 bp, Homo sapiens
tcagatgctccaagattc

SEQ ID NO: 6434155 - DNA, 19 bp, Homo sapiens
tcagatgctccaagattct

SEQ ID NO: 6434156 - DNA, 14 bp, Homo sapiens
tcagatgctcttgg

SEQ ID NO: 6434157 - DNA, 15 bp, Homo sapiens
tcagatgctgaattg

SEQ ID NO: 6434158 - DNA, 22 bp, Homo sapiens
tcagatgctggtcatcctgggc

SEQ ID NO: 6434159 - DNA, 21 bp, Homo sapiens
tcagatgctgtgcaaatgtta

SEQ ID NO: 6434160 - DNA, 22 bp, Homo sapiens
tcagatgcttgcggcaaaagga

SEQ ID NO: 6434161 - DNA, 18 bp, Homo sapiens
tcagatggaagagataaa

SEQ ID NO: 6434162 - DNA, 16 bp, Homo sapiens
tcagatggactgggag

SEQ ID NO: 6434163 - DNA, 17 bp, Homo sapiens
tcagatggcagctttta

SEQ ID NO: 6434164 - DNA, 18 bp, Homo sapiens
tcagatggcagcttttaa

SEQ ID NO: 6434165 - DNA, 15 bp, Homo sapiens
tcagatgggaagaca

SEQ ID NO: 6434166 - DNA, 19 bp, Homo sapiens
tcagatggtgtcatttagt

SEQ ID NO: 6434167 - DNA, 19 bp, Homo sapiens
tctcttgtttgagagagaa

SEQ ID NO: 6434168 - DNA, 19 bp, Homo sapiens
tctctttaaaaggaaagaa

SEQ ID NO: 6434169 - DNA, 15 bp, Homo sapiens
tctctttaactcagg

SEQ ID NO: 6434170 - DNA, 20 bp, Homo sapiens
tctctttaactcaggactcc

SEQ ID NO: 6434171 - DNA, 22 bp, Homo sapiens
tctctttaagggcatgccttgt

SEQ ID NO: 6434172 - DNA, 20 bp, Homo sapiens
tctctttaatcttcagtttt

SEQ ID NO: 6434173 - DNA, 19 bp, Homo sapiens
tctctttaattttaactga

SEQ ID NO: 6434174 - DNA, 13 bp, Homo sapiens
tctctttaggaga

SEQ ID NO: 6434175 - DNA, 16 bp, Homo sapiens
tctctttatacagctg

SEQ ID NO: 6434176 - DNA, 13 bp, Homo sapiens
tctctttatagag

SEQ ID NO: 6434177 - DNA, 15 bp, Homo sapiens
tctctttattcctag

SEQ ID NO: 6434178 - DNA, 14 bp, Homo sapiens
tctctttcacacaa

SEQ ID NO: 6434179 - DNA, 19 bp, Homo sapiens
tctctttcagtattaaact

SEQ ID NO: 6434180 - DNA, 18 bp, Homo sapiens
tctctttccaccatacct

SEQ ID NO: 6434181 - DNA, 21 bp, Homo sapiens
tctctttccccaaggacccag

SEQ ID NO: 6434182 - DNA, 14 bp, Homo sapiens
tctctttccctggt

SEQ ID NO: 6434183 - DNA, 15 bp, Homo sapiens
tctctttcctccacc

SEQ ID NO: 6434184 - DNA, 13 bp, Homo sapiens
tctctttctcacc

SEQ ID NO: 6434185 - DNA, 20 bp, Homo sapiens
tctctttctccgtatttatt

SEQ ID NO: 6434186 - DNA, 17 bp, Homo sapiens
tctctttctctcttccc

SEQ ID NO: 6434187 - DNA, 12 bp, Homo sapiens
tctctttctctg

SEQ ID NO: 6434188 - DNA, 12 bp, Homo sapiens
tctctttctgtc

SEQ ID NO: 6434189 - DNA, 18 bp, Homo sapiens
tctctttctgtttcctgg

SEQ ID NO: 6434190 - DNA, 15 bp, Homo sapiens
tctctttcttatttt

SEQ ID NO: 6434191 - DNA, 19 bp, Homo sapiens
tctctttcttctctgctgc

SEQ ID NO: 6434192 - DNA, 15 bp, Homo sapiens
tctctttctttccaa

SEQ ID NO: 6434193 - DNA, 21 bp, Homo sapiens
tctctttctttttctgtctct

SEQ ID NO: 6434194 - DNA, 16 bp, Homo sapiens
tctctttgagtcaata

SEQ ID NO: 6434195 - DNA, 19 bp, Homo sapiens
tctctttgattatttgcat

SEQ ID NO: 6434196 - DNA, 11 bp, Homo sapiens
tctctttgcca

SEQ ID NO: 6434197 - DNA, 11 bp, Homo sapiens
tctctttgccc

SEQ ID NO: 6434198 - DNA, 15 bp, Homo sapiens
tctctttgctgacac

SEQ ID NO: 6434199 - DNA, 14 bp, Homo sapiens
tctctttggaaata

SEQ ID NO: 6434200 - DNA, 19 bp, Homo sapiens
tctctttggaaatagcatg

SEQ ID NO: 6434201 - DNA, 19 bp, Homo sapiens
tctctttggaatgaacaat

SEQ ID NO: 6434202 - DNA, 21 bp, Homo sapiens
tctctttggactctcccctct

SEQ ID NO: 6434203 - DNA, 14 bp, Homo sapiens
tctctttggtttct

SEQ ID NO: 6434204 - DNA, 13 bp, Homo sapiens
tctctttgtaagg

SEQ ID NO: 6434205 - DNA, 22 bp, Homo sapiens
tctctttgtaaggacttgtgcc

SEQ ID NO: 6434206 - DNA, 16 bp, Homo sapiens
tctctttgtggggctt

SEQ ID NO: 6434207 - DNA, 19 bp, Homo sapiens
tctctttgttcttcaatgt

SEQ ID NO: 6434208 - DNA, 15 bp, Homo sapiens
tctcttttaaagtat

SEQ ID NO: 6434209 - DNA, 22 bp, Homo sapiens
tctcttttaaagtatttataaa

SEQ ID NO: 6434210 - DNA, 17 bp, Homo sapiens
tctcttttattctgtta

SEQ ID NO: 6434211 - DNA, 15 bp, Homo sapiens
tctcttttcaaaaca

SEQ ID NO: 6434212 - DNA, 16 bp, Homo sapiens
tctcttttcaaaacat

SEQ ID NO: 6434213 - DNA, 18 bp, Homo sapiens
tctcttttcattgtgtat

SEQ ID NO: 6434214 - DNA, 19 bp, Homo sapiens
tctcttttcattgtgtatc

SEQ ID NO: 6434215 - DNA, 12 bp, Homo sapiens
tctcttttccac

SEQ ID NO: 6434216 - DNA, 22 bp, Homo sapiens
tctcttttccactccattgtcg

SEQ ID NO: 6434217 - DNA, 20 bp, Homo sapiens
tctcttttcccctttcctgt

SEQ ID NO: 6434218 - DNA, 21 bp, Homo sapiens
tctcttttcccctttcctgtc

SEQ ID NO: 6434219 - DNA, 22 bp, Homo sapiens
tctcttttccctcctttccttt

SEQ ID NO: 6434220 - DNA, 12 bp, Homo sapiens
tctcttttcctc

SEQ ID NO: 6434221 - DNA, 14 bp, Homo sapiens
tctcttttcctcct

SEQ ID NO: 6434222 - DNA, 19 bp, Homo sapiens
tctcttttcctctctgtct

SEQ ID NO: 6434223 - DNA, 11 bp, Homo sapiens
tctcttttcta

SEQ ID NO: 6434224 - DNA, 14 bp, Homo sapiens
tctcttttctctac

SEQ ID NO: 6434225 - DNA, 17 bp, Homo sapiens
tctcttttctgtacttc

SEQ ID NO: 6434226 - DNA, 18 bp, Homo sapiens
tctcttttcttctcagga

SEQ ID NO: 6434227 - DNA, 13 bp, Homo sapiens
tctcttttctttc

SEQ ID NO: 6434228 - DNA, 21 bp, Homo sapiens
tctcttttctttctgtcttgt

SEQ ID NO: 6434229 - DNA, 23 bp, Homo sapiens
tctcttttgtcctcacatgcaga

SEQ ID NO: 6434230 - DNA, 22 bp, Homo sapiens
tctctttttccccgattttcca

SEQ ID NO: 6434231 - DNA, 23 bp, Homo sapiens
tctctttttccccgattttccag

SEQ ID NO: 6434232 - DNA, 14 bp, Homo sapiens
tctctttttcttcc

SEQ ID NO: 6434233 - DNA, 16 bp, Homo sapiens
tctctttttcttgtaa

SEQ ID NO: 6434234 - DNA, 15 bp, Homo sapiens
tctctttttcttttc

SEQ ID NO: 6434235 - DNA, 17 bp, Homo sapiens
tctctttttcttttcta

SEQ ID NO: 6434236 - DNA, 21 bp, Homo sapiens
tctctttttgactcttgcaat

SEQ ID NO: 6434237 - DNA, 21 bp, Homo sapiens
tctctttttgccccctctcct

SEQ ID NO: 6434238 - DNA, 18 bp, Homo sapiens
tctctttttgctttcgaa

SEQ ID NO: 6434239 - DNA, 20 bp, Homo sapiens
tctctttttggaggtgctta

SEQ ID NO: 6434240 - DNA, 22 bp, Homo sapiens
tctctttttggtaataacaaac

SEQ ID NO: 6434241 - DNA, 16 bp, Homo sapiens
tctcttttttaaaaac

SEQ ID NO: 6434242 - DNA, 22 bp, Homo sapiens
tctcttttttattctgttttct

SEQ ID NO: 6434243 - DNA, 19 bp, Homo sapiens
tctctttttttggcccagg

SEQ ID NO: 6434244 - DNA, 14 bp, Homo sapiens
tctgaaaaagacat

SEQ ID NO: 6434245 - DNA, 12 bp, Homo sapiens
tctgaaaaagag

SEQ ID NO: 6434246 - DNA, 15 bp, Homo sapiens
tctgaaaaatgaatg

SEQ ID NO: 6434247 - DNA, 16 bp, Homo sapiens
tctgaaaaatgaatgt

SEQ ID NO: 6434248 - DNA, 21 bp, Homo sapiens
tctgaaaaatggccatgttgt

SEQ ID NO: 6434249 - DNA, 12 bp, Homo sapiens
tctgaaaacaag

SEQ ID NO: 6434250 - DNA, 12 bp, Homo sapiens
tctgaaaacaat

SEQ ID NO: 6434251 - DNA, 16 bp, Homo sapiens
tctgaaaacaattggt

SEQ ID NO: 6434252 - DNA, 11 bp, Homo sapiens
tctgaaaacat

SEQ ID NO: 6434253 - DNA, 15 bp, Homo sapiens
tctgaaaacggccct

SEQ ID NO: 6434254 - DNA, 15 bp, Homo sapiens
tctgaaaactgttta

SEQ ID NO: 6434255 - DNA, 15 bp, Homo sapiens
tctgaaaacttggct

SEQ ID NO: 6434256 - DNA, 12 bp, Homo sapiens
tctgaaaagaaa

SEQ ID NO: 6434257 - DNA, 13 bp, Homo sapiens
tctgaaaagaaat

SEQ ID NO: 6434258 - DNA, 18 bp, Homo sapiens
tctgaaaagaaatgctaa

SEQ ID NO: 6434259 - DNA, 16 bp, Homo sapiens
tctgaaaagaggagcc

SEQ ID NO: 6434260 - DNA, 22 bp, Homo sapiens
tctgaaaagcaattgccctgta

SEQ ID NO: 6434261 - DNA, 16 bp, Homo sapiens
tctgaaaagcagttca

SEQ ID NO: 6434262 - DNA, 21 bp, Homo sapiens
tctgaaaagctgtgtacttta

SEQ ID NO: 6434263 - DNA, 13 bp, Homo sapiens
tctgaaaaggaac

SEQ ID NO: 6434264 - DNA, 18 bp, Homo sapiens
tctgaaaagtgaagacag

SEQ ID NO: 6434265 - DNA, 14 bp, Homo sapiens
tctgaaaatataac

SEQ ID NO: 6434266 - DNA, 18 bp, Homo sapiens
tctgaaaatataaccagc

SEQ ID NO: 6434267 - DNA, 17 bp, Homo sapiens
tctgaaaatatctcttg

SEQ ID NO: 6434268 - DNA, 18 bp, Homo sapiens
tctgaaaatctccttcca

SEQ ID NO: 6434269 - DNA, 16 bp, Homo sapiens
tctgaaaatgtatgtg

SEQ ID NO: 6434270 - DNA, 17 bp, Homo sapiens
tctgaaaattaacactg

SEQ ID NO: 6434271 - DNA, 23 bp, Homo sapiens
tctgaaaattccagaaaggatat

SEQ ID NO: 6434272 - DNA, 21 bp, Homo sapiens
tctgaaaatttatataactgt

SEQ ID NO: 6434273 - DNA, 14 bp, Homo sapiens
tctgaaacacacga

SEQ ID NO: 6434274 - DNA, 17 bp, Homo sapiens
tctgaaacacacgagca

SEQ ID NO: 6434275 - DNA, 20 bp, Homo sapiens
tctgaaacacactgaaagct

SEQ ID NO: 6434276 - DNA, 21 bp, Homo sapiens
tctgaaacacactgaaagctc

SEQ ID NO: 6434277 - DNA, 11 bp, Homo sapiens
tctgaaacagc

SEQ ID NO: 6434278 - DNA, 12 bp, Homo sapiens
tctgaaacagct

SEQ ID NO: 6434279 - DNA, 13 bp, Homo sapiens
tctgaaacagctg

SEQ ID NO: 6434280 - DNA, 15 bp, Homo sapiens
tctgaaacaggccct

SEQ ID NO: 6434281 - DNA, 14 bp, Homo sapiens
tctgaaacatagat

SEQ ID NO: 6434282 - DNA, 16 bp, Homo sapiens
tctgaaaccaaatgta

SEQ ID NO: 6434283 - DNA, 21 bp, Homo sapiens
tctgaaaccacagtttcatta

SEQ ID NO: 6434284 - DNA, 20 bp, Homo sapiens
tctgaaaccagtgttaggga

SEQ ID NO: 6434285 - DNA, 22 bp, Homo sapiens
tctgaaaccttagtttcaagag

SEQ ID NO: 6434286 - DNA, 13 bp, Homo sapiens
tctgaaactaatg

SEQ ID NO: 6434287 - DNA, 15 bp, Homo sapiens
tctgaaactaatgaa

SEQ ID NO: 6434288 - DNA, 13 bp, Homo sapiens
tctgaaactccct

SEQ ID NO: 6434289 - DNA, 16 bp, Homo sapiens
tctgaaactcccttgt

SEQ ID NO: 6434290 - DNA, 19 bp, Homo sapiens
tctgaaacttcataaatgt

SEQ ID NO: 6434291 - DNA, 14 bp, Homo sapiens
tctgaaagacagaa

SEQ ID NO: 6434292 - DNA, 19 bp, Homo sapiens
tctgaaagacagaatgtca

SEQ ID NO: 6434293 - DNA, 12 bp, Homo sapiens
tctgaaagccac

SEQ ID NO: 6434294 - DNA, 14 bp, Homo sapiens
tctgaaagccacgt

SEQ ID NO: 6434295 - DNA, 20 bp, Homo sapiens
tctgaaagctgcttctgggg

SEQ ID NO: 6434296 - DNA, 22 bp, Homo sapiens
tctgaaaggaaaagtctttgct

SEQ ID NO: 6434297 - DNA, 16 bp, Homo sapiens
tctgaaaggccagcag

SEQ ID NO: 6434298 - DNA, 21 bp, Homo sapiens
tctgaaaggccagcagctgat

SEQ ID NO: 6434299 - DNA, 13 bp, Homo sapiens
tctgaaagggacg

SEQ ID NO: 6434300 - DNA, 17 bp, Homo sapiens
tctgaaaggtgctttct

SEQ ID NO: 6434301 - DNA, 17 bp, Homo sapiens
tctgaaagtaaaacaat

SEQ ID NO: 6434302 - DNA, 22 bp, Homo sapiens
tctgaaagtatattttcctccc

SEQ ID NO: 6434303 - DNA, 23 bp, Homo sapiens
tctgaaagtatcaccaaaaaatc

SEQ ID NO: 6434304 - DNA, 19 bp, Homo sapiens
tctgaaagttacccactga

SEQ ID NO: 6434305 - DNA, 17 bp, Homo sapiens
tctgaaagttgtacatg

SEQ ID NO: 6434306 - DNA, 15 bp, Homo sapiens
tctgaaagttttgat

SEQ ID NO: 6434307 - DNA, 16 bp, Homo sapiens
tctgaaagttttgata

SEQ ID NO: 6434308 - DNA, 19 bp, Homo sapiens
tctgaaataaaatgccata

SEQ ID NO: 6434309 - DNA, 16 bp, Homo sapiens
tctgaaataaatgttc

SEQ ID NO: 6434310 - DNA, 22 bp, Homo sapiens
tctgaaatacaaccagaaacaa

SEQ ID NO: 6434311 - DNA, 18 bp, Homo sapiens
tctgaaatcgccgtgtta

SEQ ID NO: 6434312 - DNA, 14 bp, Homo sapiens
tctgaaatctcctt

SEQ ID NO: 6434313 - DNA, 13 bp, Homo sapiens
tctgaaatgaaga

SEQ ID NO: 6434314 - DNA, 12 bp, Homo sapiens
tctgaaatgcac

SEQ ID NO: 6434315 - DNA, 21 bp, Homo sapiens
tctgaaatgtcagttctgata

SEQ ID NO: 6434316 - DNA, 14 bp, Homo sapiens
tctgaaatgtgata

SEQ ID NO: 6434317 - DNA, 20 bp, Homo sapiens
tctgaaatgttacaaaaata

SEQ ID NO: 6434318 - DNA, 22 bp, Homo sapiens
tctgaaatgttacaaaaataaa

SEQ ID NO: 6434319 - DNA, 17 bp, Homo sapiens
tctgaaattaaagtatg

SEQ ID NO: 6434320 - DNA, 14 bp, Homo sapiens
tctgaaattctaaa

SEQ ID NO: 6434321 - DNA, 14 bp, Homo sapiens
tctgaaatttcctg

SEQ ID NO: 6434322 - DNA, 22 bp, Homo sapiens
tctgaaattttctagaatacta

SEQ ID NO: 6434323 - DNA, 14 bp, Homo sapiens
tctgaaatttttct

SEQ ID NO: 6434324 - DNA, 20 bp, Homo sapiens
tctgaaatttttttcctaag

SEQ ID NO: 6434325 - DNA, 13 bp, Homo sapiens
tctgaacaaaagc

SEQ ID NO: 6434326 - DNA, 13 bp, Homo sapiens
tctgaacaaacac

SEQ ID NO: 6434327 - DNA, 16 bp, Homo sapiens
tctgaacaaacactga

SEQ ID NO: 6434328 - DNA, 21 bp, Homo sapiens
tctgaacaaacactgaatcat

SEQ ID NO: 6434329 - DNA, 11 bp, Homo sapiens
tctgaacaaag

SEQ ID NO: 6434330 - DNA, 23 bp, Homo sapiens
tctgaacacacacgccagctcct

SEQ ID NO: 6434331 - DNA, 15 bp, Homo sapiens
tctgaacacacattg

SEQ ID NO: 6434332 - DNA, 17 bp, Homo sapiens
tctgaacacaggcagct

SEQ ID NO: 6434333 - DNA, 18 bp, Homo sapiens
tctgaacacaggcagctt

SEQ ID NO: 6434334 - DNA, 21 bp, Homo sapiens
tctgaacacatactagaaagc

SEQ ID NO: 6434335 - DNA, 17 bp, Homo sapiens
tctgaacactttaggta

SEQ ID NO: 6434336 - DNA, 20 bp, Homo sapiens
tctgaacagctggtgtagct

SEQ ID NO: 6434337 - DNA, 13 bp, Homo sapiens
tctgaacatctgg

SEQ ID NO: 6434338 - DNA, 17 bp, Homo sapiens
tctgaaccaatagaaag

SEQ ID NO: 6434339 - DNA, 19 bp, Homo sapiens
tctgaaccaatagaaagca

SEQ ID NO: 6434340 - DNA, 20 bp, Homo sapiens
tctgaaccaatagaaagcaa

SEQ ID NO: 6434341 - DNA, 16 bp, Homo sapiens
tctgaaccattaaagt

SEQ ID NO: 6434342 - DNA, 13 bp, Homo sapiens
tctgaacccagct

SEQ ID NO: 6434343 - DNA, 18 bp, Homo sapiens
tctgaacccaggcagctg

SEQ ID NO: 6434344 - DNA, 20 bp, Homo sapiens
tctgaacccaggcagctggc

SEQ ID NO: 6434345 - DNA, 16 bp, Homo sapiens
tctgaaccccctttcc

SEQ ID NO: 6434346 - DNA, 17 bp, Homo sapiens
tctgaacccttccacca

SEQ ID NO: 6434347 - DNA, 13 bp, Homo sapiens
tctgaactaaagt

SEQ ID NO: 6434348 - DNA, 15 bp, Homo sapiens
tcagatgtaatgttt

SEQ ID NO: 6434349 - DNA, 16 bp, Homo sapiens
tcagatgtaatgtttt

SEQ ID NO: 6434350 - DNA, 14 bp, Homo sapiens
tcagatgtcccttg

SEQ ID NO: 6434351 - DNA, 17 bp, Homo sapiens
tcagatgtcttctgcct

SEQ ID NO: 6434352 - DNA, 19 bp, Homo sapiens
tcagatgtcttctgcctgt

SEQ ID NO: 6434353 - DNA, 21 bp, Homo sapiens
tcagatgtcttctgcctgtta

SEQ ID NO: 6434354 - DNA, 14 bp, Homo sapiens
tcagatgtgcaata

SEQ ID NO: 6434355 - DNA, 15 bp, Homo sapiens
tcagatgtggagcca

SEQ ID NO: 6434356 - DNA, 24 bp, Homo sapiens
tcagatgtgttcctccattttctt

SEQ ID NO: 6434357 - DNA, 16 bp, Homo sapiens
tcagatgttaaaataa

SEQ ID NO: 6434358 - DNA, 18 bp, Homo sapiens
tcagatgttaaaataaat

SEQ ID NO: 6434359 - DNA, 20 bp, Homo sapiens
tcagatgttaaaataaatgg

SEQ ID NO: 6434360 - DNA, 15 bp, Homo sapiens
tcagatgtttaaaac

SEQ ID NO: 6434361 - DNA, 15 bp, Homo sapiens
tcagatgtttcatca

SEQ ID NO: 6434362 - DNA, 12 bp, Homo sapiens
tcagatgtttga

SEQ ID NO: 6434363 - DNA, 21 bp, Homo sapiens
tcagatgttttacgcaaggaa

SEQ ID NO: 6434364 - DNA, 22 bp, Homo sapiens
tcagatgttttacgcaaggaag

SEQ ID NO: 6434365 - DNA, 13 bp, Homo sapiens
tcagattagatgt

SEQ ID NO: 6434366 - DNA, 19 bp, Homo sapiens
tcagattaggacacagtgt

SEQ ID NO: 6434367 - DNA, 21 bp, Homo sapiens
tcagattccaagtgtatttaa

SEQ ID NO: 6434368 - DNA, 22 bp, Homo sapiens
tcagattccacacaaaatgtca

SEQ ID NO: 6434369 - DNA, 21 bp, Homo sapiens
tcagattccccactcagcctt

SEQ ID NO: 6434370 - DNA, 19 bp, Homo sapiens
tcagattccccccatctcc

SEQ ID NO: 6434371 - DNA, 15 bp, Homo sapiens
tcagattccttccca

SEQ ID NO: 6434372 - DNA, 15 bp, Homo sapiens
tcagattcctttccc

SEQ ID NO: 6434373 - DNA, 16 bp, Homo sapiens
tcagattctgtgagac

SEQ ID NO: 6434374 - DNA, 13 bp, Homo sapiens
tcagattcttgca

SEQ ID NO: 6434375 - DNA, 14 bp, Homo sapiens
tcagattcttgctg

SEQ ID NO: 6434376 - DNA, 22 bp, Homo sapiens
tcagattgacaaggtagacatg

SEQ ID NO: 6434377 - DNA, 22 bp, Homo sapiens
tcagattgactaaataaaaagt

SEQ ID NO: 6434378 - DNA, 17 bp, Homo sapiens
tcagattgcatgtgact

SEQ ID NO: 6434379 - DNA, 18 bp, Homo sapiens
tcagattgcatgtgactc

SEQ ID NO: 6434380 - DNA, 14 bp, Homo sapiens
tcagattgctggga

SEQ ID NO: 6434381 - DNA, 16 bp, Homo sapiens
tcagattgctgggagg

SEQ ID NO: 6434382 - DNA, 19 bp, Homo sapiens
tcagattgcttaaaagcat

SEQ ID NO: 6434383 - DNA, 18 bp, Homo sapiens
tcagattggacataactg

SEQ ID NO: 6434384 - DNA, 12 bp, Homo sapiens
tcagattgtaaa

SEQ ID NO: 6434385 - DNA, 13 bp, Homo sapiens
tcagattgtatct

SEQ ID NO: 6434386 - DNA, 14 bp, Homo sapiens
tcagattgtatctg

SEQ ID NO: 6434387 - DNA, 14 bp, Homo sapiens
tcagattgtcttgc

SEQ ID NO: 6434388 - DNA, 18 bp, Homo sapiens
tcagattgtggaatgttg

SEQ ID NO: 6434389 - DNA, 23 bp, Homo sapiens
tcagatttaacctgttatttcta

SEQ ID NO: 6434390 - DNA, 22 bp, Homo sapiens
tcagatttaagccttacaaagg

SEQ ID NO: 6434391 - DNA, 14 bp, Homo sapiens
tcagatttaccata

SEQ ID NO: 6434392 - DNA, 13 bp, Homo sapiens
tcagatttcaaat

SEQ ID NO: 6434393 - DNA, 22 bp, Homo sapiens
tcagatttctagttttttttct

SEQ ID NO: 6434394 - DNA, 16 bp, Homo sapiens
tcagatttctctttga

SEQ ID NO: 6434395 - DNA, 21 bp, Homo sapiens
tcagatttgaactcttcaatc

SEQ ID NO: 6434396 - DNA, 15 bp, Homo sapiens
tcagatttgcacaaa

SEQ ID NO: 6434397 - DNA, 16 bp, Homo sapiens
tcagatttgcacaaaa

SEQ ID NO: 6434398 - DNA, 19 bp, Homo sapiens
tcagatttgcacaaaaaga

SEQ ID NO: 6434399 - DNA, 20 bp, Homo sapiens
tcagatttggtgatggaaaa

SEQ ID NO: 6434400 - DNA, 21 bp, Homo sapiens
tcagatttggtgatggaaaaa

SEQ ID NO: 6434401 - DNA, 18 bp, Homo sapiens
tcagattttatattttct

SEQ ID NO: 6434402 - DNA, 19 bp, Homo sapiens
tcagattttatattttcta

SEQ ID NO: 6434403 - DNA, 21 bp, Homo sapiens
tcagattttatattttctatt

SEQ ID NO: 6434404 - DNA, 13 bp, Homo sapiens
tcagattttatta

SEQ ID NO: 6434405 - DNA, 16 bp, Homo sapiens
tcagattttattatgt

SEQ ID NO: 6434406 - DNA, 19 bp, Homo sapiens
tcagattttattatgtaaa

SEQ ID NO: 6434407 - DNA, 22 bp, Homo sapiens
tcagattttattatgtaaatcc

SEQ ID NO: 6434408 - DNA, 23 bp, Homo sapiens
tcagattttattatgtaaatccc

SEQ ID NO: 6434409 - DNA, 17 bp, Homo sapiens
tcagatttttaaagttt

SEQ ID NO: 6434410 - DNA, 19 bp, Homo sapiens
tcagatttttaaagttttg

SEQ ID NO: 6434411 - DNA, 18 bp, Homo sapiens
tcagatttttatttatga

SEQ ID NO: 6434412 - DNA, 21 bp, Homo sapiens
tcagcaaaaagcaaaatcatt

SEQ ID NO: 6434413 - DNA, 19 bp, Homo sapiens
tcagcaaaaatattttatg

SEQ ID NO: 6434414 - DNA, 22 bp, Homo sapiens
tcagcaaaaatctcccagtgac

SEQ ID NO: 6434415 - DNA, 15 bp, Homo sapiens
tcagcaaacacaata

SEQ ID NO: 6434416 - DNA, 19 bp, Homo sapiens
tcagcaaacccaaagatgt

SEQ ID NO: 6434417 - DNA, 24 bp, Homo sapiens
tcagcaaacccaaagatgttaaca

SEQ ID NO: 6434418 - DNA, 15 bp, Homo sapiens
tcagcaaagaaaaaa

SEQ ID NO: 6434419 - DNA, 18 bp, Homo sapiens
tcagcaaagtggttccct

SEQ ID NO: 6434420 - DNA, 20 bp, Homo sapiens
tcagcaaagtggttccctct

SEQ ID NO: 6434421 - DNA, 12 bp, Homo sapiens
tcagcaaatcct

SEQ ID NO: 6434422 - DNA, 16 bp, Homo sapiens
tcagcaaatgcctttt

SEQ ID NO: 6434423 - DNA, 17 bp, Homo sapiens
tcagcaaatttaagaga

SEQ ID NO: 6434424 - DNA, 19 bp, Homo sapiens
tcagcaacaagactgccag

SEQ ID NO: 6434425 - DNA, 14 bp, Homo sapiens
tcagcaacttattt

SEQ ID NO: 6434426 - DNA, 19 bp, Homo sapiens
tcagcaacttattttgctt

SEQ ID NO: 6434427 - DNA, 23 bp, Homo sapiens
tcagcaactttcccttgccctgg

SEQ ID NO: 6434428 - DNA, 15 bp, Homo sapiens
tcagcaagagagaac

SEQ ID NO: 6434429 - DNA, 16 bp, Homo sapiens
tcagcaagagagaacc

SEQ ID NO: 6434430 - DNA, 17 bp, Homo sapiens
tcagcaagctgcccagc

SEQ ID NO: 6434431 - DNA, 20 bp, Homo sapiens
tcagcaagctgcccagccct

SEQ ID NO: 6434432 - DNA, 22 bp, Homo sapiens
tcagcaagctgcccagccctgg

SEQ ID NO: 6434433 - DNA, 16 bp, Homo sapiens
tcagcaaggccacctc

SEQ ID NO: 6434434 - DNA, 19 bp, Homo sapiens
tcagcaaggcgctaacttg

SEQ ID NO: 6434435 - DNA, 20 bp, Homo sapiens
tcagcaaggcgctaacttgc

SEQ ID NO: 6434436 - DNA, 20 bp, Homo sapiens
tcagcaaggggctctgccct

SEQ ID NO: 6434437 - DNA, 15 bp, Homo sapiens
tcagcaagtgcccag

SEQ ID NO: 6434438 - DNA, 16 bp, Homo sapiens
tcagcaagtgtacagt

SEQ ID NO: 6434439 - DNA, 17 bp, Homo sapiens
tcagcaataatatgtga

SEQ ID NO: 6434440 - DNA, 19 bp, Homo sapiens
tcagcaatactcatcagag

SEQ ID NO: 6434441 - DNA, 21 bp, Homo sapiens
tcagcaatattgcctgtgctt

SEQ ID NO: 6434442 - DNA, 14 bp, Homo sapiens
tcagcaatgaagaa

SEQ ID NO: 6434443 - DNA, 18 bp, Homo sapiens
tcagcaattaaagacatt

SEQ ID NO: 6434444 - DNA, 19 bp, Homo sapiens
tcagcaatttaactagaca

SEQ ID NO: 6434445 - DNA, 19 bp, Homo sapiens
tcagcacaaggccatctgg

SEQ ID NO: 6434446 - DNA, 19 bp, Homo sapiens
tcagcacaatctgtaaatt

SEQ ID NO: 6434447 - DNA, 17 bp, Homo sapiens
tcagcacaccccaaggg

SEQ ID NO: 6434448 - DNA, 21 bp, Homo sapiens
tcagcacaccccaagggacaa

SEQ ID NO: 6434449 - DNA, 18 bp, Homo sapiens
tcagcacagcctcacccc

SEQ ID NO: 6434450 - DNA, 23 bp, Homo sapiens
tcagcacagctctcctcctccat

SEQ ID NO: 6434451 - DNA, 21 bp, Homo sapiens
tcagcacaggaattctcaaga

SEQ ID NO: 6434452 - DNA, 16 bp, Homo sapiens
tcagcacatatgggaa

SEQ ID NO: 6434453 - DNA, 18 bp, Homo sapiens
tcagcacatattttctgt

SEQ ID NO: 6434454 - DNA, 16 bp, Homo sapiens
tcagcacatctcaaca

SEQ ID NO: 6434455 - DNA, 15 bp, Homo sapiens
tcagcacatgcacta

SEQ ID NO: 6434456 - DNA, 18 bp, Homo sapiens
tcagcacatgcactactg

SEQ ID NO: 6434457 - DNA, 15 bp, Homo sapiens
tcagcaccactcaag

SEQ ID NO: 6434458 - DNA, 20 bp, Homo sapiens
tcagcaccactcaagaccaa

SEQ ID NO: 6434459 - DNA, 12 bp, Homo sapiens
tcagcaccccac

SEQ ID NO: 6434460 - DNA, 14 bp, Homo sapiens
tcagcaccccactc

SEQ ID NO: 6434461 - DNA, 12 bp, Homo sapiens
tcagcaccccca

SEQ ID NO: 6434462 - DNA, 13 bp, Homo sapiens
tcagcacccccac

SEQ ID NO: 6434463 - DNA, 22 bp, Homo sapiens
tcagcacccccaccaaacttta

SEQ ID NO: 6434464 - DNA, 19 bp, Homo sapiens
tcagcacccccacccacct

SEQ ID NO: 6434465 - DNA, 15 bp, Homo sapiens
tcagcacccctccag

SEQ ID NO: 6434466 - DNA, 14 bp, Homo sapiens
tcagcaccccttcc

SEQ ID NO: 6434467 - DNA, 15 bp, Homo sapiens
tcagcaccctgggtg

SEQ ID NO: 6434468 - DNA, 21 bp, Homo sapiens
tcagcaccgtggtgtgaggcc

SEQ ID NO: 6434469 - DNA, 20 bp, Homo sapiens
tcagcacctacagtgtacag

SEQ ID NO: 6434470 - DNA, 14 bp, Homo sapiens
tcagcaccttggcc

SEQ ID NO: 6434471 - DNA, 23 bp, Homo sapiens
tcagcaccttggcccaggagctc

SEQ ID NO: 6434472 - DNA, 15 bp, Homo sapiens
tcagcactctggact

SEQ ID NO: 6434473 - DNA, 16 bp, Homo sapiens
tcagcactctggactc

SEQ ID NO: 6434474 - DNA, 11 bp, Homo sapiens
tcagcactgaa

SEQ ID NO: 6434475 - DNA, 13 bp, Homo sapiens
tcagcactgaaaa

SEQ ID NO: 6434476 - DNA, 14 bp, Homo sapiens
tcagcactgaaaat

SEQ ID NO: 6434477 - DNA, 21 bp, Homo sapiens
tcagcactgaaaataccatca

SEQ ID NO: 6434478 - DNA, 18 bp, Homo sapiens
tcagcactgcctgctccc

SEQ ID NO: 6434479 - DNA, 12 bp, Homo sapiens
tcagcactggat

SEQ ID NO: 6434480 - DNA, 13 bp, Homo sapiens
tcagcactgtccc

SEQ ID NO: 6434481 - DNA, 20 bp, Homo sapiens
tcagcactttaaagaggctg

SEQ ID NO: 6434482 - DNA, 20 bp, Homo sapiens
tcagcactttccctctgcag

SEQ ID NO: 6434483 - DNA, 17 bp, Homo sapiens
tcagcagaaatgaaatc

SEQ ID NO: 6434484 - DNA, 20 bp, Homo sapiens
tcagcagaacctgcacacag

SEQ ID NO: 6434485 - DNA, 15 bp, Homo sapiens
tcagcagaaggcctt

SEQ ID NO: 6434486 - DNA, 15 bp, Homo sapiens
tcagcagaatgactc

SEQ ID NO: 6434487 - DNA, 15 bp, Homo sapiens
tcagcagacacacat

SEQ ID NO: 6434488 - DNA, 23 bp, Homo sapiens
tcagcagacacacatgggcagcc

SEQ ID NO: 6434489 - DNA, 15 bp, Homo sapiens
tcagcagagccgccc

SEQ ID NO: 6434490 - DNA, 20 bp, Homo sapiens
tcagcagaggcagtggccac

SEQ ID NO: 6434491 - DNA, 19 bp, Homo sapiens
tcagcagatgccagtgaag

SEQ ID NO: 6434492 - DNA, 15 bp, Homo sapiens
tcagcagcaaaacca

SEQ ID NO: 6434493 - DNA, 22 bp, Homo sapiens
tcagcagcaaaaccaaactggg

SEQ ID NO: 6434494 - DNA, 21 bp, Homo sapiens
tcagcagcaaatgccactctg

SEQ ID NO: 6434495 - DNA, 18 bp, Homo sapiens
tcagcagcagctcacacc

SEQ ID NO: 6434496 - DNA, 15 bp, Homo sapiens
tcagcagcagctctg

SEQ ID NO: 6434497 - DNA, 16 bp, Homo sapiens
tcagcagcagctctga

SEQ ID NO: 6434498 - DNA, 20 bp, Homo sapiens
tcagcagcagttggatcttt

SEQ ID NO: 6434499 - DNA, 23 bp, Homo sapiens
tcagcagccagtctcagagacca

SEQ ID NO: 6434500 - DNA, 17 bp, Homo sapiens
tcagcagccccctgccc

SEQ ID NO: 6434501 - DNA, 12 bp, Homo sapiens
tcagcagcccta

SEQ ID NO: 6434502 - DNA, 15 bp, Homo sapiens
tcagcagccctcctc

SEQ ID NO: 6434503 - DNA, 23 bp, Homo sapiens
tcagcagccgccttaagctgatc

SEQ ID NO: 6434504 - DNA, 20 bp, Homo sapiens
tcagcagcctcactgcatct

SEQ ID NO: 6434505 - DNA, 23 bp, Homo sapiens
tcagcagcgaccacccctgcctc

SEQ ID NO: 6434506 - DNA, 16 bp, Homo sapiens
tcagcagcgtgcaata

SEQ ID NO: 6434507 - DNA, 17 bp, Homo sapiens
tcagcaggaagcaacga

SEQ ID NO: 6434508 - DNA, 21 bp, Homo sapiens
tcagcaggaagggtgggaagg

SEQ ID NO: 6434509 - DNA, 12 bp, Homo sapiens
tcagcaggaggc

SEQ ID NO: 6434510 - DNA, 15 bp, Homo sapiens
tcagcaggcagcctt

SEQ ID NO: 6434511 - DNA, 17 bp, Homo sapiens
tcagcaggcaggctggg

SEQ ID NO: 6434512 - DNA, 12 bp, Homo sapiens
tcagcaggccca

SEQ ID NO: 6434513 - DNA, 15 bp, Homo sapiens
tcagcaggcccagga

SEQ ID NO: 6434514 - DNA, 16 bp, Homo sapiens
tcagcaggcccaggag

SEQ ID NO: 6434515 - DNA, 13 bp, Homo sapiens
tcagcagggacca

SEQ ID NO: 6434516 - DNA, 12 bp, Homo sapiens
tcagcagggctg

SEQ ID NO: 6434517 - DNA, 21 bp, Homo sapiens
tcagcagggctggtcacctcc

SEQ ID NO: 6434518 - DNA, 23 bp, Homo sapiens
tcagcaggggatggcgctagggg

SEQ ID NO: 6434519 - DNA, 17 bp, Homo sapiens
tcagcaggggtgggagg

SEQ ID NO: 6434520 - DNA, 18 bp, Homo sapiens
tcagcaggggtgggaggc

SEQ ID NO: 6434521 - DNA, 22 bp, Homo sapiens
tcagcaggttggcttttttccc

SEQ ID NO: 6434522 - DNA, 15 bp, Homo sapiens
tcagcagtattctat

SEQ ID NO: 6434523 - DNA, 22 bp, Homo sapiens
tcagcagtctaaattttctaaa

SEQ ID NO: 6434524 - DNA, 17 bp, Homo sapiens
tcagcagtgagagcaga

SEQ ID NO: 6434525 - DNA, 14 bp, Homo sapiens
tcagcagtggcagg

SEQ ID NO: 6434526 - DNA, 22 bp, Homo sapiens
tctgaactatcagggcaagctc

SEQ ID NO: 6434527 - DNA, 16 bp, Homo sapiens
tctgaactcaaactga

SEQ ID NO: 6434528 - DNA, 17 bp, Homo sapiens
tctgaactcaaactgag

SEQ ID NO: 6434529 - DNA, 15 bp, Homo sapiens
tctgaactcaagctg

SEQ ID NO: 6434530 - DNA, 21 bp, Homo sapiens
tctgaactcgcttctctgtga

SEQ ID NO: 6434531 - DNA, 12 bp, Homo sapiens
tctgaactgcac

SEQ ID NO: 6434532 - DNA, 16 bp, Homo sapiens
tctgaactgctgctgg

SEQ ID NO: 6434533 - DNA, 17 bp, Homo sapiens
tctgaactgctgctggt

SEQ ID NO: 6434534 - DNA, 20 bp, Homo sapiens
tctgaactggactagtgaaa

SEQ ID NO: 6434535 - DNA, 15 bp, Homo sapiens
tctgaactggagcca

SEQ ID NO: 6434536 - DNA, 19 bp, Homo sapiens
tctgaactggtagaaaaac

SEQ ID NO: 6434537 - DNA, 23 bp, Homo sapiens
tctgaacttgagtataagataaa

SEQ ID NO: 6434538 - DNA, 20 bp, Homo sapiens
tctgaacttggcgctgcccc

SEQ ID NO: 6434539 - DNA, 21 bp, Homo sapiens
tctgaacttggcgctgcccct

SEQ ID NO: 6434540 - DNA, 13 bp, Homo sapiens
tctgaactttgga

SEQ ID NO: 6434541 - DNA, 17 bp, Homo sapiens
tctgaactttggagagt

SEQ ID NO: 6434542 - DNA, 21 bp, Homo sapiens
tctgaactttgggaagccttt

SEQ ID NO: 6434543 - DNA, 15 bp, Homo sapiens
tctgaagaaaaatta

SEQ ID NO: 6434544 - DNA, 12 bp, Homo sapiens
tctgaagaagat

SEQ ID NO: 6434545 - DNA, 23 bp, Homo sapiens
tctgaagaaggaaggcctgagcc

SEQ ID NO: 6434546 - DNA, 19 bp, Homo sapiens
tctgaagactgagaacttt

SEQ ID NO: 6434547 - DNA, 18 bp, Homo sapiens
tctgaagagcctgaagct

SEQ ID NO: 6434548 - DNA, 19 bp, Homo sapiens
tctgaagagcctgaagctg

SEQ ID NO: 6434549 - DNA, 20 bp, Homo sapiens
tctgaagagcctgaagctgg

SEQ ID NO: 6434550 - DNA, 19 bp, Homo sapiens
tctgaagaggcttctcctg

SEQ ID NO: 6434551 - DNA, 20 bp, Homo sapiens
tctgaagaggcttctcctgt

SEQ ID NO: 6434552 - DNA, 22 bp, Homo sapiens
tctgaagagtgggtttcacaag

SEQ ID NO: 6434553 - DNA, 20 bp, Homo sapiens
tctgaagatatatttcactt

SEQ ID NO: 6434554 - DNA, 22 bp, Homo sapiens
tctgaagatatatttcactttt

SEQ ID NO: 6434555 - DNA, 18 bp, Homo sapiens
tctgaagattgtttatct

SEQ ID NO: 6434556 - DNA, 19 bp, Homo sapiens
tctgaagatttccatttgt

SEQ ID NO: 6434557 - DNA, 13 bp, Homo sapiens
tctgaagcaaggc

SEQ ID NO: 6434558 - DNA, 12 bp, Homo sapiens
tctgaagcatgt

SEQ ID NO: 6434559 - DNA, 13 bp, Homo sapiens
tctgaagcatgtt

SEQ ID NO: 6434560 - DNA, 14 bp, Homo sapiens
tctgaagcatgttt

SEQ ID NO: 6434561 - DNA, 15 bp, Homo sapiens
tctgaagcatgtttc

SEQ ID NO: 6434562 - DNA, 21 bp, Homo sapiens
tctgaagcatgtttcatgttt

SEQ ID NO: 6434563 - DNA, 21 bp, Homo sapiens
tctgaagccatgtagccaccc

SEQ ID NO: 6434564 - DNA, 22 bp, Homo sapiens
tctgaagcccaaagcctgagga

SEQ ID NO: 6434565 - DNA, 17 bp, Homo sapiens
tctgaagccctcccagg

SEQ ID NO: 6434566 - DNA, 17 bp, Homo sapiens
tctgaagcgactctcct

SEQ ID NO: 6434567 - DNA, 18 bp, Homo sapiens
tctgaagctagaaacaat

SEQ ID NO: 6434568 - DNA, 20 bp, Homo sapiens
tctgaagctattgatgtttc

SEQ ID NO: 6434569 - DNA, 17 bp, Homo sapiens
tctgaagctcaactctc

SEQ ID NO: 6434570 - DNA, 18 bp, Homo sapiens
tctgaagctgctgcagct

SEQ ID NO: 6434571 - DNA, 19 bp, Homo sapiens
tctgaagcttatgtttctt

SEQ ID NO: 6434572 - DNA, 14 bp, Homo sapiens
tctgaagcttgact

SEQ ID NO: 6434573 - DNA, 21 bp, Homo sapiens
tctgaagctttaccagctgaa

SEQ ID NO: 6434574 - DNA, 15 bp, Homo sapiens
tctgaaggaagagaa

SEQ ID NO: 6434575 - DNA, 16 bp, Homo sapiens
tctgaaggacacttcc

SEQ ID NO: 6434576 - DNA, 21 bp, Homo sapiens
tctgaaggacattgcggacag

SEQ ID NO: 6434577 - DNA, 13 bp, Homo sapiens
tctgaaggactgg

SEQ ID NO: 6434578 - DNA, 15 bp, Homo sapiens
tctgaaggagaggag

SEQ ID NO: 6434579 - DNA, 20 bp, Homo sapiens
tctgaaggagaggaggaatt

SEQ ID NO: 6434580 - DNA, 12 bp, Homo sapiens
tctgaaggagat

SEQ ID NO: 6434581 - DNA, 19 bp, Homo sapiens
tctgaaggaggccacctcc

SEQ ID NO: 6434582 - DNA, 18 bp, Homo sapiens
tctgaaggatcctggaac

SEQ ID NO: 6434583 - DNA, 13 bp, Homo sapiens
tctgaaggcctcc

SEQ ID NO: 6434584 - DNA, 17 bp, Homo sapiens
tctgaaggccttgttaa

SEQ ID NO: 6434585 - DNA, 23 bp, Homo sapiens
tctgaaggcgtcaacgtgcattt

SEQ ID NO: 6434586 - DNA, 12 bp, Homo sapiens
tctgaagggagg

SEQ ID NO: 6434587 - DNA, 16 bp, Homo sapiens
tctgaagggaggggaa

SEQ ID NO: 6434588 - DNA, 14 bp, Homo sapiens
tctgaagggaggtg

SEQ ID NO: 6434589 - DNA, 23 bp, Homo sapiens
tctgaaggggaaaacctcagttg

SEQ ID NO: 6434590 - DNA, 23 bp, Homo sapiens
tctgaagtaatttgtaaaaaaga

SEQ ID NO: 6434591 - DNA, 13 bp, Homo sapiens
tctgaagtactta

SEQ ID NO: 6434592 - DNA, 20 bp, Homo sapiens
tctgaagtcacatcacagga

SEQ ID NO: 6434593 - DNA, 16 bp, Homo sapiens
tctgaagtcactgcac

SEQ ID NO: 6434594 - DNA, 17 bp, Homo sapiens
tctgaagtcccttcctg

SEQ ID NO: 6434595 - DNA, 14 bp, Homo sapiens
tctgaagtctgagc

SEQ ID NO: 6434596 - DNA, 16 bp, Homo sapiens
tctgaagtctgagccc

SEQ ID NO: 6434597 - DNA, 20 bp, Homo sapiens
tctgaagtctgagcccattt

SEQ ID NO: 6434598 - DNA, 15 bp, Homo sapiens
tctgaagtctggaac

SEQ ID NO: 6434599 - DNA, 19 bp, Homo sapiens
tctgaagtctggaacactt

SEQ ID NO: 6434600 - DNA, 22 bp, Homo sapiens
tctgaagtgaaactgcttgttt

SEQ ID NO: 6434601 - DNA, 13 bp, Homo sapiens
tctgaagtgccta

SEQ ID NO: 6434602 - DNA, 19 bp, Homo sapiens
tctgaagtgcttgtatagc

SEQ ID NO: 6434603 - DNA, 20 bp, Homo sapiens
tctgaagtgggaaaaaatag

SEQ ID NO: 6434604 - DNA, 23 bp, Homo sapiens
tctgaagtggttcagtctagaag

SEQ ID NO: 6434605 - DNA, 15 bp, Homo sapiens
tctgaagttggcccc

SEQ ID NO: 6434606 - DNA, 16 bp, Homo sapiens
tctgaagtttcattta

SEQ ID NO: 6434607 - DNA, 22 bp, Homo sapiens
tctgaagttttattttaaatta

SEQ ID NO: 6434608 - DNA, 18 bp, Homo sapiens
tctgaataaaaaagattc

SEQ ID NO: 6434609 - DNA, 19 bp, Homo sapiens
tctgaataaaaaagattct

SEQ ID NO: 6434610 - DNA, 20 bp, Homo sapiens
tctgaataaaaaagattcta

SEQ ID NO: 6434611 - DNA, 14 bp, Homo sapiens
tctgaataaagcaa

SEQ ID NO: 6434612 - DNA, 17 bp, Homo sapiens
tctgaataaagtgtaac

SEQ ID NO: 6434613 - DNA, 21 bp, Homo sapiens
tctgaatacaaacatttcact

SEQ ID NO: 6434614 - DNA, 14 bp, Homo sapiens
tctgaatacacagt

SEQ ID NO: 6434615 - DNA, 15 bp, Homo sapiens
tctgaatacacagta

SEQ ID NO: 6434616 - DNA, 19 bp, Homo sapiens
tctgaatacctctttgaaa

SEQ ID NO: 6434617 - DNA, 20 bp, Homo sapiens
tctgaatagtgtcaccaatt

SEQ ID NO: 6434618 - DNA, 19 bp, Homo sapiens
tctgaatataggaagcata

SEQ ID NO: 6434619 - DNA, 17 bp, Homo sapiens
tctgaatattaagaaac

SEQ ID NO: 6434620 - DNA, 24 bp, Homo sapiens
tctgaatattagatgctctgagaa

SEQ ID NO: 6434621 - DNA, 16 bp, Homo sapiens
tctgaatattctagaa

SEQ ID NO: 6434622 - DNA, 17 bp, Homo sapiens
tctgaatattctagaac

SEQ ID NO: 6434623 - DNA, 14 bp, Homo sapiens
tctgaatattttgt

SEQ ID NO: 6434624 - DNA, 20 bp, Homo sapiens
tctgaatcaagcacactgta

SEQ ID NO: 6434625 - DNA, 21 bp, Homo sapiens
tctgaatcaccaattaaaaac

SEQ ID NO: 6434626 - DNA, 19 bp, Homo sapiens
tctgaatcagaaaagctat

SEQ ID NO: 6434627 - DNA, 15 bp, Homo sapiens
tctgaatcatgtctg

SEQ ID NO: 6434628 - DNA, 17 bp, Homo sapiens
tctgaatcatgtctgta

SEQ ID NO: 6434629 - DNA, 13 bp, Homo sapiens
tctgaatcctaag

SEQ ID NO: 6434630 - DNA, 13 bp, Homo sapiens
tctgaatctgaag

SEQ ID NO: 6434631 - DNA, 16 bp, Homo sapiens
tctgaatctgtacatg

SEQ ID NO: 6434632 - DNA, 23 bp, Homo sapiens
tctgaatgaagccttctgacctg

SEQ ID NO: 6434633 - DNA, 18 bp, Homo sapiens
tctgaatgagcctttgtg

SEQ ID NO: 6434634 - DNA, 22 bp, Homo sapiens
tctgaatgctgagctgaagaaa

SEQ ID NO: 6434635 - DNA, 13 bp, Homo sapiens
tctgaatgcttct

SEQ ID NO: 6434636 - DNA, 19 bp, Homo sapiens
tctgaatgcttctaagtaa

SEQ ID NO: 6434637 - DNA, 18 bp, Homo sapiens
tctgaatgggagccagaa

SEQ ID NO: 6434638 - DNA, 18 bp, Homo sapiens
tctgaatggtgcgtgaag

SEQ ID NO: 6434639 - DNA, 21 bp, Homo sapiens
tctgaatgtaatttgtgtaat

SEQ ID NO: 6434640 - DNA, 23 bp, Homo sapiens
tctgaatgtaatttgtgtaataa

SEQ ID NO: 6434641 - DNA, 18 bp, Homo sapiens
tctgaatgtagccagccc

SEQ ID NO: 6434642 - DNA, 19 bp, Homo sapiens
tctgaatgtagccagccca

SEQ ID NO: 6434643 - DNA, 15 bp, Homo sapiens
tctgaatgtatttat

SEQ ID NO: 6434644 - DNA, 20 bp, Homo sapiens
tctgaatgtatttatgtgta

SEQ ID NO: 6434645 - DNA, 14 bp, Homo sapiens
tctgaatgtcccag

SEQ ID NO: 6434646 - DNA, 13 bp, Homo sapiens
tctgaatgttctg

SEQ ID NO: 6434647 - DNA, 16 bp, Homo sapiens
tctgaatgttctgaca

SEQ ID NO: 6434648 - DNA, 16 bp, Homo sapiens
tctgaatgtttgtgtc

SEQ ID NO: 6434649 - DNA, 18 bp, Homo sapiens
tctgaatgtttgtgtctg

SEQ ID NO: 6434650 - DNA, 21 bp, Homo sapiens
tctgaatgtttgtgtctgtgg

SEQ ID NO: 6434651 - DNA, 22 bp, Homo sapiens
tctgaatgtttgtgtctgtggt

SEQ ID NO: 6434652 - DNA, 12 bp, Homo sapiens
tctgaattataa

SEQ ID NO: 6434653 - DNA, 12 bp, Homo sapiens
tctgaattattt

SEQ ID NO: 6434654 - DNA, 20 bp, Homo sapiens
tctgaattatttttaaagat

SEQ ID NO: 6434655 - DNA, 21 bp, Homo sapiens
tctgaattcaaagcttgtgaa

SEQ ID NO: 6434656 - DNA, 14 bp, Homo sapiens
tctgaattcaggtc

SEQ ID NO: 6434657 - DNA, 18 bp, Homo sapiens
tctgaattcataaaaata

SEQ ID NO: 6434658 - DNA, 14 bp, Homo sapiens
tctgaattgagaaa

SEQ ID NO: 6434659 - DNA, 20 bp, Homo sapiens
tctgaattggaatgcactca

SEQ ID NO: 6434660 - DNA, 18 bp, Homo sapiens
tctgaattgttgaaacta

SEQ ID NO: 6434661 - DNA, 18 bp, Homo sapiens
tctgaattgttggggttt

SEQ ID NO: 6434662 - DNA, 21 bp, Homo sapiens
tctgaatttacttccttgcat

SEQ ID NO: 6434663 - DNA, 17 bp, Homo sapiens
tctgaatttatctttga

SEQ ID NO: 6434664 - DNA, 19 bp, Homo sapiens
tctgaatttatctttgata

SEQ ID NO: 6434665 - DNA, 20 bp, Homo sapiens
tctgaatttcattctcttga

SEQ ID NO: 6434666 - DNA, 20 bp, Homo sapiens
tctgaatttctaaaaccctt

SEQ ID NO: 6434667 - DNA, 19 bp, Homo sapiens
tctgaatttgcaaagtact

SEQ ID NO: 6434668 - DNA, 22 bp, Homo sapiens
tctgaatttgcaaagtactgta

SEQ ID NO: 6434669 - DNA, 17 bp, Homo sapiens
tctgaattttaaaacat

SEQ ID NO: 6434670 - DNA, 20 bp, Homo sapiens
tctgaattttgcaatgtatt

SEQ ID NO: 6434671 - DNA, 15 bp, Homo sapiens
tctgaatttttaaac

SEQ ID NO: 6434672 - DNA, 20 bp, Homo sapiens
tctgacaaaatggggcagaa

SEQ ID NO: 6434673 - DNA, 23 bp, Homo sapiens
tctgacaaaatggggcagaagag

SEQ ID NO: 6434674 - DNA, 14 bp, Homo sapiens
tctgacaaactgtg

SEQ ID NO: 6434675 - DNA, 16 bp, Homo sapiens
tctgacaaattcaaaa

SEQ ID NO: 6434676 - DNA, 17 bp, Homo sapiens
tctgacaagctggccaa

SEQ ID NO: 6434677 - DNA, 22 bp, Homo sapiens
tctgacaattaacatacatcat

SEQ ID NO: 6434678 - DNA, 13 bp, Homo sapiens
tctgacacaaaaa

SEQ ID NO: 6434679 - DNA, 14 bp, Homo sapiens
tctgacacacagct

SEQ ID NO: 6434680 - DNA, 17 bp, Homo sapiens
tctgacacacagctctg

SEQ ID NO: 6434681 - DNA, 18 bp, Homo sapiens
tctgacacacagctctgt

SEQ ID NO: 6434682 - DNA, 23 bp, Homo sapiens
tctgacaccctttaatgttctat

SEQ ID NO: 6434683 - DNA, 21 bp, Homo sapiens
tctgacacctattttagacaa

SEQ ID NO: 6434684 - DNA, 13 bp, Homo sapiens
tctgacagcagca

SEQ ID NO: 6434685 - DNA, 17 bp, Homo sapiens
tctgacagcagcatctc

SEQ ID NO: 6434686 - DNA, 14 bp, Homo sapiens
tctgacagcagcct

SEQ ID NO: 6434687 - DNA, 17 bp, Homo sapiens
tctgacagcagcctgtg

SEQ ID NO: 6434688 - DNA, 18 bp, Homo sapiens
tctgacagcagcctgtga

SEQ ID NO: 6434689 - DNA, 23 bp, Homo sapiens
tctgacagcagcctgtgagggag

SEQ ID NO: 6434690 - DNA, 21 bp, Homo sapiens
tctgacaggaagactggagac

SEQ ID NO: 6434691 - DNA, 22 bp, Homo sapiens
tctgacaggaagactggagact

SEQ ID NO: 6434692 - DNA, 17 bp, Homo sapiens
tctgacaggtgaattgg

SEQ ID NO: 6434693 - DNA, 13 bp, Homo sapiens
tctgacagtagct

SEQ ID NO: 6434694 - DNA, 19 bp, Homo sapiens
tctgacagtattaacatca

SEQ ID NO: 6434695 - DNA, 13 bp, Homo sapiens
tctgacagtcctt

SEQ ID NO: 6434696 - DNA, 19 bp, Homo sapiens
tctgacagtccttggggtt

SEQ ID NO: 6434697 - DNA, 17 bp, Homo sapiens
tctgacagtctcaaatt

SEQ ID NO: 6434698 - DNA, 22 bp, Homo sapiens
tctgacagttactcttcagttt

SEQ ID NO: 6434699 - DNA, 23 bp, Homo sapiens
tctgacagttactcttcagtttt

SEQ ID NO: 6434700 - DNA, 17 bp, Homo sapiens
tctgacagtttttctgt

SEQ ID NO: 6434701 - DNA, 13 bp, Homo sapiens
tctgacatattat

SEQ ID NO: 6434702 - DNA, 16 bp, Homo sapiens
tctgacatcaaaactt

SEQ ID NO: 6434703 - DNA, 12 bp, Homo sapiens
tcagcagtgtct

SEQ ID NO: 6434704 - DNA, 14 bp, Homo sapiens
tcagcagttcactt

SEQ ID NO: 6434705 - DNA, 15 bp, Homo sapiens
tcagcagttgacatc

SEQ ID NO: 6434706 - DNA, 13 bp, Homo sapiens
tcagcagttgctg

SEQ ID NO: 6434707 - DNA, 14 bp, Homo sapiens
tcagcagtttctga

SEQ ID NO: 6434708 - DNA, 20 bp, Homo sapiens
tcagcatagaaggaagtgtg

SEQ ID NO: 6434709 - DNA, 19 bp, Homo sapiens
tcagcatagagctatatat

SEQ ID NO: 6434710 - DNA, 14 bp, Homo sapiens
tcagcatagcctgc

SEQ ID NO: 6434711 - DNA, 23 bp, Homo sapiens
tcagcatagcctgcctgatccct

SEQ ID NO: 6434712 - DNA, 13 bp, Homo sapiens
tcagcatatatat

SEQ ID NO: 6434713 - DNA, 20 bp, Homo sapiens
tcagcatatatataaaatac

SEQ ID NO: 6434714 - DNA, 17 bp, Homo sapiens
tcagcatatgtgtaaag

SEQ ID NO: 6434715 - DNA, 21 bp, Homo sapiens
tcagcatcaaacatgaaaaca

SEQ ID NO: 6434716 - DNA, 17 bp, Homo sapiens
tcagcatcaagtatgtg

SEQ ID NO: 6434717 - DNA, 13 bp, Homo sapiens
tcagcatcactga

SEQ ID NO: 6434718 - DNA, 23 bp, Homo sapiens
tcagcatcactgatgggaataaa

SEQ ID NO: 6434719 - DNA, 19 bp, Homo sapiens
tcagcatccaaaagcagga

SEQ ID NO: 6434720 - DNA, 20 bp, Homo sapiens
tcagcatccaaaagcaggaa

SEQ ID NO: 6434721 - DNA, 12 bp, Homo sapiens
tcagcatccagt

SEQ ID NO: 6434722 - DNA, 16 bp, Homo sapiens
tcagcatcctggaaat

SEQ ID NO: 6434723 - DNA, 19 bp, Homo sapiens
tcagcatcgtgtgggtccc

SEQ ID NO: 6434724 - DNA, 14 bp, Homo sapiens
tcagcatctgacca

SEQ ID NO: 6434725 - DNA, 22 bp, Homo sapiens
tcagcatctgaccatctgtgac

SEQ ID NO: 6434726 - DNA, 19 bp, Homo sapiens
tcagcatctttgcccttct

SEQ ID NO: 6434727 - DNA, 20 bp, Homo sapiens
tcagcatctttgcccttctg

SEQ ID NO: 6434728 - DNA, 13 bp, Homo sapiens
tcagcatgaattt

SEQ ID NO: 6434729 - DNA, 15 bp, Homo sapiens
tcagcatgaatttgt

SEQ ID NO: 6434730 - DNA, 14 bp, Homo sapiens
tcagcatgacaaaa

SEQ ID NO: 6434731 - DNA, 15 bp, Homo sapiens
tcagcatgcttccca

SEQ ID NO: 6434732 - DNA, 17 bp, Homo sapiens
tcagcatgcttcccaga

SEQ ID NO: 6434733 - DNA, 18 bp, Homo sapiens
tcagcatgcttcccagag

SEQ ID NO: 6434734 - DNA, 21 bp, Homo sapiens
tcagcatgcttcccagaggga

SEQ ID NO: 6434735 - DNA, 14 bp, Homo sapiens
tcagcatgttttct

SEQ ID NO: 6434736 - DNA, 16 bp, Homo sapiens
tcagcatgttttctgc

SEQ ID NO: 6434737 - DNA, 19 bp, Homo sapiens
tcagcattacctctttgga

SEQ ID NO: 6434738 - DNA, 20 bp, Homo sapiens
tcagcattacctctttggaa

SEQ ID NO: 6434739 - DNA, 20 bp, Homo sapiens
tcagcattagagaaatgaat

SEQ ID NO: 6434740 - DNA, 17 bp, Homo sapiens
tcagcattagtgggaaa

SEQ ID NO: 6434741 - DNA, 15 bp, Homo sapiens
tcagcattattgaaa

SEQ ID NO: 6434742 - DNA, 20 bp, Homo sapiens
tcagcattcaaaatagttct

SEQ ID NO: 6434743 - DNA, 14 bp, Homo sapiens
tcagcattccctcc

SEQ ID NO: 6434744 - DNA, 19 bp, Homo sapiens
tcagcattgtgacttggag

SEQ ID NO: 6434745 - DNA, 19 bp, Homo sapiens
tcagcattgtttcaaaata

SEQ ID NO: 6434746 - DNA, 20 bp, Homo sapiens
tcagcattgtttcaaaatag

SEQ ID NO: 6434747 - DNA, 20 bp, Homo sapiens
tcagcatttaataaatgtat

SEQ ID NO: 6434748 - DNA, 19 bp, Homo sapiens
tcagcatttccttccagcc

SEQ ID NO: 6434749 - DNA, 13 bp, Homo sapiens
tcagcatttcttt

SEQ ID NO: 6434750 - DNA, 19 bp, Homo sapiens
tcagcatttcttttctggc

SEQ ID NO: 6434751 - DNA, 22 bp, Homo sapiens
tcagcatttcttttctggccaa

SEQ ID NO: 6434752 - DNA, 17 bp, Homo sapiens
tcagcatttgatctgtt

SEQ ID NO: 6434753 - DNA, 20 bp, Homo sapiens
tcagcatttgttctttgcca

SEQ ID NO: 6434754 - DNA, 23 bp, Homo sapiens
tcagcattttttatcaggcagga

SEQ ID NO: 6434755 - DNA, 14 bp, Homo sapiens
tcagccaaacagta

SEQ ID NO: 6434756 - DNA, 14 bp, Homo sapiens
tcagccaaatgtaa

SEQ ID NO: 6434757 - DNA, 22 bp, Homo sapiens
tcagccaaatgtaattgaataa

SEQ ID NO: 6434758 - DNA, 23 bp, Homo sapiens
tcagccaaatgtaattgaataaa

SEQ ID NO: 6434759 - DNA, 15 bp, Homo sapiens
tcagccaagcacagt

SEQ ID NO: 6434760 - DNA, 20 bp, Homo sapiens
tcagccaagcacagtggtgg

SEQ ID NO: 6434761 - DNA, 22 bp, Homo sapiens
tcagccaaggttttataaggct

SEQ ID NO: 6434762 - DNA, 14 bp, Homo sapiens
tcagccaagtttta

SEQ ID NO: 6434763 - DNA, 13 bp, Homo sapiens
tcagccaattatg

SEQ ID NO: 6434764 - DNA, 14 bp, Homo sapiens
tcagccacactggg

SEQ ID NO: 6434765 - DNA, 20 bp, Homo sapiens
tcagccacactgggcctgga

SEQ ID NO: 6434766 - DNA, 19 bp, Homo sapiens
tcagccacatgccccaggc

SEQ ID NO: 6434767 - DNA, 20 bp, Homo sapiens
tcagccacatgccccaggct

SEQ ID NO: 6434768 - DNA, 22 bp, Homo sapiens
tcagccacatgccccaggctct

SEQ ID NO: 6434769 - DNA, 20 bp, Homo sapiens
tcagccaccctgaggcctct

SEQ ID NO: 6434770 - DNA, 17 bp, Homo sapiens
tcagccaccctgagttg

SEQ ID NO: 6434771 - DNA, 16 bp, Homo sapiens
tcagccaccctttctg

SEQ ID NO: 6434772 - DNA, 19 bp, Homo sapiens
tcagccaccctttctggca

SEQ ID NO: 6434773 - DNA, 16 bp, Homo sapiens
tcagccacctccctct

SEQ ID NO: 6434774 - DNA, 17 bp, Homo sapiens
tcagccacctccctctg

SEQ ID NO: 6434775 - DNA, 20 bp, Homo sapiens
tcagccacctccctctgcca

SEQ ID NO: 6434776 - DNA, 14 bp, Homo sapiens
tcagccacctggga

SEQ ID NO: 6434777 - DNA, 17 bp, Homo sapiens
tcagccacgaccagccc

SEQ ID NO: 6434778 - DNA, 19 bp, Homo sapiens
tcagccacgaccagcccct

SEQ ID NO: 6434779 - DNA, 21 bp, Homo sapiens
tcagccacgaccagccccttc

SEQ ID NO: 6434780 - DNA, 16 bp, Homo sapiens
tcagccacgcctctct

SEQ ID NO: 6434781 - DNA, 21 bp, Homo sapiens
tcagccactaagaacccctct

SEQ ID NO: 6434782 - DNA, 19 bp, Homo sapiens
tcagccactgtcacaggca

SEQ ID NO: 6434783 - DNA, 20 bp, Homo sapiens
tcagccagaatcttcgtcct

SEQ ID NO: 6434784 - DNA, 17 bp, Homo sapiens
tcagccagccccatcag

SEQ ID NO: 6434785 - DNA, 18 bp, Homo sapiens
tcagccagccctcttctg

SEQ ID NO: 6434786 - DNA, 16 bp, Homo sapiens
tcagccagcctccttg

SEQ ID NO: 6434787 - DNA, 23 bp, Homo sapiens
tcagccagctaccccttgtgggc

SEQ ID NO: 6434788 - DNA, 12 bp, Homo sapiens
tcagccagctgc

SEQ ID NO: 6434789 - DNA, 16 bp, Homo sapiens
tcagccagctgcccac

SEQ ID NO: 6434790 - DNA, 12 bp, Homo sapiens
tcagccagctta

SEQ ID NO: 6434791 - DNA, 13 bp, Homo sapiens
tcagccaggacca

SEQ ID NO: 6434792 - DNA, 19 bp, Homo sapiens
tcagccaggcaagaaagct

SEQ ID NO: 6434793 - DNA, 18 bp, Homo sapiens
tcagccaggcctgtcatg

SEQ ID NO: 6434794 - DNA, 16 bp, Homo sapiens
tcagccaggctgctaa

SEQ ID NO: 6434795 - DNA, 16 bp, Homo sapiens
tcagccagggccaggg

SEQ ID NO: 6434796 - DNA, 18 bp, Homo sapiens
tcagccagtggggatgag

SEQ ID NO: 6434797 - DNA, 20 bp, Homo sapiens
tcagccataaagtgccagtt

SEQ ID NO: 6434798 - DNA, 18 bp, Homo sapiens
tcagccatcaacaagagt

SEQ ID NO: 6434799 - DNA, 23 bp, Homo sapiens
tcagccatccgcagactgcttgg

SEQ ID NO: 6434800 - DNA, 20 bp, Homo sapiens
tcagccatcgtcctgggact

SEQ ID NO: 6434801 - DNA, 18 bp, Homo sapiens
tcagccatgggaacctca

SEQ ID NO: 6434802 - DNA, 20 bp, Homo sapiens
tcagccatgggaacctcata

SEQ ID NO: 6434803 - DNA, 15 bp, Homo sapiens
tcagccatgtacaga

SEQ ID NO: 6434804 - DNA, 16 bp, Homo sapiens
tcagccatgtctgtgc

SEQ ID NO: 6434805 - DNA, 19 bp, Homo sapiens
tcagccatgtctgtgctgt

SEQ ID NO: 6434806 - DNA, 21 bp, Homo sapiens
tcagccatgtctgtgctgtgt

SEQ ID NO: 6434807 - DNA, 14 bp, Homo sapiens
tcagccatgtttgg

SEQ ID NO: 6434808 - DNA, 22 bp, Homo sapiens
tcagccattaaaataaaacaag

SEQ ID NO: 6434809 - DNA, 14 bp, Homo sapiens
tcagccattcacaa

SEQ ID NO: 6434810 - DNA, 16 bp, Homo sapiens
tcagccattcactgcc

SEQ ID NO: 6434811 - DNA, 14 bp, Homo sapiens
tcagccattcctgt

SEQ ID NO: 6434812 - DNA, 19 bp, Homo sapiens
tcagccattcctgttctct

SEQ ID NO: 6434813 - DNA, 20 bp, Homo sapiens
tcagccatttccccctcctc

SEQ ID NO: 6434814 - DNA, 17 bp, Homo sapiens
tcagcccacagcagcaa

SEQ ID NO: 6434815 - DNA, 16 bp, Homo sapiens
tcagcccaccaccctg

SEQ ID NO: 6434816 - DNA, 14 bp, Homo sapiens
tcagcccacccccc

SEQ ID NO: 6434817 - DNA, 18 bp, Homo sapiens
tcagcccacccccctcat

SEQ ID NO: 6434818 - DNA, 14 bp, Homo sapiens
tcagcccacctgca

SEQ ID NO: 6434819 - DNA, 15 bp, Homo sapiens
tcagcccacctgcac

SEQ ID NO: 6434820 - DNA, 17 bp, Homo sapiens
tcagcccacctgcaccc

SEQ ID NO: 6434821 - DNA, 15 bp, Homo sapiens
tcagcccagcacctg

SEQ ID NO: 6434822 - DNA, 20 bp, Homo sapiens
tcagcccagcacctgctccc

SEQ ID NO: 6434823 - DNA, 12 bp, Homo sapiens
tcagcccagctg

SEQ ID NO: 6434824 - DNA, 21 bp, Homo sapiens
tcagcccaggcttttgctaga

SEQ ID NO: 6434825 - DNA, 17 bp, Homo sapiens
tcagcccaggtcccagt

SEQ ID NO: 6434826 - DNA, 13 bp, Homo sapiens
tcagcccaggtct

SEQ ID NO: 6434827 - DNA, 15 bp, Homo sapiens
tcagcccagtgcaaa

SEQ ID NO: 6434828 - DNA, 20 bp, Homo sapiens
tcagcccatcccctgcctct

SEQ ID NO: 6434829 - DNA, 13 bp, Homo sapiens
tcagcccatggag

SEQ ID NO: 6434830 - DNA, 18 bp, Homo sapiens
tcagcccatggaggcaga

SEQ ID NO: 6434831 - DNA, 22 bp, Homo sapiens
tcagcccatggaggcagatgcc

SEQ ID NO: 6434832 - DNA, 13 bp, Homo sapiens
tcagccccaaggg

SEQ ID NO: 6434833 - DNA, 18 bp, Homo sapiens
tcagccccaccccagggc

SEQ ID NO: 6434834 - DNA, 23 bp, Homo sapiens
tcagccccaccccagggcagcca

SEQ ID NO: 6434835 - DNA, 12 bp, Homo sapiens
tcagccccagcc

SEQ ID NO: 6434836 - DNA, 16 bp, Homo sapiens
tcagccccaggagaag

SEQ ID NO: 6434837 - DNA, 19 bp, Homo sapiens
tcagccccaggagaaggga

SEQ ID NO: 6434838 - DNA, 13 bp, Homo sapiens
tcagccccaggcc

SEQ ID NO: 6434839 - DNA, 16 bp, Homo sapiens
tcagccccaggccagc

SEQ ID NO: 6434840 - DNA, 17 bp, Homo sapiens
tcagccccaggccagct

SEQ ID NO: 6434841 - DNA, 21 bp, Homo sapiens
tcagccccaggccagctgcgg

SEQ ID NO: 6434842 - DNA, 13 bp, Homo sapiens
tcagccccatcgc

SEQ ID NO: 6434843 - DNA, 21 bp, Homo sapiens
tcagccccatcgccccaactc

SEQ ID NO: 6434844 - DNA, 22 bp, Homo sapiens
tcagcccccaccacaaacacag

SEQ ID NO: 6434845 - DNA, 14 bp, Homo sapiens
tcagcccccaccag

SEQ ID NO: 6434846 - DNA, 19 bp, Homo sapiens
tcagcccccaccaggggaa

SEQ ID NO: 6434847 - DNA, 14 bp, Homo sapiens
tcagcccccaggat

SEQ ID NO: 6434848 - DNA, 19 bp, Homo sapiens
tcagcccccaggatctggg

SEQ ID NO: 6434849 - DNA, 20 bp, Homo sapiens
tcagcccccaggatctgggt

SEQ ID NO: 6434850 - DNA, 15 bp, Homo sapiens
tcagcccccaggcca

SEQ ID NO: 6434851 - DNA, 18 bp, Homo sapiens
tcagcccccatcacccaa

SEQ ID NO: 6434852 - DNA, 21 bp, Homo sapiens
tcagcccccatcacccaagcc

SEQ ID NO: 6434853 - DNA, 16 bp, Homo sapiens
tcagccccctgcttca

SEQ ID NO: 6434854 - DNA, 16 bp, Homo sapiens
tcagccccgacttcct

SEQ ID NO: 6434855 - DNA, 21 bp, Homo sapiens
tcagccccgacttcctgactc

SEQ ID NO: 6434856 - DNA, 18 bp, Homo sapiens
tcagccccgcctgtcaca

SEQ ID NO: 6434857 - DNA, 19 bp, Homo sapiens
tcagccccgcctgtcacaa

SEQ ID NO: 6434858 - DNA, 20 bp, Homo sapiens
tcagccccgcctgtcacaat

SEQ ID NO: 6434859 - DNA, 18 bp, Homo sapiens
tcagccccggccactccc

SEQ ID NO: 6434860 - DNA, 16 bp, Homo sapiens
tcagcccctacccctg

SEQ ID NO: 6434861 - DNA, 20 bp, Homo sapiens
tcagcccctacccctgccct

SEQ ID NO: 6434862 - DNA, 22 bp, Homo sapiens
tcagcccctacccctgccctgc

SEQ ID NO: 6434863 - DNA, 15 bp, Homo sapiens
tcagcccctcttccc

SEQ ID NO: 6434864 - DNA, 19 bp, Homo sapiens
tcagcccctcttcccttcc

SEQ ID NO: 6434865 - DNA, 20 bp, Homo sapiens
tcagcccctcttcccttcct

SEQ ID NO: 6434866 - DNA, 23 bp, Homo sapiens
tcagcccctcttgccccccaccc

SEQ ID NO: 6434867 - DNA, 22 bp, Homo sapiens
tcagcccctgatcctgtgaagt

SEQ ID NO: 6434868 - DNA, 14 bp, Homo sapiens
tcagcccctgatct

SEQ ID NO: 6434869 - DNA, 21 bp, Homo sapiens
tcagcccctgctgctcctcgg

SEQ ID NO: 6434870 - DNA, 13 bp, Homo sapiens
tcagcccctggga

SEQ ID NO: 6434871 - DNA, 23 bp, Homo sapiens
tcagccccttaatctattttcag

SEQ ID NO: 6434872 - DNA, 13 bp, Homo sapiens
tcagccccttccc

SEQ ID NO: 6434873 - DNA, 14 bp, Homo sapiens
tcagccccttcccg

SEQ ID NO: 6434874 - DNA, 21 bp, Homo sapiens
tcagcccgggatcctgatggc

SEQ ID NO: 6434875 - DNA, 17 bp, Homo sapiens
tcagcccggtgtgagga

SEQ ID NO: 6434876 - DNA, 18 bp, Homo sapiens
tcagcccggtgtgaggag

SEQ ID NO: 6434877 - DNA, 23 bp, Homo sapiens
tcagccctagaggcgagccaggc

SEQ ID NO: 6434878 - DNA, 18 bp, Homo sapiens
tcagccctagccctcagc

SEQ ID NO: 6434879 - DNA, 15 bp, Homo sapiens
tcagccctcacaccc

SEQ ID NO: 6434880 - DNA, 14 bp, Homo sapiens
tcagccctcagaag

SEQ ID NO: 6434881 - DNA, 20 bp, Homo sapiens
tctgacatcaagtgtaatta

SEQ ID NO: 6434882 - DNA, 13 bp, Homo sapiens
tctgacatccctt

SEQ ID NO: 6434883 - DNA, 18 bp, Homo sapiens
tctgacatcccttcctgg

SEQ ID NO: 6434884 - DNA, 18 bp, Homo sapiens
tctgacatgattccttcc

SEQ ID NO: 6434885 - DNA, 16 bp, Homo sapiens
tctgacatgcattgtt

SEQ ID NO: 6434886 - DNA, 20 bp, Homo sapiens
tctgacatgtaagaaaatgt

SEQ ID NO: 6434887 - DNA, 22 bp, Homo sapiens
tctgacatgtaagaaaatgtta

SEQ ID NO: 6434888 - DNA, 19 bp, Homo sapiens
tctgacattaacagttttc

SEQ ID NO: 6434889 - DNA, 21 bp, Homo sapiens
tctgacattaacagttttcca

SEQ ID NO: 6434890 - DNA, 22 bp, Homo sapiens
tctgacattaacagttttccat

SEQ ID NO: 6434891 - DNA, 17 bp, Homo sapiens
tctgacattctgattcg

SEQ ID NO: 6434892 - DNA, 18 bp, Homo sapiens
tctgaccaaaaccagagg

SEQ ID NO: 6434893 - DNA, 20 bp, Homo sapiens
tctgaccaaaaccagagggc

SEQ ID NO: 6434894 - DNA, 23 bp, Homo sapiens
tctgaccaaaaccagagggcagt

SEQ ID NO: 6434895 - DNA, 19 bp, Homo sapiens
tctgaccaaaatgtgtttc

SEQ ID NO: 6434896 - DNA, 16 bp, Homo sapiens
tctgaccacagacact

SEQ ID NO: 6434897 - DNA, 13 bp, Homo sapiens
tctgaccacgtgc

SEQ ID NO: 6434898 - DNA, 19 bp, Homo sapiens
tctgaccacttgaggcctg

SEQ ID NO: 6434899 - DNA, 13 bp, Homo sapiens
tctgaccagcagc

SEQ ID NO: 6434900 - DNA, 17 bp, Homo sapiens
tctgaccagcagcgcct

SEQ ID NO: 6434901 - DNA, 18 bp, Homo sapiens
tctgaccagcagcgcctt

SEQ ID NO: 6434902 - DNA, 15 bp, Homo sapiens
tctgaccatctgtga

SEQ ID NO: 6434903 - DNA, 19 bp, Homo sapiens
tctgaccatctgtgactat

SEQ ID NO: 6434904 - DNA, 21 bp, Homo sapiens
tctgaccatgaggtgggggtt

SEQ ID NO: 6434905 - DNA, 22 bp, Homo sapiens
tctgacccaagaggtggggacc

SEQ ID NO: 6434906 - DNA, 17 bp, Homo sapiens
tctgacccactgatctc

SEQ ID NO: 6434907 - DNA, 14 bp, Homo sapiens
tctgacccactgct

SEQ ID NO: 6434908 - DNA, 11 bp, Homo sapiens
tctgacccagt

SEQ ID NO: 6434909 - DNA, 21 bp, Homo sapiens
tctgacccagtgagattacag

SEQ ID NO: 6434910 - DNA, 13 bp, Homo sapiens
tctgacccagtgc

SEQ ID NO: 6434911 - DNA, 14 bp, Homo sapiens
tctgacccagtgcc

SEQ ID NO: 6434912 - DNA, 15 bp, Homo sapiens
tctgacccagtgccc

SEQ ID NO: 6434913 - DNA, 19 bp, Homo sapiens
tctgacccagtgcccccac

SEQ ID NO: 6434914 - DNA, 14 bp, Homo sapiens
tctgacccatgctg

SEQ ID NO: 6434915 - DNA, 18 bp, Homo sapiens
tctgacccctcctcactg

SEQ ID NO: 6434916 - DNA, 22 bp, Homo sapiens
tctgacccggttgcagtcactg

SEQ ID NO: 6434917 - DNA, 12 bp, Homo sapiens
tctgaccctccc

SEQ ID NO: 6434918 - DNA, 23 bp, Homo sapiens
tctgaccctcccagtctcatctc

SEQ ID NO: 6434919 - DNA, 14 bp, Homo sapiens
tctgaccctccttc

SEQ ID NO: 6434920 - DNA, 14 bp, Homo sapiens
tctgaccctctcca

SEQ ID NO: 6434921 - DNA, 23 bp, Homo sapiens
tctgacccttacagcctctgact

SEQ ID NO: 6434922 - DNA, 21 bp, Homo sapiens
tctgaccgaaacagcgctggg

SEQ ID NO: 6434923 - DNA, 12 bp, Homo sapiens
tctgacctcagc

SEQ ID NO: 6434924 - DNA, 13 bp, Homo sapiens
tctgacctcagca

SEQ ID NO: 6434925 - DNA, 14 bp, Homo sapiens
tctgacctccatga

SEQ ID NO: 6434926 - DNA, 12 bp, Homo sapiens
tctgacctcccc

SEQ ID NO: 6434927 - DNA, 14 bp, Homo sapiens
tctgacctcctcct

SEQ ID NO: 6434928 - DNA, 17 bp, Homo sapiens
tctgacctcctctgggc

SEQ ID NO: 6434929 - DNA, 21 bp, Homo sapiens
tctgacctcctctgggccctg

SEQ ID NO: 6434930 - DNA, 22 bp, Homo sapiens
tctgacctgcaaaaatgctgga

SEQ ID NO: 6434931 - DNA, 18 bp, Homo sapiens
tctgacctgcactgggga

SEQ ID NO: 6434932 - DNA, 15 bp, Homo sapiens
tctgacctgcaggcc

SEQ ID NO: 6434933 - DNA, 16 bp, Homo sapiens
tctgaccttattactg

SEQ ID NO: 6434934 - DNA, 22 bp, Homo sapiens
tctgaccttccagagcccaagg

SEQ ID NO: 6434935 - DNA, 20 bp, Homo sapiens
tctgacgaaggtcctaaggg

SEQ ID NO: 6434936 - DNA, 18 bp, Homo sapiens
tctgacgcaccactgcca

SEQ ID NO: 6434937 - DNA, 22 bp, Homo sapiens
tctgacgcaccactgccaatgc

SEQ ID NO: 6434938 - DNA, 15 bp, Homo sapiens
tctgacgcagcctga

SEQ ID NO: 6434939 - DNA, 17 bp, Homo sapiens
tctgacgcagcctgaga

SEQ ID NO: 6434940 - DNA, 22 bp, Homo sapiens
tctgacgcttgtgacagtgcct

SEQ ID NO: 6434941 - DNA, 15 bp, Homo sapiens
tctgacggccctgca

SEQ ID NO: 6434942 - DNA, 23 bp, Homo sapiens
tctgacgtgccttttgcacccct

SEQ ID NO: 6434943 - DNA, 18 bp, Homo sapiens
tctgactagtagatttct

SEQ ID NO: 6434944 - DNA, 20 bp, Homo sapiens
tctgactagtagatttctat

SEQ ID NO: 6434945 - DNA, 12 bp, Homo sapiens
tctgactataac

SEQ ID NO: 6434946 - DNA, 16 bp, Homo sapiens
tctgactatgacataa

SEQ ID NO: 6434947 - DNA, 18 bp, Homo sapiens
tctgactcaggcgcctgg

SEQ ID NO: 6434948 - DNA, 19 bp, Homo sapiens
tctgactcaggcgcctggc

SEQ ID NO: 6434949 - DNA, 23 bp, Homo sapiens
tctgactcaggcgcctggcacat

SEQ ID NO: 6434950 - DNA, 14 bp, Homo sapiens
tctgactcagggct

SEQ ID NO: 6434951 - DNA, 12 bp, Homo sapiens
tctgactccaaa

SEQ ID NO: 6434952 - DNA, 15 bp, Homo sapiens
tctgactccagagtc

SEQ ID NO: 6434953 - DNA, 16 bp, Homo sapiens
tctgactccagagtct

SEQ ID NO: 6434954 - DNA, 17 bp, Homo sapiens
tctgactccagagtctg

SEQ ID NO: 6434955 - DNA, 21 bp, Homo sapiens
tctgactccagagtctgagcc

SEQ ID NO: 6434956 - DNA, 12 bp, Homo sapiens
tctgactcccaa

SEQ ID NO: 6434957 - DNA, 16 bp, Homo sapiens
tctgactccctcccca

SEQ ID NO: 6434958 - DNA, 19 bp, Homo sapiens
tctgactccctccccaccc

SEQ ID NO: 6434959 - DNA, 12 bp, Homo sapiens
tctgactctaaa

SEQ ID NO: 6434960 - DNA, 22 bp, Homo sapiens
tctgactctccgcggtggttgt

SEQ ID NO: 6434961 - DNA, 14 bp, Homo sapiens
tctgactcttgcct

SEQ ID NO: 6434962 - DNA, 17 bp, Homo sapiens
tctgactcttgcctttc

SEQ ID NO: 6434963 - DNA, 22 bp, Homo sapiens
tctgactgatggtttggaaaat

SEQ ID NO: 6434964 - DNA, 18 bp, Homo sapiens
tctgactgccaagccaga

SEQ ID NO: 6434965 - DNA, 12 bp, Homo sapiens
tctgactgcccc

SEQ ID NO: 6434966 - DNA, 16 bp, Homo sapiens
tctgactgtccctgcc

SEQ ID NO: 6434967 - DNA, 12 bp, Homo sapiens
tctgactgtgtg

SEQ ID NO: 6434968 - DNA, 15 bp, Homo sapiens
tctgactgtttattt

SEQ ID NO: 6434969 - DNA, 19 bp, Homo sapiens
tctgactgtttatttaagg

SEQ ID NO: 6434970 - DNA, 22 bp, Homo sapiens
tctgactgtttatttaaggatg

SEQ ID NO: 6434971 - DNA, 23 bp, Homo sapiens
tctgactgtttatttaaggatgg

SEQ ID NO: 6434972 - DNA, 22 bp, Homo sapiens
tctgacttccccaaacccagaa

SEQ ID NO: 6434973 - DNA, 23 bp, Homo sapiens
tctgacttccgtcccactgaagg

SEQ ID NO: 6434974 - DNA, 15 bp, Homo sapiens
tctgacttctcagga

SEQ ID NO: 6434975 - DNA, 12 bp, Homo sapiens
tctgacttctgc

SEQ ID NO: 6434976 - DNA, 14 bp, Homo sapiens
tctgacttctgcct

SEQ ID NO: 6434977 - DNA, 17 bp, Homo sapiens
tctgacttctgcctgga

SEQ ID NO: 6434978 - DNA, 22 bp, Homo sapiens
tctgactttaattgtgtgtctt

SEQ ID NO: 6434979 - DNA, 19 bp, Homo sapiens
tctgactttagcctaccta

SEQ ID NO: 6434980 - DNA, 20 bp, Homo sapiens
tctgactttcttttttgata

SEQ ID NO: 6434981 - DNA, 23 bp, Homo sapiens
tctgactttcttttttgatatag

SEQ ID NO: 6434982 - DNA, 15 bp, Homo sapiens
tctgactttgaattt

SEQ ID NO: 6434983 - DNA, 22 bp, Homo sapiens
tctgactttgaatttatataaa

SEQ ID NO: 6434984 - DNA, 23 bp, Homo sapiens
tctgactttgaatttatataaag

SEQ ID NO: 6434985 - DNA, 14 bp, Homo sapiens
tctgactttttgtt

SEQ ID NO: 6434986 - DNA, 18 bp, Homo sapiens
tctgactttttgtttctt

SEQ ID NO: 6434987 - DNA, 12 bp, Homo sapiens
tctgagaaaaca

SEQ ID NO: 6434988 - DNA, 14 bp, Homo sapiens
tctgagaaaacaag

SEQ ID NO: 6434989 - DNA, 22 bp, Homo sapiens
tctgagaaaagaacgtatttta

SEQ ID NO: 6434990 - DNA, 22 bp, Homo sapiens
tctgagaaaagctttgaaccct

SEQ ID NO: 6434991 - DNA, 15 bp, Homo sapiens
tctgagaaagactat

SEQ ID NO: 6434992 - DNA, 21 bp, Homo sapiens
tctgagaaagactattcaaac

SEQ ID NO: 6434993 - DNA, 23 bp, Homo sapiens
tctgagaaagactattcaaacag

SEQ ID NO: 6434994 - DNA, 18 bp, Homo sapiens
tctgagaacagtgcacaa

SEQ ID NO: 6434995 - DNA, 15 bp, Homo sapiens
tctgagaaccaaaag

SEQ ID NO: 6434996 - DNA, 13 bp, Homo sapiens
tctgagaactcat

SEQ ID NO: 6434997 - DNA, 11 bp, Homo sapiens
tctgagaagac

SEQ ID NO: 6434998 - DNA, 14 bp, Homo sapiens
tctgagaagaggag

SEQ ID NO: 6434999 - DNA, 16 bp, Homo sapiens
tctgagaagcgctgcc

SEQ ID NO: 6435000 - DNA, 20 bp, Homo sapiens
tctgagaagcgctgccctgt

SEQ ID NO: 6435001 - DNA, 20 bp, Homo sapiens
tctgagaaggccctgtgccc

SEQ ID NO: 6435002 - DNA, 23 bp, Homo sapiens
tctgagaaggggaggacctctgg

SEQ ID NO: 6435003 - DNA, 22 bp, Homo sapiens
tctgagaatctttattgagaaa

SEQ ID NO: 6435004 - DNA, 23 bp, Homo sapiens
tctgagaatctttattgagaaag

SEQ ID NO: 6435005 - DNA, 18 bp, Homo sapiens
tctgagaattccaaggag

SEQ ID NO: 6435006 - DNA, 22 bp, Homo sapiens
tctgagaattgttgagatactt

SEQ ID NO: 6435007 - DNA, 22 bp, Homo sapiens
tctgagacaaaagaaaaaatat

SEQ ID NO: 6435008 - DNA, 16 bp, Homo sapiens
tctgagaccacagagg

SEQ ID NO: 6435009 - DNA, 19 bp, Homo sapiens
tctgagacccttttctcag

SEQ ID NO: 6435010 - DNA, 22 bp, Homo sapiens
tctgagacccttttctcaggac

SEQ ID NO: 6435011 - DNA, 20 bp, Homo sapiens
tctgagacggatggaaggag

SEQ ID NO: 6435012 - DNA, 22 bp, Homo sapiens
tctgagacggatggaaggagag

SEQ ID NO: 6435013 - DNA, 16 bp, Homo sapiens
tctgagactaaatgag

SEQ ID NO: 6435014 - DNA, 16 bp, Homo sapiens
tctgagactctttaga

SEQ ID NO: 6435015 - DNA, 20 bp, Homo sapiens
tctgagagaccatctcctat

SEQ ID NO: 6435016 - DNA, 22 bp, Homo sapiens
tctgagagacctgtgtgaacta

SEQ ID NO: 6435017 - DNA, 21 bp, Homo sapiens
tctgagagaggctaaaatgtt

SEQ ID NO: 6435018 - DNA, 22 bp, Homo sapiens
tctgagagaggctaaaatgttt

SEQ ID NO: 6435019 - DNA, 14 bp, Homo sapiens
tctgagagatttgg

SEQ ID NO: 6435020 - DNA, 13 bp, Homo sapiens
tctgagagcacag

SEQ ID NO: 6435021 - DNA, 23 bp, Homo sapiens
tctgagagcacagcgtttacata

SEQ ID NO: 6435022 - DNA, 17 bp, Homo sapiens
tctgagaggccctggat

SEQ ID NO: 6435023 - DNA, 18 bp, Homo sapiens
tctgagaggccctggatc

SEQ ID NO: 6435024 - DNA, 15 bp, Homo sapiens
tctgagaggctctcc

SEQ ID NO: 6435025 - DNA, 14 bp, Homo sapiens
tctgagagtctaga

SEQ ID NO: 6435026 - DNA, 15 bp, Homo sapiens
tctgagagtctagat

SEQ ID NO: 6435027 - DNA, 16 bp, Homo sapiens
tctgagagtctagatt

SEQ ID NO: 6435028 - DNA, 17 bp, Homo sapiens
tctgagagtctagattc

SEQ ID NO: 6435029 - DNA, 22 bp, Homo sapiens
tctgagagtctagattctctgg

SEQ ID NO: 6435030 - DNA, 22 bp, Homo sapiens
tctgagagttggctcaggcaga

SEQ ID NO: 6435031 - DNA, 23 bp, Homo sapiens
tctgagatccagcacaactcagt

SEQ ID NO: 6435032 - DNA, 22 bp, Homo sapiens
tctgagatctgttgattgatga

SEQ ID NO: 6435033 - DNA, 14 bp, Homo sapiens
tctgagatgccccg

SEQ ID NO: 6435034 - DNA, 12 bp, Homo sapiens
tctgagatgcta

SEQ ID NO: 6435035 - DNA, 18 bp, Homo sapiens
tctgagatgctaatttat

SEQ ID NO: 6435036 - DNA, 14 bp, Homo sapiens
tctgagatgtgttc

SEQ ID NO: 6435037 - DNA, 18 bp, Homo sapiens
tctgagattcaatattga

SEQ ID NO: 6435038 - DNA, 15 bp, Homo sapiens
tctgagatttcacag

SEQ ID NO: 6435039 - DNA, 21 bp, Homo sapiens
tctgagatttttttgtgtatg

SEQ ID NO: 6435040 - DNA, 15 bp, Homo sapiens
tctgagcaaagcatc

SEQ ID NO: 6435041 - DNA, 18 bp, Homo sapiens
tctgagcaaaggccctgg

SEQ ID NO: 6435042 - DNA, 19 bp, Homo sapiens
tctgagcaaaggccctggg

SEQ ID NO: 6435043 - DNA, 18 bp, Homo sapiens
tctgagcaactgtgcagc

SEQ ID NO: 6435044 - DNA, 19 bp, Homo sapiens
tctgagcaactgtgcagca

SEQ ID NO: 6435045 - DNA, 23 bp, Homo sapiens
tctgagcacatagtgtcctgccc

SEQ ID NO: 6435046 - DNA, 16 bp, Homo sapiens
tctgagcaccccctca

SEQ ID NO: 6435047 - DNA, 20 bp, Homo sapiens
tctgagcaccccctcattcc

SEQ ID NO: 6435048 - DNA, 22 bp, Homo sapiens
tctgagcaccgaatattgagca

SEQ ID NO: 6435049 - DNA, 16 bp, Homo sapiens
tctgagcacgctacca

SEQ ID NO: 6435050 - DNA, 23 bp, Homo sapiens
tctgagcacgggcaaagaaaaca

SEQ ID NO: 6435051 - DNA, 16 bp, Homo sapiens
tctgagcagacagggc

SEQ ID NO: 6435052 - DNA, 13 bp, Homo sapiens
tctgagcagcctc

SEQ ID NO: 6435053 - DNA, 21 bp, Homo sapiens
tctgagcagcctctgccaggc

SEQ ID NO: 6435054 - DNA, 17 bp, Homo sapiens
tctgagcaggggcaggc

SEQ ID NO: 6435055 - DNA, 23 bp, Homo sapiens
tctgagcaggggcccctggggac

SEQ ID NO: 6435056 - DNA, 15 bp, Homo sapiens
tctgagcaggtacat

SEQ ID NO: 6435057 - DNA, 14 bp, Homo sapiens
tctgagcagtgcct

SEQ ID NO: 6435058 - DNA, 13 bp, Homo sapiens
tcagccctcagtt

SEQ ID NO: 6435059 - DNA, 24 bp, Homo sapiens
tcagccctcagttccttcatttcc

SEQ ID NO: 6435060 - DNA, 18 bp, Homo sapiens
tcagccctctcttgccaa

SEQ ID NO: 6435061 - DNA, 16 bp, Homo sapiens
tcagccctgaccctgt

SEQ ID NO: 6435062 - DNA, 24 bp, Homo sapiens
tcagccctgagctggcctcacctg

SEQ ID NO: 6435063 - DNA, 13 bp, Homo sapiens
tcagccctgagga

SEQ ID NO: 6435064 - DNA, 13 bp, Homo sapiens
tcagccctgaggt

SEQ ID NO: 6435065 - DNA, 14 bp, Homo sapiens
tcagccctgcacca

SEQ ID NO: 6435066 - DNA, 15 bp, Homo sapiens
tcagccctgcaccat

SEQ ID NO: 6435067 - DNA, 18 bp, Homo sapiens
tcagccctgctccctgcc

SEQ ID NO: 6435068 - DNA, 19 bp, Homo sapiens
tcagccctgctccctgcct

SEQ ID NO: 6435069 - DNA, 15 bp, Homo sapiens
tcagccctgctgtca

SEQ ID NO: 6435070 - DNA, 17 bp, Homo sapiens
tcagccctggccaagct

SEQ ID NO: 6435071 - DNA, 18 bp, Homo sapiens
tcagccctggccaagctt

SEQ ID NO: 6435072 - DNA, 19 bp, Homo sapiens
tcagccctggcccctgtgg

SEQ ID NO: 6435073 - DNA, 15 bp, Homo sapiens
tcagccctggcctgg

SEQ ID NO: 6435074 - DNA, 19 bp, Homo sapiens
tcagccctgggccccacca

SEQ ID NO: 6435075 - DNA, 12 bp, Homo sapiens
tcagccctgtgt

SEQ ID NO: 6435076 - DNA, 13 bp, Homo sapiens
tcagccctgtgtc

SEQ ID NO: 6435077 - DNA, 23 bp, Homo sapiens
tcagccctgtgtctgtcacaggc

SEQ ID NO: 6435078 - DNA, 17 bp, Homo sapiens
tcagccgaattgtggtg

SEQ ID NO: 6435079 - DNA, 15 bp, Homo sapiens
tcagccgactcagca

SEQ ID NO: 6435080 - DNA, 16 bp, Homo sapiens
tcagccgagaaattgg

SEQ ID NO: 6435081 - DNA, 17 bp, Homo sapiens
tcagccgagaaattggg

SEQ ID NO: 6435082 - DNA, 17 bp, Homo sapiens
tcagccgagcccagggg

SEQ ID NO: 6435083 - DNA, 20 bp, Homo sapiens
tcagccgagccgggcctggg

SEQ ID NO: 6435084 - DNA, 22 bp, Homo sapiens
tcagccgagccgggcctggggc

SEQ ID NO: 6435085 - DNA, 13 bp, Homo sapiens
tcagccgtgtggg

SEQ ID NO: 6435086 - DNA, 13 bp, Homo sapiens
tcagcctaagaga

SEQ ID NO: 6435087 - DNA, 19 bp, Homo sapiens
tcagcctacaggcctcaca

SEQ ID NO: 6435088 - DNA, 21 bp, Homo sapiens
tcagcctactccgctcactga

SEQ ID NO: 6435089 - DNA, 18 bp, Homo sapiens
tcagcctagccgacctca

SEQ ID NO: 6435090 - DNA, 21 bp, Homo sapiens
tcagcctagccgacctcagcc

SEQ ID NO: 6435091 - DNA, 22 bp, Homo sapiens
tcagcctagccgacctcagcct

SEQ ID NO: 6435092 - DNA, 18 bp, Homo sapiens
tcagcctccactccctgt

SEQ ID NO: 6435093 - DNA, 19 bp, Homo sapiens
tcagcctcccaaagtgttg

SEQ ID NO: 6435094 - DNA, 20 bp, Homo sapiens
tcagcctcccaagtagctgg

SEQ ID NO: 6435095 - DNA, 23 bp, Homo sapiens
tcagcctcccaagtagctgggat

SEQ ID NO: 6435096 - DNA, 14 bp, Homo sapiens
tcagcctcccagag

SEQ ID NO: 6435097 - DNA, 15 bp, Homo sapiens
tcagcctcccatagc

SEQ ID NO: 6435098 - DNA, 17 bp, Homo sapiens
tcagcctcccatagctg

SEQ ID NO: 6435099 - DNA, 20 bp, Homo sapiens
tcagcctcccatagctggga

SEQ ID NO: 6435100 - DNA, 19 bp, Homo sapiens
tcagcctccccctgctgct

SEQ ID NO: 6435101 - DNA, 21 bp, Homo sapiens
tcagcctcccgagtagctgag

SEQ ID NO: 6435102 - DNA, 20 bp, Homo sapiens
tcagcctccctagtagctgg

SEQ ID NO: 6435103 - DNA, 15 bp, Homo sapiens
tcagcctccctcagc

SEQ ID NO: 6435104 - DNA, 20 bp, Homo sapiens
tcagcctccctcagccccca

SEQ ID NO: 6435105 - DNA, 16 bp, Homo sapiens
tcagcctccctttgcc

SEQ ID NO: 6435106 - DNA, 20 bp, Homo sapiens
tcagcctcctgagcctgtgg

SEQ ID NO: 6435107 - DNA, 20 bp, Homo sapiens
tcagcctcctgagtagctgg

SEQ ID NO: 6435108 - DNA, 21 bp, Homo sapiens
tcagcctcctgagtagctgga

SEQ ID NO: 6435109 - DNA, 12 bp, Homo sapiens
tcagcctcctgt

SEQ ID NO: 6435110 - DNA, 13 bp, Homo sapiens
tcagcctcctgtc

SEQ ID NO: 6435111 - DNA, 13 bp, Homo sapiens
tcagcctcctgtg

SEQ ID NO: 6435112 - DNA, 21 bp, Homo sapiens
tcagcctctcaagtagctggg

SEQ ID NO: 6435113 - DNA, 17 bp, Homo sapiens
tcagcctctgctggaga

SEQ ID NO: 6435114 - DNA, 15 bp, Homo sapiens
tcagcctcttctctg

SEQ ID NO: 6435115 - DNA, 17 bp, Homo sapiens
tcagcctcttctctgca

SEQ ID NO: 6435116 - DNA, 17 bp, Homo sapiens
tcagcctgaaccccagg

SEQ ID NO: 6435117 - DNA, 19 bp, Homo sapiens
tcagcctgaaccccagggc

SEQ ID NO: 6435118 - DNA, 13 bp, Homo sapiens
tcagcctgaggct

SEQ ID NO: 6435119 - DNA, 18 bp, Homo sapiens
tcagcctgaggctgagac

SEQ ID NO: 6435120 - DNA, 11 bp, Homo sapiens
tcagcctgagt

SEQ ID NO: 6435121 - DNA, 16 bp, Homo sapiens
tcagcctgagtctcct

SEQ ID NO: 6435122 - DNA, 11 bp, Homo sapiens
tcagcctgccc

SEQ ID NO: 6435123 - DNA, 12 bp, Homo sapiens
tcagcctgccca

SEQ ID NO: 6435124 - DNA, 15 bp, Homo sapiens
tcagcctgcctgaag

SEQ ID NO: 6435125 - DNA, 18 bp, Homo sapiens
tcagcctgctccagctgt

SEQ ID NO: 6435126 - DNA, 20 bp, Homo sapiens
tcagcctgcttcttccccag

SEQ ID NO: 6435127 - DNA, 13 bp, Homo sapiens
tcagcctggaagg

SEQ ID NO: 6435128 - DNA, 12 bp, Homo sapiens
tcagcctggaga

SEQ ID NO: 6435129 - DNA, 17 bp, Homo sapiens
tcagcctggagaggcct

SEQ ID NO: 6435130 - DNA, 22 bp, Homo sapiens
tcagcctggagaggcctggggt

SEQ ID NO: 6435131 - DNA, 19 bp, Homo sapiens
tcagcctggccagacacag

SEQ ID NO: 6435132 - DNA, 18 bp, Homo sapiens
tcagcctggccatcccca

SEQ ID NO: 6435133 - DNA, 12 bp, Homo sapiens
tcagcctggcct

SEQ ID NO: 6435134 - DNA, 19 bp, Homo sapiens
tcagcctggcctgcccgtg

SEQ ID NO: 6435135 - DNA, 20 bp, Homo sapiens
tcagcctggctgggctctgg

SEQ ID NO: 6435136 - DNA, 19 bp, Homo sapiens
tcagcctgggacagtttat

SEQ ID NO: 6435137 - DNA, 22 bp, Homo sapiens
tcagcctgggcccctcagccac

SEQ ID NO: 6435138 - DNA, 18 bp, Homo sapiens
tcagcctggggctctctg

SEQ ID NO: 6435139 - DNA, 19 bp, Homo sapiens
tcagcctggggctctctga

SEQ ID NO: 6435140 - DNA, 18 bp, Homo sapiens
tcagcctggtgggcctcc

SEQ ID NO: 6435141 - DNA, 23 bp, Homo sapiens
tcagcctggttttcgtcatcttc

SEQ ID NO: 6435142 - DNA, 16 bp, Homo sapiens
tcagcctgtgctgccc

SEQ ID NO: 6435143 - DNA, 18 bp, Homo sapiens
tcagcctgttccagaagg

SEQ ID NO: 6435144 - DNA, 20 bp, Homo sapiens
tcagcctgttccagaaggag

SEQ ID NO: 6435145 - DNA, 23 bp, Homo sapiens
tcagcctgttccttcctgcagac

SEQ ID NO: 6435146 - DNA, 18 bp, Homo sapiens
tcagccttacatttgtga

SEQ ID NO: 6435147 - DNA, 20 bp, Homo sapiens
tcagccttccaagtagctgg

SEQ ID NO: 6435148 - DNA, 15 bp, Homo sapiens
tcagccttcctcctc

SEQ ID NO: 6435149 - DNA, 19 bp, Homo sapiens
tcagccttcgtgtggctcc

SEQ ID NO: 6435150 - DNA, 23 bp, Homo sapiens
tcagccttcgtgtggctcctggt

SEQ ID NO: 6435151 - DNA, 13 bp, Homo sapiens
tcagccttctcct

SEQ ID NO: 6435152 - DNA, 17 bp, Homo sapiens
tcagccttctcctccca

SEQ ID NO: 6435153 - DNA, 20 bp, Homo sapiens
tcagccttctgagtagctgg

SEQ ID NO: 6435154 - DNA, 12 bp, Homo sapiens
tcagccttcttt

SEQ ID NO: 6435155 - DNA, 15 bp, Homo sapiens
tcagccttctttttc

SEQ ID NO: 6435156 - DNA, 14 bp, Homo sapiens
tcagccttgcaaat

SEQ ID NO: 6435157 - DNA, 18 bp, Homo sapiens
tcagccttgcacacccac

SEQ ID NO: 6435158 - DNA, 22 bp, Homo sapiens
tcagccttgcacacccactgcc

SEQ ID NO: 6435159 - DNA, 14 bp, Homo sapiens
tcagccttgccaga

SEQ ID NO: 6435160 - DNA, 15 bp, Homo sapiens
tcagccttgccagag

SEQ ID NO: 6435161 - DNA, 17 bp, Homo sapiens
tcagccttgccagagat

SEQ ID NO: 6435162 - DNA, 13 bp, Homo sapiens
tcagccttgctga

SEQ ID NO: 6435163 - DNA, 19 bp, Homo sapiens
tcagccttgctgacctccc

SEQ ID NO: 6435164 - DNA, 16 bp, Homo sapiens
tcagccttgctgctct

SEQ ID NO: 6435165 - DNA, 22 bp, Homo sapiens
tcagccttggataatgctgttg

SEQ ID NO: 6435166 - DNA, 16 bp, Homo sapiens
tcagccttgtcctaat

SEQ ID NO: 6435167 - DNA, 18 bp, Homo sapiens
tcagcctttaggtcttta

SEQ ID NO: 6435168 - DNA, 13 bp, Homo sapiens
tcagcctttatca

SEQ ID NO: 6435169 - DNA, 21 bp, Homo sapiens
tcagcctttatcaagcttagt

SEQ ID NO: 6435170 - DNA, 22 bp, Homo sapiens
tcagcctttgttaaccttaaat

SEQ ID NO: 6435171 - DNA, 15 bp, Homo sapiens
tcagccttttgggaa

SEQ ID NO: 6435172 - DNA, 22 bp, Homo sapiens
tcagcgaagacgggaggaaaga

SEQ ID NO: 6435173 - DNA, 22 bp, Homo sapiens
tcagcgaagtctcatgggaagc

SEQ ID NO: 6435174 - DNA, 23 bp, Homo sapiens
tcagcgactccgttggccactcc

SEQ ID NO: 6435175 - DNA, 14 bp, Homo sapiens
tcagcgagaggcag

SEQ ID NO: 6435176 - DNA, 17 bp, Homo sapiens
tcagcgagaggcagcaa

SEQ ID NO: 6435177 - DNA, 17 bp, Homo sapiens
tcagcgcaggctgcaga

SEQ ID NO: 6435178 - DNA, 18 bp, Homo sapiens
tcagcgcaggctgcagag

SEQ ID NO: 6435179 - DNA, 22 bp, Homo sapiens
tcagcgcccccagagcccgtca

SEQ ID NO: 6435180 - DNA, 21 bp, Homo sapiens
tcagcgcccccaggcctgccc

SEQ ID NO: 6435181 - DNA, 13 bp, Homo sapiens
tcagcgccctgga

SEQ ID NO: 6435182 - DNA, 22 bp, Homo sapiens
tcagcgccctggagtcccctgg

SEQ ID NO: 6435183 - DNA, 14 bp, Homo sapiens
tcagcgcctggcct

SEQ ID NO: 6435184 - DNA, 21 bp, Homo sapiens
tcagcgcggtcctgactccgt

SEQ ID NO: 6435185 - DNA, 15 bp, Homo sapiens
tcagcgctcctcctg

SEQ ID NO: 6435186 - DNA, 16 bp, Homo sapiens
tcagcgctcctcctgt

SEQ ID NO: 6435187 - DNA, 20 bp, Homo sapiens
tcagcgctgtcaggattgcg

SEQ ID NO: 6435188 - DNA, 21 bp, Homo sapiens
tcagcggaccactcttctctc

SEQ ID NO: 6435189 - DNA, 15 bp, Homo sapiens
tcagcggagctgact

SEQ ID NO: 6435190 - DNA, 12 bp, Homo sapiens
tcagcggagggg

SEQ ID NO: 6435191 - DNA, 22 bp, Homo sapiens
tcagcggccccttgactctggg

SEQ ID NO: 6435192 - DNA, 14 bp, Homo sapiens
tcagcggctccagc

SEQ ID NO: 6435193 - DNA, 18 bp, Homo sapiens
tcagcgggagtctcctca

SEQ ID NO: 6435194 - DNA, 14 bp, Homo sapiens
tcagcgggcccagg

SEQ ID NO: 6435195 - DNA, 17 bp, Homo sapiens
tcagcgggcccaggcct

SEQ ID NO: 6435196 - DNA, 14 bp, Homo sapiens
tcagcggggacagc

SEQ ID NO: 6435197 - DNA, 23 bp, Homo sapiens
tcagcggggcagcggggctggcc

SEQ ID NO: 6435198 - DNA, 20 bp, Homo sapiens
tcagcgggtctcctcccagc

SEQ ID NO: 6435199 - DNA, 12 bp, Homo sapiens
tcagcggtgcag

SEQ ID NO: 6435200 - DNA, 22 bp, Homo sapiens
tcagcgtctccccatgctgggc

SEQ ID NO: 6435201 - DNA, 13 bp, Homo sapiens
tcagcgtggcctt

SEQ ID NO: 6435202 - DNA, 16 bp, Homo sapiens
tcagcgttaatgtaaa

SEQ ID NO: 6435203 - DNA, 19 bp, Homo sapiens
tcagctaaatgcagggaaa

SEQ ID NO: 6435204 - DNA, 14 bp, Homo sapiens
tcagctaacaaact

SEQ ID NO: 6435205 - DNA, 15 bp, Homo sapiens
tcagctaatgtcaca

SEQ ID NO: 6435206 - DNA, 23 bp, Homo sapiens
tcagctacccctgcagctgggga

SEQ ID NO: 6435207 - DNA, 18 bp, Homo sapiens
tcagctactctagttctg

SEQ ID NO: 6435208 - DNA, 15 bp, Homo sapiens
tcagctactgatttt

SEQ ID NO: 6435209 - DNA, 19 bp, Homo sapiens
tcagctacttaagagaaat

SEQ ID NO: 6435210 - DNA, 15 bp, Homo sapiens
tcagctactttccat

SEQ ID NO: 6435211 - DNA, 17 bp, Homo sapiens
tcagctagaatttctgg

SEQ ID NO: 6435212 - DNA, 16 bp, Homo sapiens
tcagctagacattgca

SEQ ID NO: 6435213 - DNA, 16 bp, Homo sapiens
tcagctagctctgcca

SEQ ID NO: 6435214 - DNA, 19 bp, Homo sapiens
tcagctatacctgcacgtt

SEQ ID NO: 6435215 - DNA, 16 bp, Homo sapiens
tcagctattaagaaaa

SEQ ID NO: 6435216 - DNA, 23 bp, Homo sapiens
tcagctatttaaaaaaaaaagag

SEQ ID NO: 6435217 - DNA, 18 bp, Homo sapiens
tcagctcaactcacagct

SEQ ID NO: 6435218 - DNA, 13 bp, Homo sapiens
tcagctcacgctt

SEQ ID NO: 6435219 - DNA, 14 bp, Homo sapiens
tcagctcactggtc

SEQ ID NO: 6435220 - DNA, 13 bp, Homo sapiens
tcagctcactgtg

SEQ ID NO: 6435221 - DNA, 12 bp, Homo sapiens
tcagctcagagc

SEQ ID NO: 6435222 - DNA, 15 bp, Homo sapiens
tcagctcagcctccc

SEQ ID NO: 6435223 - DNA, 19 bp, Homo sapiens
tcagctcagctgggccact

SEQ ID NO: 6435224 - DNA, 15 bp, Homo sapiens
tcagctcaggcagct

SEQ ID NO: 6435225 - DNA, 17 bp, Homo sapiens
tcagctcattatgaaaa

SEQ ID NO: 6435226 - DNA, 19 bp, Homo sapiens
tcagctcatttaatcccag

SEQ ID NO: 6435227 - DNA, 20 bp, Homo sapiens
tcagctcatttaatcccagg

SEQ ID NO: 6435228 - DNA, 14 bp, Homo sapiens
tcagctccactctg

SEQ ID NO: 6435229 - DNA, 16 bp, Homo sapiens
tcagctccactctgaa

SEQ ID NO: 6435230 - DNA, 16 bp, Homo sapiens
tcagctccagcccctt

SEQ ID NO: 6435231 - DNA, 21 bp, Homo sapiens
tcagctccagcccctttccaa

SEQ ID NO: 6435232 - DNA, 14 bp, Homo sapiens
tcagctccagctca

SEQ ID NO: 6435233 - DNA, 15 bp, Homo sapiens
tcagctccagctcac

SEQ ID NO: 6435234 - DNA, 18 bp, Homo sapiens
tcagctccagctcaccag

SEQ ID NO: 6435235 - DNA, 22 bp, Homo sapiens
tcagctccagctcaccagcccc

SEQ ID NO: 6435236 - DNA, 14 bp, Homo sapiens
tcagctccagggca

SEQ ID NO: 6435237 - DNA, 18 bp, Homo sapiens
tctgagcagtgcctcttg

SEQ ID NO: 6435238 - DNA, 19 bp, Homo sapiens
tctgagcagtgcctcttgt

SEQ ID NO: 6435239 - DNA, 17 bp, Homo sapiens
tctgagcagttgttata

SEQ ID NO: 6435240 - DNA, 22 bp, Homo sapiens
tctgagcatatgttccatgcct

SEQ ID NO: 6435241 - DNA, 23 bp, Homo sapiens
tctgagcatatgttccatgcctg

SEQ ID NO: 6435242 - DNA, 22 bp, Homo sapiens
tctgagcattagatttctcatt

SEQ ID NO: 6435243 - DNA, 19 bp, Homo sapiens
tctgagccacagcagcatt

SEQ ID NO: 6435244 - DNA, 20 bp, Homo sapiens
tctgagccacagcagcattt

SEQ ID NO: 6435245 - DNA, 22 bp, Homo sapiens
tctgagccaccgcgagggcctg

SEQ ID NO: 6435246 - DNA, 15 bp, Homo sapiens
tctgagccagattac

SEQ ID NO: 6435247 - DNA, 18 bp, Homo sapiens
tctgagccagattacagg

SEQ ID NO: 6435248 - DNA, 18 bp, Homo sapiens
tctgagccagcaccgccg

SEQ ID NO: 6435249 - DNA, 13 bp, Homo sapiens
tctgagcccaacc

SEQ ID NO: 6435250 - DNA, 14 bp, Homo sapiens
tctgagcccaaccc

SEQ ID NO: 6435251 - DNA, 13 bp, Homo sapiens
tctgagcccaagc

SEQ ID NO: 6435252 - DNA, 20 bp, Homo sapiens
tctgagcccagctgcctgga

SEQ ID NO: 6435253 - DNA, 13 bp, Homo sapiens
tctgagcccaggc

SEQ ID NO: 6435254 - DNA, 15 bp, Homo sapiens
tctgagccccagccc

SEQ ID NO: 6435255 - DNA, 16 bp, Homo sapiens
tctgagccccagcccc

SEQ ID NO: 6435256 - DNA, 16 bp, Homo sapiens
tctgagcccccacctg

SEQ ID NO: 6435257 - DNA, 17 bp, Homo sapiens
tctgagcccccacctgc

SEQ ID NO: 6435258 - DNA, 23 bp, Homo sapiens
tctgagcccccggctagtaccct

SEQ ID NO: 6435259 - DNA, 12 bp, Homo sapiens
tctgagccccct

SEQ ID NO: 6435260 - DNA, 15 bp, Homo sapiens
tctgagccccctgtg

SEQ ID NO: 6435261 - DNA, 16 bp, Homo sapiens
tctgagcccgggctgc

SEQ ID NO: 6435262 - DNA, 17 bp, Homo sapiens
tctgagcccgggctgcc

SEQ ID NO: 6435263 - DNA, 19 bp, Homo sapiens
tctgagcccgggctgcctg

SEQ ID NO: 6435264 - DNA, 21 bp, Homo sapiens
tctgagcccgggctgcctggg

SEQ ID NO: 6435265 - DNA, 24 bp, Homo sapiens
tctgagcccgggctgcctgggctg

SEQ ID NO: 6435266 - DNA, 21 bp, Homo sapiens
tctgagcccggtaagagcaaa

SEQ ID NO: 6435267 - DNA, 18 bp, Homo sapiens
tctgagccctcaaagtga

SEQ ID NO: 6435268 - DNA, 15 bp, Homo sapiens
tctgagccctccctc

SEQ ID NO: 6435269 - DNA, 23 bp, Homo sapiens
tctgagccctccttcttgccctg

SEQ ID NO: 6435270 - DNA, 20 bp, Homo sapiens
tctgagccctggtgtgtttc

SEQ ID NO: 6435271 - DNA, 20 bp, Homo sapiens
tctgagccgcagggcctgct

SEQ ID NO: 6435272 - DNA, 15 bp, Homo sapiens
tctgagcctaaatct

SEQ ID NO: 6435273 - DNA, 20 bp, Homo sapiens
tctgagcctaaatctaatca

SEQ ID NO: 6435274 - DNA, 15 bp, Homo sapiens
tctgagcctgatatt

SEQ ID NO: 6435275 - DNA, 17 bp, Homo sapiens
tctgagccttgagagaa

SEQ ID NO: 6435276 - DNA, 14 bp, Homo sapiens
tctgagcgcctcca

SEQ ID NO: 6435277 - DNA, 18 bp, Homo sapiens
tctgagcggcgcagagcc

SEQ ID NO: 6435278 - DNA, 21 bp, Homo sapiens
tctgagcggcgcagagccctc

SEQ ID NO: 6435279 - DNA, 22 bp, Homo sapiens
tctgagcggcgcagagccctcc

SEQ ID NO: 6435280 - DNA, 20 bp, Homo sapiens
tctgagcgtttaaagtactg

SEQ ID NO: 6435281 - DNA, 18 bp, Homo sapiens
tctgagctcccacctccc

SEQ ID NO: 6435282 - DNA, 22 bp, Homo sapiens
tctgagctcccacctcccttcc

SEQ ID NO: 6435283 - DNA, 12 bp, Homo sapiens
tctgagctcctg

SEQ ID NO: 6435284 - DNA, 15 bp, Homo sapiens
tctgagctgagccag

SEQ ID NO: 6435285 - DNA, 17 bp, Homo sapiens
tctgagctgagccaggc

SEQ ID NO: 6435286 - DNA, 20 bp, Homo sapiens
tctgagctgcagcctggctg

SEQ ID NO: 6435287 - DNA, 12 bp, Homo sapiens
tctgagctggac

SEQ ID NO: 6435288 - DNA, 13 bp, Homo sapiens
tctgagctggccc

SEQ ID NO: 6435289 - DNA, 16 bp, Homo sapiens
tctgagctggcctctc

SEQ ID NO: 6435290 - DNA, 22 bp, Homo sapiens
tctgagctggggtgggagctcc

SEQ ID NO: 6435291 - DNA, 14 bp, Homo sapiens
tctgagctgtatct

SEQ ID NO: 6435292 - DNA, 19 bp, Homo sapiens
tctgagctgtcaacgagac

SEQ ID NO: 6435293 - DNA, 15 bp, Homo sapiens
tctgagctgtcccaa

SEQ ID NO: 6435294 - DNA, 16 bp, Homo sapiens
tctgagctgtcccaag

SEQ ID NO: 6435295 - DNA, 14 bp, Homo sapiens
tctgagctgttatc

SEQ ID NO: 6435296 - DNA, 15 bp, Homo sapiens
tctgagctgttatct

SEQ ID NO: 6435297 - DNA, 19 bp, Homo sapiens
tctgagctgttatcttgtg

SEQ ID NO: 6435298 - DNA, 17 bp, Homo sapiens
tctgagcttacgtagtt

SEQ ID NO: 6435299 - DNA, 19 bp, Homo sapiens
tctgagcttacgtagttct

SEQ ID NO: 6435300 - DNA, 15 bp, Homo sapiens
tctgagcttcagtat

SEQ ID NO: 6435301 - DNA, 21 bp, Homo sapiens
tctgagcttttcatggaagtg

SEQ ID NO: 6435302 - DNA, 21 bp, Homo sapiens
tctgaggaaaatggaagacct

SEQ ID NO: 6435303 - DNA, 18 bp, Homo sapiens
tctgaggaagcagttggg

SEQ ID NO: 6435304 - DNA, 22 bp, Homo sapiens
tctgaggaatcaacagggcagc

SEQ ID NO: 6435305 - DNA, 21 bp, Homo sapiens
tctgaggaatccagacccggc

SEQ ID NO: 6435306 - DNA, 21 bp, Homo sapiens
tctgaggaatggacatttcta

SEQ ID NO: 6435307 - DNA, 17 bp, Homo sapiens
tctgaggaattctgtat

SEQ ID NO: 6435308 - DNA, 19 bp, Homo sapiens
tctgaggacagaggccggg

SEQ ID NO: 6435309 - DNA, 23 bp, Homo sapiens
tctgaggacatggagagagactc

SEQ ID NO: 6435310 - DNA, 22 bp, Homo sapiens
tctgaggagaaacaaataagac

SEQ ID NO: 6435311 - DNA, 13 bp, Homo sapiens
tctgaggagccca

SEQ ID NO: 6435312 - DNA, 23 bp, Homo sapiens
tctgaggaggaaataaattgcag

SEQ ID NO: 6435313 - DNA, 14 bp, Homo sapiens
tctgaggagtccaa

SEQ ID NO: 6435314 - DNA, 19 bp, Homo sapiens
tctgaggagtccaaaatat

SEQ ID NO: 6435315 - DNA, 22 bp, Homo sapiens
tctgaggagtggagttctctgt

SEQ ID NO: 6435316 - DNA, 18 bp, Homo sapiens
tctgaggataccttccat

SEQ ID NO: 6435317 - DNA, 15 bp, Homo sapiens
tctgaggcaaccccc

SEQ ID NO: 6435318 - DNA, 16 bp, Homo sapiens
tctgaggcaaggccca

SEQ ID NO: 6435319 - DNA, 23 bp, Homo sapiens
tctgaggcacctgcatatctcta

SEQ ID NO: 6435320 - DNA, 17 bp, Homo sapiens
tctgaggcatcctctga

SEQ ID NO: 6435321 - DNA, 12 bp, Homo sapiens
tctgaggccagc

SEQ ID NO: 6435322 - DNA, 13 bp, Homo sapiens
tctgaggccagcc

SEQ ID NO: 6435323 - DNA, 16 bp, Homo sapiens
tctgaggccagcctgg

SEQ ID NO: 6435324 - DNA, 17 bp, Homo sapiens
tctgaggccccaggccc

SEQ ID NO: 6435325 - DNA, 17 bp, Homo sapiens
tctgaggcccctgcctc

SEQ ID NO: 6435326 - DNA, 20 bp, Homo sapiens
tctgaggcctgccccctggg

SEQ ID NO: 6435327 - DNA, 21 bp, Homo sapiens
tctgaggcgccccaacccgtg

SEQ ID NO: 6435328 - DNA, 17 bp, Homo sapiens
tctgaggctcagccctg

SEQ ID NO: 6435329 - DNA, 22 bp, Homo sapiens
tctgaggctcagccctgagctg

SEQ ID NO: 6435330 - DNA, 16 bp, Homo sapiens
tctgaggctctccaaa

SEQ ID NO: 6435331 - DNA, 21 bp, Homo sapiens
tctgaggctctttctgggcca

SEQ ID NO: 6435332 - DNA, 21 bp, Homo sapiens
tctgaggctggatcctagcct

SEQ ID NO: 6435333 - DNA, 16 bp, Homo sapiens
tctgagggaaagtgca

SEQ ID NO: 6435334 - DNA, 18 bp, Homo sapiens
tctgagggaaatgttttg

SEQ ID NO: 6435335 - DNA, 22 bp, Homo sapiens
tctgagggaaatgttttgtaaa

SEQ ID NO: 6435336 - DNA, 18 bp, Homo sapiens
tctgagggaatttaacca

SEQ ID NO: 6435337 - DNA, 20 bp, Homo sapiens
tctgagggaggaggccacct

SEQ ID NO: 6435338 - DNA, 23 bp, Homo sapiens
tctgagggaggaggccacctctc

SEQ ID NO: 6435339 - DNA, 20 bp, Homo sapiens
tctgagggcactctctgcca

SEQ ID NO: 6435340 - DNA, 22 bp, Homo sapiens
tctgagggcactctctgccagc

SEQ ID NO: 6435341 - DNA, 18 bp, Homo sapiens
tctgagggcttcctttgg

SEQ ID NO: 6435342 - DNA, 17 bp, Homo sapiens
tctgaggggaggcacct

SEQ ID NO: 6435343 - DNA, 21 bp, Homo sapiens
tctgaggggaggcacctccag

SEQ ID NO: 6435344 - DNA, 22 bp, Homo sapiens
tctgaggggaggcacctccagg

SEQ ID NO: 6435345 - DNA, 22 bp, Homo sapiens
tctgaggggagggggtccgtgg

SEQ ID NO: 6435346 - DNA, 20 bp, Homo sapiens
tctgaggggctaccaggaaa

SEQ ID NO: 6435347 - DNA, 12 bp, Homo sapiens
tctgagggggag

SEQ ID NO: 6435348 - DNA, 23 bp, Homo sapiens
tctgaggggtgggggtgccgctg

SEQ ID NO: 6435349 - DNA, 17 bp, Homo sapiens
tctgaggggtgtccgag

SEQ ID NO: 6435350 - DNA, 14 bp, Homo sapiens
tctgaggtaagtgt

SEQ ID NO: 6435351 - DNA, 15 bp, Homo sapiens
tctgaggtcaataaa

SEQ ID NO: 6435352 - DNA, 19 bp, Homo sapiens
tctgaggtcaataaagcag

SEQ ID NO: 6435353 - DNA, 23 bp, Homo sapiens
tctgaggtcccttcaaggcctcc

SEQ ID NO: 6435354 - DNA, 18 bp, Homo sapiens
tctgaggtcctgagcact

SEQ ID NO: 6435355 - DNA, 19 bp, Homo sapiens
tctgaggtcctgagcactg

SEQ ID NO: 6435356 - DNA, 21 bp, Homo sapiens
tctgaggtcctgagcactgcc

SEQ ID NO: 6435357 - DNA, 11 bp, Homo sapiens
tctgaggtctc

SEQ ID NO: 6435358 - DNA, 12 bp, Homo sapiens
tctgaggtctca

SEQ ID NO: 6435359 - DNA, 23 bp, Homo sapiens
tctgaggtgcactgggaggctcc

SEQ ID NO: 6435360 - DNA, 21 bp, Homo sapiens
tctgaggttggatttgctcat

SEQ ID NO: 6435361 - DNA, 12 bp, Homo sapiens
tctgagtaatta

SEQ ID NO: 6435362 - DNA, 15 bp, Homo sapiens
tctgagtaattaata

SEQ ID NO: 6435363 - DNA, 23 bp, Homo sapiens
tctgagtagagcttgtaataaat

SEQ ID NO: 6435364 - DNA, 17 bp, Homo sapiens
tctgagtagtggccact

SEQ ID NO: 6435365 - DNA, 20 bp, Homo sapiens
tctgagtagtggccactggg

SEQ ID NO: 6435366 - DNA, 23 bp, Homo sapiens
tctgagtagtggccactggggtg

SEQ ID NO: 6435367 - DNA, 18 bp, Homo sapiens
tctgagtatctcctcgca

SEQ ID NO: 6435368 - DNA, 16 bp, Homo sapiens
tctgagtattcatttt

SEQ ID NO: 6435369 - DNA, 11 bp, Homo sapiens
tctgagtcaaa

SEQ ID NO: 6435370 - DNA, 14 bp, Homo sapiens
tctgagtcaaatcc

SEQ ID NO: 6435371 - DNA, 15 bp, Homo sapiens
tctgagtcaaatcca

SEQ ID NO: 6435372 - DNA, 21 bp, Homo sapiens
tctgagtcaaatccagtggtg

SEQ ID NO: 6435373 - DNA, 16 bp, Homo sapiens
tctgagtccagctccc

SEQ ID NO: 6435374 - DNA, 12 bp, Homo sapiens
tctgagtcctca

SEQ ID NO: 6435375 - DNA, 16 bp, Homo sapiens
tctgagtcctggccca

SEQ ID NO: 6435376 - DNA, 21 bp, Homo sapiens
tctgagtcctgtctctgcctg

SEQ ID NO: 6435377 - DNA, 18 bp, Homo sapiens
tctgagtctatgttcaaa

SEQ ID NO: 6435378 - DNA, 14 bp, Homo sapiens
tctgagtctcttgg

SEQ ID NO: 6435379 - DNA, 13 bp, Homo sapiens
tctgagtctgagt

SEQ ID NO: 6435380 - DNA, 20 bp, Homo sapiens
tctgagtgaagtccagtgac

SEQ ID NO: 6435381 - DNA, 15 bp, Homo sapiens
tctgagtgaatgtta

SEQ ID NO: 6435382 - DNA, 22 bp, Homo sapiens
tctgagtgaatgttaacatgcg

SEQ ID NO: 6435383 - DNA, 19 bp, Homo sapiens
tctgagtggggcttcctgg

SEQ ID NO: 6435384 - DNA, 17 bp, Homo sapiens
tctgagtggtggttcct

SEQ ID NO: 6435385 - DNA, 17 bp, Homo sapiens
tctgagtgtctctgcct

SEQ ID NO: 6435386 - DNA, 20 bp, Homo sapiens
tctgagtgtctctgcctgga

SEQ ID NO: 6435387 - DNA, 22 bp, Homo sapiens
tctgagtgtctctgcctggagc

SEQ ID NO: 6435388 - DNA, 18 bp, Homo sapiens
tctgagtgttctcctctt

SEQ ID NO: 6435389 - DNA, 23 bp, Homo sapiens
tctgagtgttttatgagaaagcc

SEQ ID NO: 6435390 - DNA, 12 bp, Homo sapiens
tctgagttatgt

SEQ ID NO: 6435391 - DNA, 23 bp, Homo sapiens
tctgagttccggcaccagtagca

SEQ ID NO: 6435392 - DNA, 17 bp, Homo sapiens
tctgagttcctggaatg

SEQ ID NO: 6435393 - DNA, 19 bp, Homo sapiens
tctgagttgttaccccaag

SEQ ID NO: 6435394 - DNA, 23 bp, Homo sapiens
tctgagttgttaccccaagcgcc

SEQ ID NO: 6435395 - DNA, 15 bp, Homo sapiens
tctgagtttaccatt

SEQ ID NO: 6435396 - DNA, 20 bp, Homo sapiens
tctgagtttaccatttgtaa

SEQ ID NO: 6435397 - DNA, 21 bp, Homo sapiens
tctgagtttatattctgaaag

SEQ ID NO: 6435398 - DNA, 22 bp, Homo sapiens
tctgagtttcattctcctgcct

SEQ ID NO: 6435399 - DNA, 24 bp, Homo sapiens
tctgagtttcattctcctgcctgt

SEQ ID NO: 6435400 - DNA, 16 bp, Homo sapiens
tctgagttttaccaaa

SEQ ID NO: 6435401 - DNA, 20 bp, Homo sapiens
tctgagttttgatgctgtat

SEQ ID NO: 6435402 - DNA, 14 bp, Homo sapiens
tctgagttttgtgt

SEQ ID NO: 6435403 - DNA, 13 bp, Homo sapiens
tctgataaacctg

SEQ ID NO: 6435404 - DNA, 13 bp, Homo sapiens
tctgataaactga

SEQ ID NO: 6435405 - DNA, 21 bp, Homo sapiens
tctgataactagatggtgctg

SEQ ID NO: 6435406 - DNA, 19 bp, Homo sapiens
tctgataatttattgtctt

SEQ ID NO: 6435407 - DNA, 20 bp, Homo sapiens
tctgatacacagtaattgtg

SEQ ID NO: 6435408 - DNA, 21 bp, Homo sapiens
tctgatacacagtaattgtga

SEQ ID NO: 6435409 - DNA, 16 bp, Homo sapiens
tctgatacatctgtca

SEQ ID NO: 6435410 - DNA, 19 bp, Homo sapiens
tctgatacatctgtcagtg

SEQ ID NO: 6435411 - DNA, 15 bp, Homo sapiens
tctgataccaaagag

SEQ ID NO: 6435412 - DNA, 17 bp, Homo sapiens
tctgatacttttttgaa

SEQ ID NO: 6435413 - DNA, 16 bp, Homo sapiens
tcagctcccacaagcc

SEQ ID NO: 6435414 - DNA, 15 bp, Homo sapiens
tcagctcccaggcca

SEQ ID NO: 6435415 - DNA, 18 bp, Homo sapiens
tcagctcccccaggctgt

SEQ ID NO: 6435416 - DNA, 23 bp, Homo sapiens
tcagctcccccaggctgttctcc

SEQ ID NO: 6435417 - DNA, 24 bp, Homo sapiens
tcagctcccccaggctgttctcca

SEQ ID NO: 6435418 - DNA, 13 bp, Homo sapiens
tcagctccctgac

SEQ ID NO: 6435419 - DNA, 19 bp, Homo sapiens
tcagctccctgaccccctg

SEQ ID NO: 6435420 - DNA, 22 bp, Homo sapiens
tcagctccctgaccccctgtcc

SEQ ID NO: 6435421 - DNA, 18 bp, Homo sapiens
tcagctccctgcctgttt

SEQ ID NO: 6435422 - DNA, 21 bp, Homo sapiens
tcagctccctgcctgtttccc

SEQ ID NO: 6435423 - DNA, 20 bp, Homo sapiens
tcagctcccttcccctgcct

SEQ ID NO: 6435424 - DNA, 17 bp, Homo sapiens
tcagctccgtcatctgc

SEQ ID NO: 6435425 - DNA, 16 bp, Homo sapiens
tcagctcctacctctg

SEQ ID NO: 6435426 - DNA, 17 bp, Homo sapiens
tcagctcctacctctgt

SEQ ID NO: 6435427 - DNA, 21 bp, Homo sapiens
tcagctcctacctctgtgcca

SEQ ID NO: 6435428 - DNA, 14 bp, Homo sapiens
tcagctcctgagta

SEQ ID NO: 6435429 - DNA, 22 bp, Homo sapiens
tcagctcctgagtagctgggcc

SEQ ID NO: 6435430 - DNA, 21 bp, Homo sapiens
tcagctcctggggaccccact

SEQ ID NO: 6435431 - DNA, 19 bp, Homo sapiens
tcagctcgctgcccaggga

SEQ ID NO: 6435432 - DNA, 13 bp, Homo sapiens
tcagctcggctca

SEQ ID NO: 6435433 - DNA, 22 bp, Homo sapiens
tcagctctaaagcagagatgta

SEQ ID NO: 6435434 - DNA, 15 bp, Homo sapiens
tcagctctcctgctg

SEQ ID NO: 6435435 - DNA, 17 bp, Homo sapiens
tcagctctcctgctgca

SEQ ID NO: 6435436 - DNA, 18 bp, Homo sapiens
tcagctctcctgctgcag

SEQ ID NO: 6435437 - DNA, 13 bp, Homo sapiens
tcagctctcctgg

SEQ ID NO: 6435438 - DNA, 14 bp, Homo sapiens
tcagctctcctggc

SEQ ID NO: 6435439 - DNA, 15 bp, Homo sapiens
tcagctctctgccct

SEQ ID NO: 6435440 - DNA, 21 bp, Homo sapiens
tcagctctctgccctgtgtac

SEQ ID NO: 6435441 - DNA, 15 bp, Homo sapiens
tcagctctctgctgg

SEQ ID NO: 6435442 - DNA, 14 bp, Homo sapiens
tcagctctctggga

SEQ ID NO: 6435443 - DNA, 18 bp, Homo sapiens
tcagctctctgggacctc

SEQ ID NO: 6435444 - DNA, 14 bp, Homo sapiens
tcagctctctgtat

SEQ ID NO: 6435445 - DNA, 14 bp, Homo sapiens
tcagctctgaaaga

SEQ ID NO: 6435446 - DNA, 22 bp, Homo sapiens
tcagctctgacattctgattcg

SEQ ID NO: 6435447 - DNA, 23 bp, Homo sapiens
tcagctctgcaagaattgaagca

SEQ ID NO: 6435448 - DNA, 16 bp, Homo sapiens
tcagctctgccttgca

SEQ ID NO: 6435449 - DNA, 14 bp, Homo sapiens
tcagctctggagaa

SEQ ID NO: 6435450 - DNA, 12 bp, Homo sapiens
tcagctctggcc

SEQ ID NO: 6435451 - DNA, 14 bp, Homo sapiens
tcagctctggccac

SEQ ID NO: 6435452 - DNA, 15 bp, Homo sapiens
tcagctctggccaca

SEQ ID NO: 6435453 - DNA, 16 bp, Homo sapiens
tcagctctggctcaca

SEQ ID NO: 6435454 - DNA, 13 bp, Homo sapiens
tcagctctggggc

SEQ ID NO: 6435455 - DNA, 17 bp, Homo sapiens
tcagctctggggcagag

SEQ ID NO: 6435456 - DNA, 20 bp, Homo sapiens
tcagctctggggcagaggaa

SEQ ID NO: 6435457 - DNA, 17 bp, Homo sapiens
tcagctctggtccaggc

SEQ ID NO: 6435458 - DNA, 18 bp, Homo sapiens
tcagctctgtctgctcaa

SEQ ID NO: 6435459 - DNA, 20 bp, Homo sapiens
tcagctcttcatctgcccaa

SEQ ID NO: 6435460 - DNA, 16 bp, Homo sapiens
tcagctcttccatgat

SEQ ID NO: 6435461 - DNA, 22 bp, Homo sapiens
tcagctcttctgacttaagtgt

SEQ ID NO: 6435462 - DNA, 21 bp, Homo sapiens
tcagctcttgtacagacatgt

SEQ ID NO: 6435463 - DNA, 15 bp, Homo sapiens
tcagctctttccaaa

SEQ ID NO: 6435464 - DNA, 17 bp, Homo sapiens
tcagctctttccaaatt

SEQ ID NO: 6435465 - DNA, 16 bp, Homo sapiens
tcagctgaaattatat

SEQ ID NO: 6435466 - DNA, 16 bp, Homo sapiens
tcagctgaacctgggt

SEQ ID NO: 6435467 - DNA, 12 bp, Homo sapiens
tcagctgaattc

SEQ ID NO: 6435468 - DNA, 21 bp, Homo sapiens
tcagctgaccagaagtggcag

SEQ ID NO: 6435469 - DNA, 15 bp, Homo sapiens
tcagctgagccctgg

SEQ ID NO: 6435470 - DNA, 12 bp, Homo sapiens
tcagctgagcct

SEQ ID NO: 6435471 - DNA, 14 bp, Homo sapiens
tcagctgagccttc

SEQ ID NO: 6435472 - DNA, 22 bp, Homo sapiens
tcagctgcaaggtactctggtg

SEQ ID NO: 6435473 - DNA, 21 bp, Homo sapiens
tcagctgcaatccatttattt

SEQ ID NO: 6435474 - DNA, 22 bp, Homo sapiens
tcagctgcaatccatttatttc

SEQ ID NO: 6435475 - DNA, 20 bp, Homo sapiens
tcagctgcacattcctggcc

SEQ ID NO: 6435476 - DNA, 20 bp, Homo sapiens
tcagctgcattccgcagccc

SEQ ID NO: 6435477 - DNA, 23 bp, Homo sapiens
tcagctgcatttcacatgccttg

SEQ ID NO: 6435478 - DNA, 16 bp, Homo sapiens
tcagctgccaagcact

SEQ ID NO: 6435479 - DNA, 15 bp, Homo sapiens
tcagctgcccatccc

SEQ ID NO: 6435480 - DNA, 19 bp, Homo sapiens
tcagctgcccatcccagtc

SEQ ID NO: 6435481 - DNA, 19 bp, Homo sapiens
tcagctgccccaatgtgac

SEQ ID NO: 6435482 - DNA, 21 bp, Homo sapiens
tcagctgccccaatgtgacct

SEQ ID NO: 6435483 - DNA, 12 bp, Homo sapiens
tcagctgccccc

SEQ ID NO: 6435484 - DNA, 16 bp, Homo sapiens
tcagctgcccccgctc

SEQ ID NO: 6435485 - DNA, 15 bp, Homo sapiens
tcagctgcctcccca

SEQ ID NO: 6435486 - DNA, 16 bp, Homo sapiens
tcagctgcctgaaaca

SEQ ID NO: 6435487 - DNA, 23 bp, Homo sapiens
tcagctgcctgaaacagccatgt

SEQ ID NO: 6435488 - DNA, 18 bp, Homo sapiens
tcagctgcgcccccttct

SEQ ID NO: 6435489 - DNA, 12 bp, Homo sapiens
tcagctgctcag

SEQ ID NO: 6435490 - DNA, 13 bp, Homo sapiens
tcagctgctccca

SEQ ID NO: 6435491 - DNA, 23 bp, Homo sapiens
tcagctgctcccacacttgtgcc

SEQ ID NO: 6435492 - DNA, 18 bp, Homo sapiens
tcagctgctcgcacagat

SEQ ID NO: 6435493 - DNA, 22 bp, Homo sapiens
tcagctgctgaaatttggaaag

SEQ ID NO: 6435494 - DNA, 19 bp, Homo sapiens
tcagctgctgaagggaggg

SEQ ID NO: 6435495 - DNA, 16 bp, Homo sapiens
tcagctgctgttgaac

SEQ ID NO: 6435496 - DNA, 22 bp, Homo sapiens
tcagctgctgttgaacttttta

SEQ ID NO: 6435497 - DNA, 19 bp, Homo sapiens
tcagctgcttctgctgcct

SEQ ID NO: 6435498 - DNA, 15 bp, Homo sapiens
tcagctgctttgtta

SEQ ID NO: 6435499 - DNA, 17 bp, Homo sapiens
tcagctgctttgttacc

SEQ ID NO: 6435500 - DNA, 22 bp, Homo sapiens
tcagctggaagtctacctgctg

SEQ ID NO: 6435501 - DNA, 13 bp, Homo sapiens
tcagctggacata

SEQ ID NO: 6435502 - DNA, 17 bp, Homo sapiens
tcagctggactgcattg

SEQ ID NO: 6435503 - DNA, 20 bp, Homo sapiens
tcagctggcagtgcaatgct

SEQ ID NO: 6435504 - DNA, 22 bp, Homo sapiens
tcagctggcggaacctggctgc

SEQ ID NO: 6435505 - DNA, 13 bp, Homo sapiens
tcagctggctgta

SEQ ID NO: 6435506 - DNA, 15 bp, Homo sapiens
tcagctggctgtatg

SEQ ID NO: 6435507 - DNA, 15 bp, Homo sapiens
tcagctggcttccta

SEQ ID NO: 6435508 - DNA, 16 bp, Homo sapiens
tcagctgggagccagt

SEQ ID NO: 6435509 - DNA, 17 bp, Homo sapiens
tcagctgggagccagtg

SEQ ID NO: 6435510 - DNA, 14 bp, Homo sapiens
tcagctgggcagtg

SEQ ID NO: 6435511 - DNA, 15 bp, Homo sapiens
tcagctggtcctgac

SEQ ID NO: 6435512 - DNA, 22 bp, Homo sapiens
tcagctggtcctgaccaggatg

SEQ ID NO: 6435513 - DNA, 11 bp, Homo sapiens
tcagctggtgg

SEQ ID NO: 6435514 - DNA, 21 bp, Homo sapiens
tcagctggtggatggtgactt

SEQ ID NO: 6435515 - DNA, 17 bp, Homo sapiens
tcagctggttactcagg

SEQ ID NO: 6435516 - DNA, 18 bp, Homo sapiens
tcagctggttactcaggg

SEQ ID NO: 6435517 - DNA, 21 bp, Homo sapiens
tcagctggttactcagggttc

SEQ ID NO: 6435518 - DNA, 17 bp, Homo sapiens
tcagctgtacttcgtct

SEQ ID NO: 6435519 - DNA, 16 bp, Homo sapiens
tcagctgtagtcctca

SEQ ID NO: 6435520 - DNA, 16 bp, Homo sapiens
tcagctgtcacctgct

SEQ ID NO: 6435521 - DNA, 18 bp, Homo sapiens
tcagctgtcctgcagcaa

SEQ ID NO: 6435522 - DNA, 19 bp, Homo sapiens
tcagctgtcctgcagcaaa

SEQ ID NO: 6435523 - DNA, 14 bp, Homo sapiens
tcagctgtcttttg

SEQ ID NO: 6435524 - DNA, 15 bp, Homo sapiens
tcagctgtcttttgg

SEQ ID NO: 6435525 - DNA, 17 bp, Homo sapiens
tcagctgtggctggagg

SEQ ID NO: 6435526 - DNA, 22 bp, Homo sapiens
tcagctgtggctggaggagctg

SEQ ID NO: 6435527 - DNA, 22 bp, Homo sapiens
tcagctgtggggaacacagcta

SEQ ID NO: 6435528 - DNA, 18 bp, Homo sapiens
tcagctgttaaccatttg

SEQ ID NO: 6435529 - DNA, 17 bp, Homo sapiens
tcagctgttactttctt

SEQ ID NO: 6435530 - DNA, 14 bp, Homo sapiens
tcagctgttgcaga

SEQ ID NO: 6435531 - DNA, 17 bp, Homo sapiens
tcagctgttgcaggcag

SEQ ID NO: 6435532 - DNA, 18 bp, Homo sapiens
tcagctgttgcaggcagt

SEQ ID NO: 6435533 - DNA, 22 bp, Homo sapiens
tcagctgttgcaggcagtgtct

SEQ ID NO: 6435534 - DNA, 22 bp, Homo sapiens
tcagctgtttcgcatccaccgc

SEQ ID NO: 6435535 - DNA, 17 bp, Homo sapiens
tcagcttaataagtatt

SEQ ID NO: 6435536 - DNA, 16 bp, Homo sapiens
tcagcttaattctcct

SEQ ID NO: 6435537 - DNA, 19 bp, Homo sapiens
tcagcttaattctccttcc

SEQ ID NO: 6435538 - DNA, 23 bp, Homo sapiens
tcagcttatcctaaggctgtcca

SEQ ID NO: 6435539 - DNA, 13 bp, Homo sapiens
tcagcttatctct

SEQ ID NO: 6435540 - DNA, 22 bp, Homo sapiens
tcagcttatgggatccttgtct

SEQ ID NO: 6435541 - DNA, 18 bp, Homo sapiens
tcagcttatgtaggtaaa

SEQ ID NO: 6435542 - DNA, 15 bp, Homo sapiens
tcagcttcaaataaa

SEQ ID NO: 6435543 - DNA, 17 bp, Homo sapiens
tcagcttcccaacaata

SEQ ID NO: 6435544 - DNA, 21 bp, Homo sapiens
tcagcttcccaacaatacttt

SEQ ID NO: 6435545 - DNA, 14 bp, Homo sapiens
tcagcttcccagcc

SEQ ID NO: 6435546 - DNA, 15 bp, Homo sapiens
tcagcttcccagcca

SEQ ID NO: 6435547 - DNA, 23 bp, Homo sapiens
tcagcttcccagccatgcccagg

SEQ ID NO: 6435548 - DNA, 23 bp, Homo sapiens
tcagcttccccaggagctctctg

SEQ ID NO: 6435549 - DNA, 19 bp, Homo sapiens
tcagcttcctgctgctggg

SEQ ID NO: 6435550 - DNA, 15 bp, Homo sapiens
tcagcttcgtgcctg

SEQ ID NO: 6435551 - DNA, 12 bp, Homo sapiens
tcagcttctccc

SEQ ID NO: 6435552 - DNA, 15 bp, Homo sapiens
tcagcttctcccaag

SEQ ID NO: 6435553 - DNA, 16 bp, Homo sapiens
tcagcttctcccaagc

SEQ ID NO: 6435554 - DNA, 15 bp, Homo sapiens
tcagcttctgctggg

SEQ ID NO: 6435555 - DNA, 13 bp, Homo sapiens
tcagcttcttaat

SEQ ID NO: 6435556 - DNA, 18 bp, Homo sapiens
tcagcttgaacctgcttc

SEQ ID NO: 6435557 - DNA, 17 bp, Homo sapiens
tcagcttgcacatttgg

SEQ ID NO: 6435558 - DNA, 15 bp, Homo sapiens
tcagcttgctgccct

SEQ ID NO: 6435559 - DNA, 13 bp, Homo sapiens
tcagcttgctggg

SEQ ID NO: 6435560 - DNA, 19 bp, Homo sapiens
tcagcttgggcttcttcct

SEQ ID NO: 6435561 - DNA, 21 bp, Homo sapiens
tcagcttggtagttaacacat

SEQ ID NO: 6435562 - DNA, 22 bp, Homo sapiens
tcagcttgtaaatagctcaggt

SEQ ID NO: 6435563 - DNA, 15 bp, Homo sapiens
tcagcttgtgccttg

SEQ ID NO: 6435564 - DNA, 14 bp, Homo sapiens
tcagcttgtttcta

SEQ ID NO: 6435565 - DNA, 20 bp, Homo sapiens
tcagcttgtttctatactgt

SEQ ID NO: 6435566 - DNA, 13 bp, Homo sapiens
tcagctttataat

SEQ ID NO: 6435567 - DNA, 20 bp, Homo sapiens
tcagctttataataaactgt

SEQ ID NO: 6435568 - DNA, 19 bp, Homo sapiens
tcagctttcagagccagtg

SEQ ID NO: 6435569 - DNA, 20 bp, Homo sapiens
tcagctttcagagccagtga

SEQ ID NO: 6435570 - DNA, 14 bp, Homo sapiens
tcagctttccctgc

SEQ ID NO: 6435571 - DNA, 18 bp, Homo sapiens
tcagctttccctggctca

SEQ ID NO: 6435572 - DNA, 22 bp, Homo sapiens
tcagctttccctggctcaggga

SEQ ID NO: 6435573 - DNA, 22 bp, Homo sapiens
tcagctttgaaggctggattct

SEQ ID NO: 6435574 - DNA, 12 bp, Homo sapiens
tcagctttgact

SEQ ID NO: 6435575 - DNA, 17 bp, Homo sapiens
tcagctttgactttatc

SEQ ID NO: 6435576 - DNA, 23 bp, Homo sapiens
tcagctttgactttatctcctgc

SEQ ID NO: 6435577 - DNA, 15 bp, Homo sapiens
tcagctttgataatt

SEQ ID NO: 6435578 - DNA, 15 bp, Homo sapiens
tcagctttgccttcc

SEQ ID NO: 6435579 - DNA, 16 bp, Homo sapiens
tcagctttgccttcca

SEQ ID NO: 6435580 - DNA, 22 bp, Homo sapiens
tcagctttgccttccacgctgt

SEQ ID NO: 6435581 - DNA, 12 bp, Homo sapiens
tcagctttgctt

SEQ ID NO: 6435582 - DNA, 18 bp, Homo sapiens
tcagctttgcttcatgtt

SEQ ID NO: 6435583 - DNA, 18 bp, Homo sapiens
tcagctttggctctggct

SEQ ID NO: 6435584 - DNA, 19 bp, Homo sapiens
tcagctttggctctggctg

SEQ ID NO: 6435585 - DNA, 16 bp, Homo sapiens
tcagcttttcagtgaa

SEQ ID NO: 6435586 - DNA, 16 bp, Homo sapiens
tcagcttttgttctag

SEQ ID NO: 6435587 - DNA, 19 bp, Homo sapiens
tcagctttttgatcctcta

SEQ ID NO: 6435588 - DNA, 20 bp, Homo sapiens
tcagctttttgtcttttctg

SEQ ID NO: 6435589 - DNA, 14 bp, Homo sapiens
tcagcttttttcct

SEQ ID NO: 6435590 - DNA, 15 bp, Homo sapiens
tcaggaaaacagcta

SEQ ID NO: 6435591 - DNA, 23 bp, Homo sapiens
tctgatagaaatggtttcctctg

SEQ ID NO: 6435592 - DNA, 12 bp, Homo sapiens
tctgatagaatt

SEQ ID NO: 6435593 - DNA, 15 bp, Homo sapiens
tctgataggaggggg

SEQ ID NO: 6435594 - DNA, 23 bp, Homo sapiens
tctgataggagggggcggcaggg

SEQ ID NO: 6435595 - DNA, 20 bp, Homo sapiens
tctgatatcaggaaatatct

SEQ ID NO: 6435596 - DNA, 17 bp, Homo sapiens
tctgatatgctgagaaa

SEQ ID NO: 6435597 - DNA, 13 bp, Homo sapiens
tctgatatgggac

SEQ ID NO: 6435598 - DNA, 21 bp, Homo sapiens
tctgatatgggactgagcctg

SEQ ID NO: 6435599 - DNA, 20 bp, Homo sapiens
tctgatattccatgaatgta

SEQ ID NO: 6435600 - DNA, 21 bp, Homo sapiens
tctgatattggtgtgaatgct

SEQ ID NO: 6435601 - DNA, 12 bp, Homo sapiens
tctgatcaaaat

SEQ ID NO: 6435602 - DNA, 12 bp, Homo sapiens
tctgatcaaagc

SEQ ID NO: 6435603 - DNA, 13 bp, Homo sapiens
tctgatcaaagca

SEQ ID NO: 6435604 - DNA, 23 bp, Homo sapiens
tctgatcaaagcaccttgaatgg

SEQ ID NO: 6435605 - DNA, 12 bp, Homo sapiens
tctgatcaaatt

SEQ ID NO: 6435606 - DNA, 15 bp, Homo sapiens
tctgatcaatttgaa

SEQ ID NO: 6435607 - DNA, 15 bp, Homo sapiens
tctgatcacaacttt

SEQ ID NO: 6435608 - DNA, 21 bp, Homo sapiens
tctgatcacattcttcaaaga

SEQ ID NO: 6435609 - DNA, 16 bp, Homo sapiens
tctgatcactgaaata

SEQ ID NO: 6435610 - DNA, 18 bp, Homo sapiens
tctgatcactgaaataaa

SEQ ID NO: 6435611 - DNA, 15 bp, Homo sapiens
tctgatcacttcatg

SEQ ID NO: 6435612 - DNA, 17 bp, Homo sapiens
tctgatcagaacaaatg

SEQ ID NO: 6435613 - DNA, 22 bp, Homo sapiens
tctgatcagaggtgtacactaa

SEQ ID NO: 6435614 - DNA, 17 bp, Homo sapiens
tctgatcatccactgtg

SEQ ID NO: 6435615 - DNA, 11 bp, Homo sapiens
tctgatccagt

SEQ ID NO: 6435616 - DNA, 16 bp, Homo sapiens
tctgatcccataaaga

SEQ ID NO: 6435617 - DNA, 23 bp, Homo sapiens
tctgatcccctttggttttacta

SEQ ID NO: 6435618 - DNA, 16 bp, Homo sapiens
tctgatccctctgggg

SEQ ID NO: 6435619 - DNA, 19 bp, Homo sapiens
tctgatcctcagcccctcc

SEQ ID NO: 6435620 - DNA, 16 bp, Homo sapiens
tctgatcggccagttt

SEQ ID NO: 6435621 - DNA, 20 bp, Homo sapiens
tctgatcgtgacgctgaata

SEQ ID NO: 6435622 - DNA, 21 bp, Homo sapiens
tctgatcgtgacgctgaataa

SEQ ID NO: 6435623 - DNA, 19 bp, Homo sapiens
tctgatctaacaaaataag

SEQ ID NO: 6435624 - DNA, 21 bp, Homo sapiens
tctgatctccatggcttcctc

SEQ ID NO: 6435625 - DNA, 17 bp, Homo sapiens
tctgatctgaggctaag

SEQ ID NO: 6435626 - DNA, 14 bp, Homo sapiens
tctgatctgggttt

SEQ ID NO: 6435627 - DNA, 19 bp, Homo sapiens
tctgatctgtactttgtgt

SEQ ID NO: 6435628 - DNA, 22 bp, Homo sapiens
tctgatctgtataaaaatgtaa

SEQ ID NO: 6435629 - DNA, 13 bp, Homo sapiens
tctgatctgtgca

SEQ ID NO: 6435630 - DNA, 21 bp, Homo sapiens
tctgatctgtgctttccagct

SEQ ID NO: 6435631 - DNA, 19 bp, Homo sapiens
tctgatctttttatacaca

SEQ ID NO: 6435632 - DNA, 21 bp, Homo sapiens
tctgatgaaaaattgctgact

SEQ ID NO: 6435633 - DNA, 13 bp, Homo sapiens
tctgatgaatctc

SEQ ID NO: 6435634 - DNA, 22 bp, Homo sapiens
tctgatgacagtgttatcccaa

SEQ ID NO: 6435635 - DNA, 21 bp, Homo sapiens
tctgatgatgttctgaaatgg

SEQ ID NO: 6435636 - DNA, 17 bp, Homo sapiens
tctgatgcagaactttc

SEQ ID NO: 6435637 - DNA, 13 bp, Homo sapiens
tctgatgcagctt

SEQ ID NO: 6435638 - DNA, 15 bp, Homo sapiens
tctgatgcagtgccc

SEQ ID NO: 6435639 - DNA, 19 bp, Homo sapiens
tctgatgccaaagctgctt

SEQ ID NO: 6435640 - DNA, 21 bp, Homo sapiens
tctgatgccaaagctgctttc

SEQ ID NO: 6435641 - DNA, 22 bp, Homo sapiens
tctgatgccaaagctgctttct

SEQ ID NO: 6435642 - DNA, 14 bp, Homo sapiens
tctgatgcccaccg

SEQ ID NO: 6435643 - DNA, 21 bp, Homo sapiens
tctgatgcccaccgaggagcc

SEQ ID NO: 6435644 - DNA, 16 bp, Homo sapiens
tctgatgcttacatct

SEQ ID NO: 6435645 - DNA, 16 bp, Homo sapiens
tctgatggccaaaata

SEQ ID NO: 6435646 - DNA, 13 bp, Homo sapiens
tctgatggcctta

SEQ ID NO: 6435647 - DNA, 20 bp, Homo sapiens
tctgatggccttaatttcct

SEQ ID NO: 6435648 - DNA, 18 bp, Homo sapiens
tctgatggtgagctggga

SEQ ID NO: 6435649 - DNA, 20 bp, Homo sapiens
tctgatggtgagctgggaag

SEQ ID NO: 6435650 - DNA, 14 bp, Homo sapiens
tctgatgtaaatga

SEQ ID NO: 6435651 - DNA, 15 bp, Homo sapiens
tctgatgtaaatgaa

SEQ ID NO: 6435652 - DNA, 18 bp, Homo sapiens
tctgatgtaaatgaagta

SEQ ID NO: 6435653 - DNA, 19 bp, Homo sapiens
tctgatgtaaatgaagtaa

SEQ ID NO: 6435654 - DNA, 17 bp, Homo sapiens
tctgatgtactctaaat

SEQ ID NO: 6435655 - DNA, 22 bp, Homo sapiens
tctgatgtataatgtaatgttt

SEQ ID NO: 6435656 - DNA, 22 bp, Homo sapiens
tctgatgtccatttgtcccaat

SEQ ID NO: 6435657 - DNA, 13 bp, Homo sapiens
tctgatgtcccag

SEQ ID NO: 6435658 - DNA, 14 bp, Homo sapiens
tctgatgtcccagt

SEQ ID NO: 6435659 - DNA, 20 bp, Homo sapiens
tctgatgtctctaaagcact

SEQ ID NO: 6435660 - DNA, 13 bp, Homo sapiens
tctgatgtggaat

SEQ ID NO: 6435661 - DNA, 15 bp, Homo sapiens
tctgatgtgtgccca

SEQ ID NO: 6435662 - DNA, 20 bp, Homo sapiens
tctgatgtgtgttgtcagcc

SEQ ID NO: 6435663 - DNA, 22 bp, Homo sapiens
tctgatgtgtgttgtcagcctg

SEQ ID NO: 6435664 - DNA, 21 bp, Homo sapiens
tctgatgttccagcttctagc

SEQ ID NO: 6435665 - DNA, 17 bp, Homo sapiens
tctgatgtttctgtgaa

SEQ ID NO: 6435666 - DNA, 18 bp, Homo sapiens
tctgatgtttctgtgaaa

SEQ ID NO: 6435667 - DNA, 15 bp, Homo sapiens
tctgattaaatttaa

SEQ ID NO: 6435668 - DNA, 14 bp, Homo sapiens
tctgattaagcatt

SEQ ID NO: 6435669 - DNA, 15 bp, Homo sapiens
tctgattaatatatt

SEQ ID NO: 6435670 - DNA, 20 bp, Homo sapiens
tctgattaatatatttaata

SEQ ID NO: 6435671 - DNA, 17 bp, Homo sapiens
tctgattaatccatttt

SEQ ID NO: 6435672 - DNA, 18 bp, Homo sapiens
tctgattagctttgtgtt

SEQ ID NO: 6435673 - DNA, 19 bp, Homo sapiens
tctgattatacaccatttt

SEQ ID NO: 6435674 - DNA, 18 bp, Homo sapiens
tctgattatgtaagcatt

SEQ ID NO: 6435675 - DNA, 14 bp, Homo sapiens
tctgattattacaa

SEQ ID NO: 6435676 - DNA, 18 bp, Homo sapiens
tctgattcacctcttcct

SEQ ID NO: 6435677 - DNA, 14 bp, Homo sapiens
tctgattccagcac

SEQ ID NO: 6435678 - DNA, 21 bp, Homo sapiens
tctgattcccaagctctgctc

SEQ ID NO: 6435679 - DNA, 18 bp, Homo sapiens
tctgattccgcaccctgc

SEQ ID NO: 6435680 - DNA, 20 bp, Homo sapiens
tctgattccgcaccctgcct

SEQ ID NO: 6435681 - DNA, 15 bp, Homo sapiens
tctgattcctttaaa

SEQ ID NO: 6435682 - DNA, 16 bp, Homo sapiens
tctgattctagtgtgt

SEQ ID NO: 6435683 - DNA, 19 bp, Homo sapiens
tctgattctatgtaacttg

SEQ ID NO: 6435684 - DNA, 19 bp, Homo sapiens
tctgattctctttaactgt

SEQ ID NO: 6435685 - DNA, 15 bp, Homo sapiens
tctgattctgattgc

SEQ ID NO: 6435686 - DNA, 17 bp, Homo sapiens
tctgattgaaacatgaa

SEQ ID NO: 6435687 - DNA, 22 bp, Homo sapiens
tctgattgaaacatgaaacaac

SEQ ID NO: 6435688 - DNA, 14 bp, Homo sapiens
tctgattgaggata

SEQ ID NO: 6435689 - DNA, 12 bp, Homo sapiens
tctgattgctat

SEQ ID NO: 6435690 - DNA, 13 bp, Homo sapiens
tctgattgctatc

SEQ ID NO: 6435691 - DNA, 20 bp, Homo sapiens
tctgattgctatcagcaatg

SEQ ID NO: 6435692 - DNA, 19 bp, Homo sapiens
tctgattggaatttctggc

SEQ ID NO: 6435693 - DNA, 15 bp, Homo sapiens
tctgattggacattt

SEQ ID NO: 6435694 - DNA, 19 bp, Homo sapiens
tctgattggacattttctt

SEQ ID NO: 6435695 - DNA, 21 bp, Homo sapiens
tctgattggacattttcttca

SEQ ID NO: 6435696 - DNA, 18 bp, Homo sapiens
tctgattggacctggccc

SEQ ID NO: 6435697 - DNA, 12 bp, Homo sapiens
tctgattggctg

SEQ ID NO: 6435698 - DNA, 21 bp, Homo sapiens
tctgattggcttgtagaattg

SEQ ID NO: 6435699 - DNA, 22 bp, Homo sapiens
tctgattggcttgtagaattgt

SEQ ID NO: 6435700 - DNA, 23 bp, Homo sapiens
tctgattggcttgtagaattgtt

SEQ ID NO: 6435701 - DNA, 13 bp, Homo sapiens
tctgattggtctg

SEQ ID NO: 6435702 - DNA, 17 bp, Homo sapiens
tctgattgtgttgaaga

SEQ ID NO: 6435703 - DNA, 17 bp, Homo sapiens
tctgatttactctttgg

SEQ ID NO: 6435704 - DNA, 21 bp, Homo sapiens
tctgatttagcaatgctgtga

SEQ ID NO: 6435705 - DNA, 23 bp, Homo sapiens
tctgatttatggtttttttaagt

SEQ ID NO: 6435706 - DNA, 13 bp, Homo sapiens
tctgatttcaagg

SEQ ID NO: 6435707 - DNA, 13 bp, Homo sapiens
tctgatttcaggg

SEQ ID NO: 6435708 - DNA, 14 bp, Homo sapiens
tctgatttcagttt

SEQ ID NO: 6435709 - DNA, 13 bp, Homo sapiens
tctgatttcataa

SEQ ID NO: 6435710 - DNA, 15 bp, Homo sapiens
tctgatttccttcca

SEQ ID NO: 6435711 - DNA, 14 bp, Homo sapiens
tctgatttctgaag

SEQ ID NO: 6435712 - DNA, 18 bp, Homo sapiens
tctgatttctgcccttgt

SEQ ID NO: 6435713 - DNA, 17 bp, Homo sapiens
tctgatttgcaaatgca

SEQ ID NO: 6435714 - DNA, 18 bp, Homo sapiens
tctgatttgcaggatttt

SEQ ID NO: 6435715 - DNA, 19 bp, Homo sapiens
tctgatttgctgctcttca

SEQ ID NO: 6435716 - DNA, 12 bp, Homo sapiens
tctgattttaat

SEQ ID NO: 6435717 - DNA, 21 bp, Homo sapiens
tctgattttaatgaaatcaaa

SEQ ID NO: 6435718 - DNA, 13 bp, Homo sapiens
tctgattttctcc

SEQ ID NO: 6435719 - DNA, 14 bp, Homo sapiens
tctgattttgaggt

SEQ ID NO: 6435720 - DNA, 17 bp, Homo sapiens
tctgattttgatatttt

SEQ ID NO: 6435721 - DNA, 14 bp, Homo sapiens
tctgattttggcat

SEQ ID NO: 6435722 - DNA, 17 bp, Homo sapiens
tctgatttttaagattt

SEQ ID NO: 6435723 - DNA, 16 bp, Homo sapiens
tctgatttttcctttc

SEQ ID NO: 6435724 - DNA, 15 bp, Homo sapiens
tctgatttttctctt

SEQ ID NO: 6435725 - DNA, 16 bp, Homo sapiens
tctgatttttctcttt

SEQ ID NO: 6435726 - DNA, 23 bp, Homo sapiens
tctgcaaaaagatttaacaaata

SEQ ID NO: 6435727 - DNA, 16 bp, Homo sapiens
tctgcaaagcatgttt

SEQ ID NO: 6435728 - DNA, 22 bp, Homo sapiens
tctgcaaaggagggcctcagag

SEQ ID NO: 6435729 - DNA, 17 bp, Homo sapiens
tctgcaaaggcctgggc

SEQ ID NO: 6435730 - DNA, 19 bp, Homo sapiens
tctgcaaaggtggcaatgc

SEQ ID NO: 6435731 - DNA, 21 bp, Homo sapiens
tctgcaaaggtggcaatgctt

SEQ ID NO: 6435732 - DNA, 21 bp, Homo sapiens
tctgcaaagtggcagggaccg

SEQ ID NO: 6435733 - DNA, 17 bp, Homo sapiens
tctgcaacaagcatgca

SEQ ID NO: 6435734 - DNA, 15 bp, Homo sapiens
tctgcaacagcctgt

SEQ ID NO: 6435735 - DNA, 15 bp, Homo sapiens
tctgcaacatggatt

SEQ ID NO: 6435736 - DNA, 19 bp, Homo sapiens
tctgcaacatggattccaa

SEQ ID NO: 6435737 - DNA, 16 bp, Homo sapiens
tctgcaactagccaag

SEQ ID NO: 6435738 - DNA, 18 bp, Homo sapiens
tctgcaactagccaaggc

SEQ ID NO: 6435739 - DNA, 19 bp, Homo sapiens
tctgcaactagccaaggct

SEQ ID NO: 6435740 - DNA, 19 bp, Homo sapiens
tctgcaactccatcctcct

SEQ ID NO: 6435741 - DNA, 15 bp, Homo sapiens
tctgcaactctgaag

SEQ ID NO: 6435742 - DNA, 19 bp, Homo sapiens
tctgcaactgaaattacat

SEQ ID NO: 6435743 - DNA, 14 bp, Homo sapiens
tctgcaactggaga

SEQ ID NO: 6435744 - DNA, 17 bp, Homo sapiens
tctgcaagaattaaaac

SEQ ID NO: 6435745 - DNA, 18 bp, Homo sapiens
tctgcaagaattaaaact

SEQ ID NO: 6435746 - DNA, 13 bp, Homo sapiens
tctgcaagacaaa

SEQ ID NO: 6435747 - DNA, 18 bp, Homo sapiens
tctgcaagagggggcatt

SEQ ID NO: 6435748 - DNA, 19 bp, Homo sapiens
tctgcaagattctgtgggc

SEQ ID NO: 6435749 - DNA, 20 bp, Homo sapiens
tctgcaagcacatctgcatt

SEQ ID NO: 6435750 - DNA, 19 bp, Homo sapiens
tctgcaagcccactggcca

SEQ ID NO: 6435751 - DNA, 15 bp, Homo sapiens
tctgcaagcctgcgt

SEQ ID NO: 6435752 - DNA, 21 bp, Homo sapiens
tctgcaaggccctctatttct

SEQ ID NO: 6435753 - DNA, 18 bp, Homo sapiens
tctgcaagggcccagagt

SEQ ID NO: 6435754 - DNA, 17 bp, Homo sapiens
tctgcaaggtctttggt

SEQ ID NO: 6435755 - DNA, 23 bp, Homo sapiens
tctgcaagtatactagggagcca

SEQ ID NO: 6435756 - DNA, 16 bp, Homo sapiens
tctgcaagtcagagga

SEQ ID NO: 6435757 - DNA, 17 bp, Homo sapiens
tctgcaagtcagaggat

SEQ ID NO: 6435758 - DNA, 23 bp, Homo sapiens
tctgcaagtcagaggatggccag

SEQ ID NO: 6435759 - DNA, 15 bp, Homo sapiens
tctgcaagtgctcag

SEQ ID NO: 6435760 - DNA, 16 bp, Homo sapiens
tctgcaagtgctcagg

SEQ ID NO: 6435761 - DNA, 17 bp, Homo sapiens
tctgcaagtgctcaggg

SEQ ID NO: 6435762 - DNA, 16 bp, Homo sapiens
tctgcaagtttctgtt

SEQ ID NO: 6435763 - DNA, 14 bp, Homo sapiens
tctgcaatcttctc

SEQ ID NO: 6435764 - DNA, 17 bp, Homo sapiens
tctgcaatcttctcaga

SEQ ID NO: 6435765 - DNA, 18 bp, Homo sapiens
tctgcaatgcttctgtag

SEQ ID NO: 6435766 - DNA, 19 bp, Homo sapiens
tctgcaatgcttctgtagc

SEQ ID NO: 6435767 - DNA, 23 bp, Homo sapiens
tctgcaatgcttctgtagcttct

SEQ ID NO: 6435768 - DNA, 23 bp, Homo sapiens
tctgcaatggcagcattcccacc

SEQ ID NO: 6435769 - DNA, 18 bp, Homo sapiens
tctgcaatgtcccttgca

SEQ ID NO: 6435770 - DNA, 21 bp, Homo sapiens
tctgcaattcccctctgctgc

SEQ ID NO: 6435771 - DNA, 15 bp, Homo sapiens
tctgcaatttctact

SEQ ID NO: 6435772 - DNA, 20 bp, Homo sapiens
tctgcaatttgtttaaagaa

SEQ ID NO: 6435773 - DNA, 19 bp, Homo sapiens
tctgcaattttactgtgaa

SEQ ID NO: 6435774 - DNA, 20 bp, Homo sapiens
tctgcaattttactgtgaaa

SEQ ID NO: 6435775 - DNA, 21 bp, Homo sapiens
tctgcaattttactgtgaaaa

SEQ ID NO: 6435776 - DNA, 22 bp, Homo sapiens
tctgcacacacctccgagacag

SEQ ID NO: 6435777 - DNA, 15 bp, Homo sapiens
tctgcacacataaca

SEQ ID NO: 6435778 - DNA, 10 bp, Homo sapiens
tctgcacaga

SEQ ID NO: 6435779 - DNA, 22 bp, Homo sapiens
tctgcacagaaacttgaactcc

SEQ ID NO: 6435780 - DNA, 17 bp, Homo sapiens
tctgcacagattctttt

SEQ ID NO: 6435781 - DNA, 16 bp, Homo sapiens
tctgcacaggtctctg

SEQ ID NO: 6435782 - DNA, 18 bp, Homo sapiens
tctgcacaggtctctgtt

SEQ ID NO: 6435783 - DNA, 19 bp, Homo sapiens
tctgcacagtcagaaggac

SEQ ID NO: 6435784 - DNA, 19 bp, Homo sapiens
tctgcacataaactctttt

SEQ ID NO: 6435785 - DNA, 22 bp, Homo sapiens
tctgcacatctgtaaatctaca

SEQ ID NO: 6435786 - DNA, 23 bp, Homo sapiens
tctgcacatgaatcccacccaca

SEQ ID NO: 6435787 - DNA, 23 bp, Homo sapiens
tctgcacatgcagctgcaccctc

SEQ ID NO: 6435788 - DNA, 16 bp, Homo sapiens
tctgcacatgtcttgt

SEQ ID NO: 6435789 - DNA, 17 bp, Homo sapiens
tctgcacatgtcttgta

SEQ ID NO: 6435790 - DNA, 19 bp, Homo sapiens
tctgcacatgtcttgtaca

SEQ ID NO: 6435791 - DNA, 20 bp, Homo sapiens
tctgcacatgtcttgtacat

SEQ ID NO: 6435792 - DNA, 21 bp, Homo sapiens
tctgcacatgtcttgtacatg

SEQ ID NO: 6435793 - DNA, 18 bp, Homo sapiens
tctgcaccaccatgccca

SEQ ID NO: 6435794 - DNA, 21 bp, Homo sapiens
tctgcacccagaaattccttc

SEQ ID NO: 6435795 - DNA, 14 bp, Homo sapiens
tctgcacccagaac

SEQ ID NO: 6435796 - DNA, 23 bp, Homo sapiens
tctgcacccagccccaaggggtg

SEQ ID NO: 6435797 - DNA, 13 bp, Homo sapiens
tctgcacccaggg

SEQ ID NO: 6435798 - DNA, 13 bp, Homo sapiens
tctgcaccccaca

SEQ ID NO: 6435799 - DNA, 16 bp, Homo sapiens
tctgcaccccacagga

SEQ ID NO: 6435800 - DNA, 18 bp, Homo sapiens
tctgcaccccacaggatg

SEQ ID NO: 6435801 - DNA, 18 bp, Homo sapiens
tctgcacccccctgggct

SEQ ID NO: 6435802 - DNA, 19 bp, Homo sapiens
tctgcaccccttctctcct

SEQ ID NO: 6435803 - DNA, 14 bp, Homo sapiens
tctgcacccgcctc

SEQ ID NO: 6435804 - DNA, 13 bp, Homo sapiens
tctgcaccctcca

SEQ ID NO: 6435805 - DNA, 14 bp, Homo sapiens
tctgcaccctccac

SEQ ID NO: 6435806 - DNA, 21 bp, Homo sapiens
tctgcaccctccaccctgtcc

SEQ ID NO: 6435807 - DNA, 19 bp, Homo sapiens
tctgcacccttcttttctc

SEQ ID NO: 6435808 - DNA, 21 bp, Homo sapiens
tctgcacccttcttttctcat

SEQ ID NO: 6435809 - DNA, 14 bp, Homo sapiens
tctgcaccttctga

SEQ ID NO: 6435810 - DNA, 19 bp, Homo sapiens
tctgcacgctcaatgccca

SEQ ID NO: 6435811 - DNA, 20 bp, Homo sapiens
tctgcacgctcaatgcccag

SEQ ID NO: 6435812 - DNA, 19 bp, Homo sapiens
tctgcactactcctctgca

SEQ ID NO: 6435813 - DNA, 23 bp, Homo sapiens
tctgcactactcctctgcagtgc

SEQ ID NO: 6435814 - DNA, 19 bp, Homo sapiens
tctgcactccatggccacc

SEQ ID NO: 6435815 - DNA, 18 bp, Homo sapiens
tctgcactcccacctgac

SEQ ID NO: 6435816 - DNA, 20 bp, Homo sapiens
tctgcactcccctgctgggt

SEQ ID NO: 6435817 - DNA, 16 bp, Homo sapiens
tctgcactcctgtctc

SEQ ID NO: 6435818 - DNA, 19 bp, Homo sapiens
tctgcactctaaactgcaa

SEQ ID NO: 6435819 - DNA, 21 bp, Homo sapiens
tctgcactctaaccctaggca

SEQ ID NO: 6435820 - DNA, 14 bp, Homo sapiens
tctgcactcttgta

SEQ ID NO: 6435821 - DNA, 16 bp, Homo sapiens
tctgcactgaaaaggt

SEQ ID NO: 6435822 - DNA, 18 bp, Homo sapiens
tctgcacttctgttccag

SEQ ID NO: 6435823 - DNA, 21 bp, Homo sapiens
tctgcagaaaaaaaagaaaaa

SEQ ID NO: 6435824 - DNA, 21 bp, Homo sapiens
tctgcagaaatttgcaactca

SEQ ID NO: 6435825 - DNA, 15 bp, Homo sapiens
tctgcagaacagtga

SEQ ID NO: 6435826 - DNA, 16 bp, Homo sapiens
tctgcagaacagtgaa

SEQ ID NO: 6435827 - DNA, 18 bp, Homo sapiens
tctgcagaacagtgaaag

SEQ ID NO: 6435828 - DNA, 10 bp, Homo sapiens
tctgcagaag

SEQ ID NO: 6435829 - DNA, 21 bp, Homo sapiens
tctgcagaagccaagggaaga

SEQ ID NO: 6435830 - DNA, 15 bp, Homo sapiens
tctgcagaaggaaaa

SEQ ID NO: 6435831 - DNA, 23 bp, Homo sapiens
tctgcagacaagtcttgctgtgc

SEQ ID NO: 6435832 - DNA, 13 bp, Homo sapiens
tctgcagagactt

SEQ ID NO: 6435833 - DNA, 18 bp, Homo sapiens
tctgcagaggcagcagga

SEQ ID NO: 6435834 - DNA, 22 bp, Homo sapiens
tctgcagaggcagcaggagcca

SEQ ID NO: 6435835 - DNA, 14 bp, Homo sapiens
tctgcagagtggtg

SEQ ID NO: 6435836 - DNA, 20 bp, Homo sapiens
tctgcagatagaaagcatta

SEQ ID NO: 6435837 - DNA, 18 bp, Homo sapiens
tctgcagatagtgcctct

SEQ ID NO: 6435838 - DNA, 20 bp, Homo sapiens
tctgcagatagtgcctctgc

SEQ ID NO: 6435839 - DNA, 22 bp, Homo sapiens
tctgcagatagtgcctctgcaa

SEQ ID NO: 6435840 - DNA, 19 bp, Homo sapiens
tctgcagatcttccgtggt

SEQ ID NO: 6435841 - DNA, 22 bp, Homo sapiens
tctgcagatcttccgtggtcag

SEQ ID NO: 6435842 - DNA, 21 bp, Homo sapiens
tctgcagcaactcccacgact

SEQ ID NO: 6435843 - DNA, 19 bp, Homo sapiens
tctgcagcaccgtgggccc

SEQ ID NO: 6435844 - DNA, 16 bp, Homo sapiens
tctgcagcattgaagt

SEQ ID NO: 6435845 - DNA, 19 bp, Homo sapiens
tctgcagccagcccagccc

SEQ ID NO: 6435846 - DNA, 19 bp, Homo sapiens
tctgcagccattcttcagg

SEQ ID NO: 6435847 - DNA, 14 bp, Homo sapiens
tctgcagcccacag

SEQ ID NO: 6435848 - DNA, 15 bp, Homo sapiens
tctgcagcccagcct

SEQ ID NO: 6435849 - DNA, 21 bp, Homo sapiens
tctgcagcccgatgtccctgt

SEQ ID NO: 6435850 - DNA, 20 bp, Homo sapiens
tctgcagcccttgggcagtt

SEQ ID NO: 6435851 - DNA, 11 bp, Homo sapiens
tctgcagcctc

SEQ ID NO: 6435852 - DNA, 13 bp, Homo sapiens
tctgcagcctcag

SEQ ID NO: 6435853 - DNA, 16 bp, Homo sapiens
tctgcagcctcggcct

SEQ ID NO: 6435854 - DNA, 13 bp, Homo sapiens
tctgcagcctgct

SEQ ID NO: 6435855 - DNA, 13 bp, Homo sapiens
tctgcagccttga

SEQ ID NO: 6435856 - DNA, 17 bp, Homo sapiens
tctgcagcggcagagca

SEQ ID NO: 6435857 - DNA, 21 bp, Homo sapiens
tctgcagctattcacacacac

SEQ ID NO: 6435858 - DNA, 23 bp, Homo sapiens
tctgcagctcaagggctggcact

SEQ ID NO: 6435859 - DNA, 13 bp, Homo sapiens
tctgcagctgacc

SEQ ID NO: 6435860 - DNA, 20 bp, Homo sapiens
tctgcagctgacctctgttg

SEQ ID NO: 6435861 - DNA, 12 bp, Homo sapiens
tctgcagctgct

SEQ ID NO: 6435862 - DNA, 15 bp, Homo sapiens
tctgcagctggtgtg

SEQ ID NO: 6435863 - DNA, 12 bp, Homo sapiens
tctgcagctgtt

SEQ ID NO: 6435864 - DNA, 18 bp, Homo sapiens
tctgcagctttggctgca

SEQ ID NO: 6435865 - DNA, 22 bp, Homo sapiens
tctgcaggaatcccggctccag

SEQ ID NO: 6435866 - DNA, 12 bp, Homo sapiens
tctgcaggacac

SEQ ID NO: 6435867 - DNA, 14 bp, Homo sapiens
tctgcaggacacag

SEQ ID NO: 6435868 - DNA, 20 bp, Homo sapiens
tctgcaggacacagatctgg

SEQ ID NO: 6435869 - DNA, 22 bp, Homo sapiens
tctgcaggcaccttagtggctt

SEQ ID NO: 6435870 - DNA, 14 bp, Homo sapiens
tctgcaggcagaca

SEQ ID NO: 6435871 - DNA, 15 bp, Homo sapiens
tctgcaggcagacac

SEQ ID NO: 6435872 - DNA, 12 bp, Homo sapiens
tctgcaggcagc

SEQ ID NO: 6435873 - DNA, 13 bp, Homo sapiens
tctgcaggccacc

SEQ ID NO: 6435874 - DNA, 23 bp, Homo sapiens
tctgcaggcctaggtgcagctcc

SEQ ID NO: 6435875 - DNA, 17 bp, Homo sapiens
tctgcaggctggggagg

SEQ ID NO: 6435876 - DNA, 18 bp, Homo sapiens
tctgcaggctggggaggt

SEQ ID NO: 6435877 - DNA, 19 bp, Homo sapiens
tctgcaggcttaataaaaa

SEQ ID NO: 6435878 - DNA, 14 bp, Homo sapiens
tctgcagggcagcc

SEQ ID NO: 6435879 - DNA, 17 bp, Homo sapiens
tctgcagggcagcctgt

SEQ ID NO: 6435880 - DNA, 18 bp, Homo sapiens
tctgcagggcagcctgtg

SEQ ID NO: 6435881 - DNA, 22 bp, Homo sapiens
tctgcagggcagcctgtgggag

SEQ ID NO: 6435882 - DNA, 20 bp, Homo sapiens
tctgcagggccgccagggag

SEQ ID NO: 6435883 - DNA, 13 bp, Homo sapiens
tctgcaggggcct

SEQ ID NO: 6435884 - DNA, 16 bp, Homo sapiens
tctgcaggggcctgga

SEQ ID NO: 6435885 - DNA, 18 bp, Homo sapiens
tctgcaggggcctggagg

SEQ ID NO: 6435886 - DNA, 23 bp, Homo sapiens
tctgcagggtgaagcaccaggga

SEQ ID NO: 6435887 - DNA, 12 bp, Homo sapiens
tctgcaggtccc

SEQ ID NO: 6435888 - DNA, 14 bp, Homo sapiens
tctgcaggtcccta

SEQ ID NO: 6435889 - DNA, 21 bp, Homo sapiens
tctgcaggtccctaataaagc

SEQ ID NO: 6435890 - DNA, 22 bp, Homo sapiens
tctgcaggtccctaataaagct

SEQ ID NO: 6435891 - DNA, 19 bp, Homo sapiens
tctgcaggtgggctgctga

SEQ ID NO: 6435892 - DNA, 21 bp, Homo sapiens
tctgcaggttcttcttcctga

SEQ ID NO: 6435893 - DNA, 18 bp, Homo sapiens
tctgcaggttgaagccat

SEQ ID NO: 6435894 - DNA, 17 bp, Homo sapiens
tctgcagtaaaacacat

SEQ ID NO: 6435895 - DNA, 23 bp, Homo sapiens
tctgcagtaaaacacatttggga

SEQ ID NO: 6435896 - DNA, 20 bp, Homo sapiens
tctgcagtagtctctgtgct

SEQ ID NO: 6435897 - DNA, 17 bp, Homo sapiens
tctgcagtattctgtag

SEQ ID NO: 6435898 - DNA, 20 bp, Homo sapiens
tctgcagtcacttcgtggga

SEQ ID NO: 6435899 - DNA, 17 bp, Homo sapiens
tctgcagtcatctcccc

SEQ ID NO: 6435900 - DNA, 13 bp, Homo sapiens
tctgcagtcctgg

SEQ ID NO: 6435901 - DNA, 14 bp, Homo sapiens
tctgcagtcctggt

SEQ ID NO: 6435902 - DNA, 17 bp, Homo sapiens
tctgcagtcgcttgcca

SEQ ID NO: 6435903 - DNA, 14 bp, Homo sapiens
tctgcagtctctat

SEQ ID NO: 6435904 - DNA, 21 bp, Homo sapiens
tctgcagtctctataccaata

SEQ ID NO: 6435905 - DNA, 18 bp, Homo sapiens
tctgcagtgtggcaagca

SEQ ID NO: 6435906 - DNA, 20 bp, Homo sapiens
tctgcagtgttctgtgaata

SEQ ID NO: 6435907 - DNA, 17 bp, Homo sapiens
tctgcagtttgtgaact

SEQ ID NO: 6435908 - DNA, 14 bp, Homo sapiens
tctgcataaacttc

SEQ ID NO: 6435909 - DNA, 16 bp, Homo sapiens
tctgcataaacttcat

SEQ ID NO: 6435910 - DNA, 19 bp, Homo sapiens
tctgcatacgagagacttg

SEQ ID NO: 6435911 - DNA, 12 bp, Homo sapiens
tctgcatagaca

SEQ ID NO: 6435912 - DNA, 21 bp, Homo sapiens
tctgcatatgttgaatacttt

SEQ ID NO: 6435913 - DNA, 21 bp, Homo sapiens
tctgcatatttctgtatattt

SEQ ID NO: 6435914 - DNA, 15 bp, Homo sapiens
tctgcatcaaaggag

SEQ ID NO: 6435915 - DNA, 19 bp, Homo sapiens
tctgcatcagctgctgaaa

SEQ ID NO: 6435916 - DNA, 16 bp, Homo sapiens
tctgcatcagcttttt

SEQ ID NO: 6435917 - DNA, 18 bp, Homo sapiens
tctgcatcatctgtagat

SEQ ID NO: 6435918 - DNA, 14 bp, Homo sapiens
tctgcatcccagca

SEQ ID NO: 6435919 - DNA, 18 bp, Homo sapiens
tctgcatcccagcacctg

SEQ ID NO: 6435920 - DNA, 19 bp, Homo sapiens
tctgcatcccagcacctgc

SEQ ID NO: 6435921 - DNA, 21 bp, Homo sapiens
tctgcatcctctggagccagc

SEQ ID NO: 6435922 - DNA, 19 bp, Homo sapiens
tctgcatctactcccaagt

SEQ ID NO: 6435923 - DNA, 13 bp, Homo sapiens
tctgcatctgacc

SEQ ID NO: 6435924 - DNA, 20 bp, Homo sapiens
tctgcatctgaccacgtgct

SEQ ID NO: 6435925 - DNA, 18 bp, Homo sapiens
tctgcatctgactctctt

SEQ ID NO: 6435926 - DNA, 17 bp, Homo sapiens
tctgcatcttaacatgc

SEQ ID NO: 6435927 - DNA, 13 bp, Homo sapiens
tctgcatcttcag

SEQ ID NO: 6435928 - DNA, 14 bp, Homo sapiens
tctgcatgagctga

SEQ ID NO: 6435929 - DNA, 13 bp, Homo sapiens
tctgcatgccctc

SEQ ID NO: 6435930 - DNA, 14 bp, Homo sapiens
tctgcatgcggccc

SEQ ID NO: 6435931 - DNA, 16 bp, Homo sapiens
tctgcatgcggcccag

SEQ ID NO: 6435932 - DNA, 20 bp, Homo sapiens
tctgcatgcggcccagcccg

SEQ ID NO: 6435933 - DNA, 21 bp, Homo sapiens
tctgcatgcggcccagcccgg

SEQ ID NO: 6435934 - DNA, 18 bp, Homo sapiens
tctgcatgctcctctgcc

SEQ ID NO: 6435935 - DNA, 21 bp, Homo sapiens
tctgcatggcagaagcgtctc

SEQ ID NO: 6435936 - DNA, 23 bp, Homo sapiens
tctgcattactattaactctgca

SEQ ID NO: 6435937 - DNA, 20 bp, Homo sapiens
tctgcattatctatgcagca

SEQ ID NO: 6435938 - DNA, 21 bp, Homo sapiens
tctgcattcacagcgcctcct

SEQ ID NO: 6435939 - DNA, 23 bp, Homo sapiens
tctgcattcacagcgcctcctgg

SEQ ID NO: 6435940 - DNA, 14 bp, Homo sapiens
tctgcattcctgat

SEQ ID NO: 6435941 - DNA, 22 bp, Homo sapiens
tctgcattcctgtaacttttaa

SEQ ID NO: 6435942 - DNA, 16 bp, Homo sapiens
tctgcattgacctgga

SEQ ID NO: 6435943 - DNA, 18 bp, Homo sapiens
tctgcattgagaaggaac

SEQ ID NO: 6435944 - DNA, 19 bp, Homo sapiens
tctgcattgagaaggaact

SEQ ID NO: 6435945 - DNA, 24 bp, Homo sapiens
tctgcattgagaaggaactgatac

SEQ ID NO: 6435946 - DNA, 17 bp, Homo sapiens
tcaggaaaagcctctgt

SEQ ID NO: 6435947 - DNA, 14 bp, Homo sapiens
tcaggaaaaggcct

SEQ ID NO: 6435948 - DNA, 21 bp, Homo sapiens
tcaggaaacgagactttccat

SEQ ID NO: 6435949 - DNA, 14 bp, Homo sapiens
tcaggaaagaatag

SEQ ID NO: 6435950 - DNA, 13 bp, Homo sapiens
tcaggaaagagag

SEQ ID NO: 6435951 - DNA, 22 bp, Homo sapiens
tcaggaaaggaatcatttctat

SEQ ID NO: 6435952 - DNA, 17 bp, Homo sapiens
tcaggaaatctacttcc

SEQ ID NO: 6435953 - DNA, 15 bp, Homo sapiens
tcaggaaatttttgc

SEQ ID NO: 6435954 - DNA, 18 bp, Homo sapiens
tcaggaacagtggctggg

SEQ ID NO: 6435955 - DNA, 15 bp, Homo sapiens
tcaggaaccctggag

SEQ ID NO: 6435956 - DNA, 19 bp, Homo sapiens
tcaggaacctcgagtactg

SEQ ID NO: 6435957 - DNA, 20 bp, Homo sapiens
tcaggaacctcgagtactgt

SEQ ID NO: 6435958 - DNA, 22 bp, Homo sapiens
tcaggaacctcgagtactgtgg

SEQ ID NO: 6435959 - DNA, 17 bp, Homo sapiens
tcaggaacctggaccaa

SEQ ID NO: 6435960 - DNA, 23 bp, Homo sapiens
tcaggaacgtttagctgacaaaa

SEQ ID NO: 6435961 - DNA, 17 bp, Homo sapiens
tcaggaactatgggagc

SEQ ID NO: 6435962 - DNA, 12 bp, Homo sapiens
tcaggaagaaat

SEQ ID NO: 6435963 - DNA, 23 bp, Homo sapiens
tcaggaagaaatcacagaatcat

SEQ ID NO: 6435964 - DNA, 22 bp, Homo sapiens
tcaggaagaacaccctctaaat

SEQ ID NO: 6435965 - DNA, 14 bp, Homo sapiens
tcaggaagaagaga

SEQ ID NO: 6435966 - DNA, 12 bp, Homo sapiens
tcaggaagctca

SEQ ID NO: 6435967 - DNA, 15 bp, Homo sapiens
tcaggaagctcaggg

SEQ ID NO: 6435968 - DNA, 17 bp, Homo sapiens
tcaggaagctcagggcc

SEQ ID NO: 6435969 - DNA, 19 bp, Homo sapiens
tcaggaagctcagggcctg

SEQ ID NO: 6435970 - DNA, 20 bp, Homo sapiens
tcaggaagctcagggcctgg

SEQ ID NO: 6435971 - DNA, 14 bp, Homo sapiens
tcaggaagctctct

SEQ ID NO: 6435972 - DNA, 13 bp, Homo sapiens
tcaggaaggacat

SEQ ID NO: 6435973 - DNA, 14 bp, Homo sapiens
tcaggaagggagag

SEQ ID NO: 6435974 - DNA, 20 bp, Homo sapiens
tcaggaagggtcggagtctg

SEQ ID NO: 6435975 - DNA, 22 bp, Homo sapiens
tcaggaaggtatcacacacttt

SEQ ID NO: 6435976 - DNA, 14 bp, Homo sapiens
tcaggaagtaaaat

SEQ ID NO: 6435977 - DNA, 17 bp, Homo sapiens
tcaggaagttgctgaga

SEQ ID NO: 6435978 - DNA, 15 bp, Homo sapiens
tcaggaatataaata

SEQ ID NO: 6435979 - DNA, 16 bp, Homo sapiens
tcaggaatataaatat

SEQ ID NO: 6435980 - DNA, 21 bp, Homo sapiens
tcaggaatatctgttcccagc

SEQ ID NO: 6435981 - DNA, 22 bp, Homo sapiens
tcaggaatcctacgctatgtag

SEQ ID NO: 6435982 - DNA, 19 bp, Homo sapiens
tcaggaatcggaatcctgt

SEQ ID NO: 6435983 - DNA, 14 bp, Homo sapiens
tcaggaatgagtca

SEQ ID NO: 6435984 - DNA, 13 bp, Homo sapiens
tcaggaattcagt

SEQ ID NO: 6435985 - DNA, 18 bp, Homo sapiens
tcaggaattcagtgcctt

SEQ ID NO: 6435986 - DNA, 18 bp, Homo sapiens
tcaggaattcttggagaa

SEQ ID NO: 6435987 - DNA, 15 bp, Homo sapiens
tcaggaattgaagat

SEQ ID NO: 6435988 - DNA, 15 bp, Homo sapiens
tcaggacacaggcct

SEQ ID NO: 6435989 - DNA, 17 bp, Homo sapiens
tcaggacacaggcctgt

SEQ ID NO: 6435990 - DNA, 18 bp, Homo sapiens
tcaggacacaggcctgtg

SEQ ID NO: 6435991 - DNA, 19 bp, Homo sapiens
tcaggacacaggcctgtgt

SEQ ID NO: 6435992 - DNA, 23 bp, Homo sapiens
tcaggacacaggcctgtgtagct

SEQ ID NO: 6435993 - DNA, 14 bp, Homo sapiens
tcaggacagatgcc

SEQ ID NO: 6435994 - DNA, 12 bp, Homo sapiens
tcaggacagctg

SEQ ID NO: 6435995 - DNA, 15 bp, Homo sapiens
tcaggacatggggca

SEQ ID NO: 6435996 - DNA, 18 bp, Homo sapiens
tcaggacatggggcatag

SEQ ID NO: 6435997 - DNA, 14 bp, Homo sapiens
tcaggaccaccctg

SEQ ID NO: 6435998 - DNA, 20 bp, Homo sapiens
tcaggaccaccctgccaagg

SEQ ID NO: 6435999 - DNA, 15 bp, Homo sapiens
tcaggaccagatgtc

SEQ ID NO: 6436000 - DNA, 13 bp, Homo sapiens
tcaggaccaggca

SEQ ID NO: 6436001 - DNA, 15 bp, Homo sapiens
tcaggacccagagga

SEQ ID NO: 6436002 - DNA, 19 bp, Homo sapiens
tcaggacccagaggaaggg

SEQ ID NO: 6436003 - DNA, 12 bp, Homo sapiens
tcaggacccagg

SEQ ID NO: 6436004 - DNA, 13 bp, Homo sapiens
tcaggacccaggc

SEQ ID NO: 6436005 - DNA, 14 bp, Homo sapiens
tcaggacccaggcc

SEQ ID NO: 6436006 - DNA, 15 bp, Homo sapiens
tcaggacccaggccc

SEQ ID NO: 6436007 - DNA, 16 bp, Homo sapiens
tcaggacccaggccct

SEQ ID NO: 6436008 - DNA, 17 bp, Homo sapiens
tcaggacccaggccgcc

SEQ ID NO: 6436009 - DNA, 20 bp, Homo sapiens
tcaggacccatccctgcctg

SEQ ID NO: 6436010 - DNA, 22 bp, Homo sapiens
tcaggacccatccctgcctgga

SEQ ID NO: 6436011 - DNA, 23 bp, Homo sapiens
tcaggacccatccctgcctggag

SEQ ID NO: 6436012 - DNA, 23 bp, Homo sapiens
tcaggaccccagagggaccagct

SEQ ID NO: 6436013 - DNA, 20 bp, Homo sapiens
tcaggaccccatctgctgag

SEQ ID NO: 6436014 - DNA, 18 bp, Homo sapiens
tcaggacctccaagccac

SEQ ID NO: 6436015 - DNA, 21 bp, Homo sapiens
tcaggacctgggacctcccct

SEQ ID NO: 6436016 - DNA, 14 bp, Homo sapiens
tcaggaccttttga

SEQ ID NO: 6436017 - DNA, 19 bp, Homo sapiens
tcaggacggctcctcagag

SEQ ID NO: 6436018 - DNA, 20 bp, Homo sapiens
tcaggacggctcctcagagc

SEQ ID NO: 6436019 - DNA, 13 bp, Homo sapiens
tcaggactccagc

SEQ ID NO: 6436020 - DNA, 14 bp, Homo sapiens
tcaggactccagcc

SEQ ID NO: 6436021 - DNA, 18 bp, Homo sapiens
tcaggactccagcccatt

SEQ ID NO: 6436022 - DNA, 13 bp, Homo sapiens
tcaggactggctc

SEQ ID NO: 6436023 - DNA, 18 bp, Homo sapiens
tcaggactggctcacccc

SEQ ID NO: 6436024 - DNA, 13 bp, Homo sapiens
tcaggactgggag

SEQ ID NO: 6436025 - DNA, 21 bp, Homo sapiens
tcaggactgggagcccccagc

SEQ ID NO: 6436026 - DNA, 23 bp, Homo sapiens
tcaggactgggagcccccagcct

SEQ ID NO: 6436027 - DNA, 19 bp, Homo sapiens
tcaggactgtgaccaaagc

SEQ ID NO: 6436028 - DNA, 15 bp, Homo sapiens
tcaggacttgggaaa

SEQ ID NO: 6436029 - DNA, 12 bp, Homo sapiens
tcaggagaaaaa

SEQ ID NO: 6436030 - DNA, 17 bp, Homo sapiens
tcaggagaagccagtgt

SEQ ID NO: 6436031 - DNA, 19 bp, Homo sapiens
tcaggagactgggctctgg

SEQ ID NO: 6436032 - DNA, 23 bp, Homo sapiens
tcaggagactttacaaacctttg

SEQ ID NO: 6436033 - DNA, 19 bp, Homo sapiens
tcaggagagagcttcctgt

SEQ ID NO: 6436034 - DNA, 20 bp, Homo sapiens
tcaggagagagttgaaccta

SEQ ID NO: 6436035 - DNA, 15 bp, Homo sapiens
tcaggagagcaaggt

SEQ ID NO: 6436036 - DNA, 23 bp, Homo sapiens
tcaggagagggatacaagagagg

SEQ ID NO: 6436037 - DNA, 15 bp, Homo sapiens
tcaggagagggcctt

SEQ ID NO: 6436038 - DNA, 23 bp, Homo sapiens
tcaggagagtaaaaattcatata

SEQ ID NO: 6436039 - DNA, 15 bp, Homo sapiens
tcaggagagtgtgca

SEQ ID NO: 6436040 - DNA, 22 bp, Homo sapiens
tcaggagatcgagaccatcctg

SEQ ID NO: 6436041 - DNA, 18 bp, Homo sapiens
tcaggagatggagggctt

SEQ ID NO: 6436042 - DNA, 15 bp, Homo sapiens
tcaggagatggggaa

SEQ ID NO: 6436043 - DNA, 16 bp, Homo sapiens
tcaggagcacagccat

SEQ ID NO: 6436044 - DNA, 11 bp, Homo sapiens
tcaggagcccc

SEQ ID NO: 6436045 - DNA, 11 bp, Homo sapiens
tcaggagccct

SEQ ID NO: 6436046 - DNA, 15 bp, Homo sapiens
tcaggagccctggga

SEQ ID NO: 6436047 - DNA, 23 bp, Homo sapiens
tcaggagccctgggaggctctgg

SEQ ID NO: 6436048 - DNA, 23 bp, Homo sapiens
tcaggagccgaagcccaggggcc

SEQ ID NO: 6436049 - DNA, 20 bp, Homo sapiens
tcaggagcctcctagggctt

SEQ ID NO: 6436050 - DNA, 14 bp, Homo sapiens
tcaggagcctgcta

SEQ ID NO: 6436051 - DNA, 17 bp, Homo sapiens
tcaggagcctgctaagg

SEQ ID NO: 6436052 - DNA, 21 bp, Homo sapiens
tcaggagcctgctaaggaaca

SEQ ID NO: 6436053 - DNA, 12 bp, Homo sapiens
tcaggagcctgg

SEQ ID NO: 6436054 - DNA, 20 bp, Homo sapiens
tcaggagcctggccaggcag

SEQ ID NO: 6436055 - DNA, 22 bp, Homo sapiens
tcaggagcctggccaggcaggg

SEQ ID NO: 6436056 - DNA, 15 bp, Homo sapiens
tcaggagctgctcag

SEQ ID NO: 6436057 - DNA, 21 bp, Homo sapiens
tcaggagcttgggcagtgccc

SEQ ID NO: 6436058 - DNA, 23 bp, Homo sapiens
tcaggaggaaggcttacacccac

SEQ ID NO: 6436059 - DNA, 19 bp, Homo sapiens
tcaggaggaatactgaaca

SEQ ID NO: 6436060 - DNA, 21 bp, Homo sapiens
tcaggaggagattaacacact

SEQ ID NO: 6436061 - DNA, 20 bp, Homo sapiens
tcaggaggcagaggttgcag

SEQ ID NO: 6436062 - DNA, 23 bp, Homo sapiens
tcaggaggcagaggttgcagtga

SEQ ID NO: 6436063 - DNA, 13 bp, Homo sapiens
tcaggaggcagtg

SEQ ID NO: 6436064 - DNA, 22 bp, Homo sapiens
tcaggaggccctggtgtcaggc

SEQ ID NO: 6436065 - DNA, 13 bp, Homo sapiens
tcaggaggctgag

SEQ ID NO: 6436066 - DNA, 18 bp, Homo sapiens
tcaggaggctgagacagg

SEQ ID NO: 6436067 - DNA, 20 bp, Homo sapiens
tcaggaggctgaggcagaag

SEQ ID NO: 6436068 - DNA, 18 bp, Homo sapiens
tcaggaggctgaggcagg

SEQ ID NO: 6436069 - DNA, 17 bp, Homo sapiens
tcaggaggggaagaggc

SEQ ID NO: 6436070 - DNA, 21 bp, Homo sapiens
tcaggagggtcaccctggcct

SEQ ID NO: 6436071 - DNA, 23 bp, Homo sapiens
tcaggagggtgacgcccagctcc

SEQ ID NO: 6436072 - DNA, 15 bp, Homo sapiens
tcaggaggtgcctga

SEQ ID NO: 6436073 - DNA, 22 bp, Homo sapiens
tcaggaggtgcctgagagcaga

SEQ ID NO: 6436074 - DNA, 18 bp, Homo sapiens
tcaggagtccaaaccttc

SEQ ID NO: 6436075 - DNA, 16 bp, Homo sapiens
tcaggagtctgccact

SEQ ID NO: 6436076 - DNA, 19 bp, Homo sapiens
tcaggagtctgccacttgt

SEQ ID NO: 6436077 - DNA, 20 bp, Homo sapiens
tcaggagttagaggccagcc

SEQ ID NO: 6436078 - DNA, 15 bp, Homo sapiens
tcaggagttcaagac

SEQ ID NO: 6436079 - DNA, 21 bp, Homo sapiens
tcaggagttcaagaccagcct

SEQ ID NO: 6436080 - DNA, 22 bp, Homo sapiens
tcaggagttcaagaccagcctg

SEQ ID NO: 6436081 - DNA, 16 bp, Homo sapiens
tcaggagttcaagact

SEQ ID NO: 6436082 - DNA, 19 bp, Homo sapiens
tcaggagttcgagaccagc

SEQ ID NO: 6436083 - DNA, 21 bp, Homo sapiens
tcaggagttcgagaccagcct

SEQ ID NO: 6436084 - DNA, 20 bp, Homo sapiens
tcaggagttcgagagcagcc

SEQ ID NO: 6436085 - DNA, 22 bp, Homo sapiens
tcaggagttcgagagcagcctg

SEQ ID NO: 6436086 - DNA, 16 bp, Homo sapiens
tcaggagttggaatgt

SEQ ID NO: 6436087 - DNA, 19 bp, Homo sapiens
tcaggagttttactgcctg

SEQ ID NO: 6436088 - DNA, 14 bp, Homo sapiens
tcaggatacatgtg

SEQ ID NO: 6436089 - DNA, 16 bp, Homo sapiens
tcaggatacatgtgcc

SEQ ID NO: 6436090 - DNA, 23 bp, Homo sapiens
tcaggatatccttatcagagcta

SEQ ID NO: 6436091 - DNA, 18 bp, Homo sapiens
tcaggatattggttcttc

SEQ ID NO: 6436092 - DNA, 15 bp, Homo sapiens
tcaggatcagctttg

SEQ ID NO: 6436093 - DNA, 20 bp, Homo sapiens
tcaggatccaagctaagcac

SEQ ID NO: 6436094 - DNA, 19 bp, Homo sapiens
tcaggatccagtgacatga

SEQ ID NO: 6436095 - DNA, 13 bp, Homo sapiens
tcaggatctcatg

SEQ ID NO: 6436096 - DNA, 18 bp, Homo sapiens
tcaggatgagaacacact

SEQ ID NO: 6436097 - DNA, 19 bp, Homo sapiens
tcaggatgaggccccgcct

SEQ ID NO: 6436098 - DNA, 20 bp, Homo sapiens
tcaggatgatacactatgaa

SEQ ID NO: 6436099 - DNA, 18 bp, Homo sapiens
tcaggatgcacatttctg

SEQ ID NO: 6436100 - DNA, 21 bp, Homo sapiens
tcaggatgcacatttctggat

SEQ ID NO: 6436101 - DNA, 23 bp, Homo sapiens
tcaggatgcacggtttctgttct

SEQ ID NO: 6436102 - DNA, 22 bp, Homo sapiens
tcaggatgccaagtggccctca

SEQ ID NO: 6436103 - DNA, 13 bp, Homo sapiens
tcaggatgcccag

SEQ ID NO: 6436104 - DNA, 22 bp, Homo sapiens
tcaggatgcccagggccactct

SEQ ID NO: 6436105 - DNA, 20 bp, Homo sapiens
tcaggattaactaaagaaga

SEQ ID NO: 6436106 - DNA, 14 bp, Homo sapiens
tcaggattccttct

SEQ ID NO: 6436107 - DNA, 20 bp, Homo sapiens
tcaggattgcgagagatgtg

SEQ ID NO: 6436108 - DNA, 15 bp, Homo sapiens
tcaggattgctagga

SEQ ID NO: 6436109 - DNA, 23 bp, Homo sapiens
tcaggattgtctggttaaatagt

SEQ ID NO: 6436110 - DNA, 21 bp, Homo sapiens
tcaggatttcaccagaagtta

SEQ ID NO: 6436111 - DNA, 20 bp, Homo sapiens
tcaggatttggtttttctct

SEQ ID NO: 6436112 - DNA, 21 bp, Homo sapiens
tcaggatttggtttttctctt

SEQ ID NO: 6436113 - DNA, 22 bp, Homo sapiens
tcaggatttggtttttctcttt

SEQ ID NO: 6436114 - DNA, 22 bp, Homo sapiens
tcaggcaagcccctcagccctt

SEQ ID NO: 6436115 - DNA, 12 bp, Homo sapiens
tcaggcaaggag

SEQ ID NO: 6436116 - DNA, 13 bp, Homo sapiens
tcaggcaaggagg

SEQ ID NO: 6436117 - DNA, 20 bp, Homo sapiens
tcaggcaaggcagctcccag

SEQ ID NO: 6436118 - DNA, 17 bp, Homo sapiens
tcaggcaatgccctgcg

SEQ ID NO: 6436119 - DNA, 14 bp, Homo sapiens
tcaggcacaggcag

SEQ ID NO: 6436120 - DNA, 18 bp, Homo sapiens
tcaggcacaggcaggaag

SEQ ID NO: 6436121 - DNA, 14 bp, Homo sapiens
tcaggcacaggtca

SEQ ID NO: 6436122 - DNA, 15 bp, Homo sapiens
tcaggcacaggtcag

SEQ ID NO: 6436123 - DNA, 22 bp, Homo sapiens
tctgcattgttattgtggaaga

SEQ ID NO: 6436124 - DNA, 19 bp, Homo sapiens
tctgcatttaccactgtat

SEQ ID NO: 6436125 - DNA, 20 bp, Homo sapiens
tctgcatttagctgtattca

SEQ ID NO: 6436126 - DNA, 21 bp, Homo sapiens
tctgcatttagctgtattcat

SEQ ID NO: 6436127 - DNA, 20 bp, Homo sapiens
tctgcatttataaatgtgtg

SEQ ID NO: 6436128 - DNA, 23 bp, Homo sapiens
tctgcatttataaatgtgtggtg

SEQ ID NO: 6436129 - DNA, 18 bp, Homo sapiens
tctgcatttcggtggcta

SEQ ID NO: 6436130 - DNA, 19 bp, Homo sapiens
tctgcatttcggtggctag

SEQ ID NO: 6436131 - DNA, 15 bp, Homo sapiens
tctgcattttaacaa

SEQ ID NO: 6436132 - DNA, 17 bp, Homo sapiens
tctgcattttcacccca

SEQ ID NO: 6436133 - DNA, 12 bp, Homo sapiens
tctgcattttct

SEQ ID NO: 6436134 - DNA, 19 bp, Homo sapiens
tctgcattttctgaaacta

SEQ ID NO: 6436135 - DNA, 20 bp, Homo sapiens
tctgcattttctgaaactaa

SEQ ID NO: 6436136 - DNA, 18 bp, Homo sapiens
tctgcattttgctattgt

SEQ ID NO: 6436137 - DNA, 15 bp, Homo sapiens
tctgcatttttctgc

SEQ ID NO: 6436138 - DNA, 14 bp, Homo sapiens
tctgccaaaataaa

SEQ ID NO: 6436139 - DNA, 14 bp, Homo sapiens
tctgccaaaatgta

SEQ ID NO: 6436140 - DNA, 19 bp, Homo sapiens
tctgccaaaggatgtgata

SEQ ID NO: 6436141 - DNA, 12 bp, Homo sapiens
tctgccaaagta

SEQ ID NO: 6436142 - DNA, 18 bp, Homo sapiens
tctgccaaagtaaaacaa

SEQ ID NO: 6436143 - DNA, 23 bp, Homo sapiens
tctgccaaattgagataatgata

SEQ ID NO: 6436144 - DNA, 22 bp, Homo sapiens
tctgccaacatgaggacagaag

SEQ ID NO: 6436145 - DNA, 14 bp, Homo sapiens
tctgccaacctaaa

SEQ ID NO: 6436146 - DNA, 17 bp, Homo sapiens
tctgccaagtcagttct

SEQ ID NO: 6436147 - DNA, 22 bp, Homo sapiens
tctgccaatcggctacccctcg

SEQ ID NO: 6436148 - DNA, 15 bp, Homo sapiens
tctgccaatctgtac

SEQ ID NO: 6436149 - DNA, 15 bp, Homo sapiens
tctgccaatgccatg

SEQ ID NO: 6436150 - DNA, 14 bp, Homo sapiens
tctgccaatgtggg

SEQ ID NO: 6436151 - DNA, 22 bp, Homo sapiens
tctgccaatttttgccttcatt

SEQ ID NO: 6436152 - DNA, 13 bp, Homo sapiens
tctgccacaaaaa

SEQ ID NO: 6436153 - DNA, 23 bp, Homo sapiens
tctgccacagagagtcctttggg

SEQ ID NO: 6436154 - DNA, 16 bp, Homo sapiens
tctgccaccagcccct

SEQ ID NO: 6436155 - DNA, 17 bp, Homo sapiens
tctgccaccagcccctc

SEQ ID NO: 6436156 - DNA, 20 bp, Homo sapiens
tctgccaccagcccctcccc

SEQ ID NO: 6436157 - DNA, 23 bp, Homo sapiens
tctgccaccagcccctccccaga

SEQ ID NO: 6436158 - DNA, 21 bp, Homo sapiens
tctgccaccagcgcccccact

SEQ ID NO: 6436159 - DNA, 22 bp, Homo sapiens
tctgccaccagcgcccccactc

SEQ ID NO: 6436160 - DNA, 17 bp, Homo sapiens
tctgccaccatcctgct

SEQ ID NO: 6436161 - DNA, 21 bp, Homo sapiens
tctgccaccatgcctaatttt

SEQ ID NO: 6436162 - DNA, 16 bp, Homo sapiens
tctgccacccactcag

SEQ ID NO: 6436163 - DNA, 15 bp, Homo sapiens
tctgccacccaggat

SEQ ID NO: 6436164 - DNA, 22 bp, Homo sapiens
tctgccacccctaaactccagg

SEQ ID NO: 6436165 - DNA, 17 bp, Homo sapiens
tctgccaccctacctgt

SEQ ID NO: 6436166 - DNA, 18 bp, Homo sapiens
tctgccaccctacctgtt

SEQ ID NO: 6436167 - DNA, 21 bp, Homo sapiens
tctgccaccctacctgttcag

SEQ ID NO: 6436168 - DNA, 17 bp, Homo sapiens
tctgccaccgtggggga

SEQ ID NO: 6436169 - DNA, 23 bp, Homo sapiens
tctgccacctcccctatccaccc

SEQ ID NO: 6436170 - DNA, 15 bp, Homo sapiens
tctgccacctgcaca

SEQ ID NO: 6436171 - DNA, 19 bp, Homo sapiens
tctgccactgaggagacag

SEQ ID NO: 6436172 - DNA, 14 bp, Homo sapiens
tctgccactggaag

SEQ ID NO: 6436173 - DNA, 22 bp, Homo sapiens
tctgccacttagggagtgtgcc

SEQ ID NO: 6436174 - DNA, 19 bp, Homo sapiens
tctgccacttctgcgggct

SEQ ID NO: 6436175 - DNA, 19 bp, Homo sapiens
tctgccacttgcactgtgc

SEQ ID NO: 6436176 - DNA, 21 bp, Homo sapiens
tctgccacttgcactgtgctt

SEQ ID NO: 6436177 - DNA, 16 bp, Homo sapiens
tctgccacttgtcaaa

SEQ ID NO: 6436178 - DNA, 20 bp, Homo sapiens
tctgccagaagatcccctca

SEQ ID NO: 6436179 - DNA, 21 bp, Homo sapiens
tctgccagaagatcccctcag

SEQ ID NO: 6436180 - DNA, 13 bp, Homo sapiens
tctgccagacctg

SEQ ID NO: 6436181 - DNA, 15 bp, Homo sapiens
tctgccagacctgca

SEQ ID NO: 6436182 - DNA, 16 bp, Homo sapiens
tctgccagacctgcat

SEQ ID NO: 6436183 - DNA, 21 bp, Homo sapiens
tctgccagacctgcatggtca

SEQ ID NO: 6436184 - DNA, 13 bp, Homo sapiens
tctgccagacctt

SEQ ID NO: 6436185 - DNA, 13 bp, Homo sapiens
tctgccagcagga

SEQ ID NO: 6436186 - DNA, 14 bp, Homo sapiens
tctgccagcaggaa

SEQ ID NO: 6436187 - DNA, 15 bp, Homo sapiens
tctgccagcaggaat

SEQ ID NO: 6436188 - DNA, 18 bp, Homo sapiens
tctgccagcaggaataaa

SEQ ID NO: 6436189 - DNA, 21 bp, Homo sapiens
tctgccagcaggaataaagac

SEQ ID NO: 6436190 - DNA, 13 bp, Homo sapiens
tctgccagcccat

SEQ ID NO: 6436191 - DNA, 14 bp, Homo sapiens
tctgccaggcactc

SEQ ID NO: 6436192 - DNA, 14 bp, Homo sapiens
tctgccaggcctgt

SEQ ID NO: 6436193 - DNA, 22 bp, Homo sapiens
tctgccaggcctgtatgaggct

SEQ ID NO: 6436194 - DNA, 12 bp, Homo sapiens
tctgccagggag

SEQ ID NO: 6436195 - DNA, 16 bp, Homo sapiens
tctgccagggcagtgc

SEQ ID NO: 6436196 - DNA, 20 bp, Homo sapiens
tctgccagggcccctctccc

SEQ ID NO: 6436197 - DNA, 17 bp, Homo sapiens
tctgccaggggtaacct

SEQ ID NO: 6436198 - DNA, 21 bp, Homo sapiens
tctgccaggggtaacctggcc

SEQ ID NO: 6436199 - DNA, 22 bp, Homo sapiens
tctgccaggggtaacctggcca

SEQ ID NO: 6436200 - DNA, 13 bp, Homo sapiens
tctgccagtgaca

SEQ ID NO: 6436201 - DNA, 23 bp, Homo sapiens
tctgccagtgacagacaggctct

SEQ ID NO: 6436202 - DNA, 16 bp, Homo sapiens
tctgccagtggatccc

SEQ ID NO: 6436203 - DNA, 18 bp, Homo sapiens
tctgccagttacttgggc

SEQ ID NO: 6436204 - DNA, 18 bp, Homo sapiens
tctgccatattctgttgg

SEQ ID NO: 6436205 - DNA, 22 bp, Homo sapiens
tctgccatcatttttgatgact

SEQ ID NO: 6436206 - DNA, 17 bp, Homo sapiens
tctgccatcctccctgt

SEQ ID NO: 6436207 - DNA, 18 bp, Homo sapiens
tctgccatctagccagcc

SEQ ID NO: 6436208 - DNA, 15 bp, Homo sapiens
tctgccatcttcagg

SEQ ID NO: 6436209 - DNA, 19 bp, Homo sapiens
tctgccatgatgtttacaa

SEQ ID NO: 6436210 - DNA, 19 bp, Homo sapiens
tctgccatgggagagtcca

SEQ ID NO: 6436211 - DNA, 16 bp, Homo sapiens
tctgccatgtccatag

SEQ ID NO: 6436212 - DNA, 19 bp, Homo sapiens
tctgccatgttgccccttt

SEQ ID NO: 6436213 - DNA, 17 bp, Homo sapiens
tctgccattctgtgcag

SEQ ID NO: 6436214 - DNA, 14 bp, Homo sapiens
tctgccatttcatg

SEQ ID NO: 6436215 - DNA, 19 bp, Homo sapiens
tctgcccaaaaatatggtt

SEQ ID NO: 6436216 - DNA, 17 bp, Homo sapiens
tctgcccaaatcccctc

SEQ ID NO: 6436217 - DNA, 18 bp, Homo sapiens
tctgcccaaatcccctcc

SEQ ID NO: 6436218 - DNA, 15 bp, Homo sapiens
tctgcccaaattatg

SEQ ID NO: 6436219 - DNA, 12 bp, Homo sapiens
tctgcccaaccc

SEQ ID NO: 6436220 - DNA, 19 bp, Homo sapiens
tctgcccaagttgctctgt

SEQ ID NO: 6436221 - DNA, 15 bp, Homo sapiens
tctgcccaccctcct

SEQ ID NO: 6436222 - DNA, 18 bp, Homo sapiens
tctgcccaccctcctgta

SEQ ID NO: 6436223 - DNA, 13 bp, Homo sapiens
tctgcccacctct

SEQ ID NO: 6436224 - DNA, 17 bp, Homo sapiens
tctgcccacctggggtc

SEQ ID NO: 6436225 - DNA, 21 bp, Homo sapiens
tctgcccacgatcccctcccc

SEQ ID NO: 6436226 - DNA, 17 bp, Homo sapiens
tctgcccacgcagagga

SEQ ID NO: 6436227 - DNA, 12 bp, Homo sapiens
tctgcccactcc

SEQ ID NO: 6436228 - DNA, 14 bp, Homo sapiens
tctgcccactccct

SEQ ID NO: 6436229 - DNA, 21 bp, Homo sapiens
tctgcccactccctgcaacct

SEQ ID NO: 6436230 - DNA, 22 bp, Homo sapiens
tctgcccagcaatcaaaggcaa

SEQ ID NO: 6436231 - DNA, 23 bp, Homo sapiens
tctgcccagccctctgtggccag

SEQ ID NO: 6436232 - DNA, 13 bp, Homo sapiens
tctgcccagccgg

SEQ ID NO: 6436233 - DNA, 19 bp, Homo sapiens
tctgcccagcctgccccag

SEQ ID NO: 6436234 - DNA, 18 bp, Homo sapiens
tctgcccagcctgctcag

SEQ ID NO: 6436235 - DNA, 12 bp, Homo sapiens
tctgcccagctt

SEQ ID NO: 6436236 - DNA, 16 bp, Homo sapiens
tctgcccagcttgggc

SEQ ID NO: 6436237 - DNA, 23 bp, Homo sapiens
tctgcccaggacggggccggcca

SEQ ID NO: 6436238 - DNA, 13 bp, Homo sapiens
tctgcccagggag

SEQ ID NO: 6436239 - DNA, 19 bp, Homo sapiens
tctgcccaggggtgccccc

SEQ ID NO: 6436240 - DNA, 22 bp, Homo sapiens
tctgcccatgcctaaagcccat

SEQ ID NO: 6436241 - DNA, 14 bp, Homo sapiens
tctgcccattcccc

SEQ ID NO: 6436242 - DNA, 19 bp, Homo sapiens
tctgcccattccccagcct

SEQ ID NO: 6436243 - DNA, 14 bp, Homo sapiens
tctgccccaagagc

SEQ ID NO: 6436244 - DNA, 22 bp, Homo sapiens
tctgccccaagcagccagccag

SEQ ID NO: 6436245 - DNA, 12 bp, Homo sapiens
tctgccccaagg

SEQ ID NO: 6436246 - DNA, 22 bp, Homo sapiens
tctgccccaagttttgtgaaat

SEQ ID NO: 6436247 - DNA, 11 bp, Homo sapiens
tctgccccacc

SEQ ID NO: 6436248 - DNA, 14 bp, Homo sapiens
tctgccccacccaa

SEQ ID NO: 6436249 - DNA, 18 bp, Homo sapiens
tctgccccacccaagccc

SEQ ID NO: 6436250 - DNA, 16 bp, Homo sapiens
tctgccccacccatca

SEQ ID NO: 6436251 - DNA, 15 bp, Homo sapiens
tctgccccagaggcc

SEQ ID NO: 6436252 - DNA, 17 bp, Homo sapiens
tctgccccagcccagat

SEQ ID NO: 6436253 - DNA, 20 bp, Homo sapiens
tctgccccagcccagattcc

SEQ ID NO: 6436254 - DNA, 13 bp, Homo sapiens
tctgccccagcct

SEQ ID NO: 6436255 - DNA, 14 bp, Homo sapiens
tctgccccagcctg

SEQ ID NO: 6436256 - DNA, 17 bp, Homo sapiens
tctgccccagcctgtcc

SEQ ID NO: 6436257 - DNA, 16 bp, Homo sapiens
tctgccccagctctgg

SEQ ID NO: 6436258 - DNA, 17 bp, Homo sapiens
tctgccccagctctggc

SEQ ID NO: 6436259 - DNA, 11 bp, Homo sapiens
tctgccccagg

SEQ ID NO: 6436260 - DNA, 18 bp, Homo sapiens
tctgccccaggccctact

SEQ ID NO: 6436261 - DNA, 13 bp, Homo sapiens
tctgccccaggta

SEQ ID NO: 6436262 - DNA, 16 bp, Homo sapiens
tctgcccccagcccaa

SEQ ID NO: 6436263 - DNA, 18 bp, Homo sapiens
tctgcccccagcccaaag

SEQ ID NO: 6436264 - DNA, 20 bp, Homo sapiens
tctgcccccagctgctcctc

SEQ ID NO: 6436265 - DNA, 16 bp, Homo sapiens
tctgccccccaagttc

SEQ ID NO: 6436266 - DNA, 16 bp, Homo sapiens
tctgccccccagggct

SEQ ID NO: 6436267 - DNA, 21 bp, Homo sapiens
tctgcccccgcgggttctaga

SEQ ID NO: 6436268 - DNA, 23 bp, Homo sapiens
tctgcccccgcgggttctagacg

SEQ ID NO: 6436269 - DNA, 22 bp, Homo sapiens
tctgcccccgtcttctctccat

SEQ ID NO: 6436270 - DNA, 15 bp, Homo sapiens
tctgccccctccccc

SEQ ID NO: 6436271 - DNA, 16 bp, Homo sapiens
tctgccccctccccca

SEQ ID NO: 6436272 - DNA, 19 bp, Homo sapiens
tctgccccctcccccgcag

SEQ ID NO: 6436273 - DNA, 22 bp, Homo sapiens
tctgccccctcccccgcagaca

SEQ ID NO: 6436274 - DNA, 14 bp, Homo sapiens
tctgccccctgctg

SEQ ID NO: 6436275 - DNA, 13 bp, Homo sapiens
tctgcccctcagg

SEQ ID NO: 6436276 - DNA, 22 bp, Homo sapiens
tctgcccctcagggggccagct

SEQ ID NO: 6436277 - DNA, 15 bp, Homo sapiens
tctgcccctccccca

SEQ ID NO: 6436278 - DNA, 16 bp, Homo sapiens
tctgcccctcccccaa

SEQ ID NO: 6436279 - DNA, 18 bp, Homo sapiens
tctgcccctcccccaacc

SEQ ID NO: 6436280 - DNA, 22 bp, Homo sapiens
tctgcccctcccccaaccccca

SEQ ID NO: 6436281 - DNA, 12 bp, Homo sapiens
tctgcccctccg

SEQ ID NO: 6436282 - DNA, 22 bp, Homo sapiens
tctgcccctgatcactcccagc

SEQ ID NO: 6436283 - DNA, 19 bp, Homo sapiens
tctgcccctggacctggga

SEQ ID NO: 6436284 - DNA, 18 bp, Homo sapiens
tctgccccttccccatga

SEQ ID NO: 6436285 - DNA, 17 bp, Homo sapiens
tctgccccttgacccca

SEQ ID NO: 6436286 - DNA, 19 bp, Homo sapiens
tctgccccttgaccccaca

SEQ ID NO: 6436287 - DNA, 20 bp, Homo sapiens
tctgccccttgaccccacac

SEQ ID NO: 6436288 - DNA, 22 bp, Homo sapiens
tctgccccttgggcatccaccc

SEQ ID NO: 6436289 - DNA, 18 bp, Homo sapiens
tctgccccttgggcctcc

SEQ ID NO: 6436290 - DNA, 13 bp, Homo sapiens
tctgcccgcagag

SEQ ID NO: 6436291 - DNA, 15 bp, Homo sapiens
tctgcccgcagagcc

SEQ ID NO: 6436292 - DNA, 21 bp, Homo sapiens
tctgcccgcagagcccacgcc

SEQ ID NO: 6436293 - DNA, 19 bp, Homo sapiens
tctgcccgcctgcccacct

SEQ ID NO: 6436294 - DNA, 21 bp, Homo sapiens
tctgcccgcctgcccacctgc

SEQ ID NO: 6436295 - DNA, 22 bp, Homo sapiens
tctgcccgcctgcccacctgcc

SEQ ID NO: 6436296 - DNA, 15 bp, Homo sapiens
tctgcccgggcccct

SEQ ID NO: 6436297 - DNA, 18 bp, Homo sapiens
tctgccctaacctgacag

SEQ ID NO: 6436298 - DNA, 23 bp, Homo sapiens
tctgccctcacaattaggcttca

SEQ ID NO: 6436299 - DNA, 17 bp, Homo sapiens
tctgccctccctggcct

SEQ ID NO: 6436300 - DNA, 15 bp, Homo sapiens
tctgccctcctgcca

SEQ ID NO: 6436301 - DNA, 17 bp, Homo sapiens
tcaggcacatcattgga

SEQ ID NO: 6436302 - DNA, 17 bp, Homo sapiens
tcaggcaccagcatcca

SEQ ID NO: 6436303 - DNA, 19 bp, Homo sapiens
tcaggcaccagtccctgtc

SEQ ID NO: 6436304 - DNA, 17 bp, Homo sapiens
tcaggcacgtctcctgc

SEQ ID NO: 6436305 - DNA, 21 bp, Homo sapiens
tcaggcacgtctcctgctgcg

SEQ ID NO: 6436306 - DNA, 21 bp, Homo sapiens
tcaggcactagcctttggctc

SEQ ID NO: 6436307 - DNA, 22 bp, Homo sapiens
tcaggcactagcctttggctct

SEQ ID NO: 6436308 - DNA, 15 bp, Homo sapiens
tcaggcactctcctg

SEQ ID NO: 6436309 - DNA, 17 bp, Homo sapiens
tcaggcactctcctgtc

SEQ ID NO: 6436310 - DNA, 15 bp, Homo sapiens
tcaggcactggtggc

SEQ ID NO: 6436311 - DNA, 22 bp, Homo sapiens
tcaggcagaaccggtcccagcc

SEQ ID NO: 6436312 - DNA, 23 bp, Homo sapiens
tcaggcagacaagagctgctgtc

SEQ ID NO: 6436313 - DNA, 20 bp, Homo sapiens
tcaggcagaggatgttctgg

SEQ ID NO: 6436314 - DNA, 22 bp, Homo sapiens
tcaggcagaggatgttctggac

SEQ ID NO: 6436315 - DNA, 23 bp, Homo sapiens
tcaggcagaggatgttctggacc

SEQ ID NO: 6436316 - DNA, 18 bp, Homo sapiens
tcaggcagaggcaactga

SEQ ID NO: 6436317 - DNA, 21 bp, Homo sapiens
tcaggcagataactgctgtat

SEQ ID NO: 6436318 - DNA, 16 bp, Homo sapiens
tcaggcagcagtgtct

SEQ ID NO: 6436319 - DNA, 19 bp, Homo sapiens
tcaggcagcagtgtctgta

SEQ ID NO: 6436320 - DNA, 19 bp, Homo sapiens
tcaggcagcgttagggctg

SEQ ID NO: 6436321 - DNA, 13 bp, Homo sapiens
tcaggcaggaagg

SEQ ID NO: 6436322 - DNA, 21 bp, Homo sapiens
tcaggcaggaagggcaggaag

SEQ ID NO: 6436323 - DNA, 23 bp, Homo sapiens
tcaggcaggcacctagcaattcc

SEQ ID NO: 6436324 - DNA, 23 bp, Homo sapiens
tcaggcaggcgggccggggcagg

SEQ ID NO: 6436325 - DNA, 16 bp, Homo sapiens
tcaggcaggggcctcc

SEQ ID NO: 6436326 - DNA, 21 bp, Homo sapiens
tcaggcaggggcctccatggg

SEQ ID NO: 6436327 - DNA, 17 bp, Homo sapiens
tcaggcaggtgggatgg

SEQ ID NO: 6436328 - DNA, 14 bp, Homo sapiens
tcaggcaggtttgc

SEQ ID NO: 6436329 - DNA, 16 bp, Homo sapiens
tcaggcagtagcagct

SEQ ID NO: 6436330 - DNA, 16 bp, Homo sapiens
tcaggcagtaggcatt

SEQ ID NO: 6436331 - DNA, 19 bp, Homo sapiens
tcaggcagtaggcattctt

SEQ ID NO: 6436332 - DNA, 17 bp, Homo sapiens
tcaggcagtggcccagg

SEQ ID NO: 6436333 - DNA, 18 bp, Homo sapiens
tcaggcatgaacatgtac

SEQ ID NO: 6436334 - DNA, 19 bp, Homo sapiens
tcaggcatggctcagagct

SEQ ID NO: 6436335 - DNA, 20 bp, Homo sapiens
tcaggcatggctcagagctt

SEQ ID NO: 6436336 - DNA, 17 bp, Homo sapiens
tcaggcattttccccct

SEQ ID NO: 6436337 - DNA, 20 bp, Homo sapiens
tcaggccaaactcacctgcc

SEQ ID NO: 6436338 - DNA, 20 bp, Homo sapiens
tcaggccaagaccccagctt

SEQ ID NO: 6436339 - DNA, 15 bp, Homo sapiens
tcaggccaccctcca

SEQ ID NO: 6436340 - DNA, 17 bp, Homo sapiens
tcaggccacctgccccc

SEQ ID NO: 6436341 - DNA, 19 bp, Homo sapiens
tcaggccacctgccccctt

SEQ ID NO: 6436342 - DNA, 21 bp, Homo sapiens
tcaggccacctgcccccttct

SEQ ID NO: 6436343 - DNA, 17 bp, Homo sapiens
tcaggccacggcagcct

SEQ ID NO: 6436344 - DNA, 14 bp, Homo sapiens
tcaggccagagcca

SEQ ID NO: 6436345 - DNA, 13 bp, Homo sapiens
tcaggccagccca

SEQ ID NO: 6436346 - DNA, 15 bp, Homo sapiens
tcaggccagcctgtc

SEQ ID NO: 6436347 - DNA, 13 bp, Homo sapiens
tcaggccagctgg

SEQ ID NO: 6436348 - DNA, 13 bp, Homo sapiens
tcaggccaggccc

SEQ ID NO: 6436349 - DNA, 15 bp, Homo sapiens
tcaggccaggccctc

SEQ ID NO: 6436350 - DNA, 15 bp, Homo sapiens
tcaggccagggctca

SEQ ID NO: 6436351 - DNA, 18 bp, Homo sapiens
tcaggccaggtgcagtgg

SEQ ID NO: 6436352 - DNA, 15 bp, Homo sapiens
tcaggccaggtgggc

SEQ ID NO: 6436353 - DNA, 20 bp, Homo sapiens
tcaggccaggtgggcggaca

SEQ ID NO: 6436354 - DNA, 16 bp, Homo sapiens
tcaggccagtgccagg

SEQ ID NO: 6436355 - DNA, 19 bp, Homo sapiens
tcaggccagtgccaggaca

SEQ ID NO: 6436356 - DNA, 21 bp, Homo sapiens
tcaggccagtgccaggacagc

SEQ ID NO: 6436357 - DNA, 19 bp, Homo sapiens
tcaggcccacattgcccac

SEQ ID NO: 6436358 - DNA, 19 bp, Homo sapiens
tcaggcccaggagtccagg

SEQ ID NO: 6436359 - DNA, 21 bp, Homo sapiens
tcaggcccaggagtccaggcc

SEQ ID NO: 6436360 - DNA, 15 bp, Homo sapiens
tcaggccccacccct

SEQ ID NO: 6436361 - DNA, 13 bp, Homo sapiens
tcaggccccagga

SEQ ID NO: 6436362 - DNA, 21 bp, Homo sapiens
tcaggcccccacctggctcac

SEQ ID NO: 6436363 - DNA, 17 bp, Homo sapiens
tcaggccccgggcttcc

SEQ ID NO: 6436364 - DNA, 16 bp, Homo sapiens
tcaggcccggcagggc

SEQ ID NO: 6436365 - DNA, 21 bp, Homo sapiens
tcaggcccggcagggcgggca

SEQ ID NO: 6436366 - DNA, 21 bp, Homo sapiens
tcaggcccggctaactctggc

SEQ ID NO: 6436367 - DNA, 22 bp, Homo sapiens
tcaggcccgtcagcatcactga

SEQ ID NO: 6436368 - DNA, 21 bp, Homo sapiens
tcaggcccgtcggagctgcct

SEQ ID NO: 6436369 - DNA, 22 bp, Homo sapiens
tcaggcccgtcggagctgcctg

SEQ ID NO: 6436370 - DNA, 23 bp, Homo sapiens
tcaggcccgtcggagctgcctgc

SEQ ID NO: 6436371 - DNA, 12 bp, Homo sapiens
tcaggccctcag

SEQ ID NO: 6436372 - DNA, 15 bp, Homo sapiens
tcaggccctcagctg

SEQ ID NO: 6436373 - DNA, 19 bp, Homo sapiens
tcaggccctgactcctctg

SEQ ID NO: 6436374 - DNA, 20 bp, Homo sapiens
tcaggccctgactcctctgg

SEQ ID NO: 6436375 - DNA, 11 bp, Homo sapiens
tcaggccctgg

SEQ ID NO: 6436376 - DNA, 15 bp, Homo sapiens
tcaggccgaaggagg

SEQ ID NO: 6436377 - DNA, 21 bp, Homo sapiens
tcaggccggcagccccagcct

SEQ ID NO: 6436378 - DNA, 18 bp, Homo sapiens
tcaggccgggcagagcac

SEQ ID NO: 6436379 - DNA, 22 bp, Homo sapiens
tcaggccgggtgcagtggctcc

SEQ ID NO: 6436380 - DNA, 14 bp, Homo sapiens
tcaggcctaggagg

SEQ ID NO: 6436381 - DNA, 18 bp, Homo sapiens
tcaggcctataaccccag

SEQ ID NO: 6436382 - DNA, 22 bp, Homo sapiens
tcaggcctataaccccagctcc

SEQ ID NO: 6436383 - DNA, 18 bp, Homo sapiens
tcaggcctcacctcccag

SEQ ID NO: 6436384 - DNA, 19 bp, Homo sapiens
tcaggcctcacctcccagg

SEQ ID NO: 6436385 - DNA, 23 bp, Homo sapiens
tcaggcctcacctggcttcccag

SEQ ID NO: 6436386 - DNA, 17 bp, Homo sapiens
tcaggcctccctctctc

SEQ ID NO: 6436387 - DNA, 18 bp, Homo sapiens
tcaggcctccctctctct

SEQ ID NO: 6436388 - DNA, 18 bp, Homo sapiens
tcaggcctctgagcccaa

SEQ ID NO: 6436389 - DNA, 19 bp, Homo sapiens
tcaggcctctgagcccaag

SEQ ID NO: 6436390 - DNA, 14 bp, Homo sapiens
tcaggcctctgagg

SEQ ID NO: 6436391 - DNA, 17 bp, Homo sapiens
tcaggcctctgcagaag

SEQ ID NO: 6436392 - DNA, 13 bp, Homo sapiens
tcaggcctgccaa

SEQ ID NO: 6436393 - DNA, 14 bp, Homo sapiens
tcaggcctggccct

SEQ ID NO: 6436394 - DNA, 14 bp, Homo sapiens
tcaggcctggcctc

SEQ ID NO: 6436395 - DNA, 15 bp, Homo sapiens
tcaggcctgggcagg

SEQ ID NO: 6436396 - DNA, 14 bp, Homo sapiens
tcaggcctgtgccc

SEQ ID NO: 6436397 - DNA, 16 bp, Homo sapiens
tcaggcctgtgcccac

SEQ ID NO: 6436398 - DNA, 13 bp, Homo sapiens
tcaggcctgtgtg

SEQ ID NO: 6436399 - DNA, 13 bp, Homo sapiens
tcaggccttcttt

SEQ ID NO: 6436400 - DNA, 17 bp, Homo sapiens
tcaggccttgcctggga

SEQ ID NO: 6436401 - DNA, 12 bp, Homo sapiens
tcaggcgcagcc

SEQ ID NO: 6436402 - DNA, 15 bp, Homo sapiens
tcaggcgcagcccta

SEQ ID NO: 6436403 - DNA, 17 bp, Homo sapiens
tcaggcgcagccctagt

SEQ ID NO: 6436404 - DNA, 23 bp, Homo sapiens
tcaggcgcctggcacatttcagg

SEQ ID NO: 6436405 - DNA, 13 bp, Homo sapiens
tcaggcggggagg

SEQ ID NO: 6436406 - DNA, 16 bp, Homo sapiens
tcaggcggggaggagg

SEQ ID NO: 6436407 - DNA, 17 bp, Homo sapiens
tcaggcggggaggagga

SEQ ID NO: 6436408 - DNA, 19 bp, Homo sapiens
tcaggctaagaccctgtgt

SEQ ID NO: 6436409 - DNA, 21 bp, Homo sapiens
tcaggctactcattcagtccc

SEQ ID NO: 6436410 - DNA, 20 bp, Homo sapiens
tcaggctagccctgccctcc

SEQ ID NO: 6436411 - DNA, 15 bp, Homo sapiens
tcaggctagctgtgc

SEQ ID NO: 6436412 - DNA, 17 bp, Homo sapiens
tcaggctagctgtgctg

SEQ ID NO: 6436413 - DNA, 12 bp, Homo sapiens
tcaggctaggcc

SEQ ID NO: 6436414 - DNA, 14 bp, Homo sapiens
tcaggctaggccag

SEQ ID NO: 6436415 - DNA, 18 bp, Homo sapiens
tcaggctaggccagcagg

SEQ ID NO: 6436416 - DNA, 14 bp, Homo sapiens
tcaggctcaagttt

SEQ ID NO: 6436417 - DNA, 11 bp, Homo sapiens
tcaggctccat

SEQ ID NO: 6436418 - DNA, 15 bp, Homo sapiens
tcaggctccccaaga

SEQ ID NO: 6436419 - DNA, 18 bp, Homo sapiens
tcaggctccccagaactg

SEQ ID NO: 6436420 - DNA, 23 bp, Homo sapiens
tcaggctccccagaactggctgg

SEQ ID NO: 6436421 - DNA, 15 bp, Homo sapiens
tcaggctcctcagcc

SEQ ID NO: 6436422 - DNA, 17 bp, Homo sapiens
tcaggctcgccaaggcc

SEQ ID NO: 6436423 - DNA, 12 bp, Homo sapiens
tcaggctctgaa

SEQ ID NO: 6436424 - DNA, 15 bp, Homo sapiens
tcaggctctgaatct

SEQ ID NO: 6436425 - DNA, 21 bp, Homo sapiens
tcaggctctgaatctctcaaa

SEQ ID NO: 6436426 - DNA, 13 bp, Homo sapiens
tcaggctctgaga

SEQ ID NO: 6436427 - DNA, 11 bp, Homo sapiens
tcaggctctgc

SEQ ID NO: 6436428 - DNA, 13 bp, Homo sapiens
tcaggctctgcac

SEQ ID NO: 6436429 - DNA, 17 bp, Homo sapiens
tcaggctctgcacagac

SEQ ID NO: 6436430 - DNA, 13 bp, Homo sapiens
tcaggctctgccc

SEQ ID NO: 6436431 - DNA, 16 bp, Homo sapiens
tcaggctctggccctt

SEQ ID NO: 6436432 - DNA, 20 bp, Homo sapiens
tcaggctctggcccttgcct

SEQ ID NO: 6436433 - DNA, 19 bp, Homo sapiens
tcaggctctgtggagggca

SEQ ID NO: 6436434 - DNA, 21 bp, Homo sapiens
tcaggctctgtggagggcatt

SEQ ID NO: 6436435 - DNA, 16 bp, Homo sapiens
tcaggctctgttcctc

SEQ ID NO: 6436436 - DNA, 14 bp, Homo sapiens
tcaggctgagccca

SEQ ID NO: 6436437 - DNA, 19 bp, Homo sapiens
tcaggctgagcccagccac

SEQ ID NO: 6436438 - DNA, 18 bp, Homo sapiens
tcaggctgagggaggcag

SEQ ID NO: 6436439 - DNA, 22 bp, Homo sapiens
tcaggctgcagctggacagagg

SEQ ID NO: 6436440 - DNA, 12 bp, Homo sapiens
tcaggctgccag

SEQ ID NO: 6436441 - DNA, 16 bp, Homo sapiens
tcaggctgccagagaa

SEQ ID NO: 6436442 - DNA, 21 bp, Homo sapiens
tcaggctgcccagcggctctt

SEQ ID NO: 6436443 - DNA, 20 bp, Homo sapiens
tcaggctgcctaagacatgt

SEQ ID NO: 6436444 - DNA, 12 bp, Homo sapiens
tcaggctgcctg

SEQ ID NO: 6436445 - DNA, 13 bp, Homo sapiens
tcaggctgcctga

SEQ ID NO: 6436446 - DNA, 16 bp, Homo sapiens
tcaggctgctggagga

SEQ ID NO: 6436447 - DNA, 21 bp, Homo sapiens
tcaggctgctggcgcctctgc

SEQ ID NO: 6436448 - DNA, 20 bp, Homo sapiens
tcaggctggcatctccccca

SEQ ID NO: 6436449 - DNA, 18 bp, Homo sapiens
tcaggctgggacaggctt

SEQ ID NO: 6436450 - DNA, 15 bp, Homo sapiens
tcaggctgggcagcc

SEQ ID NO: 6436451 - DNA, 16 bp, Homo sapiens
tcaggctgggcagccc

SEQ ID NO: 6436452 - DNA, 13 bp, Homo sapiens
tcaggctgggccc

SEQ ID NO: 6436453 - DNA, 21 bp, Homo sapiens
tcaggctgggttgtcactgag

SEQ ID NO: 6436454 - DNA, 23 bp, Homo sapiens
tcaggctggtctcgaactcctga

SEQ ID NO: 6436455 - DNA, 17 bp, Homo sapiens
tcaggctggtgggaggg

SEQ ID NO: 6436456 - DNA, 13 bp, Homo sapiens
tcaggctgtgctt

SEQ ID NO: 6436457 - DNA, 18 bp, Homo sapiens
tcaggctgttggcgtgtc

SEQ ID NO: 6436458 - DNA, 21 bp, Homo sapiens
tcaggctgttggcgtgtccca

SEQ ID NO: 6436459 - DNA, 20 bp, Homo sapiens
tcaggcttcctggtgagaac

SEQ ID NO: 6436460 - DNA, 22 bp, Homo sapiens
tcaggcttgagggagggctggg

SEQ ID NO: 6436461 - DNA, 15 bp, Homo sapiens
tcaggcttgataata

SEQ ID NO: 6436462 - DNA, 17 bp, Homo sapiens
tcaggcttgcattaaaa

SEQ ID NO: 6436463 - DNA, 21 bp, Homo sapiens
tcaggcttgcattaaaagact

SEQ ID NO: 6436464 - DNA, 21 bp, Homo sapiens
tcaggctttgtctgctcccaa

SEQ ID NO: 6436465 - DNA, 23 bp, Homo sapiens
tcagggaaaagcagctctcccct

SEQ ID NO: 6436466 - DNA, 19 bp, Homo sapiens
tcagggaaactaagattct

SEQ ID NO: 6436467 - DNA, 16 bp, Homo sapiens
tcagggaaaggccagt

SEQ ID NO: 6436468 - DNA, 19 bp, Homo sapiens
tcagggaaatggagggtgg

SEQ ID NO: 6436469 - DNA, 20 bp, Homo sapiens
tcagggaaatggccttcccg

SEQ ID NO: 6436470 - DNA, 21 bp, Homo sapiens
tcagggaacatatttaaggaa

SEQ ID NO: 6436471 - DNA, 19 bp, Homo sapiens
tcagggaactgcttgccca

SEQ ID NO: 6436472 - DNA, 21 bp, Homo sapiens
tcagggaactgcttgcccagg

SEQ ID NO: 6436473 - DNA, 14 bp, Homo sapiens
tcagggaactggga

SEQ ID NO: 6436474 - DNA, 12 bp, Homo sapiens
tcagggaagcag

SEQ ID NO: 6436475 - DNA, 16 bp, Homo sapiens
tcagggaagcaggcag

SEQ ID NO: 6436476 - DNA, 21 bp, Homo sapiens
tcagggaagcccagctccagg

SEQ ID NO: 6436477 - DNA, 19 bp, Homo sapiens
tcagggaaggaggagcctg

SEQ ID NO: 6436478 - DNA, 20 bp, Homo sapiens
tcagggaaggaggagcctgt

SEQ ID NO: 6436479 - DNA, 19 bp, Homo sapiens
tctgccctctagagccttc

SEQ ID NO: 6436480 - DNA, 21 bp, Homo sapiens
tctgccctctgcatcctctgg

SEQ ID NO: 6436481 - DNA, 13 bp, Homo sapiens
tctgccctctgct

SEQ ID NO: 6436482 - DNA, 16 bp, Homo sapiens
tctgccctctgctcta

SEQ ID NO: 6436483 - DNA, 20 bp, Homo sapiens
tctgccctctgctgctgccc

SEQ ID NO: 6436484 - DNA, 15 bp, Homo sapiens
tctgccctctgggtc

SEQ ID NO: 6436485 - DNA, 18 bp, Homo sapiens
tctgccctgagccctcca

SEQ ID NO: 6436486 - DNA, 14 bp, Homo sapiens
tctgccctgcccat

SEQ ID NO: 6436487 - DNA, 13 bp, Homo sapiens
tctgccctgcctc

SEQ ID NO: 6436488 - DNA, 14 bp, Homo sapiens
tctgccctgcctcc

SEQ ID NO: 6436489 - DNA, 20 bp, Homo sapiens
tctgccctgcctccctttct

SEQ ID NO: 6436490 - DNA, 16 bp, Homo sapiens
tctgccctgcctgagg

SEQ ID NO: 6436491 - DNA, 18 bp, Homo sapiens
tctgccctgcctgaggag

SEQ ID NO: 6436492 - DNA, 14 bp, Homo sapiens
tctgccctggaacc

SEQ ID NO: 6436493 - DNA, 20 bp, Homo sapiens
tctgccctggaacctaccag

SEQ ID NO: 6436494 - DNA, 21 bp, Homo sapiens
tctgccctggctgctgccccc

SEQ ID NO: 6436495 - DNA, 19 bp, Homo sapiens
tctgccctgggctcctctt

SEQ ID NO: 6436496 - DNA, 12 bp, Homo sapiens
tctgccctgtgg

SEQ ID NO: 6436497 - DNA, 13 bp, Homo sapiens
tctgcccttcctc

SEQ ID NO: 6436498 - DNA, 14 bp, Homo sapiens
tctgcccttcctcc

SEQ ID NO: 6436499 - DNA, 18 bp, Homo sapiens
tctgcccttcctccagga

SEQ ID NO: 6436500 - DNA, 19 bp, Homo sapiens
tctgcccttcctccaggag

SEQ ID NO: 6436501 - DNA, 15 bp, Homo sapiens
tctgcccttctctgc

SEQ ID NO: 6436502 - DNA, 16 bp, Homo sapiens
tctgccgattttgtaa

SEQ ID NO: 6436503 - DNA, 20 bp, Homo sapiens
tctgccgattttgtaaatgt

SEQ ID NO: 6436504 - DNA, 14 bp, Homo sapiens
tctgccgcccacct

SEQ ID NO: 6436505 - DNA, 15 bp, Homo sapiens
tctgccgcctcagct

SEQ ID NO: 6436506 - DNA, 14 bp, Homo sapiens
tctgccgcctgcgt

SEQ ID NO: 6436507 - DNA, 13 bp, Homo sapiens
tctgccgcggtgg

SEQ ID NO: 6436508 - DNA, 19 bp, Homo sapiens
tctgccgctgtcaaggccg

SEQ ID NO: 6436509 - DNA, 20 bp, Homo sapiens
tctgccgctttgtctgtcca

SEQ ID NO: 6436510 - DNA, 22 bp, Homo sapiens
tctgccggacccggaggccgag

SEQ ID NO: 6436511 - DNA, 16 bp, Homo sapiens
tctgccggccctgggg

SEQ ID NO: 6436512 - DNA, 18 bp, Homo sapiens
tctgccggtcccccatgc

SEQ ID NO: 6436513 - DNA, 23 bp, Homo sapiens
tctgccggtcccccatgccacca

SEQ ID NO: 6436514 - DNA, 16 bp, Homo sapiens
tctgccggtgctcgga

SEQ ID NO: 6436515 - DNA, 14 bp, Homo sapiens
tctgcctaaggact

SEQ ID NO: 6436516 - DNA, 13 bp, Homo sapiens
tctgcctaataaa

SEQ ID NO: 6436517 - DNA, 21 bp, Homo sapiens
tctgcctacagaacttcagaa

SEQ ID NO: 6436518 - DNA, 16 bp, Homo sapiens
tctgcctacagccagg

SEQ ID NO: 6436519 - DNA, 23 bp, Homo sapiens
tctgcctacgttctctttaaaag

SEQ ID NO: 6436520 - DNA, 13 bp, Homo sapiens
tctgcctagatcc

SEQ ID NO: 6436521 - DNA, 21 bp, Homo sapiens
tctgcctataaatttactctg

SEQ ID NO: 6436522 - DNA, 15 bp, Homo sapiens
tctgcctatgcactg

SEQ ID NO: 6436523 - DNA, 23 bp, Homo sapiens
tctgcctcagacgttgcctgaga

SEQ ID NO: 6436524 - DNA, 16 bp, Homo sapiens
tctgcctcagcctccc

SEQ ID NO: 6436525 - DNA, 13 bp, Homo sapiens
tctgcctcaggag

SEQ ID NO: 6436526 - DNA, 23 bp, Homo sapiens
tctgcctcaggaggtcacctgcc

SEQ ID NO: 6436527 - DNA, 19 bp, Homo sapiens
tctgcctcatcctcctcct

SEQ ID NO: 6436528 - DNA, 20 bp, Homo sapiens
tctgcctccaacccagcagt

SEQ ID NO: 6436529 - DNA, 17 bp, Homo sapiens
tctgcctccaccctcct

SEQ ID NO: 6436530 - DNA, 18 bp, Homo sapiens
tctgcctccaccctcctc

SEQ ID NO: 6436531 - DNA, 14 bp, Homo sapiens
tctgcctccagcca

SEQ ID NO: 6436532 - DNA, 15 bp, Homo sapiens
tctgcctccaggagg

SEQ ID NO: 6436533 - DNA, 20 bp, Homo sapiens
tctgcctcccatcacccgct

SEQ ID NO: 6436534 - DNA, 22 bp, Homo sapiens
tctgcctccccttaaaggggag

SEQ ID NO: 6436535 - DNA, 16 bp, Homo sapiens
tctgcctcccgggttc

SEQ ID NO: 6436536 - DNA, 12 bp, Homo sapiens
tctgcctcccta

SEQ ID NO: 6436537 - DNA, 17 bp, Homo sapiens
tctgcctcctcctcacg

SEQ ID NO: 6436538 - DNA, 15 bp, Homo sapiens
tctgcctcctcttca

SEQ ID NO: 6436539 - DNA, 16 bp, Homo sapiens
tctgcctcctgctttg

SEQ ID NO: 6436540 - DNA, 12 bp, Homo sapiens
tctgcctcctgg

SEQ ID NO: 6436541 - DNA, 20 bp, Homo sapiens
tctgcctctaactccctcct

SEQ ID NO: 6436542 - DNA, 22 bp, Homo sapiens
tctgcctctaactccctcctca

SEQ ID NO: 6436543 - DNA, 18 bp, Homo sapiens
tctgcctctaagctgctc

SEQ ID NO: 6436544 - DNA, 15 bp, Homo sapiens
tctgcctctattcaa

SEQ ID NO: 6436545 - DNA, 17 bp, Homo sapiens
tctgcctctatttttgt

SEQ ID NO: 6436546 - DNA, 12 bp, Homo sapiens
tctgcctctcaa

SEQ ID NO: 6436547 - DNA, 18 bp, Homo sapiens
tctgcctctccaggcatt

SEQ ID NO: 6436548 - DNA, 15 bp, Homo sapiens
tctgcctctcccagg

SEQ ID NO: 6436549 - DNA, 20 bp, Homo sapiens
tctgcctctcccaggctgtc

SEQ ID NO: 6436550 - DNA, 15 bp, Homo sapiens
tctgcctctccctgg

SEQ ID NO: 6436551 - DNA, 16 bp, Homo sapiens
tctgcctctccctggg

SEQ ID NO: 6436552 - DNA, 17 bp, Homo sapiens
tctgcctctccctgggt

SEQ ID NO: 6436553 - DNA, 13 bp, Homo sapiens
tctgcctctcctc

SEQ ID NO: 6436554 - DNA, 15 bp, Homo sapiens
tctgcctctcttgta

SEQ ID NO: 6436555 - DNA, 23 bp, Homo sapiens
tctgcctctgacacacagctctg

SEQ ID NO: 6436556 - DNA, 14 bp, Homo sapiens
tctgcctctgatgt

SEQ ID NO: 6436557 - DNA, 18 bp, Homo sapiens
tctgcctctgatgtattt

SEQ ID NO: 6436558 - DNA, 14 bp, Homo sapiens
tctgcctctgcctg

SEQ ID NO: 6436559 - DNA, 16 bp, Homo sapiens
tctgcctctgcctgca

SEQ ID NO: 6436560 - DNA, 21 bp, Homo sapiens
tctgcctctggaaaactattg

SEQ ID NO: 6436561 - DNA, 20 bp, Homo sapiens
tctgcctctgggcagcctgc

SEQ ID NO: 6436562 - DNA, 22 bp, Homo sapiens
tctgcctcttaacttaaaagaa

SEQ ID NO: 6436563 - DNA, 14 bp, Homo sapiens
tctgcctcttctgg

SEQ ID NO: 6436564 - DNA, 15 bp, Homo sapiens
tctgcctcttctggg

SEQ ID NO: 6436565 - DNA, 16 bp, Homo sapiens
tctgcctgaacctggg

SEQ ID NO: 6436566 - DNA, 20 bp, Homo sapiens
tctgcctgaacctggggtca

SEQ ID NO: 6436567 - DNA, 17 bp, Homo sapiens
tctgcctgacaggctgt

SEQ ID NO: 6436568 - DNA, 18 bp, Homo sapiens
tctgcctgacaggctgtg

SEQ ID NO: 6436569 - DNA, 22 bp, Homo sapiens
tctgcctgacaggctgtgactc

SEQ ID NO: 6436570 - DNA, 14 bp, Homo sapiens
tctgcctgagattc

SEQ ID NO: 6436571 - DNA, 23 bp, Homo sapiens
tctgcctgaggggcagcctgcct

SEQ ID NO: 6436572 - DNA, 16 bp, Homo sapiens
tctgcctgccagctgc

SEQ ID NO: 6436573 - DNA, 18 bp, Homo sapiens
tctgcctgccagctgcac

SEQ ID NO: 6436574 - DNA, 21 bp, Homo sapiens
tctgcctgccagctgcactga

SEQ ID NO: 6436575 - DNA, 22 bp, Homo sapiens
tctgcctgccagctgcactgat

SEQ ID NO: 6436576 - DNA, 18 bp, Homo sapiens
tctgcctgcccaggcccc

SEQ ID NO: 6436577 - DNA, 21 bp, Homo sapiens
tctgcctgcccaggcccctgc

SEQ ID NO: 6436578 - DNA, 19 bp, Homo sapiens
tctgcctgcctcatgctct

SEQ ID NO: 6436579 - DNA, 22 bp, Homo sapiens
tctgcctgcctcatgctctcta

SEQ ID NO: 6436580 - DNA, 19 bp, Homo sapiens
tctgcctgcctcctccctc

SEQ ID NO: 6436581 - DNA, 13 bp, Homo sapiens
tctgcctgctggg

SEQ ID NO: 6436582 - DNA, 16 bp, Homo sapiens
tctgcctgctgggctc

SEQ ID NO: 6436583 - DNA, 16 bp, Homo sapiens
tctgcctgctggggat

SEQ ID NO: 6436584 - DNA, 23 bp, Homo sapiens
tctgcctggagcctgggcagcac

SEQ ID NO: 6436585 - DNA, 13 bp, Homo sapiens
tctgcctggagtg

SEQ ID NO: 6436586 - DNA, 21 bp, Homo sapiens
tctgcctggagtgtatgactg

SEQ ID NO: 6436587 - DNA, 11 bp, Homo sapiens
tctgcctggca

SEQ ID NO: 6436588 - DNA, 12 bp, Homo sapiens
tctgcctggcaa

SEQ ID NO: 6436589 - DNA, 12 bp, Homo sapiens
tctgcctggcct

SEQ ID NO: 6436590 - DNA, 15 bp, Homo sapiens
tctgcctggcctggc

SEQ ID NO: 6436591 - DNA, 18 bp, Homo sapiens
tctgcctgggcctgtgca

SEQ ID NO: 6436592 - DNA, 19 bp, Homo sapiens
tctgcctgggcctgtgcag

SEQ ID NO: 6436593 - DNA, 21 bp, Homo sapiens
tctgcctgggcctgtgcagca

SEQ ID NO: 6436594 - DNA, 17 bp, Homo sapiens
tctgcctggttttattt

SEQ ID NO: 6436595 - DNA, 16 bp, Homo sapiens
tctgcctgtcaagttt

SEQ ID NO: 6436596 - DNA, 12 bp, Homo sapiens
tctgcctgtccc

SEQ ID NO: 6436597 - DNA, 21 bp, Homo sapiens
tctgcctgtccctctcaggca

SEQ ID NO: 6436598 - DNA, 17 bp, Homo sapiens
tctgcctgtcctagtct

SEQ ID NO: 6436599 - DNA, 12 bp, Homo sapiens
tctgcctgtctc

SEQ ID NO: 6436600 - DNA, 13 bp, Homo sapiens
tctgcctgtctgg

SEQ ID NO: 6436601 - DNA, 11 bp, Homo sapiens
tctgcctgtga

SEQ ID NO: 6436602 - DNA, 15 bp, Homo sapiens
tctgcctgtgcccgc

SEQ ID NO: 6436603 - DNA, 18 bp, Homo sapiens
tctgcctgtgcccgctgc

SEQ ID NO: 6436604 - DNA, 16 bp, Homo sapiens
tctgcctgtggaactg

SEQ ID NO: 6436605 - DNA, 19 bp, Homo sapiens
tctgcctgtggccttgccc

SEQ ID NO: 6436606 - DNA, 15 bp, Homo sapiens
tctgcctgttataac

SEQ ID NO: 6436607 - DNA, 19 bp, Homo sapiens
tctgcctgttataactctg

SEQ ID NO: 6436608 - DNA, 13 bp, Homo sapiens
tctgccttagagg

SEQ ID NO: 6436609 - DNA, 17 bp, Homo sapiens
tctgccttaggctgctg

SEQ ID NO: 6436610 - DNA, 15 bp, Homo sapiens
tctgccttagtctca

SEQ ID NO: 6436611 - DNA, 19 bp, Homo sapiens
tctgccttagtctcagttt

SEQ ID NO: 6436612 - DNA, 14 bp, Homo sapiens
tctgccttatacat

SEQ ID NO: 6436613 - DNA, 16 bp, Homo sapiens
tctgccttatctcatt

SEQ ID NO: 6436614 - DNA, 15 bp, Homo sapiens
tctgccttcacaaat

SEQ ID NO: 6436615 - DNA, 18 bp, Homo sapiens
tctgccttccagcccaga

SEQ ID NO: 6436616 - DNA, 13 bp, Homo sapiens
tctgccttccagg

SEQ ID NO: 6436617 - DNA, 14 bp, Homo sapiens
tctgccttccaggc

SEQ ID NO: 6436618 - DNA, 16 bp, Homo sapiens
tctgccttccttgcta

SEQ ID NO: 6436619 - DNA, 12 bp, Homo sapiens
tctgccttctca

SEQ ID NO: 6436620 - DNA, 23 bp, Homo sapiens
tctgccttctcaggccccgggct

SEQ ID NO: 6436621 - DNA, 19 bp, Homo sapiens
tctgccttctgctgaaaga

SEQ ID NO: 6436622 - DNA, 19 bp, Homo sapiens
tctgccttgagtccccagg

SEQ ID NO: 6436623 - DNA, 18 bp, Homo sapiens
tctgccttgatggagaag

SEQ ID NO: 6436624 - DNA, 21 bp, Homo sapiens
tctgccttgatggagaaggaa

SEQ ID NO: 6436625 - DNA, 16 bp, Homo sapiens
tctgccttgcactgtg

SEQ ID NO: 6436626 - DNA, 13 bp, Homo sapiens
tctgccttgccct

SEQ ID NO: 6436627 - DNA, 14 bp, Homo sapiens
tctgccttgccctc

SEQ ID NO: 6436628 - DNA, 20 bp, Homo sapiens
tctgccttgccctcctgggc

SEQ ID NO: 6436629 - DNA, 21 bp, Homo sapiens
tctgccttgccctcctgggcc

SEQ ID NO: 6436630 - DNA, 22 bp, Homo sapiens
tctgccttgccctcctgggccc

SEQ ID NO: 6436631 - DNA, 15 bp, Homo sapiens
tctgccttgctgcac

SEQ ID NO: 6436632 - DNA, 19 bp, Homo sapiens
tctgccttggattcctaga

SEQ ID NO: 6436633 - DNA, 15 bp, Homo sapiens
tctgccttggcatcc

SEQ ID NO: 6436634 - DNA, 20 bp, Homo sapiens
tctgccttggttctggccac

SEQ ID NO: 6436635 - DNA, 21 bp, Homo sapiens
tctgcctttagcctggaccaa

SEQ ID NO: 6436636 - DNA, 18 bp, Homo sapiens
tctgcctttattgtgttt

SEQ ID NO: 6436637 - DNA, 20 bp, Homo sapiens
tctgcctttattgtgtttgt

SEQ ID NO: 6436638 - DNA, 18 bp, Homo sapiens
tctgcctttcccccctca

SEQ ID NO: 6436639 - DNA, 16 bp, Homo sapiens
tctgcctttgcagaaa

SEQ ID NO: 6436640 - DNA, 20 bp, Homo sapiens
tctgcctttgcagaaacaga

SEQ ID NO: 6436641 - DNA, 15 bp, Homo sapiens
tctgcctttgccagg

SEQ ID NO: 6436642 - DNA, 22 bp, Homo sapiens
tctgcctttgttcactgtgagt

SEQ ID NO: 6436643 - DNA, 18 bp, Homo sapiens
tctgcctttgtttctaaa

SEQ ID NO: 6436644 - DNA, 19 bp, Homo sapiens
tctgcctttgtttctaaag

SEQ ID NO: 6436645 - DNA, 11 bp, Homo sapiens
tctgccttttc

SEQ ID NO: 6436646 - DNA, 19 bp, Homo sapiens
tctgcgagcaacagtgccc

SEQ ID NO: 6436647 - DNA, 14 bp, Homo sapiens
tctgcgatgcagcg

SEQ ID NO: 6436648 - DNA, 16 bp, Homo sapiens
tctgcgccacttcctt

SEQ ID NO: 6436649 - DNA, 13 bp, Homo sapiens
tctgcgccaggca

SEQ ID NO: 6436650 - DNA, 14 bp, Homo sapiens
tctgcgccaggcag

SEQ ID NO: 6436651 - DNA, 18 bp, Homo sapiens
tctgcgccaggcagagct

SEQ ID NO: 6436652 - DNA, 17 bp, Homo sapiens
tctgcgccccgcctccc

SEQ ID NO: 6436653 - DNA, 16 bp, Homo sapiens
tctgcgccgctgtgct

SEQ ID NO: 6436654 - DNA, 17 bp, Homo sapiens
tctgcgcctgaaaaggg

SEQ ID NO: 6436655 - DNA, 13 bp, Homo sapiens
tctgcgccttggg

SEQ ID NO: 6436656 - DNA, 14 bp, Homo sapiens
tctgcgcgttcctc

SEQ ID NO: 6436657 - DNA, 16 bp, Homo sapiens
tctgcgcgttcctccg

SEQ ID NO: 6436658 - DNA, 22 bp, Homo sapiens
tctgcgctgaggcccagcccct

SEQ ID NO: 6436659 - DNA, 22 bp, Homo sapiens
tcagggaaggaggagcctgtcc

SEQ ID NO: 6436660 - DNA, 18 bp, Homo sapiens
tcagggacagagacacct

SEQ ID NO: 6436661 - DNA, 15 bp, Homo sapiens
tcagggacaggatga

SEQ ID NO: 6436662 - DNA, 14 bp, Homo sapiens
tcagggaccaagga

SEQ ID NO: 6436663 - DNA, 13 bp, Homo sapiens
tcagggaccagct

SEQ ID NO: 6436664 - DNA, 14 bp, Homo sapiens
tcagggaccagctt

SEQ ID NO: 6436665 - DNA, 15 bp, Homo sapiens
tcagggaccagcttt

SEQ ID NO: 6436666 - DNA, 19 bp, Homo sapiens
tcagggaccagctttactg

SEQ ID NO: 6436667 - DNA, 17 bp, Homo sapiens
tcagggacccctgccct

SEQ ID NO: 6436668 - DNA, 12 bp, Homo sapiens
tcagggacctca

SEQ ID NO: 6436669 - DNA, 15 bp, Homo sapiens
tcagggacctcaggg

SEQ ID NO: 6436670 - DNA, 16 bp, Homo sapiens
tcagggacctcagggg

SEQ ID NO: 6436671 - DNA, 19 bp, Homo sapiens
tcagggacctcaggggcac

SEQ ID NO: 6436672 - DNA, 17 bp, Homo sapiens
tcagggacctgctgctc

SEQ ID NO: 6436673 - DNA, 23 bp, Homo sapiens
tcagggacctgctgctcagtaag

SEQ ID NO: 6436674 - DNA, 22 bp, Homo sapiens
tcagggagagctgggcagacag

SEQ ID NO: 6436675 - DNA, 20 bp, Homo sapiens
tcagggagcactggaggcct

SEQ ID NO: 6436676 - DNA, 21 bp, Homo sapiens
tcagggagcagggaaggcctg

SEQ ID NO: 6436677 - DNA, 23 bp, Homo sapiens
tcagggagcagggaaggcctgac

SEQ ID NO: 6436678 - DNA, 18 bp, Homo sapiens
tcagggagggaaggggat

SEQ ID NO: 6436679 - DNA, 22 bp, Homo sapiens
tcagggagggaaggggatggag

SEQ ID NO: 6436680 - DNA, 12 bp, Homo sapiens
tcagggagggcc

SEQ ID NO: 6436681 - DNA, 15 bp, Homo sapiens
tcagggagggccagg

SEQ ID NO: 6436682 - DNA, 20 bp, Homo sapiens
tcagggagggccagggaggc

SEQ ID NO: 6436683 - DNA, 22 bp, Homo sapiens
tcagggagggccagggaggcag

SEQ ID NO: 6436684 - DNA, 13 bp, Homo sapiens
tcagggaggggcc

SEQ ID NO: 6436685 - DNA, 14 bp, Homo sapiens
tcagggaggggccg

SEQ ID NO: 6436686 - DNA, 22 bp, Homo sapiens
tcagggaggggccggctggcct

SEQ ID NO: 6436687 - DNA, 15 bp, Homo sapiens
tcagggaggtcattt

SEQ ID NO: 6436688 - DNA, 21 bp, Homo sapiens
tcagggagtgggctaagcacg

SEQ ID NO: 6436689 - DNA, 15 bp, Homo sapiens
tcagggatcttgcat

SEQ ID NO: 6436690 - DNA, 16 bp, Homo sapiens
tcagggatggagggaa

SEQ ID NO: 6436691 - DNA, 18 bp, Homo sapiens
tcagggattccctgtccc

SEQ ID NO: 6436692 - DNA, 15 bp, Homo sapiens
tcagggcaaagccag

SEQ ID NO: 6436693 - DNA, 21 bp, Homo sapiens
tcagggcaactcggagagggc

SEQ ID NO: 6436694 - DNA, 23 bp, Homo sapiens
tcagggcaagctcatagcacatg

SEQ ID NO: 6436695 - DNA, 16 bp, Homo sapiens
tcagggcacagctgcc

SEQ ID NO: 6436696 - DNA, 20 bp, Homo sapiens
tcagggcacagctgccctgc

SEQ ID NO: 6436697 - DNA, 14 bp, Homo sapiens
tcagggcacagtct

SEQ ID NO: 6436698 - DNA, 15 bp, Homo sapiens
tcagggcacagtctc

SEQ ID NO: 6436699 - DNA, 22 bp, Homo sapiens
tcagggcactgctgctgccttt

SEQ ID NO: 6436700 - DNA, 14 bp, Homo sapiens
tcagggcagatttt

SEQ ID NO: 6436701 - DNA, 20 bp, Homo sapiens
tcagggcagcccctgcagac

SEQ ID NO: 6436702 - DNA, 16 bp, Homo sapiens
tcagggcagctgcctg

SEQ ID NO: 6436703 - DNA, 18 bp, Homo sapiens
tcagggcagctgcctggc

SEQ ID NO: 6436704 - DNA, 21 bp, Homo sapiens
tcagggcagctgcctggccat

SEQ ID NO: 6436705 - DNA, 11 bp, Homo sapiens
tcagggcaggg

SEQ ID NO: 6436706 - DNA, 16 bp, Homo sapiens
tcagggcagggctctg

SEQ ID NO: 6436707 - DNA, 15 bp, Homo sapiens
tcagggcataaagca

SEQ ID NO: 6436708 - DNA, 21 bp, Homo sapiens
tcagggcattctgttggccta

SEQ ID NO: 6436709 - DNA, 19 bp, Homo sapiens
tcagggcattgcctgtgac

SEQ ID NO: 6436710 - DNA, 13 bp, Homo sapiens
tcagggccaagcc

SEQ ID NO: 6436711 - DNA, 16 bp, Homo sapiens
tcagggccagactgga

SEQ ID NO: 6436712 - DNA, 12 bp, Homo sapiens
tcagggccagga

SEQ ID NO: 6436713 - DNA, 15 bp, Homo sapiens
tcagggccaggaagg

SEQ ID NO: 6436714 - DNA, 17 bp, Homo sapiens
tcagggccaggcccagg

SEQ ID NO: 6436715 - DNA, 21 bp, Homo sapiens
tcagggccaggcccaggcctc

SEQ ID NO: 6436716 - DNA, 19 bp, Homo sapiens
tcagggccaggtcctcaca

SEQ ID NO: 6436717 - DNA, 13 bp, Homo sapiens
tcagggccagtcc

SEQ ID NO: 6436718 - DNA, 14 bp, Homo sapiens
tcagggccatgctg

SEQ ID NO: 6436719 - DNA, 14 bp, Homo sapiens
tcagggcccaagtc

SEQ ID NO: 6436720 - DNA, 19 bp, Homo sapiens
tcagggcccaagtccctgt

SEQ ID NO: 6436721 - DNA, 14 bp, Homo sapiens
tcagggcccacctc

SEQ ID NO: 6436722 - DNA, 16 bp, Homo sapiens
tcagggcccctgaagt

SEQ ID NO: 6436723 - DNA, 18 bp, Homo sapiens
tcagggcccctgaagtga

SEQ ID NO: 6436724 - DNA, 15 bp, Homo sapiens
tcagggccctgcccc

SEQ ID NO: 6436725 - DNA, 17 bp, Homo sapiens
tcagggccctgccccag

SEQ ID NO: 6436726 - DNA, 23 bp, Homo sapiens
tcagggccgagaggacagaatgg

SEQ ID NO: 6436727 - DNA, 13 bp, Homo sapiens
tcagggcctgagt

SEQ ID NO: 6436728 - DNA, 19 bp, Homo sapiens
tcagggcctgagtgcttta

SEQ ID NO: 6436729 - DNA, 18 bp, Homo sapiens
tcagggcctgccccctgg

SEQ ID NO: 6436730 - DNA, 20 bp, Homo sapiens
tcagggcctggggcctgaga

SEQ ID NO: 6436731 - DNA, 21 bp, Homo sapiens
tcagggcctggggcctgagag

SEQ ID NO: 6436732 - DNA, 17 bp, Homo sapiens
tcagggcctttctcctc

SEQ ID NO: 6436733 - DNA, 18 bp, Homo sapiens
tcagggcctttctcctcc

SEQ ID NO: 6436734 - DNA, 20 bp, Homo sapiens
tcagggcctttctcctcccc

SEQ ID NO: 6436735 - DNA, 21 bp, Homo sapiens
tcagggcctttctcctcccca

SEQ ID NO: 6436736 - DNA, 19 bp, Homo sapiens
tcagggcggcctcccaggt

SEQ ID NO: 6436737 - DNA, 20 bp, Homo sapiens
tcagggcggggctggccagc

SEQ ID NO: 6436738 - DNA, 23 bp, Homo sapiens
tcagggcggggctggccagctgt

SEQ ID NO: 6436739 - DNA, 12 bp, Homo sapiens
tcagggctcaga

SEQ ID NO: 6436740 - DNA, 16 bp, Homo sapiens
tcagggctcctcccag

SEQ ID NO: 6436741 - DNA, 23 bp, Homo sapiens
tcagggctccttgtgggcctggg

SEQ ID NO: 6436742 - DNA, 22 bp, Homo sapiens
tcagggctgacacgtccacccc

SEQ ID NO: 6436743 - DNA, 19 bp, Homo sapiens
tcagggctgagtgaatcaa

SEQ ID NO: 6436744 - DNA, 21 bp, Homo sapiens
tcagggctggaaaagtcacac

SEQ ID NO: 6436745 - DNA, 18 bp, Homo sapiens
tcagggctggagcctggg

SEQ ID NO: 6436746 - DNA, 18 bp, Homo sapiens
tcagggctggctcctgat

SEQ ID NO: 6436747 - DNA, 12 bp, Homo sapiens
tcagggctgggc

SEQ ID NO: 6436748 - DNA, 14 bp, Homo sapiens
tcagggctgggcag

SEQ ID NO: 6436749 - DNA, 14 bp, Homo sapiens
tcagggctgtccca

SEQ ID NO: 6436750 - DNA, 16 bp, Homo sapiens
tcagggctgtcccagc

SEQ ID NO: 6436751 - DNA, 19 bp, Homo sapiens
tcagggctgtcccagcccc

SEQ ID NO: 6436752 - DNA, 23 bp, Homo sapiens
tcagggctgtcggtgtgctgtca

SEQ ID NO: 6436753 - DNA, 14 bp, Homo sapiens
tcagggctgtgctt

SEQ ID NO: 6436754 - DNA, 14 bp, Homo sapiens
tcaggggaagagaa

SEQ ID NO: 6436755 - DNA, 20 bp, Homo sapiens
tcaggggaagagaagacaaa

SEQ ID NO: 6436756 - DNA, 17 bp, Homo sapiens
tcaggggaagggcaggc

SEQ ID NO: 6436757 - DNA, 16 bp, Homo sapiens
tcaggggacactggcc

SEQ ID NO: 6436758 - DNA, 18 bp, Homo sapiens
tcaggggactcagccctg

SEQ ID NO: 6436759 - DNA, 18 bp, Homo sapiens
tcaggggagaagctgaag

SEQ ID NO: 6436760 - DNA, 11 bp, Homo sapiens
tcaggggagac

SEQ ID NO: 6436761 - DNA, 21 bp, Homo sapiens
tcaggggatcaaaaggacgga

SEQ ID NO: 6436762 - DNA, 16 bp, Homo sapiens
tcaggggatgggtgtg

SEQ ID NO: 6436763 - DNA, 15 bp, Homo sapiens
tcaggggcaggaacc

SEQ ID NO: 6436764 - DNA, 14 bp, Homo sapiens
tcaggggcaggtgg

SEQ ID NO: 6436765 - DNA, 12 bp, Homo sapiens
tcaggggccaga

SEQ ID NO: 6436766 - DNA, 20 bp, Homo sapiens
tcaggggccagagagcaggg

SEQ ID NO: 6436767 - DNA, 15 bp, Homo sapiens
tcaggggccagagga

SEQ ID NO: 6436768 - DNA, 16 bp, Homo sapiens
tcaggggccctggagc

SEQ ID NO: 6436769 - DNA, 18 bp, Homo sapiens
tcaggggcctctctcctg

SEQ ID NO: 6436770 - DNA, 13 bp, Homo sapiens
tcaggggcctgga

SEQ ID NO: 6436771 - DNA, 14 bp, Homo sapiens
tcaggggcctggag

SEQ ID NO: 6436772 - DNA, 19 bp, Homo sapiens
tcaggggcctggaggtctg

SEQ ID NO: 6436773 - DNA, 10 bp, Homo sapiens
tcaggggctc

SEQ ID NO: 6436774 - DNA, 13 bp, Homo sapiens
tcaggggctctgt

SEQ ID NO: 6436775 - DNA, 17 bp, Homo sapiens
tcaggggctgacacttc

SEQ ID NO: 6436776 - DNA, 22 bp, Homo sapiens
tcaggggctgcccgctcccagt

SEQ ID NO: 6436777 - DNA, 12 bp, Homo sapiens
tcaggggctggg

SEQ ID NO: 6436778 - DNA, 23 bp, Homo sapiens
tcaggggctgggcatcccagctt

SEQ ID NO: 6436779 - DNA, 14 bp, Homo sapiens
tcaggggctgtttg

SEQ ID NO: 6436780 - DNA, 13 bp, Homo sapiens
tcaggggctttgg

SEQ ID NO: 6436781 - DNA, 15 bp, Homo sapiens
tcaggggctttgggc

SEQ ID NO: 6436782 - DNA, 17 bp, Homo sapiens
tcaggggctttgggccc

SEQ ID NO: 6436783 - DNA, 17 bp, Homo sapiens
tcagggggaagaagcag

SEQ ID NO: 6436784 - DNA, 19 bp, Homo sapiens
tcagggggaagaagcagag

SEQ ID NO: 6436785 - DNA, 17 bp, Homo sapiens
tcagggggccagctggg

SEQ ID NO: 6436786 - DNA, 18 bp, Homo sapiens
tcagggggccagctgggg

SEQ ID NO: 6436787 - DNA, 19 bp, Homo sapiens
tcagggggccagctgggga

SEQ ID NO: 6436788 - DNA, 22 bp, Homo sapiens
tcagggggccagctggggagat

SEQ ID NO: 6436789 - DNA, 22 bp, Homo sapiens
tcagggggcctttaaagactta

SEQ ID NO: 6436790 - DNA, 17 bp, Homo sapiens
tcagggggcgcctgtgg

SEQ ID NO: 6436791 - DNA, 17 bp, Homo sapiens
tcagggggtaggagagc

SEQ ID NO: 6436792 - DNA, 17 bp, Homo sapiens
tcaggggtacacagagc

SEQ ID NO: 6436793 - DNA, 16 bp, Homo sapiens
tcaggggtgacacaga

SEQ ID NO: 6436794 - DNA, 16 bp, Homo sapiens
tcaggggtgagacctg

SEQ ID NO: 6436795 - DNA, 20 bp, Homo sapiens
tcaggggtgctggggcagag

SEQ ID NO: 6436796 - DNA, 12 bp, Homo sapiens
tcaggggtgtgc

SEQ ID NO: 6436797 - DNA, 19 bp, Homo sapiens
tcaggggtgtgcggccttt

SEQ ID NO: 6436798 - DNA, 22 bp, Homo sapiens
tcaggggttcgagaccagtctg

SEQ ID NO: 6436799 - DNA, 15 bp, Homo sapiens
tcagggtagcagcag

SEQ ID NO: 6436800 - DNA, 23 bp, Homo sapiens
tcagggtagcagcagaggcagga

SEQ ID NO: 6436801 - DNA, 18 bp, Homo sapiens
tcagggtatcccagaccc

SEQ ID NO: 6436802 - DNA, 22 bp, Homo sapiens
tcagggtcaaagacagaatggt

SEQ ID NO: 6436803 - DNA, 21 bp, Homo sapiens
tcagggtccaggagagcctgg

SEQ ID NO: 6436804 - DNA, 16 bp, Homo sapiens
tcagggtccctcagga

SEQ ID NO: 6436805 - DNA, 13 bp, Homo sapiens
tcagggtccctgg

SEQ ID NO: 6436806 - DNA, 18 bp, Homo sapiens
tcagggtccctggtggca

SEQ ID NO: 6436807 - DNA, 15 bp, Homo sapiens
tcagggtcctgccct

SEQ ID NO: 6436808 - DNA, 24 bp, Homo sapiens
tcagggtctttctgatgacgcctg

SEQ ID NO: 6436809 - DNA, 19 bp, Homo sapiens
tcagggtgaactgcaaagc

SEQ ID NO: 6436810 - DNA, 22 bp, Homo sapiens
tcagggtgcagcccaatctgcc

SEQ ID NO: 6436811 - DNA, 22 bp, Homo sapiens
tcagggtgctccctcctcagtc

SEQ ID NO: 6436812 - DNA, 13 bp, Homo sapiens
tcagggtggctgg

SEQ ID NO: 6436813 - DNA, 23 bp, Homo sapiens
tcagggtggtctcttcttggggc

SEQ ID NO: 6436814 - DNA, 15 bp, Homo sapiens
tcagggtgtgaggcc

SEQ ID NO: 6436815 - DNA, 13 bp, Homo sapiens
tcagggtgtggga

SEQ ID NO: 6436816 - DNA, 21 bp, Homo sapiens
tcagggtgtgggatctgagga

SEQ ID NO: 6436817 - DNA, 17 bp, Homo sapiens
tcagggttaagcctgta

SEQ ID NO: 6436818 - DNA, 14 bp, Homo sapiens
tcagggttcatctg

SEQ ID NO: 6436819 - DNA, 15 bp, Homo sapiens
tcagggttcatctgt

SEQ ID NO: 6436820 - DNA, 16 bp, Homo sapiens
tcagggttggcccctg

SEQ ID NO: 6436821 - DNA, 17 bp, Homo sapiens
tcagggtttaatagact

SEQ ID NO: 6436822 - DNA, 22 bp, Homo sapiens
tcagggtttgtcagaggaacaa

SEQ ID NO: 6436823 - DNA, 16 bp, Homo sapiens
tcagggttttggggtc

SEQ ID NO: 6436824 - DNA, 22 bp, Homo sapiens
tcaggtaaaatattttccaaag

SEQ ID NO: 6436825 - DNA, 15 bp, Homo sapiens
tcaggtaacaggcag

SEQ ID NO: 6436826 - DNA, 15 bp, Homo sapiens
tcaggtaatatacct

SEQ ID NO: 6436827 - DNA, 16 bp, Homo sapiens
tcaggtaatatacctg

SEQ ID NO: 6436828 - DNA, 18 bp, Homo sapiens
tcaggtaatcgacctgcc

SEQ ID NO: 6436829 - DNA, 20 bp, Homo sapiens
tcaggtacagaaaacatgtt

SEQ ID NO: 6436830 - DNA, 21 bp, Homo sapiens
tcaggtacagcgggctgtgcc

SEQ ID NO: 6436831 - DNA, 13 bp, Homo sapiens
tcaggtagctgcc

SEQ ID NO: 6436832 - DNA, 15 bp, Homo sapiens
tcaggtaggcccttg

SEQ ID NO: 6436833 - DNA, 21 bp, Homo sapiens
tcaggtaggcccttgtcctgc

SEQ ID NO: 6436834 - DNA, 16 bp, Homo sapiens
tcaggtagtactaaga

SEQ ID NO: 6436835 - DNA, 17 bp, Homo sapiens
tcaggtatacctcactt

SEQ ID NO: 6436836 - DNA, 15 bp, Homo sapiens
tcaggtatgttgcct

SEQ ID NO: 6436837 - DNA, 16 bp, Homo sapiens
tcaggtatgttgcctt

SEQ ID NO: 6436838 - DNA, 17 bp, Homo sapiens
tctgcgcttcagtaaca

SEQ ID NO: 6436839 - DNA, 15 bp, Homo sapiens
tctgcggaccccagc

SEQ ID NO: 6436840 - DNA, 21 bp, Homo sapiens
tctgcggagcacactggctca

SEQ ID NO: 6436841 - DNA, 21 bp, Homo sapiens
tctgcggagccagcgcctgcc

SEQ ID NO: 6436842 - DNA, 22 bp, Homo sapiens
tctgcggagccagcgcctgccc

SEQ ID NO: 6436843 - DNA, 20 bp, Homo sapiens
tctgcggagcttctccagcc

SEQ ID NO: 6436844 - DNA, 15 bp, Homo sapiens
tctgcgggaggctgg

SEQ ID NO: 6436845 - DNA, 20 bp, Homo sapiens
tctgcgggaggctggggccc

SEQ ID NO: 6436846 - DNA, 15 bp, Homo sapiens
tctgcgggctccctc

SEQ ID NO: 6436847 - DNA, 23 bp, Homo sapiens
tctgcgggctccctcctctggca

SEQ ID NO: 6436848 - DNA, 15 bp, Homo sapiens
tctgcggtgaggcag

SEQ ID NO: 6436849 - DNA, 20 bp, Homo sapiens
tctgcggtgaggcaggggag

SEQ ID NO: 6436850 - DNA, 17 bp, Homo sapiens
tctgcggtggtgccaga

SEQ ID NO: 6436851 - DNA, 20 bp, Homo sapiens
tctgcggtggtgccagaggt

SEQ ID NO: 6436852 - DNA, 16 bp, Homo sapiens
tctgcgtcatgcttgt

SEQ ID NO: 6436853 - DNA, 15 bp, Homo sapiens
tctgcgtccaccagg

SEQ ID NO: 6436854 - DNA, 17 bp, Homo sapiens
tctgcgtccaccaggcc

SEQ ID NO: 6436855 - DNA, 14 bp, Homo sapiens
tctgcgtcccccag

SEQ ID NO: 6436856 - DNA, 19 bp, Homo sapiens
tctgcgtctctgctttaaa

SEQ ID NO: 6436857 - DNA, 20 bp, Homo sapiens
tctgcgtctctgctttaaag

SEQ ID NO: 6436858 - DNA, 16 bp, Homo sapiens
tctgcgtgactatttt

SEQ ID NO: 6436859 - DNA, 19 bp, Homo sapiens
tctgcgtggcgcaggtgcc

SEQ ID NO: 6436860 - DNA, 14 bp, Homo sapiens
tctgcgtgtgtata

SEQ ID NO: 6436861 - DNA, 15 bp, Homo sapiens
tctgcgttggcttct

SEQ ID NO: 6436862 - DNA, 15 bp, Homo sapiens
tctgcgtttgtccct

SEQ ID NO: 6436863 - DNA, 15 bp, Homo sapiens
tctgctaaatatcac

SEQ ID NO: 6436864 - DNA, 23 bp, Homo sapiens
tctgctaagattccttttgtcaa

SEQ ID NO: 6436865 - DNA, 13 bp, Homo sapiens
tctgctaagttct

SEQ ID NO: 6436866 - DNA, 16 bp, Homo sapiens
tctgctaatttatgaa

SEQ ID NO: 6436867 - DNA, 19 bp, Homo sapiens
tctgctaccagggctcacc

SEQ ID NO: 6436868 - DNA, 14 bp, Homo sapiens
tctgctacctcact

SEQ ID NO: 6436869 - DNA, 17 bp, Homo sapiens
tctgctacctcactggg

SEQ ID NO: 6436870 - DNA, 15 bp, Homo sapiens
tctgctacctggttt

SEQ ID NO: 6436871 - DNA, 14 bp, Homo sapiens
tctgctaccttgcc

SEQ ID NO: 6436872 - DNA, 15 bp, Homo sapiens
tctgctaccttgccc

SEQ ID NO: 6436873 - DNA, 15 bp, Homo sapiens
tctgctagaaagtta

SEQ ID NO: 6436874 - DNA, 19 bp, Homo sapiens
tctgctagactcctcagga

SEQ ID NO: 6436875 - DNA, 13 bp, Homo sapiens
tctgctagagagt

SEQ ID NO: 6436876 - DNA, 22 bp, Homo sapiens
tctgctagagcagacaggcctg

SEQ ID NO: 6436877 - DNA, 15 bp, Homo sapiens
tctgctatatataaa

SEQ ID NO: 6436878 - DNA, 13 bp, Homo sapiens
tctgctatgcttg

SEQ ID NO: 6436879 - DNA, 14 bp, Homo sapiens
tctgctatgcttga

SEQ ID NO: 6436880 - DNA, 21 bp, Homo sapiens
tctgctcaatgaaaccttcct

SEQ ID NO: 6436881 - DNA, 22 bp, Homo sapiens
tctgctcaatgaaaccttcctc

SEQ ID NO: 6436882 - DNA, 17 bp, Homo sapiens
tctgctcacatatctgt

SEQ ID NO: 6436883 - DNA, 19 bp, Homo sapiens
tctgctcacatatctgtca

SEQ ID NO: 6436884 - DNA, 20 bp, Homo sapiens
tctgctcacatatctgtcat

SEQ ID NO: 6436885 - DNA, 21 bp, Homo sapiens
tctgctcacattccctctcat

SEQ ID NO: 6436886 - DNA, 22 bp, Homo sapiens
tctgctcacattccctctcatc

SEQ ID NO: 6436887 - DNA, 21 bp, Homo sapiens
tctgctcaccgcccatcaggg

SEQ ID NO: 6436888 - DNA, 22 bp, Homo sapiens
tctgctcagacagaacccctac

SEQ ID NO: 6436889 - DNA, 20 bp, Homo sapiens
tctgctcagaggccttgctg

SEQ ID NO: 6436890 - DNA, 13 bp, Homo sapiens
tctgctcagcagc

SEQ ID NO: 6436891 - DNA, 14 bp, Homo sapiens
tctgctcagcagct

SEQ ID NO: 6436892 - DNA, 15 bp, Homo sapiens
tctgctcagcagcta

SEQ ID NO: 6436893 - DNA, 17 bp, Homo sapiens
tctgctcagcaggccct

SEQ ID NO: 6436894 - DNA, 17 bp, Homo sapiens
tctgctcagccaagctt

SEQ ID NO: 6436895 - DNA, 14 bp, Homo sapiens
tctgctcagccctg

SEQ ID NO: 6436896 - DNA, 18 bp, Homo sapiens
tctgctcagccctggagg

SEQ ID NO: 6436897 - DNA, 19 bp, Homo sapiens
tctgctcaggaattgaaga

SEQ ID NO: 6436898 - DNA, 15 bp, Homo sapiens
tctgctcatcattct

SEQ ID NO: 6436899 - DNA, 18 bp, Homo sapiens
tctgctcattttgacaaa

SEQ ID NO: 6436900 - DNA, 22 bp, Homo sapiens
tctgctccaacagacaccctcc

SEQ ID NO: 6436901 - DNA, 16 bp, Homo sapiens
tctgctccaactccac

SEQ ID NO: 6436902 - DNA, 10 bp, Homo sapiens
tctgctccac

SEQ ID NO: 6436903 - DNA, 15 bp, Homo sapiens
tctgctccacccttg

SEQ ID NO: 6436904 - DNA, 17 bp, Homo sapiens
tctgctccacccttggc

SEQ ID NO: 6436905 - DNA, 19 bp, Homo sapiens
tctgctccacccttggcct

SEQ ID NO: 6436906 - DNA, 12 bp, Homo sapiens
tctgctccagag

SEQ ID NO: 6436907 - DNA, 14 bp, Homo sapiens
tctgctccagcaac

SEQ ID NO: 6436908 - DNA, 20 bp, Homo sapiens
tctgctccagcaactgccct

SEQ ID NO: 6436909 - DNA, 12 bp, Homo sapiens
tctgctccagcc

SEQ ID NO: 6436910 - DNA, 15 bp, Homo sapiens
tctgctccagcccct

SEQ ID NO: 6436911 - DNA, 16 bp, Homo sapiens
tctgctccagcccctt

SEQ ID NO: 6436912 - DNA, 20 bp, Homo sapiens
tctgctccagctctggcatg

SEQ ID NO: 6436913 - DNA, 12 bp, Homo sapiens
tctgctccatgc

SEQ ID NO: 6436914 - DNA, 22 bp, Homo sapiens
tctgctccatgcagatctagcc

SEQ ID NO: 6436915 - DNA, 23 bp, Homo sapiens
tctgctccatgcagatctagcca

SEQ ID NO: 6436916 - DNA, 11 bp, Homo sapiens
tctgctcccaa

SEQ ID NO: 6436917 - DNA, 12 bp, Homo sapiens
tctgctcccaag

SEQ ID NO: 6436918 - DNA, 13 bp, Homo sapiens
tctgctcccaagg

SEQ ID NO: 6436919 - DNA, 22 bp, Homo sapiens
tctgctcccaaggggcctgagc

SEQ ID NO: 6436920 - DNA, 16 bp, Homo sapiens
tctgctcccaccccag

SEQ ID NO: 6436921 - DNA, 14 bp, Homo sapiens
tctgctcccagccc

SEQ ID NO: 6436922 - DNA, 20 bp, Homo sapiens
tctgctcccccttttccctc

SEQ ID NO: 6436923 - DNA, 23 bp, Homo sapiens
tctgctccctgcaagctccgcct

SEQ ID NO: 6436924 - DNA, 23 bp, Homo sapiens
tctgctcctcacccccacccctg

SEQ ID NO: 6436925 - DNA, 22 bp, Homo sapiens
tctgctcctcccattcccctta

SEQ ID NO: 6436926 - DNA, 14 bp, Homo sapiens
tctgctcctccctc

SEQ ID NO: 6436927 - DNA, 15 bp, Homo sapiens
tctgctcctccctcc

SEQ ID NO: 6436928 - DNA, 16 bp, Homo sapiens
tctgctcctccctccc

SEQ ID NO: 6436929 - DNA, 18 bp, Homo sapiens
tctgctcctctccaggca

SEQ ID NO: 6436930 - DNA, 18 bp, Homo sapiens
tctgctcctgaaaaatga

SEQ ID NO: 6436931 - DNA, 14 bp, Homo sapiens
tctgctcctgaacc

SEQ ID NO: 6436932 - DNA, 11 bp, Homo sapiens
tctgctcctgc

SEQ ID NO: 6436933 - DNA, 13 bp, Homo sapiens
tctgctcctgctt

SEQ ID NO: 6436934 - DNA, 17 bp, Homo sapiens
tctgctcctgcttttct

SEQ ID NO: 6436935 - DNA, 15 bp, Homo sapiens
tctgctccttcctgt

SEQ ID NO: 6436936 - DNA, 20 bp, Homo sapiens
tctgctccttcctgtggcct

SEQ ID NO: 6436937 - DNA, 16 bp, Homo sapiens
tctgctcctttcccct

SEQ ID NO: 6436938 - DNA, 17 bp, Homo sapiens
tctgctcgccctccttt

SEQ ID NO: 6436939 - DNA, 19 bp, Homo sapiens
tctgctcgccctcctttct

SEQ ID NO: 6436940 - DNA, 15 bp, Homo sapiens
tctgctcggccgtct

SEQ ID NO: 6436941 - DNA, 22 bp, Homo sapiens
tctgctcggcttcttggacctt

SEQ ID NO: 6436942 - DNA, 16 bp, Homo sapiens
tctgctcgggcccagg

SEQ ID NO: 6436943 - DNA, 17 bp, Homo sapiens
tctgctcgggcccaggc

SEQ ID NO: 6436944 - DNA, 17 bp, Homo sapiens
tctgctctaaataaaga

SEQ ID NO: 6436945 - DNA, 21 bp, Homo sapiens
tctgctctaattgctgccagg

SEQ ID NO: 6436946 - DNA, 18 bp, Homo sapiens
tctgctctagattcataa

SEQ ID NO: 6436947 - DNA, 18 bp, Homo sapiens
tctgctctagccaggagt

SEQ ID NO: 6436948 - DNA, 18 bp, Homo sapiens
tctgctctagggaatctg

SEQ ID NO: 6436949 - DNA, 16 bp, Homo sapiens
tctgctctatactgtg

SEQ ID NO: 6436950 - DNA, 13 bp, Homo sapiens
tctgctctcagct

SEQ ID NO: 6436951 - DNA, 14 bp, Homo sapiens
tctgctctcagctt

SEQ ID NO: 6436952 - DNA, 20 bp, Homo sapiens
tctgctctcatccattcctc

SEQ ID NO: 6436953 - DNA, 17 bp, Homo sapiens
tctgctctcctcgggcc

SEQ ID NO: 6436954 - DNA, 21 bp, Homo sapiens
tctgctctcctcgggccctgt

SEQ ID NO: 6436955 - DNA, 12 bp, Homo sapiens
tctgctctcctt

SEQ ID NO: 6436956 - DNA, 19 bp, Homo sapiens
tctgctctctatgtatgta

SEQ ID NO: 6436957 - DNA, 19 bp, Homo sapiens
tctgctctgaggcttccag

SEQ ID NO: 6436958 - DNA, 20 bp, Homo sapiens
tctgctctgaggcttccaga

SEQ ID NO: 6436959 - DNA, 11 bp, Homo sapiens
tctgctctgat

SEQ ID NO: 6436960 - DNA, 13 bp, Homo sapiens
tctgctctgatgc

SEQ ID NO: 6436961 - DNA, 12 bp, Homo sapiens
tctgctctgccc

SEQ ID NO: 6436962 - DNA, 13 bp, Homo sapiens
tctgctctgccca

SEQ ID NO: 6436963 - DNA, 13 bp, Homo sapiens
tctgctctgccct

SEQ ID NO: 6436964 - DNA, 13 bp, Homo sapiens
tctgctctgcctg

SEQ ID NO: 6436965 - DNA, 15 bp, Homo sapiens
tctgctctgcctgga

SEQ ID NO: 6436966 - DNA, 12 bp, Homo sapiens
tctgctctgctg

SEQ ID NO: 6436967 - DNA, 17 bp, Homo sapiens
tctgctctggtggctta

SEQ ID NO: 6436968 - DNA, 18 bp, Homo sapiens
tctgctctggttgtttct

SEQ ID NO: 6436969 - DNA, 18 bp, Homo sapiens
tctgctcttatttttgta

SEQ ID NO: 6436970 - DNA, 18 bp, Homo sapiens
tctgctcttccaaagctc

SEQ ID NO: 6436971 - DNA, 16 bp, Homo sapiens
tctgctcttgcctgca

SEQ ID NO: 6436972 - DNA, 16 bp, Homo sapiens
tctgctcttgtttcac

SEQ ID NO: 6436973 - DNA, 23 bp, Homo sapiens
tctgctcttgtttcactccacca

SEQ ID NO: 6436974 - DNA, 14 bp, Homo sapiens
tctgctctttacat

SEQ ID NO: 6436975 - DNA, 15 bp, Homo sapiens
tctgctctttctctg

SEQ ID NO: 6436976 - DNA, 19 bp, Homo sapiens
tctgctctttctctgccag

SEQ ID NO: 6436977 - DNA, 13 bp, Homo sapiens
tctgctgaaggaa

SEQ ID NO: 6436978 - DNA, 16 bp, Homo sapiens
tctgctgaattttcac

SEQ ID NO: 6436979 - DNA, 17 bp, Homo sapiens
tctgctgacagacacag

SEQ ID NO: 6436980 - DNA, 18 bp, Homo sapiens
tctgctgacagacacagg

SEQ ID NO: 6436981 - DNA, 19 bp, Homo sapiens
tctgctgacagatgttcca

SEQ ID NO: 6436982 - DNA, 15 bp, Homo sapiens
tctgctgaccaaatg

SEQ ID NO: 6436983 - DNA, 15 bp, Homo sapiens
tctgctgacctgctg

SEQ ID NO: 6436984 - DNA, 17 bp, Homo sapiens
tctgctgactgtttcat

SEQ ID NO: 6436985 - DNA, 18 bp, Homo sapiens
tctgctgactgtttcatt

SEQ ID NO: 6436986 - DNA, 19 bp, Homo sapiens
tctgctgactgtttcattc

SEQ ID NO: 6436987 - DNA, 19 bp, Homo sapiens
tctgctgacttctgagcag

SEQ ID NO: 6436988 - DNA, 19 bp, Homo sapiens
tctgctgagaggcaccagt

SEQ ID NO: 6436989 - DNA, 18 bp, Homo sapiens
tctgctgagcagcccagc

SEQ ID NO: 6436990 - DNA, 20 bp, Homo sapiens
tctgctgagctctgacctgc

SEQ ID NO: 6436991 - DNA, 19 bp, Homo sapiens
tctgctgagctgggcccag

SEQ ID NO: 6436992 - DNA, 11 bp, Homo sapiens
tctgctgaggc

SEQ ID NO: 6436993 - DNA, 16 bp, Homo sapiens
tctgctgaggccagag

SEQ ID NO: 6436994 - DNA, 12 bp, Homo sapiens
tctgctgagggt

SEQ ID NO: 6436995 - DNA, 16 bp, Homo sapiens
tctgctgcacatagca

SEQ ID NO: 6436996 - DNA, 20 bp, Homo sapiens
tctgctgcaccttgtaaatg

SEQ ID NO: 6436997 - DNA, 12 bp, Homo sapiens
tctgctgcagtt

SEQ ID NO: 6436998 - DNA, 13 bp, Homo sapiens
tctgctgcatccc

SEQ ID NO: 6436999 - DNA, 19 bp, Homo sapiens
tctgctgcatccccttcca

SEQ ID NO: 6437000 - DNA, 20 bp, Homo sapiens
tctgctgcatccccttccag

SEQ ID NO: 6437001 - DNA, 16 bp, Homo sapiens
tctgctgccagcacag

SEQ ID NO: 6437002 - DNA, 15 bp, Homo sapiens
tctgctgcccaggcc

SEQ ID NO: 6437003 - DNA, 15 bp, Homo sapiens
tctgctgcccctgca

SEQ ID NO: 6437004 - DNA, 16 bp, Homo sapiens
tctgctgcccctgcag

SEQ ID NO: 6437005 - DNA, 17 bp, Homo sapiens
tctgctgcccctgcagt

SEQ ID NO: 6437006 - DNA, 22 bp, Homo sapiens
tctgctgccgccccacccagat

SEQ ID NO: 6437007 - DNA, 14 bp, Homo sapiens
tctgctgccggctc

SEQ ID NO: 6437008 - DNA, 18 bp, Homo sapiens
tctgctgccggctctggg

SEQ ID NO: 6437009 - DNA, 16 bp, Homo sapiens
tctgctgcctccaagt

SEQ ID NO: 6437010 - DNA, 19 bp, Homo sapiens
tctgctgcctctacacagg

SEQ ID NO: 6437011 - DNA, 11 bp, Homo sapiens
tctgctgcctg

SEQ ID NO: 6437012 - DNA, 17 bp, Homo sapiens
tctgctgcctgcccgca

SEQ ID NO: 6437013 - DNA, 16 bp, Homo sapiens
tctgctgctctgacct

SEQ ID NO: 6437014 - DNA, 18 bp, Homo sapiens
tctgctgcttctgggcct

SEQ ID NO: 6437015 - DNA, 11 bp, Homo sapiens
tctgctgcttg

SEQ ID NO: 6437016 - DNA, 13 bp, Homo sapiens
tctgctgcttttg

SEQ ID NO: 6437017 - DNA, 17 bp, Homo sapiens
tctgctggaaggggcag

SEQ ID NO: 6437018 - DNA, 20 bp, Homo sapiens
tctgctggaaggggcagcag

SEQ ID NO: 6437019 - DNA, 13 bp, Homo sapiens
tcaggtcaataac

SEQ ID NO: 6437020 - DNA, 18 bp, Homo sapiens
tcaggtcacataaaactt

SEQ ID NO: 6437021 - DNA, 17 bp, Homo sapiens
tcaggtcagagcccagg

SEQ ID NO: 6437022 - DNA, 20 bp, Homo sapiens
tcaggtcagagcccaggaat

SEQ ID NO: 6437023 - DNA, 20 bp, Homo sapiens
tcaggtcagctgggagccag

SEQ ID NO: 6437024 - DNA, 23 bp, Homo sapiens
tcaggtcagggctatggatgggg

SEQ ID NO: 6437025 - DNA, 21 bp, Homo sapiens
tcaggtccagctttactgtgg

SEQ ID NO: 6437026 - DNA, 22 bp, Homo sapiens
tcaggtccaggccagtgggcct

SEQ ID NO: 6437027 - DNA, 18 bp, Homo sapiens
tcaggtcccagttgctgt

SEQ ID NO: 6437028 - DNA, 22 bp, Homo sapiens
tcaggtcccagttgctgtcaca

SEQ ID NO: 6437029 - DNA, 16 bp, Homo sapiens
tcaggtccccatggct

SEQ ID NO: 6437030 - DNA, 17 bp, Homo sapiens
tcaggtcccctggccct

SEQ ID NO: 6437031 - DNA, 23 bp, Homo sapiens
tcaggtcccctggcccttccttc

SEQ ID NO: 6437032 - DNA, 22 bp, Homo sapiens
tcaggtccgtgggccgtatctg

SEQ ID NO: 6437033 - DNA, 23 bp, Homo sapiens
tcaggtccgtgggccgtatctgt

SEQ ID NO: 6437034 - DNA, 14 bp, Homo sapiens
tcaggtcctgctca

SEQ ID NO: 6437035 - DNA, 13 bp, Homo sapiens
tcaggtctgggca

SEQ ID NO: 6437036 - DNA, 15 bp, Homo sapiens
tcaggtctgggcaag

SEQ ID NO: 6437037 - DNA, 15 bp, Homo sapiens
tcaggtctgtaactg

SEQ ID NO: 6437038 - DNA, 18 bp, Homo sapiens
tcaggtctgtaactgccc

SEQ ID NO: 6437039 - DNA, 14 bp, Homo sapiens
tcaggtgaaaatgt

SEQ ID NO: 6437040 - DNA, 14 bp, Homo sapiens
tcaggtgaacactt

SEQ ID NO: 6437041 - DNA, 15 bp, Homo sapiens
tcaggtgacatgtga

SEQ ID NO: 6437042 - DNA, 20 bp, Homo sapiens
tcaggtgacggactcagact

SEQ ID NO: 6437043 - DNA, 22 bp, Homo sapiens
tcaggtgacggactcagactcc

SEQ ID NO: 6437044 - DNA, 21 bp, Homo sapiens
tcaggtgacttctagcagaga

SEQ ID NO: 6437045 - DNA, 22 bp, Homo sapiens
tcaggtgacttctagcagagac

SEQ ID NO: 6437046 - DNA, 16 bp, Homo sapiens
tcaggtgagaagcaga

SEQ ID NO: 6437047 - DNA, 15 bp, Homo sapiens
tcaggtgagccaagg

SEQ ID NO: 6437048 - DNA, 18 bp, Homo sapiens
tcaggtgaggcatcttta

SEQ ID NO: 6437049 - DNA, 16 bp, Homo sapiens
tcaggtgatccacctg

SEQ ID NO: 6437050 - DNA, 20 bp, Homo sapiens
tcaggtgatccgcccacctc

SEQ ID NO: 6437051 - DNA, 21 bp, Homo sapiens
tcaggtgatccgcccacctca

SEQ ID NO: 6437052 - DNA, 20 bp, Homo sapiens
tcaggtgatctgcccgcctc

SEQ ID NO: 6437053 - DNA, 14 bp, Homo sapiens
tcaggtgcagagga

SEQ ID NO: 6437054 - DNA, 15 bp, Homo sapiens
tcaggtgcagaggaa

SEQ ID NO: 6437055 - DNA, 13 bp, Homo sapiens
tcaggtgccactc

SEQ ID NO: 6437056 - DNA, 19 bp, Homo sapiens
tcaggtgccactccctgag

SEQ ID NO: 6437057 - DNA, 20 bp, Homo sapiens
tcaggtgccactccctgagc

SEQ ID NO: 6437058 - DNA, 21 bp, Homo sapiens
tcaggtgcccatccctggaag

SEQ ID NO: 6437059 - DNA, 13 bp, Homo sapiens
tcaggtgcccctc

SEQ ID NO: 6437060 - DNA, 20 bp, Homo sapiens
tcaggtgcccctcttccaaa

SEQ ID NO: 6437061 - DNA, 21 bp, Homo sapiens
tcaggtgcccctcttccaaag

SEQ ID NO: 6437062 - DNA, 23 bp, Homo sapiens
tcaggtgcctcaagagaaggcaa

SEQ ID NO: 6437063 - DNA, 14 bp, Homo sapiens
tcaggtgctcaatg

SEQ ID NO: 6437064 - DNA, 12 bp, Homo sapiens
tcaggtgctgaa

SEQ ID NO: 6437065 - DNA, 13 bp, Homo sapiens
tcaggtgctgcca

SEQ ID NO: 6437066 - DNA, 16 bp, Homo sapiens
tcaggtgctgtccatg

SEQ ID NO: 6437067 - DNA, 18 bp, Homo sapiens
tcaggtgcttttgatgtg

SEQ ID NO: 6437068 - DNA, 15 bp, Homo sapiens
tcaggtggaccctgt

SEQ ID NO: 6437069 - DNA, 20 bp, Homo sapiens
tcaggtggaccctgtaaata

SEQ ID NO: 6437070 - DNA, 23 bp, Homo sapiens
tcaggtggaccctgtaaatacat

SEQ ID NO: 6437071 - DNA, 21 bp, Homo sapiens
tcaggtgggcggtgtgtcttt

SEQ ID NO: 6437072 - DNA, 14 bp, Homo sapiens
tcaggtggggcagc

SEQ ID NO: 6437073 - DNA, 20 bp, Homo sapiens
tcaggtggggcagcttgagg

SEQ ID NO: 6437074 - DNA, 21 bp, Homo sapiens
tcaggtggggcagcttgaggg

SEQ ID NO: 6437075 - DNA, 17 bp, Homo sapiens
tcaggtggggtcactct

SEQ ID NO: 6437076 - DNA, 23 bp, Homo sapiens
tcaggtggggtcactctggcagc

SEQ ID NO: 6437077 - DNA, 22 bp, Homo sapiens
tcaggtggtgtccttcttcctc

SEQ ID NO: 6437078 - DNA, 20 bp, Homo sapiens
tcaggtgtagctgagctgtg

SEQ ID NO: 6437079 - DNA, 22 bp, Homo sapiens
tcaggtgtatagggaattttca

SEQ ID NO: 6437080 - DNA, 16 bp, Homo sapiens
tcaggtgtcaggcccg

SEQ ID NO: 6437081 - DNA, 23 bp, Homo sapiens
tcaggtgtcatggactgttgcca

SEQ ID NO: 6437082 - DNA, 16 bp, Homo sapiens
tcaggtgtgataaaat

SEQ ID NO: 6437083 - DNA, 22 bp, Homo sapiens
tcaggtgttttttatgaagtgc

SEQ ID NO: 6437084 - DNA, 20 bp, Homo sapiens
tcaggttatttattttataa

SEQ ID NO: 6437085 - DNA, 20 bp, Homo sapiens
tcaggttcactcattgacat

SEQ ID NO: 6437086 - DNA, 18 bp, Homo sapiens
tcaggttcagtattatgt

SEQ ID NO: 6437087 - DNA, 13 bp, Homo sapiens
tcaggttccagaa

SEQ ID NO: 6437088 - DNA, 14 bp, Homo sapiens
tcaggttccatccc

SEQ ID NO: 6437089 - DNA, 14 bp, Homo sapiens
tcaggttcctccta

SEQ ID NO: 6437090 - DNA, 16 bp, Homo sapiens
tcaggttcctcctagg

SEQ ID NO: 6437091 - DNA, 16 bp, Homo sapiens
tcaggttctccttgat

SEQ ID NO: 6437092 - DNA, 17 bp, Homo sapiens
tcaggttcttgcctttc

SEQ ID NO: 6437093 - DNA, 17 bp, Homo sapiens
tcaggttgacaggaggt

SEQ ID NO: 6437094 - DNA, 17 bp, Homo sapiens
tcaggttgctggttgct

SEQ ID NO: 6437095 - DNA, 22 bp, Homo sapiens
tcaggttgctggttgctgtgtg

SEQ ID NO: 6437096 - DNA, 23 bp, Homo sapiens
tcaggttgctggttgctgtgtgg

SEQ ID NO: 6437097 - DNA, 20 bp, Homo sapiens
tcaggttgtctgtagagaat

SEQ ID NO: 6437098 - DNA, 15 bp, Homo sapiens
tcaggttgttctgta

SEQ ID NO: 6437099 - DNA, 17 bp, Homo sapiens
tcaggttgttctgtata

SEQ ID NO: 6437100 - DNA, 17 bp, Homo sapiens
tcaggtttaacatttgc

SEQ ID NO: 6437101 - DNA, 19 bp, Homo sapiens
tcaggtttaacatttgcct

SEQ ID NO: 6437102 - DNA, 18 bp, Homo sapiens
tcaggtttgcctgagggc

SEQ ID NO: 6437103 - DNA, 21 bp, Homo sapiens
tcaggtttggtttttttgtac

SEQ ID NO: 6437104 - DNA, 23 bp, Homo sapiens
tcaggtttggtttttttgtacaa

SEQ ID NO: 6437105 - DNA, 14 bp, Homo sapiens
tcaggtttgttttg

SEQ ID NO: 6437106 - DNA, 19 bp, Homo sapiens
tcaggttttcttttaagaa

SEQ ID NO: 6437107 - DNA, 18 bp, Homo sapiens
tcagtaaaattatactgt

SEQ ID NO: 6437108 - DNA, 20 bp, Homo sapiens
tcagtaaaattatactgtgt

SEQ ID NO: 6437109 - DNA, 21 bp, Homo sapiens
tcagtaaaattatactgtgtg

SEQ ID NO: 6437110 - DNA, 17 bp, Homo sapiens
tcagtaaacaccatgaa

SEQ ID NO: 6437111 - DNA, 15 bp, Homo sapiens
tcagtaaacactgtg

SEQ ID NO: 6437112 - DNA, 18 bp, Homo sapiens
tcagtaaacatttgtaaa

SEQ ID NO: 6437113 - DNA, 17 bp, Homo sapiens
tcagtaaacctgtctga

SEQ ID NO: 6437114 - DNA, 21 bp, Homo sapiens
tcagtaaacgggaacatgccc

SEQ ID NO: 6437115 - DNA, 22 bp, Homo sapiens
tcagtaaacgggaacatgcccc

SEQ ID NO: 6437116 - DNA, 17 bp, Homo sapiens
tcagtaaataactggaa

SEQ ID NO: 6437117 - DNA, 14 bp, Homo sapiens
tcagtaaataatga

SEQ ID NO: 6437118 - DNA, 20 bp, Homo sapiens
tcagtaacaaaggtttaaag

SEQ ID NO: 6437119 - DNA, 15 bp, Homo sapiens
tcagtaacagggcct

SEQ ID NO: 6437120 - DNA, 18 bp, Homo sapiens
tcagtaacatttctgttc

SEQ ID NO: 6437121 - DNA, 21 bp, Homo sapiens
tcagtaacatttctgttctca

SEQ ID NO: 6437122 - DNA, 23 bp, Homo sapiens
tcagtaacccccttaaatttaat

SEQ ID NO: 6437123 - DNA, 17 bp, Homo sapiens
tcagtaacttgtttaca

SEQ ID NO: 6437124 - DNA, 14 bp, Homo sapiens
tcagtaagcagcct

SEQ ID NO: 6437125 - DNA, 15 bp, Homo sapiens
tcagtaagctgtgtg

SEQ ID NO: 6437126 - DNA, 22 bp, Homo sapiens
tcagtaagtagcaaccctgtga

SEQ ID NO: 6437127 - DNA, 19 bp, Homo sapiens
tcagtaataaactgtgttt

SEQ ID NO: 6437128 - DNA, 22 bp, Homo sapiens
tcagtaatctgtcgcatttcat

SEQ ID NO: 6437129 - DNA, 13 bp, Homo sapiens
tcagtaatgtctt

SEQ ID NO: 6437130 - DNA, 19 bp, Homo sapiens
tcagtaattaacatatcaa

SEQ ID NO: 6437131 - DNA, 20 bp, Homo sapiens
tcagtaattgtgtcctctct

SEQ ID NO: 6437132 - DNA, 22 bp, Homo sapiens
tcagtacaattctttgttgctt

SEQ ID NO: 6437133 - DNA, 19 bp, Homo sapiens
tcagtacacccaattttaa

SEQ ID NO: 6437134 - DNA, 20 bp, Homo sapiens
tcagtacacttggtgtactg

SEQ ID NO: 6437135 - DNA, 12 bp, Homo sapiens
tcagtacagggc

SEQ ID NO: 6437136 - DNA, 13 bp, Homo sapiens
tcagtacccacct

SEQ ID NO: 6437137 - DNA, 18 bp, Homo sapiens
tcagtacccacctgagct

SEQ ID NO: 6437138 - DNA, 22 bp, Homo sapiens
tcagtacccacctgagctttgg

SEQ ID NO: 6437139 - DNA, 16 bp, Homo sapiens
tcagtaccctctcagc

SEQ ID NO: 6437140 - DNA, 19 bp, Homo sapiens
tcagtaccctctcagctcc

SEQ ID NO: 6437141 - DNA, 14 bp, Homo sapiens
tcagtacctggagg

SEQ ID NO: 6437142 - DNA, 15 bp, Homo sapiens
tcagtacctggagga

SEQ ID NO: 6437143 - DNA, 18 bp, Homo sapiens
tcagtacctggaggagga

SEQ ID NO: 6437144 - DNA, 19 bp, Homo sapiens
tcagtacgatcaagttgtt

SEQ ID NO: 6437145 - DNA, 17 bp, Homo sapiens
tcagtactaaggtgact

SEQ ID NO: 6437146 - DNA, 16 bp, Homo sapiens
tcagtactcaaattca

SEQ ID NO: 6437147 - DNA, 14 bp, Homo sapiens
tcagtactgacttt

SEQ ID NO: 6437148 - DNA, 15 bp, Homo sapiens
tcagtactgactttc

SEQ ID NO: 6437149 - DNA, 17 bp, Homo sapiens
tcagtactgattattct

SEQ ID NO: 6437150 - DNA, 22 bp, Homo sapiens
tcagtactgattattcttctta

SEQ ID NO: 6437151 - DNA, 21 bp, Homo sapiens
tcagtacttcagcaagagaga

SEQ ID NO: 6437152 - DNA, 12 bp, Homo sapiens
tcagtagaaagc

SEQ ID NO: 6437153 - DNA, 17 bp, Homo sapiens
tcagtagaaagctaaag

SEQ ID NO: 6437154 - DNA, 21 bp, Homo sapiens
tcagtagaaagctaaagtgat

SEQ ID NO: 6437155 - DNA, 19 bp, Homo sapiens
tcagtagacctgattttca

SEQ ID NO: 6437156 - DNA, 16 bp, Homo sapiens
tcagtagactgtgatt

SEQ ID NO: 6437157 - DNA, 17 bp, Homo sapiens
tcagtagattgcagaaa

SEQ ID NO: 6437158 - DNA, 16 bp, Homo sapiens
tcagtagatttccttt

SEQ ID NO: 6437159 - DNA, 15 bp, Homo sapiens
tcagtagcaggacct

SEQ ID NO: 6437160 - DNA, 23 bp, Homo sapiens
tcagtagcaggacctgccaagaa

SEQ ID NO: 6437161 - DNA, 20 bp, Homo sapiens
tcagtagcattttaatagtt

SEQ ID NO: 6437162 - DNA, 14 bp, Homo sapiens
tcagtagccagagt

SEQ ID NO: 6437163 - DNA, 13 bp, Homo sapiens
tcagtagctcctt

SEQ ID NO: 6437164 - DNA, 23 bp, Homo sapiens
tcagtagctccttggttttgcct

SEQ ID NO: 6437165 - DNA, 18 bp, Homo sapiens
tcagtaggaacaagctgg

SEQ ID NO: 6437166 - DNA, 21 bp, Homo sapiens
tcagtaggaacaagctggctt

SEQ ID NO: 6437167 - DNA, 23 bp, Homo sapiens
tcagtaggaacaagctggcttct

SEQ ID NO: 6437168 - DNA, 16 bp, Homo sapiens
tcagtaggtccaaggg

SEQ ID NO: 6437169 - DNA, 17 bp, Homo sapiens
tcagtaggtctgaaggc

SEQ ID NO: 6437170 - DNA, 23 bp, Homo sapiens
tcagtaggtgcccagaataagtt

SEQ ID NO: 6437171 - DNA, 18 bp, Homo sapiens
tcagtagtgctaatgcat

SEQ ID NO: 6437172 - DNA, 22 bp, Homo sapiens
tcagtagtgctaatgcattttg

SEQ ID NO: 6437173 - DNA, 19 bp, Homo sapiens
tcagtagtttaaaagttct

SEQ ID NO: 6437174 - DNA, 20 bp, Homo sapiens
tcagtagtttctaagtctgt

SEQ ID NO: 6437175 - DNA, 13 bp, Homo sapiens
tcagtagtttgag

SEQ ID NO: 6437176 - DNA, 21 bp, Homo sapiens
tcagtagtttgagaccagcct

SEQ ID NO: 6437177 - DNA, 15 bp, Homo sapiens
tcagtataaacaaag

SEQ ID NO: 6437178 - DNA, 13 bp, Homo sapiens
tcagtatactgtg

SEQ ID NO: 6437179 - DNA, 12 bp, Homo sapiens
tcagtatagcat

SEQ ID NO: 6437180 - DNA, 15 bp, Homo sapiens
tcagtatattttctg

SEQ ID NO: 6437181 - DNA, 20 bp, Homo sapiens
tcagtatattttctgtattt

SEQ ID NO: 6437182 - DNA, 14 bp, Homo sapiens
tcagtatcatctcc

SEQ ID NO: 6437183 - DNA, 13 bp, Homo sapiens
tcagtatccaggc

SEQ ID NO: 6437184 - DNA, 20 bp, Homo sapiens
tcagtatccatgctcttgac

SEQ ID NO: 6437185 - DNA, 18 bp, Homo sapiens
tcagtatctgtatctctc

SEQ ID NO: 6437186 - DNA, 17 bp, Homo sapiens
tcagtatcttagagttt

SEQ ID NO: 6437187 - DNA, 20 bp, Homo sapiens
tcagtatcttagagtttaca

SEQ ID NO: 6437188 - DNA, 13 bp, Homo sapiens
tcagtatgaatta

SEQ ID NO: 6437189 - DNA, 17 bp, Homo sapiens
tcagtatgaattattca

SEQ ID NO: 6437190 - DNA, 22 bp, Homo sapiens
tcagtatgctttccctgaggaa

SEQ ID NO: 6437191 - DNA, 15 bp, Homo sapiens
tcagtatgtcactct

SEQ ID NO: 6437192 - DNA, 18 bp, Homo sapiens
tcagtatgtgggggcttc

SEQ ID NO: 6437193 - DNA, 22 bp, Homo sapiens
tcagtatgtgggggcttcatct

SEQ ID NO: 6437194 - DNA, 17 bp, Homo sapiens
tcagtatgttgtcaaag

SEQ ID NO: 6437195 - DNA, 17 bp, Homo sapiens
tctgctggagaaagcca

SEQ ID NO: 6437196 - DNA, 13 bp, Homo sapiens
tctgctggaggag

SEQ ID NO: 6437197 - DNA, 21 bp, Homo sapiens
tctgctggaggaggggaagct

SEQ ID NO: 6437198 - DNA, 13 bp, Homo sapiens
tctgctggagttt

SEQ ID NO: 6437199 - DNA, 19 bp, Homo sapiens
tctgctggagtttcatgta

SEQ ID NO: 6437200 - DNA, 23 bp, Homo sapiens
tctgctggcatcaagaggtggga

SEQ ID NO: 6437201 - DNA, 14 bp, Homo sapiens
tctgctggcccagc

SEQ ID NO: 6437202 - DNA, 20 bp, Homo sapiens
tctgctggcccagccaaacc

SEQ ID NO: 6437203 - DNA, 16 bp, Homo sapiens
tctgctggcctggccg

SEQ ID NO: 6437204 - DNA, 14 bp, Homo sapiens
tctgctggctcagg

SEQ ID NO: 6437205 - DNA, 15 bp, Homo sapiens
tctgctggctcagga

SEQ ID NO: 6437206 - DNA, 16 bp, Homo sapiens
tctgctggctcaggag

SEQ ID NO: 6437207 - DNA, 12 bp, Homo sapiens
tctgctggctga

SEQ ID NO: 6437208 - DNA, 12 bp, Homo sapiens
tctgctgggact

SEQ ID NO: 6437209 - DNA, 17 bp, Homo sapiens
tctgctgggctctgcct

SEQ ID NO: 6437210 - DNA, 13 bp, Homo sapiens
tctgctgggctgg

SEQ ID NO: 6437211 - DNA, 17 bp, Homo sapiens
tctgctgggctggcggc

SEQ ID NO: 6437212 - DNA, 19 bp, Homo sapiens
tctgctggggcctgggaca

SEQ ID NO: 6437213 - DNA, 16 bp, Homo sapiens
tctgctgggtttccac

SEQ ID NO: 6437214 - DNA, 20 bp, Homo sapiens
tctgctggtcacttcttctg

SEQ ID NO: 6437215 - DNA, 17 bp, Homo sapiens
tctgctggtctctggct

SEQ ID NO: 6437216 - DNA, 22 bp, Homo sapiens
tctgctgtaagacggccttgga

SEQ ID NO: 6437217 - DNA, 14 bp, Homo sapiens
tctgctgtccagac

SEQ ID NO: 6437218 - DNA, 15 bp, Homo sapiens
tctgctgtccagaca

SEQ ID NO: 6437219 - DNA, 17 bp, Homo sapiens
tctgctgtccagacagc

SEQ ID NO: 6437220 - DNA, 15 bp, Homo sapiens
tctgctgtccccttg

SEQ ID NO: 6437221 - DNA, 22 bp, Homo sapiens
tctgctgtccccttggcaggtc

SEQ ID NO: 6437222 - DNA, 14 bp, Homo sapiens
tctgctgtcctgca

SEQ ID NO: 6437223 - DNA, 22 bp, Homo sapiens
tctgctgtctcatcacataaaa

SEQ ID NO: 6437224 - DNA, 22 bp, Homo sapiens
tctgctgtgggcacaggtcagg

SEQ ID NO: 6437225 - DNA, 23 bp, Homo sapiens
tctgctgtgggcacaggtcaggc

SEQ ID NO: 6437226 - DNA, 15 bp, Homo sapiens
tctgctgtggtctat

SEQ ID NO: 6437227 - DNA, 12 bp, Homo sapiens
tctgctgtgtgg

SEQ ID NO: 6437228 - DNA, 20 bp, Homo sapiens
tctgctgttacgacaaagaa

SEQ ID NO: 6437229 - DNA, 19 bp, Homo sapiens
tctgctgttacgtttgaag

SEQ ID NO: 6437230 - DNA, 16 bp, Homo sapiens
tctgctgttcttcact

SEQ ID NO: 6437231 - DNA, 22 bp, Homo sapiens
tctgctgttcttcacttctggg

SEQ ID NO: 6437232 - DNA, 12 bp, Homo sapiens
tctgctgttgcc

SEQ ID NO: 6437233 - DNA, 15 bp, Homo sapiens
tctgcttaaacaaag

SEQ ID NO: 6437234 - DNA, 17 bp, Homo sapiens
tctgcttaaagcttccc

SEQ ID NO: 6437235 - DNA, 19 bp, Homo sapiens
tctgcttaaagttgtaaca

SEQ ID NO: 6437236 - DNA, 17 bp, Homo sapiens
tctgcttacaattccct

SEQ ID NO: 6437237 - DNA, 23 bp, Homo sapiens
tctgcttacaattccctgctgtc

SEQ ID NO: 6437238 - DNA, 18 bp, Homo sapiens
tctgcttaccaaaacata

SEQ ID NO: 6437239 - DNA, 16 bp, Homo sapiens
tctgcttacccttcac

SEQ ID NO: 6437240 - DNA, 18 bp, Homo sapiens
tctgcttaccgttcaaga

SEQ ID NO: 6437241 - DNA, 17 bp, Homo sapiens
tctgcttagaaataaca

SEQ ID NO: 6437242 - DNA, 17 bp, Homo sapiens
tctgcttaggagagacc

SEQ ID NO: 6437243 - DNA, 18 bp, Homo sapiens
tctgcttaggcccctcag

SEQ ID NO: 6437244 - DNA, 21 bp, Homo sapiens
tctgcttaggcccctcaggac

SEQ ID NO: 6437245 - DNA, 20 bp, Homo sapiens
tctgcttaggtgccaggcat

SEQ ID NO: 6437246 - DNA, 16 bp, Homo sapiens
tctgcttatttcatct

SEQ ID NO: 6437247 - DNA, 14 bp, Homo sapiens
tctgcttcagcctc

SEQ ID NO: 6437248 - DNA, 15 bp, Homo sapiens
tctgcttcagcctcc

SEQ ID NO: 6437249 - DNA, 14 bp, Homo sapiens
tctgcttcagcttg

SEQ ID NO: 6437250 - DNA, 14 bp, Homo sapiens
tctgcttcagtgga

SEQ ID NO: 6437251 - DNA, 12 bp, Homo sapiens
tctgcttcatcc

SEQ ID NO: 6437252 - DNA, 21 bp, Homo sapiens
tctgcttcatccaatgtgaag

SEQ ID NO: 6437253 - DNA, 19 bp, Homo sapiens
tctgcttccacatgtgcca

SEQ ID NO: 6437254 - DNA, 15 bp, Homo sapiens
tctgcttccagttgg

SEQ ID NO: 6437255 - DNA, 21 bp, Homo sapiens
tctgcttccatggcttcctga

SEQ ID NO: 6437256 - DNA, 17 bp, Homo sapiens
tctgcttccgtatttta

SEQ ID NO: 6437257 - DNA, 19 bp, Homo sapiens
tctgcttcctcagccctag

SEQ ID NO: 6437258 - DNA, 12 bp, Homo sapiens
tctgcttctcca

SEQ ID NO: 6437259 - DNA, 14 bp, Homo sapiens
tctgcttctccctg

SEQ ID NO: 6437260 - DNA, 19 bp, Homo sapiens
tctgcttctccctggctga

SEQ ID NO: 6437261 - DNA, 13 bp, Homo sapiens
tctgcttctctca

SEQ ID NO: 6437262 - DNA, 16 bp, Homo sapiens
tctgcttctctcacct

SEQ ID NO: 6437263 - DNA, 15 bp, Homo sapiens
tctgcttctctctct

SEQ ID NO: 6437264 - DNA, 19 bp, Homo sapiens
tctgcttctctctctctca

SEQ ID NO: 6437265 - DNA, 16 bp, Homo sapiens
tctgcttctctcttct

SEQ ID NO: 6437266 - DNA, 19 bp, Homo sapiens
tctgcttctgtccaggaca

SEQ ID NO: 6437267 - DNA, 18 bp, Homo sapiens
tctgcttgacaacatctg

SEQ ID NO: 6437268 - DNA, 11 bp, Homo sapiens
tctgcttgcat

SEQ ID NO: 6437269 - DNA, 11 bp, Homo sapiens
tctgcttgcca

SEQ ID NO: 6437270 - DNA, 13 bp, Homo sapiens
tctgcttgccagc

SEQ ID NO: 6437271 - DNA, 15 bp, Homo sapiens
tctgcttgccagcca

SEQ ID NO: 6437272 - DNA, 18 bp, Homo sapiens
tctgcttgccagccagga

SEQ ID NO: 6437273 - DNA, 12 bp, Homo sapiens
tctgcttgccat

SEQ ID NO: 6437274 - DNA, 14 bp, Homo sapiens
tctgcttgccatcc

SEQ ID NO: 6437275 - DNA, 16 bp, Homo sapiens
tctgcttgccatccct

SEQ ID NO: 6437276 - DNA, 20 bp, Homo sapiens
tctgcttgccatccctccct

SEQ ID NO: 6437277 - DNA, 16 bp, Homo sapiens
tctgcttgctcccaag

SEQ ID NO: 6437278 - DNA, 21 bp, Homo sapiens
tctgcttgctcccaagcccct

SEQ ID NO: 6437279 - DNA, 16 bp, Homo sapiens
tctgcttgcttggccc

SEQ ID NO: 6437280 - DNA, 11 bp, Homo sapiens
tctgcttggag

SEQ ID NO: 6437281 - DNA, 17 bp, Homo sapiens
tctgcttgtcaaaagaa

SEQ ID NO: 6437282 - DNA, 13 bp, Homo sapiens
tctgcttgtcatc

SEQ ID NO: 6437283 - DNA, 14 bp, Homo sapiens
tctgcttgtcatcc

SEQ ID NO: 6437284 - DNA, 16 bp, Homo sapiens
tctgcttgtcattctg

SEQ ID NO: 6437285 - DNA, 19 bp, Homo sapiens
tctgcttgtcattctgcta

SEQ ID NO: 6437286 - DNA, 20 bp, Homo sapiens
tctgctttaaaaatgtctta

SEQ ID NO: 6437287 - DNA, 21 bp, Homo sapiens
tctgctttaaattaaaatttt

SEQ ID NO: 6437288 - DNA, 14 bp, Homo sapiens
tctgctttaattac

SEQ ID NO: 6437289 - DNA, 17 bp, Homo sapiens
tctgctttatcttttca

SEQ ID NO: 6437290 - DNA, 21 bp, Homo sapiens
tctgctttattgcctctgtct

SEQ ID NO: 6437291 - DNA, 16 bp, Homo sapiens
tctgctttccttttct

SEQ ID NO: 6437292 - DNA, 16 bp, Homo sapiens
tctgctttctgcctct

SEQ ID NO: 6437293 - DNA, 13 bp, Homo sapiens
tctgctttctgtt

SEQ ID NO: 6437294 - DNA, 21 bp, Homo sapiens
tctgctttctgttcatctctt

SEQ ID NO: 6437295 - DNA, 20 bp, Homo sapiens
tctgctttcttgccacacag

SEQ ID NO: 6437296 - DNA, 18 bp, Homo sapiens
tctgctttgactgagcag

SEQ ID NO: 6437297 - DNA, 12 bp, Homo sapiens
tctgctttgctg

SEQ ID NO: 6437298 - DNA, 18 bp, Homo sapiens
tctgctttgttgtgtgcc

SEQ ID NO: 6437299 - DNA, 19 bp, Homo sapiens
tctgcttttaaacttggct

SEQ ID NO: 6437300 - DNA, 13 bp, Homo sapiens
tctgcttttacca

SEQ ID NO: 6437301 - DNA, 18 bp, Homo sapiens
tctgcttttcctctgcct

SEQ ID NO: 6437302 - DNA, 21 bp, Homo sapiens
tctgcttttctgccctggctg

SEQ ID NO: 6437303 - DNA, 15 bp, Homo sapiens
tctgctttttctgta

SEQ ID NO: 6437304 - DNA, 15 bp, Homo sapiens
tctggaaaaaaaata

SEQ ID NO: 6437305 - DNA, 14 bp, Homo sapiens
tctggaaaactatt

SEQ ID NO: 6437306 - DNA, 21 bp, Homo sapiens
tctggaaaactattgagcctt

SEQ ID NO: 6437307 - DNA, 19 bp, Homo sapiens
tctggaaaagaactgttta

SEQ ID NO: 6437308 - DNA, 15 bp, Homo sapiens
tctggaaaagcactt

SEQ ID NO: 6437309 - DNA, 15 bp, Homo sapiens
tctggaaaataaaag

SEQ ID NO: 6437310 - DNA, 18 bp, Homo sapiens
tctggaaaatgtgaccca

SEQ ID NO: 6437311 - DNA, 13 bp, Homo sapiens
tctggaaacagct

SEQ ID NO: 6437312 - DNA, 15 bp, Homo sapiens
tctggaaagaggctc

SEQ ID NO: 6437313 - DNA, 16 bp, Homo sapiens
tctggaaaggaaacat

SEQ ID NO: 6437314 - DNA, 13 bp, Homo sapiens
tctggaaaggggg

SEQ ID NO: 6437315 - DNA, 16 bp, Homo sapiens
tctggaaataatatca

SEQ ID NO: 6437316 - DNA, 18 bp, Homo sapiens
tctggaaattcttccctg

SEQ ID NO: 6437317 - DNA, 22 bp, Homo sapiens
tctggaaattcttccctggggg

SEQ ID NO: 6437318 - DNA, 13 bp, Homo sapiens
tctggaaattttg

SEQ ID NO: 6437319 - DNA, 17 bp, Homo sapiens
tctggaaattttgtcca

SEQ ID NO: 6437320 - DNA, 21 bp, Homo sapiens
tctggaacatggactttcttg

SEQ ID NO: 6437321 - DNA, 15 bp, Homo sapiens
tctggaacccagact

SEQ ID NO: 6437322 - DNA, 17 bp, Homo sapiens
tctggaacccagactca

SEQ ID NO: 6437323 - DNA, 18 bp, Homo sapiens
tctggaacctcagcctgg

SEQ ID NO: 6437324 - DNA, 23 bp, Homo sapiens
tctggaacgctctaggcagaaga

SEQ ID NO: 6437325 - DNA, 21 bp, Homo sapiens
tctggaactgctgctgacccc

SEQ ID NO: 6437326 - DNA, 15 bp, Homo sapiens
tctggaagaagcagc

SEQ ID NO: 6437327 - DNA, 15 bp, Homo sapiens
tctggaagacgtggc

SEQ ID NO: 6437328 - DNA, 17 bp, Homo sapiens
tctggaagacgtggctc

SEQ ID NO: 6437329 - DNA, 18 bp, Homo sapiens
tctggaagacgtggctct

SEQ ID NO: 6437330 - DNA, 13 bp, Homo sapiens
tctggaagactgc

SEQ ID NO: 6437331 - DNA, 18 bp, Homo sapiens
tctggaagactgctcccg

SEQ ID NO: 6437332 - DNA, 20 bp, Homo sapiens
tctggaagagaggaatgcct

SEQ ID NO: 6437333 - DNA, 23 bp, Homo sapiens
tctggaagatggggaccagcagc

SEQ ID NO: 6437334 - DNA, 18 bp, Homo sapiens
tctggaagattttcattg

SEQ ID NO: 6437335 - DNA, 18 bp, Homo sapiens
tctggaagcccctgggcc

SEQ ID NO: 6437336 - DNA, 13 bp, Homo sapiens
tctggaagctgag

SEQ ID NO: 6437337 - DNA, 21 bp, Homo sapiens
tctggaagctgagcaggcccg

SEQ ID NO: 6437338 - DNA, 15 bp, Homo sapiens
tctggaaggctggct

SEQ ID NO: 6437339 - DNA, 19 bp, Homo sapiens
tctggaagggagggcttca

SEQ ID NO: 6437340 - DNA, 19 bp, Homo sapiens
tctggaagggcagcatata

SEQ ID NO: 6437341 - DNA, 19 bp, Homo sapiens
tctggaaggggcagccctg

SEQ ID NO: 6437342 - DNA, 21 bp, Homo sapiens
tctggaaggggcagccctgag

SEQ ID NO: 6437343 - DNA, 22 bp, Homo sapiens
tctggaaggggcagccctgagt

SEQ ID NO: 6437344 - DNA, 22 bp, Homo sapiens
tctggaaggtcacgctgaatga

SEQ ID NO: 6437345 - DNA, 17 bp, Homo sapiens
tctggaaggtctgatct

SEQ ID NO: 6437346 - DNA, 20 bp, Homo sapiens
tctggaagtattttcctcca

SEQ ID NO: 6437347 - DNA, 18 bp, Homo sapiens
tctggaagtgactttggc

SEQ ID NO: 6437348 - DNA, 14 bp, Homo sapiens
tctggaatacatga

SEQ ID NO: 6437349 - DNA, 19 bp, Homo sapiens
tctggaatagttactttac

SEQ ID NO: 6437350 - DNA, 20 bp, Homo sapiens
tctggaatatgcaacattgt

SEQ ID NO: 6437351 - DNA, 19 bp, Homo sapiens
tctggaatattgtgattct

SEQ ID NO: 6437352 - DNA, 17 bp, Homo sapiens
tctggaatcccagctcc

SEQ ID NO: 6437353 - DNA, 22 bp, Homo sapiens
tctggaatcccagctccgctgc

SEQ ID NO: 6437354 - DNA, 19 bp, Homo sapiens
tctggaatctggagaccag

SEQ ID NO: 6437355 - DNA, 15 bp, Homo sapiens
tctggaatgcagtgg

SEQ ID NO: 6437356 - DNA, 16 bp, Homo sapiens
tctggaatgcttctgc

SEQ ID NO: 6437357 - DNA, 18 bp, Homo sapiens
tctggaatgtaatcaatg

SEQ ID NO: 6437358 - DNA, 12 bp, Homo sapiens
tctggacaagcc

SEQ ID NO: 6437359 - DNA, 14 bp, Homo sapiens
tctggacacttctt

SEQ ID NO: 6437360 - DNA, 14 bp, Homo sapiens
tctggacacttgct

SEQ ID NO: 6437361 - DNA, 16 bp, Homo sapiens
tctggacagcagaagc

SEQ ID NO: 6437362 - DNA, 20 bp, Homo sapiens
tctggacagcagaagcctcc

SEQ ID NO: 6437363 - DNA, 13 bp, Homo sapiens
tctggacagccag

SEQ ID NO: 6437364 - DNA, 19 bp, Homo sapiens
tctggacagccccaccctg

SEQ ID NO: 6437365 - DNA, 20 bp, Homo sapiens
tctggacagccccaccctgg

SEQ ID NO: 6437366 - DNA, 14 bp, Homo sapiens
tctggacaggcatg

SEQ ID NO: 6437367 - DNA, 17 bp, Homo sapiens
tctggacagtcagctct

SEQ ID NO: 6437368 - DNA, 24 bp, Homo sapiens
tctggacattctctttgataacaa

SEQ ID NO: 6437369 - DNA, 23 bp, Homo sapiens
tctggaccaaccctgtttcctga

SEQ ID NO: 6437370 - DNA, 17 bp, Homo sapiens
tctggaccccatctgtg

SEQ ID NO: 6437371 - DNA, 18 bp, Homo sapiens
tctggacccttataaaat

SEQ ID NO: 6437372 - DNA, 17 bp, Homo sapiens
tctggacctcaggaggg

SEQ ID NO: 6437373 - DNA, 22 bp, Homo sapiens
tctggacctcaggagggcaggc

SEQ ID NO: 6437374 - DNA, 17 bp, Homo sapiens
tctggacctcagtttcc

SEQ ID NO: 6437375 - DNA, 18 bp, Homo sapiens
tcagtatgttttacactg

SEQ ID NO: 6437376 - DNA, 13 bp, Homo sapiens
tcagtattaaact

SEQ ID NO: 6437377 - DNA, 23 bp, Homo sapiens
tcagtattaaactctcctttgat

SEQ ID NO: 6437378 - DNA, 16 bp, Homo sapiens
tcagtattaatactaa

SEQ ID NO: 6437379 - DNA, 17 bp, Homo sapiens
tcagtattactttctgc

SEQ ID NO: 6437380 - DNA, 14 bp, Homo sapiens
tcagtattatatgt

SEQ ID NO: 6437381 - DNA, 15 bp, Homo sapiens
tcagtattatatgta

SEQ ID NO: 6437382 - DNA, 20 bp, Homo sapiens
tcagtattatctaaatgaat

SEQ ID NO: 6437383 - DNA, 17 bp, Homo sapiens
tcagtattatgtagttg

SEQ ID NO: 6437384 - DNA, 14 bp, Homo sapiens
tcagtattgaagca

SEQ ID NO: 6437385 - DNA, 15 bp, Homo sapiens
tcagtattgaagcat

SEQ ID NO: 6437386 - DNA, 16 bp, Homo sapiens
tcagtattgaagcatt

SEQ ID NO: 6437387 - DNA, 17 bp, Homo sapiens
tcagtattgaagcattt

SEQ ID NO: 6437388 - DNA, 19 bp, Homo sapiens
tcagtattgaagcatttta

SEQ ID NO: 6437389 - DNA, 23 bp, Homo sapiens
tcagtattgaagcattttataaa

SEQ ID NO: 6437390 - DNA, 15 bp, Homo sapiens
tcagtattgacactg

SEQ ID NO: 6437391 - DNA, 15 bp, Homo sapiens
tcagtattgagacac

SEQ ID NO: 6437392 - DNA, 21 bp, Homo sapiens
tcagtattgagacactgtcaa

SEQ ID NO: 6437393 - DNA, 12 bp, Homo sapiens
tcagtattgtgt

SEQ ID NO: 6437394 - DNA, 17 bp, Homo sapiens
tcagtattgtgtaaagg

SEQ ID NO: 6437395 - DNA, 14 bp, Homo sapiens
tcagtattgttttg

SEQ ID NO: 6437396 - DNA, 17 bp, Homo sapiens
tcagtatttaatgaaac

SEQ ID NO: 6437397 - DNA, 15 bp, Homo sapiens
tcagtatttatgtaa

SEQ ID NO: 6437398 - DNA, 19 bp, Homo sapiens
tcagtatttcaactgctgt

SEQ ID NO: 6437399 - DNA, 22 bp, Homo sapiens
tcagtatttcaactgctgtaaa

SEQ ID NO: 6437400 - DNA, 15 bp, Homo sapiens
tcagtatttccttcc

SEQ ID NO: 6437401 - DNA, 23 bp, Homo sapiens
tcagtattttccagccttatgtg

SEQ ID NO: 6437402 - DNA, 16 bp, Homo sapiens
tcagtattttccctgc

SEQ ID NO: 6437403 - DNA, 19 bp, Homo sapiens
tcagtattttggagaaatt

SEQ ID NO: 6437404 - DNA, 20 bp, Homo sapiens
tcagtattttggagaaatta

SEQ ID NO: 6437405 - DNA, 13 bp, Homo sapiens
tcagtatttttta

SEQ ID NO: 6437406 - DNA, 15 bp, Homo sapiens
tcagtattttttact

SEQ ID NO: 6437407 - DNA, 19 bp, Homo sapiens
tcagtatttttttttaatt

SEQ ID NO: 6437408 - DNA, 18 bp, Homo sapiens
tcagtcacaaaccagcct

SEQ ID NO: 6437409 - DNA, 19 bp, Homo sapiens
tcagtcacaaaccagcctg

SEQ ID NO: 6437410 - DNA, 15 bp, Homo sapiens
tcagtcacagccacc

SEQ ID NO: 6437411 - DNA, 13 bp, Homo sapiens
tcagtcaccccca

SEQ ID NO: 6437412 - DNA, 17 bp, Homo sapiens
tcagtcagaaaacttta

SEQ ID NO: 6437413 - DNA, 13 bp, Homo sapiens
tcagtcagagaac

SEQ ID NO: 6437414 - DNA, 19 bp, Homo sapiens
tcagtcagtgcaaatgtca

SEQ ID NO: 6437415 - DNA, 13 bp, Homo sapiens
tcagtcagttccc

SEQ ID NO: 6437416 - DNA, 14 bp, Homo sapiens
tcagtcatattctt

SEQ ID NO: 6437417 - DNA, 12 bp, Homo sapiens
tcagtcatattt

SEQ ID NO: 6437418 - DNA, 15 bp, Homo sapiens
tcagtcatcatgggt

SEQ ID NO: 6437419 - DNA, 14 bp, Homo sapiens
tcagtcatctccaa

SEQ ID NO: 6437420 - DNA, 17 bp, Homo sapiens
tcagtcatgaggaaaga

SEQ ID NO: 6437421 - DNA, 14 bp, Homo sapiens
tcagtcatgcataa

SEQ ID NO: 6437422 - DNA, 16 bp, Homo sapiens
tcagtcatgcataaat

SEQ ID NO: 6437423 - DNA, 21 bp, Homo sapiens
tcagtcattagactcctcctc

SEQ ID NO: 6437424 - DNA, 15 bp, Homo sapiens
tcagtcattttgggt

SEQ ID NO: 6437425 - DNA, 21 bp, Homo sapiens
tcagtccacccccattgtgaa

SEQ ID NO: 6437426 - DNA, 12 bp, Homo sapiens
tcagtccactgt

SEQ ID NO: 6437427 - DNA, 18 bp, Homo sapiens
tcagtccagcagtttcca

SEQ ID NO: 6437428 - DNA, 15 bp, Homo sapiens
tcagtccatagcaga

SEQ ID NO: 6437429 - DNA, 14 bp, Homo sapiens
tcagtccatttata

SEQ ID NO: 6437430 - DNA, 14 bp, Homo sapiens
tcagtcccaaagcg

SEQ ID NO: 6437431 - DNA, 18 bp, Homo sapiens
tcagtccccgtgaaggag

SEQ ID NO: 6437432 - DNA, 12 bp, Homo sapiens
tcagtcccctcc

SEQ ID NO: 6437433 - DNA, 15 bp, Homo sapiens
tcagtcccctcccat

SEQ ID NO: 6437434 - DNA, 14 bp, Homo sapiens
tcagtcccctctct

SEQ ID NO: 6437435 - DNA, 18 bp, Homo sapiens
tcagtccctatgtatttg

SEQ ID NO: 6437436 - DNA, 18 bp, Homo sapiens
tcagtccctccctcctgg

SEQ ID NO: 6437437 - DNA, 21 bp, Homo sapiens
tcagtccctccctcctggctc

SEQ ID NO: 6437438 - DNA, 22 bp, Homo sapiens
tcagtccctccctcctggctca

SEQ ID NO: 6437439 - DNA, 18 bp, Homo sapiens
tcagtcccttccccatgc

SEQ ID NO: 6437440 - DNA, 22 bp, Homo sapiens
tcagtccgcctggccggctcca

SEQ ID NO: 6437441 - DNA, 17 bp, Homo sapiens
tcagtcctaatttgaac

SEQ ID NO: 6437442 - DNA, 18 bp, Homo sapiens
tcagtcctcctctccttt

SEQ ID NO: 6437443 - DNA, 12 bp, Homo sapiens
tcagtcctggaa

SEQ ID NO: 6437444 - DNA, 12 bp, Homo sapiens
tcagtcctggtc

SEQ ID NO: 6437445 - DNA, 22 bp, Homo sapiens
tcagtcctgtagttttatttta

SEQ ID NO: 6437446 - DNA, 14 bp, Homo sapiens
tcagtcctttgtct

SEQ ID NO: 6437447 - DNA, 15 bp, Homo sapiens
tcagtcctttgtctt

SEQ ID NO: 6437448 - DNA, 23 bp, Homo sapiens
tcagtcgcctttcagcaggcagc

SEQ ID NO: 6437449 - DNA, 20 bp, Homo sapiens
tcagtcggggcaggccaggg

SEQ ID NO: 6437450 - DNA, 19 bp, Homo sapiens
tcagtcgttgtgctttttt

SEQ ID NO: 6437451 - DNA, 19 bp, Homo sapiens
tcagtcgttttagtgtctg

SEQ ID NO: 6437452 - DNA, 23 bp, Homo sapiens
tcagtcgttttagtgtctgacct

SEQ ID NO: 6437453 - DNA, 20 bp, Homo sapiens
tcagtctacccctctccttt

SEQ ID NO: 6437454 - DNA, 17 bp, Homo sapiens
tcagtctagtgaagatg

SEQ ID NO: 6437455 - DNA, 19 bp, Homo sapiens
tcagtctagtgaagatgtt

SEQ ID NO: 6437456 - DNA, 16 bp, Homo sapiens
tcagtctatccacaga

SEQ ID NO: 6437457 - DNA, 15 bp, Homo sapiens
tcagtctatgctgtg

SEQ ID NO: 6437458 - DNA, 19 bp, Homo sapiens
tcagtctatgctgtgtgca

SEQ ID NO: 6437459 - DNA, 21 bp, Homo sapiens
tcagtctatgctgtgtgcaga

SEQ ID NO: 6437460 - DNA, 16 bp, Homo sapiens
tcagtctcaaataata

SEQ ID NO: 6437461 - DNA, 17 bp, Homo sapiens
tcagtctcaaataataa

SEQ ID NO: 6437462 - DNA, 18 bp, Homo sapiens
tcagtctcacagagaagc

SEQ ID NO: 6437463 - DNA, 21 bp, Homo sapiens
tcagtctcacctgccggctct

SEQ ID NO: 6437464 - DNA, 23 bp, Homo sapiens
tcagtctcacctgccggctctgg

SEQ ID NO: 6437465 - DNA, 20 bp, Homo sapiens
tcagtctcccttctcccatg

SEQ ID NO: 6437466 - DNA, 15 bp, Homo sapiens
tcagtctctatacca

SEQ ID NO: 6437467 - DNA, 20 bp, Homo sapiens
tcagtctctataccaataaa

SEQ ID NO: 6437468 - DNA, 20 bp, Homo sapiens
tcagtctctcaaagacccca

SEQ ID NO: 6437469 - DNA, 22 bp, Homo sapiens
tcagtctctcaaagaccccatg

SEQ ID NO: 6437470 - DNA, 15 bp, Homo sapiens
tcagtctctgagcag

SEQ ID NO: 6437471 - DNA, 13 bp, Homo sapiens
tcagtctctgcag

SEQ ID NO: 6437472 - DNA, 12 bp, Homo sapiens
tcagtctctttc

SEQ ID NO: 6437473 - DNA, 21 bp, Homo sapiens
tcagtctgaatggcatggaga

SEQ ID NO: 6437474 - DNA, 21 bp, Homo sapiens
tcagtctgattcccaagctct

SEQ ID NO: 6437475 - DNA, 22 bp, Homo sapiens
tcagtctgattcccaagctctg

SEQ ID NO: 6437476 - DNA, 24 bp, Homo sapiens
tcagtctgattcccaagctctgct

SEQ ID NO: 6437477 - DNA, 20 bp, Homo sapiens
tcagtctgcacttaaatatc

SEQ ID NO: 6437478 - DNA, 14 bp, Homo sapiens
tcagtctgctccac

SEQ ID NO: 6437479 - DNA, 17 bp, Homo sapiens
tcagtctgctccaccaa

SEQ ID NO: 6437480 - DNA, 15 bp, Homo sapiens
tcagtctgctttctc

SEQ ID NO: 6437481 - DNA, 16 bp, Homo sapiens
tcagtctggtgggagg

SEQ ID NO: 6437482 - DNA, 23 bp, Homo sapiens
tcagtcttcacttgcactggggg

SEQ ID NO: 6437483 - DNA, 22 bp, Homo sapiens
tcagtcttccttgtggaatgct

SEQ ID NO: 6437484 - DNA, 13 bp, Homo sapiens
tcagtcttctgga

SEQ ID NO: 6437485 - DNA, 12 bp, Homo sapiens
tcagtcttgcct

SEQ ID NO: 6437486 - DNA, 21 bp, Homo sapiens
tcagtctttgtcaatgctcta

SEQ ID NO: 6437487 - DNA, 12 bp, Homo sapiens
tcagtcttttcc

SEQ ID NO: 6437488 - DNA, 22 bp, Homo sapiens
tcagtgaaaagattttatttat

SEQ ID NO: 6437489 - DNA, 16 bp, Homo sapiens
tcagtgaaattttcag

SEQ ID NO: 6437490 - DNA, 22 bp, Homo sapiens
tcagtgaactaatttggttttt

SEQ ID NO: 6437491 - DNA, 23 bp, Homo sapiens
tcagtgaactaatttggttttta

SEQ ID NO: 6437492 - DNA, 14 bp, Homo sapiens
tcagtgaaggccca

SEQ ID NO: 6437493 - DNA, 16 bp, Homo sapiens
tcagtgaagtctagaa

SEQ ID NO: 6437494 - DNA, 15 bp, Homo sapiens
tcagtgacagagttc

SEQ ID NO: 6437495 - DNA, 15 bp, Homo sapiens
tcagtgacataaaaa

SEQ ID NO: 6437496 - DNA, 23 bp, Homo sapiens
tcagtgacatcaaagcctggcct

SEQ ID NO: 6437497 - DNA, 14 bp, Homo sapiens
tcagtgacatctga

SEQ ID NO: 6437498 - DNA, 20 bp, Homo sapiens
tcagtgactgaattctgcct

SEQ ID NO: 6437499 - DNA, 15 bp, Homo sapiens
tcagtgacttctgaa

SEQ ID NO: 6437500 - DNA, 16 bp, Homo sapiens
tcagtgacttctggct

SEQ ID NO: 6437501 - DNA, 15 bp, Homo sapiens
tcagtgagcccctcc

SEQ ID NO: 6437502 - DNA, 17 bp, Homo sapiens
tcagtgagcccctcccc

SEQ ID NO: 6437503 - DNA, 21 bp, Homo sapiens
tcagtgagcctcctgtgcctg

SEQ ID NO: 6437504 - DNA, 16 bp, Homo sapiens
tcagtgagctggggcc

SEQ ID NO: 6437505 - DNA, 13 bp, Homo sapiens
tcagtgaggactc

SEQ ID NO: 6437506 - DNA, 21 bp, Homo sapiens
tcagtgaggagggatgtgggt

SEQ ID NO: 6437507 - DNA, 14 bp, Homo sapiens
tcagtgataaagcg

SEQ ID NO: 6437508 - DNA, 17 bp, Homo sapiens
tcagtgataatgttcat

SEQ ID NO: 6437509 - DNA, 19 bp, Homo sapiens
tcagtgataatgttcattt

SEQ ID NO: 6437510 - DNA, 23 bp, Homo sapiens
tcagtgataattggtttgactgt

SEQ ID NO: 6437511 - DNA, 19 bp, Homo sapiens
tcagtgatacgtacagcca

SEQ ID NO: 6437512 - DNA, 16 bp, Homo sapiens
tcagtgatctatgttt

SEQ ID NO: 6437513 - DNA, 19 bp, Homo sapiens
tcagtgatggaatatcatg

SEQ ID NO: 6437514 - DNA, 12 bp, Homo sapiens
tcagtgatggga

SEQ ID NO: 6437515 - DNA, 14 bp, Homo sapiens
tcagtgatgggagt

SEQ ID NO: 6437516 - DNA, 15 bp, Homo sapiens
tcagtgatgtgccta

SEQ ID NO: 6437517 - DNA, 19 bp, Homo sapiens
tcagtgattcgcttttggt

SEQ ID NO: 6437518 - DNA, 16 bp, Homo sapiens
tcagtgatttcctaca

SEQ ID NO: 6437519 - DNA, 17 bp, Homo sapiens
tcagtgattttcaaacc

SEQ ID NO: 6437520 - DNA, 22 bp, Homo sapiens
tcagtgattttgtatatgaaaa

SEQ ID NO: 6437521 - DNA, 14 bp, Homo sapiens
tcagtgcaaaatgt

SEQ ID NO: 6437522 - DNA, 16 bp, Homo sapiens
tcagtgcaaaatgtct

SEQ ID NO: 6437523 - DNA, 17 bp, Homo sapiens
tcagtgcaaaatgtctt

SEQ ID NO: 6437524 - DNA, 19 bp, Homo sapiens
tcagtgcaaattgtatctt

SEQ ID NO: 6437525 - DNA, 22 bp, Homo sapiens
tcagtgcaaattgtatcttatt

SEQ ID NO: 6437526 - DNA, 17 bp, Homo sapiens
tcagtgcaacctctgct

SEQ ID NO: 6437527 - DNA, 15 bp, Homo sapiens
tcagtgcaagagact

SEQ ID NO: 6437528 - DNA, 19 bp, Homo sapiens
tcagtgcacacggatgcac

SEQ ID NO: 6437529 - DNA, 16 bp, Homo sapiens
tcagtgcacctgcctc

SEQ ID NO: 6437530 - DNA, 21 bp, Homo sapiens
tcagtgcactaaccccagctg

SEQ ID NO: 6437531 - DNA, 23 bp, Homo sapiens
tcagtgcactaaccccagctgcc

SEQ ID NO: 6437532 - DNA, 19 bp, Homo sapiens
tcagtgcagggacagcctg

SEQ ID NO: 6437533 - DNA, 20 bp, Homo sapiens
tcagtgcagggacagcctgc

SEQ ID NO: 6437534 - DNA, 21 bp, Homo sapiens
tcagtgcagtgatacatgtac

SEQ ID NO: 6437535 - DNA, 14 bp, Homo sapiens
tcagtgcagtttct

SEQ ID NO: 6437536 - DNA, 14 bp, Homo sapiens
tcagtgcatttcaa

SEQ ID NO: 6437537 - DNA, 14 bp, Homo sapiens
tcagtgcatttgtg

SEQ ID NO: 6437538 - DNA, 21 bp, Homo sapiens
tcagtgccaagtctcaggagg

SEQ ID NO: 6437539 - DNA, 15 bp, Homo sapiens
tcagtgccacttgac

SEQ ID NO: 6437540 - DNA, 21 bp, Homo sapiens
tcagtgccacttgacattcct

SEQ ID NO: 6437541 - DNA, 9 bp, Homo sapiens
tcagtgccc

SEQ ID NO: 6437542 - DNA, 20 bp, Homo sapiens
tcagtgccctccaggataga

SEQ ID NO: 6437543 - DNA, 16 bp, Homo sapiens
tcagtgccgccgcctc

SEQ ID NO: 6437544 - DNA, 20 bp, Homo sapiens
tcagtgccgccgcctcgccc

SEQ ID NO: 6437545 - DNA, 14 bp, Homo sapiens
tcagtgcctccaca

SEQ ID NO: 6437546 - DNA, 16 bp, Homo sapiens
tcagtgcctcctggcc

SEQ ID NO: 6437547 - DNA, 20 bp, Homo sapiens
tcagtgcctggtgttctgaa

SEQ ID NO: 6437548 - DNA, 12 bp, Homo sapiens
tcagtgccttat

SEQ ID NO: 6437549 - DNA, 14 bp, Homo sapiens
tcagtgccttcctc

SEQ ID NO: 6437550 - DNA, 18 bp, Homo sapiens
tcagtgccttcctctctc

SEQ ID NO: 6437551 - DNA, 19 bp, Homo sapiens
tcagtgccttctctcagct

SEQ ID NO: 6437552 - DNA, 22 bp, Homo sapiens
tcagtgccttctctcagctccc

SEQ ID NO: 6437553 - DNA, 23 bp, Homo sapiens
tcagtgccttttggtttcacctt

SEQ ID NO: 6437554 - DNA, 19 bp, Homo sapiens
tctggacctccatccctgc

SEQ ID NO: 6437555 - DNA, 20 bp, Homo sapiens
tctggacctcggtgatgcct

SEQ ID NO: 6437556 - DNA, 17 bp, Homo sapiens
tctggacctctcttgtg

SEQ ID NO: 6437557 - DNA, 13 bp, Homo sapiens
tctggacctgacc

SEQ ID NO: 6437558 - DNA, 20 bp, Homo sapiens
tctggaccttgttgttgtta

SEQ ID NO: 6437559 - DNA, 19 bp, Homo sapiens
tctggacgccgagggcagc

SEQ ID NO: 6437560 - DNA, 23 bp, Homo sapiens
tctggacggcaggctcactgcca

SEQ ID NO: 6437561 - DNA, 18 bp, Homo sapiens
tctggacgtgaaatactt

SEQ ID NO: 6437562 - DNA, 15 bp, Homo sapiens
tctggactctaaaga

SEQ ID NO: 6437563 - DNA, 20 bp, Homo sapiens
tctggactctaaagaccaaa

SEQ ID NO: 6437564 - DNA, 14 bp, Homo sapiens
tctggactctgccc

SEQ ID NO: 6437565 - DNA, 19 bp, Homo sapiens
tctggactctgccccaatc

SEQ ID NO: 6437566 - DNA, 20 bp, Homo sapiens
tctggactctgccccaatcg

SEQ ID NO: 6437567 - DNA, 14 bp, Homo sapiens
tctggactgacagc

SEQ ID NO: 6437568 - DNA, 19 bp, Homo sapiens
tctggactgccccagaaaa

SEQ ID NO: 6437569 - DNA, 22 bp, Homo sapiens
tctggactggaaagcacaagac

SEQ ID NO: 6437570 - DNA, 15 bp, Homo sapiens
tctggactgttctgt

SEQ ID NO: 6437571 - DNA, 19 bp, Homo sapiens
tctggacttggcaacagaa

SEQ ID NO: 6437572 - DNA, 22 bp, Homo sapiens
tctggagaagcagtgagccgca

SEQ ID NO: 6437573 - DNA, 23 bp, Homo sapiens
tctggagaagctcccaggaacaa

SEQ ID NO: 6437574 - DNA, 16 bp, Homo sapiens
tctggagaaggcctgg

SEQ ID NO: 6437575 - DNA, 17 bp, Homo sapiens
tctggagaaggcctgga

SEQ ID NO: 6437576 - DNA, 11 bp, Homo sapiens
tctggagaagt

SEQ ID NO: 6437577 - DNA, 16 bp, Homo sapiens
tctggagaatcttaca

SEQ ID NO: 6437578 - DNA, 12 bp, Homo sapiens
tctggagacaga

SEQ ID NO: 6437579 - DNA, 15 bp, Homo sapiens
tctggagacagcccc

SEQ ID NO: 6437580 - DNA, 16 bp, Homo sapiens
tctggagaccaggact

SEQ ID NO: 6437581 - DNA, 19 bp, Homo sapiens
tctggagaccagggagcct

SEQ ID NO: 6437582 - DNA, 14 bp, Homo sapiens
tctggagagcccag

SEQ ID NO: 6437583 - DNA, 23 bp, Homo sapiens
tctggagagctagaacctggagg

SEQ ID NO: 6437584 - DNA, 20 bp, Homo sapiens
tctggagaggttataggtca

SEQ ID NO: 6437585 - DNA, 22 bp, Homo sapiens
tctggagaggttataggtcact

SEQ ID NO: 6437586 - DNA, 16 bp, Homo sapiens
tctggagatggaagct

SEQ ID NO: 6437587 - DNA, 21 bp, Homo sapiens
tctggagcaacctactgtcta

SEQ ID NO: 6437588 - DNA, 12 bp, Homo sapiens
tctggagcaaga

SEQ ID NO: 6437589 - DNA, 16 bp, Homo sapiens
tctggagcaagagaga

SEQ ID NO: 6437590 - DNA, 16 bp, Homo sapiens
tctggagcaagccctg

SEQ ID NO: 6437591 - DNA, 16 bp, Homo sapiens
tctggagccaaggcag

SEQ ID NO: 6437592 - DNA, 17 bp, Homo sapiens
tctggagccaaggcaga

SEQ ID NO: 6437593 - DNA, 23 bp, Homo sapiens
tctggagccacctgtcccacctc

SEQ ID NO: 6437594 - DNA, 12 bp, Homo sapiens
tctggagcccac

SEQ ID NO: 6437595 - DNA, 22 bp, Homo sapiens
tctggagcccactgtacttgct

SEQ ID NO: 6437596 - DNA, 13 bp, Homo sapiens
tctggagccccta

SEQ ID NO: 6437597 - DNA, 16 bp, Homo sapiens
tctggagccctaaccc

SEQ ID NO: 6437598 - DNA, 23 bp, Homo sapiens
tctggagccctaaccccttccag

SEQ ID NO: 6437599 - DNA, 17 bp, Homo sapiens
tctggagcggctgctcg

SEQ ID NO: 6437600 - DNA, 14 bp, Homo sapiens
tctggagctgagct

SEQ ID NO: 6437601 - DNA, 14 bp, Homo sapiens
tctggagctgctgt

SEQ ID NO: 6437602 - DNA, 15 bp, Homo sapiens
tctggagctgctgtt

SEQ ID NO: 6437603 - DNA, 19 bp, Homo sapiens
tctggagctgctgttccaa

SEQ ID NO: 6437604 - DNA, 20 bp, Homo sapiens
tctggagctgggagacaaag

SEQ ID NO: 6437605 - DNA, 22 bp, Homo sapiens
tctggaggaagttctccagctt

SEQ ID NO: 6437606 - DNA, 17 bp, Homo sapiens
tctggaggacctgcccg

SEQ ID NO: 6437607 - DNA, 13 bp, Homo sapiens
tctggaggaggag

SEQ ID NO: 6437608 - DNA, 19 bp, Homo sapiens
tctggaggcctctggccct

SEQ ID NO: 6437609 - DNA, 20 bp, Homo sapiens
tctggaggcctctggccctc

SEQ ID NO: 6437610 - DNA, 17 bp, Homo sapiens
tctggaggccttccagc

SEQ ID NO: 6437611 - DNA, 22 bp, Homo sapiens
tctggaggccttccagctgctg

SEQ ID NO: 6437612 - DNA, 21 bp, Homo sapiens
tctggagggctatggcctccc

SEQ ID NO: 6437613 - DNA, 15 bp, Homo sapiens
tctggaggggagctc

SEQ ID NO: 6437614 - DNA, 13 bp, Homo sapiens
tctggaggggcag

SEQ ID NO: 6437615 - DNA, 20 bp, Homo sapiens
tctggaggtactgagacagg

SEQ ID NO: 6437616 - DNA, 18 bp, Homo sapiens
tctggaggtgttgtgggg

SEQ ID NO: 6437617 - DNA, 17 bp, Homo sapiens
tctggagtattctataa

SEQ ID NO: 6437618 - DNA, 15 bp, Homo sapiens
tctggagtcccaccc

SEQ ID NO: 6437619 - DNA, 20 bp, Homo sapiens
tctggagtgagaggccccca

SEQ ID NO: 6437620 - DNA, 22 bp, Homo sapiens
tctggagtgagtctgtcataat

SEQ ID NO: 6437621 - DNA, 17 bp, Homo sapiens
tctggagtgattctaga

SEQ ID NO: 6437622 - DNA, 13 bp, Homo sapiens
tctggagtgggca

SEQ ID NO: 6437623 - DNA, 18 bp, Homo sapiens
tctggagtggtaacagct

SEQ ID NO: 6437624 - DNA, 21 bp, Homo sapiens
tctggagtggtaacagctctc

SEQ ID NO: 6437625 - DNA, 12 bp, Homo sapiens
tctggagtgtgt

SEQ ID NO: 6437626 - DNA, 15 bp, Homo sapiens
tctggagtttcatgt

SEQ ID NO: 6437627 - DNA, 16 bp, Homo sapiens
tctggagtttctctaa

SEQ ID NO: 6437628 - DNA, 22 bp, Homo sapiens
tctggagtttttgtttggagag

SEQ ID NO: 6437629 - DNA, 24 bp, Homo sapiens
tctggagtttttgtttggagagca

SEQ ID NO: 6437630 - DNA, 22 bp, Homo sapiens
tctggataccagatatttgaat

SEQ ID NO: 6437631 - DNA, 20 bp, Homo sapiens
tctggataggagcctgctgg

SEQ ID NO: 6437632 - DNA, 15 bp, Homo sapiens
tctggatccatgggg

SEQ ID NO: 6437633 - DNA, 18 bp, Homo sapiens
tctggatccttcccaagg

SEQ ID NO: 6437634 - DNA, 18 bp, Homo sapiens
tctggatctgaccctccc

SEQ ID NO: 6437635 - DNA, 13 bp, Homo sapiens
tctggatgcacac

SEQ ID NO: 6437636 - DNA, 18 bp, Homo sapiens
tctggatggcaccagagg

SEQ ID NO: 6437637 - DNA, 23 bp, Homo sapiens
tctggatggccgggctgctgctg

SEQ ID NO: 6437638 - DNA, 21 bp, Homo sapiens
tctggatggtgtgccttccag

SEQ ID NO: 6437639 - DNA, 23 bp, Homo sapiens
tctggattatgttatacaaggca

SEQ ID NO: 6437640 - DNA, 13 bp, Homo sapiens
tctggattcaaat

SEQ ID NO: 6437641 - DNA, 17 bp, Homo sapiens
tctggattcacagacca

SEQ ID NO: 6437642 - DNA, 13 bp, Homo sapiens
tctggattcagcc

SEQ ID NO: 6437643 - DNA, 17 bp, Homo sapiens
tctggattcagccttct

SEQ ID NO: 6437644 - DNA, 17 bp, Homo sapiens
tctggattcccaggatg

SEQ ID NO: 6437645 - DNA, 21 bp, Homo sapiens
tctggattcccaggatgagca

SEQ ID NO: 6437646 - DNA, 20 bp, Homo sapiens
tctggattccccatctcagg

SEQ ID NO: 6437647 - DNA, 14 bp, Homo sapiens
tctggattcccttt

SEQ ID NO: 6437648 - DNA, 16 bp, Homo sapiens
tctggattctgaatct

SEQ ID NO: 6437649 - DNA, 16 bp, Homo sapiens
tctggattcttggccc

SEQ ID NO: 6437650 - DNA, 14 bp, Homo sapiens
tctggattgtggga

SEQ ID NO: 6437651 - DNA, 23 bp, Homo sapiens
tctggattgtggttccatgcagc

SEQ ID NO: 6437652 - DNA, 22 bp, Homo sapiens
tctggatttttacaaataaaga

SEQ ID NO: 6437653 - DNA, 22 bp, Homo sapiens
tctggcaaaaaggagccttttg

SEQ ID NO: 6437654 - DNA, 18 bp, Homo sapiens
tctggcaaacatgtgcaa

SEQ ID NO: 6437655 - DNA, 13 bp, Homo sapiens
tctggcaaatatt

SEQ ID NO: 6437656 - DNA, 20 bp, Homo sapiens
tctggcaaatattttgtcac

SEQ ID NO: 6437657 - DNA, 19 bp, Homo sapiens
tctggcaaggacagaggcg

SEQ ID NO: 6437658 - DNA, 18 bp, Homo sapiens
tctggcaaggactttgta

SEQ ID NO: 6437659 - DNA, 18 bp, Homo sapiens
tctggcaagtcggggcct

SEQ ID NO: 6437660 - DNA, 15 bp, Homo sapiens
tctggcaatcttgcc

SEQ ID NO: 6437661 - DNA, 21 bp, Homo sapiens
tctggcaatgccacagccctg

SEQ ID NO: 6437662 - DNA, 17 bp, Homo sapiens
tctggcacagcctgcac

SEQ ID NO: 6437663 - DNA, 22 bp, Homo sapiens
tctggcacagcctggctgtggc

SEQ ID NO: 6437664 - DNA, 19 bp, Homo sapiens
tctggcacagtgatgccgg

SEQ ID NO: 6437665 - DNA, 18 bp, Homo sapiens
tctggcaccatcagcctg

SEQ ID NO: 6437666 - DNA, 12 bp, Homo sapiens
tctggcacccag

SEQ ID NO: 6437667 - DNA, 17 bp, Homo sapiens
tctggcacgtggccagg

SEQ ID NO: 6437668 - DNA, 15 bp, Homo sapiens
tctggcagagcctct

SEQ ID NO: 6437669 - DNA, 18 bp, Homo sapiens
tctggcagagcctctgag

SEQ ID NO: 6437670 - DNA, 23 bp, Homo sapiens
tctggcagagttgaagacagagc

SEQ ID NO: 6437671 - DNA, 14 bp, Homo sapiens
tctggcagctcaga

SEQ ID NO: 6437672 - DNA, 10 bp, Homo sapiens
tctggcagga

SEQ ID NO: 6437673 - DNA, 12 bp, Homo sapiens
tctggcaggacc

SEQ ID NO: 6437674 - DNA, 20 bp, Homo sapiens
tctggcaggacctgcctagc

SEQ ID NO: 6437675 - DNA, 21 bp, Homo sapiens
tctggcaggacctgcctagca

SEQ ID NO: 6437676 - DNA, 17 bp, Homo sapiens
tctggcagggcagcagg

SEQ ID NO: 6437677 - DNA, 19 bp, Homo sapiens
tctggcagggtgggatgga

SEQ ID NO: 6437678 - DNA, 17 bp, Homo sapiens
tctggcagtctggagca

SEQ ID NO: 6437679 - DNA, 16 bp, Homo sapiens
tctggcatggctccct

SEQ ID NO: 6437680 - DNA, 20 bp, Homo sapiens
tctggcattctacacctgga

SEQ ID NO: 6437681 - DNA, 12 bp, Homo sapiens
tctggccaaggg

SEQ ID NO: 6437682 - DNA, 17 bp, Homo sapiens
tctggccaagggccaga

SEQ ID NO: 6437683 - DNA, 17 bp, Homo sapiens
tctggccacatcagccc

SEQ ID NO: 6437684 - DNA, 14 bp, Homo sapiens
tctggccaccccag

SEQ ID NO: 6437685 - DNA, 14 bp, Homo sapiens
tctggccactctgc

SEQ ID NO: 6437686 - DNA, 16 bp, Homo sapiens
tctggccaggaagctt

SEQ ID NO: 6437687 - DNA, 19 bp, Homo sapiens
tctggccaggatggagggg

SEQ ID NO: 6437688 - DNA, 14 bp, Homo sapiens
tctggccaggcact

SEQ ID NO: 6437689 - DNA, 17 bp, Homo sapiens
tctggccaggcactgcc

SEQ ID NO: 6437690 - DNA, 17 bp, Homo sapiens
tctggccagggaggagc

SEQ ID NO: 6437691 - DNA, 22 bp, Homo sapiens
tctggccagggaggagccccag

SEQ ID NO: 6437692 - DNA, 13 bp, Homo sapiens
tctggcccagaaa

SEQ ID NO: 6437693 - DNA, 21 bp, Homo sapiens
tctggcccagaaagcctctct

SEQ ID NO: 6437694 - DNA, 17 bp, Homo sapiens
tctggcccagccatggc

SEQ ID NO: 6437695 - DNA, 18 bp, Homo sapiens
tctggcccagccatggct

SEQ ID NO: 6437696 - DNA, 20 bp, Homo sapiens
tctggcccagccatggctgg

SEQ ID NO: 6437697 - DNA, 23 bp, Homo sapiens
tctggcccaggctagagtgcagt

SEQ ID NO: 6437698 - DNA, 16 bp, Homo sapiens
tctggcccaggctggc

SEQ ID NO: 6437699 - DNA, 21 bp, Homo sapiens
tctggccccacaccagcccca

SEQ ID NO: 6437700 - DNA, 16 bp, Homo sapiens
tctggccccagcctag

SEQ ID NO: 6437701 - DNA, 17 bp, Homo sapiens
tctggccccagcctagg

SEQ ID NO: 6437702 - DNA, 12 bp, Homo sapiens
tctggcccccct

SEQ ID NO: 6437703 - DNA, 22 bp, Homo sapiens
tctggcccccctggtcccctcc

SEQ ID NO: 6437704 - DNA, 16 bp, Homo sapiens
tctggccccctattgt

SEQ ID NO: 6437705 - DNA, 13 bp, Homo sapiens
tctggcccctcac

SEQ ID NO: 6437706 - DNA, 16 bp, Homo sapiens
tctggccctaactcct

SEQ ID NO: 6437707 - DNA, 14 bp, Homo sapiens
tctggccctagact

SEQ ID NO: 6437708 - DNA, 22 bp, Homo sapiens
tctggccctcggtggctgcaca

SEQ ID NO: 6437709 - DNA, 10 bp, Homo sapiens
tctggccctg

SEQ ID NO: 6437710 - DNA, 11 bp, Homo sapiens
tctggccctga

SEQ ID NO: 6437711 - DNA, 13 bp, Homo sapiens
tctggccctgcct

SEQ ID NO: 6437712 - DNA, 16 bp, Homo sapiens
tctggccctgccttct

SEQ ID NO: 6437713 - DNA, 12 bp, Homo sapiens
tctggccctgct

SEQ ID NO: 6437714 - DNA, 15 bp, Homo sapiens
tctggccctgctgcc

SEQ ID NO: 6437715 - DNA, 13 bp, Homo sapiens
tctggccctggcc

SEQ ID NO: 6437716 - DNA, 23 bp, Homo sapiens
tctggccctggcgggtggctgca

SEQ ID NO: 6437717 - DNA, 21 bp, Homo sapiens
tctggccctgttgtgggggtg

SEQ ID NO: 6437718 - DNA, 23 bp, Homo sapiens
tctggcccttgcttacctctcag

SEQ ID NO: 6437719 - DNA, 12 bp, Homo sapiens
tctggcccttgg

SEQ ID NO: 6437720 - DNA, 16 bp, Homo sapiens
tctggcccttggaata

SEQ ID NO: 6437721 - DNA, 18 bp, Homo sapiens
tctggccctttctggacc

SEQ ID NO: 6437722 - DNA, 16 bp, Homo sapiens
tctggccggtgctggg

SEQ ID NO: 6437723 - DNA, 22 bp, Homo sapiens
tctggccggtgctgggttccca

SEQ ID NO: 6437724 - DNA, 21 bp, Homo sapiens
tctggccgtccttgtctctgg

SEQ ID NO: 6437725 - DNA, 22 bp, Homo sapiens
tctggcctaggacccctcgcct

SEQ ID NO: 6437726 - DNA, 23 bp, Homo sapiens
tctggcctaggacccctcgcctt

SEQ ID NO: 6437727 - DNA, 16 bp, Homo sapiens
tctggcctatgaccct

SEQ ID NO: 6437728 - DNA, 21 bp, Homo sapiens
tctggcctatgaccctgtgcc

SEQ ID NO: 6437729 - DNA, 22 bp, Homo sapiens
tctggcctatgaccctgtgcct

SEQ ID NO: 6437730 - DNA, 16 bp, Homo sapiens
tctggcctcagaccaa

SEQ ID NO: 6437731 - DNA, 20 bp, Homo sapiens
tctggcctcagaccaactct

SEQ ID NO: 6437732 - DNA, 15 bp, Homo sapiens
tcagtgctacatttt

SEQ ID NO: 6437733 - DNA, 20 bp, Homo sapiens
tcagtgctataaatgccaga

SEQ ID NO: 6437734 - DNA, 18 bp, Homo sapiens
tcagtgctcctggaaact

SEQ ID NO: 6437735 - DNA, 17 bp, Homo sapiens
tcagtgctcggcagtca

SEQ ID NO: 6437736 - DNA, 16 bp, Homo sapiens
tcagtgctgtgctgtg

SEQ ID NO: 6437737 - DNA, 14 bp, Homo sapiens
tcagtgctgtggcc

SEQ ID NO: 6437738 - DNA, 16 bp, Homo sapiens
tcagtgcttgggctcc

SEQ ID NO: 6437739 - DNA, 15 bp, Homo sapiens
tcagtgctttttcct

SEQ ID NO: 6437740 - DNA, 23 bp, Homo sapiens
tcagtgctttttccttttcatct

SEQ ID NO: 6437741 - DNA, 16 bp, Homo sapiens
tcagtggaagaagcag

SEQ ID NO: 6437742 - DNA, 21 bp, Homo sapiens
tcagtggaagccccaacggga

SEQ ID NO: 6437743 - DNA, 19 bp, Homo sapiens
tcagtggacactcagacca

SEQ ID NO: 6437744 - DNA, 15 bp, Homo sapiens
tcagtggacatttgt

SEQ ID NO: 6437745 - DNA, 18 bp, Homo sapiens
tcagtggacatttgttct

SEQ ID NO: 6437746 - DNA, 23 bp, Homo sapiens
tcagtggactttccaccccctcc

SEQ ID NO: 6437747 - DNA, 15 bp, Homo sapiens
tcagtggagtccaga

SEQ ID NO: 6437748 - DNA, 11 bp, Homo sapiens
tcagtggatca

SEQ ID NO: 6437749 - DNA, 17 bp, Homo sapiens
tcagtggcaacttgtga

SEQ ID NO: 6437750 - DNA, 16 bp, Homo sapiens
tcagtggccaggtgcc

SEQ ID NO: 6437751 - DNA, 16 bp, Homo sapiens
tcagtggctggaatta

SEQ ID NO: 6437752 - DNA, 21 bp, Homo sapiens
tcagtgggaaatatgccactg

SEQ ID NO: 6437753 - DNA, 23 bp, Homo sapiens
tcagtgggaacgtgactgcccca

SEQ ID NO: 6437754 - DNA, 19 bp, Homo sapiens
tcagtgggacatagccagc

SEQ ID NO: 6437755 - DNA, 12 bp, Homo sapiens
tcagtgggagaa

SEQ ID NO: 6437756 - DNA, 18 bp, Homo sapiens
tcagtgggctgtttctgc

SEQ ID NO: 6437757 - DNA, 21 bp, Homo sapiens
tcagtgggctgtttctgctta

SEQ ID NO: 6437758 - DNA, 16 bp, Homo sapiens
tcagtggggaggggct

SEQ ID NO: 6437759 - DNA, 14 bp, Homo sapiens
tcagtggggcagtc

SEQ ID NO: 6437760 - DNA, 14 bp, Homo sapiens
tcagtggggctggc

SEQ ID NO: 6437761 - DNA, 15 bp, Homo sapiens
tcagtggggctggca

SEQ ID NO: 6437762 - DNA, 16 bp, Homo sapiens
tcagtggggctggcat

SEQ ID NO: 6437763 - DNA, 16 bp, Homo sapiens
tcagtgggttaatttt

SEQ ID NO: 6437764 - DNA, 20 bp, Homo sapiens
tcagtggttatttagggaac

SEQ ID NO: 6437765 - DNA, 23 bp, Homo sapiens
tcagtggttggcaattgtttcaa

SEQ ID NO: 6437766 - DNA, 23 bp, Homo sapiens
tcagtggtttctacttcccctgg

SEQ ID NO: 6437767 - DNA, 14 bp, Homo sapiens
tcagtgtaaagtgt

SEQ ID NO: 6437768 - DNA, 16 bp, Homo sapiens
tcagtgtaagccctgc

SEQ ID NO: 6437769 - DNA, 21 bp, Homo sapiens
tcagtgtaatgtgacttcatg

SEQ ID NO: 6437770 - DNA, 19 bp, Homo sapiens
tcagtgtaatttctttgcc

SEQ ID NO: 6437771 - DNA, 11 bp, Homo sapiens
tcagtgtacat

SEQ ID NO: 6437772 - DNA, 18 bp, Homo sapiens
tcagtgtaccatttgcct

SEQ ID NO: 6437773 - DNA, 19 bp, Homo sapiens
tcagtgtaccatttgcctc

SEQ ID NO: 6437774 - DNA, 20 bp, Homo sapiens
tcagtgtacccccgcccagg

SEQ ID NO: 6437775 - DNA, 22 bp, Homo sapiens
tcagtgtacccccgcccaggct

SEQ ID NO: 6437776 - DNA, 17 bp, Homo sapiens
tcagtgtagacacaggt

SEQ ID NO: 6437777 - DNA, 18 bp, Homo sapiens
tcagtgtagacacaggtc

SEQ ID NO: 6437778 - DNA, 20 bp, Homo sapiens
tcagtgtagacacaggtcac

SEQ ID NO: 6437779 - DNA, 22 bp, Homo sapiens
tcagtgtatggaaataaatgta

SEQ ID NO: 6437780 - DNA, 16 bp, Homo sapiens
tcagtgtatttcagtt

SEQ ID NO: 6437781 - DNA, 12 bp, Homo sapiens
tcagtgtatttt

SEQ ID NO: 6437782 - DNA, 17 bp, Homo sapiens
tcagtgtcattattagt

SEQ ID NO: 6437783 - DNA, 16 bp, Homo sapiens
tcagtgtccaaagcag

SEQ ID NO: 6437784 - DNA, 15 bp, Homo sapiens
tcagtgtccagcttc

SEQ ID NO: 6437785 - DNA, 16 bp, Homo sapiens
tcagtgtccagcttcc

SEQ ID NO: 6437786 - DNA, 14 bp, Homo sapiens
tcagtgtcccaggc

SEQ ID NO: 6437787 - DNA, 21 bp, Homo sapiens
tcagtgtcccaggcagcacag

SEQ ID NO: 6437788 - DNA, 17 bp, Homo sapiens
tcagtgtcccgggcccg

SEQ ID NO: 6437789 - DNA, 11 bp, Homo sapiens
tcagtgtcctc

SEQ ID NO: 6437790 - DNA, 13 bp, Homo sapiens
tcagtgtcctcag

SEQ ID NO: 6437791 - DNA, 14 bp, Homo sapiens
tcagtgtcctcatc

SEQ ID NO: 6437792 - DNA, 15 bp, Homo sapiens
tcagtgtcctttcca

SEQ ID NO: 6437793 - DNA, 12 bp, Homo sapiens
tcagtgtctgaa

SEQ ID NO: 6437794 - DNA, 14 bp, Homo sapiens
tcagtgtgatgaat

SEQ ID NO: 6437795 - DNA, 19 bp, Homo sapiens
tcagtgtgccaccctctgc

SEQ ID NO: 6437796 - DNA, 22 bp, Homo sapiens
tcagtgtgccccccatcctggc

SEQ ID NO: 6437797 - DNA, 19 bp, Homo sapiens
tcagtgtggactgggaagc

SEQ ID NO: 6437798 - DNA, 17 bp, Homo sapiens
tcagtgtgtcagttttt

SEQ ID NO: 6437799 - DNA, 13 bp, Homo sapiens
tcagtgtgtgtgt

SEQ ID NO: 6437800 - DNA, 20 bp, Homo sapiens
tcagtgtgtttgctaattaa

SEQ ID NO: 6437801 - DNA, 13 bp, Homo sapiens
tcagtgttaaaaa

SEQ ID NO: 6437802 - DNA, 22 bp, Homo sapiens
tcagtgttaaagtggtctgaac

SEQ ID NO: 6437803 - DNA, 15 bp, Homo sapiens
tcagtgttaaatgtg

SEQ ID NO: 6437804 - DNA, 19 bp, Homo sapiens
tcagtgttaatactgagaa

SEQ ID NO: 6437805 - DNA, 16 bp, Homo sapiens
tcagtgttacctgtgt

SEQ ID NO: 6437806 - DNA, 13 bp, Homo sapiens
tcagtgttataaa

SEQ ID NO: 6437807 - DNA, 15 bp, Homo sapiens
tcagtgttataaaat

SEQ ID NO: 6437808 - DNA, 20 bp, Homo sapiens
tcagtgttcccaaagtgaac

SEQ ID NO: 6437809 - DNA, 14 bp, Homo sapiens
tcagtgttgaattt

SEQ ID NO: 6437810 - DNA, 18 bp, Homo sapiens
tcagtgttgacatagcct

SEQ ID NO: 6437811 - DNA, 19 bp, Homo sapiens
tcagtgttgacatagcctt

SEQ ID NO: 6437812 - DNA, 21 bp, Homo sapiens
tcagtgttgacatagcctttg

SEQ ID NO: 6437813 - DNA, 15 bp, Homo sapiens
tcagtgttgagatgg

SEQ ID NO: 6437814 - DNA, 16 bp, Homo sapiens
tcagtgtttaaataaa

SEQ ID NO: 6437815 - DNA, 12 bp, Homo sapiens
tcagtgtttaca

SEQ ID NO: 6437816 - DNA, 17 bp, Homo sapiens
tcagtgtttcttttaag

SEQ ID NO: 6437817 - DNA, 17 bp, Homo sapiens
tcagtgttttaaattct

SEQ ID NO: 6437818 - DNA, 18 bp, Homo sapiens
tcagtgttttcattttag

SEQ ID NO: 6437819 - DNA, 15 bp, Homo sapiens
tcagtgttttggact

SEQ ID NO: 6437820 - DNA, 20 bp, Homo sapiens
tcagtgttttggactccatc

SEQ ID NO: 6437821 - DNA, 14 bp, Homo sapiens
tcagtgtttttcct

SEQ ID NO: 6437822 - DNA, 14 bp, Homo sapiens
tcagtgtttttgaa

SEQ ID NO: 6437823 - DNA, 22 bp, Homo sapiens
tcagtgtttttgaaacccacag

SEQ ID NO: 6437824 - DNA, 19 bp, Homo sapiens
tcagttaagaaaaaaataa

SEQ ID NO: 6437825 - DNA, 17 bp, Homo sapiens
tcagttaagtttttccc

SEQ ID NO: 6437826 - DNA, 23 bp, Homo sapiens
tcagttaattcaatgtgaacact

SEQ ID NO: 6437827 - DNA, 18 bp, Homo sapiens
tcagttaattcttagata

SEQ ID NO: 6437828 - DNA, 13 bp, Homo sapiens
tcagttacagaaa

SEQ ID NO: 6437829 - DNA, 14 bp, Homo sapiens
tcagttacagaaag

SEQ ID NO: 6437830 - DNA, 20 bp, Homo sapiens
tcagttacagtggcagtatt

SEQ ID NO: 6437831 - DNA, 21 bp, Homo sapiens
tcagttacagtggcagtattg

SEQ ID NO: 6437832 - DNA, 21 bp, Homo sapiens
tcagttaccaaacattacaaa

SEQ ID NO: 6437833 - DNA, 14 bp, Homo sapiens
tcagttactcagcc

SEQ ID NO: 6437834 - DNA, 16 bp, Homo sapiens
tcagttactcagccct

SEQ ID NO: 6437835 - DNA, 16 bp, Homo sapiens
tcagttactctgaagg

SEQ ID NO: 6437836 - DNA, 15 bp, Homo sapiens
tcagttactcttcag

SEQ ID NO: 6437837 - DNA, 22 bp, Homo sapiens
tcagttagagctgacacaaacc

SEQ ID NO: 6437838 - DNA, 14 bp, Homo sapiens
tcagttataaagtc

SEQ ID NO: 6437839 - DNA, 15 bp, Homo sapiens
tcagttataatttca

SEQ ID NO: 6437840 - DNA, 16 bp, Homo sapiens
tcagttatatgatatt

SEQ ID NO: 6437841 - DNA, 18 bp, Homo sapiens
tcagttatattctttaaa

SEQ ID NO: 6437842 - DNA, 14 bp, Homo sapiens
tcagttatcactac

SEQ ID NO: 6437843 - DNA, 17 bp, Homo sapiens
tcagttatcctttgtga

SEQ ID NO: 6437844 - DNA, 14 bp, Homo sapiens
tcagttattcagat

SEQ ID NO: 6437845 - DNA, 13 bp, Homo sapiens
tcagttattcatt

SEQ ID NO: 6437846 - DNA, 15 bp, Homo sapiens
tcagttattggtgga

SEQ ID NO: 6437847 - DNA, 17 bp, Homo sapiens
tcagttattggtggaat

SEQ ID NO: 6437848 - DNA, 23 bp, Homo sapiens
tcagttattgtccctggcttcct

SEQ ID NO: 6437849 - DNA, 22 bp, Homo sapiens
tcagttcaaaagcctgaaagtt

SEQ ID NO: 6437850 - DNA, 16 bp, Homo sapiens
tcagttcaaagtcatg

SEQ ID NO: 6437851 - DNA, 21 bp, Homo sapiens
tcagttcaaagtcatgatgtt

SEQ ID NO: 6437852 - DNA, 17 bp, Homo sapiens
tcagttcaacctggtgg

SEQ ID NO: 6437853 - DNA, 19 bp, Homo sapiens
tcagttcactgctgcatgt

SEQ ID NO: 6437854 - DNA, 19 bp, Homo sapiens
tcagttcataatatatgga

SEQ ID NO: 6437855 - DNA, 17 bp, Homo sapiens
tcagttcatatgcagaa

SEQ ID NO: 6437856 - DNA, 19 bp, Homo sapiens
tcagttcattgtggtcctt

SEQ ID NO: 6437857 - DNA, 15 bp, Homo sapiens
tcagttcatttcctg

SEQ ID NO: 6437858 - DNA, 19 bp, Homo sapiens
tcagttccaatacttcatt

SEQ ID NO: 6437859 - DNA, 18 bp, Homo sapiens
tcagttccagccttctct

SEQ ID NO: 6437860 - DNA, 18 bp, Homo sapiens
tcagttcccagaatcaaa

SEQ ID NO: 6437861 - DNA, 13 bp, Homo sapiens
tcagttcccgctc

SEQ ID NO: 6437862 - DNA, 17 bp, Homo sapiens
tcagttcccgctctgca

SEQ ID NO: 6437863 - DNA, 21 bp, Homo sapiens
tcagttcccggagcacagccc

SEQ ID NO: 6437864 - DNA, 15 bp, Homo sapiens
tcagttcccttggcc

SEQ ID NO: 6437865 - DNA, 16 bp, Homo sapiens
tcagttcctctttgca

SEQ ID NO: 6437866 - DNA, 18 bp, Homo sapiens
tcagttcctctttgcatg

SEQ ID NO: 6437867 - DNA, 21 bp, Homo sapiens
tcagttcctctttgcatggaa

SEQ ID NO: 6437868 - DNA, 20 bp, Homo sapiens
tcagttcctgcagcagagcc

SEQ ID NO: 6437869 - DNA, 20 bp, Homo sapiens
tcagttcctgcccttggcct

SEQ ID NO: 6437870 - DNA, 16 bp, Homo sapiens
tcagttcctttgtgtg

SEQ ID NO: 6437871 - DNA, 22 bp, Homo sapiens
tcagttcctttgtgtgtactca

SEQ ID NO: 6437872 - DNA, 20 bp, Homo sapiens
tcagttcgttggtagagccc

SEQ ID NO: 6437873 - DNA, 15 bp, Homo sapiens
tcagttctaggcctt

SEQ ID NO: 6437874 - DNA, 21 bp, Homo sapiens
tcagttctaggcctttcctct

SEQ ID NO: 6437875 - DNA, 23 bp, Homo sapiens
tcagttctaggcctttcctctgc

SEQ ID NO: 6437876 - DNA, 20 bp, Homo sapiens
tcagttctagtctctctggg

SEQ ID NO: 6437877 - DNA, 12 bp, Homo sapiens
tcagttctcaaa

SEQ ID NO: 6437878 - DNA, 14 bp, Homo sapiens
tcagttctcaaatg

SEQ ID NO: 6437879 - DNA, 19 bp, Homo sapiens
tcagttctctactccctct

SEQ ID NO: 6437880 - DNA, 18 bp, Homo sapiens
tcagttctctcccttcct

SEQ ID NO: 6437881 - DNA, 16 bp, Homo sapiens
tcagttctcttgcttt

SEQ ID NO: 6437882 - DNA, 13 bp, Homo sapiens
tcagttctgatat

SEQ ID NO: 6437883 - DNA, 17 bp, Homo sapiens
tcagttctgccttatct

SEQ ID NO: 6437884 - DNA, 15 bp, Homo sapiens
tcagttctgcttgct

SEQ ID NO: 6437885 - DNA, 13 bp, Homo sapiens
tcagttctgtgta

SEQ ID NO: 6437886 - DNA, 17 bp, Homo sapiens
tcagttctgtgtacatt

SEQ ID NO: 6437887 - DNA, 20 bp, Homo sapiens
tcagttcttgccactttttt

SEQ ID NO: 6437888 - DNA, 14 bp, Homo sapiens
tcagttcttggcct

SEQ ID NO: 6437889 - DNA, 18 bp, Homo sapiens
tcagttcttggtgctctg

SEQ ID NO: 6437890 - DNA, 17 bp, Homo sapiens
tcagttgagaaacagtt

SEQ ID NO: 6437891 - DNA, 23 bp, Homo sapiens
tcagttgagagggtgcagtccag

SEQ ID NO: 6437892 - DNA, 20 bp, Homo sapiens
tcagttgatttttcttattt

SEQ ID NO: 6437893 - DNA, 13 bp, Homo sapiens
tcagttgcagaaa

SEQ ID NO: 6437894 - DNA, 12 bp, Homo sapiens
tcagttgcagcc

SEQ ID NO: 6437895 - DNA, 13 bp, Homo sapiens
tcagttgcccccc

SEQ ID NO: 6437896 - DNA, 22 bp, Homo sapiens
tcagttgctaaacactgcgctt

SEQ ID NO: 6437897 - DNA, 15 bp, Homo sapiens
tcagttgcttgtctt

SEQ ID NO: 6437898 - DNA, 13 bp, Homo sapiens
tcagttgctttgc

SEQ ID NO: 6437899 - DNA, 12 bp, Homo sapiens
tcagttggagaa

SEQ ID NO: 6437900 - DNA, 17 bp, Homo sapiens
tcagttggcctctgccc

SEQ ID NO: 6437901 - DNA, 17 bp, Homo sapiens
tcagttgggaagctttt

SEQ ID NO: 6437902 - DNA, 23 bp, Homo sapiens
tcagttgggatccctcctccagc

SEQ ID NO: 6437903 - DNA, 20 bp, Homo sapiens
tcagttggtgtgtttttggg

SEQ ID NO: 6437904 - DNA, 18 bp, Homo sapiens
tcagttggttgtgtcttt

SEQ ID NO: 6437905 - DNA, 12 bp, Homo sapiens
tcagttgtaata

SEQ ID NO: 6437906 - DNA, 19 bp, Homo sapiens
tcagttgtacgtaatgtat

SEQ ID NO: 6437907 - DNA, 21 bp, Homo sapiens
tcagttgtagaatgtattgta

SEQ ID NO: 6437908 - DNA, 20 bp, Homo sapiens
tcagttgtccttaaatttgt

SEQ ID NO: 6437909 - DNA, 15 bp, Homo sapiens
tcagttgtgactaac

SEQ ID NO: 6437910 - DNA, 12 bp, Homo sapiens
tcagttgtgttt

SEQ ID NO: 6437911 - DNA, 14 bp, Homo sapiens
tcagttgtgttttt

SEQ ID NO: 6437912 - DNA, 18 bp, Homo sapiens
tctggcctcagcaggaac

SEQ ID NO: 6437913 - DNA, 11 bp, Homo sapiens
tctggcctcca

SEQ ID NO: 6437914 - DNA, 13 bp, Homo sapiens
tctggcctccagc

SEQ ID NO: 6437915 - DNA, 15 bp, Homo sapiens
tctggcctccagcct

SEQ ID NO: 6437916 - DNA, 15 bp, Homo sapiens
tctggcctcccaccc

SEQ ID NO: 6437917 - DNA, 16 bp, Homo sapiens
tctggcctcccacccg

SEQ ID NO: 6437918 - DNA, 23 bp, Homo sapiens
tctggcctcccacccgatgctgc

SEQ ID NO: 6437919 - DNA, 14 bp, Homo sapiens
tctggcctcctaag

SEQ ID NO: 6437920 - DNA, 16 bp, Homo sapiens
tctggcctcctaaggc

SEQ ID NO: 6437921 - DNA, 23 bp, Homo sapiens
tctggcctcctaaggctccccac

SEQ ID NO: 6437922 - DNA, 17 bp, Homo sapiens
tctggcctctggcctgg

SEQ ID NO: 6437923 - DNA, 19 bp, Homo sapiens
tctggcctctggcctggga

SEQ ID NO: 6437924 - DNA, 12 bp, Homo sapiens
tctggcctggcc

SEQ ID NO: 6437925 - DNA, 15 bp, Homo sapiens
tctggccttacacct

SEQ ID NO: 6437926 - DNA, 20 bp, Homo sapiens
tctggccttggttcctccag

SEQ ID NO: 6437927 - DNA, 15 bp, Homo sapiens
tctggcctttcatgg

SEQ ID NO: 6437928 - DNA, 21 bp, Homo sapiens
tctggcctttcctctctcctg

SEQ ID NO: 6437929 - DNA, 18 bp, Homo sapiens
tctggcgacagttttcct

SEQ ID NO: 6437930 - DNA, 19 bp, Homo sapiens
tctggcgagcccttagcct

SEQ ID NO: 6437931 - DNA, 20 bp, Homo sapiens
tctggcgagcccttagcctt

SEQ ID NO: 6437932 - DNA, 12 bp, Homo sapiens
tctggcgccagg

SEQ ID NO: 6437933 - DNA, 22 bp, Homo sapiens
tctggcgccaggggcaggcagc

SEQ ID NO: 6437934 - DNA, 23 bp, Homo sapiens
tctggcggtggccacagcgtgct

SEQ ID NO: 6437935 - DNA, 18 bp, Homo sapiens
tctggcgttctcaagaat

SEQ ID NO: 6437936 - DNA, 15 bp, Homo sapiens
tctggctaaggcatc

SEQ ID NO: 6437937 - DNA, 17 bp, Homo sapiens
tctggctaaggcatcat

SEQ ID NO: 6437938 - DNA, 14 bp, Homo sapiens
tctggctacctgtt

SEQ ID NO: 6437939 - DNA, 14 bp, Homo sapiens
tctggctagagccg

SEQ ID NO: 6437940 - DNA, 16 bp, Homo sapiens
tctggctagaggccag

SEQ ID NO: 6437941 - DNA, 21 bp, Homo sapiens
tctggctagaggccagcccca

SEQ ID NO: 6437942 - DNA, 22 bp, Homo sapiens
tctggctagaggccagccccac

SEQ ID NO: 6437943 - DNA, 20 bp, Homo sapiens
tctggctcaaagcagcagga

SEQ ID NO: 6437944 - DNA, 12 bp, Homo sapiens
tctggctcagcc

SEQ ID NO: 6437945 - DNA, 17 bp, Homo sapiens
tctggctcagcccggga

SEQ ID NO: 6437946 - DNA, 17 bp, Homo sapiens
tctggctcagctgtggt

SEQ ID NO: 6437947 - DNA, 19 bp, Homo sapiens
tctggctccaaggtgctct

SEQ ID NO: 6437948 - DNA, 19 bp, Homo sapiens
tctggctccacacctccac

SEQ ID NO: 6437949 - DNA, 15 bp, Homo sapiens
tctggctcctaccac

SEQ ID NO: 6437950 - DNA, 17 bp, Homo sapiens
tctggctcctttacaaa

SEQ ID NO: 6437951 - DNA, 21 bp, Homo sapiens
tctggctcggacccaccccaa

SEQ ID NO: 6437952 - DNA, 23 bp, Homo sapiens
tctggctcggacccaccccaact

SEQ ID NO: 6437953 - DNA, 15 bp, Homo sapiens
tctggctctaattca

SEQ ID NO: 6437954 - DNA, 16 bp, Homo sapiens
tctggctctacacata

SEQ ID NO: 6437955 - DNA, 13 bp, Homo sapiens
tctggctctgtct

SEQ ID NO: 6437956 - DNA, 18 bp, Homo sapiens
tctggctgaacactggca

SEQ ID NO: 6437957 - DNA, 13 bp, Homo sapiens
tctggctgaaccc

SEQ ID NO: 6437958 - DNA, 17 bp, Homo sapiens
tctggctgaaccctgtg

SEQ ID NO: 6437959 - DNA, 13 bp, Homo sapiens
tctggctgagccc

SEQ ID NO: 6437960 - DNA, 16 bp, Homo sapiens
tctggctgagccctgc

SEQ ID NO: 6437961 - DNA, 21 bp, Homo sapiens
tctggctgagctgaacccatt

SEQ ID NO: 6437962 - DNA, 15 bp, Homo sapiens
tctggctgcagagca

SEQ ID NO: 6437963 - DNA, 12 bp, Homo sapiens
tctggctgccaa

SEQ ID NO: 6437964 - DNA, 15 bp, Homo sapiens
tctggctgcctggcc

SEQ ID NO: 6437965 - DNA, 20 bp, Homo sapiens
tctggctgcctggcccaggg

SEQ ID NO: 6437966 - DNA, 14 bp, Homo sapiens
tctggctgctgtat

SEQ ID NO: 6437967 - DNA, 15 bp, Homo sapiens
tctggctggagagga

SEQ ID NO: 6437968 - DNA, 20 bp, Homo sapiens
tctggctgggtcaccagaaa

SEQ ID NO: 6437969 - DNA, 13 bp, Homo sapiens
tctggctggtgtt

SEQ ID NO: 6437970 - DNA, 18 bp, Homo sapiens
tctggctggtgttaacag

SEQ ID NO: 6437971 - DNA, 18 bp, Homo sapiens
tctggctgtaaggctcta

SEQ ID NO: 6437972 - DNA, 14 bp, Homo sapiens
tctggctgtctaga

SEQ ID NO: 6437973 - DNA, 23 bp, Homo sapiens
tctggctgtgacagcctctgcag

SEQ ID NO: 6437974 - DNA, 13 bp, Homo sapiens
tctggctgtggcc

SEQ ID NO: 6437975 - DNA, 15 bp, Homo sapiens
tctggctgtggcccc

SEQ ID NO: 6437976 - DNA, 19 bp, Homo sapiens
tctggctgtggcccctcct

SEQ ID NO: 6437977 - DNA, 17 bp, Homo sapiens
tctggctgtggtcagca

SEQ ID NO: 6437978 - DNA, 15 bp, Homo sapiens
tctggctgtgtggcc

SEQ ID NO: 6437979 - DNA, 18 bp, Homo sapiens
tctggctgtgttgccctg

SEQ ID NO: 6437980 - DNA, 19 bp, Homo sapiens
tctggcttagacaccacct

SEQ ID NO: 6437981 - DNA, 13 bp, Homo sapiens
tctggcttagtgc

SEQ ID NO: 6437982 - DNA, 16 bp, Homo sapiens
tctggcttattttaat

SEQ ID NO: 6437983 - DNA, 18 bp, Homo sapiens
tctggcttattttaatgt

SEQ ID NO: 6437984 - DNA, 20 bp, Homo sapiens
tctggcttattttaatgtga

SEQ ID NO: 6437985 - DNA, 19 bp, Homo sapiens
tctggcttcaaatattatg

SEQ ID NO: 6437986 - DNA, 15 bp, Homo sapiens
tctggcttcagcccc

SEQ ID NO: 6437987 - DNA, 20 bp, Homo sapiens
tctggcttcagcccccacca

SEQ ID NO: 6437988 - DNA, 23 bp, Homo sapiens
tctggcttccagaaaaccccagc

SEQ ID NO: 6437989 - DNA, 22 bp, Homo sapiens
tctggcttccaggtatctccag

SEQ ID NO: 6437990 - DNA, 14 bp, Homo sapiens
tctggcttccctgc

SEQ ID NO: 6437991 - DNA, 15 bp, Homo sapiens
tctggcttccctgga

SEQ ID NO: 6437992 - DNA, 22 bp, Homo sapiens
tctggcttcgcagctctggcct

SEQ ID NO: 6437993 - DNA, 21 bp, Homo sapiens
tctggcttctagagatgtgcc

SEQ ID NO: 6437994 - DNA, 23 bp, Homo sapiens
tctggcttctagagatgtgcctg

SEQ ID NO: 6437995 - DNA, 13 bp, Homo sapiens
tctggcttctctc

SEQ ID NO: 6437996 - DNA, 16 bp, Homo sapiens
tctggcttctctcttt

SEQ ID NO: 6437997 - DNA, 18 bp, Homo sapiens
tctggcttctctcttttc

SEQ ID NO: 6437998 - DNA, 22 bp, Homo sapiens
tctggcttctctcttttcctcc

SEQ ID NO: 6437999 - DNA, 16 bp, Homo sapiens
tctggcttgccccagg

SEQ ID NO: 6438000 - DNA, 20 bp, Homo sapiens
tctggcttggccacagccag

SEQ ID NO: 6438001 - DNA, 14 bp, Homo sapiens
tctggcttggccta

SEQ ID NO: 6438002 - DNA, 22 bp, Homo sapiens
tctggcttgggcagggtctgtt

SEQ ID NO: 6438003 - DNA, 16 bp, Homo sapiens
tctggctttaagaatg

SEQ ID NO: 6438004 - DNA, 16 bp, Homo sapiens
tctggctttcccagga

SEQ ID NO: 6438005 - DNA, 21 bp, Homo sapiens
tctggctttcccaggagatgg

SEQ ID NO: 6438006 - DNA, 12 bp, Homo sapiens
tctggctttgct

SEQ ID NO: 6438007 - DNA, 16 bp, Homo sapiens
tctggctttgctctat

SEQ ID NO: 6438008 - DNA, 21 bp, Homo sapiens
tctggctttggaaagacctgt

SEQ ID NO: 6438009 - DNA, 16 bp, Homo sapiens
tctggctttggcactc

SEQ ID NO: 6438010 - DNA, 21 bp, Homo sapiens
tctggctttggcactctctgc

SEQ ID NO: 6438011 - DNA, 15 bp, Homo sapiens
tctggctttgtctct

SEQ ID NO: 6438012 - DNA, 23 bp, Homo sapiens
tctggctttttcctctgagccca

SEQ ID NO: 6438013 - DNA, 13 bp, Homo sapiens
tctggctttttct

SEQ ID NO: 6438014 - DNA, 13 bp, Homo sapiens
tctgggaaaggtg

SEQ ID NO: 6438015 - DNA, 18 bp, Homo sapiens
tctgggaaataagagaga

SEQ ID NO: 6438016 - DNA, 17 bp, Homo sapiens
tctgggaacctcccaga

SEQ ID NO: 6438017 - DNA, 19 bp, Homo sapiens
tctgggaacctcccagagg

SEQ ID NO: 6438018 - DNA, 12 bp, Homo sapiens
tctgggacacag

SEQ ID NO: 6438019 - DNA, 13 bp, Homo sapiens
tctgggacacagt

SEQ ID NO: 6438020 - DNA, 15 bp, Homo sapiens
tctgggaccccagct

SEQ ID NO: 6438021 - DNA, 17 bp, Homo sapiens
tctgggaccccagctgc

SEQ ID NO: 6438022 - DNA, 16 bp, Homo sapiens
tctgggaccctttcct

SEQ ID NO: 6438023 - DNA, 16 bp, Homo sapiens
tctgggacctcagttt

SEQ ID NO: 6438024 - DNA, 20 bp, Homo sapiens
tctgggacctgccaggcagg

SEQ ID NO: 6438025 - DNA, 22 bp, Homo sapiens
tctgggacctgccaggcagggg

SEQ ID NO: 6438026 - DNA, 14 bp, Homo sapiens
tctgggacgtggac

SEQ ID NO: 6438027 - DNA, 22 bp, Homo sapiens
tctgggacgtggacatgcctca

SEQ ID NO: 6438028 - DNA, 17 bp, Homo sapiens
tctgggactctcctcct

SEQ ID NO: 6438029 - DNA, 20 bp, Homo sapiens
tctgggactctcctcctccc

SEQ ID NO: 6438030 - DNA, 19 bp, Homo sapiens
tctgggactgtgcctggct

SEQ ID NO: 6438031 - DNA, 21 bp, Homo sapiens
tctgggacttccttgctctcc

SEQ ID NO: 6438032 - DNA, 22 bp, Homo sapiens
tctgggagaaaatcatcaagaa

SEQ ID NO: 6438033 - DNA, 23 bp, Homo sapiens
tctgggagaaaatcatcaagaag

SEQ ID NO: 6438034 - DNA, 17 bp, Homo sapiens
tctgggagagcctggca

SEQ ID NO: 6438035 - DNA, 16 bp, Homo sapiens
tctgggagaggatttt

SEQ ID NO: 6438036 - DNA, 14 bp, Homo sapiens
tctgggagcagaaa

SEQ ID NO: 6438037 - DNA, 21 bp, Homo sapiens
tctgggagcagggcataggaa

SEQ ID NO: 6438038 - DNA, 14 bp, Homo sapiens
tctgggagcccaga

SEQ ID NO: 6438039 - DNA, 15 bp, Homo sapiens
tctgggagcccagaa

SEQ ID NO: 6438040 - DNA, 20 bp, Homo sapiens
tctgggagctgcgccggaca

SEQ ID NO: 6438041 - DNA, 13 bp, Homo sapiens
tctgggaggcaga

SEQ ID NO: 6438042 - DNA, 19 bp, Homo sapiens
tctgggaggctggtctccc

SEQ ID NO: 6438043 - DNA, 16 bp, Homo sapiens
tctgggaggcttcagt

SEQ ID NO: 6438044 - DNA, 12 bp, Homo sapiens
tctgggagggaa

SEQ ID NO: 6438045 - DNA, 13 bp, Homo sapiens
tctgggagggaag

SEQ ID NO: 6438046 - DNA, 12 bp, Homo sapiens
tctgggaggggg

SEQ ID NO: 6438047 - DNA, 18 bp, Homo sapiens
tctgggaggtctccactg

SEQ ID NO: 6438048 - DNA, 23 bp, Homo sapiens
tctgggagtaatactttttaaat

SEQ ID NO: 6438049 - DNA, 17 bp, Homo sapiens
tctgggagtcacacagt

SEQ ID NO: 6438050 - DNA, 18 bp, Homo sapiens
tctgggagtcaggcccgg

SEQ ID NO: 6438051 - DNA, 19 bp, Homo sapiens
tctgggagtcaggcccggc

SEQ ID NO: 6438052 - DNA, 17 bp, Homo sapiens
tctgggagtcctgtcag

SEQ ID NO: 6438053 - DNA, 19 bp, Homo sapiens
tctgggagtgttctgtttc

SEQ ID NO: 6438054 - DNA, 20 bp, Homo sapiens
tctgggatcggggtggggac

SEQ ID NO: 6438055 - DNA, 21 bp, Homo sapiens
tctgggatctgttttctggaa

SEQ ID NO: 6438056 - DNA, 22 bp, Homo sapiens
tctgggatgtggtattggtgct

SEQ ID NO: 6438057 - DNA, 17 bp, Homo sapiens
tctgggattaagggcaa

SEQ ID NO: 6438058 - DNA, 17 bp, Homo sapiens
tctgggcaagaggaaaa

SEQ ID NO: 6438059 - DNA, 17 bp, Homo sapiens
tctgggcaagggctcct

SEQ ID NO: 6438060 - DNA, 16 bp, Homo sapiens
tctgggcacaagcagg

SEQ ID NO: 6438061 - DNA, 18 bp, Homo sapiens
tctgggcacaagcagggc

SEQ ID NO: 6438062 - DNA, 18 bp, Homo sapiens
tctgggcacactctgcca

SEQ ID NO: 6438063 - DNA, 20 bp, Homo sapiens
tctgggcaccacaaaatata

SEQ ID NO: 6438064 - DNA, 21 bp, Homo sapiens
tctgggcagcacctctggtca

SEQ ID NO: 6438065 - DNA, 14 bp, Homo sapiens
tctgggcagcctgc

SEQ ID NO: 6438066 - DNA, 15 bp, Homo sapiens
tctgggcagcctgct

SEQ ID NO: 6438067 - DNA, 20 bp, Homo sapiens
tctgggcaggactcagctcc

SEQ ID NO: 6438068 - DNA, 14 bp, Homo sapiens
tctgggcagtgcca

SEQ ID NO: 6438069 - DNA, 22 bp, Homo sapiens
tctgggcagtgccacagcctgc

SEQ ID NO: 6438070 - DNA, 18 bp, Homo sapiens
tctgggcagtgtggcctc

SEQ ID NO: 6438071 - DNA, 19 bp, Homo sapiens
tctgggcagtgtggcctct

SEQ ID NO: 6438072 - DNA, 21 bp, Homo sapiens
tctgggcattttcctcctctg

SEQ ID NO: 6438073 - DNA, 12 bp, Homo sapiens
tctgggccaagt

SEQ ID NO: 6438074 - DNA, 23 bp, Homo sapiens
tctgggccaagttcctctagtgc

SEQ ID NO: 6438075 - DNA, 15 bp, Homo sapiens
tctgggccagaattt

SEQ ID NO: 6438076 - DNA, 16 bp, Homo sapiens
tctgggccccaggcac

SEQ ID NO: 6438077 - DNA, 15 bp, Homo sapiens
tctgggccctgcagg

SEQ ID NO: 6438078 - DNA, 19 bp, Homo sapiens
tctgggccctgcaggaggc

SEQ ID NO: 6438079 - DNA, 22 bp, Homo sapiens
tctgggccctgcaggaggcctg

SEQ ID NO: 6438080 - DNA, 12 bp, Homo sapiens
tctgggcctctt

SEQ ID NO: 6438081 - DNA, 12 bp, Homo sapiens
tctgggcctgac

SEQ ID NO: 6438082 - DNA, 20 bp, Homo sapiens
tctgggcctgatggagagga

SEQ ID NO: 6438083 - DNA, 17 bp, Homo sapiens
tctgggcctgggctagg

SEQ ID NO: 6438084 - DNA, 21 bp, Homo sapiens
tctgggcctgggttccaggga

SEQ ID NO: 6438085 - DNA, 15 bp, Homo sapiens
tctgggcctgttctc

SEQ ID NO: 6438086 - DNA, 17 bp, Homo sapiens
tctgggcgtccagctca

SEQ ID NO: 6438087 - DNA, 20 bp, Homo sapiens
tctgggcgtccagctcagcc

SEQ ID NO: 6438088 - DNA, 21 bp, Homo sapiens
tctgggcgtccagctcagccc

SEQ ID NO: 6438089 - DNA, 17 bp, Homo sapiens
tctgggctaggtagaaa

SEQ ID NO: 6438090 - DNA, 18 bp, Homo sapiens
tctgggctatggacacag

SEQ ID NO: 6438091 - DNA, 19 bp, Homo sapiens
tcagttgttagtgtgtctt

SEQ ID NO: 6438092 - DNA, 15 bp, Homo sapiens
tcagttgttatttat

SEQ ID NO: 6438093 - DNA, 20 bp, Homo sapiens
tcagttgttatttattgaaa

SEQ ID NO: 6438094 - DNA, 15 bp, Homo sapiens
tcagttgttcttttt

SEQ ID NO: 6438095 - DNA, 12 bp, Homo sapiens
tcagttgttttc

SEQ ID NO: 6438096 - DNA, 23 bp, Homo sapiens
tcagtttaaggtacactgtttcc

SEQ ID NO: 6438097 - DNA, 15 bp, Homo sapiens
tcagtttaattctgt

SEQ ID NO: 6438098 - DNA, 21 bp, Homo sapiens
tcagtttaggccttggcttga

SEQ ID NO: 6438099 - DNA, 14 bp, Homo sapiens
tcagtttatcctga

SEQ ID NO: 6438100 - DNA, 16 bp, Homo sapiens
tcagtttatcctgaca

SEQ ID NO: 6438101 - DNA, 14 bp, Homo sapiens
tcagtttatgtttt

SEQ ID NO: 6438102 - DNA, 16 bp, Homo sapiens
tcagtttatgttttgg

SEQ ID NO: 6438103 - DNA, 16 bp, Homo sapiens
tcagtttatttccact

SEQ ID NO: 6438104 - DNA, 21 bp, Homo sapiens
tcagtttattttttcttctgt

SEQ ID NO: 6438105 - DNA, 19 bp, Homo sapiens
tcagtttcacatatttgta

SEQ ID NO: 6438106 - DNA, 14 bp, Homo sapiens
tcagtttcactccc

SEQ ID NO: 6438107 - DNA, 15 bp, Homo sapiens
tcagtttcactccct

SEQ ID NO: 6438108 - DNA, 19 bp, Homo sapiens
tcagtttcataaaaggaga

SEQ ID NO: 6438109 - DNA, 16 bp, Homo sapiens
tcagtttcatatatta

SEQ ID NO: 6438110 - DNA, 14 bp, Homo sapiens
tcagtttcatgaaa

SEQ ID NO: 6438111 - DNA, 23 bp, Homo sapiens
tcagtttccccattgacttgcac

SEQ ID NO: 6438112 - DNA, 17 bp, Homo sapiens
tcagtttccctatctgc

SEQ ID NO: 6438113 - DNA, 18 bp, Homo sapiens
tcagtttccctatctgca

SEQ ID NO: 6438114 - DNA, 10 bp, Homo sapiens
tcagtttctc

SEQ ID NO: 6438115 - DNA, 13 bp, Homo sapiens
tcagtttctctgg

SEQ ID NO: 6438116 - DNA, 15 bp, Homo sapiens
tcagtttctgcctgg

SEQ ID NO: 6438117 - DNA, 18 bp, Homo sapiens
tcagtttctgcctgggca

SEQ ID NO: 6438118 - DNA, 20 bp, Homo sapiens
tcagtttgaaaatattttgt

SEQ ID NO: 6438119 - DNA, 12 bp, Homo sapiens
tcagtttgatca

SEQ ID NO: 6438120 - DNA, 19 bp, Homo sapiens
tcagtttgctagcagaaat

SEQ ID NO: 6438121 - DNA, 21 bp, Homo sapiens
tcagtttggctgtaatttaat

SEQ ID NO: 6438122 - DNA, 21 bp, Homo sapiens
tcagtttgtccacacaagaca

SEQ ID NO: 6438123 - DNA, 12 bp, Homo sapiens
tcagtttgtgaa

SEQ ID NO: 6438124 - DNA, 13 bp, Homo sapiens
tcagtttgtgaag

SEQ ID NO: 6438125 - DNA, 17 bp, Homo sapiens
tcagtttgtgtgtctta

SEQ ID NO: 6438126 - DNA, 20 bp, Homo sapiens
tcagtttgttccttttgtac

SEQ ID NO: 6438127 - DNA, 19 bp, Homo sapiens
tcagttttatcattttcaa

SEQ ID NO: 6438128 - DNA, 13 bp, Homo sapiens
tcagttttcacag

SEQ ID NO: 6438129 - DNA, 18 bp, Homo sapiens
tcagttttcacagaggcg

SEQ ID NO: 6438130 - DNA, 23 bp, Homo sapiens
tcagttttcagctatacctgcac

SEQ ID NO: 6438131 - DNA, 13 bp, Homo sapiens
tcagttttcccac

SEQ ID NO: 6438132 - DNA, 16 bp, Homo sapiens
tcagttttcccacttt

SEQ ID NO: 6438133 - DNA, 14 bp, Homo sapiens
tcagttttccttct

SEQ ID NO: 6438134 - DNA, 17 bp, Homo sapiens
tcagtttttaaaatatt

SEQ ID NO: 6438135 - DNA, 18 bp, Homo sapiens
tcagtttttattaatcta

SEQ ID NO: 6438136 - DNA, 23 bp, Homo sapiens
tcagtttttcatttgttttgctt

SEQ ID NO: 6438137 - DNA, 13 bp, Homo sapiens
tcagtttttcctc

SEQ ID NO: 6438138 - DNA, 23 bp, Homo sapiens
tcagtttttcggtgggacagccc

SEQ ID NO: 6438139 - DNA, 23 bp, Homo sapiens
tcagtttttgctgattgctaagg

SEQ ID NO: 6438140 - DNA, 17 bp, Homo sapiens
tcagtttttgtgaaaag

SEQ ID NO: 6438141 - DNA, 14 bp, Homo sapiens
tcagtttttgttct

SEQ ID NO: 6438142 - DNA, 17 bp, Homo sapiens
tcagttttttgttttac

SEQ ID NO: 6438143 - DNA, 15 bp, Homo sapiens
tcagtttttttttat

SEQ ID NO: 6438144 - DNA, 17 bp, Homo sapiens
tcagtttttttttgtat

SEQ ID NO: 6438145 - DNA, 15 bp, Homo sapiens
tcataaaaaataaca

SEQ ID NO: 6438146 - DNA, 20 bp, Homo sapiens
tcataaaaaataacaactga

SEQ ID NO: 6438147 - DNA, 15 bp, Homo sapiens
tcataaaaactgctt

SEQ ID NO: 6438148 - DNA, 14 bp, Homo sapiens
tcataaaaataacc

SEQ ID NO: 6438149 - DNA, 20 bp, Homo sapiens
tcataaaaatctagcacact

SEQ ID NO: 6438150 - DNA, 16 bp, Homo sapiens
tcataaaataaagtat

SEQ ID NO: 6438151 - DNA, 14 bp, Homo sapiens
tcataaaatgcata

SEQ ID NO: 6438152 - DNA, 22 bp, Homo sapiens
tcataaaatgcatactgttgat

SEQ ID NO: 6438153 - DNA, 13 bp, Homo sapiens
tcataaaatgcta

SEQ ID NO: 6438154 - DNA, 16 bp, Homo sapiens
tcataaaccttaagta

SEQ ID NO: 6438155 - DNA, 13 bp, Homo sapiens
tcataaagaaaaa

SEQ ID NO: 6438156 - DNA, 21 bp, Homo sapiens
tcataaagagcacgttttcca

SEQ ID NO: 6438157 - DNA, 20 bp, Homo sapiens
tcataaagatgttaaatgga

SEQ ID NO: 6438158 - DNA, 20 bp, Homo sapiens
tcataaaggatatttcaaat

SEQ ID NO: 6438159 - DNA, 20 bp, Homo sapiens
tcataaagggttgaaaatgt

SEQ ID NO: 6438160 - DNA, 21 bp, Homo sapiens
tcataaagggttgaaaatgtg

SEQ ID NO: 6438161 - DNA, 22 bp, Homo sapiens
tcataaagtaatgatgaaatct

SEQ ID NO: 6438162 - DNA, 15 bp, Homo sapiens
tcataaagtacttga

SEQ ID NO: 6438163 - DNA, 13 bp, Homo sapiens
tcataaagtatgc

SEQ ID NO: 6438164 - DNA, 11 bp, Homo sapiens
tcataaatgaa

SEQ ID NO: 6438165 - DNA, 17 bp, Homo sapiens
tcataaatgtcacaata

SEQ ID NO: 6438166 - DNA, 21 bp, Homo sapiens
tcataaattaatgattctgaa

SEQ ID NO: 6438167 - DNA, 14 bp, Homo sapiens
tcataaattacaca

SEQ ID NO: 6438168 - DNA, 24 bp, Homo sapiens
tcataaattcaaacctaagttgct

SEQ ID NO: 6438169 - DNA, 20 bp, Homo sapiens
tcataaattggctcctttcc

SEQ ID NO: 6438170 - DNA, 16 bp, Homo sapiens
tcataaatttacttta

SEQ ID NO: 6438171 - DNA, 16 bp, Homo sapiens
tcataaatttatggtt

SEQ ID NO: 6438172 - DNA, 21 bp, Homo sapiens
tcataaatttgaataagcaga

SEQ ID NO: 6438173 - DNA, 23 bp, Homo sapiens
tcataaatttgttgtcatgtgta

SEQ ID NO: 6438174 - DNA, 24 bp, Homo sapiens
tcataaatttgttgtcatgtgtat

SEQ ID NO: 6438175 - DNA, 13 bp, Homo sapiens
tcataacaatgta

SEQ ID NO: 6438176 - DNA, 12 bp, Homo sapiens
tcataacagcaa

SEQ ID NO: 6438177 - DNA, 16 bp, Homo sapiens
tcataacagtgccatt

SEQ ID NO: 6438178 - DNA, 22 bp, Homo sapiens
tcataacagtgccattgtcttt

SEQ ID NO: 6438179 - DNA, 14 bp, Homo sapiens
tcataacggatcag

SEQ ID NO: 6438180 - DNA, 21 bp, Homo sapiens
tcataacggatcagaaataca

SEQ ID NO: 6438181 - DNA, 23 bp, Homo sapiens
tcataactaatgaattgaaattt

SEQ ID NO: 6438182 - DNA, 18 bp, Homo sapiens
tcataactagagtatgtg

SEQ ID NO: 6438183 - DNA, 23 bp, Homo sapiens
tcataactagagtatgtgtatgt

SEQ ID NO: 6438184 - DNA, 14 bp, Homo sapiens
tcataactcacttt

SEQ ID NO: 6438185 - DNA, 22 bp, Homo sapiens
tcataactggtagctataactt

SEQ ID NO: 6438186 - DNA, 16 bp, Homo sapiens
tcataactgtgtcatt

SEQ ID NO: 6438187 - DNA, 22 bp, Homo sapiens
tcataacttaataaatattgta

SEQ ID NO: 6438188 - DNA, 21 bp, Homo sapiens
tcataacttattgctgatttt

SEQ ID NO: 6438189 - DNA, 14 bp, Homo sapiens
tcataacttgctga

SEQ ID NO: 6438190 - DNA, 17 bp, Homo sapiens
tcataactttcattaaa

SEQ ID NO: 6438191 - DNA, 21 bp, Homo sapiens
tcataagaatttttcagcact

SEQ ID NO: 6438192 - DNA, 19 bp, Homo sapiens
tcataagagtaacagtcat

SEQ ID NO: 6438193 - DNA, 21 bp, Homo sapiens
tcataagatattctttacaaa

SEQ ID NO: 6438194 - DNA, 18 bp, Homo sapiens
tcataagatatttttcat

SEQ ID NO: 6438195 - DNA, 13 bp, Homo sapiens
tcataagcacact

SEQ ID NO: 6438196 - DNA, 15 bp, Homo sapiens
tcataagccaatttt

SEQ ID NO: 6438197 - DNA, 23 bp, Homo sapiens
tcataagccaatttttctgcact

SEQ ID NO: 6438198 - DNA, 16 bp, Homo sapiens
tcataagcgatcactt

SEQ ID NO: 6438199 - DNA, 22 bp, Homo sapiens
tcataagctgtagaactctgca

SEQ ID NO: 6438200 - DNA, 16 bp, Homo sapiens
tcataagctttgtaat

SEQ ID NO: 6438201 - DNA, 19 bp, Homo sapiens
tcataaggaagttattaac

SEQ ID NO: 6438202 - DNA, 20 bp, Homo sapiens
tcataaggagacttctgtct

SEQ ID NO: 6438203 - DNA, 14 bp, Homo sapiens
tcataaggcttcaa

SEQ ID NO: 6438204 - DNA, 20 bp, Homo sapiens
tcataaggttttattcatat

SEQ ID NO: 6438205 - DNA, 15 bp, Homo sapiens
tcataagtaaaccta

SEQ ID NO: 6438206 - DNA, 20 bp, Homo sapiens
tcataagtaaacctagtaaa

SEQ ID NO: 6438207 - DNA, 14 bp, Homo sapiens
tcataagtaaatgt

SEQ ID NO: 6438208 - DNA, 20 bp, Homo sapiens
tcataagtattatgtctctt

SEQ ID NO: 6438209 - DNA, 16 bp, Homo sapiens
tcataagtatttggaa

SEQ ID NO: 6438210 - DNA, 15 bp, Homo sapiens
tcataagtgaatatt

SEQ ID NO: 6438211 - DNA, 23 bp, Homo sapiens
tcataagttggaccagaggaagc

SEQ ID NO: 6438212 - DNA, 13 bp, Homo sapiens
tcataataaagtt

SEQ ID NO: 6438213 - DNA, 16 bp, Homo sapiens
tcataataaatagaca

SEQ ID NO: 6438214 - DNA, 13 bp, Homo sapiens
tcataatacataa

SEQ ID NO: 6438215 - DNA, 21 bp, Homo sapiens
tcataatatattgtgttttaa

SEQ ID NO: 6438216 - DNA, 19 bp, Homo sapiens
tcataatatttgaacaaaa

SEQ ID NO: 6438217 - DNA, 14 bp, Homo sapiens
tcataatcagtaaa

SEQ ID NO: 6438218 - DNA, 18 bp, Homo sapiens
tcataatcagtaaatagt

SEQ ID NO: 6438219 - DNA, 17 bp, Homo sapiens
tcataatctctttccat

SEQ ID NO: 6438220 - DNA, 20 bp, Homo sapiens
tcataatctctttccatctt

SEQ ID NO: 6438221 - DNA, 15 bp, Homo sapiens
tcataatctttgctt

SEQ ID NO: 6438222 - DNA, 17 bp, Homo sapiens
tcataatgaataaagtg

SEQ ID NO: 6438223 - DNA, 21 bp, Homo sapiens
tcataatgaattataacagtt

SEQ ID NO: 6438224 - DNA, 16 bp, Homo sapiens
tcataatgctttgtta

SEQ ID NO: 6438225 - DNA, 20 bp, Homo sapiens
tcataatggtgaatgttcaa

SEQ ID NO: 6438226 - DNA, 13 bp, Homo sapiens
tcataatgtatta

SEQ ID NO: 6438227 - DNA, 14 bp, Homo sapiens
tcataatgtattat

SEQ ID NO: 6438228 - DNA, 20 bp, Homo sapiens
tcataattaaaatttatctt

SEQ ID NO: 6438229 - DNA, 14 bp, Homo sapiens
tcataattagaaca

SEQ ID NO: 6438230 - DNA, 17 bp, Homo sapiens
tcataattagaacaata

SEQ ID NO: 6438231 - DNA, 15 bp, Homo sapiens
tcataattattttgt

SEQ ID NO: 6438232 - DNA, 16 bp, Homo sapiens
tcataattattttgtt

SEQ ID NO: 6438233 - DNA, 22 bp, Homo sapiens
tcataattcagaactaaatttt

SEQ ID NO: 6438234 - DNA, 12 bp, Homo sapiens
tcataattcatt

SEQ ID NO: 6438235 - DNA, 14 bp, Homo sapiens
tcataattcattta

SEQ ID NO: 6438236 - DNA, 18 bp, Homo sapiens
tcataattcatttaagaa

SEQ ID NO: 6438237 - DNA, 13 bp, Homo sapiens
tcataattctgaa

SEQ ID NO: 6438238 - DNA, 21 bp, Homo sapiens
tcataattgtcaaaaaccaga

SEQ ID NO: 6438239 - DNA, 16 bp, Homo sapiens
tcataatttgtttcca

SEQ ID NO: 6438240 - DNA, 19 bp, Homo sapiens
tcataatttgtttccagca

SEQ ID NO: 6438241 - DNA, 14 bp, Homo sapiens
tcataattttcaaa

SEQ ID NO: 6438242 - DNA, 15 bp, Homo sapiens
tcataattttcaaga

SEQ ID NO: 6438243 - DNA, 19 bp, Homo sapiens
tcatacaaaactgttcacg

SEQ ID NO: 6438244 - DNA, 21 bp, Homo sapiens
tcatacaaaggacagtacaca

SEQ ID NO: 6438245 - DNA, 20 bp, Homo sapiens
tcatacaaatactatccaaa

SEQ ID NO: 6438246 - DNA, 21 bp, Homo sapiens
tcatacaaatactatccaaat

SEQ ID NO: 6438247 - DNA, 14 bp, Homo sapiens
tcatacaagccatt

SEQ ID NO: 6438248 - DNA, 23 bp, Homo sapiens
tcatacaagtcatggtcacagta

SEQ ID NO: 6438249 - DNA, 23 bp, Homo sapiens
tcatacaatgacaagtatgatga

SEQ ID NO: 6438250 - DNA, 16 bp, Homo sapiens
tcatacaccagaagac

SEQ ID NO: 6438251 - DNA, 11 bp, Homo sapiens
tcatacagaga

SEQ ID NO: 6438252 - DNA, 14 bp, Homo sapiens
tcatacagagaagt

SEQ ID NO: 6438253 - DNA, 17 bp, Homo sapiens
tcatacagagaagtcac

SEQ ID NO: 6438254 - DNA, 13 bp, Homo sapiens
tcatacagtttta

SEQ ID NO: 6438255 - DNA, 22 bp, Homo sapiens
tcatacatccctcagtttctta

SEQ ID NO: 6438256 - DNA, 14 bp, Homo sapiens
tcatacattttcta

SEQ ID NO: 6438257 - DNA, 22 bp, Homo sapiens
tcataccacttgaatttattga

SEQ ID NO: 6438258 - DNA, 22 bp, Homo sapiens
tcataccgcctcgtgccagcag

SEQ ID NO: 6438259 - DNA, 23 bp, Homo sapiens
tcataccgcctcgtgccagcagc

SEQ ID NO: 6438260 - DNA, 14 bp, Homo sapiens
tcatacctctgacc

SEQ ID NO: 6438261 - DNA, 20 bp, Homo sapiens
tcatacctgctcctcatctg

SEQ ID NO: 6438262 - DNA, 17 bp, Homo sapiens
tcatacgcatcccatct

SEQ ID NO: 6438263 - DNA, 14 bp, Homo sapiens
tcatacgtccacca

SEQ ID NO: 6438264 - DNA, 15 bp, Homo sapiens
tcatactaaataaaa

SEQ ID NO: 6438265 - DNA, 22 bp, Homo sapiens
tcatactaccggctacatcaaa

SEQ ID NO: 6438266 - DNA, 20 bp, Homo sapiens
tcatactactgaaacagatt

SEQ ID NO: 6438267 - DNA, 16 bp, Homo sapiens
tcatactatttaagag

SEQ ID NO: 6438268 - DNA, 20 bp, Homo sapiens
tcatactcctatgctttagc

SEQ ID NO: 6438269 - DNA, 18 bp, Homo sapiens
aagaagacaaatgacaga

SEQ ID NO: 6438270 - DNA, 21 bp, Homo sapiens
aagaagacagcaaaaaaagca

SEQ ID NO: 6438271 - DNA, 11 bp, Homo sapiens
aagaagacata

SEQ ID NO: 6438272 - DNA, 14 bp, Homo sapiens
aagaagacatgaca

SEQ ID NO: 6438273 - DNA, 17 bp, Homo sapiens
aagaagacatggagact

SEQ ID NO: 6438274 - DNA, 12 bp, Homo sapiens
aagaagacattt

SEQ ID NO: 6438275 - DNA, 13 bp, Homo sapiens
aagaagacatttt

SEQ ID NO: 6438276 - DNA, 14 bp, Homo sapiens
aagaagacattttc

SEQ ID NO: 6438277 - DNA, 17 bp, Homo sapiens
aagaagaccagtcacag

SEQ ID NO: 6438278 - DNA, 24 bp, Homo sapiens
aagaagaccctttgttgaaaaatg

SEQ ID NO: 6438279 - DNA, 20 bp, Homo sapiens
aagaagactgcattatattt

SEQ ID NO: 6438280 - DNA, 14 bp, Homo sapiens
aagaagagaaagaa

SEQ ID NO: 6438281 - DNA, 11 bp, Homo sapiens
aagaagagaca

SEQ ID NO: 6438282 - DNA, 15 bp, Homo sapiens
aagaagagccacagt

SEQ ID NO: 6438283 - DNA, 15 bp, Homo sapiens
aagaagagctatcag

SEQ ID NO: 6438284 - DNA, 18 bp, Homo sapiens
aagaagaggagaaaaaga

SEQ ID NO: 6438285 - DNA, 12 bp, Homo sapiens
aagaagaggagc

SEQ ID NO: 6438286 - DNA, 16 bp, Homo sapiens
aagaagaggagcctca

SEQ ID NO: 6438287 - DNA, 17 bp, Homo sapiens
aagaagaggagcctcag

SEQ ID NO: 6438288 - DNA, 15 bp, Homo sapiens
aagaagaggaggaag

SEQ ID NO: 6438289 - DNA, 12 bp, Homo sapiens
aagaagagtttg

SEQ ID NO: 6438290 - DNA, 17 bp, Homo sapiens
aagaagatagttgtaaa

SEQ ID NO: 6438291 - DNA, 21 bp, Homo sapiens
aagaagatagttgtaaagata

SEQ ID NO: 6438292 - DNA, 22 bp, Homo sapiens
aagaagatgatcagtggacagt

SEQ ID NO: 6438293 - DNA, 14 bp, Homo sapiens
aagaagatgtttaa

SEQ ID NO: 6438294 - DNA, 17 bp, Homo sapiens
aagaagattcaagagga

SEQ ID NO: 6438295 - DNA, 22 bp, Homo sapiens
aagaagattctcgccccttccc

SEQ ID NO: 6438296 - DNA, 23 bp, Homo sapiens
aagaagcaaagttcaacttattt

SEQ ID NO: 6438297 - DNA, 16 bp, Homo sapiens
aagaagcaataactat

SEQ ID NO: 6438298 - DNA, 17 bp, Homo sapiens
aagaagcaataactatt

SEQ ID NO: 6438299 - DNA, 17 bp, Homo sapiens
aagaagcaatctttgaa

SEQ ID NO: 6438300 - DNA, 23 bp, Homo sapiens
aagaagcaattatttaaagaaag

SEQ ID NO: 6438301 - DNA, 11 bp, Homo sapiens
aagaagcagcg

SEQ ID NO: 6438302 - DNA, 14 bp, Homo sapiens
aagaagcaggctac

SEQ ID NO: 6438303 - DNA, 22 bp, Homo sapiens
aagaagcagtggccttattgca

SEQ ID NO: 6438304 - DNA, 21 bp, Homo sapiens
aagaagcattgaaaacaaaga

SEQ ID NO: 6438305 - DNA, 12 bp, Homo sapiens
aagaagcatttc

SEQ ID NO: 6438306 - DNA, 22 bp, Homo sapiens
aagaagcattttgtaagttgaa

SEQ ID NO: 6438307 - DNA, 12 bp, Homo sapiens
aagaagccacag

SEQ ID NO: 6438308 - DNA, 11 bp, Homo sapiens
aagaagccata

SEQ ID NO: 6438309 - DNA, 23 bp, Homo sapiens
aagaagccatatatgaccagaag

SEQ ID NO: 6438310 - DNA, 21 bp, Homo sapiens
aagaagccatcaattttaaca

SEQ ID NO: 6438311 - DNA, 22 bp, Homo sapiens
aagaagccatttagggcagcaa

SEQ ID NO: 6438312 - DNA, 16 bp, Homo sapiens
aagaagcccaggaaag

SEQ ID NO: 6438313 - DNA, 15 bp, Homo sapiens
aagaagcccccagct

SEQ ID NO: 6438314 - DNA, 19 bp, Homo sapiens
aagaagcccccagctaaga

SEQ ID NO: 6438315 - DNA, 17 bp, Homo sapiens
aagaagccccttatttt

SEQ ID NO: 6438316 - DNA, 22 bp, Homo sapiens
aagaagccccttatttttagcc

SEQ ID NO: 6438317 - DNA, 19 bp, Homo sapiens
aagaagcccgatccacatt

SEQ ID NO: 6438318 - DNA, 17 bp, Homo sapiens
aagaagcccggctcctg

SEQ ID NO: 6438319 - DNA, 18 bp, Homo sapiens
aagaagccctgcagagca

SEQ ID NO: 6438320 - DNA, 14 bp, Homo sapiens
aagaagccctgttc

SEQ ID NO: 6438321 - DNA, 15 bp, Homo sapiens
aagaagccctgttct

SEQ ID NO: 6438322 - DNA, 15 bp, Homo sapiens
aagaagcctagaaaa

SEQ ID NO: 6438323 - DNA, 19 bp, Homo sapiens
aagaagctaaaatgaaaaa

SEQ ID NO: 6438324 - DNA, 19 bp, Homo sapiens
aagaagctcgccccacctc

SEQ ID NO: 6438325 - DNA, 20 bp, Homo sapiens
aagaagctcgccccacctcc

SEQ ID NO: 6438326 - DNA, 19 bp, Homo sapiens
aagaagctctccaggcccc

SEQ ID NO: 6438327 - DNA, 14 bp, Homo sapiens
aagaagctgaggat

SEQ ID NO: 6438328 - DNA, 11 bp, Homo sapiens
aagaagctgct

SEQ ID NO: 6438329 - DNA, 17 bp, Homo sapiens
aagaagctgcttctgcc

SEQ ID NO: 6438330 - DNA, 13 bp, Homo sapiens
aagaagctggcta

SEQ ID NO: 6438331 - DNA, 14 bp, Homo sapiens
aagaagctgtcttg

SEQ ID NO: 6438332 - DNA, 22 bp, Homo sapiens
aagaagctgtcttggaagtctg

SEQ ID NO: 6438333 - DNA, 14 bp, Homo sapiens
aagaagctgtgaat

SEQ ID NO: 6438334 - DNA, 21 bp, Homo sapiens
aagaagctgttgtacatttat

SEQ ID NO: 6438335 - DNA, 22 bp, Homo sapiens
aagaagctgttgtacatttatg

SEQ ID NO: 6438336 - DNA, 23 bp, Homo sapiens
aagaagctgttgtacatttatga

SEQ ID NO: 6438337 - DNA, 14 bp, Homo sapiens
aagaagcttccaca

SEQ ID NO: 6438338 - DNA, 16 bp, Homo sapiens
aagaagcttccacaaa

SEQ ID NO: 6438339 - DNA, 15 bp, Homo sapiens
aagaagcttctaata

SEQ ID NO: 6438340 - DNA, 22 bp, Homo sapiens
aagaagcttctaataaattata

SEQ ID NO: 6438341 - DNA, 21 bp, Homo sapiens
aagaagctttaatatttaaat

SEQ ID NO: 6438342 - DNA, 13 bp, Homo sapiens
aagaagctttatc

SEQ ID NO: 6438343 - DNA, 16 bp, Homo sapiens
aagaagctttatttct

SEQ ID NO: 6438344 - DNA, 16 bp, Homo sapiens
aagaaggaaaatgatc

SEQ ID NO: 6438345 - DNA, 23 bp, Homo sapiens
aagaaggaaaatgatctgagtcc

SEQ ID NO: 6438346 - DNA, 14 bp, Homo sapiens
aagaaggaaagatg

SEQ ID NO: 6438347 - DNA, 17 bp, Homo sapiens
aagaaggaaagggaaga

SEQ ID NO: 6438348 - DNA, 13 bp, Homo sapiens
aagaaggaaggcc

SEQ ID NO: 6438349 - DNA, 11 bp, Homo sapiens
aagaaggaagt

SEQ ID NO: 6438350 - DNA, 23 bp, Homo sapiens
aagaaggaatataccttttttgt

SEQ ID NO: 6438351 - DNA, 16 bp, Homo sapiens
aagaaggaccagtgaa

SEQ ID NO: 6438352 - DNA, 14 bp, Homo sapiens
aagaaggagatgaa

SEQ ID NO: 6438353 - DNA, 22 bp, Homo sapiens
aagaaggagatgaatagaagaa

SEQ ID NO: 6438354 - DNA, 20 bp, Homo sapiens
aagaaggagctcaactaaaa

SEQ ID NO: 6438355 - DNA, 19 bp, Homo sapiens
aagaaggcaaaaatagttt

SEQ ID NO: 6438356 - DNA, 15 bp, Homo sapiens
aagaaggcaatatta

SEQ ID NO: 6438357 - DNA, 22 bp, Homo sapiens
aagaaggcaattttagtgtatt

SEQ ID NO: 6438358 - DNA, 23 bp, Homo sapiens
aagaaggcaattttagtgtatta

SEQ ID NO: 6438359 - DNA, 12 bp, Homo sapiens
aagaaggccaga

SEQ ID NO: 6438360 - DNA, 15 bp, Homo sapiens
aagaaggcccgggag

SEQ ID NO: 6438361 - DNA, 15 bp, Homo sapiens
aagaagggaaattca

SEQ ID NO: 6438362 - DNA, 15 bp, Homo sapiens
aagaagggaagcctt

SEQ ID NO: 6438363 - DNA, 23 bp, Homo sapiens
aagaagggaagccttttgcaaat

SEQ ID NO: 6438364 - DNA, 15 bp, Homo sapiens
aagaagggatcccta

SEQ ID NO: 6438365 - DNA, 13 bp, Homo sapiens
aagaagggatgga

SEQ ID NO: 6438366 - DNA, 22 bp, Homo sapiens
aagaagggctagaacctggagg

SEQ ID NO: 6438367 - DNA, 16 bp, Homo sapiens
aagaagggctggtatt

SEQ ID NO: 6438368 - DNA, 14 bp, Homo sapiens
aagaaggggctcga

SEQ ID NO: 6438369 - DNA, 15 bp, Homo sapiens
aagaagggggccctg

SEQ ID NO: 6438370 - DNA, 22 bp, Homo sapiens
aagaaggggggtctctggcttt

SEQ ID NO: 6438371 - DNA, 17 bp, Homo sapiens
aagaagggggtgggggg

SEQ ID NO: 6438372 - DNA, 16 bp, Homo sapiens
aagaagggtaagtgct

SEQ ID NO: 6438373 - DNA, 20 bp, Homo sapiens
aagaagggtgggagtggggc

SEQ ID NO: 6438374 - DNA, 16 bp, Homo sapiens
aagaaggtggaccttt

SEQ ID NO: 6438375 - DNA, 15 bp, Homo sapiens
aagaagtaggcatga

SEQ ID NO: 6438376 - DNA, 20 bp, Homo sapiens
aagaagtaggggaagacatg

SEQ ID NO: 6438377 - DNA, 17 bp, Homo sapiens
aagaagtatttttttaa

SEQ ID NO: 6438378 - DNA, 19 bp, Homo sapiens
aagaagtatttttttaatt

SEQ ID NO: 6438379 - DNA, 23 bp, Homo sapiens
aagaagtatttttttaatttctg

SEQ ID NO: 6438380 - DNA, 14 bp, Homo sapiens
aagaagtcaaatga

SEQ ID NO: 6438381 - DNA, 19 bp, Homo sapiens
aagaagtcactgaacaaaa

SEQ ID NO: 6438382 - DNA, 18 bp, Homo sapiens
aagaagtcagagaaaaca

SEQ ID NO: 6438383 - DNA, 21 bp, Homo sapiens
aagaagtcagagaaaacactt

SEQ ID NO: 6438384 - DNA, 17 bp, Homo sapiens
aagaagtcagttaacgt

SEQ ID NO: 6438385 - DNA, 21 bp, Homo sapiens
aagaagtccatgtgataattg

SEQ ID NO: 6438386 - DNA, 22 bp, Homo sapiens
aagaagtgaaaatctacactcc

SEQ ID NO: 6438387 - DNA, 15 bp, Homo sapiens
aagaagtgaacactt

SEQ ID NO: 6438388 - DNA, 20 bp, Homo sapiens
aagaagtgaccaaggaggag

SEQ ID NO: 6438389 - DNA, 20 bp, Homo sapiens
aagaagtgagtgtttctatg

SEQ ID NO: 6438390 - DNA, 15 bp, Homo sapiens
aagaagtgcatgaaa

SEQ ID NO: 6438391 - DNA, 16 bp, Homo sapiens
aagaagtggagacagt

SEQ ID NO: 6438392 - DNA, 18 bp, Homo sapiens
aagaagtgggagcagctt

SEQ ID NO: 6438393 - DNA, 20 bp, Homo sapiens
aagaagtgggagtgggagag

SEQ ID NO: 6438394 - DNA, 22 bp, Homo sapiens
aagaagtgggagtgggagagga

SEQ ID NO: 6438395 - DNA, 19 bp, Homo sapiens
aagaagtggggcagcagca

SEQ ID NO: 6438396 - DNA, 16 bp, Homo sapiens
aagaagtggtgttcca

SEQ ID NO: 6438397 - DNA, 18 bp, Homo sapiens
aagaagtggtgttccatg

SEQ ID NO: 6438398 - DNA, 16 bp, Homo sapiens
aagaagtgtccgagaa

SEQ ID NO: 6438399 - DNA, 19 bp, Homo sapiens
aagaagtgtccgagaacta

SEQ ID NO: 6438400 - DNA, 21 bp, Homo sapiens
aagaagtgtgactagatatca

SEQ ID NO: 6438401 - DNA, 14 bp, Homo sapiens
aagaagtgtgagaa

SEQ ID NO: 6438402 - DNA, 19 bp, Homo sapiens
aagaagttaattcttaaaa

SEQ ID NO: 6438403 - DNA, 23 bp, Homo sapiens
aagaagttattttcttgtttaac

SEQ ID NO: 6438404 - DNA, 18 bp, Homo sapiens
aagaagttcaccagccct

SEQ ID NO: 6438405 - DNA, 17 bp, Homo sapiens
aagaagttcattcctgt

SEQ ID NO: 6438406 - DNA, 20 bp, Homo sapiens
aagaagtttctggagcaaga

SEQ ID NO: 6438407 - DNA, 19 bp, Homo sapiens
aagaagtttgggctaacat

SEQ ID NO: 6438408 - DNA, 18 bp, Homo sapiens
aagaagtttgtgtctttg

SEQ ID NO: 6438409 - DNA, 14 bp, Homo sapiens
aagaagtttgttat

SEQ ID NO: 6438410 - DNA, 18 bp, Homo sapiens
aagaagttttaaaaagcc

SEQ ID NO: 6438411 - DNA, 14 bp, Homo sapiens
aagaagttttaact

SEQ ID NO: 6438412 - DNA, 14 bp, Homo sapiens
aagaagttttatgc

SEQ ID NO: 6438413 - DNA, 14 bp, Homo sapiens
aagaagtttttggt

SEQ ID NO: 6438414 - DNA, 13 bp, Homo sapiens
aagaataaaatgt

SEQ ID NO: 6438415 - DNA, 20 bp, Homo sapiens
aagaataaaatgttgaaaag

SEQ ID NO: 6438416 - DNA, 12 bp, Homo sapiens
aagaataaagtc

SEQ ID NO: 6438417 - DNA, 12 bp, Homo sapiens
aagaataaattc

SEQ ID NO: 6438418 - DNA, 13 bp, Homo sapiens
aagaataataaaa

SEQ ID NO: 6438419 - DNA, 14 bp, Homo sapiens
aagaataataaaat

SEQ ID NO: 6438420 - DNA, 21 bp, Homo sapiens
aagaataataaaatacttttt

SEQ ID NO: 6438421 - DNA, 15 bp, Homo sapiens
aagaataataaaatc

SEQ ID NO: 6438422 - DNA, 21 bp, Homo sapiens
aagaataatggactcttaagg

SEQ ID NO: 6438423 - DNA, 21 bp, Homo sapiens
aagaataattcaattttaaag

SEQ ID NO: 6438424 - DNA, 18 bp, Homo sapiens
aagaatacaaacatattt

SEQ ID NO: 6438425 - DNA, 13 bp, Homo sapiens
aagaatacagaaa

SEQ ID NO: 6438426 - DNA, 16 bp, Homo sapiens
aagaatacagaaaatg

SEQ ID NO: 6438427 - DNA, 14 bp, Homo sapiens
aagaatacagaaag

SEQ ID NO: 6438428 - DNA, 15 bp, Homo sapiens
aagaatacagctttc

SEQ ID NO: 6438429 - DNA, 23 bp, Homo sapiens
aagaatacccaggaagactttgt

SEQ ID NO: 6438430 - DNA, 13 bp, Homo sapiens
aagaatacttgaa

SEQ ID NO: 6438431 - DNA, 17 bp, Homo sapiens
aagaatacttgaacttg

SEQ ID NO: 6438432 - DNA, 13 bp, Homo sapiens
aagaatagaaaca

SEQ ID NO: 6438433 - DNA, 21 bp, Homo sapiens
aagaatagcatctgtacaaag

SEQ ID NO: 6438434 - DNA, 23 bp, Homo sapiens
aagaatagcatctgtacaaaggg

SEQ ID NO: 6438435 - DNA, 20 bp, Homo sapiens
aagaatagcctagatatgaa

SEQ ID NO: 6438436 - DNA, 15 bp, Homo sapiens
aagaatagcttatct

SEQ ID NO: 6438437 - DNA, 13 bp, Homo sapiens
aagaataggactt

SEQ ID NO: 6438438 - DNA, 22 bp, Homo sapiens
aagaataggacttgtttttgtt

SEQ ID NO: 6438439 - DNA, 19 bp, Homo sapiens
aagaataggcattaacaca

SEQ ID NO: 6438440 - DNA, 13 bp, Homo sapiens
aagaatagttcta

SEQ ID NO: 6438441 - DNA, 15 bp, Homo sapiens
aagaatatcaaataa

SEQ ID NO: 6438442 - DNA, 18 bp, Homo sapiens
aagaatatcctttaaaat

SEQ ID NO: 6438443 - DNA, 19 bp, Homo sapiens
aagaatatcctttaaaatt

SEQ ID NO: 6438444 - DNA, 19 bp, Homo sapiens
aagaatatcgatataaatt

SEQ ID NO: 6438445 - DNA, 17 bp, Homo sapiens
aagaatatctgtaatgg

SEQ ID NO: 6438446 - DNA, 19 bp, Homo sapiens
aagaatatctgtaatggta

SEQ ID NO: 6438447 - DNA, 17 bp, Homo sapiens
aagaatatgaagttcta

SEQ ID NO: 6438448 - DNA, 16 bp, Homo sapiens
tcatactcgagtctga

SEQ ID NO: 6438449 - DNA, 13 bp, Homo sapiens
tcatactctgtgt

SEQ ID NO: 6438450 - DNA, 16 bp, Homo sapiens
tcatactctgtgtaat

SEQ ID NO: 6438451 - DNA, 13 bp, Homo sapiens
tcatactctgttg

SEQ ID NO: 6438452 - DNA, 19 bp, Homo sapiens
tcatactctgttgcctcct

SEQ ID NO: 6438453 - DNA, 23 bp, Homo sapiens
tcatactctgttgcctcctctct

SEQ ID NO: 6438454 - DNA, 21 bp, Homo sapiens
tcatactgaaattattttctc

SEQ ID NO: 6438455 - DNA, 17 bp, Homo sapiens
tcatactgaaattgttt

SEQ ID NO: 6438456 - DNA, 15 bp, Homo sapiens
tcatactgattttta

SEQ ID NO: 6438457 - DNA, 17 bp, Homo sapiens
tcatactgatttttaag

SEQ ID NO: 6438458 - DNA, 18 bp, Homo sapiens
tcatactgcctactgtta

SEQ ID NO: 6438459 - DNA, 22 bp, Homo sapiens
tcatactgcctactgttactct

SEQ ID NO: 6438460 - DNA, 22 bp, Homo sapiens
tcatactggggtgcgagagagg

SEQ ID NO: 6438461 - DNA, 17 bp, Homo sapiens
tcatactgtacacattt

SEQ ID NO: 6438462 - DNA, 18 bp, Homo sapiens
tcatactgtacacatttc

SEQ ID NO: 6438463 - DNA, 17 bp, Homo sapiens
tcatactgtcatataat

SEQ ID NO: 6438464 - DNA, 13 bp, Homo sapiens
tcatactgtctgg

SEQ ID NO: 6438465 - DNA, 20 bp, Homo sapiens
tcatactgtgctggagccac

SEQ ID NO: 6438466 - DNA, 13 bp, Homo sapiens
tcatacttaaaaa

SEQ ID NO: 6438467 - DNA, 14 bp, Homo sapiens
tcatacttaacatt

SEQ ID NO: 6438468 - DNA, 19 bp, Homo sapiens
tcatacttaactttactaa

SEQ ID NO: 6438469 - DNA, 15 bp, Homo sapiens
tcatacttctaaatc

SEQ ID NO: 6438470 - DNA, 14 bp, Homo sapiens
tcatacttgaacgt

SEQ ID NO: 6438471 - DNA, 21 bp, Homo sapiens
tcatacttgctccttgaataa

SEQ ID NO: 6438472 - DNA, 14 bp, Homo sapiens
tcatactttccaac

SEQ ID NO: 6438473 - DNA, 23 bp, Homo sapiens
tcatactttccaacattatcctg

SEQ ID NO: 6438474 - DNA, 13 bp, Homo sapiens
tcatactttggct

SEQ ID NO: 6438475 - DNA, 20 bp, Homo sapiens
tcatagaaatacctcattcg

SEQ ID NO: 6438476 - DNA, 13 bp, Homo sapiens
tcatagaaattct

SEQ ID NO: 6438477 - DNA, 17 bp, Homo sapiens
tcatagaaattctttat

SEQ ID NO: 6438478 - DNA, 15 bp, Homo sapiens
tcatagaaattgtgt

SEQ ID NO: 6438479 - DNA, 14 bp, Homo sapiens
tcatagaacagaaa

SEQ ID NO: 6438480 - DNA, 19 bp, Homo sapiens
tcatagaacagaaatatat

SEQ ID NO: 6438481 - DNA, 17 bp, Homo sapiens
tcatagaaggagagccc

SEQ ID NO: 6438482 - DNA, 14 bp, Homo sapiens
tcatagaagtgttg

SEQ ID NO: 6438483 - DNA, 18 bp, Homo sapiens
tcatagaatagcatgttg

SEQ ID NO: 6438484 - DNA, 15 bp, Homo sapiens
tcatagaattgcagt

SEQ ID NO: 6438485 - DNA, 14 bp, Homo sapiens
tcatagaattttga

SEQ ID NO: 6438486 - DNA, 20 bp, Homo sapiens
tcatagactcctttgctaat

SEQ ID NO: 6438487 - DNA, 20 bp, Homo sapiens
tcatagagatttgtctaatt

SEQ ID NO: 6438488 - DNA, 20 bp, Homo sapiens
tcatagaggatgatgtaatt

SEQ ID NO: 6438489 - DNA, 19 bp, Homo sapiens
tcatagaggtgagaaaact

SEQ ID NO: 6438490 - DNA, 23 bp, Homo sapiens
tcatagagttgattgtctagtga

SEQ ID NO: 6438491 - DNA, 17 bp, Homo sapiens
tcatagattattataaa

SEQ ID NO: 6438492 - DNA, 20 bp, Homo sapiens
tcatagattattataaacta

SEQ ID NO: 6438493 - DNA, 22 bp, Homo sapiens
tcatagattattataaactata

SEQ ID NO: 6438494 - DNA, 21 bp, Homo sapiens
tcatagattcttgagctgttg

SEQ ID NO: 6438495 - DNA, 23 bp, Homo sapiens
tcatagatttctgattttatgta

SEQ ID NO: 6438496 - DNA, 19 bp, Homo sapiens
tcatagatttgaaaaactt

SEQ ID NO: 6438497 - DNA, 20 bp, Homo sapiens
tcatagcaagcttttgctca

SEQ ID NO: 6438498 - DNA, 17 bp, Homo sapiens
tcatagcaatacttgga

SEQ ID NO: 6438499 - DNA, 15 bp, Homo sapiens
tcatagcactgcaga

SEQ ID NO: 6438500 - DNA, 14 bp, Homo sapiens
tcatagcacttccc

SEQ ID NO: 6438501 - DNA, 18 bp, Homo sapiens
tcatagcatcctgattat

SEQ ID NO: 6438502 - DNA, 21 bp, Homo sapiens
tcatagcattaactaatctat

SEQ ID NO: 6438503 - DNA, 16 bp, Homo sapiens
tcatagcattgtctat

SEQ ID NO: 6438504 - DNA, 15 bp, Homo sapiens
tcatagccaaacagg

SEQ ID NO: 6438505 - DNA, 16 bp, Homo sapiens
tcatagccaaagccag

SEQ ID NO: 6438506 - DNA, 17 bp, Homo sapiens
tcatagccaaagccagg

SEQ ID NO: 6438507 - DNA, 17 bp, Homo sapiens
tcatagccttatgagtt

SEQ ID NO: 6438508 - DNA, 13 bp, Homo sapiens
tcatagctaagaa

SEQ ID NO: 6438509 - DNA, 12 bp, Homo sapiens
tcatagctgaga

SEQ ID NO: 6438510 - DNA, 20 bp, Homo sapiens
tcataggaaaagtacattta

SEQ ID NO: 6438511 - DNA, 20 bp, Homo sapiens
tcataggaagggaccaaggc

SEQ ID NO: 6438512 - DNA, 18 bp, Homo sapiens
tcataggaagtggctggt

SEQ ID NO: 6438513 - DNA, 23 bp, Homo sapiens
tcataggaagtggctggtctgga

SEQ ID NO: 6438514 - DNA, 21 bp, Homo sapiens
tcataggaattggtaaggcct

SEQ ID NO: 6438515 - DNA, 18 bp, Homo sapiens
tcataggcggtcatgtgt

SEQ ID NO: 6438516 - DNA, 19 bp, Homo sapiens
tcataggcggtcatgtgtg

SEQ ID NO: 6438517 - DNA, 20 bp, Homo sapiens
tcataggcggtcatgtgtgc

SEQ ID NO: 6438518 - DNA, 15 bp, Homo sapiens
tcatagggaaaggtt

SEQ ID NO: 6438519 - DNA, 19 bp, Homo sapiens
tcatagggaagacctgctg

SEQ ID NO: 6438520 - DNA, 19 bp, Homo sapiens
tcataggggcatagccagt

SEQ ID NO: 6438521 - DNA, 18 bp, Homo sapiens
tcataggtcactggctct

SEQ ID NO: 6438522 - DNA, 23 bp, Homo sapiens
tcataggtcactggctctccaag

SEQ ID NO: 6438523 - DNA, 22 bp, Homo sapiens
tcataggtctgaaatttttctt

SEQ ID NO: 6438524 - DNA, 23 bp, Homo sapiens
tcataggttaaaaaaaaaagtca

SEQ ID NO: 6438525 - DNA, 20 bp, Homo sapiens
tcataggttgccaataatac

SEQ ID NO: 6438526 - DNA, 22 bp, Homo sapiens
tcataggttttaaatctgcttt

SEQ ID NO: 6438527 - DNA, 14 bp, Homo sapiens
tcatagtaaaatac

SEQ ID NO: 6438528 - DNA, 16 bp, Homo sapiens
tcatagtaacttctta

SEQ ID NO: 6438529 - DNA, 21 bp, Homo sapiens
tcatagtaacttcttatggaa

SEQ ID NO: 6438530 - DNA, 20 bp, Homo sapiens
tcatagtactctttgtagca

SEQ ID NO: 6438531 - DNA, 16 bp, Homo sapiens
tcatagtataaatcta

SEQ ID NO: 6438532 - DNA, 17 bp, Homo sapiens
tcatagtatccatattt

SEQ ID NO: 6438533 - DNA, 14 bp, Homo sapiens
tcatagtattggag

SEQ ID NO: 6438534 - DNA, 22 bp, Homo sapiens
tcatagtcttgaaatgaaaggg

SEQ ID NO: 6438535 - DNA, 18 bp, Homo sapiens
tcatagtgtcaagaagga

SEQ ID NO: 6438536 - DNA, 12 bp, Homo sapiens
tcatagtgtcat

SEQ ID NO: 6438537 - DNA, 15 bp, Homo sapiens
tcatagttaaatgtt

SEQ ID NO: 6438538 - DNA, 14 bp, Homo sapiens
tcatagttactgtg

SEQ ID NO: 6438539 - DNA, 15 bp, Homo sapiens
tcatagttactgtgt

SEQ ID NO: 6438540 - DNA, 18 bp, Homo sapiens
tcatagttatgtgatttt

SEQ ID NO: 6438541 - DNA, 22 bp, Homo sapiens
tcatagttatgtgattttcctt

SEQ ID NO: 6438542 - DNA, 13 bp, Homo sapiens
tcatagttctgtt

SEQ ID NO: 6438543 - DNA, 15 bp, Homo sapiens
tcatagtttaattgg

SEQ ID NO: 6438544 - DNA, 14 bp, Homo sapiens
tcatagtttattat

SEQ ID NO: 6438545 - DNA, 12 bp, Homo sapiens
tcatagttttat

SEQ ID NO: 6438546 - DNA, 15 bp, Homo sapiens
tcatagttttattta

SEQ ID NO: 6438547 - DNA, 12 bp, Homo sapiens
tcatagttttct

SEQ ID NO: 6438548 - DNA, 13 bp, Homo sapiens
tcatataaaaaca

SEQ ID NO: 6438549 - DNA, 19 bp, Homo sapiens
tcatataaaaggtgagctc

SEQ ID NO: 6438550 - DNA, 14 bp, Homo sapiens
tcatataaaatttc

SEQ ID NO: 6438551 - DNA, 13 bp, Homo sapiens
tcatataaagtat

SEQ ID NO: 6438552 - DNA, 18 bp, Homo sapiens
tcatataaagtatcatca

SEQ ID NO: 6438553 - DNA, 12 bp, Homo sapiens
tcatataaagtg

SEQ ID NO: 6438554 - DNA, 21 bp, Homo sapiens
tcatataacagctcaaagagt

SEQ ID NO: 6438555 - DNA, 12 bp, Homo sapiens
tcatataagaca

SEQ ID NO: 6438556 - DNA, 16 bp, Homo sapiens
tcatataataaatgta

SEQ ID NO: 6438557 - DNA, 23 bp, Homo sapiens
tcatataattaaagactcaagag

SEQ ID NO: 6438558 - DNA, 14 bp, Homo sapiens
tcatataatttaaa

SEQ ID NO: 6438559 - DNA, 23 bp, Homo sapiens
tcatataatttgccagacagaga

SEQ ID NO: 6438560 - DNA, 17 bp, Homo sapiens
tcatataccagcaatat

SEQ ID NO: 6438561 - DNA, 15 bp, Homo sapiens
tcatatactgccatg

SEQ ID NO: 6438562 - DNA, 12 bp, Homo sapiens
tcatatacttat

SEQ ID NO: 6438563 - DNA, 11 bp, Homo sapiens
tcatatagacc

SEQ ID NO: 6438564 - DNA, 18 bp, Homo sapiens
tcatatagaccaattgaa

SEQ ID NO: 6438565 - DNA, 22 bp, Homo sapiens
tcatatagcattgataatcttc

SEQ ID NO: 6438566 - DNA, 17 bp, Homo sapiens
tcatatagtcaatgtaa

SEQ ID NO: 6438567 - DNA, 19 bp, Homo sapiens
tcatatagtcaatgtaaaa

SEQ ID NO: 6438568 - DNA, 20 bp, Homo sapiens
tcatatagttagctaataaa

SEQ ID NO: 6438569 - DNA, 17 bp, Homo sapiens
tcatatataataaatta

SEQ ID NO: 6438570 - DNA, 12 bp, Homo sapiens
tcatatatactg

SEQ ID NO: 6438571 - DNA, 20 bp, Homo sapiens
tcatatatactgtatcctga

SEQ ID NO: 6438572 - DNA, 15 bp, Homo sapiens
tcatatatcaaatca

SEQ ID NO: 6438573 - DNA, 13 bp, Homo sapiens
tcatatatcataa

SEQ ID NO: 6438574 - DNA, 14 bp, Homo sapiens
tcatatatctatat

SEQ ID NO: 6438575 - DNA, 16 bp, Homo sapiens
tcatatatgactttat

SEQ ID NO: 6438576 - DNA, 22 bp, Homo sapiens
tcatatatggggggccaacacc

SEQ ID NO: 6438577 - DNA, 14 bp, Homo sapiens
tcatatattatcaa

SEQ ID NO: 6438578 - DNA, 14 bp, Homo sapiens
tcatatattcatgt

SEQ ID NO: 6438579 - DNA, 17 bp, Homo sapiens
tcatatattgcatttct

SEQ ID NO: 6438580 - DNA, 14 bp, Homo sapiens
tcatatatttaaca

SEQ ID NO: 6438581 - DNA, 13 bp, Homo sapiens
tcatatatttaag

SEQ ID NO: 6438582 - DNA, 14 bp, Homo sapiens
tcatatcaaacatt

SEQ ID NO: 6438583 - DNA, 21 bp, Homo sapiens
tcatatcaacttagtcaataa

SEQ ID NO: 6438584 - DNA, 21 bp, Homo sapiens
tcatatcactgaaggatattt

SEQ ID NO: 6438585 - DNA, 21 bp, Homo sapiens
tcatatcagctttatcccttg

SEQ ID NO: 6438586 - DNA, 21 bp, Homo sapiens
tcatatcataggtacaatctt

SEQ ID NO: 6438587 - DNA, 19 bp, Homo sapiens
tcatatcatttcactgtct

SEQ ID NO: 6438588 - DNA, 16 bp, Homo sapiens
tcatatccaagatcaa

SEQ ID NO: 6438589 - DNA, 15 bp, Homo sapiens
tcatatccagctgag

SEQ ID NO: 6438590 - DNA, 23 bp, Homo sapiens
tcatatcctcagaccaggtggaa

SEQ ID NO: 6438591 - DNA, 22 bp, Homo sapiens
tcatatcctctataattgactt

SEQ ID NO: 6438592 - DNA, 15 bp, Homo sapiens
tcatatcctttgccc

SEQ ID NO: 6438593 - DNA, 13 bp, Homo sapiens
tcatatctaaata

SEQ ID NO: 6438594 - DNA, 16 bp, Homo sapiens
tcatatctatgggaaa

SEQ ID NO: 6438595 - DNA, 22 bp, Homo sapiens
tcatatctctcccttctttacc

SEQ ID NO: 6438596 - DNA, 15 bp, Homo sapiens
tcatatcttcacaat

SEQ ID NO: 6438597 - DNA, 18 bp, Homo sapiens
tcatatcttcctcatcag

SEQ ID NO: 6438598 - DNA, 12 bp, Homo sapiens
tcatatgaaaaa

SEQ ID NO: 6438599 - DNA, 21 bp, Homo sapiens
tcatatgaaaaaaatgcattt

SEQ ID NO: 6438600 - DNA, 16 bp, Homo sapiens
tcatatgaaaggtgcc

SEQ ID NO: 6438601 - DNA, 16 bp, Homo sapiens
tcatatgaatgttctt

SEQ ID NO: 6438602 - DNA, 18 bp, Homo sapiens
tcatatgaccattgaaaa

SEQ ID NO: 6438603 - DNA, 20 bp, Homo sapiens
tcatatgaccattgaaaaag

SEQ ID NO: 6438604 - DNA, 23 bp, Homo sapiens
tcatatgaccattgaaaaaggaa

SEQ ID NO: 6438605 - DNA, 16 bp, Homo sapiens
tcatatgagttcctga

SEQ ID NO: 6438606 - DNA, 15 bp, Homo sapiens
tcatatgatctccct

SEQ ID NO: 6438607 - DNA, 13 bp, Homo sapiens
tcatatgcagaac

SEQ ID NO: 6438608 - DNA, 19 bp, Homo sapiens
tcatatgccaccccatgtg

SEQ ID NO: 6438609 - DNA, 23 bp, Homo sapiens
tcatatgccaccccatgtgcctt

SEQ ID NO: 6438610 - DNA, 22 bp, Homo sapiens
tcatatgcttcccagagaagct

SEQ ID NO: 6438611 - DNA, 19 bp, Homo sapiens
tcatatggaaaaaatgtat

SEQ ID NO: 6438612 - DNA, 20 bp, Homo sapiens
tcatatggaaaaaatgtatg

SEQ ID NO: 6438613 - DNA, 18 bp, Homo sapiens
tcatatggagctcatgtc

SEQ ID NO: 6438614 - DNA, 16 bp, Homo sapiens
tcatatgtaatctcta

SEQ ID NO: 6438615 - DNA, 21 bp, Homo sapiens
tcatatgtaccatgtacatga

SEQ ID NO: 6438616 - DNA, 15 bp, Homo sapiens
tcatatgtacttgtt

SEQ ID NO: 6438617 - DNA, 15 bp, Homo sapiens
tcatatgtagccctc

SEQ ID NO: 6438618 - DNA, 23 bp, Homo sapiens
tcatatgtatctaaatgaaaaga

SEQ ID NO: 6438619 - DNA, 13 bp, Homo sapiens
tcatatgtgaaga

SEQ ID NO: 6438620 - DNA, 17 bp, Homo sapiens
tcatatgtgaagacaga

SEQ ID NO: 6438621 - DNA, 15 bp, Homo sapiens
tcatatgtgatctgt

SEQ ID NO: 6438622 - DNA, 18 bp, Homo sapiens
tcatatgtgtctttatag

SEQ ID NO: 6438623 - DNA, 15 bp, Homo sapiens
tcatatgttagatac

SEQ ID NO: 6438624 - DNA, 13 bp, Homo sapiens
tcatatgttgctc

SEQ ID NO: 6438625 - DNA, 14 bp, Homo sapiens
tcatatgttgctca

SEQ ID NO: 6438626 - DNA, 15 bp, Homo sapiens
tcatatgttgctcag

SEQ ID NO: 6438627 - DNA, 21 bp, Homo sapiens
tctgggctatggacacagggt

SEQ ID NO: 6438628 - DNA, 15 bp, Homo sapiens
tctgggctcaagctt

SEQ ID NO: 6438629 - DNA, 20 bp, Homo sapiens
tctgggctcacaccagccct

SEQ ID NO: 6438630 - DNA, 15 bp, Homo sapiens
tctgggctcagggct

SEQ ID NO: 6438631 - DNA, 16 bp, Homo sapiens
tctgggctcagggctg

SEQ ID NO: 6438632 - DNA, 12 bp, Homo sapiens
tctgggctctgg

SEQ ID NO: 6438633 - DNA, 14 bp, Homo sapiens
tctgggctctggac

SEQ ID NO: 6438634 - DNA, 14 bp, Homo sapiens
tctgggctctttcc

SEQ ID NO: 6438635 - DNA, 14 bp, Homo sapiens
tctgggctggctgc

SEQ ID NO: 6438636 - DNA, 18 bp, Homo sapiens
tctgggctggctgctcct

SEQ ID NO: 6438637 - DNA, 13 bp, Homo sapiens
tctgggctgggca

SEQ ID NO: 6438638 - DNA, 17 bp, Homo sapiens
tctgggctgggcacctg

SEQ ID NO: 6438639 - DNA, 13 bp, Homo sapiens
tctgggctggggc

SEQ ID NO: 6438640 - DNA, 22 bp, Homo sapiens
tctgggctgtaacgtggcactg

SEQ ID NO: 6438641 - DNA, 19 bp, Homo sapiens
tctgggctgtctattctag

SEQ ID NO: 6438642 - DNA, 15 bp, Homo sapiens
tctgggctgtggggc

SEQ ID NO: 6438643 - DNA, 16 bp, Homo sapiens
tctgggctgtggggcc

SEQ ID NO: 6438644 - DNA, 14 bp, Homo sapiens
tctgggcttcattc

SEQ ID NO: 6438645 - DNA, 13 bp, Homo sapiens
tctgggcttcctg

SEQ ID NO: 6438646 - DNA, 14 bp, Homo sapiens
tctgggcttcctgg

SEQ ID NO: 6438647 - DNA, 21 bp, Homo sapiens
tctgggcttggggcttcctaa

SEQ ID NO: 6438648 - DNA, 17 bp, Homo sapiens
tctgggctttctcctgg

SEQ ID NO: 6438649 - DNA, 21 bp, Homo sapiens
tctgggcttttccttttgcac

SEQ ID NO: 6438650 - DNA, 20 bp, Homo sapiens
tctggggaaaaaaaagagac

SEQ ID NO: 6438651 - DNA, 13 bp, Homo sapiens
tctggggaaggac

SEQ ID NO: 6438652 - DNA, 14 bp, Homo sapiens
tctggggaagtcag

SEQ ID NO: 6438653 - DNA, 11 bp, Homo sapiens
tctggggacag

SEQ ID NO: 6438654 - DNA, 16 bp, Homo sapiens
tctggggacaggcccg

SEQ ID NO: 6438655 - DNA, 21 bp, Homo sapiens
tctggggaccccaacctcaga

SEQ ID NO: 6438656 - DNA, 20 bp, Homo sapiens
tctggggacccgctgggggc

SEQ ID NO: 6438657 - DNA, 22 bp, Homo sapiens
tctggggacccgctgggggctg

SEQ ID NO: 6438658 - DNA, 17 bp, Homo sapiens
tctggggaccctgtaga

SEQ ID NO: 6438659 - DNA, 23 bp, Homo sapiens
tctggggagaaatccctcagatc

SEQ ID NO: 6438660 - DNA, 21 bp, Homo sapiens
tctggggagagcggctggaga

SEQ ID NO: 6438661 - DNA, 15 bp, Homo sapiens
tctggggagggacac

SEQ ID NO: 6438662 - DNA, 16 bp, Homo sapiens
tctggggatggagaat

SEQ ID NO: 6438663 - DNA, 22 bp, Homo sapiens
tctggggatggagaatgccagc

SEQ ID NO: 6438664 - DNA, 18 bp, Homo sapiens
tctggggatgggtgggga

SEQ ID NO: 6438665 - DNA, 17 bp, Homo sapiens
tctggggatttctggga

SEQ ID NO: 6438666 - DNA, 18 bp, Homo sapiens
tctggggatttctgggat

SEQ ID NO: 6438667 - DNA, 14 bp, Homo sapiens
tctggggcagagct

SEQ ID NO: 6438668 - DNA, 23 bp, Homo sapiens
tctggggcagagcttgtagccct

SEQ ID NO: 6438669 - DNA, 11 bp, Homo sapiens
tctggggcagc

SEQ ID NO: 6438670 - DNA, 15 bp, Homo sapiens
tctggggcaggacca

SEQ ID NO: 6438671 - DNA, 18 bp, Homo sapiens
tctggggcaggctgggcc

SEQ ID NO: 6438672 - DNA, 14 bp, Homo sapiens
tctggggccagccc

SEQ ID NO: 6438673 - DNA, 17 bp, Homo sapiens
tctggggccagcccctc

SEQ ID NO: 6438674 - DNA, 19 bp, Homo sapiens
tctggggccagcccctccc

SEQ ID NO: 6438675 - DNA, 13 bp, Homo sapiens
tctggggcccagg

SEQ ID NO: 6438676 - DNA, 14 bp, Homo sapiens
tctggggcccagga

SEQ ID NO: 6438677 - DNA, 21 bp, Homo sapiens
tctggggccccatcagctgcc

SEQ ID NO: 6438678 - DNA, 13 bp, Homo sapiens
tctggggccctgg

SEQ ID NO: 6438679 - DNA, 19 bp, Homo sapiens
tctggggcctaataaaact

SEQ ID NO: 6438680 - DNA, 17 bp, Homo sapiens
tctggggctcagccctg

SEQ ID NO: 6438681 - DNA, 13 bp, Homo sapiens
tctggggctgtgt

SEQ ID NO: 6438682 - DNA, 14 bp, Homo sapiens
tctgggggaaaaag

SEQ ID NO: 6438683 - DNA, 19 bp, Homo sapiens
tctgggggcacaagactga

SEQ ID NO: 6438684 - DNA, 15 bp, Homo sapiens
tctgggggcagctgt

SEQ ID NO: 6438685 - DNA, 17 bp, Homo sapiens
tctgggggcagctgtcc

SEQ ID NO: 6438686 - DNA, 18 bp, Homo sapiens
tctgggggcagctgtcct

SEQ ID NO: 6438687 - DNA, 19 bp, Homo sapiens
tctgggggcagctgtcctg

SEQ ID NO: 6438688 - DNA, 16 bp, Homo sapiens
tctgggggctctggcc

SEQ ID NO: 6438689 - DNA, 19 bp, Homo sapiens
tctgggggctctggccaag

SEQ ID NO: 6438690 - DNA, 20 bp, Homo sapiens
tctgggggctctggccaagg

SEQ ID NO: 6438691 - DNA, 23 bp, Homo sapiens
tctggggggataatgtccccact

SEQ ID NO: 6438692 - DNA, 20 bp, Homo sapiens
tctggggggcagttgggtag

SEQ ID NO: 6438693 - DNA, 18 bp, Homo sapiens
tctggggggtggccaggc

SEQ ID NO: 6438694 - DNA, 20 bp, Homo sapiens
tctggggggtggccaggccg

SEQ ID NO: 6438695 - DNA, 18 bp, Homo sapiens
tctggggggttgcctcga

SEQ ID NO: 6438696 - DNA, 20 bp, Homo sapiens
tctgggggtaggatgaagag

SEQ ID NO: 6438697 - DNA, 15 bp, Homo sapiens
tctgggggtcctctc

SEQ ID NO: 6438698 - DNA, 18 bp, Homo sapiens
tctgggggtcctctctga

SEQ ID NO: 6438699 - DNA, 22 bp, Homo sapiens
tctgggggtcctctctgagtca

SEQ ID NO: 6438700 - DNA, 13 bp, Homo sapiens
tctgggggtgagg

SEQ ID NO: 6438701 - DNA, 14 bp, Homo sapiens
tctggggtaaaatt

SEQ ID NO: 6438702 - DNA, 22 bp, Homo sapiens
tctggggtaggctgctccctga

SEQ ID NO: 6438703 - DNA, 21 bp, Homo sapiens
tctggggtatggcgtaagtac

SEQ ID NO: 6438704 - DNA, 15 bp, Homo sapiens
tctggggtgagggag

SEQ ID NO: 6438705 - DNA, 19 bp, Homo sapiens
tctggggtgctgcctgaat

SEQ ID NO: 6438706 - DNA, 15 bp, Homo sapiens
tctggggtgggaggg

SEQ ID NO: 6438707 - DNA, 14 bp, Homo sapiens
tctggggtggggct

SEQ ID NO: 6438708 - DNA, 20 bp, Homo sapiens
tctggggtggggcttggaag

SEQ ID NO: 6438709 - DNA, 17 bp, Homo sapiens
tctggggttatgatggc

SEQ ID NO: 6438710 - DNA, 19 bp, Homo sapiens
tctggggttgattcccaga

SEQ ID NO: 6438711 - DNA, 14 bp, Homo sapiens
tctgggtagaagcc

SEQ ID NO: 6438712 - DNA, 21 bp, Homo sapiens
tctgggtagaagccacccttc

SEQ ID NO: 6438713 - DNA, 16 bp, Homo sapiens
tctgggtcaatggaat

SEQ ID NO: 6438714 - DNA, 19 bp, Homo sapiens
tctgggtcatgcactgagg

SEQ ID NO: 6438715 - DNA, 15 bp, Homo sapiens
tctgggtcccggggt

SEQ ID NO: 6438716 - DNA, 16 bp, Homo sapiens
tctgggtccctcggag

SEQ ID NO: 6438717 - DNA, 15 bp, Homo sapiens
tctgggtccctgctc

SEQ ID NO: 6438718 - DNA, 18 bp, Homo sapiens
tctgggtccctgctcccc

SEQ ID NO: 6438719 - DNA, 15 bp, Homo sapiens
tctgggtccttcctg

SEQ ID NO: 6438720 - DNA, 16 bp, Homo sapiens
tctgggtccttcctga

SEQ ID NO: 6438721 - DNA, 17 bp, Homo sapiens
tctgggtctcagtgtcc

SEQ ID NO: 6438722 - DNA, 23 bp, Homo sapiens
tctgggtgaaagggatactttta

SEQ ID NO: 6438723 - DNA, 17 bp, Homo sapiens
tctgggtgatttctaga

SEQ ID NO: 6438724 - DNA, 17 bp, Homo sapiens
tctgggtgcagctgggc

SEQ ID NO: 6438725 - DNA, 12 bp, Homo sapiens
tctgggtgccct

SEQ ID NO: 6438726 - DNA, 17 bp, Homo sapiens
tctgggtgccctgaaag

SEQ ID NO: 6438727 - DNA, 18 bp, Homo sapiens
tctgggtgctactgggga

SEQ ID NO: 6438728 - DNA, 19 bp, Homo sapiens
tctgggtgctactggggaa

SEQ ID NO: 6438729 - DNA, 20 bp, Homo sapiens
tctgggtggatgtgagcaga

SEQ ID NO: 6438730 - DNA, 22 bp, Homo sapiens
tctgggtggatgtgagcagaag

SEQ ID NO: 6438731 - DNA, 14 bp, Homo sapiens
tctgggtggctcac

SEQ ID NO: 6438732 - DNA, 15 bp, Homo sapiens
tctgggtggctcctg

SEQ ID NO: 6438733 - DNA, 19 bp, Homo sapiens
tctgggtggctcctgccac

SEQ ID NO: 6438734 - DNA, 17 bp, Homo sapiens
tctgggtgggcggggca

SEQ ID NO: 6438735 - DNA, 20 bp, Homo sapiens
tctgggtgggcggggcacta

SEQ ID NO: 6438736 - DNA, 18 bp, Homo sapiens
tctgggtggggcccaggc

SEQ ID NO: 6438737 - DNA, 18 bp, Homo sapiens
tctgggtggtaactgcca

SEQ ID NO: 6438738 - DNA, 23 bp, Homo sapiens
tctgggtgtccgccatccagggt

SEQ ID NO: 6438739 - DNA, 21 bp, Homo sapiens
tctgggtgtgctttttgggac

SEQ ID NO: 6438740 - DNA, 14 bp, Homo sapiens
tctgggtgtgtcca

SEQ ID NO: 6438741 - DNA, 14 bp, Homo sapiens
tctgggtgttttca

SEQ ID NO: 6438742 - DNA, 14 bp, Homo sapiens
tctgggttaacagt

SEQ ID NO: 6438743 - DNA, 18 bp, Homo sapiens
tctgggttaacagtaaat

SEQ ID NO: 6438744 - DNA, 16 bp, Homo sapiens
tctgggttcactgcaa

SEQ ID NO: 6438745 - DNA, 23 bp, Homo sapiens
tctgggttctcttcattcccact

SEQ ID NO: 6438746 - DNA, 16 bp, Homo sapiens
tctgggttctgggtgg

SEQ ID NO: 6438747 - DNA, 15 bp, Homo sapiens
tctgggttgccttta

SEQ ID NO: 6438748 - DNA, 13 bp, Homo sapiens
tctgggtttctaa

SEQ ID NO: 6438749 - DNA, 17 bp, Homo sapiens
tctgggtttgaagctgc

SEQ ID NO: 6438750 - DNA, 16 bp, Homo sapiens
tctgggtttgagaaat

SEQ ID NO: 6438751 - DNA, 15 bp, Homo sapiens
tctgggtttgcccag

SEQ ID NO: 6438752 - DNA, 14 bp, Homo sapiens
tctgggtttttctt

SEQ ID NO: 6438753 - DNA, 17 bp, Homo sapiens
tctggtaaagttacact

SEQ ID NO: 6438754 - DNA, 17 bp, Homo sapiens
tctggtaacctgtggtg

SEQ ID NO: 6438755 - DNA, 18 bp, Homo sapiens
tctggtaagactgctggt

SEQ ID NO: 6438756 - DNA, 22 bp, Homo sapiens
tctggtaatattgacttgtata

SEQ ID NO: 6438757 - DNA, 16 bp, Homo sapiens
tctggtactctgtgaa

SEQ ID NO: 6438758 - DNA, 17 bp, Homo sapiens
tctggtactctgtgaaa

SEQ ID NO: 6438759 - DNA, 20 bp, Homo sapiens
tctggtactctgtgaaagaa

SEQ ID NO: 6438760 - DNA, 21 bp, Homo sapiens
tctggtagaagggaaagccca

SEQ ID NO: 6438761 - DNA, 18 bp, Homo sapiens
tctggtagatagaaataa

SEQ ID NO: 6438762 - DNA, 15 bp, Homo sapiens
tctggtaggttctgt

SEQ ID NO: 6438763 - DNA, 21 bp, Homo sapiens
tctggtatacattgaattcat

SEQ ID NO: 6438764 - DNA, 15 bp, Homo sapiens
tctggtatatgtcat

SEQ ID NO: 6438765 - DNA, 16 bp, Homo sapiens
tctggtatatgtcatt

SEQ ID NO: 6438766 - DNA, 17 bp, Homo sapiens
tctggtatatgtcatta

SEQ ID NO: 6438767 - DNA, 14 bp, Homo sapiens
tctggtatgaaaca

SEQ ID NO: 6438768 - DNA, 22 bp, Homo sapiens
tctggtatgaacttgaggacac

SEQ ID NO: 6438769 - DNA, 22 bp, Homo sapiens
tctggtcaagaagcatcgtgtc

SEQ ID NO: 6438770 - DNA, 20 bp, Homo sapiens
tctggtcaagggctgtcatt

SEQ ID NO: 6438771 - DNA, 13 bp, Homo sapiens
tctggtcaagtag

SEQ ID NO: 6438772 - DNA, 22 bp, Homo sapiens
tctggtcaagttgagattttta

SEQ ID NO: 6438773 - DNA, 20 bp, Homo sapiens
tctggtcagagccacagggt

SEQ ID NO: 6438774 - DNA, 23 bp, Homo sapiens
tctggtcaggcaatgccctgcgg

SEQ ID NO: 6438775 - DNA, 23 bp, Homo sapiens
tctggtcagtgaagcccaggagg

SEQ ID NO: 6438776 - DNA, 18 bp, Homo sapiens
tctggtccacacaccaca

SEQ ID NO: 6438777 - DNA, 17 bp, Homo sapiens
tctggtccacactagaa

SEQ ID NO: 6438778 - DNA, 18 bp, Homo sapiens
tctggtccatagagagca

SEQ ID NO: 6438779 - DNA, 22 bp, Homo sapiens
tctggtcccacaaatgggcgcc

SEQ ID NO: 6438780 - DNA, 13 bp, Homo sapiens
tctggtccctctt

SEQ ID NO: 6438781 - DNA, 23 bp, Homo sapiens
tctggtccctcttctctcctcag

SEQ ID NO: 6438782 - DNA, 13 bp, Homo sapiens
tctggtcccttgc

SEQ ID NO: 6438783 - DNA, 21 bp, Homo sapiens
tctggtccctttaaagagcaa

SEQ ID NO: 6438784 - DNA, 18 bp, Homo sapiens
tctggtccggacactcct

SEQ ID NO: 6438785 - DNA, 15 bp, Homo sapiens
tctggtcgctcctgc

SEQ ID NO: 6438786 - DNA, 17 bp, Homo sapiens
tctggtcgctcctgccc

SEQ ID NO: 6438787 - DNA, 17 bp, Homo sapiens
tctggtctactctagaa

SEQ ID NO: 6438788 - DNA, 17 bp, Homo sapiens
tctggtctcctcagcct

SEQ ID NO: 6438789 - DNA, 18 bp, Homo sapiens
tctggtctcctcagcctc

SEQ ID NO: 6438790 - DNA, 21 bp, Homo sapiens
tctggtcttgtttccaggagc

SEQ ID NO: 6438791 - DNA, 22 bp, Homo sapiens
tctggtctttgaaagaaatgta

SEQ ID NO: 6438792 - DNA, 15 bp, Homo sapiens
tctggtgacaaatat

SEQ ID NO: 6438793 - DNA, 17 bp, Homo sapiens
tctggtgacaccagcct

SEQ ID NO: 6438794 - DNA, 18 bp, Homo sapiens
tctggtgacccagagatc

SEQ ID NO: 6438795 - DNA, 16 bp, Homo sapiens
tctggtgaccttccaa

SEQ ID NO: 6438796 - DNA, 18 bp, Homo sapiens
tctggtgaccttccaaga

SEQ ID NO: 6438797 - DNA, 17 bp, Homo sapiens
tctggtgaggccttgct

SEQ ID NO: 6438798 - DNA, 14 bp, Homo sapiens
tctggtgaggtggc

SEQ ID NO: 6438799 - DNA, 15 bp, Homo sapiens
tctggtgaggtggcc

SEQ ID NO: 6438800 - DNA, 20 bp, Homo sapiens
tctggtgagtcaccacttca

SEQ ID NO: 6438801 - DNA, 14 bp, Homo sapiens
tctggtgcatgttc

SEQ ID NO: 6438802 - DNA, 15 bp, Homo sapiens
tctggtgccaatcct

SEQ ID NO: 6438803 - DNA, 17 bp, Homo sapiens
tctggtgccatttctga

SEQ ID NO: 6438804 - DNA, 17 bp, Homo sapiens
tctggtgcctatttatt

SEQ ID NO: 6438805 - DNA, 15 bp, Homo sapiens
tctggtgcgtgtggc

SEQ ID NO: 6438806 - DNA, 19 bp, Homo sapiens
tcatatgttgctcagtctc

SEQ ID NO: 6438807 - DNA, 20 bp, Homo sapiens
tcatatgtttattcaaaata

SEQ ID NO: 6438808 - DNA, 19 bp, Homo sapiens
tcatattaaaattacagat

SEQ ID NO: 6438809 - DNA, 21 bp, Homo sapiens
tcatattaaaattacagatgt

SEQ ID NO: 6438810 - DNA, 13 bp, Homo sapiens
tcatattaagaca

SEQ ID NO: 6438811 - DNA, 22 bp, Homo sapiens
tcatattaatataagtttcttt

SEQ ID NO: 6438812 - DNA, 15 bp, Homo sapiens
tcatattacaatatt

SEQ ID NO: 6438813 - DNA, 16 bp, Homo sapiens
tcatattaccagaaaa

SEQ ID NO: 6438814 - DNA, 17 bp, Homo sapiens
tcatattaccagaaaat

SEQ ID NO: 6438815 - DNA, 13 bp, Homo sapiens
tcatattagactt

SEQ ID NO: 6438816 - DNA, 12 bp, Homo sapiens
tcatattataca

SEQ ID NO: 6438817 - DNA, 16 bp, Homo sapiens
tcatattattttagtg

SEQ ID NO: 6438818 - DNA, 19 bp, Homo sapiens
tcatattattttagtgtgt

SEQ ID NO: 6438819 - DNA, 22 bp, Homo sapiens
tcatattcataccttctgatga

SEQ ID NO: 6438820 - DNA, 21 bp, Homo sapiens
tcatattcatgcaagtattct

SEQ ID NO: 6438821 - DNA, 23 bp, Homo sapiens
tcatattcctgcctttcttccat

SEQ ID NO: 6438822 - DNA, 20 bp, Homo sapiens
tcatattctaaaagtaataa

SEQ ID NO: 6438823 - DNA, 12 bp, Homo sapiens
tcatattgaata

SEQ ID NO: 6438824 - DNA, 14 bp, Homo sapiens
tcatattgaatata

SEQ ID NO: 6438825 - DNA, 19 bp, Homo sapiens
tcatattgaatgtttccaa

SEQ ID NO: 6438826 - DNA, 17 bp, Homo sapiens
tcatattgagaataatt

SEQ ID NO: 6438827 - DNA, 23 bp, Homo sapiens
tcatattgagatcagcattcaaa

SEQ ID NO: 6438828 - DNA, 21 bp, Homo sapiens
tcatattggattgcgcctttg

SEQ ID NO: 6438829 - DNA, 22 bp, Homo sapiens
tcatattggattgcgcctttgt

SEQ ID NO: 6438830 - DNA, 19 bp, Homo sapiens
tcatattggtgctgagtgc

SEQ ID NO: 6438831 - DNA, 13 bp, Homo sapiens
tcatattgtatgt

SEQ ID NO: 6438832 - DNA, 18 bp, Homo sapiens
tcatattgtatgtaagta

SEQ ID NO: 6438833 - DNA, 19 bp, Homo sapiens
tcatatttaaagacaggga

SEQ ID NO: 6438834 - DNA, 17 bp, Homo sapiens
tcatatttaaagccaaa

SEQ ID NO: 6438835 - DNA, 13 bp, Homo sapiens
tcatatttaatat

SEQ ID NO: 6438836 - DNA, 16 bp, Homo sapiens
tcatatttacttctta

SEQ ID NO: 6438837 - DNA, 20 bp, Homo sapiens
tcatatttacttcttataca

SEQ ID NO: 6438838 - DNA, 14 bp, Homo sapiens
tcatatttatactt

SEQ ID NO: 6438839 - DNA, 22 bp, Homo sapiens
tcatatttcccatgatttcatg

SEQ ID NO: 6438840 - DNA, 14 bp, Homo sapiens
tcatatttcccctt

SEQ ID NO: 6438841 - DNA, 12 bp, Homo sapiens
tcatatttgaaa

SEQ ID NO: 6438842 - DNA, 20 bp, Homo sapiens
tcatatttggtgatgagact

SEQ ID NO: 6438843 - DNA, 14 bp, Homo sapiens
tcatatttgtactt

SEQ ID NO: 6438844 - DNA, 22 bp, Homo sapiens
tcatatttgtactttctgttaa

SEQ ID NO: 6438845 - DNA, 18 bp, Homo sapiens
tcatatttgtctttgaat

SEQ ID NO: 6438846 - DNA, 20 bp, Homo sapiens
tcatattttaaacagaggat

SEQ ID NO: 6438847 - DNA, 16 bp, Homo sapiens
tcatattttaaatctg

SEQ ID NO: 6438848 - DNA, 16 bp, Homo sapiens
tcatattttaatttca

SEQ ID NO: 6438849 - DNA, 20 bp, Homo sapiens
tcatattttcctttatgtga

SEQ ID NO: 6438850 - DNA, 21 bp, Homo sapiens
tcatattttcctttatgtgat

SEQ ID NO: 6438851 - DNA, 14 bp, Homo sapiens
tcatattttgatta

SEQ ID NO: 6438852 - DNA, 16 bp, Homo sapiens
tcatattttgattatt

SEQ ID NO: 6438853 - DNA, 21 bp, Homo sapiens
tcatattttgccactgccttt

SEQ ID NO: 6438854 - DNA, 15 bp, Homo sapiens
tcatattttgtatat

SEQ ID NO: 6438855 - DNA, 13 bp, Homo sapiens
tcatatttttaca

SEQ ID NO: 6438856 - DNA, 22 bp, Homo sapiens
tcatatttttcatagctaaaaa

SEQ ID NO: 6438857 - DNA, 15 bp, Homo sapiens
tcatatttttgtaaa

SEQ ID NO: 6438858 - DNA, 14 bp, Homo sapiens
tcatcaaaaagagt

SEQ ID NO: 6438859 - DNA, 22 bp, Homo sapiens
tcatcaaaaagagtcttaattt

SEQ ID NO: 6438860 - DNA, 19 bp, Homo sapiens
tcatcaaaaagtaattata

SEQ ID NO: 6438861 - DNA, 20 bp, Homo sapiens
tcatcaaaatcatggatctt

SEQ ID NO: 6438862 - DNA, 20 bp, Homo sapiens
tcatcaaagtggggtacagt

SEQ ID NO: 6438863 - DNA, 17 bp, Homo sapiens
tcatcaaagtgtttaat

SEQ ID NO: 6438864 - DNA, 16 bp, Homo sapiens
tcatcaaatcatcatt

SEQ ID NO: 6438865 - DNA, 22 bp, Homo sapiens
tcatcaacaaaagggagaacat

SEQ ID NO: 6438866 - DNA, 18 bp, Homo sapiens
tcatcaacaaagaaatat

SEQ ID NO: 6438867 - DNA, 13 bp, Homo sapiens
tcatcaactgaat

SEQ ID NO: 6438868 - DNA, 22 bp, Homo sapiens
tcatcaactgaatgaggtcagc

SEQ ID NO: 6438869 - DNA, 13 bp, Homo sapiens
tcatcaagaaggg

SEQ ID NO: 6438870 - DNA, 14 bp, Homo sapiens
tcatcaagaatgag

SEQ ID NO: 6438871 - DNA, 11 bp, Homo sapiens
tcatcaagact

SEQ ID NO: 6438872 - DNA, 21 bp, Homo sapiens
tcatcaagcaggaattatgtc

SEQ ID NO: 6438873 - DNA, 21 bp, Homo sapiens
tcatcaaggcactgcctgatg

SEQ ID NO: 6438874 - DNA, 16 bp, Homo sapiens
tcatcaagtaatcatg

SEQ ID NO: 6438875 - DNA, 24 bp, Homo sapiens
tcatcaatacttttgtgtattctg

SEQ ID NO: 6438876 - DNA, 21 bp, Homo sapiens
tcatcaatatccctcttgtaa

SEQ ID NO: 6438877 - DNA, 14 bp, Homo sapiens
tcatcaatcattgt

SEQ ID NO: 6438878 - DNA, 15 bp, Homo sapiens
tcatcaatcattgta

SEQ ID NO: 6438879 - DNA, 19 bp, Homo sapiens
tcatcaatcattgtacagt

SEQ ID NO: 6438880 - DNA, 13 bp, Homo sapiens
tcatcaatgcaat

SEQ ID NO: 6438881 - DNA, 16 bp, Homo sapiens
tcatcaatgtgacatt

SEQ ID NO: 6438882 - DNA, 14 bp, Homo sapiens
tcatcaatttaaaa

SEQ ID NO: 6438883 - DNA, 21 bp, Homo sapiens
tcatcaatttaaaatcattca

SEQ ID NO: 6438884 - DNA, 22 bp, Homo sapiens
tcatcaatttgtaattttagta

SEQ ID NO: 6438885 - DNA, 17 bp, Homo sapiens
tcatcaattttgtctat

SEQ ID NO: 6438886 - DNA, 20 bp, Homo sapiens
tcatcacaacctaaatggag

SEQ ID NO: 6438887 - DNA, 23 bp, Homo sapiens
tcatcacaagaacacacacatat

SEQ ID NO: 6438888 - DNA, 13 bp, Homo sapiens
tcatcacacacat

SEQ ID NO: 6438889 - DNA, 20 bp, Homo sapiens
tcatcacagcatgtgcaata

SEQ ID NO: 6438890 - DNA, 20 bp, Homo sapiens
tcatcaccaacgtctgtgcc

SEQ ID NO: 6438891 - DNA, 13 bp, Homo sapiens
tcatcaccaccct

SEQ ID NO: 6438892 - DNA, 16 bp, Homo sapiens
tcatcaccagtctgta

SEQ ID NO: 6438893 - DNA, 12 bp, Homo sapiens
tcatcaccagtg

SEQ ID NO: 6438894 - DNA, 19 bp, Homo sapiens
tcatcaccatttcctcctt

SEQ ID NO: 6438895 - DNA, 12 bp, Homo sapiens
tcatcacccagt

SEQ ID NO: 6438896 - DNA, 20 bp, Homo sapiens
tcatcacccagtcctggcca

SEQ ID NO: 6438897 - DNA, 21 bp, Homo sapiens
tcatcacccggatagaggaca

SEQ ID NO: 6438898 - DNA, 16 bp, Homo sapiens
tcatcacctgctagaa

SEQ ID NO: 6438899 - DNA, 20 bp, Homo sapiens
tcatcactacctttatagct

SEQ ID NO: 6438900 - DNA, 16 bp, Homo sapiens
tcatcactcccctcca

SEQ ID NO: 6438901 - DNA, 15 bp, Homo sapiens
tcatcactccctgga

SEQ ID NO: 6438902 - DNA, 14 bp, Homo sapiens
tcatcactggactg

SEQ ID NO: 6438903 - DNA, 17 bp, Homo sapiens
tcatcactggactgcat

SEQ ID NO: 6438904 - DNA, 22 bp, Homo sapiens
tcatcactggatgaagattctc

SEQ ID NO: 6438905 - DNA, 12 bp, Homo sapiens
tcatcactgtaa

SEQ ID NO: 6438906 - DNA, 14 bp, Homo sapiens
tcatcactgtaaag

SEQ ID NO: 6438907 - DNA, 14 bp, Homo sapiens
tcatcactgtgcct

SEQ ID NO: 6438908 - DNA, 15 bp, Homo sapiens
tcatcacttcttcca

SEQ ID NO: 6438909 - DNA, 13 bp, Homo sapiens
tcatcactttgga

SEQ ID NO: 6438910 - DNA, 15 bp, Homo sapiens
tcatcacttttcagt

SEQ ID NO: 6438911 - DNA, 15 bp, Homo sapiens
tcatcagaaaaagtc

SEQ ID NO: 6438912 - DNA, 13 bp, Homo sapiens
tcatcagaacagc

SEQ ID NO: 6438913 - DNA, 16 bp, Homo sapiens
tcatcagaacagctgt

SEQ ID NO: 6438914 - DNA, 15 bp, Homo sapiens
tcatcagaagataac

SEQ ID NO: 6438915 - DNA, 21 bp, Homo sapiens
tcatcagagctcctctgtcct

SEQ ID NO: 6438916 - DNA, 18 bp, Homo sapiens
tcatcagaggggagcagc

SEQ ID NO: 6438917 - DNA, 16 bp, Homo sapiens
tcatcagatgcctgct

SEQ ID NO: 6438918 - DNA, 20 bp, Homo sapiens
tcatcagatggaaatatttt

SEQ ID NO: 6438919 - DNA, 22 bp, Homo sapiens
tcatcagatggaaatattttga

SEQ ID NO: 6438920 - DNA, 14 bp, Homo sapiens
tcatcagcatacct

SEQ ID NO: 6438921 - DNA, 21 bp, Homo sapiens
tcatcagcatacctttattgt

SEQ ID NO: 6438922 - DNA, 20 bp, Homo sapiens
tcatcagccttttcagcagg

SEQ ID NO: 6438923 - DNA, 15 bp, Homo sapiens
tcatcaggaacgttt

SEQ ID NO: 6438924 - DNA, 14 bp, Homo sapiens
tcatcaggatgaac

SEQ ID NO: 6438925 - DNA, 21 bp, Homo sapiens
tcatcaggctctgttcctcaa

SEQ ID NO: 6438926 - DNA, 23 bp, Homo sapiens
tcatcaggcttggaatgaattct

SEQ ID NO: 6438927 - DNA, 19 bp, Homo sapiens
tcatcagggtagcagcaga

SEQ ID NO: 6438928 - DNA, 20 bp, Homo sapiens
tcatcagggtagcagcagag

SEQ ID NO: 6438929 - DNA, 22 bp, Homo sapiens
tcatcaggtttactcagtgaaa

SEQ ID NO: 6438930 - DNA, 14 bp, Homo sapiens
tcatcagtaagtat

SEQ ID NO: 6438931 - DNA, 18 bp, Homo sapiens
tcatcagtagatggtacg

SEQ ID NO: 6438932 - DNA, 16 bp, Homo sapiens
tcatcagtattgaagc

SEQ ID NO: 6438933 - DNA, 17 bp, Homo sapiens
tcatcagtattgtgtaa

SEQ ID NO: 6438934 - DNA, 18 bp, Homo sapiens
tcatcagtcatcaggtgt

SEQ ID NO: 6438935 - DNA, 15 bp, Homo sapiens
tcatcagtggagcca

SEQ ID NO: 6438936 - DNA, 17 bp, Homo sapiens
tcatcagtgtgtaaata

SEQ ID NO: 6438937 - DNA, 18 bp, Homo sapiens
tcatcagtgtgtaaataa

SEQ ID NO: 6438938 - DNA, 16 bp, Homo sapiens
tcatcagtgttaaaaa

SEQ ID NO: 6438939 - DNA, 19 bp, Homo sapiens
tcatcagtgttaaaaaatt

SEQ ID NO: 6438940 - DNA, 22 bp, Homo sapiens
tcatcataggtaaggttttcaa

SEQ ID NO: 6438941 - DNA, 17 bp, Homo sapiens
tcatcatattatacaga

SEQ ID NO: 6438942 - DNA, 14 bp, Homo sapiens
tcatcatattgtat

SEQ ID NO: 6438943 - DNA, 15 bp, Homo sapiens
tcatcatcagggcct

SEQ ID NO: 6438944 - DNA, 16 bp, Homo sapiens
tcatcatcataggtaa

SEQ ID NO: 6438945 - DNA, 13 bp, Homo sapiens
tcatcatccaccc

SEQ ID NO: 6438946 - DNA, 19 bp, Homo sapiens
tcatcatccacccgctgcc

SEQ ID NO: 6438947 - DNA, 16 bp, Homo sapiens
tcatcatccagatgtg

SEQ ID NO: 6438948 - DNA, 13 bp, Homo sapiens
tcatcatccctcc

SEQ ID NO: 6438949 - DNA, 14 bp, Homo sapiens
tcatcatcctaagc

SEQ ID NO: 6438950 - DNA, 15 bp, Homo sapiens
tcatcatctccaaac

SEQ ID NO: 6438951 - DNA, 18 bp, Homo sapiens
tcatcatctcttgataaa

SEQ ID NO: 6438952 - DNA, 18 bp, Homo sapiens
tcatcatgagttctgctg

SEQ ID NO: 6438953 - DNA, 21 bp, Homo sapiens
tcatcatgcttatgttaaact

SEQ ID NO: 6438954 - DNA, 18 bp, Homo sapiens
tcatcatggccagctgga

SEQ ID NO: 6438955 - DNA, 22 bp, Homo sapiens
tcatcatggccagctggaggca

SEQ ID NO: 6438956 - DNA, 20 bp, Homo sapiens
tcatcatgggggatttttca

SEQ ID NO: 6438957 - DNA, 22 bp, Homo sapiens
tcatcatgtatcgcttcatgta

SEQ ID NO: 6438958 - DNA, 17 bp, Homo sapiens
tcatcatgttgaccagg

SEQ ID NO: 6438959 - DNA, 21 bp, Homo sapiens
tcatcatgttgaccaggctgg

SEQ ID NO: 6438960 - DNA, 16 bp, Homo sapiens
tcatcattaatgactt

SEQ ID NO: 6438961 - DNA, 13 bp, Homo sapiens
tcatcattattat

SEQ ID NO: 6438962 - DNA, 19 bp, Homo sapiens
tcatcattcacttcactgt

SEQ ID NO: 6438963 - DNA, 21 bp, Homo sapiens
tcatcattcacttcactgtgc

SEQ ID NO: 6438964 - DNA, 22 bp, Homo sapiens
tcatcattcacttcactgtgct

SEQ ID NO: 6438965 - DNA, 23 bp, Homo sapiens
tcatcattcacttcactgtgctg

SEQ ID NO: 6438966 - DNA, 17 bp, Homo sapiens
tcatcattccttgagaa

SEQ ID NO: 6438967 - DNA, 14 bp, Homo sapiens
tcatcattctctgt

SEQ ID NO: 6438968 - DNA, 22 bp, Homo sapiens
tcatcattgtttctgcatgaat

SEQ ID NO: 6438969 - DNA, 13 bp, Homo sapiens
tcatcatttcagc

SEQ ID NO: 6438970 - DNA, 18 bp, Homo sapiens
tcatcatttcagccaaag

SEQ ID NO: 6438971 - DNA, 20 bp, Homo sapiens
tcatcatttcagccaaagtc

SEQ ID NO: 6438972 - DNA, 17 bp, Homo sapiens
tcatccaaaagtgacca

SEQ ID NO: 6438973 - DNA, 22 bp, Homo sapiens
tcatccaaactgtatcttcctt

SEQ ID NO: 6438974 - DNA, 16 bp, Homo sapiens
tcatccaacaagaaga

SEQ ID NO: 6438975 - DNA, 20 bp, Homo sapiens
tcatccaacaagaagaaata

SEQ ID NO: 6438976 - DNA, 17 bp, Homo sapiens
tcatccaacttatgttt

SEQ ID NO: 6438977 - DNA, 24 bp, Homo sapiens
tcatccaaggaacctaattgaaat

SEQ ID NO: 6438978 - DNA, 17 bp, Homo sapiens
tcatccaagttaaatgt

SEQ ID NO: 6438979 - DNA, 18 bp, Homo sapiens
tcatccaatcctcactgg

SEQ ID NO: 6438980 - DNA, 19 bp, Homo sapiens
tcatccaatcctcactggg

SEQ ID NO: 6438981 - DNA, 13 bp, Homo sapiens
tcatccaatgtga

SEQ ID NO: 6438982 - DNA, 17 bp, Homo sapiens
tcatccacacttaagcc

SEQ ID NO: 6438983 - DNA, 15 bp, Homo sapiens
tcatccacagaggcc

SEQ ID NO: 6438984 - DNA, 21 bp, Homo sapiens
tctggtgcgtgtggccctgtg

SEQ ID NO: 6438985 - DNA, 14 bp, Homo sapiens
tctggtgctgagga

SEQ ID NO: 6438986 - DNA, 17 bp, Homo sapiens
tctggtgcttgggagag

SEQ ID NO: 6438987 - DNA, 22 bp, Homo sapiens
tctggtggccactgagctggct

SEQ ID NO: 6438988 - DNA, 21 bp, Homo sapiens
tctggtggccacttcattcca

SEQ ID NO: 6438989 - DNA, 13 bp, Homo sapiens
tctggtggcccca

SEQ ID NO: 6438990 - DNA, 14 bp, Homo sapiens
tctggtggccccgt

SEQ ID NO: 6438991 - DNA, 12 bp, Homo sapiens
tctggtggctcc

SEQ ID NO: 6438992 - DNA, 20 bp, Homo sapiens
tctggtggctcctcctagga

SEQ ID NO: 6438993 - DNA, 15 bp, Homo sapiens
tctggtggctgccag

SEQ ID NO: 6438994 - DNA, 18 bp, Homo sapiens
tctggtggctgggctgct

SEQ ID NO: 6438995 - DNA, 12 bp, Homo sapiens
tctggtggctta

SEQ ID NO: 6438996 - DNA, 21 bp, Homo sapiens
tctggtgggaaaatgtccccc

SEQ ID NO: 6438997 - DNA, 21 bp, Homo sapiens
tctggtggggctgtcctgctg

SEQ ID NO: 6438998 - DNA, 16 bp, Homo sapiens
tctggtggtcagccct

SEQ ID NO: 6438999 - DNA, 15 bp, Homo sapiens
tctggtggtctcctc

SEQ ID NO: 6439000 - DNA, 16 bp, Homo sapiens
tctggtggtcttcctt

SEQ ID NO: 6439001 - DNA, 18 bp, Homo sapiens
tctggtggtcttccttct

SEQ ID NO: 6439002 - DNA, 16 bp, Homo sapiens
tctggtggttatttaa

SEQ ID NO: 6439003 - DNA, 16 bp, Homo sapiens
tctggtggtttaatac

SEQ ID NO: 6439004 - DNA, 17 bp, Homo sapiens
tctggtgtctaataaac

SEQ ID NO: 6439005 - DNA, 16 bp, Homo sapiens
tctggtgtgtggtgag

SEQ ID NO: 6439006 - DNA, 13 bp, Homo sapiens
tctggtgttctat

SEQ ID NO: 6439007 - DNA, 13 bp, Homo sapiens
tctggtgttgact

SEQ ID NO: 6439008 - DNA, 21 bp, Homo sapiens
tctggtgttggacaagcttct

SEQ ID NO: 6439009 - DNA, 19 bp, Homo sapiens
tctggtgttttatttccta

SEQ ID NO: 6439010 - DNA, 17 bp, Homo sapiens
tctggttaggatggcag

SEQ ID NO: 6439011 - DNA, 21 bp, Homo sapiens
tctggttccagggtccctctg

SEQ ID NO: 6439012 - DNA, 20 bp, Homo sapiens
tctggttccatttttcctct

SEQ ID NO: 6439013 - DNA, 17 bp, Homo sapiens
tctggttcctccagcca

SEQ ID NO: 6439014 - DNA, 13 bp, Homo sapiens
tctggttctaaca

SEQ ID NO: 6439015 - DNA, 20 bp, Homo sapiens
tctggttctaactgctgtta

SEQ ID NO: 6439016 - DNA, 17 bp, Homo sapiens
tctggttctcaattcca

SEQ ID NO: 6439017 - DNA, 15 bp, Homo sapiens
tctggttctgtgtcc

SEQ ID NO: 6439018 - DNA, 15 bp, Homo sapiens
tctggttcttgaaaa

SEQ ID NO: 6439019 - DNA, 23 bp, Homo sapiens
tctggttcttgaaaataagattc

SEQ ID NO: 6439020 - DNA, 13 bp, Homo sapiens
tctggttgaagct

SEQ ID NO: 6439021 - DNA, 23 bp, Homo sapiens
tctggttgacgggctgtccgtgt

SEQ ID NO: 6439022 - DNA, 22 bp, Homo sapiens
tctggttgatttgtaacacagt

SEQ ID NO: 6439023 - DNA, 13 bp, Homo sapiens
tctggttgcctcc

SEQ ID NO: 6439024 - DNA, 14 bp, Homo sapiens
tctggttgctaatg

SEQ ID NO: 6439025 - DNA, 12 bp, Homo sapiens
tctggttgcttc

SEQ ID NO: 6439026 - DNA, 14 bp, Homo sapiens
tctggttgtatttc

SEQ ID NO: 6439027 - DNA, 15 bp, Homo sapiens
tctggttgtatttct

SEQ ID NO: 6439028 - DNA, 16 bp, Homo sapiens
tctggttgtatttcta

SEQ ID NO: 6439029 - DNA, 16 bp, Homo sapiens
tctggttgtttctgtt

SEQ ID NO: 6439030 - DNA, 18 bp, Homo sapiens
tctggttgtttctgttcc

SEQ ID NO: 6439031 - DNA, 19 bp, Homo sapiens
tctggttgtttttgttctt

SEQ ID NO: 6439032 - DNA, 22 bp, Homo sapiens
tctggtttaactaatatttgtc

SEQ ID NO: 6439033 - DNA, 13 bp, Homo sapiens
tctggtttctaag

SEQ ID NO: 6439034 - DNA, 18 bp, Homo sapiens
tctggtttggcatggtga

SEQ ID NO: 6439035 - DNA, 13 bp, Homo sapiens
tctggttttaaca

SEQ ID NO: 6439036 - DNA, 21 bp, Homo sapiens
tctggttttctggtggggctg

SEQ ID NO: 6439037 - DNA, 23 bp, Homo sapiens
tctggtttttaaaagataaacag

SEQ ID NO: 6439038 - DNA, 20 bp, Homo sapiens
tctgtaaaaaagaaaaacaa

SEQ ID NO: 6439039 - DNA, 15 bp, Homo sapiens
tctgtaaaaattgtt

SEQ ID NO: 6439040 - DNA, 22 bp, Homo sapiens
tctgtaaaatctttctttctta

SEQ ID NO: 6439041 - DNA, 16 bp, Homo sapiens
tctgtaaaatggaaaa

SEQ ID NO: 6439042 - DNA, 15 bp, Homo sapiens
tctgtaaactcaaaa

SEQ ID NO: 6439043 - DNA, 18 bp, Homo sapiens
tctgtaaactcaaaactt

SEQ ID NO: 6439044 - DNA, 15 bp, Homo sapiens
tctgtaaactgtgta

SEQ ID NO: 6439045 - DNA, 12 bp, Homo sapiens
tctgtaaagcca

SEQ ID NO: 6439046 - DNA, 19 bp, Homo sapiens
tctgtaaagctaaaataaa

SEQ ID NO: 6439047 - DNA, 14 bp, Homo sapiens
tctgtaaataacct

SEQ ID NO: 6439048 - DNA, 13 bp, Homo sapiens
tctgtaaatacca

SEQ ID NO: 6439049 - DNA, 16 bp, Homo sapiens
tctgtaaatatgtttt

SEQ ID NO: 6439050 - DNA, 16 bp, Homo sapiens
tctgtaaatgaacaca

SEQ ID NO: 6439051 - DNA, 10 bp, Homo sapiens
tctgtaaatt

SEQ ID NO: 6439052 - DNA, 12 bp, Homo sapiens
tctgtaaattca

SEQ ID NO: 6439053 - DNA, 17 bp, Homo sapiens
tctgtaaattcatattt

SEQ ID NO: 6439054 - DNA, 11 bp, Homo sapiens
tctgtaaattt

SEQ ID NO: 6439055 - DNA, 15 bp, Homo sapiens
tctgtaaatttaact

SEQ ID NO: 6439056 - DNA, 19 bp, Homo sapiens
tctgtaaatttaactgcat

SEQ ID NO: 6439057 - DNA, 14 bp, Homo sapiens
tctgtaaattttta

SEQ ID NO: 6439058 - DNA, 23 bp, Homo sapiens
tctgtaacaggtattttgtttct

SEQ ID NO: 6439059 - DNA, 22 bp, Homo sapiens
tctgtaaccacctctctgtctt

SEQ ID NO: 6439060 - DNA, 14 bp, Homo sapiens
tctgtaacccttga

SEQ ID NO: 6439061 - DNA, 20 bp, Homo sapiens
tctgtaacgcctgcttgtcc

SEQ ID NO: 6439062 - DNA, 13 bp, Homo sapiens
tctgtaactcttt

SEQ ID NO: 6439063 - DNA, 14 bp, Homo sapiens
tctgtaactgccca

SEQ ID NO: 6439064 - DNA, 17 bp, Homo sapiens
tctgtaactgcccagcc

SEQ ID NO: 6439065 - DNA, 20 bp, Homo sapiens
tctgtaactgcccagcccct

SEQ ID NO: 6439066 - DNA, 13 bp, Homo sapiens
tctgtaagagctt

SEQ ID NO: 6439067 - DNA, 16 bp, Homo sapiens
tctgtaagagcttgct

SEQ ID NO: 6439068 - DNA, 15 bp, Homo sapiens
tctgtaagctgaagt

SEQ ID NO: 6439069 - DNA, 22 bp, Homo sapiens
tctgtaagctgtttggttttaa

SEQ ID NO: 6439070 - DNA, 17 bp, Homo sapiens
tctgtaaggaactggaa

SEQ ID NO: 6439071 - DNA, 14 bp, Homo sapiens
tctgtaagtaattg

SEQ ID NO: 6439072 - DNA, 19 bp, Homo sapiens
tctgtaataaactcatttc

SEQ ID NO: 6439073 - DNA, 13 bp, Homo sapiens
tctgtaataatag

SEQ ID NO: 6439074 - DNA, 16 bp, Homo sapiens
tctgtaataatagact

SEQ ID NO: 6439075 - DNA, 19 bp, Homo sapiens
tctgtaataatagactgta

SEQ ID NO: 6439076 - DNA, 22 bp, Homo sapiens
tctgtaatactaagtcctcaga

SEQ ID NO: 6439077 - DNA, 20 bp, Homo sapiens
tctgtaatatattgccagta

SEQ ID NO: 6439078 - DNA, 20 bp, Homo sapiens
tctgtaatatttacaatgta

SEQ ID NO: 6439079 - DNA, 22 bp, Homo sapiens
tctgtaatatttacaatgtatt

SEQ ID NO: 6439080 - DNA, 23 bp, Homo sapiens
tctgtaatatttacaatgtatta

SEQ ID NO: 6439081 - DNA, 14 bp, Homo sapiens
tctgtaatcaatat

SEQ ID NO: 6439082 - DNA, 19 bp, Homo sapiens
tctgtaatcacatttctga

SEQ ID NO: 6439083 - DNA, 16 bp, Homo sapiens
tctgtaatcagcaata

SEQ ID NO: 6439084 - DNA, 14 bp, Homo sapiens
tctgtaatcccagc

SEQ ID NO: 6439085 - DNA, 20 bp, Homo sapiens
tctgtaatctcgtttcaaaa

SEQ ID NO: 6439086 - DNA, 23 bp, Homo sapiens
tctgtaatgatactgattatgaa

SEQ ID NO: 6439087 - DNA, 20 bp, Homo sapiens
tctgtaatggaactgacccc

SEQ ID NO: 6439088 - DNA, 20 bp, Homo sapiens
tctgtaattatatctaaaat

SEQ ID NO: 6439089 - DNA, 16 bp, Homo sapiens
tctgtaattcaggttt

SEQ ID NO: 6439090 - DNA, 20 bp, Homo sapiens
tctgtaattcaggtttttcc

SEQ ID NO: 6439091 - DNA, 12 bp, Homo sapiens
tctgtaattgca

SEQ ID NO: 6439092 - DNA, 14 bp, Homo sapiens
tctgtaatttatta

SEQ ID NO: 6439093 - DNA, 18 bp, Homo sapiens
tctgtaatttgcttgttt

SEQ ID NO: 6439094 - DNA, 16 bp, Homo sapiens
tctgtacaaaaacaaa

SEQ ID NO: 6439095 - DNA, 22 bp, Homo sapiens
tctgtacaaagtactagctaaa

SEQ ID NO: 6439096 - DNA, 23 bp, Homo sapiens
tctgtacaatgaacccccatgat

SEQ ID NO: 6439097 - DNA, 13 bp, Homo sapiens
tctgtacacgtgt

SEQ ID NO: 6439098 - DNA, 17 bp, Homo sapiens
tctgtacacgtgtcctg

SEQ ID NO: 6439099 - DNA, 23 bp, Homo sapiens
tctgtacagagccgtaaaaactg

SEQ ID NO: 6439100 - DNA, 17 bp, Homo sapiens
tctgtacagatcaagaa

SEQ ID NO: 6439101 - DNA, 19 bp, Homo sapiens
tctgtacagattcagcctc

SEQ ID NO: 6439102 - DNA, 18 bp, Homo sapiens
tctgtacatactggcctc

SEQ ID NO: 6439103 - DNA, 19 bp, Homo sapiens
tctgtacatactttttcaa

SEQ ID NO: 6439104 - DNA, 23 bp, Homo sapiens
tctgtacatgttcttgtcataaa

SEQ ID NO: 6439105 - DNA, 15 bp, Homo sapiens
tctgtacatttgcaa

SEQ ID NO: 6439106 - DNA, 16 bp, Homo sapiens
tctgtacatttgcaat

SEQ ID NO: 6439107 - DNA, 13 bp, Homo sapiens
tctgtacattttg

SEQ ID NO: 6439108 - DNA, 22 bp, Homo sapiens
tctgtacattttttctttatca

SEQ ID NO: 6439109 - DNA, 12 bp, Homo sapiens
tctgtaccagtt

SEQ ID NO: 6439110 - DNA, 13 bp, Homo sapiens
tctgtaccagtta

SEQ ID NO: 6439111 - DNA, 22 bp, Homo sapiens
tctgtaccagttaatttttcca

SEQ ID NO: 6439112 - DNA, 22 bp, Homo sapiens
tctgtaccatagcgctgctctt

SEQ ID NO: 6439113 - DNA, 13 bp, Homo sapiens
tctgtaccccatg

SEQ ID NO: 6439114 - DNA, 18 bp, Homo sapiens
tctgtaccccatgacctt

SEQ ID NO: 6439115 - DNA, 18 bp, Homo sapiens
tctgtaccgcccggcagc

SEQ ID NO: 6439116 - DNA, 16 bp, Homo sapiens
tctgtacctcaaatga

SEQ ID NO: 6439117 - DNA, 18 bp, Homo sapiens
tctgtacgaggcttctct

SEQ ID NO: 6439118 - DNA, 21 bp, Homo sapiens
tctgtactccttggatttgca

SEQ ID NO: 6439119 - DNA, 23 bp, Homo sapiens
tctgtactgattcaatttgatgt

SEQ ID NO: 6439120 - DNA, 14 bp, Homo sapiens
tctgtactgtaatt

SEQ ID NO: 6439121 - DNA, 23 bp, Homo sapiens
tctgtactgttactgggccctga

SEQ ID NO: 6439122 - DNA, 22 bp, Homo sapiens
tctgtacttcagtatgtgtcaa

SEQ ID NO: 6439123 - DNA, 21 bp, Homo sapiens
tctgtagaaaagaaaacattt

SEQ ID NO: 6439124 - DNA, 22 bp, Homo sapiens
tctgtagaaatggttgtattag

SEQ ID NO: 6439125 - DNA, 22 bp, Homo sapiens
tctgtagaagtctgtctttcta

SEQ ID NO: 6439126 - DNA, 14 bp, Homo sapiens
tctgtagacttctg

SEQ ID NO: 6439127 - DNA, 22 bp, Homo sapiens
tctgtagacttctggttgtatt

SEQ ID NO: 6439128 - DNA, 19 bp, Homo sapiens
tctgtagagaatgaaagga

SEQ ID NO: 6439129 - DNA, 13 bp, Homo sapiens
tctgtagaggagc

SEQ ID NO: 6439130 - DNA, 23 bp, Homo sapiens
tctgtagaggagcctggagtcgg

SEQ ID NO: 6439131 - DNA, 17 bp, Homo sapiens
tctgtagagggccctgg

SEQ ID NO: 6439132 - DNA, 20 bp, Homo sapiens
tctgtagagggccctggtgt

SEQ ID NO: 6439133 - DNA, 17 bp, Homo sapiens
tctgtagatgttgtctt

SEQ ID NO: 6439134 - DNA, 19 bp, Homo sapiens
tctgtagattctgtggaac

SEQ ID NO: 6439135 - DNA, 23 bp, Homo sapiens
tctgtagattctgtggaacaagc

SEQ ID NO: 6439136 - DNA, 20 bp, Homo sapiens
tctgtagccaacttaaacct

SEQ ID NO: 6439137 - DNA, 20 bp, Homo sapiens
tctgtagctacactgtataa

SEQ ID NO: 6439138 - DNA, 21 bp, Homo sapiens
tctgtagctattctttgacca

SEQ ID NO: 6439139 - DNA, 15 bp, Homo sapiens
tctgtagctccctcc

SEQ ID NO: 6439140 - DNA, 20 bp, Homo sapiens
tctgtagctccctcctccca

SEQ ID NO: 6439141 - DNA, 23 bp, Homo sapiens
tctgtagctccctcctcccatct

SEQ ID NO: 6439142 - DNA, 13 bp, Homo sapiens
tctgtagctcctc

SEQ ID NO: 6439143 - DNA, 19 bp, Homo sapiens
tctgtagcttatctgcccc

SEQ ID NO: 6439144 - DNA, 20 bp, Homo sapiens
tctgtagcttatctgcccct

SEQ ID NO: 6439145 - DNA, 13 bp, Homo sapiens
tctgtaggagaga

SEQ ID NO: 6439146 - DNA, 20 bp, Homo sapiens
tctgtaggagcaacttctct

SEQ ID NO: 6439147 - DNA, 18 bp, Homo sapiens
tctgtaggcacagagctg

SEQ ID NO: 6439148 - DNA, 22 bp, Homo sapiens
tctgtaggccagtagttctcaa

SEQ ID NO: 6439149 - DNA, 19 bp, Homo sapiens
tctgtagggaactctgggg

SEQ ID NO: 6439150 - DNA, 21 bp, Homo sapiens
tctgtagggaattcttctgtt

SEQ ID NO: 6439151 - DNA, 22 bp, Homo sapiens
tctgtagggatttttggctaca

SEQ ID NO: 6439152 - DNA, 15 bp, Homo sapiens
tctgtagggctggac

SEQ ID NO: 6439153 - DNA, 15 bp, Homo sapiens
tctgtaggtggagag

SEQ ID NO: 6439154 - DNA, 18 bp, Homo sapiens
tctgtaggtgtctctggg

SEQ ID NO: 6439155 - DNA, 21 bp, Homo sapiens
tctgtaggtgtctctgggcct

SEQ ID NO: 6439156 - DNA, 16 bp, Homo sapiens
tctgtaggttaaaaaa

SEQ ID NO: 6439157 - DNA, 18 bp, Homo sapiens
tctgtaggttgcacactt

SEQ ID NO: 6439158 - DNA, 21 bp, Homo sapiens
tctgtaggttgcacactttgg

SEQ ID NO: 6439159 - DNA, 22 bp, Homo sapiens
tctgtagtaatttattgtctgt

SEQ ID NO: 6439160 - DNA, 19 bp, Homo sapiens
tctgtagtactccttaaga

SEQ ID NO: 6439161 - DNA, 15 bp, Homo sapiens
tctgtagtcatttac

SEQ ID NO: 6439162 - DNA, 19 bp, Homo sapiens
tcatccacataagcactcc

SEQ ID NO: 6439163 - DNA, 16 bp, Homo sapiens
tcatccaccaatatca

SEQ ID NO: 6439164 - DNA, 17 bp, Homo sapiens
tcatccaccaatatcat

SEQ ID NO: 6439165 - DNA, 12 bp, Homo sapiens
tcatccacccca

SEQ ID NO: 6439166 - DNA, 18 bp, Homo sapiens
tcatccacccgctgcccc

SEQ ID NO: 6439167 - DNA, 19 bp, Homo sapiens
tcatccactagtgcaaatc

SEQ ID NO: 6439168 - DNA, 14 bp, Homo sapiens
tcatccactgtgcc

SEQ ID NO: 6439169 - DNA, 17 bp, Homo sapiens
tcatccactgtgccatg

SEQ ID NO: 6439170 - DNA, 14 bp, Homo sapiens
tcatccagaaaaga

SEQ ID NO: 6439171 - DNA, 22 bp, Homo sapiens
tcatccagaagtgtattcatat

SEQ ID NO: 6439172 - DNA, 20 bp, Homo sapiens
tcatccagactcagagctct

SEQ ID NO: 6439173 - DNA, 16 bp, Homo sapiens
tcatccagctacttag

SEQ ID NO: 6439174 - DNA, 16 bp, Homo sapiens
tcatccaggactgaga

SEQ ID NO: 6439175 - DNA, 18 bp, Homo sapiens
tcatccaggaggttcaaa

SEQ ID NO: 6439176 - DNA, 12 bp, Homo sapiens
tcatccaggcct

SEQ ID NO: 6439177 - DNA, 23 bp, Homo sapiens
tcatccagggaaatgcctcgagc

SEQ ID NO: 6439178 - DNA, 14 bp, Homo sapiens
tcatccagggctct

SEQ ID NO: 6439179 - DNA, 16 bp, Homo sapiens
tcatccagttgcaata

SEQ ID NO: 6439180 - DNA, 13 bp, Homo sapiens
tcatccatccagg

SEQ ID NO: 6439181 - DNA, 22 bp, Homo sapiens
tcatccatgcactttaattgaa

SEQ ID NO: 6439182 - DNA, 12 bp, Homo sapiens
tcatccattcct

SEQ ID NO: 6439183 - DNA, 13 bp, Homo sapiens
tcatccattcctc

SEQ ID NO: 6439184 - DNA, 23 bp, Homo sapiens
tcatcccaaaggacagccgcctg

SEQ ID NO: 6439185 - DNA, 20 bp, Homo sapiens
tcatcccaacagccaagacc

SEQ ID NO: 6439186 - DNA, 23 bp, Homo sapiens
tcatcccaacctctttttcctcc

SEQ ID NO: 6439187 - DNA, 20 bp, Homo sapiens
tcatcccacttcctttccta

SEQ ID NO: 6439188 - DNA, 13 bp, Homo sapiens
tcatcccagcacc

SEQ ID NO: 6439189 - DNA, 14 bp, Homo sapiens
tcatcccagcacct

SEQ ID NO: 6439190 - DNA, 17 bp, Homo sapiens
tcatcccagcacctgcc

SEQ ID NO: 6439191 - DNA, 20 bp, Homo sapiens
tcatcccagcacctgccagg

SEQ ID NO: 6439192 - DNA, 23 bp, Homo sapiens
tcatcccagcacctgccagggcc

SEQ ID NO: 6439193 - DNA, 16 bp, Homo sapiens
tcatcccagctgctga

SEQ ID NO: 6439194 - DNA, 22 bp, Homo sapiens
tcatcccattaatcatttcccc

SEQ ID NO: 6439195 - DNA, 23 bp, Homo sapiens
tcatcccattccaggcagcctct

SEQ ID NO: 6439196 - DNA, 19 bp, Homo sapiens
tcatccccaaatgtgtctt

SEQ ID NO: 6439197 - DNA, 20 bp, Homo sapiens
tcatccccacagctggctct

SEQ ID NO: 6439198 - DNA, 13 bp, Homo sapiens
tcatcccccctgc

SEQ ID NO: 6439199 - DNA, 14 bp, Homo sapiens
tcatcccccctgct

SEQ ID NO: 6439200 - DNA, 14 bp, Homo sapiens
tcatccccctgtgg

SEQ ID NO: 6439201 - DNA, 17 bp, Homo sapiens
tcatcccctcacttgcc

SEQ ID NO: 6439202 - DNA, 15 bp, Homo sapiens
tcatcccctctcagg

SEQ ID NO: 6439203 - DNA, 13 bp, Homo sapiens
tcatccccttgtg

SEQ ID NO: 6439204 - DNA, 18 bp, Homo sapiens
tcatccccttgtgtcaga

SEQ ID NO: 6439205 - DNA, 12 bp, Homo sapiens
tcatcccgctcc

SEQ ID NO: 6439206 - DNA, 17 bp, Homo sapiens
tcatccctaatgctgca

SEQ ID NO: 6439207 - DNA, 17 bp, Homo sapiens
tcatccctcaactgagg

SEQ ID NO: 6439208 - DNA, 19 bp, Homo sapiens
tcatccctggacttctggg

SEQ ID NO: 6439209 - DNA, 22 bp, Homo sapiens
tcatcccttcctcctctcctgg

SEQ ID NO: 6439210 - DNA, 23 bp, Homo sapiens
tcatcccttcctcctctcctgga

SEQ ID NO: 6439211 - DNA, 23 bp, Homo sapiens
tcatcccttctcttccaggcagc

SEQ ID NO: 6439212 - DNA, 12 bp, Homo sapiens
tcatccctttcc

SEQ ID NO: 6439213 - DNA, 14 bp, Homo sapiens
tcatccctttggtt

SEQ ID NO: 6439214 - DNA, 15 bp, Homo sapiens
tcatccgtctgtgtg

SEQ ID NO: 6439215 - DNA, 15 bp, Homo sapiens
tcatccgttgtgact

SEQ ID NO: 6439216 - DNA, 14 bp, Homo sapiens
tcatcctaacatga

SEQ ID NO: 6439217 - DNA, 15 bp, Homo sapiens
tcatcctaagctatt

SEQ ID NO: 6439218 - DNA, 18 bp, Homo sapiens
tcatcctcaaagaaagtg

SEQ ID NO: 6439219 - DNA, 22 bp, Homo sapiens
tcatcctcaaagaaagtgtatt

SEQ ID NO: 6439220 - DNA, 23 bp, Homo sapiens
tcatcctcaaagaaagtgtattg

SEQ ID NO: 6439221 - DNA, 15 bp, Homo sapiens
tcatcctcacatgtg

SEQ ID NO: 6439222 - DNA, 12 bp, Homo sapiens
tcatcctcagca

SEQ ID NO: 6439223 - DNA, 14 bp, Homo sapiens
tcatcctcagcaag

SEQ ID NO: 6439224 - DNA, 21 bp, Homo sapiens
tcatcctccagtaccttgctt

SEQ ID NO: 6439225 - DNA, 21 bp, Homo sapiens
tcatcctcccgccaggagctt

SEQ ID NO: 6439226 - DNA, 18 bp, Homo sapiens
tcatcctccctgaccctg

SEQ ID NO: 6439227 - DNA, 23 bp, Homo sapiens
tcatcctcccttgccccaggcca

SEQ ID NO: 6439228 - DNA, 14 bp, Homo sapiens
tcatcctcctcctc

SEQ ID NO: 6439229 - DNA, 12 bp, Homo sapiens
tcatcctcctgg

SEQ ID NO: 6439230 - DNA, 16 bp, Homo sapiens
tcatcctcctggaacc

SEQ ID NO: 6439231 - DNA, 22 bp, Homo sapiens
tcatcctcctggaaccttgctg

SEQ ID NO: 6439232 - DNA, 23 bp, Homo sapiens
tcatcctcctggaaccttgctgt

SEQ ID NO: 6439233 - DNA, 19 bp, Homo sapiens
tcatcctctggaagggatg

SEQ ID NO: 6439234 - DNA, 17 bp, Homo sapiens
tcatcctcttttaatgg

SEQ ID NO: 6439235 - DNA, 15 bp, Homo sapiens
tcatcctgaccaaga

SEQ ID NO: 6439236 - DNA, 20 bp, Homo sapiens
tcatcctgagcccaaccagg

SEQ ID NO: 6439237 - DNA, 18 bp, Homo sapiens
tcatcctgatttttacta

SEQ ID NO: 6439238 - DNA, 13 bp, Homo sapiens
tcatcctgcaggc

SEQ ID NO: 6439239 - DNA, 22 bp, Homo sapiens
tcatcctgcatgggaaaaatgt

SEQ ID NO: 6439240 - DNA, 15 bp, Homo sapiens
tcatcctgccctgca

SEQ ID NO: 6439241 - DNA, 23 bp, Homo sapiens
tcatcctgccttcatggaactca

SEQ ID NO: 6439242 - DNA, 20 bp, Homo sapiens
tcatcctggcctccttttgc

SEQ ID NO: 6439243 - DNA, 11 bp, Homo sapiens
tcatcctggct

SEQ ID NO: 6439244 - DNA, 12 bp, Homo sapiens
tcatcctgggca

SEQ ID NO: 6439245 - DNA, 16 bp, Homo sapiens
tcatcctgggggctct

SEQ ID NO: 6439246 - DNA, 20 bp, Homo sapiens
tcatcctgtagggcacccaa

SEQ ID NO: 6439247 - DNA, 11 bp, Homo sapiens
tcatcctgtgt

SEQ ID NO: 6439248 - DNA, 13 bp, Homo sapiens
tcatcctgtgtcc

SEQ ID NO: 6439249 - DNA, 18 bp, Homo sapiens
tcatcctgtgtcccctga

SEQ ID NO: 6439250 - DNA, 20 bp, Homo sapiens
tcatcctgtgtcccctgacc

SEQ ID NO: 6439251 - DNA, 17 bp, Homo sapiens
tcatcctgttggctgct

SEQ ID NO: 6439252 - DNA, 12 bp, Homo sapiens
tcatcctgtttt

SEQ ID NO: 6439253 - DNA, 14 bp, Homo sapiens
tcatcctgttttct

SEQ ID NO: 6439254 - DNA, 18 bp, Homo sapiens
tcatccttcccactctgt

SEQ ID NO: 6439255 - DNA, 22 bp, Homo sapiens
tcatccttctggaataaggaga

SEQ ID NO: 6439256 - DNA, 22 bp, Homo sapiens
tcatccttcttccactgtctca

SEQ ID NO: 6439257 - DNA, 16 bp, Homo sapiens
tcatccttctttcctt

SEQ ID NO: 6439258 - DNA, 17 bp, Homo sapiens
tcatccttctttccttg

SEQ ID NO: 6439259 - DNA, 15 bp, Homo sapiens
tcatccttgcccatc

SEQ ID NO: 6439260 - DNA, 17 bp, Homo sapiens
tcatcctttccagcatg

SEQ ID NO: 6439261 - DNA, 16 bp, Homo sapiens
tcatcctttccctctc

SEQ ID NO: 6439262 - DNA, 20 bp, Homo sapiens
tcatcctttccctctcccag

SEQ ID NO: 6439263 - DNA, 23 bp, Homo sapiens
tcatcctttccctctcccagtcc

SEQ ID NO: 6439264 - DNA, 17 bp, Homo sapiens
tcatccttttggataag

SEQ ID NO: 6439265 - DNA, 18 bp, Homo sapiens
tcatcgaaaattcatttc

SEQ ID NO: 6439266 - DNA, 19 bp, Homo sapiens
tcatcgaaaattcatttca

SEQ ID NO: 6439267 - DNA, 20 bp, Homo sapiens
tcatcgaagggattgtgtat

SEQ ID NO: 6439268 - DNA, 16 bp, Homo sapiens
tcatcgagatggagct

SEQ ID NO: 6439269 - DNA, 21 bp, Homo sapiens
tcatcgaggagctagaacatt

SEQ ID NO: 6439270 - DNA, 17 bp, Homo sapiens
tcatcgaggtatgttta

SEQ ID NO: 6439271 - DNA, 17 bp, Homo sapiens
tcatcgccagacaactg

SEQ ID NO: 6439272 - DNA, 17 bp, Homo sapiens
tcatcgctcgtgtgttc

SEQ ID NO: 6439273 - DNA, 22 bp, Homo sapiens
tcatcggagttgacagtgaaac

SEQ ID NO: 6439274 - DNA, 16 bp, Homo sapiens
tcatcgtcttttagtt

SEQ ID NO: 6439275 - DNA, 15 bp, Homo sapiens
tcatcgttccccacc

SEQ ID NO: 6439276 - DNA, 17 bp, Homo sapiens
tcatcgttccccacccc

SEQ ID NO: 6439277 - DNA, 21 bp, Homo sapiens
tcatctaattctggcaggacc

SEQ ID NO: 6439278 - DNA, 19 bp, Homo sapiens
tcatctacacatataaaca

SEQ ID NO: 6439279 - DNA, 20 bp, Homo sapiens
tcatctaccattttctggtt

SEQ ID NO: 6439280 - DNA, 17 bp, Homo sapiens
tcatctaccttttctct

SEQ ID NO: 6439281 - DNA, 13 bp, Homo sapiens
tcatctacttttt

SEQ ID NO: 6439282 - DNA, 15 bp, Homo sapiens
tcatctagccccttc

SEQ ID NO: 6439283 - DNA, 23 bp, Homo sapiens
tcatctataaagaagaacttgca

SEQ ID NO: 6439284 - DNA, 22 bp, Homo sapiens
tcatctatgagggtgtttcctc

SEQ ID NO: 6439285 - DNA, 18 bp, Homo sapiens
tcatctatggttctaaat

SEQ ID NO: 6439286 - DNA, 13 bp, Homo sapiens
tcatctatgtcat

SEQ ID NO: 6439287 - DNA, 16 bp, Homo sapiens
tcatctatttctgaga

SEQ ID NO: 6439288 - DNA, 16 bp, Homo sapiens
tcatctattttatttt

SEQ ID NO: 6439289 - DNA, 13 bp, Homo sapiens
tcatctattttga

SEQ ID NO: 6439290 - DNA, 17 bp, Homo sapiens
tcatctcaaacactgct

SEQ ID NO: 6439291 - DNA, 20 bp, Homo sapiens
tcatctcaaacactgcttaa

SEQ ID NO: 6439292 - DNA, 12 bp, Homo sapiens
tcatctcaagct

SEQ ID NO: 6439293 - DNA, 17 bp, Homo sapiens
tcatctcactgcccagt

SEQ ID NO: 6439294 - DNA, 13 bp, Homo sapiens
tcatctcagctca

SEQ ID NO: 6439295 - DNA, 17 bp, Homo sapiens
tcatctcatgctctctg

SEQ ID NO: 6439296 - DNA, 14 bp, Homo sapiens
tcatctcatttaag

SEQ ID NO: 6439297 - DNA, 20 bp, Homo sapiens
tcatctcatttaagggaaaa

SEQ ID NO: 6439298 - DNA, 21 bp, Homo sapiens
tcatctcatttaatcctccct

SEQ ID NO: 6439299 - DNA, 21 bp, Homo sapiens
tcatctccaaatcttgccatt

SEQ ID NO: 6439300 - DNA, 22 bp, Homo sapiens
tcatctccaaggatcctctcca

SEQ ID NO: 6439301 - DNA, 22 bp, Homo sapiens
tcatctccagggagtcccctcc

SEQ ID NO: 6439302 - DNA, 13 bp, Homo sapiens
tcatctccagtgt

SEQ ID NO: 6439303 - DNA, 13 bp, Homo sapiens
tcatctccatcag

SEQ ID NO: 6439304 - DNA, 20 bp, Homo sapiens
tcatctccatcatatgcctg

SEQ ID NO: 6439305 - DNA, 15 bp, Homo sapiens
tcatctccatgctct

SEQ ID NO: 6439306 - DNA, 17 bp, Homo sapiens
tcatctccatgctcttt

SEQ ID NO: 6439307 - DNA, 22 bp, Homo sapiens
tcatctcccacctagcagcacc

SEQ ID NO: 6439308 - DNA, 19 bp, Homo sapiens
tcatctcccaggccccagg

SEQ ID NO: 6439309 - DNA, 23 bp, Homo sapiens
tcatctcccatgtgtgatgctga

SEQ ID NO: 6439310 - DNA, 16 bp, Homo sapiens
tcatctccccatcatt

SEQ ID NO: 6439311 - DNA, 22 bp, Homo sapiens
tcatctcctgaccctcccactc

SEQ ID NO: 6439312 - DNA, 17 bp, Homo sapiens
tcatctcctgagtatgt

SEQ ID NO: 6439313 - DNA, 18 bp, Homo sapiens
tcatctcctgagtatgta

SEQ ID NO: 6439314 - DNA, 15 bp, Homo sapiens
tcatctccttcctga

SEQ ID NO: 6439315 - DNA, 14 bp, Homo sapiens
tcatctcctttgct

SEQ ID NO: 6439316 - DNA, 16 bp, Homo sapiens
tcatctctcaaactta

SEQ ID NO: 6439317 - DNA, 18 bp, Homo sapiens
tcatctctctacctccac

SEQ ID NO: 6439318 - DNA, 20 bp, Homo sapiens
tcatctctctacctccaccc

SEQ ID NO: 6439319 - DNA, 13 bp, Homo sapiens
tcatctctctggg

SEQ ID NO: 6439320 - DNA, 16 bp, Homo sapiens
tcatctctctggggcc

SEQ ID NO: 6439321 - DNA, 20 bp, Homo sapiens
tcatctctctggggccctgg

SEQ ID NO: 6439322 - DNA, 18 bp, Homo sapiens
tcatctctgaaaattctg

SEQ ID NO: 6439323 - DNA, 20 bp, Homo sapiens
tcatctctgaaaattctgga

SEQ ID NO: 6439324 - DNA, 21 bp, Homo sapiens
tcatctctgcctgacaaggcc

SEQ ID NO: 6439325 - DNA, 23 bp, Homo sapiens
tcatctctgcctgacaaggccag

SEQ ID NO: 6439326 - DNA, 16 bp, Homo sapiens
tcatctctgcctttga

SEQ ID NO: 6439327 - DNA, 18 bp, Homo sapiens
tcatctctgcctttgagt

SEQ ID NO: 6439328 - DNA, 12 bp, Homo sapiens
tcatctctggtt

SEQ ID NO: 6439329 - DNA, 17 bp, Homo sapiens
tcatctctgtcgtgctt

SEQ ID NO: 6439330 - DNA, 16 bp, Homo sapiens
tcatctcttaaatttt

SEQ ID NO: 6439331 - DNA, 23 bp, Homo sapiens
tcatctcttaaattttgttttct

SEQ ID NO: 6439332 - DNA, 14 bp, Homo sapiens
tcatctcttagctc

SEQ ID NO: 6439333 - DNA, 19 bp, Homo sapiens
tcatctcttagctcccctc

SEQ ID NO: 6439334 - DNA, 21 bp, Homo sapiens
tcatctcttagctcccctcca

SEQ ID NO: 6439335 - DNA, 17 bp, Homo sapiens
tcatctcttcaatcact

SEQ ID NO: 6439336 - DNA, 12 bp, Homo sapiens
tcatctcttcag

SEQ ID NO: 6439337 - DNA, 14 bp, Homo sapiens
tcatctcttctttt

SEQ ID NO: 6439338 - DNA, 15 bp, Homo sapiens
tcatctcttgataaa

SEQ ID NO: 6439339 - DNA, 16 bp, Homo sapiens
tcatctcttgataaag

SEQ ID NO: 6439340 - DNA, 15 bp, Homo sapiens
tcatctcttgatgaa

SEQ ID NO: 6439341 - DNA, 17 bp, Homo sapiens
tctgtagtgagatagca

SEQ ID NO: 6439342 - DNA, 14 bp, Homo sapiens
tctgtagttacatt

SEQ ID NO: 6439343 - DNA, 20 bp, Homo sapiens
tctgtagttcaatttcatgt

SEQ ID NO: 6439344 - DNA, 19 bp, Homo sapiens
tctgtagttcctaatggat

SEQ ID NO: 6439345 - DNA, 22 bp, Homo sapiens
tctgtagttttatcacatgtat

SEQ ID NO: 6439346 - DNA, 23 bp, Homo sapiens
tctgtagttttatcacatgtatg

SEQ ID NO: 6439347 - DNA, 15 bp, Homo sapiens
tctgtataaaaatgt

SEQ ID NO: 6439348 - DNA, 17 bp, Homo sapiens
tctgtataaaaatgtaa

SEQ ID NO: 6439349 - DNA, 22 bp, Homo sapiens
tctgtataaaaatgtaaattag

SEQ ID NO: 6439350 - DNA, 21 bp, Homo sapiens
tctgtataaacattaaatgtc

SEQ ID NO: 6439351 - DNA, 13 bp, Homo sapiens
tctgtataaataa

SEQ ID NO: 6439352 - DNA, 14 bp, Homo sapiens
tctgtataaataag

SEQ ID NO: 6439353 - DNA, 14 bp, Homo sapiens
tctgtataaataat

SEQ ID NO: 6439354 - DNA, 16 bp, Homo sapiens
tctgtataaatgtcta

SEQ ID NO: 6439355 - DNA, 18 bp, Homo sapiens
tctgtataagctgtaata

SEQ ID NO: 6439356 - DNA, 23 bp, Homo sapiens
tctgtataagctgtaatatcatt

SEQ ID NO: 6439357 - DNA, 21 bp, Homo sapiens
tctgtataagtaagaaaatat

SEQ ID NO: 6439358 - DNA, 19 bp, Homo sapiens
tctgtataagttgaaggaa

SEQ ID NO: 6439359 - DNA, 17 bp, Homo sapiens
tctgtataatctattta

SEQ ID NO: 6439360 - DNA, 17 bp, Homo sapiens
tctgtatactgtaaaag

SEQ ID NO: 6439361 - DNA, 20 bp, Homo sapiens
tctgtatagattataaaatt

SEQ ID NO: 6439362 - DNA, 14 bp, Homo sapiens
tctgtatataaaat

SEQ ID NO: 6439363 - DNA, 14 bp, Homo sapiens
tctgtatataaata

SEQ ID NO: 6439364 - DNA, 15 bp, Homo sapiens
tctgtatatactttt

SEQ ID NO: 6439365 - DNA, 15 bp, Homo sapiens
tctgtatatagatgt

SEQ ID NO: 6439366 - DNA, 18 bp, Homo sapiens
tctgtatatagatgtctg

SEQ ID NO: 6439367 - DNA, 23 bp, Homo sapiens
tctgtatatagatgtctgtgtat

SEQ ID NO: 6439368 - DNA, 17 bp, Homo sapiens
tctgtatatcagctcta

SEQ ID NO: 6439369 - DNA, 20 bp, Homo sapiens
tctgtatatgttgtaataaa

SEQ ID NO: 6439370 - DNA, 14 bp, Homo sapiens
tctgtatattgggc

SEQ ID NO: 6439371 - DNA, 17 bp, Homo sapiens
tctgtatatttgtcatg

SEQ ID NO: 6439372 - DNA, 19 bp, Homo sapiens
tctgtatatttgtcatgac

SEQ ID NO: 6439373 - DNA, 15 bp, Homo sapiens
tctgtatattttggg

SEQ ID NO: 6439374 - DNA, 16 bp, Homo sapiens
tctgtatcaagcccct

SEQ ID NO: 6439375 - DNA, 18 bp, Homo sapiens
tctgtatcaagcccctgt

SEQ ID NO: 6439376 - DNA, 17 bp, Homo sapiens
tctgtatcactctgtgt

SEQ ID NO: 6439377 - DNA, 19 bp, Homo sapiens
tctgtatccaaataatgaa

SEQ ID NO: 6439378 - DNA, 16 bp, Homo sapiens
tctgtatccccagtgc

SEQ ID NO: 6439379 - DNA, 16 bp, Homo sapiens
tctgtatccgtgaatt

SEQ ID NO: 6439380 - DNA, 18 bp, Homo sapiens
tctgtatcggagacagtg

SEQ ID NO: 6439381 - DNA, 13 bp, Homo sapiens
tctgtatctatgc

SEQ ID NO: 6439382 - DNA, 14 bp, Homo sapiens
tctgtatcttttct

SEQ ID NO: 6439383 - DNA, 14 bp, Homo sapiens
tctgtatgattcta

SEQ ID NO: 6439384 - DNA, 22 bp, Homo sapiens
tctgtatgtattagtgatattt

SEQ ID NO: 6439385 - DNA, 13 bp, Homo sapiens
tctgtatgtcatg

SEQ ID NO: 6439386 - DNA, 14 bp, Homo sapiens
tctgtatgtcatgg

SEQ ID NO: 6439387 - DNA, 15 bp, Homo sapiens
tctgtatgtgttcta

SEQ ID NO: 6439388 - DNA, 19 bp, Homo sapiens
tctgtattaaatattttca

SEQ ID NO: 6439389 - DNA, 18 bp, Homo sapiens
tctgtattcatacagcac

SEQ ID NO: 6439390 - DNA, 19 bp, Homo sapiens
tctgtattcatacagcact

SEQ ID NO: 6439391 - DNA, 22 bp, Homo sapiens
tctgtattctgcaacagcctgt

SEQ ID NO: 6439392 - DNA, 19 bp, Homo sapiens
tctgtattgaaaatggctt

SEQ ID NO: 6439393 - DNA, 13 bp, Homo sapiens
tctgtattgccat

SEQ ID NO: 6439394 - DNA, 22 bp, Homo sapiens
tctgtattgtctattatttaga

SEQ ID NO: 6439395 - DNA, 17 bp, Homo sapiens
tctgtattgtgctgatt

SEQ ID NO: 6439396 - DNA, 20 bp, Homo sapiens
tctgtatttccccaacatgt

SEQ ID NO: 6439397 - DNA, 23 bp, Homo sapiens
tctgtatttccccaacatgtaat

SEQ ID NO: 6439398 - DNA, 13 bp, Homo sapiens
tctgtatttgaaa

SEQ ID NO: 6439399 - DNA, 12 bp, Homo sapiens
tctgtattttca

SEQ ID NO: 6439400 - DNA, 13 bp, Homo sapiens
tctgtattttcat

SEQ ID NO: 6439401 - DNA, 14 bp, Homo sapiens
tctgtattttcatt

SEQ ID NO: 6439402 - DNA, 16 bp, Homo sapiens
tctgtattttcattta

SEQ ID NO: 6439403 - DNA, 12 bp, Homo sapiens
tctgtattttcc

SEQ ID NO: 6439404 - DNA, 21 bp, Homo sapiens
tctgtattttttcttgcattg

SEQ ID NO: 6439405 - DNA, 15 bp, Homo sapiens
tctgtcaaaacactg

SEQ ID NO: 6439406 - DNA, 15 bp, Homo sapiens
tctgtcaaagtcaga

SEQ ID NO: 6439407 - DNA, 14 bp, Homo sapiens
tctgtcaaatgtgt

SEQ ID NO: 6439408 - DNA, 20 bp, Homo sapiens
tctgtcaaatgtttccttaa

SEQ ID NO: 6439409 - DNA, 21 bp, Homo sapiens
tctgtcaaatgtttccttaaa

SEQ ID NO: 6439410 - DNA, 17 bp, Homo sapiens
tctgtcaagagtagtta

SEQ ID NO: 6439411 - DNA, 20 bp, Homo sapiens
tctgtcaagcatattggaaa

SEQ ID NO: 6439412 - DNA, 21 bp, Homo sapiens
tctgtcaagcatattggaaag

SEQ ID NO: 6439413 - DNA, 13 bp, Homo sapiens
tctgtcaattttt

SEQ ID NO: 6439414 - DNA, 22 bp, Homo sapiens
tctgtcacaggctgggtcaaaa

SEQ ID NO: 6439415 - DNA, 20 bp, Homo sapiens
tctgtcacagtaaaaataaa

SEQ ID NO: 6439416 - DNA, 21 bp, Homo sapiens
tctgtcacatccaactggaaa

SEQ ID NO: 6439417 - DNA, 13 bp, Homo sapiens
tctgtcaccaaat

SEQ ID NO: 6439418 - DNA, 19 bp, Homo sapiens
tctgtcaccacatcttgtc

SEQ ID NO: 6439419 - DNA, 20 bp, Homo sapiens
tctgtcaccacatcttgtct

SEQ ID NO: 6439420 - DNA, 16 bp, Homo sapiens
tctgtcacccaggctg

SEQ ID NO: 6439421 - DNA, 18 bp, Homo sapiens
tctgtcaccctggccacc

SEQ ID NO: 6439422 - DNA, 19 bp, Homo sapiens
tctgtcaccctggccacca

SEQ ID NO: 6439423 - DNA, 21 bp, Homo sapiens
tctgtcaccctggccaccacc

SEQ ID NO: 6439424 - DNA, 19 bp, Homo sapiens
tctgtcagatgagaacaaa

SEQ ID NO: 6439425 - DNA, 20 bp, Homo sapiens
tctgtcagatgagaacaaag

SEQ ID NO: 6439426 - DNA, 24 bp, Homo sapiens
tctgtcagatgagaacaaagctgt

SEQ ID NO: 6439427 - DNA, 13 bp, Homo sapiens
tctgtcagccagc

SEQ ID NO: 6439428 - DNA, 17 bp, Homo sapiens
tctgtcagccagccgcc

SEQ ID NO: 6439429 - DNA, 13 bp, Homo sapiens
tctgtcagctgca

SEQ ID NO: 6439430 - DNA, 16 bp, Homo sapiens
tctgtcaggagagcag

SEQ ID NO: 6439431 - DNA, 23 bp, Homo sapiens
tctgtcagggccttggcccaggg

SEQ ID NO: 6439432 - DNA, 14 bp, Homo sapiens
tctgtcagtaaaac

SEQ ID NO: 6439433 - DNA, 20 bp, Homo sapiens
tctgtcagtaaaactctcaa

SEQ ID NO: 6439434 - DNA, 13 bp, Homo sapiens
tctgtcagtcaca

SEQ ID NO: 6439435 - DNA, 12 bp, Homo sapiens
tctgtcagtgtg

SEQ ID NO: 6439436 - DNA, 13 bp, Homo sapiens
tctgtcagtgttt

SEQ ID NO: 6439437 - DNA, 19 bp, Homo sapiens
tctgtcagtgtttgtattt

SEQ ID NO: 6439438 - DNA, 15 bp, Homo sapiens
tctgtcagtttgtga

SEQ ID NO: 6439439 - DNA, 18 bp, Homo sapiens
tctgtcagtttgtgaagt

SEQ ID NO: 6439440 - DNA, 12 bp, Homo sapiens
tctgtcataata

SEQ ID NO: 6439441 - DNA, 18 bp, Homo sapiens
tctgtcatatcttcacaa

SEQ ID NO: 6439442 - DNA, 20 bp, Homo sapiens
tctgtcatcactccctggat

SEQ ID NO: 6439443 - DNA, 11 bp, Homo sapiens
tctgtcatcca

SEQ ID NO: 6439444 - DNA, 21 bp, Homo sapiens
tctgtcatctaccttttctct

SEQ ID NO: 6439445 - DNA, 22 bp, Homo sapiens
tctgtcatgaacatgttcctga

SEQ ID NO: 6439446 - DNA, 14 bp, Homo sapiens
tctgtcattatatt

SEQ ID NO: 6439447 - DNA, 13 bp, Homo sapiens
tctgtcattgtta

SEQ ID NO: 6439448 - DNA, 18 bp, Homo sapiens
tctgtcatttctctttca

SEQ ID NO: 6439449 - DNA, 23 bp, Homo sapiens
tctgtcatttgagcagggctcag

SEQ ID NO: 6439450 - DNA, 21 bp, Homo sapiens
tctgtccaaacatttcatccg

SEQ ID NO: 6439451 - DNA, 15 bp, Homo sapiens
tctgtccaaaggagg

SEQ ID NO: 6439452 - DNA, 22 bp, Homo sapiens
tctgtccaaaggaggctggcag

SEQ ID NO: 6439453 - DNA, 23 bp, Homo sapiens
tctgtccaaaggaggctggcagg

SEQ ID NO: 6439454 - DNA, 17 bp, Homo sapiens
tctgtccaacccctccc

SEQ ID NO: 6439455 - DNA, 19 bp, Homo sapiens
tctgtccaacccctccccc

SEQ ID NO: 6439456 - DNA, 12 bp, Homo sapiens
tctgtccaagga

SEQ ID NO: 6439457 - DNA, 16 bp, Homo sapiens
tctgtccaatctgcaa

SEQ ID NO: 6439458 - DNA, 22 bp, Homo sapiens
tctgtccaatttcgggagcctt

SEQ ID NO: 6439459 - DNA, 23 bp, Homo sapiens
tctgtccacatccccagagccca

SEQ ID NO: 6439460 - DNA, 13 bp, Homo sapiens
tctgtccacctcg

SEQ ID NO: 6439461 - DNA, 21 bp, Homo sapiens
tctgtccacctcggcctccca

SEQ ID NO: 6439462 - DNA, 23 bp, Homo sapiens
tctgtccacctcggcctcccaga

SEQ ID NO: 6439463 - DNA, 14 bp, Homo sapiens
tctgtccagaaaat

SEQ ID NO: 6439464 - DNA, 19 bp, Homo sapiens
tctgtccagataagttatt

SEQ ID NO: 6439465 - DNA, 20 bp, Homo sapiens
tctgtccagataagttattt

SEQ ID NO: 6439466 - DNA, 16 bp, Homo sapiens
tctgtccagccagctc

SEQ ID NO: 6439467 - DNA, 21 bp, Homo sapiens
tctgtccagctggggccagag

SEQ ID NO: 6439468 - DNA, 24 bp, Homo sapiens
tctgtccaggcactgctgcccagc

SEQ ID NO: 6439469 - DNA, 14 bp, Homo sapiens
tctgtccaggccac

SEQ ID NO: 6439470 - DNA, 20 bp, Homo sapiens
tctgtccagggccctgagct

SEQ ID NO: 6439471 - DNA, 19 bp, Homo sapiens
tctgtccagggcttcagat

SEQ ID NO: 6439472 - DNA, 15 bp, Homo sapiens
tctgtccatcctcct

SEQ ID NO: 6439473 - DNA, 19 bp, Homo sapiens
tctgtccatcctcctctcc

SEQ ID NO: 6439474 - DNA, 20 bp, Homo sapiens
tctgtccatcctcctctcca

SEQ ID NO: 6439475 - DNA, 22 bp, Homo sapiens
tctgtccatcctcctctccatg

SEQ ID NO: 6439476 - DNA, 24 bp, Homo sapiens
tctgtccatcctcctctccatgca

SEQ ID NO: 6439477 - DNA, 15 bp, Homo sapiens
tctgtccatctgccc

SEQ ID NO: 6439478 - DNA, 17 bp, Homo sapiens
tctgtccatctgcccgc

SEQ ID NO: 6439479 - DNA, 18 bp, Homo sapiens
tctgtccatggcctttct

SEQ ID NO: 6439480 - DNA, 15 bp, Homo sapiens
tctgtcccaccccta

SEQ ID NO: 6439481 - DNA, 12 bp, Homo sapiens
tctgtcccactg

SEQ ID NO: 6439482 - DNA, 18 bp, Homo sapiens
tctgtcccagttaactgt

SEQ ID NO: 6439483 - DNA, 14 bp, Homo sapiens
tctgtcccattccc

SEQ ID NO: 6439484 - DNA, 18 bp, Homo sapiens
tctgtcccattccctggg

SEQ ID NO: 6439485 - DNA, 24 bp, Homo sapiens
tctgtcccattccctgggatctgg

SEQ ID NO: 6439486 - DNA, 13 bp, Homo sapiens
tctgtccccagcc

SEQ ID NO: 6439487 - DNA, 15 bp, Homo sapiens
tctgtccccaggcct

SEQ ID NO: 6439488 - DNA, 15 bp, Homo sapiens
tctgtccccaggtcc

SEQ ID NO: 6439489 - DNA, 13 bp, Homo sapiens
tctgtcccccagg

SEQ ID NO: 6439490 - DNA, 17 bp, Homo sapiens
tctgtcccccaggctgg

SEQ ID NO: 6439491 - DNA, 22 bp, Homo sapiens
tctgtccccctttagatctctg

SEQ ID NO: 6439492 - DNA, 23 bp, Homo sapiens
tctgtccccctttagatctctga

SEQ ID NO: 6439493 - DNA, 14 bp, Homo sapiens
tctgtcccctctcc

SEQ ID NO: 6439494 - DNA, 20 bp, Homo sapiens
tctgtccccttctctcatct

SEQ ID NO: 6439495 - DNA, 21 bp, Homo sapiens
tctgtccccttctctcatctc

SEQ ID NO: 6439496 - DNA, 15 bp, Homo sapiens
tctgtccctcacagc

SEQ ID NO: 6439497 - DNA, 17 bp, Homo sapiens
tctgtccctcactgcct

SEQ ID NO: 6439498 - DNA, 20 bp, Homo sapiens
tctgtccctcactgccttcc

SEQ ID NO: 6439499 - DNA, 12 bp, Homo sapiens
tctgtccctctc

SEQ ID NO: 6439500 - DNA, 13 bp, Homo sapiens
tctgtccctctcc

SEQ ID NO: 6439501 - DNA, 17 bp, Homo sapiens
tctgtccctctttgcct

SEQ ID NO: 6439502 - DNA, 15 bp, Homo sapiens
tctgtccctgtcctt

SEQ ID NO: 6439503 - DNA, 18 bp, Homo sapiens
tctgtcccttccccttca

SEQ ID NO: 6439504 - DNA, 19 bp, Homo sapiens
tctgtcccttctgtccctc

SEQ ID NO: 6439505 - DNA, 17 bp, Homo sapiens
tctgtcccttgctgtat

SEQ ID NO: 6439506 - DNA, 16 bp, Homo sapiens
tctgtcccttgttttt

SEQ ID NO: 6439507 - DNA, 16 bp, Homo sapiens
tctgtccgtccagagc

SEQ ID NO: 6439508 - DNA, 17 bp, Homo sapiens
tctgtccgtccagagcc

SEQ ID NO: 6439509 - DNA, 21 bp, Homo sapiens
tctgtccgtgccccttccctg

SEQ ID NO: 6439510 - DNA, 15 bp, Homo sapiens
tctgtccgtggaaaa

SEQ ID NO: 6439511 - DNA, 15 bp, Homo sapiens
tctgtcctactctgt

SEQ ID NO: 6439512 - DNA, 20 bp, Homo sapiens
tctgtcctactctgtgtcag

SEQ ID NO: 6439513 - DNA, 13 bp, Homo sapiens
tctgtcctatgga

SEQ ID NO: 6439514 - DNA, 13 bp, Homo sapiens
tctgtcctcaccc

SEQ ID NO: 6439515 - DNA, 13 bp, Homo sapiens
tctgtcctcagag

SEQ ID NO: 6439516 - DNA, 21 bp, Homo sapiens
tctgtcctcagccttgccaga

SEQ ID NO: 6439517 - DNA, 19 bp, Homo sapiens
tctgtcctcccatcccctc

SEQ ID NO: 6439518 - DNA, 11 bp, Homo sapiens
tctgtcctcct

SEQ ID NO: 6439519 - DNA, 12 bp, Homo sapiens
tctgtcctctgt

SEQ ID NO: 6439520 - DNA, 13 bp, Homo sapiens
tcatctctttaga

SEQ ID NO: 6439521 - DNA, 16 bp, Homo sapiens
tcatctctttgtcctg

SEQ ID NO: 6439522 - DNA, 23 bp, Homo sapiens
tcatctgaaggggcaaattcttt

SEQ ID NO: 6439523 - DNA, 20 bp, Homo sapiens
tcatctgaatttgccctggg

SEQ ID NO: 6439524 - DNA, 22 bp, Homo sapiens
tcatctgaccttcaccttggat

SEQ ID NO: 6439525 - DNA, 11 bp, Homo sapiens
tcatctgagag

SEQ ID NO: 6439526 - DNA, 23 bp, Homo sapiens
tcatctgagaggctctccgtgca

SEQ ID NO: 6439527 - DNA, 18 bp, Homo sapiens
tcatctgagcttttacca

SEQ ID NO: 6439528 - DNA, 22 bp, Homo sapiens
tcatctgaggagtccaaaatat

SEQ ID NO: 6439529 - DNA, 22 bp, Homo sapiens
tcatctgatcacttcatgtttt

SEQ ID NO: 6439530 - DNA, 21 bp, Homo sapiens
tcatctgattggacaggcatg

SEQ ID NO: 6439531 - DNA, 12 bp, Homo sapiens
tcatctgcaaaa

SEQ ID NO: 6439532 - DNA, 13 bp, Homo sapiens
tcatctgcaaaag

SEQ ID NO: 6439533 - DNA, 16 bp, Homo sapiens
tcatctgcacccttct

SEQ ID NO: 6439534 - DNA, 23 bp, Homo sapiens
tcatctgcagttctttttgtaca

SEQ ID NO: 6439535 - DNA, 17 bp, Homo sapiens
tcatctgcattcctgat

SEQ ID NO: 6439536 - DNA, 18 bp, Homo sapiens
tcatctgccggcccccag

SEQ ID NO: 6439537 - DNA, 13 bp, Homo sapiens
tcatctgccgtgc

SEQ ID NO: 6439538 - DNA, 16 bp, Homo sapiens
tcatctgcctggaaag

SEQ ID NO: 6439539 - DNA, 21 bp, Homo sapiens
tcatctgctcctagcccagca

SEQ ID NO: 6439540 - DNA, 12 bp, Homo sapiens
tcatctgctctc

SEQ ID NO: 6439541 - DNA, 17 bp, Homo sapiens
tcatctgctctccttcc

SEQ ID NO: 6439542 - DNA, 21 bp, Homo sapiens
tcatctgctgcacatagcaga

SEQ ID NO: 6439543 - DNA, 17 bp, Homo sapiens
tcatctggaggctgcgt

SEQ ID NO: 6439544 - DNA, 21 bp, Homo sapiens
tcatctggagtccctcctccc

SEQ ID NO: 6439545 - DNA, 22 bp, Homo sapiens
tcatctggataggagcctgctg

SEQ ID NO: 6439546 - DNA, 17 bp, Homo sapiens
tcatctggattccagag

SEQ ID NO: 6439547 - DNA, 19 bp, Homo sapiens
tcatctggcaacatcttta

SEQ ID NO: 6439548 - DNA, 23 bp, Homo sapiens
tcatctggcggaggtctctggga

SEQ ID NO: 6439549 - DNA, 12 bp, Homo sapiens
tcatctgggaaa

SEQ ID NO: 6439550 - DNA, 13 bp, Homo sapiens
tcatctgggaaag

SEQ ID NO: 6439551 - DNA, 13 bp, Homo sapiens
tcatctgggctgg

SEQ ID NO: 6439552 - DNA, 14 bp, Homo sapiens
tcatctgggctggc

SEQ ID NO: 6439553 - DNA, 23 bp, Homo sapiens
tcatctggggagcaggcagccag

SEQ ID NO: 6439554 - DNA, 16 bp, Homo sapiens
tcatctgggggagtgg

SEQ ID NO: 6439555 - DNA, 22 bp, Homo sapiens
tcatctggggttggcaacagga

SEQ ID NO: 6439556 - DNA, 21 bp, Homo sapiens
tcatctgggtctcccaggaca

SEQ ID NO: 6439557 - DNA, 13 bp, Homo sapiens
tcatctgggtggt

SEQ ID NO: 6439558 - DNA, 20 bp, Homo sapiens
tcatctggttgaactctggt

SEQ ID NO: 6439559 - DNA, 23 bp, Homo sapiens
tcatctggttgaactctggtggc

SEQ ID NO: 6439560 - DNA, 20 bp, Homo sapiens
tcatctgtaaaaccaggctg

SEQ ID NO: 6439561 - DNA, 23 bp, Homo sapiens
tcatctgtaaaatagtctcattg

SEQ ID NO: 6439562 - DNA, 11 bp, Homo sapiens
tcatctgtaag

SEQ ID NO: 6439563 - DNA, 13 bp, Homo sapiens
tcatctgtaatct

SEQ ID NO: 6439564 - DNA, 13 bp, Homo sapiens
tcatctgtacata

SEQ ID NO: 6439565 - DNA, 15 bp, Homo sapiens
tcatctgtacatact

SEQ ID NO: 6439566 - DNA, 14 bp, Homo sapiens
tcatctgtcattat

SEQ ID NO: 6439567 - DNA, 19 bp, Homo sapiens
tcatctgtcattatattct

SEQ ID NO: 6439568 - DNA, 23 bp, Homo sapiens
tcatctgtcattatattctaatt

SEQ ID NO: 6439569 - DNA, 17 bp, Homo sapiens
tcatctgtccctccggg

SEQ ID NO: 6439570 - DNA, 12 bp, Homo sapiens
tcatctgtgcac

SEQ ID NO: 6439571 - DNA, 18 bp, Homo sapiens
tcatctgtgcctgtctgt

SEQ ID NO: 6439572 - DNA, 15 bp, Homo sapiens
tcatctgtggagctg

SEQ ID NO: 6439573 - DNA, 16 bp, Homo sapiens
tcatctgttgttctgt

SEQ ID NO: 6439574 - DNA, 15 bp, Homo sapiens
tcatctgtttgtaat

SEQ ID NO: 6439575 - DNA, 16 bp, Homo sapiens
tcatctgtttgtaatc

SEQ ID NO: 6439576 - DNA, 12 bp, Homo sapiens
tcatcttactgt

SEQ ID NO: 6439577 - DNA, 16 bp, Homo sapiens
tcatcttactgtacct

SEQ ID NO: 6439578 - DNA, 20 bp, Homo sapiens
tcatcttcagttgtctctga

SEQ ID NO: 6439579 - DNA, 11 bp, Homo sapiens
tcatcttccct

SEQ ID NO: 6439580 - DNA, 21 bp, Homo sapiens
tcatcttccctgcccctgtgc

SEQ ID NO: 6439581 - DNA, 12 bp, Homo sapiens
tcatcttcctgt

SEQ ID NO: 6439582 - DNA, 14 bp, Homo sapiens
tcatcttcctgtgt

SEQ ID NO: 6439583 - DNA, 14 bp, Homo sapiens
tcatcttctcagct

SEQ ID NO: 6439584 - DNA, 15 bp, Homo sapiens
tcatcttctcagctc

SEQ ID NO: 6439585 - DNA, 13 bp, Homo sapiens
tcatcttctctgg

SEQ ID NO: 6439586 - DNA, 12 bp, Homo sapiens
tcatcttctctt

SEQ ID NO: 6439587 - DNA, 14 bp, Homo sapiens
tcatcttctctttt

SEQ ID NO: 6439588 - DNA, 13 bp, Homo sapiens
tcatcttctggaa

SEQ ID NO: 6439589 - DNA, 19 bp, Homo sapiens
tcatcttgaattgtaagga

SEQ ID NO: 6439590 - DNA, 16 bp, Homo sapiens
tcatcttgaccaagca

SEQ ID NO: 6439591 - DNA, 19 bp, Homo sapiens
tcatcttgagcctgagcct

SEQ ID NO: 6439592 - DNA, 22 bp, Homo sapiens
tcatcttgatgtctatgataga

SEQ ID NO: 6439593 - DNA, 23 bp, Homo sapiens
tcatcttgatgtctatgatagat

SEQ ID NO: 6439594 - DNA, 20 bp, Homo sapiens
tcatcttgcagcatttacta

SEQ ID NO: 6439595 - DNA, 21 bp, Homo sapiens
tcatcttgcagcatttactat

SEQ ID NO: 6439596 - DNA, 22 bp, Homo sapiens
tcatcttgcagcatttactatg

SEQ ID NO: 6439597 - DNA, 11 bp, Homo sapiens
tcatcttgcta

SEQ ID NO: 6439598 - DNA, 20 bp, Homo sapiens
tcatcttggaaaggggagga

SEQ ID NO: 6439599 - DNA, 19 bp, Homo sapiens
tcatcttggccctcctcag

SEQ ID NO: 6439600 - DNA, 22 bp, Homo sapiens
tcatcttggtactactagatgt

SEQ ID NO: 6439601 - DNA, 15 bp, Homo sapiens
tcatcttgtgaaatg

SEQ ID NO: 6439602 - DNA, 18 bp, Homo sapiens
tcatctttatctcctggg

SEQ ID NO: 6439603 - DNA, 15 bp, Homo sapiens
tcatctttcagaaat

SEQ ID NO: 6439604 - DNA, 19 bp, Homo sapiens
tcatctttcagaaataaaa

SEQ ID NO: 6439605 - DNA, 22 bp, Homo sapiens
tcatctttcattaaaggcttct

SEQ ID NO: 6439606 - DNA, 15 bp, Homo sapiens
tcatctttccctcct

SEQ ID NO: 6439607 - DNA, 16 bp, Homo sapiens
tcatctttccctcctt

SEQ ID NO: 6439608 - DNA, 18 bp, Homo sapiens
tcatctttccctccttgg

SEQ ID NO: 6439609 - DNA, 19 bp, Homo sapiens
tcatctttccctccttggt

SEQ ID NO: 6439610 - DNA, 16 bp, Homo sapiens
tcatctttcctttgct

SEQ ID NO: 6439611 - DNA, 17 bp, Homo sapiens
tcatctttcctttgctc

SEQ ID NO: 6439612 - DNA, 19 bp, Homo sapiens
tcatctttcctttgctctg

SEQ ID NO: 6439613 - DNA, 20 bp, Homo sapiens
tcatctttcctttgctctgg

SEQ ID NO: 6439614 - DNA, 23 bp, Homo sapiens
tcatctttcctttgctctggata

SEQ ID NO: 6439615 - DNA, 22 bp, Homo sapiens
tcatctttcttgatcaacatct

SEQ ID NO: 6439616 - DNA, 22 bp, Homo sapiens
tcatctttgttggctcagaaaa

SEQ ID NO: 6439617 - DNA, 14 bp, Homo sapiens
tcatcttttaatca

SEQ ID NO: 6439618 - DNA, 16 bp, Homo sapiens
tcatcttttaattcac

SEQ ID NO: 6439619 - DNA, 20 bp, Homo sapiens
tcatcttttaattcacctct

SEQ ID NO: 6439620 - DNA, 21 bp, Homo sapiens
tcatcttttaattcacctctt

SEQ ID NO: 6439621 - DNA, 17 bp, Homo sapiens
tcatcttttagagtaaa

SEQ ID NO: 6439622 - DNA, 12 bp, Homo sapiens
tcatcttttgaa

SEQ ID NO: 6439623 - DNA, 21 bp, Homo sapiens
tcatgaaaaagctgcttctta

SEQ ID NO: 6439624 - DNA, 15 bp, Homo sapiens
tcatgaaaactggga

SEQ ID NO: 6439625 - DNA, 18 bp, Homo sapiens
tcatgaaaagaggaacag

SEQ ID NO: 6439626 - DNA, 11 bp, Homo sapiens
tcatgaaaagt

SEQ ID NO: 6439627 - DNA, 13 bp, Homo sapiens
tcatgaaaagtgc

SEQ ID NO: 6439628 - DNA, 16 bp, Homo sapiens
tcatgaaaataccatt

SEQ ID NO: 6439629 - DNA, 19 bp, Homo sapiens
tcatgaaaatgtattcctt

SEQ ID NO: 6439630 - DNA, 14 bp, Homo sapiens
tcatgaaagaataa

SEQ ID NO: 6439631 - DNA, 15 bp, Homo sapiens
tcatgaaagattcaa

SEQ ID NO: 6439632 - DNA, 16 bp, Homo sapiens
tcatgaaagattcaat

SEQ ID NO: 6439633 - DNA, 21 bp, Homo sapiens
tcatgaaagcacctgccctct

SEQ ID NO: 6439634 - DNA, 22 bp, Homo sapiens
tcatgaaagcacctgccctctg

SEQ ID NO: 6439635 - DNA, 15 bp, Homo sapiens
tcatgaaagcagtga

SEQ ID NO: 6439636 - DNA, 15 bp, Homo sapiens
tcatgaaatatgcat

SEQ ID NO: 6439637 - DNA, 15 bp, Homo sapiens
tcatgaaatgattgg

SEQ ID NO: 6439638 - DNA, 18 bp, Homo sapiens
tcatgaaatgctatgtca

SEQ ID NO: 6439639 - DNA, 20 bp, Homo sapiens
tcatgaaatgctatgtcatt

SEQ ID NO: 6439640 - DNA, 16 bp, Homo sapiens
tcatgaaatgtgtttt

SEQ ID NO: 6439641 - DNA, 15 bp, Homo sapiens
tcatgaaattaccct

SEQ ID NO: 6439642 - DNA, 12 bp, Homo sapiens
tcatgaacacat

SEQ ID NO: 6439643 - DNA, 13 bp, Homo sapiens
tcatgaactggct

SEQ ID NO: 6439644 - DNA, 18 bp, Homo sapiens
tcatgaactggcttgtac

SEQ ID NO: 6439645 - DNA, 20 bp, Homo sapiens
tcatgaactggcttgtacat

SEQ ID NO: 6439646 - DNA, 15 bp, Homo sapiens
tcatgaacttcgcat

SEQ ID NO: 6439647 - DNA, 23 bp, Homo sapiens
tcatgaagaaaaaattttaaaaa

SEQ ID NO: 6439648 - DNA, 21 bp, Homo sapiens
tcatgaagacttaactggccc

SEQ ID NO: 6439649 - DNA, 18 bp, Homo sapiens
tcatgaagagttgtttat

SEQ ID NO: 6439650 - DNA, 16 bp, Homo sapiens
tcatgaagcaggaggc

SEQ ID NO: 6439651 - DNA, 12 bp, Homo sapiens
tcatgaagcctg

SEQ ID NO: 6439652 - DNA, 13 bp, Homo sapiens
tcatgaagcctgt

SEQ ID NO: 6439653 - DNA, 18 bp, Homo sapiens
tcatgaagccttgctgaa

SEQ ID NO: 6439654 - DNA, 20 bp, Homo sapiens
tcatgaagctcagtttggct

SEQ ID NO: 6439655 - DNA, 21 bp, Homo sapiens
tcatgaaggacactctgcagg

SEQ ID NO: 6439656 - DNA, 20 bp, Homo sapiens
tcatgaaggtcctagcttta

SEQ ID NO: 6439657 - DNA, 21 bp, Homo sapiens
tcatgaataactgattagtaa

SEQ ID NO: 6439658 - DNA, 19 bp, Homo sapiens
tcatgaatattttcaagtt

SEQ ID NO: 6439659 - DNA, 21 bp, Homo sapiens
tcatgaatcactgcacctctt

SEQ ID NO: 6439660 - DNA, 14 bp, Homo sapiens
tcatgaatctttca

SEQ ID NO: 6439661 - DNA, 15 bp, Homo sapiens
tcatgaatctttcat

SEQ ID NO: 6439662 - DNA, 22 bp, Homo sapiens
tcatgaatctttcatacatata

SEQ ID NO: 6439663 - DNA, 13 bp, Homo sapiens
tcatgaatgcttt

SEQ ID NO: 6439664 - DNA, 12 bp, Homo sapiens
tcatgaatgtaa

SEQ ID NO: 6439665 - DNA, 13 bp, Homo sapiens
tcatgaatgtaaa

SEQ ID NO: 6439666 - DNA, 19 bp, Homo sapiens
tcatgaatgtaaatttgta

SEQ ID NO: 6439667 - DNA, 19 bp, Homo sapiens
tcatgaatgtgagtcatta

SEQ ID NO: 6439668 - DNA, 22 bp, Homo sapiens
tcatgaattagaagaaaatgga

SEQ ID NO: 6439669 - DNA, 16 bp, Homo sapiens
tcatgaattagtttta

SEQ ID NO: 6439670 - DNA, 23 bp, Homo sapiens
tcatgaatttattgcacattgtt

SEQ ID NO: 6439671 - DNA, 19 bp, Homo sapiens
tcatgaattttacatggta

SEQ ID NO: 6439672 - DNA, 23 bp, Homo sapiens
tcatgacaaagttacaaattcaa

SEQ ID NO: 6439673 - DNA, 16 bp, Homo sapiens
tcatgacaagcatttt

SEQ ID NO: 6439674 - DNA, 14 bp, Homo sapiens
tcatgacagatgaa

SEQ ID NO: 6439675 - DNA, 16 bp, Homo sapiens
tcatgacagatgaaga

SEQ ID NO: 6439676 - DNA, 14 bp, Homo sapiens
tcatgacagcctcc

SEQ ID NO: 6439677 - DNA, 16 bp, Homo sapiens
tcatgacagtgcttgc

SEQ ID NO: 6439678 - DNA, 17 bp, Homo sapiens
tcatgacagtgcttgca

SEQ ID NO: 6439679 - DNA, 17 bp, Homo sapiens
tcatgacataataaagt

SEQ ID NO: 6439680 - DNA, 21 bp, Homo sapiens
tcatgacataataaagtattt

SEQ ID NO: 6439681 - DNA, 19 bp, Homo sapiens
tcatgacatgttatatatt

SEQ ID NO: 6439682 - DNA, 21 bp, Homo sapiens
tcatgacatgttatatatttt

SEQ ID NO: 6439683 - DNA, 22 bp, Homo sapiens
tcatgacattcctaaactatct

SEQ ID NO: 6439684 - DNA, 14 bp, Homo sapiens
tcatgaccagtaaa

SEQ ID NO: 6439685 - DNA, 21 bp, Homo sapiens
tcatgacccaggatatctgaa

SEQ ID NO: 6439686 - DNA, 22 bp, Homo sapiens
tcatgacccctcgtccaccccc

SEQ ID NO: 6439687 - DNA, 14 bp, Homo sapiens
tcatgactgcatga

SEQ ID NO: 6439688 - DNA, 22 bp, Homo sapiens
tcatgactggtgcgttcctaaa

SEQ ID NO: 6439689 - DNA, 20 bp, Homo sapiens
tcatgactttcagattgtat

SEQ ID NO: 6439690 - DNA, 21 bp, Homo sapiens
tcatgactttcagattgtatc

SEQ ID NO: 6439691 - DNA, 18 bp, Homo sapiens
tcatgacttttccatgta

SEQ ID NO: 6439692 - DNA, 16 bp, Homo sapiens
tcatgagaagccaagc

SEQ ID NO: 6439693 - DNA, 20 bp, Homo sapiens
tcatgagaattacagaaaat

SEQ ID NO: 6439694 - DNA, 22 bp, Homo sapiens
tcatgagaattacagaaaattt

SEQ ID NO: 6439695 - DNA, 14 bp, Homo sapiens
tcatgagcctgctg

SEQ ID NO: 6439696 - DNA, 16 bp, Homo sapiens
tcatgagcctgctgga

SEQ ID NO: 6439697 - DNA, 12 bp, Homo sapiens
tcatgagcctgt

SEQ ID NO: 6439698 - DNA, 14 bp, Homo sapiens
tctgtcctctgtag

SEQ ID NO: 6439699 - DNA, 16 bp, Homo sapiens
tctgtcctcttggcca

SEQ ID NO: 6439700 - DNA, 15 bp, Homo sapiens
tctgtcctgccccca

SEQ ID NO: 6439701 - DNA, 15 bp, Homo sapiens
tctgtcctgcttctg

SEQ ID NO: 6439702 - DNA, 22 bp, Homo sapiens
tctgtcctgtgaggtttcccaa

SEQ ID NO: 6439703 - DNA, 22 bp, Homo sapiens
tctgtccttccaacctgttcac

SEQ ID NO: 6439704 - DNA, 13 bp, Homo sapiens
tctgtccttcccc

SEQ ID NO: 6439705 - DNA, 14 bp, Homo sapiens
tctgtccttctgaa

SEQ ID NO: 6439706 - DNA, 18 bp, Homo sapiens
tctgtccttgaaggacta

SEQ ID NO: 6439707 - DNA, 14 bp, Homo sapiens
tctgtcgcccaggc

SEQ ID NO: 6439708 - DNA, 15 bp, Homo sapiens
tctgtcgcccaggct

SEQ ID NO: 6439709 - DNA, 16 bp, Homo sapiens
tctgtcgcccagtctg

SEQ ID NO: 6439710 - DNA, 17 bp, Homo sapiens
tctgtcgcccagtctgg

SEQ ID NO: 6439711 - DNA, 17 bp, Homo sapiens
tctgtcgcccatgctgg

SEQ ID NO: 6439712 - DNA, 17 bp, Homo sapiens
tctgtcgccttagcatg

SEQ ID NO: 6439713 - DNA, 17 bp, Homo sapiens
tctgtcgtggagccatt

SEQ ID NO: 6439714 - DNA, 14 bp, Homo sapiens
tctgtctaaaaaac

SEQ ID NO: 6439715 - DNA, 15 bp, Homo sapiens
tctgtctaaaaaaca

SEQ ID NO: 6439716 - DNA, 17 bp, Homo sapiens
tctgtctaaaaaccaga

SEQ ID NO: 6439717 - DNA, 15 bp, Homo sapiens
tctgtctaaagatag

SEQ ID NO: 6439718 - DNA, 14 bp, Homo sapiens
tctgtctactgtgg

SEQ ID NO: 6439719 - DNA, 16 bp, Homo sapiens
tctgtctactgtggtg

SEQ ID NO: 6439720 - DNA, 20 bp, Homo sapiens
tctgtctactttctcttgtt

SEQ ID NO: 6439721 - DNA, 15 bp, Homo sapiens
tctgtctagactggc

SEQ ID NO: 6439722 - DNA, 18 bp, Homo sapiens
tctgtctagactggccta

SEQ ID NO: 6439723 - DNA, 13 bp, Homo sapiens
tctgtctaggaat

SEQ ID NO: 6439724 - DNA, 20 bp, Homo sapiens
tctgtctaggttaaagctaa

SEQ ID NO: 6439725 - DNA, 15 bp, Homo sapiens
tctgtctagtgtctg

SEQ ID NO: 6439726 - DNA, 22 bp, Homo sapiens
tctgtctcaaaaaaaaaaagaa

SEQ ID NO: 6439727 - DNA, 15 bp, Homo sapiens
tctgtctcagacttt

SEQ ID NO: 6439728 - DNA, 14 bp, Homo sapiens
tctgtctcagtcca

SEQ ID NO: 6439729 - DNA, 17 bp, Homo sapiens
tctgtctccaagacctt

SEQ ID NO: 6439730 - DNA, 16 bp, Homo sapiens
tctgtctcccaggctg

SEQ ID NO: 6439731 - DNA, 18 bp, Homo sapiens
tctgtctcccttctctct

SEQ ID NO: 6439732 - DNA, 19 bp, Homo sapiens
tctgtctcccttctctctc

SEQ ID NO: 6439733 - DNA, 22 bp, Homo sapiens
tctgtctcgagcgccctgcaga

SEQ ID NO: 6439734 - DNA, 12 bp, Homo sapiens
tctgtctcgatg

SEQ ID NO: 6439735 - DNA, 15 bp, Homo sapiens
tctgtctcgatgcct

SEQ ID NO: 6439736 - DNA, 18 bp, Homo sapiens
tctgtctcgatgcctgat

SEQ ID NO: 6439737 - DNA, 20 bp, Homo sapiens
tctgtctctaatttaactta

SEQ ID NO: 6439738 - DNA, 14 bp, Homo sapiens
tctgtctctatatt

SEQ ID NO: 6439739 - DNA, 14 bp, Homo sapiens
tctgtctctcctag

SEQ ID NO: 6439740 - DNA, 21 bp, Homo sapiens
tctgtctctctctctttttct

SEQ ID NO: 6439741 - DNA, 11 bp, Homo sapiens
tctgtctctgc

SEQ ID NO: 6439742 - DNA, 14 bp, Homo sapiens
tctgtctctgcctc

SEQ ID NO: 6439743 - DNA, 17 bp, Homo sapiens
tctgtctctgcctccct

SEQ ID NO: 6439744 - DNA, 12 bp, Homo sapiens
tctgtctctgct

SEQ ID NO: 6439745 - DNA, 21 bp, Homo sapiens
tctgtctctgctcttgcctgc

SEQ ID NO: 6439746 - DNA, 19 bp, Homo sapiens
tctgtctgagacaggtgcc

SEQ ID NO: 6439747 - DNA, 17 bp, Homo sapiens
tctgtctgagccctgcc

SEQ ID NO: 6439748 - DNA, 19 bp, Homo sapiens
tctgtctgagccctgccct

SEQ ID NO: 6439749 - DNA, 16 bp, Homo sapiens
tctgtctgattctatg

SEQ ID NO: 6439750 - DNA, 17 bp, Homo sapiens
tctgtctgattctatgc

SEQ ID NO: 6439751 - DNA, 9 bp, Homo sapiens
tctgtctgc

SEQ ID NO: 6439752 - DNA, 21 bp, Homo sapiens
tctgtctgccaacctaaaact

SEQ ID NO: 6439753 - DNA, 14 bp, Homo sapiens
tctgtctgccctca

SEQ ID NO: 6439754 - DNA, 17 bp, Homo sapiens
tctgtctgctctgcata

SEQ ID NO: 6439755 - DNA, 14 bp, Homo sapiens
tctgtctggcaatg

SEQ ID NO: 6439756 - DNA, 18 bp, Homo sapiens
tctgtctgggctcagaca

SEQ ID NO: 6439757 - DNA, 16 bp, Homo sapiens
tctgtctggtggcccc

SEQ ID NO: 6439758 - DNA, 17 bp, Homo sapiens
tctgtctggtggccccg

SEQ ID NO: 6439759 - DNA, 16 bp, Homo sapiens
tctgtctgtcgccctt

SEQ ID NO: 6439760 - DNA, 16 bp, Homo sapiens
tctgtctgtctgtggg

SEQ ID NO: 6439761 - DNA, 23 bp, Homo sapiens
tctgtctgtgggcttcagcactt

SEQ ID NO: 6439762 - DNA, 12 bp, Homo sapiens
tctgtcttaaag

SEQ ID NO: 6439763 - DNA, 22 bp, Homo sapiens
tctgtcttaaatgagaagtact

SEQ ID NO: 6439764 - DNA, 16 bp, Homo sapiens
tctgtcttcaaggact

SEQ ID NO: 6439765 - DNA, 17 bp, Homo sapiens
tctgtcttcactattca

SEQ ID NO: 6439766 - DNA, 18 bp, Homo sapiens
tctgtcttccaggcccag

SEQ ID NO: 6439767 - DNA, 15 bp, Homo sapiens
tctgtcttcctggtc

SEQ ID NO: 6439768 - DNA, 12 bp, Homo sapiens
tctgtcttcctt

SEQ ID NO: 6439769 - DNA, 14 bp, Homo sapiens
tctgtcttcctttg

SEQ ID NO: 6439770 - DNA, 16 bp, Homo sapiens
tctgtcttctctccac

SEQ ID NO: 6439771 - DNA, 18 bp, Homo sapiens
tctgtcttctctccactt

SEQ ID NO: 6439772 - DNA, 18 bp, Homo sapiens
tctgtcttctgtatataa

SEQ ID NO: 6439773 - DNA, 13 bp, Homo sapiens
tctgtcttgtaat

SEQ ID NO: 6439774 - DNA, 20 bp, Homo sapiens
tctgtcttgtaatattttgt

SEQ ID NO: 6439775 - DNA, 18 bp, Homo sapiens
tctgtcttgttaatgctt

SEQ ID NO: 6439776 - DNA, 13 bp, Homo sapiens
tctgtcttgttca

SEQ ID NO: 6439777 - DNA, 14 bp, Homo sapiens
tctgtcttgttcat

SEQ ID NO: 6439778 - DNA, 16 bp, Homo sapiens
tctgtctttatgattt

SEQ ID NO: 6439779 - DNA, 19 bp, Homo sapiens
tctgtctttatgatttcat

SEQ ID NO: 6439780 - DNA, 20 bp, Homo sapiens
tctgtctttatgtttttcta

SEQ ID NO: 6439781 - DNA, 14 bp, Homo sapiens
tctgtctttcaaaa

SEQ ID NO: 6439782 - DNA, 16 bp, Homo sapiens
tctgtctttccactct

SEQ ID NO: 6439783 - DNA, 13 bp, Homo sapiens
tctgtctttgcaa

SEQ ID NO: 6439784 - DNA, 16 bp, Homo sapiens
tctgtctttgcaaagg

SEQ ID NO: 6439785 - DNA, 20 bp, Homo sapiens
tctgtctttgcggggcctgt

SEQ ID NO: 6439786 - DNA, 16 bp, Homo sapiens
tctgtcttttaaactc

SEQ ID NO: 6439787 - DNA, 14 bp, Homo sapiens
tctgtctttttcct

SEQ ID NO: 6439788 - DNA, 18 bp, Homo sapiens
tctgtctttttccttcct

SEQ ID NO: 6439789 - DNA, 15 bp, Homo sapiens
tctgtcttttttctc

SEQ ID NO: 6439790 - DNA, 22 bp, Homo sapiens
tctgtgaaaacatatttgtgaa

SEQ ID NO: 6439791 - DNA, 13 bp, Homo sapiens
tctgtgaaacctg

SEQ ID NO: 6439792 - DNA, 22 bp, Homo sapiens
tctgtgaaagccttaagaagat

SEQ ID NO: 6439793 - DNA, 14 bp, Homo sapiens
tctgtgaaagcttt

SEQ ID NO: 6439794 - DNA, 19 bp, Homo sapiens
tctgtgaaagctttggaaa

SEQ ID NO: 6439795 - DNA, 22 bp, Homo sapiens
tctgtgaaaggaaagagggagg

SEQ ID NO: 6439796 - DNA, 16 bp, Homo sapiens
tctgtgaaagtacatt

SEQ ID NO: 6439797 - DNA, 14 bp, Homo sapiens
tctgtgaaatataa

SEQ ID NO: 6439798 - DNA, 16 bp, Homo sapiens
tctgtgaaatatcatc

SEQ ID NO: 6439799 - DNA, 17 bp, Homo sapiens
tctgtgaaatgctggca

SEQ ID NO: 6439800 - DNA, 20 bp, Homo sapiens
tctgtgaaatgctggcattt

SEQ ID NO: 6439801 - DNA, 17 bp, Homo sapiens
tctgtgaaattctcaga

SEQ ID NO: 6439802 - DNA, 18 bp, Homo sapiens
tctgtgaaattctcagag

SEQ ID NO: 6439803 - DNA, 17 bp, Homo sapiens
tctgtgaaatttgtaat

SEQ ID NO: 6439804 - DNA, 17 bp, Homo sapiens
tctgtgaacagagagac

SEQ ID NO: 6439805 - DNA, 21 bp, Homo sapiens
tctgtgaacataggtgtgctt

SEQ ID NO: 6439806 - DNA, 21 bp, Homo sapiens
tctgtgaactatcccctgcgc

SEQ ID NO: 6439807 - DNA, 23 bp, Homo sapiens
tctgtgaactatcccctgcgctt

SEQ ID NO: 6439808 - DNA, 17 bp, Homo sapiens
tctgtgaacttccctac

SEQ ID NO: 6439809 - DNA, 20 bp, Homo sapiens
tctgtgaacttccctaccct

SEQ ID NO: 6439810 - DNA, 18 bp, Homo sapiens
tctgtgaacttgaaattt

SEQ ID NO: 6439811 - DNA, 19 bp, Homo sapiens
tctgtgaacttgaaatttg

SEQ ID NO: 6439812 - DNA, 22 bp, Homo sapiens
tctgtgaacttgaaatttgaat

SEQ ID NO: 6439813 - DNA, 15 bp, Homo sapiens
tctgtgaacttgatg

SEQ ID NO: 6439814 - DNA, 19 bp, Homo sapiens
tctgtgaagaagccctgtt

SEQ ID NO: 6439815 - DNA, 22 bp, Homo sapiens
tctgtgaagaagccctgttctc

SEQ ID NO: 6439816 - DNA, 14 bp, Homo sapiens
tctgtgaagagcaa

SEQ ID NO: 6439817 - DNA, 19 bp, Homo sapiens
tctgtgaagaggaacagtg

SEQ ID NO: 6439818 - DNA, 20 bp, Homo sapiens
tctgtgaagccctttgcctg

SEQ ID NO: 6439819 - DNA, 18 bp, Homo sapiens
tctgtgaagcctctctcc

SEQ ID NO: 6439820 - DNA, 12 bp, Homo sapiens
tctgtgaagcta

SEQ ID NO: 6439821 - DNA, 20 bp, Homo sapiens
tctgtgaagtgagaccttcc

SEQ ID NO: 6439822 - DNA, 17 bp, Homo sapiens
tctgtgaataaagccac

SEQ ID NO: 6439823 - DNA, 12 bp, Homo sapiens
tctgtgaataag

SEQ ID NO: 6439824 - DNA, 19 bp, Homo sapiens
tctgtgaatccatgggtct

SEQ ID NO: 6439825 - DNA, 23 bp, Homo sapiens
tctgtgaatgctaagtccatcac

SEQ ID NO: 6439826 - DNA, 21 bp, Homo sapiens
tctgtgaattgtggctgttca

SEQ ID NO: 6439827 - DNA, 23 bp, Homo sapiens
tctgtgaattgtggctgttcact

SEQ ID NO: 6439828 - DNA, 22 bp, Homo sapiens
tctgtgacacatcgttttgggg

SEQ ID NO: 6439829 - DNA, 21 bp, Homo sapiens
tctgtgaccaaaataccttgg

SEQ ID NO: 6439830 - DNA, 16 bp, Homo sapiens
tctgtgacccacttct

SEQ ID NO: 6439831 - DNA, 15 bp, Homo sapiens
tctgtgacccatctg

SEQ ID NO: 6439832 - DNA, 16 bp, Homo sapiens
tctgtgacctcaggca

SEQ ID NO: 6439833 - DNA, 16 bp, Homo sapiens
tctgtgacctgcatct

SEQ ID NO: 6439834 - DNA, 17 bp, Homo sapiens
tctgtgacgcagacaga

SEQ ID NO: 6439835 - DNA, 20 bp, Homo sapiens
tctgtgactataaagctgtt

SEQ ID NO: 6439836 - DNA, 12 bp, Homo sapiens
tctgtgactgga

SEQ ID NO: 6439837 - DNA, 13 bp, Homo sapiens
tctgtgactggat

SEQ ID NO: 6439838 - DNA, 20 bp, Homo sapiens
tctgtgactggatcttctat

SEQ ID NO: 6439839 - DNA, 18 bp, Homo sapiens
tctgtgacttatctacca

SEQ ID NO: 6439840 - DNA, 23 bp, Homo sapiens
tctgtgagaaggtttattgttaa

SEQ ID NO: 6439841 - DNA, 20 bp, Homo sapiens
tctgtgagagaccccctcca

SEQ ID NO: 6439842 - DNA, 17 bp, Homo sapiens
tctgtgagattcattca

SEQ ID NO: 6439843 - DNA, 15 bp, Homo sapiens
tctgtgagtcagtca

SEQ ID NO: 6439844 - DNA, 16 bp, Homo sapiens
tctgtgagtgaaagtt

SEQ ID NO: 6439845 - DNA, 18 bp, Homo sapiens
tctgtgagtgaaagttgc

SEQ ID NO: 6439846 - DNA, 14 bp, Homo sapiens
tctgtgagttctgt

SEQ ID NO: 6439847 - DNA, 17 bp, Homo sapiens
tctgtgatacagaactc

SEQ ID NO: 6439848 - DNA, 14 bp, Homo sapiens
tctgtgatcattta

SEQ ID NO: 6439849 - DNA, 17 bp, Homo sapiens
tctgtgatctctgctgg

SEQ ID NO: 6439850 - DNA, 20 bp, Homo sapiens
tctgtgatctgggtctctaa

SEQ ID NO: 6439851 - DNA, 17 bp, Homo sapiens
tctgtgatgacattccc

SEQ ID NO: 6439852 - DNA, 23 bp, Homo sapiens
tctgtgatgactggttgttcaaa

SEQ ID NO: 6439853 - DNA, 17 bp, Homo sapiens
tctgtgatgagctgatc

SEQ ID NO: 6439854 - DNA, 13 bp, Homo sapiens
tctgtgattacat

SEQ ID NO: 6439855 - DNA, 16 bp, Homo sapiens
tctgtgattacataga

SEQ ID NO: 6439856 - DNA, 15 bp, Homo sapiens
tctgtgattacctct

SEQ ID NO: 6439857 - DNA, 17 bp, Homo sapiens
tctgtgattatttgtgt

SEQ ID NO: 6439858 - DNA, 21 bp, Homo sapiens
tctgtgattgccatttcttcc

SEQ ID NO: 6439859 - DNA, 23 bp, Homo sapiens
tctgtgattgccatttcttccca

SEQ ID NO: 6439860 - DNA, 15 bp, Homo sapiens
tctgtgattggctgg

SEQ ID NO: 6439861 - DNA, 16 bp, Homo sapiens
tctgtgattggctggt

SEQ ID NO: 6439862 - DNA, 17 bp, Homo sapiens
tctgtgcaataaaacca

SEQ ID NO: 6439863 - DNA, 16 bp, Homo sapiens
tctgtgcacagtggct

SEQ ID NO: 6439864 - DNA, 18 bp, Homo sapiens
tctgtgcacatgcctctg

SEQ ID NO: 6439865 - DNA, 23 bp, Homo sapiens
tctgtgcacatgcctctgtagag

SEQ ID NO: 6439866 - DNA, 14 bp, Homo sapiens
tctgtgcacctggg

SEQ ID NO: 6439867 - DNA, 16 bp, Homo sapiens
tctgtgcacctgggct

SEQ ID NO: 6439868 - DNA, 19 bp, Homo sapiens
tctgtgcacgcagtggcct

SEQ ID NO: 6439869 - DNA, 19 bp, Homo sapiens
tctgtgcactagcctgtga

SEQ ID NO: 6439870 - DNA, 13 bp, Homo sapiens
tctgtgcaggagc

SEQ ID NO: 6439871 - DNA, 15 bp, Homo sapiens
tctgtgcaggagcca

SEQ ID NO: 6439872 - DNA, 21 bp, Homo sapiens
tctgtgcaggagccagtcctg

SEQ ID NO: 6439873 - DNA, 16 bp, Homo sapiens
tctgtgcagggtatta

SEQ ID NO: 6439874 - DNA, 13 bp, Homo sapiens
tctgtgcaggtgc

SEQ ID NO: 6439875 - DNA, 14 bp, Homo sapiens
tctgtgcaggtgct

SEQ ID NO: 6439876 - DNA, 20 bp, Homo sapiens
tctgtgcagtttggtatgaa

SEQ ID NO: 6439877 - DNA, 21 bp, Homo sapiens
tctgtgcagtttggtatgaaa

SEQ ID NO: 6439878 - DNA, 15 bp, Homo sapiens
tcatgagcctgttta

SEQ ID NO: 6439879 - DNA, 16 bp, Homo sapiens
tcatgagcctgtttat

SEQ ID NO: 6439880 - DNA, 21 bp, Homo sapiens
tcatgagcctgtttattgcca

SEQ ID NO: 6439881 - DNA, 16 bp, Homo sapiens
tcatgagccttcagtc

SEQ ID NO: 6439882 - DNA, 12 bp, Homo sapiens
tcatgagctcct

SEQ ID NO: 6439883 - DNA, 18 bp, Homo sapiens
tcatgagctgggtactga

SEQ ID NO: 6439884 - DNA, 13 bp, Homo sapiens
tcatgaggaaaga

SEQ ID NO: 6439885 - DNA, 20 bp, Homo sapiens
tcatgaggaggggcccccct

SEQ ID NO: 6439886 - DNA, 21 bp, Homo sapiens
tcatgaggaggtcagcccatt

SEQ ID NO: 6439887 - DNA, 19 bp, Homo sapiens
tcatgaggggaaagggaga

SEQ ID NO: 6439888 - DNA, 14 bp, Homo sapiens
tcatgaggggagag

SEQ ID NO: 6439889 - DNA, 17 bp, Homo sapiens
tcatgaggtcaggagtt

SEQ ID NO: 6439890 - DNA, 22 bp, Homo sapiens
tcatgagtggatggatggacag

SEQ ID NO: 6439891 - DNA, 15 bp, Homo sapiens
tcatgagttctgctg

SEQ ID NO: 6439892 - DNA, 22 bp, Homo sapiens
tcatgatagaaagaataaaatg

SEQ ID NO: 6439893 - DNA, 22 bp, Homo sapiens
tcatgatagaaggctatgggga

SEQ ID NO: 6439894 - DNA, 16 bp, Homo sapiens
tcatgatagtgtgatt

SEQ ID NO: 6439895 - DNA, 17 bp, Homo sapiens
tcatgatagtgtgattt

SEQ ID NO: 6439896 - DNA, 13 bp, Homo sapiens
tcatgatccaact

SEQ ID NO: 6439897 - DNA, 19 bp, Homo sapiens
tcatgatctccctgccgcc

SEQ ID NO: 6439898 - DNA, 18 bp, Homo sapiens
tcatgatcttgtgacata

SEQ ID NO: 6439899 - DNA, 15 bp, Homo sapiens
tcatgatgatgatga

SEQ ID NO: 6439900 - DNA, 13 bp, Homo sapiens
tcatgatgcagtc

SEQ ID NO: 6439901 - DNA, 20 bp, Homo sapiens
tcatgatgcagtctcctctt

SEQ ID NO: 6439902 - DNA, 22 bp, Homo sapiens
tcatgatgcagtctcctcttta

SEQ ID NO: 6439903 - DNA, 13 bp, Homo sapiens
tcatgatgctagt

SEQ ID NO: 6439904 - DNA, 22 bp, Homo sapiens
tcatgatgtctgcaaaggaggg

SEQ ID NO: 6439905 - DNA, 13 bp, Homo sapiens
tcatgatgttttt

SEQ ID NO: 6439906 - DNA, 14 bp, Homo sapiens
tcatgattagacaa

SEQ ID NO: 6439907 - DNA, 14 bp, Homo sapiens
tcatgattagcaag

SEQ ID NO: 6439908 - DNA, 16 bp, Homo sapiens
tcatgattagcaagtt

SEQ ID NO: 6439909 - DNA, 18 bp, Homo sapiens
tcatgattatagcaacta

SEQ ID NO: 6439910 - DNA, 17 bp, Homo sapiens
tcatgattcatgagctg

SEQ ID NO: 6439911 - DNA, 23 bp, Homo sapiens
tcatgatttcatttcaactgttt

SEQ ID NO: 6439912 - DNA, 19 bp, Homo sapiens
tcatgatttcccttgtaga

SEQ ID NO: 6439913 - DNA, 21 bp, Homo sapiens
tcatgatttctgtgaagcaaa

SEQ ID NO: 6439914 - DNA, 15 bp, Homo sapiens
tcatgatttgcaact

SEQ ID NO: 6439915 - DNA, 14 bp, Homo sapiens
tcatgattttgaaa

SEQ ID NO: 6439916 - DNA, 11 bp, Homo sapiens
tcatgattttt

SEQ ID NO: 6439917 - DNA, 22 bp, Homo sapiens
tcatgattttttacaaattatg

SEQ ID NO: 6439918 - DNA, 17 bp, Homo sapiens
tcatgcaaactgcttta

SEQ ID NO: 6439919 - DNA, 19 bp, Homo sapiens
tcatgcaaactgctttatt

SEQ ID NO: 6439920 - DNA, 17 bp, Homo sapiens
tcatgcaaaggctggga

SEQ ID NO: 6439921 - DNA, 17 bp, Homo sapiens
tcatgcaagacttcact

SEQ ID NO: 6439922 - DNA, 21 bp, Homo sapiens
tcatgcaagacttcactgcag

SEQ ID NO: 6439923 - DNA, 22 bp, Homo sapiens
tcatgcaagacttcactgcagc

SEQ ID NO: 6439924 - DNA, 20 bp, Homo sapiens
tcatgcaagagtttcttgta

SEQ ID NO: 6439925 - DNA, 17 bp, Homo sapiens
tcatgcaagtgagaaag

SEQ ID NO: 6439926 - DNA, 18 bp, Homo sapiens
tcatgcaagtgagaaaga

SEQ ID NO: 6439927 - DNA, 20 bp, Homo sapiens
tcatgcaagtgagaaagaca

SEQ ID NO: 6439928 - DNA, 14 bp, Homo sapiens
tcatgcaagtggag

SEQ ID NO: 6439929 - DNA, 16 bp, Homo sapiens
tcatgcaatgacatct

SEQ ID NO: 6439930 - DNA, 15 bp, Homo sapiens
tcatgcagttcctgg

SEQ ID NO: 6439931 - DNA, 16 bp, Homo sapiens
tcatgcagttcctggc

SEQ ID NO: 6439932 - DNA, 14 bp, Homo sapiens
tcatgcataaatat

SEQ ID NO: 6439933 - DNA, 19 bp, Homo sapiens
tcatgcataaatatgcagt

SEQ ID NO: 6439934 - DNA, 14 bp, Homo sapiens
tcatgcatagacaa

SEQ ID NO: 6439935 - DNA, 14 bp, Homo sapiens
tcatgcatggaaat

SEQ ID NO: 6439936 - DNA, 15 bp, Homo sapiens
tcatgcattgtaatc

SEQ ID NO: 6439937 - DNA, 16 bp, Homo sapiens
tcatgcattgtcctct

SEQ ID NO: 6439938 - DNA, 17 bp, Homo sapiens
tcatgccaaagcaaaag

SEQ ID NO: 6439939 - DNA, 22 bp, Homo sapiens
tcatgccaccatggccagccaa

SEQ ID NO: 6439940 - DNA, 15 bp, Homo sapiens
tcatgccagcagcac

SEQ ID NO: 6439941 - DNA, 15 bp, Homo sapiens
tcatgccagtatttt

SEQ ID NO: 6439942 - DNA, 18 bp, Homo sapiens
tcatgccagtgcatgcca

SEQ ID NO: 6439943 - DNA, 15 bp, Homo sapiens
tcatgccatctgttt

SEQ ID NO: 6439944 - DNA, 14 bp, Homo sapiens
tcatgccattctgc

SEQ ID NO: 6439945 - DNA, 14 bp, Homo sapiens
tcatgccattttat

SEQ ID NO: 6439946 - DNA, 19 bp, Homo sapiens
tcatgccattttatttctt

SEQ ID NO: 6439947 - DNA, 21 bp, Homo sapiens
tcatgccattttatttctttt

SEQ ID NO: 6439948 - DNA, 13 bp, Homo sapiens
tcatgcccacccc

SEQ ID NO: 6439949 - DNA, 15 bp, Homo sapiens
tcatgcccaccccct

SEQ ID NO: 6439950 - DNA, 20 bp, Homo sapiens
tcatgcccaccccctgccct

SEQ ID NO: 6439951 - DNA, 15 bp, Homo sapiens
tcatgcccactcccc

SEQ ID NO: 6439952 - DNA, 15 bp, Homo sapiens
tcatgcccagctctc

SEQ ID NO: 6439953 - DNA, 19 bp, Homo sapiens
tcatgcccagctctctgac

SEQ ID NO: 6439954 - DNA, 20 bp, Homo sapiens
tcatgcccagctctctgacg

SEQ ID NO: 6439955 - DNA, 15 bp, Homo sapiens
tcatgccccctttca

SEQ ID NO: 6439956 - DNA, 18 bp, Homo sapiens
tcatgccccctttcagat

SEQ ID NO: 6439957 - DNA, 15 bp, Homo sapiens
tcatgccccgccatg

SEQ ID NO: 6439958 - DNA, 16 bp, Homo sapiens
tcatgcccctggctgg

SEQ ID NO: 6439959 - DNA, 14 bp, Homo sapiens
tcatgccctcctct

SEQ ID NO: 6439960 - DNA, 16 bp, Homo sapiens
tcatgccgccgcagct

SEQ ID NO: 6439961 - DNA, 16 bp, Homo sapiens
tcatgcctcagtttcc

SEQ ID NO: 6439962 - DNA, 17 bp, Homo sapiens
tcatgcctcctgaggct

SEQ ID NO: 6439963 - DNA, 20 bp, Homo sapiens
tcatgcctcctgaggctgtt

SEQ ID NO: 6439964 - DNA, 14 bp, Homo sapiens
tcatgcctctgagc

SEQ ID NO: 6439965 - DNA, 15 bp, Homo sapiens
tcatgcctctgaggc

SEQ ID NO: 6439966 - DNA, 16 bp, Homo sapiens
tcatgcctctgaggcc

SEQ ID NO: 6439967 - DNA, 22 bp, Homo sapiens
tcatgcctgcctgataccctgc

SEQ ID NO: 6439968 - DNA, 15 bp, Homo sapiens
tcatgcctggccccc

SEQ ID NO: 6439969 - DNA, 23 bp, Homo sapiens
tcatgcctggcccccctccaggc

SEQ ID NO: 6439970 - DNA, 13 bp, Homo sapiens
tcatgcctggctt

SEQ ID NO: 6439971 - DNA, 15 bp, Homo sapiens
tcatgcctggcttcg

SEQ ID NO: 6439972 - DNA, 17 bp, Homo sapiens
tcatgcctggcttcgca

SEQ ID NO: 6439973 - DNA, 11 bp, Homo sapiens
tcatgcctggg

SEQ ID NO: 6439974 - DNA, 20 bp, Homo sapiens
tcatgcctgtaatcccagca

SEQ ID NO: 6439975 - DNA, 21 bp, Homo sapiens
tcatgcctgtaatcccagcac

SEQ ID NO: 6439976 - DNA, 17 bp, Homo sapiens
tcatgccttgataaata

SEQ ID NO: 6439977 - DNA, 21 bp, Homo sapiens
tcatgcctttatttctgtatc

SEQ ID NO: 6439978 - DNA, 14 bp, Homo sapiens
tcatgcctttcata

SEQ ID NO: 6439979 - DNA, 13 bp, Homo sapiens
tcatgcctttgta

SEQ ID NO: 6439980 - DNA, 14 bp, Homo sapiens
tcatgcctttgtaa

SEQ ID NO: 6439981 - DNA, 22 bp, Homo sapiens
tcatgcgatggtcccccacacc

SEQ ID NO: 6439982 - DNA, 16 bp, Homo sapiens
tcatgcggcccagcca

SEQ ID NO: 6439983 - DNA, 19 bp, Homo sapiens
tcatgcggcccagccatgg

SEQ ID NO: 6439984 - DNA, 16 bp, Homo sapiens
tcatgcggtgggtgct

SEQ ID NO: 6439985 - DNA, 13 bp, Homo sapiens
tcatgctacagaa

SEQ ID NO: 6439986 - DNA, 18 bp, Homo sapiens
tcatgctatcagaaacag

SEQ ID NO: 6439987 - DNA, 15 bp, Homo sapiens
tcatgctcacttttg

SEQ ID NO: 6439988 - DNA, 21 bp, Homo sapiens
tcatgctcagccttgctgctc

SEQ ID NO: 6439989 - DNA, 22 bp, Homo sapiens
tcatgctcagccttgctgctct

SEQ ID NO: 6439990 - DNA, 19 bp, Homo sapiens
tcatgctccaagactttag

SEQ ID NO: 6439991 - DNA, 20 bp, Homo sapiens
tcatgctcccaaatgcagct

SEQ ID NO: 6439992 - DNA, 23 bp, Homo sapiens
tcatgctcccctgtgccagccca

SEQ ID NO: 6439993 - DNA, 11 bp, Homo sapiens
tcatgctgaaa

SEQ ID NO: 6439994 - DNA, 14 bp, Homo sapiens
tcatgctgaaagcc

SEQ ID NO: 6439995 - DNA, 15 bp, Homo sapiens
tcatgctgaatccac

SEQ ID NO: 6439996 - DNA, 18 bp, Homo sapiens
tcatgctgaatccacctc

SEQ ID NO: 6439997 - DNA, 19 bp, Homo sapiens
tcatgctgaatccacctcg

SEQ ID NO: 6439998 - DNA, 22 bp, Homo sapiens
tcatgctgaatccacctcggag

SEQ ID NO: 6439999 - DNA, 19 bp, Homo sapiens
tcatgctgacttgcagagt

SEQ ID NO: 6440000 - DNA, 13 bp, Homo sapiens
tcatgctgagcaa

SEQ ID NO: 6440001 - DNA, 19 bp, Homo sapiens
tcatgctgccaatatccta

SEQ ID NO: 6440002 - DNA, 15 bp, Homo sapiens
tcatgctgcctgcca

SEQ ID NO: 6440003 - DNA, 18 bp, Homo sapiens
tcatgctgcctgccatgt

SEQ ID NO: 6440004 - DNA, 12 bp, Homo sapiens
tcatgctgcctt

SEQ ID NO: 6440005 - DNA, 18 bp, Homo sapiens
tcatgctgggatttccaa

SEQ ID NO: 6440006 - DNA, 13 bp, Homo sapiens
tcatgctggtggg

SEQ ID NO: 6440007 - DNA, 14 bp, Homo sapiens
tcatgctgtctgtg

SEQ ID NO: 6440008 - DNA, 15 bp, Homo sapiens
tcatgctgtgcattt

SEQ ID NO: 6440009 - DNA, 16 bp, Homo sapiens
tcatgctgtgcatttt

SEQ ID NO: 6440010 - DNA, 17 bp, Homo sapiens
tcatgctgttcatgaaa

SEQ ID NO: 6440011 - DNA, 17 bp, Homo sapiens
tcatgctgttctctttg

SEQ ID NO: 6440012 - DNA, 21 bp, Homo sapiens
tcatgcttataagcaacatga

SEQ ID NO: 6440013 - DNA, 21 bp, Homo sapiens
tcatgcttgacacaactgctg

SEQ ID NO: 6440014 - DNA, 15 bp, Homo sapiens
tcatgcttgacatac

SEQ ID NO: 6440015 - DNA, 21 bp, Homo sapiens
tcatgcttgccatctgttcat

SEQ ID NO: 6440016 - DNA, 22 bp, Homo sapiens
tcatgctttaaagtgtaataat

SEQ ID NO: 6440017 - DNA, 23 bp, Homo sapiens
tcatgctttcctaaagtctctgc

SEQ ID NO: 6440018 - DNA, 18 bp, Homo sapiens
tcatgcttttctcatggt

SEQ ID NO: 6440019 - DNA, 17 bp, Homo sapiens
tcatgcttttgccactt

SEQ ID NO: 6440020 - DNA, 17 bp, Homo sapiens
tcatggaaaagcccagt

SEQ ID NO: 6440021 - DNA, 22 bp, Homo sapiens
tcatggaaaagcccagtgacct

SEQ ID NO: 6440022 - DNA, 18 bp, Homo sapiens
tcatggaaaagccttctt

SEQ ID NO: 6440023 - DNA, 20 bp, Homo sapiens
tcatggaaaagccttcttat

SEQ ID NO: 6440024 - DNA, 17 bp, Homo sapiens
tcatggaaactggccag

SEQ ID NO: 6440025 - DNA, 18 bp, Homo sapiens
tcatggaaatagaatgaa

SEQ ID NO: 6440026 - DNA, 15 bp, Homo sapiens
tcatggaaatattat

SEQ ID NO: 6440027 - DNA, 17 bp, Homo sapiens
tcatggaacacaaacac

SEQ ID NO: 6440028 - DNA, 22 bp, Homo sapiens
tcatggaacactcatgtctgga

SEQ ID NO: 6440029 - DNA, 21 bp, Homo sapiens
tcatggaacgcgttgaaattg

SEQ ID NO: 6440030 - DNA, 15 bp, Homo sapiens
tcatggaagaaaagg

SEQ ID NO: 6440031 - DNA, 14 bp, Homo sapiens
tcatggaatcttgc

SEQ ID NO: 6440032 - DNA, 16 bp, Homo sapiens
tcatggaatgcaattt

SEQ ID NO: 6440033 - DNA, 20 bp, Homo sapiens
tcatggaatgcaatttgact

SEQ ID NO: 6440034 - DNA, 18 bp, Homo sapiens
tcatggaatggacatcct

SEQ ID NO: 6440035 - DNA, 20 bp, Homo sapiens
tcatggaatggcaggtgtca

SEQ ID NO: 6440036 - DNA, 12 bp, Homo sapiens
tcatggaatggt

SEQ ID NO: 6440037 - DNA, 22 bp, Homo sapiens
tcatggaatggttataaaagtg

SEQ ID NO: 6440038 - DNA, 22 bp, Homo sapiens
tcatggaattggtttaaacttt

SEQ ID NO: 6440039 - DNA, 17 bp, Homo sapiens
tcatggacaaagttctg

SEQ ID NO: 6440040 - DNA, 13 bp, Homo sapiens
tcatggacattca

SEQ ID NO: 6440041 - DNA, 16 bp, Homo sapiens
tcatggacattcatgc

SEQ ID NO: 6440042 - DNA, 16 bp, Homo sapiens
tcatggaccaaatgtg

SEQ ID NO: 6440043 - DNA, 22 bp, Homo sapiens
tcatggaccaaatgtgccatac

SEQ ID NO: 6440044 - DNA, 23 bp, Homo sapiens
tcatggaccactgtttcttgctt

SEQ ID NO: 6440045 - DNA, 22 bp, Homo sapiens
tcatggaccagtggctggtctc

SEQ ID NO: 6440046 - DNA, 23 bp, Homo sapiens
tcatggaccagtggctggtctca

SEQ ID NO: 6440047 - DNA, 18 bp, Homo sapiens
tcatggacctggtgcccc

SEQ ID NO: 6440048 - DNA, 20 bp, Homo sapiens
tcatggagaagtgaaggcat

SEQ ID NO: 6440049 - DNA, 20 bp, Homo sapiens
tcatggagacctcatgccat

SEQ ID NO: 6440050 - DNA, 15 bp, Homo sapiens
tcatggagcagcccc

SEQ ID NO: 6440051 - DNA, 16 bp, Homo sapiens
tcatggagcagccccc

SEQ ID NO: 6440052 - DNA, 18 bp, Homo sapiens
tcatggagcagcccccaa

SEQ ID NO: 6440053 - DNA, 21 bp, Homo sapiens
tcatggagcagcccccaaaga

SEQ ID NO: 6440054 - DNA, 14 bp, Homo sapiens
tcatggagctgagg

SEQ ID NO: 6440055 - DNA, 18 bp, Homo sapiens
tcatggagggggctgcag

SEQ ID NO: 6440056 - DNA, 19 bp, Homo sapiens
tcatggagggggctgcagg

SEQ ID NO: 6440057 - DNA, 22 bp, Homo sapiens
tctgtgcatggtggcaccagcg

SEQ ID NO: 6440058 - DNA, 12 bp, Homo sapiens
tctgtgcattct

SEQ ID NO: 6440059 - DNA, 14 bp, Homo sapiens
tctgtgccacgctc

SEQ ID NO: 6440060 - DNA, 21 bp, Homo sapiens
tctgtgccagacattgctctc

SEQ ID NO: 6440061 - DNA, 20 bp, Homo sapiens
tctgtgccagagcctggggc

SEQ ID NO: 6440062 - DNA, 18 bp, Homo sapiens
tctgtgccatagaacaag

SEQ ID NO: 6440063 - DNA, 16 bp, Homo sapiens
tctgtgccatggattt

SEQ ID NO: 6440064 - DNA, 24 bp, Homo sapiens
tctgtgcccacggtctgagctagc

SEQ ID NO: 6440065 - DNA, 13 bp, Homo sapiens
tctgtgcccagct

SEQ ID NO: 6440066 - DNA, 14 bp, Homo sapiens
tctgtgcccagctc

SEQ ID NO: 6440067 - DNA, 16 bp, Homo sapiens
tctgtgcccagctcag

SEQ ID NO: 6440068 - DNA, 23 bp, Homo sapiens
tctgtgcccagggtggctgccag

SEQ ID NO: 6440069 - DNA, 16 bp, Homo sapiens
tctgtgcccatgggca

SEQ ID NO: 6440070 - DNA, 21 bp, Homo sapiens
tctgtgcccatgggcactgct

SEQ ID NO: 6440071 - DNA, 21 bp, Homo sapiens
tctgtgcccgaggttcctgtc

SEQ ID NO: 6440072 - DNA, 22 bp, Homo sapiens
tctgtgcccgaggttcctgtca

SEQ ID NO: 6440073 - DNA, 11 bp, Homo sapiens
tctgtgcctaa

SEQ ID NO: 6440074 - DNA, 15 bp, Homo sapiens
tctgtgcctaataaa

SEQ ID NO: 6440075 - DNA, 16 bp, Homo sapiens
tctgtgcctaataaag

SEQ ID NO: 6440076 - DNA, 13 bp, Homo sapiens
tctgtgcctcagt

SEQ ID NO: 6440077 - DNA, 14 bp, Homo sapiens
tctgtgcctccagg

SEQ ID NO: 6440078 - DNA, 18 bp, Homo sapiens
tctgtgcctgcactgaga

SEQ ID NO: 6440079 - DNA, 14 bp, Homo sapiens
tctgtgcctggagc

SEQ ID NO: 6440080 - DNA, 15 bp, Homo sapiens
tctgtgcctggagct

SEQ ID NO: 6440081 - DNA, 20 bp, Homo sapiens
tctgtgcctggagctcctgg

SEQ ID NO: 6440082 - DNA, 12 bp, Homo sapiens
tctgtgcctggg

SEQ ID NO: 6440083 - DNA, 14 bp, Homo sapiens
tctgtgcctgggat

SEQ ID NO: 6440084 - DNA, 18 bp, Homo sapiens
tctgtgccttcttttgat

SEQ ID NO: 6440085 - DNA, 14 bp, Homo sapiens
tctgtgccttggtc

SEQ ID NO: 6440086 - DNA, 17 bp, Homo sapiens
tctgtgccttgtttttt

SEQ ID NO: 6440087 - DNA, 20 bp, Homo sapiens
tctgtgccttttttatatct

SEQ ID NO: 6440088 - DNA, 22 bp, Homo sapiens
tctgtgctagggaaacttcccg

SEQ ID NO: 6440089 - DNA, 15 bp, Homo sapiens
tctgtgctcacccat

SEQ ID NO: 6440090 - DNA, 19 bp, Homo sapiens
tctgtgctcatcggagact

SEQ ID NO: 6440091 - DNA, 18 bp, Homo sapiens
tctgtgctcatgtttgga

SEQ ID NO: 6440092 - DNA, 23 bp, Homo sapiens
tctgtgctgaccctcctgttgca

SEQ ID NO: 6440093 - DNA, 21 bp, Homo sapiens
tctgtgctggagatgttttag

SEQ ID NO: 6440094 - DNA, 14 bp, Homo sapiens
tctgtgctggccat

SEQ ID NO: 6440095 - DNA, 17 bp, Homo sapiens
tctgtgctgtgcctgct

SEQ ID NO: 6440096 - DNA, 14 bp, Homo sapiens
tctgtgcttctaat

SEQ ID NO: 6440097 - DNA, 12 bp, Homo sapiens
tctgtgcttgac

SEQ ID NO: 6440098 - DNA, 12 bp, Homo sapiens
tctgtgcttgga

SEQ ID NO: 6440099 - DNA, 22 bp, Homo sapiens
tctgtgctttgactcacctgtt

SEQ ID NO: 6440100 - DNA, 14 bp, Homo sapiens
tctgtggaaagtgt

SEQ ID NO: 6440101 - DNA, 16 bp, Homo sapiens
tctgtggaaatgacag

SEQ ID NO: 6440102 - DNA, 17 bp, Homo sapiens
tctgtggaagagattcc

SEQ ID NO: 6440103 - DNA, 17 bp, Homo sapiens
tctgtggacaagacatg

SEQ ID NO: 6440104 - DNA, 22 bp, Homo sapiens
tctgtggacaccactgagctct

SEQ ID NO: 6440105 - DNA, 22 bp, Homo sapiens
tctgtggaccactgcatgagct

SEQ ID NO: 6440106 - DNA, 22 bp, Homo sapiens
tctgtggaccctcgctctctgt

SEQ ID NO: 6440107 - DNA, 19 bp, Homo sapiens
tctgtggaggtggaaaagc

SEQ ID NO: 6440108 - DNA, 20 bp, Homo sapiens
tctgtggatacagtgcccac

SEQ ID NO: 6440109 - DNA, 20 bp, Homo sapiens
tctgtggattcagcttctgt

SEQ ID NO: 6440110 - DNA, 22 bp, Homo sapiens
tctgtggattctatatttcata

SEQ ID NO: 6440111 - DNA, 12 bp, Homo sapiens
tctgtggccagc

SEQ ID NO: 6440112 - DNA, 15 bp, Homo sapiens
tctgtggccagcctg

SEQ ID NO: 6440113 - DNA, 18 bp, Homo sapiens
tctgtggccagcctggca

SEQ ID NO: 6440114 - DNA, 16 bp, Homo sapiens
tctgtggccaggagcc

SEQ ID NO: 6440115 - DNA, 15 bp, Homo sapiens
tctgtggcccaagag

SEQ ID NO: 6440116 - DNA, 12 bp, Homo sapiens
tctgtggccctc

SEQ ID NO: 6440117 - DNA, 17 bp, Homo sapiens
tctgtggccctctctta

SEQ ID NO: 6440118 - DNA, 13 bp, Homo sapiens
tctgtggccgcca

SEQ ID NO: 6440119 - DNA, 12 bp, Homo sapiens
tctgtggcctgt

SEQ ID NO: 6440120 - DNA, 14 bp, Homo sapiens
tctgtggcctgtgt

SEQ ID NO: 6440121 - DNA, 15 bp, Homo sapiens
tctgtggccttggcc

SEQ ID NO: 6440122 - DNA, 17 bp, Homo sapiens
tctgtggccttggccct

SEQ ID NO: 6440123 - DNA, 15 bp, Homo sapiens
tctgtggccttgttc

SEQ ID NO: 6440124 - DNA, 22 bp, Homo sapiens
tctgtggccttgttctctctat

SEQ ID NO: 6440125 - DNA, 21 bp, Homo sapiens
tctgtggcgccgcgtggacag

SEQ ID NO: 6440126 - DNA, 12 bp, Homo sapiens
tctgtggctcca

SEQ ID NO: 6440127 - DNA, 15 bp, Homo sapiens
tctgtggctcctccc

SEQ ID NO: 6440128 - DNA, 20 bp, Homo sapiens
tctgtggctgccatcagaaa

SEQ ID NO: 6440129 - DNA, 14 bp, Homo sapiens
tctgtggctggctc

SEQ ID NO: 6440130 - DNA, 13 bp, Homo sapiens
tctgtgggaaaaa

SEQ ID NO: 6440131 - DNA, 20 bp, Homo sapiens
tctgtgggaaaaaagaaaaa

SEQ ID NO: 6440132 - DNA, 16 bp, Homo sapiens
tctgtgggagctcagc

SEQ ID NO: 6440133 - DNA, 22 bp, Homo sapiens
tctgtgggcatggccgcttcta

SEQ ID NO: 6440134 - DNA, 23 bp, Homo sapiens
tctgtgggcatggccgcttctag

SEQ ID NO: 6440135 - DNA, 13 bp, Homo sapiens
tctgtgggcccct

SEQ ID NO: 6440136 - DNA, 20 bp, Homo sapiens
tctgtgggcgggcccagcac

SEQ ID NO: 6440137 - DNA, 23 bp, Homo sapiens
tctgtgggctacatgctggggtc

SEQ ID NO: 6440138 - DNA, 15 bp, Homo sapiens
tctgtgggctgcact

SEQ ID NO: 6440139 - DNA, 19 bp, Homo sapiens
tctgtgggctgcactctgt

SEQ ID NO: 6440140 - DNA, 20 bp, Homo sapiens
tctgtgggctgcactctgtg

SEQ ID NO: 6440141 - DNA, 23 bp, Homo sapiens
tctgtgggctgcactctgtgccc

SEQ ID NO: 6440142 - DNA, 18 bp, Homo sapiens
tctgtgggcttcagcact

SEQ ID NO: 6440143 - DNA, 20 bp, Homo sapiens
tctgtgggcttggccttgtg

SEQ ID NO: 6440144 - DNA, 21 bp, Homo sapiens
tctgtggggaggggttgtttt

SEQ ID NO: 6440145 - DNA, 15 bp, Homo sapiens
tctgtggggccacac

SEQ ID NO: 6440146 - DNA, 12 bp, Homo sapiens
tctgtggggccc

SEQ ID NO: 6440147 - DNA, 16 bp, Homo sapiens
tctgtgggtctctgga

SEQ ID NO: 6440148 - DNA, 21 bp, Homo sapiens
tctgtgggtgacccaggtcct

SEQ ID NO: 6440149 - DNA, 23 bp, Homo sapiens
tctgtgggtttctaaagctgcca

SEQ ID NO: 6440150 - DNA, 16 bp, Homo sapiens
tctgtggtcacagtga

SEQ ID NO: 6440151 - DNA, 21 bp, Homo sapiens
tctgtggtccagaagaaatta

SEQ ID NO: 6440152 - DNA, 15 bp, Homo sapiens
tctgtggtccagagt

SEQ ID NO: 6440153 - DNA, 18 bp, Homo sapiens
tctgtggtgcagtgtgtg

SEQ ID NO: 6440154 - DNA, 22 bp, Homo sapiens
tctgtggtggttcattccacag

SEQ ID NO: 6440155 - DNA, 17 bp, Homo sapiens
tctgtggttcctctgct

SEQ ID NO: 6440156 - DNA, 20 bp, Homo sapiens
tctgtggttcctctgctcac

SEQ ID NO: 6440157 - DNA, 18 bp, Homo sapiens
tctgtggttctataataa

SEQ ID NO: 6440158 - DNA, 22 bp, Homo sapiens
tctgtggttgcagcctgaccaa

SEQ ID NO: 6440159 - DNA, 20 bp, Homo sapiens
tctgtggttggctgggaaat

SEQ ID NO: 6440160 - DNA, 14 bp, Homo sapiens
tctgtgtaaaatga

SEQ ID NO: 6440161 - DNA, 17 bp, Homo sapiens
tctgtgtaatagaataa

SEQ ID NO: 6440162 - DNA, 15 bp, Homo sapiens
tctgtgtacaaagaa

SEQ ID NO: 6440163 - DNA, 23 bp, Homo sapiens
tctgtgtacatgtgtgcagagca

SEQ ID NO: 6440164 - DNA, 21 bp, Homo sapiens
tctgtgtaccacttctgtggg

SEQ ID NO: 6440165 - DNA, 20 bp, Homo sapiens
tctgtgtagccgccctgaga

SEQ ID NO: 6440166 - DNA, 21 bp, Homo sapiens
tctgtgtatatctcttggaaa

SEQ ID NO: 6440167 - DNA, 13 bp, Homo sapiens
tctgtgtatgtat

SEQ ID NO: 6440168 - DNA, 12 bp, Homo sapiens
tctgtgtatgtg

SEQ ID NO: 6440169 - DNA, 18 bp, Homo sapiens
tctgtgtattttcagtca

SEQ ID NO: 6440170 - DNA, 18 bp, Homo sapiens
tctgtgtcacgtgaccct

SEQ ID NO: 6440171 - DNA, 22 bp, Homo sapiens
tctgtgtcactggctgcctcca

SEQ ID NO: 6440172 - DNA, 23 bp, Homo sapiens
tctgtgtcactggctgcctccac

SEQ ID NO: 6440173 - DNA, 21 bp, Homo sapiens
tctgtgtcagagcccagccca

SEQ ID NO: 6440174 - DNA, 23 bp, Homo sapiens
tctgtgtcagcatctttgccctt

SEQ ID NO: 6440175 - DNA, 15 bp, Homo sapiens
tctgtgtcagcattc

SEQ ID NO: 6440176 - DNA, 14 bp, Homo sapiens
tctgtgtcccagcc

SEQ ID NO: 6440177 - DNA, 17 bp, Homo sapiens
tctgtgtccttccctgc

SEQ ID NO: 6440178 - DNA, 18 bp, Homo sapiens
tctgtgtccttccctgca

SEQ ID NO: 6440179 - DNA, 18 bp, Homo sapiens
tctgtgtctaagattcta

SEQ ID NO: 6440180 - DNA, 22 bp, Homo sapiens
tctgtgtctaagattctagatc

SEQ ID NO: 6440181 - DNA, 23 bp, Homo sapiens
tctgtgtctaagattctagatca

SEQ ID NO: 6440182 - DNA, 13 bp, Homo sapiens
tctgtgtctgctc

SEQ ID NO: 6440183 - DNA, 15 bp, Homo sapiens
tctgtgtctgctctc

SEQ ID NO: 6440184 - DNA, 16 bp, Homo sapiens
tctgtgtctggcaggc

SEQ ID NO: 6440185 - DNA, 15 bp, Homo sapiens
tctgtgtctgtcacc

SEQ ID NO: 6440186 - DNA, 13 bp, Homo sapiens
tctgtgtgaatgt

SEQ ID NO: 6440187 - DNA, 14 bp, Homo sapiens
tctgtgtgaatgtg

SEQ ID NO: 6440188 - DNA, 13 bp, Homo sapiens
tctgtgtgcaatt

SEQ ID NO: 6440189 - DNA, 21 bp, Homo sapiens
tctgtgtgcacaaatatttat

SEQ ID NO: 6440190 - DNA, 18 bp, Homo sapiens
tctgtgtgcaccttacca

SEQ ID NO: 6440191 - DNA, 14 bp, Homo sapiens
tctgtgtgcagcaa

SEQ ID NO: 6440192 - DNA, 15 bp, Homo sapiens
tctgtgtgccctagg

SEQ ID NO: 6440193 - DNA, 11 bp, Homo sapiens
tctgtgtgcta

SEQ ID NO: 6440194 - DNA, 13 bp, Homo sapiens
tctgtgtgctact

SEQ ID NO: 6440195 - DNA, 15 bp, Homo sapiens
tctgtgtgctactaa

SEQ ID NO: 6440196 - DNA, 16 bp, Homo sapiens
tctgtgtgctactaac

SEQ ID NO: 6440197 - DNA, 18 bp, Homo sapiens
tctgtgtgctactaacag

SEQ ID NO: 6440198 - DNA, 21 bp, Homo sapiens
tctgtgtgctactaacagatt

SEQ ID NO: 6440199 - DNA, 11 bp, Homo sapiens
tctgtgtggca

SEQ ID NO: 6440200 - DNA, 16 bp, Homo sapiens
tctgtgtggctcctgg

SEQ ID NO: 6440201 - DNA, 17 bp, Homo sapiens
tctgtgtggctcctggg

SEQ ID NO: 6440202 - DNA, 21 bp, Homo sapiens
tctgtgtggctgtgcaatttc

SEQ ID NO: 6440203 - DNA, 23 bp, Homo sapiens
tctgtgtgggaaaatggcagaaa

SEQ ID NO: 6440204 - DNA, 19 bp, Homo sapiens
tctgtgtgggactgtacac

SEQ ID NO: 6440205 - DNA, 18 bp, Homo sapiens
tctgtgtgggtctgggga

SEQ ID NO: 6440206 - DNA, 22 bp, Homo sapiens
tctgtgtggtggagccagggcc

SEQ ID NO: 6440207 - DNA, 17 bp, Homo sapiens
tctgtgtggttcagcta

SEQ ID NO: 6440208 - DNA, 15 bp, Homo sapiens
tctgtgtgtatattg

SEQ ID NO: 6440209 - DNA, 13 bp, Homo sapiens
tctgtgtgtcagt

SEQ ID NO: 6440210 - DNA, 15 bp, Homo sapiens
tctgtgtgtcagttt

SEQ ID NO: 6440211 - DNA, 19 bp, Homo sapiens
tctgtgtgtctgatgtttg

SEQ ID NO: 6440212 - DNA, 22 bp, Homo sapiens
tctgtgtgtgacccctcctggg

SEQ ID NO: 6440213 - DNA, 21 bp, Homo sapiens
tctgtgtgtgagctaccgtgg

SEQ ID NO: 6440214 - DNA, 14 bp, Homo sapiens
tctgtgtgtgcctg

SEQ ID NO: 6440215 - DNA, 23 bp, Homo sapiens
tctgtgtgtgtccccctatgctc

SEQ ID NO: 6440216 - DNA, 15 bp, Homo sapiens
tctgtgtgtgtggcg

SEQ ID NO: 6440217 - DNA, 19 bp, Homo sapiens
tctgtgtgtgtgtatgtgg

SEQ ID NO: 6440218 - DNA, 22 bp, Homo sapiens
tctgtgtgtgtgtatgtggggg

SEQ ID NO: 6440219 - DNA, 15 bp, Homo sapiens
tctgtgtgtgtgtgc

SEQ ID NO: 6440220 - DNA, 20 bp, Homo sapiens
tctgtgtgtgtgtgtgtgcg

SEQ ID NO: 6440221 - DNA, 20 bp, Homo sapiens
tctgtgtgtttatgtgtgtg

SEQ ID NO: 6440222 - DNA, 20 bp, Homo sapiens
tctgtgttaattgcgtagag

SEQ ID NO: 6440223 - DNA, 21 bp, Homo sapiens
tctgtgttcccagaggcaggc

SEQ ID NO: 6440224 - DNA, 17 bp, Homo sapiens
tctgtgttctaacttat

SEQ ID NO: 6440225 - DNA, 22 bp, Homo sapiens
tctgtgttctaacttatttata

SEQ ID NO: 6440226 - DNA, 13 bp, Homo sapiens
tctgtgttgaaca

SEQ ID NO: 6440227 - DNA, 17 bp, Homo sapiens
tctgtgttgagcgtgcg

SEQ ID NO: 6440228 - DNA, 22 bp, Homo sapiens
tctgtgttgcattattcattta

SEQ ID NO: 6440229 - DNA, 15 bp, Homo sapiens
tctgtgtttaaagtg

SEQ ID NO: 6440230 - DNA, 20 bp, Homo sapiens
tctgtgtttacagagatgtc

SEQ ID NO: 6440231 - DNA, 17 bp, Homo sapiens
tctgtgtttattcaaac

SEQ ID NO: 6440232 - DNA, 16 bp, Homo sapiens
tctgtgtttctggagt

SEQ ID NO: 6440233 - DNA, 17 bp, Homo sapiens
tctgtgtttctggagtg

SEQ ID NO: 6440234 - DNA, 13 bp, Homo sapiens
tctgtgttttaat

SEQ ID NO: 6440235 - DNA, 23 bp, Homo sapiens
tcatggagtgacggtcccacact

SEQ ID NO: 6440236 - DNA, 21 bp, Homo sapiens
tcatggatcaaccaagttaca

SEQ ID NO: 6440237 - DNA, 23 bp, Homo sapiens
tcatggatgggggaactcagatc

SEQ ID NO: 6440238 - DNA, 22 bp, Homo sapiens
tcatggattacttctctataaa

SEQ ID NO: 6440239 - DNA, 18 bp, Homo sapiens
tcatggatttattttttg

SEQ ID NO: 6440240 - DNA, 20 bp, Homo sapiens
tcatggatttattttttgta

SEQ ID NO: 6440241 - DNA, 23 bp, Homo sapiens
tcatggatttattttttgtaact

SEQ ID NO: 6440242 - DNA, 20 bp, Homo sapiens
tcatggattttccaggactg

SEQ ID NO: 6440243 - DNA, 17 bp, Homo sapiens
tcatggcaatgaaaatt

SEQ ID NO: 6440244 - DNA, 18 bp, Homo sapiens
tcatggcagatgtaggag

SEQ ID NO: 6440245 - DNA, 22 bp, Homo sapiens
tcatggcagatgtaggagggac

SEQ ID NO: 6440246 - DNA, 13 bp, Homo sapiens
tcatggcagctgt

SEQ ID NO: 6440247 - DNA, 17 bp, Homo sapiens
tcatggcagctgtttct

SEQ ID NO: 6440248 - DNA, 19 bp, Homo sapiens
tcatggcagctgtttctca

SEQ ID NO: 6440249 - DNA, 21 bp, Homo sapiens
tcatggcagtgcctgaacatg

SEQ ID NO: 6440250 - DNA, 12 bp, Homo sapiens
tcatggccacac

SEQ ID NO: 6440251 - DNA, 21 bp, Homo sapiens
tcatggccacactgtgacaca

SEQ ID NO: 6440252 - DNA, 18 bp, Homo sapiens
tcatggcccatcaggggc

SEQ ID NO: 6440253 - DNA, 19 bp, Homo sapiens
tcatggcccatcaggggca

SEQ ID NO: 6440254 - DNA, 19 bp, Homo sapiens
tcatggcccccaggggcag

SEQ ID NO: 6440255 - DNA, 14 bp, Homo sapiens
tcatggcccctctg

SEQ ID NO: 6440256 - DNA, 20 bp, Homo sapiens
tcatggcctattatattaaa

SEQ ID NO: 6440257 - DNA, 16 bp, Homo sapiens
tcatggccttgaaaca

SEQ ID NO: 6440258 - DNA, 18 bp, Homo sapiens
tcatggcgtaatgggcct

SEQ ID NO: 6440259 - DNA, 20 bp, Homo sapiens
tcatggcgtaatgggcctgc

SEQ ID NO: 6440260 - DNA, 16 bp, Homo sapiens
tcatggctcactgcag

SEQ ID NO: 6440261 - DNA, 16 bp, Homo sapiens
tcatggctcttagaaa

SEQ ID NO: 6440262 - DNA, 13 bp, Homo sapiens
tcatggctgaagt

SEQ ID NO: 6440263 - DNA, 13 bp, Homo sapiens
tcatggctgtccc

SEQ ID NO: 6440264 - DNA, 18 bp, Homo sapiens
tcatggctgtgtccactg

SEQ ID NO: 6440265 - DNA, 15 bp, Homo sapiens
tcatggctgttatct

SEQ ID NO: 6440266 - DNA, 16 bp, Homo sapiens
tcatggctttttcttt

SEQ ID NO: 6440267 - DNA, 21 bp, Homo sapiens
tcatgggaaaagaccagggct

SEQ ID NO: 6440268 - DNA, 19 bp, Homo sapiens
tcatgggaacgcagcctcc

SEQ ID NO: 6440269 - DNA, 20 bp, Homo sapiens
tcatgggaacgcagcctcca

SEQ ID NO: 6440270 - DNA, 21 bp, Homo sapiens
tcatgggaatgatagcccaga

SEQ ID NO: 6440271 - DNA, 13 bp, Homo sapiens
tcatgggaatttt

SEQ ID NO: 6440272 - DNA, 17 bp, Homo sapiens
tcatgggaattttaact

SEQ ID NO: 6440273 - DNA, 17 bp, Homo sapiens
tcatgggagaagagggg

SEQ ID NO: 6440274 - DNA, 23 bp, Homo sapiens
tcatgggagggggcttgaagcca

SEQ ID NO: 6440275 - DNA, 18 bp, Homo sapiens
tcatgggagtcagggagc

SEQ ID NO: 6440276 - DNA, 22 bp, Homo sapiens
tcatgggagtcagggagccctg

SEQ ID NO: 6440277 - DNA, 21 bp, Homo sapiens
tcatgggccccccatgcatac

SEQ ID NO: 6440278 - DNA, 14 bp, Homo sapiens
tcatgggcctgtgg

SEQ ID NO: 6440279 - DNA, 14 bp, Homo sapiens
tcatgggctgtgtg

SEQ ID NO: 6440280 - DNA, 18 bp, Homo sapiens
tcatgggggatttttcat

SEQ ID NO: 6440281 - DNA, 17 bp, Homo sapiens
tcatgggggtaagaaaa

SEQ ID NO: 6440282 - DNA, 17 bp, Homo sapiens
tcatggggtccctgctg

SEQ ID NO: 6440283 - DNA, 22 bp, Homo sapiens
tcatgggtcccgggttagcctg

SEQ ID NO: 6440284 - DNA, 20 bp, Homo sapiens
tcatgggtcccttgaaggaa

SEQ ID NO: 6440285 - DNA, 17 bp, Homo sapiens
tcatgggtcctagccct

SEQ ID NO: 6440286 - DNA, 23 bp, Homo sapiens
tcatggtagagaccgagcctctg

SEQ ID NO: 6440287 - DNA, 19 bp, Homo sapiens
tcatggtagatttttttca

SEQ ID NO: 6440288 - DNA, 20 bp, Homo sapiens
tcatggtagatttttttcat

SEQ ID NO: 6440289 - DNA, 21 bp, Homo sapiens
tcatggtagatttttttcata

SEQ ID NO: 6440290 - DNA, 15 bp, Homo sapiens
tcatggtcagctcac

SEQ ID NO: 6440291 - DNA, 18 bp, Homo sapiens
tcatggtcagctcacacc

SEQ ID NO: 6440292 - DNA, 15 bp, Homo sapiens
tcatggtcctttctg

SEQ ID NO: 6440293 - DNA, 13 bp, Homo sapiens
tcatggtctcagt

SEQ ID NO: 6440294 - DNA, 14 bp, Homo sapiens
tcatggtgaaaatg

SEQ ID NO: 6440295 - DNA, 19 bp, Homo sapiens
tcatggtgaaaatgtactg

SEQ ID NO: 6440296 - DNA, 20 bp, Homo sapiens
tcatggtgaaattataacta

SEQ ID NO: 6440297 - DNA, 23 bp, Homo sapiens
tcatggtgaaattataactatta

SEQ ID NO: 6440298 - DNA, 22 bp, Homo sapiens
tcatggtgaccaccccctgttc

SEQ ID NO: 6440299 - DNA, 22 bp, Homo sapiens
tcatggtgaggcttaacaatgt

SEQ ID NO: 6440300 - DNA, 16 bp, Homo sapiens
tcatggtgatgcaagt

SEQ ID NO: 6440301 - DNA, 18 bp, Homo sapiens
tcatggtgcaatttgtct

SEQ ID NO: 6440302 - DNA, 16 bp, Homo sapiens
tcatggtgcatataaa

SEQ ID NO: 6440303 - DNA, 17 bp, Homo sapiens
tcatggtgcatataaat

SEQ ID NO: 6440304 - DNA, 23 bp, Homo sapiens
tcatggtggccacggccacagcc

SEQ ID NO: 6440305 - DNA, 13 bp, Homo sapiens
tcatggtgtaata

SEQ ID NO: 6440306 - DNA, 14 bp, Homo sapiens
tcatggtgtaataa

SEQ ID NO: 6440307 - DNA, 21 bp, Homo sapiens
tcatggtgtaataagacataa

SEQ ID NO: 6440308 - DNA, 18 bp, Homo sapiens
tcatggttcaagtattaa

SEQ ID NO: 6440309 - DNA, 22 bp, Homo sapiens
tcatggttcaagtattaagcag

SEQ ID NO: 6440310 - DNA, 15 bp, Homo sapiens
tcatggtttccattt

SEQ ID NO: 6440311 - DNA, 19 bp, Homo sapiens
tcatgtaaaaagtgcagta

SEQ ID NO: 6440312 - DNA, 14 bp, Homo sapiens
tcatgtaaaataag

SEQ ID NO: 6440313 - DNA, 15 bp, Homo sapiens
tcatgtaaaataaga

SEQ ID NO: 6440314 - DNA, 20 bp, Homo sapiens
tcatgtaaacctaagcacgt

SEQ ID NO: 6440315 - DNA, 21 bp, Homo sapiens
tcatgtaaacctaagcacgta

SEQ ID NO: 6440316 - DNA, 14 bp, Homo sapiens
tcatgtaaactgtg

SEQ ID NO: 6440317 - DNA, 16 bp, Homo sapiens
tcatgtaaactgtgca

SEQ ID NO: 6440318 - DNA, 19 bp, Homo sapiens
tcatgtaaagaaatgtctt

SEQ ID NO: 6440319 - DNA, 22 bp, Homo sapiens
tcatgtaaagaaatgtcttaat

SEQ ID NO: 6440320 - DNA, 15 bp, Homo sapiens
tcatgtaaataaata

SEQ ID NO: 6440321 - DNA, 13 bp, Homo sapiens
tcatgtaaatgct

SEQ ID NO: 6440322 - DNA, 14 bp, Homo sapiens
tcatgtaaatgctc

SEQ ID NO: 6440323 - DNA, 22 bp, Homo sapiens
tcatgtaaatgctcattttctt

SEQ ID NO: 6440324 - DNA, 13 bp, Homo sapiens
tcatgtaaattac

SEQ ID NO: 6440325 - DNA, 16 bp, Homo sapiens
tcatgtaaattttgta

SEQ ID NO: 6440326 - DNA, 18 bp, Homo sapiens
tcatgtaacacataaaca

SEQ ID NO: 6440327 - DNA, 20 bp, Homo sapiens
tcatgtaacacataaacaat

SEQ ID NO: 6440328 - DNA, 16 bp, Homo sapiens
tcatgtaacagttgtg

SEQ ID NO: 6440329 - DNA, 15 bp, Homo sapiens
tcatgtaacattggt

SEQ ID NO: 6440330 - DNA, 13 bp, Homo sapiens
tcatgtaactctc

SEQ ID NO: 6440331 - DNA, 22 bp, Homo sapiens
tcatgtaagaatccaaagtgga

SEQ ID NO: 6440332 - DNA, 19 bp, Homo sapiens
tcatgtaagctgaaaatat

SEQ ID NO: 6440333 - DNA, 17 bp, Homo sapiens
tcatgtaagtagcaaac

SEQ ID NO: 6440334 - DNA, 17 bp, Homo sapiens
tcatgtaataaacaggt

SEQ ID NO: 6440335 - DNA, 17 bp, Homo sapiens
tcatgtaatataagtga

SEQ ID NO: 6440336 - DNA, 19 bp, Homo sapiens
tcatgtaatataagtgaac

SEQ ID NO: 6440337 - DNA, 15 bp, Homo sapiens
tcatgtaatcacata

SEQ ID NO: 6440338 - DNA, 18 bp, Homo sapiens
tcatgtacaagatgaagg

SEQ ID NO: 6440339 - DNA, 21 bp, Homo sapiens
tcatgtacattggtctttcta

SEQ ID NO: 6440340 - DNA, 19 bp, Homo sapiens
tcatgtacatttggaacta

SEQ ID NO: 6440341 - DNA, 22 bp, Homo sapiens
tcatgtacttcctgtgtactct

SEQ ID NO: 6440342 - DNA, 23 bp, Homo sapiens
tcatgtacttcctgtgtactctt

SEQ ID NO: 6440343 - DNA, 18 bp, Homo sapiens
tcatgtagaatatggcta

SEQ ID NO: 6440344 - DNA, 16 bp, Homo sapiens
tcatgtagagaaaagc

SEQ ID NO: 6440345 - DNA, 16 bp, Homo sapiens
tcatgtaggtgagcct

SEQ ID NO: 6440346 - DNA, 18 bp, Homo sapiens
tcatgtaggtgagcctgg

SEQ ID NO: 6440347 - DNA, 19 bp, Homo sapiens
tcatgtaggtgagcctggg

SEQ ID NO: 6440348 - DNA, 20 bp, Homo sapiens
tcatgtaggtgagcctgggc

SEQ ID NO: 6440349 - DNA, 16 bp, Homo sapiens
tcatgtagtatcaaat

SEQ ID NO: 6440350 - DNA, 17 bp, Homo sapiens
tcatgtagtatcaaata

SEQ ID NO: 6440351 - DNA, 19 bp, Homo sapiens
tcatgtagtatcaaatatt

SEQ ID NO: 6440352 - DNA, 15 bp, Homo sapiens
tcatgtatacttcaa

SEQ ID NO: 6440353 - DNA, 15 bp, Homo sapiens
tcatgtatcatctgg

SEQ ID NO: 6440354 - DNA, 18 bp, Homo sapiens
tcatgtatcatctggata

SEQ ID NO: 6440355 - DNA, 14 bp, Homo sapiens
tcatgtatgcaagt

SEQ ID NO: 6440356 - DNA, 16 bp, Homo sapiens
tcatgtatgtatataa

SEQ ID NO: 6440357 - DNA, 13 bp, Homo sapiens
tcatgtatgtttc

SEQ ID NO: 6440358 - DNA, 13 bp, Homo sapiens
tcatgtatttctt

SEQ ID NO: 6440359 - DNA, 18 bp, Homo sapiens
tcatgtatttctttagaa

SEQ ID NO: 6440360 - DNA, 18 bp, Homo sapiens
tcatgtatttgagcatat

SEQ ID NO: 6440361 - DNA, 18 bp, Homo sapiens
tcatgtattttacacaaa

SEQ ID NO: 6440362 - DNA, 22 bp, Homo sapiens
tcatgtcaaagtgaaagacatt

SEQ ID NO: 6440363 - DNA, 21 bp, Homo sapiens
tcatgtcacatcctaatagaa

SEQ ID NO: 6440364 - DNA, 19 bp, Homo sapiens
tcatgtcaggcctgtgtgt

SEQ ID NO: 6440365 - DNA, 18 bp, Homo sapiens
tcatgtcattatgacatt

SEQ ID NO: 6440366 - DNA, 13 bp, Homo sapiens
tcatgtcatttct

SEQ ID NO: 6440367 - DNA, 21 bp, Homo sapiens
tcatgtccaaacgtcctcttt

SEQ ID NO: 6440368 - DNA, 22 bp, Homo sapiens
tcatgtccagtgagcagtgttg

SEQ ID NO: 6440369 - DNA, 13 bp, Homo sapiens
tcatgtccatccc

SEQ ID NO: 6440370 - DNA, 15 bp, Homo sapiens
tcatgtccatccctt

SEQ ID NO: 6440371 - DNA, 23 bp, Homo sapiens
tcatgtccatcccttttcctgtc

SEQ ID NO: 6440372 - DNA, 17 bp, Homo sapiens
tcatgtccccaaacctg

SEQ ID NO: 6440373 - DNA, 14 bp, Homo sapiens
tcatgtccccctta

SEQ ID NO: 6440374 - DNA, 18 bp, Homo sapiens
tcatgtccctgtccccag

SEQ ID NO: 6440375 - DNA, 22 bp, Homo sapiens
tcatgtccctgtccccaggccc

SEQ ID NO: 6440376 - DNA, 22 bp, Homo sapiens
tcatgtcctgctggcttccagc

SEQ ID NO: 6440377 - DNA, 17 bp, Homo sapiens
tcatgtcctgtcctggt

SEQ ID NO: 6440378 - DNA, 16 bp, Homo sapiens
tcatgtcctgtgtcag

SEQ ID NO: 6440379 - DNA, 18 bp, Homo sapiens
tcatgtcctgtgtcagtt

SEQ ID NO: 6440380 - DNA, 19 bp, Homo sapiens
tcatgtcctgtgtcagttt

SEQ ID NO: 6440381 - DNA, 16 bp, Homo sapiens
tcatgtcgtaggtaaa

SEQ ID NO: 6440382 - DNA, 16 bp, Homo sapiens
tcatgtctattccatt

SEQ ID NO: 6440383 - DNA, 20 bp, Homo sapiens
tcatgtctattgtccaaagt

SEQ ID NO: 6440384 - DNA, 15 bp, Homo sapiens
tcatgtctgaaacag

SEQ ID NO: 6440385 - DNA, 20 bp, Homo sapiens
tcatgtctgaaacagagaac

SEQ ID NO: 6440386 - DNA, 20 bp, Homo sapiens
tcatgtctggagtcccctcc

SEQ ID NO: 6440387 - DNA, 13 bp, Homo sapiens
tcatgtctgtatc

SEQ ID NO: 6440388 - DNA, 14 bp, Homo sapiens
tcatgtctgtatcc

SEQ ID NO: 6440389 - DNA, 20 bp, Homo sapiens
tcatgtctgtatccccagtg

SEQ ID NO: 6440390 - DNA, 23 bp, Homo sapiens
tcatgtctgtatccccagtgccc

SEQ ID NO: 6440391 - DNA, 22 bp, Homo sapiens
tcatgtcttcattttttaatgt

SEQ ID NO: 6440392 - DNA, 20 bp, Homo sapiens
tcatgtcttccattaagaac

SEQ ID NO: 6440393 - DNA, 15 bp, Homo sapiens
tcatgtcttgtgcat

SEQ ID NO: 6440394 - DNA, 14 bp, Homo sapiens
tcatgtctttccac

SEQ ID NO: 6440395 - DNA, 14 bp, Homo sapiens
tcatgtgaaatcat

SEQ ID NO: 6440396 - DNA, 16 bp, Homo sapiens
tcatgtgaaatcattc

SEQ ID NO: 6440397 - DNA, 15 bp, Homo sapiens
tcatgtgaaatgttt

SEQ ID NO: 6440398 - DNA, 17 bp, Homo sapiens
tcatgtgaccactctgt

SEQ ID NO: 6440399 - DNA, 22 bp, Homo sapiens
tcatgtgactagcgcctggcct

SEQ ID NO: 6440400 - DNA, 16 bp, Homo sapiens
tcatgtgagaaagcag

SEQ ID NO: 6440401 - DNA, 17 bp, Homo sapiens
tcatgtgagaaagctaa

SEQ ID NO: 6440402 - DNA, 16 bp, Homo sapiens
tcatgtgagtctggga

SEQ ID NO: 6440403 - DNA, 17 bp, Homo sapiens
tcatgtgagtctgggat

SEQ ID NO: 6440404 - DNA, 20 bp, Homo sapiens
tcatgtgatccttttatgtt

SEQ ID NO: 6440405 - DNA, 18 bp, Homo sapiens
tcatgtgcatctggtgta

SEQ ID NO: 6440406 - DNA, 15 bp, Homo sapiens
tcatgtgcctggaaa

SEQ ID NO: 6440407 - DNA, 14 bp, Homo sapiens
tcatgtgctcagaa

SEQ ID NO: 6440408 - DNA, 14 bp, Homo sapiens
tcatgtgctttgta

SEQ ID NO: 6440409 - DNA, 19 bp, Homo sapiens
tcatgtggaatataaagat

SEQ ID NO: 6440410 - DNA, 21 bp, Homo sapiens
tcatgtggactgggaccgtgc

SEQ ID NO: 6440411 - DNA, 24 bp, Homo sapiens
tcatgtggcacttgggcatttata

SEQ ID NO: 6440412 - DNA, 21 bp, Homo sapiens
tctgtgttttcagactgcctg

SEQ ID NO: 6440413 - DNA, 14 bp, Homo sapiens
tctgtgttttgaat

SEQ ID NO: 6440414 - DNA, 15 bp, Homo sapiens
tctgtgttttgtgag

SEQ ID NO: 6440415 - DNA, 18 bp, Homo sapiens
tctgtgtttttttctgaa

SEQ ID NO: 6440416 - DNA, 15 bp, Homo sapiens
tctgttaaaatctat

SEQ ID NO: 6440417 - DNA, 22 bp, Homo sapiens
tctgttaaccaaataaaacata

SEQ ID NO: 6440418 - DNA, 17 bp, Homo sapiens
tctgttaaggttgaact

SEQ ID NO: 6440419 - DNA, 21 bp, Homo sapiens
tctgttaagtaaaatgtcata

SEQ ID NO: 6440420 - DNA, 16 bp, Homo sapiens
tctgttacaaaatgta

SEQ ID NO: 6440421 - DNA, 17 bp, Homo sapiens
tctgttacaaaatgtaa

SEQ ID NO: 6440422 - DNA, 13 bp, Homo sapiens
tctgttacacaat

SEQ ID NO: 6440423 - DNA, 17 bp, Homo sapiens
tctgttacacaatatgt

SEQ ID NO: 6440424 - DNA, 21 bp, Homo sapiens
tctgttaccatgtcactgtgg

SEQ ID NO: 6440425 - DNA, 15 bp, Homo sapiens
tctgttacccaggct

SEQ ID NO: 6440426 - DNA, 23 bp, Homo sapiens
tctgttactccaaaaagaaatat

SEQ ID NO: 6440427 - DNA, 22 bp, Homo sapiens
tctgttactccattactgtgat

SEQ ID NO: 6440428 - DNA, 23 bp, Homo sapiens
tctgttactccattactgtgatt

SEQ ID NO: 6440429 - DNA, 14 bp, Homo sapiens
tctgttagcagagt

SEQ ID NO: 6440430 - DNA, 23 bp, Homo sapiens
tctgttagcattattgccaaata

SEQ ID NO: 6440431 - DNA, 13 bp, Homo sapiens
tctgttagctgct

SEQ ID NO: 6440432 - DNA, 17 bp, Homo sapiens
tctgttagctgctcact

SEQ ID NO: 6440433 - DNA, 19 bp, Homo sapiens
tctgttaggggccaataaa

SEQ ID NO: 6440434 - DNA, 21 bp, Homo sapiens
tctgttaggggccaataaaat

SEQ ID NO: 6440435 - DNA, 23 bp, Homo sapiens
tctgttaggggccaataaaatgt

SEQ ID NO: 6440436 - DNA, 23 bp, Homo sapiens
tctgttatacacagttccacaat

SEQ ID NO: 6440437 - DNA, 21 bp, Homo sapiens
tctgttataggtcctttagaa

SEQ ID NO: 6440438 - DNA, 22 bp, Homo sapiens
tctgttataggtcctttagaaa

SEQ ID NO: 6440439 - DNA, 15 bp, Homo sapiens
tctgttatataaatg

SEQ ID NO: 6440440 - DNA, 18 bp, Homo sapiens
tctgttatgcaagcacaa

SEQ ID NO: 6440441 - DNA, 12 bp, Homo sapiens
tctgttatgcac

SEQ ID NO: 6440442 - DNA, 15 bp, Homo sapiens
tctgttatgggcttt

SEQ ID NO: 6440443 - DNA, 16 bp, Homo sapiens
tctgttatgtactgta

SEQ ID NO: 6440444 - DNA, 22 bp, Homo sapiens
tctgttatgtactgtactaatt

SEQ ID NO: 6440445 - DNA, 15 bp, Homo sapiens
tctgttattaacaaa

SEQ ID NO: 6440446 - DNA, 13 bp, Homo sapiens
tctgttattgttt

SEQ ID NO: 6440447 - DNA, 18 bp, Homo sapiens
tctgttatttagactcat

SEQ ID NO: 6440448 - DNA, 16 bp, Homo sapiens
tctgttatttatttca

SEQ ID NO: 6440449 - DNA, 19 bp, Homo sapiens
tctgttatttttaagcttt

SEQ ID NO: 6440450 - DNA, 16 bp, Homo sapiens
tctgttcaaggaatca

SEQ ID NO: 6440451 - DNA, 22 bp, Homo sapiens
tctgttcacaaactacctctgg

SEQ ID NO: 6440452 - DNA, 13 bp, Homo sapiens
tctgttcaccctg

SEQ ID NO: 6440453 - DNA, 19 bp, Homo sapiens
tctgttcacttttcctccc

SEQ ID NO: 6440454 - DNA, 21 bp, Homo sapiens
tctgttcacttttcctccctc

SEQ ID NO: 6440455 - DNA, 17 bp, Homo sapiens
tctgttcagatgtgcat

SEQ ID NO: 6440456 - DNA, 20 bp, Homo sapiens
tctgttcagcgttttgcaag

SEQ ID NO: 6440457 - DNA, 14 bp, Homo sapiens
tctgttcaggaagt

SEQ ID NO: 6440458 - DNA, 22 bp, Homo sapiens
tctgttcagtaacagggccttg

SEQ ID NO: 6440459 - DNA, 13 bp, Homo sapiens
tctgttcatctct

SEQ ID NO: 6440460 - DNA, 16 bp, Homo sapiens
tctgttcatctctttg

SEQ ID NO: 6440461 - DNA, 18 bp, Homo sapiens
tctgttcatctctttgtc

SEQ ID NO: 6440462 - DNA, 21 bp, Homo sapiens
tctgttcatctctttgtcctg

SEQ ID NO: 6440463 - DNA, 22 bp, Homo sapiens
tctgttcatctctttgtcctga

SEQ ID NO: 6440464 - DNA, 23 bp, Homo sapiens
tctgttcatctctttgtcctgaa

SEQ ID NO: 6440465 - DNA, 16 bp, Homo sapiens
tctgttcattcctcca

SEQ ID NO: 6440466 - DNA, 17 bp, Homo sapiens
tctgttcattcctccag

SEQ ID NO: 6440467 - DNA, 21 bp, Homo sapiens
tctgttcatttgttattctta

SEQ ID NO: 6440468 - DNA, 12 bp, Homo sapiens
tctgttccaaat

SEQ ID NO: 6440469 - DNA, 22 bp, Homo sapiens
tctgttccaacctcctgctctg

SEQ ID NO: 6440470 - DNA, 24 bp, Homo sapiens
tctgttccaacctcctgctctggg

SEQ ID NO: 6440471 - DNA, 21 bp, Homo sapiens
tctgttccaagtgtgtgtgca

SEQ ID NO: 6440472 - DNA, 12 bp, Homo sapiens
tctgttccacat

SEQ ID NO: 6440473 - DNA, 13 bp, Homo sapiens
tctgttcccagcc

SEQ ID NO: 6440474 - DNA, 14 bp, Homo sapiens
tctgttcccagccc

SEQ ID NO: 6440475 - DNA, 18 bp, Homo sapiens
tctgttcccagcccctgc

SEQ ID NO: 6440476 - DNA, 20 bp, Homo sapiens
tctgttccccatggccactt

SEQ ID NO: 6440477 - DNA, 13 bp, Homo sapiens
tctgttccccctt

SEQ ID NO: 6440478 - DNA, 18 bp, Homo sapiens
tctgttcccccttcacaa

SEQ ID NO: 6440479 - DNA, 20 bp, Homo sapiens
tctgttcccccttcacaaag

SEQ ID NO: 6440480 - DNA, 12 bp, Homo sapiens
tctgttccctgc

SEQ ID NO: 6440481 - DNA, 15 bp, Homo sapiens
tctgttcccttcctc

SEQ ID NO: 6440482 - DNA, 23 bp, Homo sapiens
tctgttcccttcctctgtgccac

SEQ ID NO: 6440483 - DNA, 19 bp, Homo sapiens
tctgttcctcaatggcctt

SEQ ID NO: 6440484 - DNA, 22 bp, Homo sapiens
tctgttccttatgatattctca

SEQ ID NO: 6440485 - DNA, 13 bp, Homo sapiens
tctgttccttcac

SEQ ID NO: 6440486 - DNA, 15 bp, Homo sapiens
tctgttctaacatgt

SEQ ID NO: 6440487 - DNA, 19 bp, Homo sapiens
tctgttctactcttaatga

SEQ ID NO: 6440488 - DNA, 13 bp, Homo sapiens
tctgttctagttt

SEQ ID NO: 6440489 - DNA, 15 bp, Homo sapiens
tctgttctagttttt

SEQ ID NO: 6440490 - DNA, 15 bp, Homo sapiens
tctgttctatgcttc

SEQ ID NO: 6440491 - DNA, 19 bp, Homo sapiens
tctgttctcaaagcagaag

SEQ ID NO: 6440492 - DNA, 22 bp, Homo sapiens
tctgttctcacataacagagta

SEQ ID NO: 6440493 - DNA, 15 bp, Homo sapiens
tctgttctccctggg

SEQ ID NO: 6440494 - DNA, 15 bp, Homo sapiens
tctgttctctcccct

SEQ ID NO: 6440495 - DNA, 18 bp, Homo sapiens
tctgttctctcccctcac

SEQ ID NO: 6440496 - DNA, 20 bp, Homo sapiens
tctgttctctcccctcacat

SEQ ID NO: 6440497 - DNA, 12 bp, Homo sapiens
tctgttctgata

SEQ ID NO: 6440498 - DNA, 17 bp, Homo sapiens
tctgttctgccccctca

SEQ ID NO: 6440499 - DNA, 18 bp, Homo sapiens
tctgttctgctgggagtt

SEQ ID NO: 6440500 - DNA, 24 bp, Homo sapiens
tctgttctgctgggagttctagaa

SEQ ID NO: 6440501 - DNA, 13 bp, Homo sapiens
tctgttctggggg

SEQ ID NO: 6440502 - DNA, 16 bp, Homo sapiens
tctgttctggtggccc

SEQ ID NO: 6440503 - DNA, 14 bp, Homo sapiens
tctgttctgtggaa

SEQ ID NO: 6440504 - DNA, 16 bp, Homo sapiens
tctgttctgtggaaag

SEQ ID NO: 6440505 - DNA, 17 bp, Homo sapiens
tctgttctgtttggcac

SEQ ID NO: 6440506 - DNA, 17 bp, Homo sapiens
tctgttcttcctcagcc

SEQ ID NO: 6440507 - DNA, 19 bp, Homo sapiens
tctgttctttcatactaca

SEQ ID NO: 6440508 - DNA, 17 bp, Homo sapiens
tctgttcttttgactta

SEQ ID NO: 6440509 - DNA, 16 bp, Homo sapiens
tctgttgaaaagcaca

SEQ ID NO: 6440510 - DNA, 12 bp, Homo sapiens
tctgttgaaata

SEQ ID NO: 6440511 - DNA, 17 bp, Homo sapiens
tctgttgaaataaaaca

SEQ ID NO: 6440512 - DNA, 22 bp, Homo sapiens
tctgttgaaggtgccattttaa

SEQ ID NO: 6440513 - DNA, 18 bp, Homo sapiens
tctgttgaattatgtttt

SEQ ID NO: 6440514 - DNA, 18 bp, Homo sapiens
tctgttgacaatttgcca

SEQ ID NO: 6440515 - DNA, 22 bp, Homo sapiens
tctgttgaccaatctctattca

SEQ ID NO: 6440516 - DNA, 17 bp, Homo sapiens
tctgttgaccaggctgg

SEQ ID NO: 6440517 - DNA, 14 bp, Homo sapiens
tctgttgagtaaaa

SEQ ID NO: 6440518 - DNA, 17 bp, Homo sapiens
tctgttgagtaaaacac

SEQ ID NO: 6440519 - DNA, 14 bp, Homo sapiens
tctgttgagtgcaa

SEQ ID NO: 6440520 - DNA, 22 bp, Homo sapiens
tctgttgatcccacttcactgt

SEQ ID NO: 6440521 - DNA, 23 bp, Homo sapiens
tctgttgatcccacttcactgtg

SEQ ID NO: 6440522 - DNA, 22 bp, Homo sapiens
tctgttgatctacccgtgcctg

SEQ ID NO: 6440523 - DNA, 12 bp, Homo sapiens
tctgttgcaaac

SEQ ID NO: 6440524 - DNA, 18 bp, Homo sapiens
tctgttgcaagcccctct

SEQ ID NO: 6440525 - DNA, 15 bp, Homo sapiens
tctgttgcaattagg

SEQ ID NO: 6440526 - DNA, 14 bp, Homo sapiens
tctgttgcctcctc

SEQ ID NO: 6440527 - DNA, 16 bp, Homo sapiens
tctgttgcctcctctc

SEQ ID NO: 6440528 - DNA, 21 bp, Homo sapiens
tctgttgcctcctctctccct

SEQ ID NO: 6440529 - DNA, 23 bp, Homo sapiens
tctgttgcctttttacagccaac

SEQ ID NO: 6440530 - DNA, 13 bp, Homo sapiens
tctgttgctggag

SEQ ID NO: 6440531 - DNA, 22 bp, Homo sapiens
tctgttgctggtcttctcagtt

SEQ ID NO: 6440532 - DNA, 22 bp, Homo sapiens
tctgttgctgtcctccagggcg

SEQ ID NO: 6440533 - DNA, 22 bp, Homo sapiens
tctgttggaagcttgttttcca

SEQ ID NO: 6440534 - DNA, 16 bp, Homo sapiens
tctgttggagaaagaa

SEQ ID NO: 6440535 - DNA, 17 bp, Homo sapiens
tctgttggagaaagaaa

SEQ ID NO: 6440536 - DNA, 18 bp, Homo sapiens
tctgttggagttccctca

SEQ ID NO: 6440537 - DNA, 21 bp, Homo sapiens
tctgttggcaaatttgtgaac

SEQ ID NO: 6440538 - DNA, 18 bp, Homo sapiens
tctgttggcaggctggcc

SEQ ID NO: 6440539 - DNA, 20 bp, Homo sapiens
tctgttggtctgccttctgc

SEQ ID NO: 6440540 - DNA, 23 bp, Homo sapiens
tctgttggtgggcgtgcccctga

SEQ ID NO: 6440541 - DNA, 12 bp, Homo sapiens
tctgttgtaaat

SEQ ID NO: 6440542 - DNA, 14 bp, Homo sapiens
tctgttgtaactta

SEQ ID NO: 6440543 - DNA, 15 bp, Homo sapiens
tctgttgtaacttat

SEQ ID NO: 6440544 - DNA, 19 bp, Homo sapiens
tctgttgtaagtaataatt

SEQ ID NO: 6440545 - DNA, 11 bp, Homo sapiens
tctgttgtaat

SEQ ID NO: 6440546 - DNA, 16 bp, Homo sapiens
tctgttgtaatatcag

SEQ ID NO: 6440547 - DNA, 16 bp, Homo sapiens
tctgttgtattcattg

SEQ ID NO: 6440548 - DNA, 16 bp, Homo sapiens
tctgttgtcaccttca

SEQ ID NO: 6440549 - DNA, 18 bp, Homo sapiens
tctgttgtcattgctgtt

SEQ ID NO: 6440550 - DNA, 19 bp, Homo sapiens
tctgttgtcctccccttgg

SEQ ID NO: 6440551 - DNA, 23 bp, Homo sapiens
tctgttgtgcatgctcaaatgaa

SEQ ID NO: 6440552 - DNA, 23 bp, Homo sapiens
tctgttgtggaaagtagctgcta

SEQ ID NO: 6440553 - DNA, 14 bp, Homo sapiens
tctgttgtgtgtca

SEQ ID NO: 6440554 - DNA, 15 bp, Homo sapiens
tctgttgtgttcgtt

SEQ ID NO: 6440555 - DNA, 13 bp, Homo sapiens
tctgttgttattc

SEQ ID NO: 6440556 - DNA, 13 bp, Homo sapiens
tctgttgttcact

SEQ ID NO: 6440557 - DNA, 17 bp, Homo sapiens
tctgttgttccatttta

SEQ ID NO: 6440558 - DNA, 14 bp, Homo sapiens
tctgttgttctgtg

SEQ ID NO: 6440559 - DNA, 15 bp, Homo sapiens
tctgttgttctgtgg

SEQ ID NO: 6440560 - DNA, 23 bp, Homo sapiens
tctgttgttctgtggtcacagtg

SEQ ID NO: 6440561 - DNA, 22 bp, Homo sapiens
tctgtttaaagcatatagagat

SEQ ID NO: 6440562 - DNA, 14 bp, Homo sapiens
tctgtttaagaaaa

SEQ ID NO: 6440563 - DNA, 20 bp, Homo sapiens
tctgtttaccctccctgtcc

SEQ ID NO: 6440564 - DNA, 24 bp, Homo sapiens
tctgtttaccctccctgtcccctg

SEQ ID NO: 6440565 - DNA, 14 bp, Homo sapiens
tctgtttagaacac

SEQ ID NO: 6440566 - DNA, 16 bp, Homo sapiens
tctgtttagataatac

SEQ ID NO: 6440567 - DNA, 19 bp, Homo sapiens
tctgtttagataatacacc

SEQ ID NO: 6440568 - DNA, 12 bp, Homo sapiens
tctgtttaggaa

SEQ ID NO: 6440569 - DNA, 18 bp, Homo sapiens
tctgtttataatgaagaa

SEQ ID NO: 6440570 - DNA, 23 bp, Homo sapiens
tctgtttatggccacatttaata

SEQ ID NO: 6440571 - DNA, 20 bp, Homo sapiens
tctgtttattaactactgaa

SEQ ID NO: 6440572 - DNA, 20 bp, Homo sapiens
tctgtttattcttccagaat

SEQ ID NO: 6440573 - DNA, 19 bp, Homo sapiens
tctgtttcaaactgaattt

SEQ ID NO: 6440574 - DNA, 17 bp, Homo sapiens
tctgtttccaaatccct

SEQ ID NO: 6440575 - DNA, 14 bp, Homo sapiens
tctgtttcccaagc

SEQ ID NO: 6440576 - DNA, 18 bp, Homo sapiens
tctgtttcctatttaata

SEQ ID NO: 6440577 - DNA, 12 bp, Homo sapiens
tctgtttcctga

SEQ ID NO: 6440578 - DNA, 16 bp, Homo sapiens
tctgtttcctgacatt

SEQ ID NO: 6440579 - DNA, 13 bp, Homo sapiens
tctgtttcctggc

SEQ ID NO: 6440580 - DNA, 15 bp, Homo sapiens
tctgtttcctggcct

SEQ ID NO: 6440581 - DNA, 14 bp, Homo sapiens
tctgtttcctgtgt

SEQ ID NO: 6440582 - DNA, 15 bp, Homo sapiens
tctgtttcctgtgtc

SEQ ID NO: 6440583 - DNA, 21 bp, Homo sapiens
tctgtttcctgtgtctccaag

SEQ ID NO: 6440584 - DNA, 13 bp, Homo sapiens
tctgtttctctgc

SEQ ID NO: 6440585 - DNA, 15 bp, Homo sapiens
tctgtttctctgctg

SEQ ID NO: 6440586 - DNA, 13 bp, Homo sapiens
tctgtttcttctc

SEQ ID NO: 6440587 - DNA, 14 bp, Homo sapiens
tctgtttgaaaaac

SEQ ID NO: 6440588 - DNA, 17 bp, Homo sapiens
tctgtttgaattttcaa

SEQ ID NO: 6440589 - DNA, 15 bp, Homo sapiens
tctgtttgaggagag

SEQ ID NO: 6440590 - DNA, 13 bp, Homo sapiens
tctgtttgattct

SEQ ID NO: 6440591 - DNA, 14 bp, Homo sapiens
tctgtttgattctt

SEQ ID NO: 6440592 - DNA, 16 bp, Homo sapiens
tctgtttgattctttt

SEQ ID NO: 6440593 - DNA, 18 bp, Homo sapiens
tctgtttgccacacccag

SEQ ID NO: 6440594 - DNA, 13 bp, Homo sapiens
tctgtttgctgtg

SEQ ID NO: 6440595 - DNA, 16 bp, Homo sapiens
tctgtttgcttttgaa

SEQ ID NO: 6440596 - DNA, 14 bp, Homo sapiens
tctgtttggcactt

SEQ ID NO: 6440597 - DNA, 12 bp, Homo sapiens
tctgtttgtaaa

SEQ ID NO: 6440598 - DNA, 21 bp, Homo sapiens
tctgtttgtaaattatttgct

SEQ ID NO: 6440599 - DNA, 17 bp, Homo sapiens
tctgtttgtctgaacaa

SEQ ID NO: 6440600 - DNA, 19 bp, Homo sapiens
tctgtttgtctgaacaaag

SEQ ID NO: 6440601 - DNA, 15 bp, Homo sapiens
tctgtttgtgggact

SEQ ID NO: 6440602 - DNA, 13 bp, Homo sapiens
tctgtttgttaaa

SEQ ID NO: 6440603 - DNA, 14 bp, Homo sapiens
tctgtttgttaaaa

SEQ ID NO: 6440604 - DNA, 14 bp, Homo sapiens
tctgttttacaagt

SEQ ID NO: 6440605 - DNA, 18 bp, Homo sapiens
tctgttttagtatgtaaa

SEQ ID NO: 6440606 - DNA, 20 bp, Homo sapiens
tctgttttataattttgtga

SEQ ID NO: 6440607 - DNA, 17 bp, Homo sapiens
tctgttttatgacttca

SEQ ID NO: 6440608 - DNA, 12 bp, Homo sapiens
tctgttttcaat

SEQ ID NO: 6440609 - DNA, 22 bp, Homo sapiens
tctgttttcaatctcgtataga

SEQ ID NO: 6440610 - DNA, 13 bp, Homo sapiens
tctgttttccttt

SEQ ID NO: 6440611 - DNA, 11 bp, Homo sapiens
tctgttttctt

SEQ ID NO: 6440612 - DNA, 16 bp, Homo sapiens
tctgttttgcctgaag

SEQ ID NO: 6440613 - DNA, 18 bp, Homo sapiens
tctgttttggtcccctcc

SEQ ID NO: 6440614 - DNA, 15 bp, Homo sapiens
tctgttttgtaaagt

SEQ ID NO: 6440615 - DNA, 22 bp, Homo sapiens
tctgttttgtaaagtccccaga

SEQ ID NO: 6440616 - DNA, 14 bp, Homo sapiens
tctgttttgtaaat

SEQ ID NO: 6440617 - DNA, 18 bp, Homo sapiens
tctgttttgtaaatgtaa

SEQ ID NO: 6440618 - DNA, 17 bp, Homo sapiens
tctgttttgtatcttaa

SEQ ID NO: 6440619 - DNA, 18 bp, Homo sapiens
tctgttttgtatcttaaa

SEQ ID NO: 6440620 - DNA, 13 bp, Homo sapiens
tctgttttgtgta

SEQ ID NO: 6440621 - DNA, 19 bp, Homo sapiens
tctgttttgtgtactttta

SEQ ID NO: 6440622 - DNA, 19 bp, Homo sapiens
tctgttttgtgtctggtgc

SEQ ID NO: 6440623 - DNA, 15 bp, Homo sapiens
tctgttttgttaata

SEQ ID NO: 6440624 - DNA, 19 bp, Homo sapiens
tctgttttgtttcgctctt

SEQ ID NO: 6440625 - DNA, 19 bp, Homo sapiens
tctgtttttaatgctattt

SEQ ID NO: 6440626 - DNA, 18 bp, Homo sapiens
tctgtttttctaactggg

SEQ ID NO: 6440627 - DNA, 14 bp, Homo sapiens
tctgtttttctcaa

SEQ ID NO: 6440628 - DNA, 17 bp, Homo sapiens
tctgtttttctcaaata

SEQ ID NO: 6440629 - DNA, 18 bp, Homo sapiens
tctgtttttctcaaataa

SEQ ID NO: 6440630 - DNA, 13 bp, Homo sapiens
tctgtttttgtat

SEQ ID NO: 6440631 - DNA, 15 bp, Homo sapiens
tctgtttttgtatct

SEQ ID NO: 6440632 - DNA, 20 bp, Homo sapiens
tctgttttttttttttgtat

SEQ ID NO: 6440633 - DNA, 21 bp, Homo sapiens
tctgttttttttttttgtatt

SEQ ID NO: 6440634 - DNA, 21 bp, Homo sapiens
tcttaaaaaatgtgaaatgct

SEQ ID NO: 6440635 - DNA, 22 bp, Homo sapiens
tcttaaaaaatgtgaaatgctt

SEQ ID NO: 6440636 - DNA, 20 bp, Homo sapiens
tcttaaaaaatttatactta

SEQ ID NO: 6440637 - DNA, 13 bp, Homo sapiens
tcttaaaaacaac

SEQ ID NO: 6440638 - DNA, 22 bp, Homo sapiens
tcttaaaaacaacgaaagaagg

SEQ ID NO: 6440639 - DNA, 17 bp, Homo sapiens
tcttaaaaactgtgtat

SEQ ID NO: 6440640 - DNA, 18 bp, Homo sapiens
tcttaaaaactgtgtatc

SEQ ID NO: 6440641 - DNA, 22 bp, Homo sapiens
tcttaaaaagttataaccaact

SEQ ID NO: 6440642 - DNA, 21 bp, Homo sapiens
tcttaaaaagttgttcaacta

SEQ ID NO: 6440643 - DNA, 13 bp, Homo sapiens
tcttaaaaatctt

SEQ ID NO: 6440644 - DNA, 17 bp, Homo sapiens
tcttaaaaatttataca

SEQ ID NO: 6440645 - DNA, 15 bp, Homo sapiens
tcttaaaacacatga

SEQ ID NO: 6440646 - DNA, 12 bp, Homo sapiens
tcttaaaacact

SEQ ID NO: 6440647 - DNA, 14 bp, Homo sapiens
tcttaaaacactaa

SEQ ID NO: 6440648 - DNA, 12 bp, Homo sapiens
tcttaaaacaga

SEQ ID NO: 6440649 - DNA, 20 bp, Homo sapiens
tcttaaaaccaatcaataat

SEQ ID NO: 6440650 - DNA, 18 bp, Homo sapiens
tcttaaaactataacatt

SEQ ID NO: 6440651 - DNA, 23 bp, Homo sapiens
tcttaaaactataacattatata

SEQ ID NO: 6440652 - DNA, 12 bp, Homo sapiens
tcttaaaactcc

SEQ ID NO: 6440653 - DNA, 12 bp, Homo sapiens
tcttaaaagata

SEQ ID NO: 6440654 - DNA, 14 bp, Homo sapiens
tcttaaaagtactt

SEQ ID NO: 6440655 - DNA, 23 bp, Homo sapiens
tcttaaaagtactttaaaaagga

SEQ ID NO: 6440656 - DNA, 23 bp, Homo sapiens
tcttaaaagttgtgattccagat

SEQ ID NO: 6440657 - DNA, 15 bp, Homo sapiens
tcttaaaagtttcta

SEQ ID NO: 6440658 - DNA, 14 bp, Homo sapiens
tcttaaaataactt

SEQ ID NO: 6440659 - DNA, 15 bp, Homo sapiens
tcttaaaataactta

SEQ ID NO: 6440660 - DNA, 20 bp, Homo sapiens
tcttaaaatatatttcagat

SEQ ID NO: 6440661 - DNA, 20 bp, Homo sapiens
tcttaaaatatcttcctttg

SEQ ID NO: 6440662 - DNA, 22 bp, Homo sapiens
tcttaaaatattgtgtaagaat

SEQ ID NO: 6440663 - DNA, 15 bp, Homo sapiens
tcttaaaatgcaata

SEQ ID NO: 6440664 - DNA, 17 bp, Homo sapiens
tcttaaaatgtttcatt

SEQ ID NO: 6440665 - DNA, 19 bp, Homo sapiens
tcttaaacaatgtataaag

SEQ ID NO: 6440666 - DNA, 21 bp, Homo sapiens
tcttaaacataataaatcaca

SEQ ID NO: 6440667 - DNA, 16 bp, Homo sapiens
tcttaaaccaaccttt

SEQ ID NO: 6440668 - DNA, 14 bp, Homo sapiens
tcttaaactctctt

SEQ ID NO: 6440669 - DNA, 19 bp, Homo sapiens
tcttaaactctcttcttcc

SEQ ID NO: 6440670 - DNA, 20 bp, Homo sapiens
tcttaaactctcttcttcca

SEQ ID NO: 6440671 - DNA, 18 bp, Homo sapiens
tcttaaactcttgaatat

SEQ ID NO: 6440672 - DNA, 22 bp, Homo sapiens
tcttaaactgttcttcattaga

SEQ ID NO: 6440673 - DNA, 22 bp, Homo sapiens
tcttaaagaaacagctttcaag

SEQ ID NO: 6440674 - DNA, 12 bp, Homo sapiens
tcttaaagaatt

SEQ ID NO: 6440675 - DNA, 13 bp, Homo sapiens
tcttaaagaattt

SEQ ID NO: 6440676 - DNA, 17 bp, Homo sapiens
tcttaaagaatttgaaa

SEQ ID NO: 6440677 - DNA, 19 bp, Homo sapiens
tcttaaagaatttgaaagt

SEQ ID NO: 6440678 - DNA, 22 bp, Homo sapiens
tcttaaagaatttgaaagtttc

SEQ ID NO: 6440679 - DNA, 18 bp, Homo sapiens
tcttaaaggaaaagtcaa

SEQ ID NO: 6440680 - DNA, 23 bp, Homo sapiens
tcttaaaggacataaaatttaaa

SEQ ID NO: 6440681 - DNA, 15 bp, Homo sapiens
tcttaaaggcctgga

SEQ ID NO: 6440682 - DNA, 17 bp, Homo sapiens
tcttaaaggcctggaac

SEQ ID NO: 6440683 - DNA, 20 bp, Homo sapiens
tcttaaagggaatcattttt

SEQ ID NO: 6440684 - DNA, 18 bp, Homo sapiens
tcttaaagtattcttctc

SEQ ID NO: 6440685 - DNA, 14 bp, Homo sapiens
tcttaaagttgaat

SEQ ID NO: 6440686 - DNA, 20 bp, Homo sapiens
tcttaaagttgaatttattg

SEQ ID NO: 6440687 - DNA, 18 bp, Homo sapiens
tcttaaataaaaataata

SEQ ID NO: 6440688 - DNA, 19 bp, Homo sapiens
tcttaaataataaagatca

SEQ ID NO: 6440689 - DNA, 22 bp, Homo sapiens
tcttaaataatgcttcagatat

SEQ ID NO: 6440690 - DNA, 13 bp, Homo sapiens
tcttaaatacttt

SEQ ID NO: 6440691 - DNA, 12 bp, Homo sapiens
tcttaaatatat

SEQ ID NO: 6440692 - DNA, 23 bp, Homo sapiens
tcttaaatatatgatttatatta

SEQ ID NO: 6440693 - DNA, 15 bp, Homo sapiens
tcttaaatatctttt

SEQ ID NO: 6440694 - DNA, 15 bp, Homo sapiens
tcttaaatatgaatt

SEQ ID NO: 6440695 - DNA, 15 bp, Homo sapiens
tcttaaatcagaata

SEQ ID NO: 6440696 - DNA, 16 bp, Homo sapiens
tcttaaatcagaataa

SEQ ID NO: 6440697 - DNA, 19 bp, Homo sapiens
tcttaaatcagaataaatt

SEQ ID NO: 6440698 - DNA, 14 bp, Homo sapiens
tcttaaatcagttt

SEQ ID NO: 6440699 - DNA, 18 bp, Homo sapiens
tcttaaatcatttggtta

SEQ ID NO: 6440700 - DNA, 17 bp, Homo sapiens
tcttaaatctaaacaaa

SEQ ID NO: 6440701 - DNA, 14 bp, Homo sapiens
tcttaaatctttct

SEQ ID NO: 6440702 - DNA, 20 bp, Homo sapiens
tcttaaatgaagtgcccact

SEQ ID NO: 6440703 - DNA, 12 bp, Homo sapiens
tcttaaatgaca

SEQ ID NO: 6440704 - DNA, 19 bp, Homo sapiens
tcttaaatgctcataaaga

SEQ ID NO: 6440705 - DNA, 23 bp, Homo sapiens
tcttaaatgctcattttctggtt

SEQ ID NO: 6440706 - DNA, 20 bp, Homo sapiens
tcttaaatgtttatactgta

SEQ ID NO: 6440707 - DNA, 21 bp, Homo sapiens
tcttaaatgtttatactgtat

SEQ ID NO: 6440708 - DNA, 16 bp, Homo sapiens
tcttaaatgttttcat

SEQ ID NO: 6440709 - DNA, 17 bp, Homo sapiens
tcttaaatgttttcatt

SEQ ID NO: 6440710 - DNA, 15 bp, Homo sapiens
tcttaaattttcttc

SEQ ID NO: 6440711 - DNA, 18 bp, Homo sapiens
tcttaaattttgttttct

SEQ ID NO: 6440712 - DNA, 21 bp, Homo sapiens
tcttaacaaaccaacatcttt

SEQ ID NO: 6440713 - DNA, 14 bp, Homo sapiens
tcttaacaacagct

SEQ ID NO: 6440714 - DNA, 21 bp, Homo sapiens
tcttaacaagatatttatatg

SEQ ID NO: 6440715 - DNA, 17 bp, Homo sapiens
tcttaacactgaaattg

SEQ ID NO: 6440716 - DNA, 19 bp, Homo sapiens
tcttaacagtggttcaaat

SEQ ID NO: 6440717 - DNA, 16 bp, Homo sapiens
tcttaaccagatcatt

SEQ ID NO: 6440718 - DNA, 12 bp, Homo sapiens
tcttaaccatct

SEQ ID NO: 6440719 - DNA, 21 bp, Homo sapiens
tcttaacccctaagactgcct

SEQ ID NO: 6440720 - DNA, 24 bp, Homo sapiens
tcttaacccctaagactgccttca

SEQ ID NO: 6440721 - DNA, 23 bp, Homo sapiens
tcttaacctactaatagtttgtt

SEQ ID NO: 6440722 - DNA, 13 bp, Homo sapiens
tcttaacctcagg

SEQ ID NO: 6440723 - DNA, 15 bp, Homo sapiens
tcttaacctcaggga

SEQ ID NO: 6440724 - DNA, 20 bp, Homo sapiens
tcttaacctcttcttaccct

SEQ ID NO: 6440725 - DNA, 16 bp, Homo sapiens
tcttaacctttgctat

SEQ ID NO: 6440726 - DNA, 22 bp, Homo sapiens
tcttaacgttagaccacaaata

SEQ ID NO: 6440727 - DNA, 13 bp, Homo sapiens
tcttaactaatgt

SEQ ID NO: 6440728 - DNA, 14 bp, Homo sapiens
tcttaactaatgta

SEQ ID NO: 6440729 - DNA, 13 bp, Homo sapiens
tcttaactctgca

SEQ ID NO: 6440730 - DNA, 16 bp, Homo sapiens
tcttaactctgcagga

SEQ ID NO: 6440731 - DNA, 12 bp, Homo sapiens
tcttaactcttt

SEQ ID NO: 6440732 - DNA, 13 bp, Homo sapiens
tcttaactgtatt

SEQ ID NO: 6440733 - DNA, 16 bp, Homo sapiens
tcttaactgtatttca

SEQ ID NO: 6440734 - DNA, 17 bp, Homo sapiens
tcttaactgtatttcag

SEQ ID NO: 6440735 - DNA, 23 bp, Homo sapiens
tcttaactgtatttcagtatttt

SEQ ID NO: 6440736 - DNA, 14 bp, Homo sapiens
tcttaactgttgct

SEQ ID NO: 6440737 - DNA, 17 bp, Homo sapiens
tcttaacttaaaagaac

SEQ ID NO: 6440738 - DNA, 19 bp, Homo sapiens
tcttaacttaaaagaacat

SEQ ID NO: 6440739 - DNA, 12 bp, Homo sapiens
tcttaacttctt

SEQ ID NO: 6440740 - DNA, 12 bp, Homo sapiens
tcttaagaatgt

SEQ ID NO: 6440741 - DNA, 12 bp, Homo sapiens
tcttaagacact

SEQ ID NO: 6440742 - DNA, 21 bp, Homo sapiens
tcttaagacagagtcttgctc

SEQ ID NO: 6440743 - DNA, 22 bp, Homo sapiens
tcttaagaccacctcaaattta

SEQ ID NO: 6440744 - DNA, 23 bp, Homo sapiens
tcttaagaccacctcaaatttaa

SEQ ID NO: 6440745 - DNA, 20 bp, Homo sapiens
tcttaagagcttgatctgtg

SEQ ID NO: 6440746 - DNA, 21 bp, Homo sapiens
tcttaagagcttgatctgtga

SEQ ID NO: 6440747 - DNA, 18 bp, Homo sapiens
tcttaagatggaaataca

SEQ ID NO: 6440748 - DNA, 20 bp, Homo sapiens
tcttaagatggaaatacagt

SEQ ID NO: 6440749 - DNA, 16 bp, Homo sapiens
tcttaagattaatttt

SEQ ID NO: 6440750 - DNA, 16 bp, Homo sapiens
tcttaagattctttgt

SEQ ID NO: 6440751 - DNA, 18 bp, Homo sapiens
tcttaagattctttgtga

SEQ ID NO: 6440752 - DNA, 19 bp, Homo sapiens
tcttaagcagagataaata

SEQ ID NO: 6440753 - DNA, 23 bp, Homo sapiens
tcttaagcagagataaataaaag

SEQ ID NO: 6440754 - DNA, 18 bp, Homo sapiens
tcttaagcagcatggaaa

SEQ ID NO: 6440755 - DNA, 21 bp, Homo sapiens
tcttaagcaggtttgttttca

SEQ ID NO: 6440756 - DNA, 20 bp, Homo sapiens
tcttaagccatcttggtaaa

SEQ ID NO: 6440757 - DNA, 23 bp, Homo sapiens
tcttaagccatcttggtaaattt

SEQ ID NO: 6440758 - DNA, 20 bp, Homo sapiens
tcttaagctgcccaatttca

SEQ ID NO: 6440759 - DNA, 22 bp, Homo sapiens
tcttaagctgcccaatttcaca

SEQ ID NO: 6440760 - DNA, 16 bp, Homo sapiens
tcttaaggacaaagtg

SEQ ID NO: 6440761 - DNA, 13 bp, Homo sapiens
tcttaaggagact

SEQ ID NO: 6440762 - DNA, 15 bp, Homo sapiens
tcttaaggagactgg

SEQ ID NO: 6440763 - DNA, 12 bp, Homo sapiens
tcttaagggcac

SEQ ID NO: 6440764 - DNA, 16 bp, Homo sapiens
tcttaaggggcagctt

SEQ ID NO: 6440765 - DNA, 23 bp, Homo sapiens
tcttaagggggccttggaatcta

SEQ ID NO: 6440766 - DNA, 23 bp, Homo sapiens
tcttaaggtgaggcctgtctgtg

SEQ ID NO: 6440767 - DNA, 19 bp, Homo sapiens
tcttaagtaaggacaaaga

SEQ ID NO: 6440768 - DNA, 22 bp, Homo sapiens
tcttaagtaccaatgggaagca

SEQ ID NO: 6440769 - DNA, 22 bp, Homo sapiens
aagaatattcagagaatatcaa

SEQ ID NO: 6440770 - DNA, 12 bp, Homo sapiens
aagaatattgca

SEQ ID NO: 6440771 - DNA, 21 bp, Homo sapiens
aagaatattgcccaaataata

SEQ ID NO: 6440772 - DNA, 21 bp, Homo sapiens
aagaatattgttcctaagttc

SEQ ID NO: 6440773 - DNA, 17 bp, Homo sapiens
aagaatatttaagaaaa

SEQ ID NO: 6440774 - DNA, 23 bp, Homo sapiens
aagaatatttaagaaaagcactt

SEQ ID NO: 6440775 - DNA, 15 bp, Homo sapiens
aagaatatttgaatg

SEQ ID NO: 6440776 - DNA, 13 bp, Homo sapiens
aagaatattttga

SEQ ID NO: 6440777 - DNA, 15 bp, Homo sapiens
aagaatattttgatg

SEQ ID NO: 6440778 - DNA, 18 bp, Homo sapiens
aagaatatttttagacta

SEQ ID NO: 6440779 - DNA, 22 bp, Homo sapiens
aagaatcaacagccaaactgct

SEQ ID NO: 6440780 - DNA, 18 bp, Homo sapiens
aagaatcagacagcagga

SEQ ID NO: 6440781 - DNA, 20 bp, Homo sapiens
aagaatcagtaggaccaggc

SEQ ID NO: 6440782 - DNA, 22 bp, Homo sapiens
aagaatcagtaggaccaggcca

SEQ ID NO: 6440783 - DNA, 23 bp, Homo sapiens
aagaatcagtctatccacagaga

SEQ ID NO: 6440784 - DNA, 22 bp, Homo sapiens
aagaatcatcctcatgccttta

SEQ ID NO: 6440785 - DNA, 14 bp, Homo sapiens
aagaatcatggatt

SEQ ID NO: 6440786 - DNA, 16 bp, Homo sapiens
aagaatcatggattta

SEQ ID NO: 6440787 - DNA, 15 bp, Homo sapiens
aagaatccacaagga

SEQ ID NO: 6440788 - DNA, 17 bp, Homo sapiens
aagaatccacatttcta

SEQ ID NO: 6440789 - DNA, 18 bp, Homo sapiens
aagaatccacatttctaa

SEQ ID NO: 6440790 - DNA, 13 bp, Homo sapiens
aagaatccatctg

SEQ ID NO: 6440791 - DNA, 23 bp, Homo sapiens
aagaatccctagactttaggctt

SEQ ID NO: 6440792 - DNA, 20 bp, Homo sapiens
aagaatccttagatgcctaa

SEQ ID NO: 6440793 - DNA, 23 bp, Homo sapiens
aagaatccttatctataaaaggt

SEQ ID NO: 6440794 - DNA, 20 bp, Homo sapiens
aagaatcggcagtattttct

SEQ ID NO: 6440795 - DNA, 19 bp, Homo sapiens
aagaatcggcatgtatact

SEQ ID NO: 6440796 - DNA, 21 bp, Homo sapiens
aagaatcggcatgtatactta

SEQ ID NO: 6440797 - DNA, 15 bp, Homo sapiens
aagaatctaatgaat

SEQ ID NO: 6440798 - DNA, 18 bp, Homo sapiens
aagaatctagaagatgtg

SEQ ID NO: 6440799 - DNA, 19 bp, Homo sapiens
aagaatctagaagatgtgt

SEQ ID NO: 6440800 - DNA, 12 bp, Homo sapiens
aagaatctcatc

SEQ ID NO: 6440801 - DNA, 14 bp, Homo sapiens
aagaatcttagata

SEQ ID NO: 6440802 - DNA, 15 bp, Homo sapiens
aagaatctttagaga

SEQ ID NO: 6440803 - DNA, 13 bp, Homo sapiens
aagaatgaaaaat

SEQ ID NO: 6440804 - DNA, 14 bp, Homo sapiens
aagaatgaaaaata

SEQ ID NO: 6440805 - DNA, 18 bp, Homo sapiens
aagaatgaaggtttttgt

SEQ ID NO: 6440806 - DNA, 12 bp, Homo sapiens
aagaatgaatat

SEQ ID NO: 6440807 - DNA, 22 bp, Homo sapiens
aagaatgagcctacgctgaaga

SEQ ID NO: 6440808 - DNA, 18 bp, Homo sapiens
aagaatgagtgaagtatt

SEQ ID NO: 6440809 - DNA, 23 bp, Homo sapiens
aagaatgagtgaagtattgctga

SEQ ID NO: 6440810 - DNA, 21 bp, Homo sapiens
aagaatgagtttcttagactt

SEQ ID NO: 6440811 - DNA, 16 bp, Homo sapiens
aagaatgcaagagtgg

SEQ ID NO: 6440812 - DNA, 18 bp, Homo sapiens
aagaatgcacaagaatgg

SEQ ID NO: 6440813 - DNA, 19 bp, Homo sapiens
aagaatgcacaagaatgga

SEQ ID NO: 6440814 - DNA, 20 bp, Homo sapiens
aagaatgcacaagaatggat

SEQ ID NO: 6440815 - DNA, 21 bp, Homo sapiens
aagaatgcacaagaatggatc

SEQ ID NO: 6440816 - DNA, 13 bp, Homo sapiens
aagaatgcagaga

SEQ ID NO: 6440817 - DNA, 14 bp, Homo sapiens
aagaatgcagagat

SEQ ID NO: 6440818 - DNA, 21 bp, Homo sapiens
aagaatgcagattcctgggcc

SEQ ID NO: 6440819 - DNA, 22 bp, Homo sapiens
aagaatgcagattcctgggcct

SEQ ID NO: 6440820 - DNA, 24 bp, Homo sapiens
aagaatgcagtactaacatttatt

SEQ ID NO: 6440821 - DNA, 14 bp, Homo sapiens
aagaatgcattcaa

SEQ ID NO: 6440822 - DNA, 15 bp, Homo sapiens
aagaatgcattcaaa

SEQ ID NO: 6440823 - DNA, 21 bp, Homo sapiens
aagaatgcattgatattgtga

SEQ ID NO: 6440824 - DNA, 23 bp, Homo sapiens
aagaatgcattgatattgtgaac

SEQ ID NO: 6440825 - DNA, 17 bp, Homo sapiens
aagaatgccatttctca

SEQ ID NO: 6440826 - DNA, 14 bp, Homo sapiens
aagaatgctgaaac

SEQ ID NO: 6440827 - DNA, 15 bp, Homo sapiens
aagaatgctggtttt

SEQ ID NO: 6440828 - DNA, 15 bp, Homo sapiens
aagaatggagaggaa

SEQ ID NO: 6440829 - DNA, 13 bp, Homo sapiens
aagaatggccaac

SEQ ID NO: 6440830 - DNA, 20 bp, Homo sapiens
aagaatgggcagttacatgc

SEQ ID NO: 6440831 - DNA, 22 bp, Homo sapiens
aagaatggtccgtgctaaggac

SEQ ID NO: 6440832 - DNA, 17 bp, Homo sapiens
aagaatggtctcagtgt

SEQ ID NO: 6440833 - DNA, 19 bp, Homo sapiens
aagaatggtggcttctttt

SEQ ID NO: 6440834 - DNA, 14 bp, Homo sapiens
aagaatggtgtgtt

SEQ ID NO: 6440835 - DNA, 18 bp, Homo sapiens
aagaatggtgtgtttccc

SEQ ID NO: 6440836 - DNA, 15 bp, Homo sapiens
aagaatgtacagaaa

SEQ ID NO: 6440837 - DNA, 19 bp, Homo sapiens
aagaatgtctgtaccttga

SEQ ID NO: 6440838 - DNA, 22 bp, Homo sapiens
aagaatgtgctagagttaaaag

SEQ ID NO: 6440839 - DNA, 23 bp, Homo sapiens
aagaatgtgctagagttaaaagt

SEQ ID NO: 6440840 - DNA, 16 bp, Homo sapiens
aagaatgtgtttcaaa

SEQ ID NO: 6440841 - DNA, 19 bp, Homo sapiens
aagaatgttaagacttgac

SEQ ID NO: 6440842 - DNA, 19 bp, Homo sapiens
aagaatgttactgccttaa

SEQ ID NO: 6440843 - DNA, 20 bp, Homo sapiens
aagaatgttactgccttaat

SEQ ID NO: 6440844 - DNA, 12 bp, Homo sapiens
aagaatgttagt

SEQ ID NO: 6440845 - DNA, 14 bp, Homo sapiens
aagaatgtttcagt

SEQ ID NO: 6440846 - DNA, 12 bp, Homo sapiens
aagaattaaaac

SEQ ID NO: 6440847 - DNA, 15 bp, Homo sapiens
aagaattaaaactga

SEQ ID NO: 6440848 - DNA, 20 bp, Homo sapiens
aagaattaaacccacaagct

SEQ ID NO: 6440849 - DNA, 22 bp, Homo sapiens
aagaattaaacccacaagctgc

SEQ ID NO: 6440850 - DNA, 19 bp, Homo sapiens
aagaattacaatttcttta

SEQ ID NO: 6440851 - DNA, 20 bp, Homo sapiens
aagaattacaatttctttaa

SEQ ID NO: 6440852 - DNA, 20 bp, Homo sapiens
aagaattaccaagagaaggg

SEQ ID NO: 6440853 - DNA, 21 bp, Homo sapiens
aagaattattcagtgaatttg

SEQ ID NO: 6440854 - DNA, 11 bp, Homo sapiens
aagaattattt

SEQ ID NO: 6440855 - DNA, 20 bp, Homo sapiens
aagaattatttgccttctga

SEQ ID NO: 6440856 - DNA, 14 bp, Homo sapiens
aagaattattttgt

SEQ ID NO: 6440857 - DNA, 14 bp, Homo sapiens
aagaattatttttg

SEQ ID NO: 6440858 - DNA, 17 bp, Homo sapiens
aagaattcaaatttgta

SEQ ID NO: 6440859 - DNA, 11 bp, Homo sapiens
aagaattcagt

SEQ ID NO: 6440860 - DNA, 23 bp, Homo sapiens
aagaattcatgatgctagttctt

SEQ ID NO: 6440861 - DNA, 16 bp, Homo sapiens
aagaattccaaagcaa

SEQ ID NO: 6440862 - DNA, 17 bp, Homo sapiens
aagaattcctacaatat

SEQ ID NO: 6440863 - DNA, 20 bp, Homo sapiens
aagaattctattttgctgga

SEQ ID NO: 6440864 - DNA, 18 bp, Homo sapiens
aagaattcttaacatagc

SEQ ID NO: 6440865 - DNA, 18 bp, Homo sapiens
aagaattgaaaagttttt

SEQ ID NO: 6440866 - DNA, 14 bp, Homo sapiens
aagaattgaaacca

SEQ ID NO: 6440867 - DNA, 21 bp, Homo sapiens
aagaattgaattggaaagact

SEQ ID NO: 6440868 - DNA, 20 bp, Homo sapiens
aagaattgaccatctgcttt

SEQ ID NO: 6440869 - DNA, 16 bp, Homo sapiens
aagaattgactgattt

SEQ ID NO: 6440870 - DNA, 15 bp, Homo sapiens
aagaattgagtaatg

SEQ ID NO: 6440871 - DNA, 14 bp, Homo sapiens
aagaattgagtatc

SEQ ID NO: 6440872 - DNA, 23 bp, Homo sapiens
aagaattgccaatcttgttttaa

SEQ ID NO: 6440873 - DNA, 17 bp, Homo sapiens
aagaattgccagtcttt

SEQ ID NO: 6440874 - DNA, 22 bp, Homo sapiens
aagaattgctaaatataaaaac

SEQ ID NO: 6440875 - DNA, 20 bp, Homo sapiens
aagaattgtggtttatatat

SEQ ID NO: 6440876 - DNA, 22 bp, Homo sapiens
aagaattgttagcaaatgacag

SEQ ID NO: 6440877 - DNA, 22 bp, Homo sapiens
aagaattgttgggggttttttt

SEQ ID NO: 6440878 - DNA, 22 bp, Homo sapiens
aagaatttaaattctttttcaa

SEQ ID NO: 6440879 - DNA, 17 bp, Homo sapiens
aagaatttaatggactg

SEQ ID NO: 6440880 - DNA, 20 bp, Homo sapiens
aagaatttaatgtacagtaa

SEQ ID NO: 6440881 - DNA, 20 bp, Homo sapiens
aagaatttaccagaaatatt

SEQ ID NO: 6440882 - DNA, 15 bp, Homo sapiens
aagaatttagaggat

SEQ ID NO: 6440883 - DNA, 16 bp, Homo sapiens
aagaatttagtattat

SEQ ID NO: 6440884 - DNA, 22 bp, Homo sapiens
aagaatttcttggtaagaagcc

SEQ ID NO: 6440885 - DNA, 21 bp, Homo sapiens
aagaatttgaaagtttcctta

SEQ ID NO: 6440886 - DNA, 22 bp, Homo sapiens
aagaatttgagaagaaatactc

SEQ ID NO: 6440887 - DNA, 20 bp, Homo sapiens
aagaatttgaggtctacatt

SEQ ID NO: 6440888 - DNA, 15 bp, Homo sapiens
aagaatttgtttaaa

SEQ ID NO: 6440889 - DNA, 14 bp, Homo sapiens
aagaattttaaaaa

SEQ ID NO: 6440890 - DNA, 15 bp, Homo sapiens
aagaattttaaaaat

SEQ ID NO: 6440891 - DNA, 20 bp, Homo sapiens
aagaattttatttttctgtg

SEQ ID NO: 6440892 - DNA, 19 bp, Homo sapiens
aagaattttgagtgaatta

SEQ ID NO: 6440893 - DNA, 19 bp, Homo sapiens
aagaattttgttttacttt

SEQ ID NO: 6440894 - DNA, 13 bp, Homo sapiens
aagaatttttaaa

SEQ ID NO: 6440895 - DNA, 12 bp, Homo sapiens
aagaatttttgc

SEQ ID NO: 6440896 - DNA, 14 bp, Homo sapiens
aagaatttttttgt

SEQ ID NO: 6440897 - DNA, 18 bp, Homo sapiens
aagaattttttttttaag

SEQ ID NO: 6440898 - DNA, 17 bp, Homo sapiens
aagacaaaaagccttga

SEQ ID NO: 6440899 - DNA, 20 bp, Homo sapiens
aagacaaaaagccttgaaga

SEQ ID NO: 6440900 - DNA, 21 bp, Homo sapiens
aagacaaaaagccttgaagaa

SEQ ID NO: 6440901 - DNA, 16 bp, Homo sapiens
aagacaaaaataatag

SEQ ID NO: 6440902 - DNA, 18 bp, Homo sapiens
aagacaaaaatactctaa

SEQ ID NO: 6440903 - DNA, 21 bp, Homo sapiens
aagacaaaacatacattttgt

SEQ ID NO: 6440904 - DNA, 18 bp, Homo sapiens
aagacaaaacgagtcttt

SEQ ID NO: 6440905 - DNA, 16 bp, Homo sapiens
aagacaaaagaaactt

SEQ ID NO: 6440906 - DNA, 17 bp, Homo sapiens
aagacaaaagaaactta

SEQ ID NO: 6440907 - DNA, 14 bp, Homo sapiens
aagacaaaatgtga

SEQ ID NO: 6440908 - DNA, 13 bp, Homo sapiens
aagacaaaattta

SEQ ID NO: 6440909 - DNA, 17 bp, Homo sapiens
aagacaaaatttaattg

SEQ ID NO: 6440910 - DNA, 19 bp, Homo sapiens
aagacaaaatttagattta

SEQ ID NO: 6440911 - DNA, 16 bp, Homo sapiens
aagacaaacactgcca

SEQ ID NO: 6440912 - DNA, 19 bp, Homo sapiens
aagacaaacactgccatat

SEQ ID NO: 6440913 - DNA, 15 bp, Homo sapiens
aagacaaaggcccaa

SEQ ID NO: 6440914 - DNA, 20 bp, Homo sapiens
aagacaaagtgtgtaattat

SEQ ID NO: 6440915 - DNA, 17 bp, Homo sapiens
aagacaaataaatgatt

SEQ ID NO: 6440916 - DNA, 14 bp, Homo sapiens
aagacaaatacaca

SEQ ID NO: 6440917 - DNA, 18 bp, Homo sapiens
aagacaaatacacataca

SEQ ID NO: 6440918 - DNA, 13 bp, Homo sapiens
aagacaaatagta

SEQ ID NO: 6440919 - DNA, 13 bp, Homo sapiens
aagacaaatattc

SEQ ID NO: 6440920 - DNA, 20 bp, Homo sapiens
aagacaaatattcctttgca

SEQ ID NO: 6440921 - DNA, 17 bp, Homo sapiens
aagacaaatcaaagcag

SEQ ID NO: 6440922 - DNA, 22 bp, Homo sapiens
aagacaaatgacagattctgac

SEQ ID NO: 6440923 - DNA, 16 bp, Homo sapiens
aagacaaattctgttt

SEQ ID NO: 6440924 - DNA, 18 bp, Homo sapiens
aagacaaattttgcatat

SEQ ID NO: 6440925 - DNA, 14 bp, Homo sapiens
aagacaacaggcat

SEQ ID NO: 6440926 - DNA, 12 bp, Homo sapiens
aagacaacatta

SEQ ID NO: 6440927 - DNA, 15 bp, Homo sapiens
aagacaacattaaaa

SEQ ID NO: 6440928 - DNA, 17 bp, Homo sapiens
aagacaaccatatttag

SEQ ID NO: 6440929 - DNA, 14 bp, Homo sapiens
aagacaagaaaatc

SEQ ID NO: 6440930 - DNA, 15 bp, Homo sapiens
aagacaagacttcag

SEQ ID NO: 6440931 - DNA, 21 bp, Homo sapiens
aagacaagcattgggtcagac

SEQ ID NO: 6440932 - DNA, 19 bp, Homo sapiens
aagacaagtacataaaggt

SEQ ID NO: 6440933 - DNA, 16 bp, Homo sapiens
aagacaagtatgaata

SEQ ID NO: 6440934 - DNA, 16 bp, Homo sapiens
aagacaatccatgtaa

SEQ ID NO: 6440935 - DNA, 15 bp, Homo sapiens
aagacaatgacatac

SEQ ID NO: 6440936 - DNA, 11 bp, Homo sapiens
aagacaattct

SEQ ID NO: 6440937 - DNA, 12 bp, Homo sapiens
aagacaattctt

SEQ ID NO: 6440938 - DNA, 19 bp, Homo sapiens
aagacaattctttatacaa

SEQ ID NO: 6440939 - DNA, 22 bp, Homo sapiens
aagacacaaggtgatttcagac

SEQ ID NO: 6440940 - DNA, 15 bp, Homo sapiens
aagacacacagcctt

SEQ ID NO: 6440941 - DNA, 16 bp, Homo sapiens
aagacacacagccttt

SEQ ID NO: 6440942 - DNA, 18 bp, Homo sapiens
aagacacacagcctttct

SEQ ID NO: 6440943 - DNA, 19 bp, Homo sapiens
aagacacacagcctttctg

SEQ ID NO: 6440944 - DNA, 20 bp, Homo sapiens
aagacacacagcctttctgt

SEQ ID NO: 6440945 - DNA, 21 bp, Homo sapiens
aagacacactccccacttcac

SEQ ID NO: 6440946 - DNA, 16 bp, Homo sapiens
aagacacagcccagac

SEQ ID NO: 6440947 - DNA, 21 bp, Homo sapiens
tcatgtggcattctctctgct

SEQ ID NO: 6440948 - DNA, 17 bp, Homo sapiens
tcatgtggcctaatatt

SEQ ID NO: 6440949 - DNA, 16 bp, Homo sapiens
tcatgtggcttttaat

SEQ ID NO: 6440950 - DNA, 22 bp, Homo sapiens
tcatgtgggccacacaagtgca

SEQ ID NO: 6440951 - DNA, 20 bp, Homo sapiens
tcatgtggtgaatatgcaag

SEQ ID NO: 6440952 - DNA, 21 bp, Homo sapiens
tcatgtgtaatcaataaacga

SEQ ID NO: 6440953 - DNA, 22 bp, Homo sapiens
tcatgtgtaatcaataaacgat

SEQ ID NO: 6440954 - DNA, 23 bp, Homo sapiens
tcatgtgtaatcaataaacgatt

SEQ ID NO: 6440955 - DNA, 18 bp, Homo sapiens
tcatgtgtacagaaacaa

SEQ ID NO: 6440956 - DNA, 23 bp, Homo sapiens
tcatgtgtagatattatgtatag

SEQ ID NO: 6440957 - DNA, 10 bp, Homo sapiens
tcatgtgtat

SEQ ID NO: 6440958 - DNA, 14 bp, Homo sapiens
tcatgtgtataaaa

SEQ ID NO: 6440959 - DNA, 12 bp, Homo sapiens
tcatgtgtatga

SEQ ID NO: 6440960 - DNA, 19 bp, Homo sapiens
tcatgtgtatgagaagtac

SEQ ID NO: 6440961 - DNA, 15 bp, Homo sapiens
tcatgtgtcagctgt

SEQ ID NO: 6440962 - DNA, 15 bp, Homo sapiens
tcatgtgtctgttta

SEQ ID NO: 6440963 - DNA, 20 bp, Homo sapiens
tcatgtgtgcaacagggtat

SEQ ID NO: 6440964 - DNA, 13 bp, Homo sapiens
tcatgtgtgctca

SEQ ID NO: 6440965 - DNA, 12 bp, Homo sapiens
tcatgtgtgtag

SEQ ID NO: 6440966 - DNA, 19 bp, Homo sapiens
tcatgtgtgtattttttca

SEQ ID NO: 6440967 - DNA, 12 bp, Homo sapiens
tcatgtgtgtcc

SEQ ID NO: 6440968 - DNA, 14 bp, Homo sapiens
tcatgtgttccctt

SEQ ID NO: 6440969 - DNA, 22 bp, Homo sapiens
tcatgttaaataggcggggctt

SEQ ID NO: 6440970 - DNA, 16 bp, Homo sapiens
tcatgttaaattagaa

SEQ ID NO: 6440971 - DNA, 22 bp, Homo sapiens
tcatgttaaattagaatgaatt

SEQ ID NO: 6440972 - DNA, 18 bp, Homo sapiens
tcatgttaatcctagctg

SEQ ID NO: 6440973 - DNA, 21 bp, Homo sapiens
tcatgttaatcctagctgtgt

SEQ ID NO: 6440974 - DNA, 21 bp, Homo sapiens
tcatgttactaaatggtgtta

SEQ ID NO: 6440975 - DNA, 17 bp, Homo sapiens
tcatgttagtaatacct

SEQ ID NO: 6440976 - DNA, 15 bp, Homo sapiens
tcatgttataaagca

SEQ ID NO: 6440977 - DNA, 20 bp, Homo sapiens
tcatgttatgcagtgaacta

SEQ ID NO: 6440978 - DNA, 23 bp, Homo sapiens
tcatgttatgcagtgaactattt

SEQ ID NO: 6440979 - DNA, 16 bp, Homo sapiens
tcatgttcatgtgatt

SEQ ID NO: 6440980 - DNA, 13 bp, Homo sapiens
tcatgttccaaat

SEQ ID NO: 6440981 - DNA, 22 bp, Homo sapiens
tcatgttcccacttcaaaacaa

SEQ ID NO: 6440982 - DNA, 23 bp, Homo sapiens
tcatgttcccacttcaaaacaaa

SEQ ID NO: 6440983 - DNA, 21 bp, Homo sapiens
tcatgttcgagcttacctact

SEQ ID NO: 6440984 - DNA, 10 bp, Homo sapiens
tcatgttctc

SEQ ID NO: 6440985 - DNA, 16 bp, Homo sapiens
tcatgttctcatgttt

SEQ ID NO: 6440986 - DNA, 17 bp, Homo sapiens
tcatgttctcttcccag

SEQ ID NO: 6440987 - DNA, 18 bp, Homo sapiens
tcatgttctcttcccagg

SEQ ID NO: 6440988 - DNA, 21 bp, Homo sapiens
tcatgttctgagctataacat

SEQ ID NO: 6440989 - DNA, 15 bp, Homo sapiens
tcatgttctgtgaca

SEQ ID NO: 6440990 - DNA, 13 bp, Homo sapiens
tcatgttctgtgg

SEQ ID NO: 6440991 - DNA, 17 bp, Homo sapiens
tcatgttgaagccactg

SEQ ID NO: 6440992 - DNA, 20 bp, Homo sapiens
tcatgttgaagctttaagaa

SEQ ID NO: 6440993 - DNA, 17 bp, Homo sapiens
tcatgttgaccaggctg

SEQ ID NO: 6440994 - DNA, 19 bp, Homo sapiens
tcatgttgatcatgtactt

SEQ ID NO: 6440995 - DNA, 19 bp, Homo sapiens
tcatgttgttgtgtgtata

SEQ ID NO: 6440996 - DNA, 21 bp, Homo sapiens
tcatgttgttgtgtgtatatg

SEQ ID NO: 6440997 - DNA, 14 bp, Homo sapiens
tcatgtttaacgtt

SEQ ID NO: 6440998 - DNA, 22 bp, Homo sapiens
tcatgtttaacgtttctcatta

SEQ ID NO: 6440999 - DNA, 23 bp, Homo sapiens
tcatgtttaagaaatgagaaatt

SEQ ID NO: 6441000 - DNA, 16 bp, Homo sapiens
tcatgtttaagaaatt

SEQ ID NO: 6441001 - DNA, 18 bp, Homo sapiens
tcatgtttaatttgcatc

SEQ ID NO: 6441002 - DNA, 23 bp, Homo sapiens
tcatgtttataactattcagttg

SEQ ID NO: 6441003 - DNA, 22 bp, Homo sapiens
tcatgtttatgaaaataaatag

SEQ ID NO: 6441004 - DNA, 14 bp, Homo sapiens
tcatgtttctgcag

SEQ ID NO: 6441005 - DNA, 15 bp, Homo sapiens
tcatgtttctgcagt

SEQ ID NO: 6441006 - DNA, 23 bp, Homo sapiens
tcatgtttctgcagtattctgta

SEQ ID NO: 6441007 - DNA, 12 bp, Homo sapiens
tcatgtttcttt

SEQ ID NO: 6441008 - DNA, 15 bp, Homo sapiens
tcatgtttctttgat

SEQ ID NO: 6441009 - DNA, 21 bp, Homo sapiens
tcatgtttctttgatcatgaa

SEQ ID NO: 6441010 - DNA, 17 bp, Homo sapiens
tcatgtttgcttcataa

SEQ ID NO: 6441011 - DNA, 21 bp, Homo sapiens
tcatgtttgcttcataaatga

SEQ ID NO: 6441012 - DNA, 22 bp, Homo sapiens
tcatgtttggtggggccatcca

SEQ ID NO: 6441013 - DNA, 13 bp, Homo sapiens
tcatgtttgtaaa

SEQ ID NO: 6441014 - DNA, 15 bp, Homo sapiens
tcatgtttgtgcatg

SEQ ID NO: 6441015 - DNA, 13 bp, Homo sapiens
tcatgttttaaca

SEQ ID NO: 6441016 - DNA, 14 bp, Homo sapiens
tcatgttttaacaa

SEQ ID NO: 6441017 - DNA, 14 bp, Homo sapiens
tcatgttttaactt

SEQ ID NO: 6441018 - DNA, 15 bp, Homo sapiens
tcatgttttataatt

SEQ ID NO: 6441019 - DNA, 15 bp, Homo sapiens
tcatgttttatatga

SEQ ID NO: 6441020 - DNA, 22 bp, Homo sapiens
tcatgttttccattgtttgaaa

SEQ ID NO: 6441021 - DNA, 23 bp, Homo sapiens
tcatgttttgagacataaatgtt

SEQ ID NO: 6441022 - DNA, 16 bp, Homo sapiens
tcatgttttgatgaga

SEQ ID NO: 6441023 - DNA, 14 bp, Homo sapiens
tcatgttttgtgac

SEQ ID NO: 6441024 - DNA, 16 bp, Homo sapiens
tcatgttttgtgacta

SEQ ID NO: 6441025 - DNA, 17 bp, Homo sapiens
tcatgttttgtgactat

SEQ ID NO: 6441026 - DNA, 15 bp, Homo sapiens
tcatgtttttaactt

SEQ ID NO: 6441027 - DNA, 15 bp, Homo sapiens
tcatgtttttgatca

SEQ ID NO: 6441028 - DNA, 16 bp, Homo sapiens
tcatgttttttctgca

SEQ ID NO: 6441029 - DNA, 20 bp, Homo sapiens
tcattaaaaacatagaaaaa

SEQ ID NO: 6441030 - DNA, 22 bp, Homo sapiens
tcattaaaaacatagaaaaatg

SEQ ID NO: 6441031 - DNA, 13 bp, Homo sapiens
tcattaaaaatta

SEQ ID NO: 6441032 - DNA, 16 bp, Homo sapiens
tcattaaaaattacct

SEQ ID NO: 6441033 - DNA, 12 bp, Homo sapiens
tcattaaaacaa

SEQ ID NO: 6441034 - DNA, 13 bp, Homo sapiens
tcattaaaacaag

SEQ ID NO: 6441035 - DNA, 22 bp, Homo sapiens
tcattaaaacaagagaccactt

SEQ ID NO: 6441036 - DNA, 22 bp, Homo sapiens
tcattaaaaggaaaaaagaaaa

SEQ ID NO: 6441037 - DNA, 21 bp, Homo sapiens
tcattaaaataaataaatgca

SEQ ID NO: 6441038 - DNA, 21 bp, Homo sapiens
tcattaaaatagattatccca

SEQ ID NO: 6441039 - DNA, 22 bp, Homo sapiens
tcattaaaatagattatcccac

SEQ ID NO: 6441040 - DNA, 14 bp, Homo sapiens
tcattaaaatatat

SEQ ID NO: 6441041 - DNA, 15 bp, Homo sapiens
tcattaaaatccagt

SEQ ID NO: 6441042 - DNA, 16 bp, Homo sapiens
tcattaaaatccagta

SEQ ID NO: 6441043 - DNA, 12 bp, Homo sapiens
tcattaaaattg

SEQ ID NO: 6441044 - DNA, 15 bp, Homo sapiens
tcattaaacaaataa

SEQ ID NO: 6441045 - DNA, 22 bp, Homo sapiens
tcattaaacatgaatttaatgt

SEQ ID NO: 6441046 - DNA, 14 bp, Homo sapiens
tcattaaacgtcat

SEQ ID NO: 6441047 - DNA, 23 bp, Homo sapiens
tcattaaactaattaaactgatg

SEQ ID NO: 6441048 - DNA, 17 bp, Homo sapiens
tcattaaactcatattt

SEQ ID NO: 6441049 - DNA, 19 bp, Homo sapiens
tcattaaactctaaagatt

SEQ ID NO: 6441050 - DNA, 17 bp, Homo sapiens
tcattaaactgattcca

SEQ ID NO: 6441051 - DNA, 16 bp, Homo sapiens
tcattaaacttgaagc

SEQ ID NO: 6441052 - DNA, 17 bp, Homo sapiens
tcattaaacttttttaa

SEQ ID NO: 6441053 - DNA, 14 bp, Homo sapiens
tcattaaagaaaaa

SEQ ID NO: 6441054 - DNA, 13 bp, Homo sapiens
tcattaaagtgca

SEQ ID NO: 6441055 - DNA, 12 bp, Homo sapiens
tcattaaataaa

SEQ ID NO: 6441056 - DNA, 14 bp, Homo sapiens
tcattaaataaatt

SEQ ID NO: 6441057 - DNA, 19 bp, Homo sapiens
tcattaaataaatttgact

SEQ ID NO: 6441058 - DNA, 17 bp, Homo sapiens
tcattaaatattctgta

SEQ ID NO: 6441059 - DNA, 23 bp, Homo sapiens
tcattaaatggtgatttcttgct

SEQ ID NO: 6441060 - DNA, 24 bp, Homo sapiens
tcattaaatggtgatttcttgcta

SEQ ID NO: 6441061 - DNA, 16 bp, Homo sapiens
tcattaaatgtttgtt

SEQ ID NO: 6441062 - DNA, 22 bp, Homo sapiens
tcattaaatgtttgttgaataa

SEQ ID NO: 6441063 - DNA, 14 bp, Homo sapiens
tcattaaattacct

SEQ ID NO: 6441064 - DNA, 15 bp, Homo sapiens
tcattaaattactat

SEQ ID NO: 6441065 - DNA, 20 bp, Homo sapiens
tcattaaccatctttaatca

SEQ ID NO: 6441066 - DNA, 21 bp, Homo sapiens
tcattaaccatctttaatcaa

SEQ ID NO: 6441067 - DNA, 23 bp, Homo sapiens
tcattaaccgatgctttaccaaa

SEQ ID NO: 6441068 - DNA, 16 bp, Homo sapiens
tcattaactcaaattc

SEQ ID NO: 6441069 - DNA, 18 bp, Homo sapiens
tcattaactcaaattcaa

SEQ ID NO: 6441070 - DNA, 22 bp, Homo sapiens
tcattaagccctcttccatcat

SEQ ID NO: 6441071 - DNA, 21 bp, Homo sapiens
tcattaagcgggatcccagca

SEQ ID NO: 6441072 - DNA, 22 bp, Homo sapiens
tcattaagctttttttttttga

SEQ ID NO: 6441073 - DNA, 22 bp, Homo sapiens
tcattaaggttatgcactgcct

SEQ ID NO: 6441074 - DNA, 14 bp, Homo sapiens
tcattaataaaata

SEQ ID NO: 6441075 - DNA, 22 bp, Homo sapiens
tcattaatagctgccttcaagg

SEQ ID NO: 6441076 - DNA, 23 bp, Homo sapiens
tcattaataggaaagatttaatg

SEQ ID NO: 6441077 - DNA, 18 bp, Homo sapiens
tcattaatctgcctccct

SEQ ID NO: 6441078 - DNA, 13 bp, Homo sapiens
tcattaatgacac

SEQ ID NO: 6441079 - DNA, 22 bp, Homo sapiens
tcattaatgacacttgtcccca

SEQ ID NO: 6441080 - DNA, 15 bp, Homo sapiens
tcattaatgacttta

SEQ ID NO: 6441081 - DNA, 15 bp, Homo sapiens
tcattaatgttcttt

SEQ ID NO: 6441082 - DNA, 19 bp, Homo sapiens
tcattacaattttctgtaa

SEQ ID NO: 6441083 - DNA, 15 bp, Homo sapiens
tcattacagttcttt

SEQ ID NO: 6441084 - DNA, 15 bp, Homo sapiens
tcattacatagaaca

SEQ ID NO: 6441085 - DNA, 13 bp, Homo sapiens
tcattaccacagg

SEQ ID NO: 6441086 - DNA, 17 bp, Homo sapiens
tcattaccagtgactaa

SEQ ID NO: 6441087 - DNA, 23 bp, Homo sapiens
tcattacccacccgacctggctg

SEQ ID NO: 6441088 - DNA, 16 bp, Homo sapiens
tcattaccctacagac

SEQ ID NO: 6441089 - DNA, 19 bp, Homo sapiens
tcattacccttccctgcac

SEQ ID NO: 6441090 - DNA, 18 bp, Homo sapiens
tcattacctgtagctttg

SEQ ID NO: 6441091 - DNA, 15 bp, Homo sapiens
tcattacctgtttat

SEQ ID NO: 6441092 - DNA, 17 bp, Homo sapiens
tcattaccttaaagcat

SEQ ID NO: 6441093 - DNA, 12 bp, Homo sapiens
tcattactaacc

SEQ ID NO: 6441094 - DNA, 15 bp, Homo sapiens
tcattactacactgg

SEQ ID NO: 6441095 - DNA, 22 bp, Homo sapiens
tcattactacactggtgtgtcc

SEQ ID NO: 6441096 - DNA, 17 bp, Homo sapiens
tcattactcttaaggaa

SEQ ID NO: 6441097 - DNA, 21 bp, Homo sapiens
tcattactgcccagatgtttt

SEQ ID NO: 6441098 - DNA, 14 bp, Homo sapiens
tcattactgcttca

SEQ ID NO: 6441099 - DNA, 17 bp, Homo sapiens
tcattactggctgtgga

SEQ ID NO: 6441100 - DNA, 14 bp, Homo sapiens
tcattactgggcct

SEQ ID NO: 6441101 - DNA, 21 bp, Homo sapiens
tcattactgttccagattcct

SEQ ID NO: 6441102 - DNA, 13 bp, Homo sapiens
tcattacttctga

SEQ ID NO: 6441103 - DNA, 19 bp, Homo sapiens
tcattacttgggaaatttt

SEQ ID NO: 6441104 - DNA, 21 bp, Homo sapiens
tcattacttgggaaattttta

SEQ ID NO: 6441105 - DNA, 12 bp, Homo sapiens
tcattacttgtt

SEQ ID NO: 6441106 - DNA, 17 bp, Homo sapiens
tcattacttgttgccta

SEQ ID NO: 6441107 - DNA, 20 bp, Homo sapiens
tcattactttaccaccccca

SEQ ID NO: 6441108 - DNA, 20 bp, Homo sapiens
tcattacttttaaaaatgta

SEQ ID NO: 6441109 - DNA, 16 bp, Homo sapiens
tcattacttttgaagt

SEQ ID NO: 6441110 - DNA, 22 bp, Homo sapiens
tcattagacaaatgtcttgaag

SEQ ID NO: 6441111 - DNA, 18 bp, Homo sapiens
tcattagactcctcctcc

SEQ ID NO: 6441112 - DNA, 15 bp, Homo sapiens
tcattagagcttaaa

SEQ ID NO: 6441113 - DNA, 12 bp, Homo sapiens
tcattagcaaaa

SEQ ID NO: 6441114 - DNA, 20 bp, Homo sapiens
tcattagcaaaaaaagttgt

SEQ ID NO: 6441115 - DNA, 13 bp, Homo sapiens
tcattagctgtga

SEQ ID NO: 6441116 - DNA, 17 bp, Homo sapiens
tcattagctgtgatttt

SEQ ID NO: 6441117 - DNA, 14 bp, Homo sapiens
tcattaggcaaagt

SEQ ID NO: 6441118 - DNA, 17 bp, Homo sapiens
tcattaggcaaagtaca

SEQ ID NO: 6441119 - DNA, 18 bp, Homo sapiens
tcattaggcaaagtacaa

SEQ ID NO: 6441120 - DNA, 18 bp, Homo sapiens
tcattaggtgtgactgaa

SEQ ID NO: 6441121 - DNA, 22 bp, Homo sapiens
tcattaggtgtgactgaatttc

SEQ ID NO: 6441122 - DNA, 16 bp, Homo sapiens
tcattaggtttccttt

SEQ ID NO: 6441123 - DNA, 15 bp, Homo sapiens
tcattaggttttgct

SEQ ID NO: 6441124 - DNA, 23 bp, Homo sapiens
tcattagttttgaagattctatg

SEQ ID NO: 6441125 - DNA, 13 bp, Homo sapiens
tcttaagtcccag

SEQ ID NO: 6441126 - DNA, 14 bp, Homo sapiens
tcttaagtgtttct

SEQ ID NO: 6441127 - DNA, 17 bp, Homo sapiens
tcttaagtgtttctcaa

SEQ ID NO: 6441128 - DNA, 17 bp, Homo sapiens
tcttaagtttctcagct

SEQ ID NO: 6441129 - DNA, 24 bp, Homo sapiens
tcttaataaaataaactagatatt

SEQ ID NO: 6441130 - DNA, 14 bp, Homo sapiens
tcttaatactgtta

SEQ ID NO: 6441131 - DNA, 22 bp, Homo sapiens
tcttaatactgttattctttgc

SEQ ID NO: 6441132 - DNA, 14 bp, Homo sapiens
tcttaatacttgaa

SEQ ID NO: 6441133 - DNA, 23 bp, Homo sapiens
tcttaatacttgaactgttgccc

SEQ ID NO: 6441134 - DNA, 20 bp, Homo sapiens
tcttaatataaattcacttt

SEQ ID NO: 6441135 - DNA, 15 bp, Homo sapiens
tcttaatataactgc

SEQ ID NO: 6441136 - DNA, 18 bp, Homo sapiens
tcttaatataactgcctt

SEQ ID NO: 6441137 - DNA, 19 bp, Homo sapiens
tcttaatatatacattttt

SEQ ID NO: 6441138 - DNA, 16 bp, Homo sapiens
tcttaatattaaatat

SEQ ID NO: 6441139 - DNA, 20 bp, Homo sapiens
tcttaatattcagagaaaac

SEQ ID NO: 6441140 - DNA, 15 bp, Homo sapiens
tcttaatcactactg

SEQ ID NO: 6441141 - DNA, 18 bp, Homo sapiens
tcttaatcactactgtat

SEQ ID NO: 6441142 - DNA, 22 bp, Homo sapiens
tcttaatccattaaaaagttgt

SEQ ID NO: 6441143 - DNA, 19 bp, Homo sapiens
tcttaatcgatgaatgtaa

SEQ ID NO: 6441144 - DNA, 17 bp, Homo sapiens
tcttaatctcacttcat

SEQ ID NO: 6441145 - DNA, 11 bp, Homo sapiens
tcttaatctgt

SEQ ID NO: 6441146 - DNA, 11 bp, Homo sapiens
tcttaatcttt

SEQ ID NO: 6441147 - DNA, 21 bp, Homo sapiens
tcttaatcttttcacaaataa

SEQ ID NO: 6441148 - DNA, 20 bp, Homo sapiens
tcttaatgaagtttgaatgt

SEQ ID NO: 6441149 - DNA, 23 bp, Homo sapiens
tcttaatgaagtttgaatgttaa

SEQ ID NO: 6441150 - DNA, 16 bp, Homo sapiens
tcttaatgtaacatgt

SEQ ID NO: 6441151 - DNA, 14 bp, Homo sapiens
tcttaatgtacata

SEQ ID NO: 6441152 - DNA, 15 bp, Homo sapiens
tcttaatgtatcaaa

SEQ ID NO: 6441153 - DNA, 18 bp, Homo sapiens
tcttaatgtctcaaaata

SEQ ID NO: 6441154 - DNA, 16 bp, Homo sapiens
tcttaatgtctggtgt

SEQ ID NO: 6441155 - DNA, 23 bp, Homo sapiens
tcttaatgtctggtgtttgtcat

SEQ ID NO: 6441156 - DNA, 22 bp, Homo sapiens
tcttaatgtctgtcagaagaca

SEQ ID NO: 6441157 - DNA, 14 bp, Homo sapiens
tcttaattaaaaga

SEQ ID NO: 6441158 - DNA, 18 bp, Homo sapiens
tcttaattaaaagaatat

SEQ ID NO: 6441159 - DNA, 18 bp, Homo sapiens
tcttaattaagtaaacta

SEQ ID NO: 6441160 - DNA, 14 bp, Homo sapiens
tcttaattaatttg

SEQ ID NO: 6441161 - DNA, 16 bp, Homo sapiens
tcttaattagacctag

SEQ ID NO: 6441162 - DNA, 13 bp, Homo sapiens
tcttaattatggt

SEQ ID NO: 6441163 - DNA, 14 bp, Homo sapiens
tcttaattattata

SEQ ID NO: 6441164 - DNA, 17 bp, Homo sapiens
tcttaattattataaaa

SEQ ID NO: 6441165 - DNA, 18 bp, Homo sapiens
tcttaattattataaaaa

SEQ ID NO: 6441166 - DNA, 19 bp, Homo sapiens
tcttaattattataaaaat

SEQ ID NO: 6441167 - DNA, 20 bp, Homo sapiens
tcttaattattataaaaata

SEQ ID NO: 6441168 - DNA, 23 bp, Homo sapiens
tcttaattctcagccatgtgctt

SEQ ID NO: 6441169 - DNA, 16 bp, Homo sapiens
tcttaattgtgtttat

SEQ ID NO: 6441170 - DNA, 15 bp, Homo sapiens
tcttaatttggataa

SEQ ID NO: 6441171 - DNA, 18 bp, Homo sapiens
tcttaatttggataataa

SEQ ID NO: 6441172 - DNA, 16 bp, Homo sapiens
tcttaatttggatcta

SEQ ID NO: 6441173 - DNA, 17 bp, Homo sapiens
tcttaatttggatctat

SEQ ID NO: 6441174 - DNA, 19 bp, Homo sapiens
tcttaatttggatctattt

SEQ ID NO: 6441175 - DNA, 21 bp, Homo sapiens
tcttaatttggatctatttat

SEQ ID NO: 6441176 - DNA, 10 bp, Homo sapiens
tcttaatttt

SEQ ID NO: 6441177 - DNA, 19 bp, Homo sapiens
tcttaattttttttaatgt

SEQ ID NO: 6441178 - DNA, 19 bp, Homo sapiens
tcttacaaaaacaagacac

SEQ ID NO: 6441179 - DNA, 20 bp, Homo sapiens
tcttacaaaaagaaatgtca

SEQ ID NO: 6441180 - DNA, 13 bp, Homo sapiens
tcttacaaaacat

SEQ ID NO: 6441181 - DNA, 13 bp, Homo sapiens
tcttacaaagtgt

SEQ ID NO: 6441182 - DNA, 16 bp, Homo sapiens
tcttacaaagtgtatt

SEQ ID NO: 6441183 - DNA, 16 bp, Homo sapiens
tcttacaactccccca

SEQ ID NO: 6441184 - DNA, 22 bp, Homo sapiens
tcttacaaggcaggcctttcct

SEQ ID NO: 6441185 - DNA, 21 bp, Homo sapiens
tcttacaataaaccctccttg

SEQ ID NO: 6441186 - DNA, 21 bp, Homo sapiens
tcttacaattgcactgctgtt

SEQ ID NO: 6441187 - DNA, 18 bp, Homo sapiens
tcttacacactgtctgta

SEQ ID NO: 6441188 - DNA, 14 bp, Homo sapiens
tcttacacatacag

SEQ ID NO: 6441189 - DNA, 22 bp, Homo sapiens
tcttacacattccatcttacat

SEQ ID NO: 6441190 - DNA, 18 bp, Homo sapiens
tcttacaccgtgaggcca

SEQ ID NO: 6441191 - DNA, 14 bp, Homo sapiens
tcttacagaagagt

SEQ ID NO: 6441192 - DNA, 20 bp, Homo sapiens
tcttacagcacatcacctct

SEQ ID NO: 6441193 - DNA, 17 bp, Homo sapiens
tcttacagccagaggaa

SEQ ID NO: 6441194 - DNA, 14 bp, Homo sapiens
tcttacagtggagt

SEQ ID NO: 6441195 - DNA, 16 bp, Homo sapiens
tcttacataaaccatt

SEQ ID NO: 6441196 - DNA, 19 bp, Homo sapiens
tcttacataaaccattttt

SEQ ID NO: 6441197 - DNA, 17 bp, Homo sapiens
tcttacataatttgcaa

SEQ ID NO: 6441198 - DNA, 12 bp, Homo sapiens
tcttacatctcc

SEQ ID NO: 6441199 - DNA, 15 bp, Homo sapiens
tcttacatctgaaat

SEQ ID NO: 6441200 - DNA, 14 bp, Homo sapiens
tcttacatggccac

SEQ ID NO: 6441201 - DNA, 15 bp, Homo sapiens
tcttacatgttttct

SEQ ID NO: 6441202 - DNA, 23 bp, Homo sapiens
tcttacattattaatcattccat

SEQ ID NO: 6441203 - DNA, 16 bp, Homo sapiens
tcttaccacagtgttt

SEQ ID NO: 6441204 - DNA, 18 bp, Homo sapiens
tcttaccactagttgctt

SEQ ID NO: 6441205 - DNA, 19 bp, Homo sapiens
tcttaccattaacattttt

SEQ ID NO: 6441206 - DNA, 13 bp, Homo sapiens
tcttacccaaagc

SEQ ID NO: 6441207 - DNA, 17 bp, Homo sapiens
tcttacccaaagcacat

SEQ ID NO: 6441208 - DNA, 14 bp, Homo sapiens
tcttacccacacta

SEQ ID NO: 6441209 - DNA, 21 bp, Homo sapiens
tcttacccacttccctgcaag

SEQ ID NO: 6441210 - DNA, 20 bp, Homo sapiens
tcttacccagattgtgtaca

SEQ ID NO: 6441211 - DNA, 23 bp, Homo sapiens
tcttaccctagttctcttatctt

SEQ ID NO: 6441212 - DNA, 21 bp, Homo sapiens
tcttaccctctctttcaattg

SEQ ID NO: 6441213 - DNA, 16 bp, Homo sapiens
tcttacccttcaatgt

SEQ ID NO: 6441214 - DNA, 20 bp, Homo sapiens
tcttacccttctgtgcccag

SEQ ID NO: 6441215 - DNA, 14 bp, Homo sapiens
tcttaccctttctt

SEQ ID NO: 6441216 - DNA, 19 bp, Homo sapiens
tcttaccgaaatgaaaatg

SEQ ID NO: 6441217 - DNA, 14 bp, Homo sapiens
tcttaccgagaaaa

SEQ ID NO: 6441218 - DNA, 17 bp, Homo sapiens
tcttacctaaactgagc

SEQ ID NO: 6441219 - DNA, 21 bp, Homo sapiens
tcttacctacaaaatgagatt

SEQ ID NO: 6441220 - DNA, 17 bp, Homo sapiens
tcttacctactattggc

SEQ ID NO: 6441221 - DNA, 14 bp, Homo sapiens
tcttacctcatttg

SEQ ID NO: 6441222 - DNA, 16 bp, Homo sapiens
tcttacctcatttgca

SEQ ID NO: 6441223 - DNA, 19 bp, Homo sapiens
tcttacctcccactaaagg

SEQ ID NO: 6441224 - DNA, 13 bp, Homo sapiens
tcttacctggcag

SEQ ID NO: 6441225 - DNA, 18 bp, Homo sapiens
tcttacctgttatttatc

SEQ ID NO: 6441226 - DNA, 18 bp, Homo sapiens
tcttaccttaaaaagtaa

SEQ ID NO: 6441227 - DNA, 19 bp, Homo sapiens
tcttaccttaaaaagtaat

SEQ ID NO: 6441228 - DNA, 20 bp, Homo sapiens
tcttaccttgaactgaaggc

SEQ ID NO: 6441229 - DNA, 16 bp, Homo sapiens
tcttacgctatttctg

SEQ ID NO: 6441230 - DNA, 17 bp, Homo sapiens
tcttactaaaaagtata

SEQ ID NO: 6441231 - DNA, 16 bp, Homo sapiens
tcttactaaacatttt

SEQ ID NO: 6441232 - DNA, 18 bp, Homo sapiens
tcttactaataggtctgg

SEQ ID NO: 6441233 - DNA, 15 bp, Homo sapiens
tcttactaatgtaaa

SEQ ID NO: 6441234 - DNA, 19 bp, Homo sapiens
tcttactagtgtttggctc

SEQ ID NO: 6441235 - DNA, 23 bp, Homo sapiens
tcttactattaagcagtaaaaac

SEQ ID NO: 6441236 - DNA, 23 bp, Homo sapiens
tcttactcaagatactggactaa

SEQ ID NO: 6441237 - DNA, 18 bp, Homo sapiens
tcttactcattactgcaa

SEQ ID NO: 6441238 - DNA, 15 bp, Homo sapiens
tcttactcctcctct

SEQ ID NO: 6441239 - DNA, 18 bp, Homo sapiens
tcttactcctcctctttc

SEQ ID NO: 6441240 - DNA, 19 bp, Homo sapiens
tcttactcctcctctttct

SEQ ID NO: 6441241 - DNA, 20 bp, Homo sapiens
tcttactcctcctctttctc

SEQ ID NO: 6441242 - DNA, 21 bp, Homo sapiens
tcttactcctcctctttctct

SEQ ID NO: 6441243 - DNA, 14 bp, Homo sapiens
tcttactctactgc

SEQ ID NO: 6441244 - DNA, 22 bp, Homo sapiens
tcttactctactgctgctgaca

SEQ ID NO: 6441245 - DNA, 14 bp, Homo sapiens
tcttactctgtctc

SEQ ID NO: 6441246 - DNA, 19 bp, Homo sapiens
tcttactctgtctcccagg

SEQ ID NO: 6441247 - DNA, 23 bp, Homo sapiens
tcttactctgtctcccaggctgc

SEQ ID NO: 6441248 - DNA, 14 bp, Homo sapiens
tcttactctttcct

SEQ ID NO: 6441249 - DNA, 16 bp, Homo sapiens
tcttactctttcctat

SEQ ID NO: 6441250 - DNA, 15 bp, Homo sapiens
tcttactgcaaatgt

SEQ ID NO: 6441251 - DNA, 13 bp, Homo sapiens
tcttactgcagta

SEQ ID NO: 6441252 - DNA, 12 bp, Homo sapiens
tcttactgcttg

SEQ ID NO: 6441253 - DNA, 18 bp, Homo sapiens
tcttactgtacctgttcc

SEQ ID NO: 6441254 - DNA, 19 bp, Homo sapiens
tcttactgtcttttttcta

SEQ ID NO: 6441255 - DNA, 18 bp, Homo sapiens
tcttactgttttgaggaa

SEQ ID NO: 6441256 - DNA, 16 bp, Homo sapiens
tcttacttgagccttt

SEQ ID NO: 6441257 - DNA, 17 bp, Homo sapiens
tcttacttgcaaaatgg

SEQ ID NO: 6441258 - DNA, 17 bp, Homo sapiens
tcttactttgtaaattc

SEQ ID NO: 6441259 - DNA, 20 bp, Homo sapiens
tcttactttgtaaattctga

SEQ ID NO: 6441260 - DNA, 23 bp, Homo sapiens
tcttactttgttaatttatctgt

SEQ ID NO: 6441261 - DNA, 14 bp, Homo sapiens
tcttactttttgta

SEQ ID NO: 6441262 - DNA, 17 bp, Homo sapiens
tcttactttttgtaaat

SEQ ID NO: 6441263 - DNA, 23 bp, Homo sapiens
tcttactttttgtaaatgctgta

SEQ ID NO: 6441264 - DNA, 22 bp, Homo sapiens
tcttagaaaaggtgataaaatc

SEQ ID NO: 6441265 - DNA, 14 bp, Homo sapiens
tcttagaaatactt

SEQ ID NO: 6441266 - DNA, 19 bp, Homo sapiens
tcttagaagaatattgtat

SEQ ID NO: 6441267 - DNA, 12 bp, Homo sapiens
tcttagaagcca

SEQ ID NO: 6441268 - DNA, 13 bp, Homo sapiens
tcttagaagccat

SEQ ID NO: 6441269 - DNA, 17 bp, Homo sapiens
tcttagaagtgttgtaa

SEQ ID NO: 6441270 - DNA, 14 bp, Homo sapiens
tcttagaatttgtt

SEQ ID NO: 6441271 - DNA, 22 bp, Homo sapiens
tcttagactgagtaaagtgtta

SEQ ID NO: 6441272 - DNA, 18 bp, Homo sapiens
tcttagacttctgctttc

SEQ ID NO: 6441273 - DNA, 20 bp, Homo sapiens
tcttagacttctgctttcca

SEQ ID NO: 6441274 - DNA, 18 bp, Homo sapiens
tcttagacttgaaatact

SEQ ID NO: 6441275 - DNA, 23 bp, Homo sapiens
tcttagacttttccaatatgtga

SEQ ID NO: 6441276 - DNA, 13 bp, Homo sapiens
tcttagagaataa

SEQ ID NO: 6441277 - DNA, 14 bp, Homo sapiens
tcttagagaataag

SEQ ID NO: 6441278 - DNA, 15 bp, Homo sapiens
tcttagagagagaga

SEQ ID NO: 6441279 - DNA, 13 bp, Homo sapiens
tcttagagatacc

SEQ ID NO: 6441280 - DNA, 18 bp, Homo sapiens
tcttagagccaagtgtct

SEQ ID NO: 6441281 - DNA, 21 bp, Homo sapiens
tcttagagccaagtgtctttt

SEQ ID NO: 6441282 - DNA, 23 bp, Homo sapiens
tcttagagccaagtgtcttttaa

SEQ ID NO: 6441283 - DNA, 23 bp, Homo sapiens
tcttagaggggtattcttcttga

SEQ ID NO: 6441284 - DNA, 13 bp, Homo sapiens
tcttagagtcctt

SEQ ID NO: 6441285 - DNA, 14 bp, Homo sapiens
tcttagagtcctta

SEQ ID NO: 6441286 - DNA, 18 bp, Homo sapiens
tcttagagtgtagctgta

SEQ ID NO: 6441287 - DNA, 15 bp, Homo sapiens
tcttagagttttatt

SEQ ID NO: 6441288 - DNA, 21 bp, Homo sapiens
tcttagagttttattcctttc

SEQ ID NO: 6441289 - DNA, 17 bp, Homo sapiens
tcttagataacttcttg

SEQ ID NO: 6441290 - DNA, 20 bp, Homo sapiens
tcttagataacttcttgaaa

SEQ ID NO: 6441291 - DNA, 21 bp, Homo sapiens
tcttagataacttcttgaaaa

SEQ ID NO: 6441292 - DNA, 14 bp, Homo sapiens
tcttagatatcttt

SEQ ID NO: 6441293 - DNA, 22 bp, Homo sapiens
tcttagatctggtgtccagcat

SEQ ID NO: 6441294 - DNA, 23 bp, Homo sapiens
tcttagatgcagttctgaagaag

SEQ ID NO: 6441295 - DNA, 14 bp, Homo sapiens
tcttagatgtatat

SEQ ID NO: 6441296 - DNA, 16 bp, Homo sapiens
tcttagattcagggga

SEQ ID NO: 6441297 - DNA, 12 bp, Homo sapiens
tcttagattctc

SEQ ID NO: 6441298 - DNA, 18 bp, Homo sapiens
tcttagcaaaaaatgaac

SEQ ID NO: 6441299 - DNA, 15 bp, Homo sapiens
tcttagcctctggat

SEQ ID NO: 6441300 - DNA, 23 bp, Homo sapiens
tcttagcctctggatctagaagg

SEQ ID NO: 6441301 - DNA, 18 bp, Homo sapiens
tcttagctactgtatgca

SEQ ID NO: 6441302 - DNA, 20 bp, Homo sapiens
tcttagctatcattgcttcc

SEQ ID NO: 6441303 - DNA, 23 bp, Homo sapiens
tcattataaacgtgatgatcagc

SEQ ID NO: 6441304 - DNA, 16 bp, Homo sapiens
tcattataatctcaaa

SEQ ID NO: 6441305 - DNA, 17 bp, Homo sapiens
tcattataatctcaaag

SEQ ID NO: 6441306 - DNA, 17 bp, Homo sapiens
tcattatagatccccca

SEQ ID NO: 6441307 - DNA, 13 bp, Homo sapiens
tcattatattcta

SEQ ID NO: 6441308 - DNA, 15 bp, Homo sapiens
tcattatattctaat

SEQ ID NO: 6441309 - DNA, 17 bp, Homo sapiens
tcattatcatcaagcag

SEQ ID NO: 6441310 - DNA, 15 bp, Homo sapiens
tcattatctcacttt

SEQ ID NO: 6441311 - DNA, 14 bp, Homo sapiens
tcattatctgagtt

SEQ ID NO: 6441312 - DNA, 18 bp, Homo sapiens
tcattatctgagttgcat

SEQ ID NO: 6441313 - DNA, 23 bp, Homo sapiens
tcattatctgtactgaaagcaaa

SEQ ID NO: 6441314 - DNA, 18 bp, Homo sapiens
tcattatctttgctgtta

SEQ ID NO: 6441315 - DNA, 23 bp, Homo sapiens
tcattatgaaaaacatcccaaac

SEQ ID NO: 6441316 - DNA, 12 bp, Homo sapiens
tcattatgaaga

SEQ ID NO: 6441317 - DNA, 15 bp, Homo sapiens
tcattatgaagatgt

SEQ ID NO: 6441318 - DNA, 18 bp, Homo sapiens
tcattatgaagatgtttt

SEQ ID NO: 6441319 - DNA, 18 bp, Homo sapiens
tcattatgcacttttaga

SEQ ID NO: 6441320 - DNA, 21 bp, Homo sapiens
tcattatgctttgaactttag

SEQ ID NO: 6441321 - DNA, 12 bp, Homo sapiens
tcattatgtaga

SEQ ID NO: 6441322 - DNA, 18 bp, Homo sapiens
tcattatgtagaaatatt

SEQ ID NO: 6441323 - DNA, 17 bp, Homo sapiens
tcattatgtagctgtcg

SEQ ID NO: 6441324 - DNA, 13 bp, Homo sapiens
tcattatgtcaac

SEQ ID NO: 6441325 - DNA, 20 bp, Homo sapiens
tcattatgtcaattcattaa

SEQ ID NO: 6441326 - DNA, 16 bp, Homo sapiens
tcattatgttaatatt

SEQ ID NO: 6441327 - DNA, 17 bp, Homo sapiens
tcattatgttaatattt

SEQ ID NO: 6441328 - DNA, 13 bp, Homo sapiens
tcattatgttcat

SEQ ID NO: 6441329 - DNA, 14 bp, Homo sapiens
tcattatgttcatg

SEQ ID NO: 6441330 - DNA, 19 bp, Homo sapiens
tcattattacttttgctgt

SEQ ID NO: 6441331 - DNA, 19 bp, Homo sapiens
tcattattatctagctaag

SEQ ID NO: 6441332 - DNA, 12 bp, Homo sapiens
tcattattatta

SEQ ID NO: 6441333 - DNA, 16 bp, Homo sapiens
tcattattcaagaatg

SEQ ID NO: 6441334 - DNA, 22 bp, Homo sapiens
tcattattcaagaatgaaaaat

SEQ ID NO: 6441335 - DNA, 21 bp, Homo sapiens
tcattattcctcagattgctg

SEQ ID NO: 6441336 - DNA, 23 bp, Homo sapiens
tcattattcgtagatattggaca

SEQ ID NO: 6441337 - DNA, 14 bp, Homo sapiens
tcattattctctgc

SEQ ID NO: 6441338 - DNA, 17 bp, Homo sapiens
tcattattctctgctat

SEQ ID NO: 6441339 - DNA, 15 bp, Homo sapiens
tcattattgagtcac

SEQ ID NO: 6441340 - DNA, 14 bp, Homo sapiens
tcattattggaatt

SEQ ID NO: 6441341 - DNA, 18 bp, Homo sapiens
tcattattggaattaacc

SEQ ID NO: 6441342 - DNA, 17 bp, Homo sapiens
tcattatttatgtattg

SEQ ID NO: 6441343 - DNA, 18 bp, Homo sapiens
tcattatttattgttaaa

SEQ ID NO: 6441344 - DNA, 14 bp, Homo sapiens
tcattatttcaagg

SEQ ID NO: 6441345 - DNA, 14 bp, Homo sapiens
tcattatttcagtg

SEQ ID NO: 6441346 - DNA, 15 bp, Homo sapiens
tcattatttcagtgt

SEQ ID NO: 6441347 - DNA, 16 bp, Homo sapiens
tcattatttgataaca

SEQ ID NO: 6441348 - DNA, 16 bp, Homo sapiens
tcattatttgcagaga

SEQ ID NO: 6441349 - DNA, 19 bp, Homo sapiens
tcattatttgtcaaattgt

SEQ ID NO: 6441350 - DNA, 16 bp, Homo sapiens
tcattattttattatg

SEQ ID NO: 6441351 - DNA, 23 bp, Homo sapiens
tcattattttattatgaaacttg

SEQ ID NO: 6441352 - DNA, 14 bp, Homo sapiens
tcattattttccca

SEQ ID NO: 6441353 - DNA, 19 bp, Homo sapiens
tcattatttttcaattatg

SEQ ID NO: 6441354 - DNA, 21 bp, Homo sapiens
tcattatttttcaattatgtt

SEQ ID NO: 6441355 - DNA, 17 bp, Homo sapiens
tcattatttttccactt

SEQ ID NO: 6441356 - DNA, 22 bp, Homo sapiens
tcattcaaaacaaccatcctgc

SEQ ID NO: 6441357 - DNA, 17 bp, Homo sapiens
tcattcaaaactttcag

SEQ ID NO: 6441358 - DNA, 15 bp, Homo sapiens
tcattcaaatcagtg

SEQ ID NO: 6441359 - DNA, 16 bp, Homo sapiens
tcattcaagctattta

SEQ ID NO: 6441360 - DNA, 21 bp, Homo sapiens
tcattcacaaagtataacaat

SEQ ID NO: 6441361 - DNA, 16 bp, Homo sapiens
tcattcactagctttg

SEQ ID NO: 6441362 - DNA, 15 bp, Homo sapiens
tcattcactcttcct

SEQ ID NO: 6441363 - DNA, 12 bp, Homo sapiens
tcattcactgtc

SEQ ID NO: 6441364 - DNA, 20 bp, Homo sapiens
tcattcactgtcctggcttt

SEQ ID NO: 6441365 - DNA, 15 bp, Homo sapiens
tcattcactgtgcac

SEQ ID NO: 6441366 - DNA, 16 bp, Homo sapiens
tcattcacttctctta

SEQ ID NO: 6441367 - DNA, 14 bp, Homo sapiens
tcattcagaaaaaa

SEQ ID NO: 6441368 - DNA, 23 bp, Homo sapiens
tcattcagagactgcccttctca

SEQ ID NO: 6441369 - DNA, 14 bp, Homo sapiens
tcattcagagtcag

SEQ ID NO: 6441370 - DNA, 20 bp, Homo sapiens
tcattcagagtcagccagga

SEQ ID NO: 6441371 - DNA, 10 bp, Homo sapiens
tcattcagca

SEQ ID NO: 6441372 - DNA, 18 bp, Homo sapiens
tcattcagcaaatgcctt

SEQ ID NO: 6441373 - DNA, 20 bp, Homo sapiens
tcattcagcatctactctaa

SEQ ID NO: 6441374 - DNA, 18 bp, Homo sapiens
tcattcagccttgctgac

SEQ ID NO: 6441375 - DNA, 22 bp, Homo sapiens
tcattcaggtgacctcctgcag

SEQ ID NO: 6441376 - DNA, 17 bp, Homo sapiens
tcattcagtattaaagg

SEQ ID NO: 6441377 - DNA, 13 bp, Homo sapiens
tcattcagtattt

SEQ ID NO: 6441378 - DNA, 21 bp, Homo sapiens
tcattcagtgagacacagagt

SEQ ID NO: 6441379 - DNA, 13 bp, Homo sapiens
tcattcagttcta

SEQ ID NO: 6441380 - DNA, 16 bp, Homo sapiens
tcattcagttctaggc

SEQ ID NO: 6441381 - DNA, 21 bp, Homo sapiens
tcattcataaaagtttgcatg

SEQ ID NO: 6441382 - DNA, 19 bp, Homo sapiens
tcattcatacttaaaaatt

SEQ ID NO: 6441383 - DNA, 20 bp, Homo sapiens
tcattcatattacaatattt

SEQ ID NO: 6441384 - DNA, 16 bp, Homo sapiens
tcattcatattcctgc

SEQ ID NO: 6441385 - DNA, 11 bp, Homo sapiens
tcattcatctt

SEQ ID NO: 6441386 - DNA, 15 bp, Homo sapiens
tcattcatcttgcaa

SEQ ID NO: 6441387 - DNA, 19 bp, Homo sapiens
tcattcatggaccactgtt

SEQ ID NO: 6441388 - DNA, 20 bp, Homo sapiens
tcattcatggaccactgttt

SEQ ID NO: 6441389 - DNA, 15 bp, Homo sapiens
tcattcattcttagc

SEQ ID NO: 6441390 - DNA, 16 bp, Homo sapiens
tcattccaattctaaa

SEQ ID NO: 6441391 - DNA, 15 bp, Homo sapiens
tcattccacacattt

SEQ ID NO: 6441392 - DNA, 17 bp, Homo sapiens
tcattccacacatttcc

SEQ ID NO: 6441393 - DNA, 19 bp, Homo sapiens
tcattccacacatttccct

SEQ ID NO: 6441394 - DNA, 13 bp, Homo sapiens
tcattccacactg

SEQ ID NO: 6441395 - DNA, 14 bp, Homo sapiens
tcattccacaggac

SEQ ID NO: 6441396 - DNA, 22 bp, Homo sapiens
tcattccactatacaattcagt

SEQ ID NO: 6441397 - DNA, 15 bp, Homo sapiens
tcattccagcagctg

SEQ ID NO: 6441398 - DNA, 18 bp, Homo sapiens
tcattccagcagctgcac

SEQ ID NO: 6441399 - DNA, 19 bp, Homo sapiens
tcattccatgactctgcct

SEQ ID NO: 6441400 - DNA, 20 bp, Homo sapiens
tcattccatgactctgccta

SEQ ID NO: 6441401 - DNA, 16 bp, Homo sapiens
tcattccatgtgccca

SEQ ID NO: 6441402 - DNA, 20 bp, Homo sapiens
tcattccatgtgcccagtta

SEQ ID NO: 6441403 - DNA, 16 bp, Homo sapiens
tcattccattctggaa

SEQ ID NO: 6441404 - DNA, 14 bp, Homo sapiens
tcattccattgact

SEQ ID NO: 6441405 - DNA, 13 bp, Homo sapiens
tcattccattgcc

SEQ ID NO: 6441406 - DNA, 14 bp, Homo sapiens
tcattccattgcct

SEQ ID NO: 6441407 - DNA, 18 bp, Homo sapiens
tcattcccactgcacttg

SEQ ID NO: 6441408 - DNA, 22 bp, Homo sapiens
tcattcccactgcacttggtgc

SEQ ID NO: 6441409 - DNA, 14 bp, Homo sapiens
tcattcccatgtgg

SEQ ID NO: 6441410 - DNA, 12 bp, Homo sapiens
tcattccccagg

SEQ ID NO: 6441411 - DNA, 14 bp, Homo sapiens
tcattccccaggtg

SEQ ID NO: 6441412 - DNA, 24 bp, Homo sapiens
tcattccccattctgtgtcccatg

SEQ ID NO: 6441413 - DNA, 18 bp, Homo sapiens
tcattcccccttcctagt

SEQ ID NO: 6441414 - DNA, 19 bp, Homo sapiens
tcattccctcgtctttccc

SEQ ID NO: 6441415 - DNA, 17 bp, Homo sapiens
tcattccctctcatctc

SEQ ID NO: 6441416 - DNA, 18 bp, Homo sapiens
tcattccctctcatctca

SEQ ID NO: 6441417 - DNA, 22 bp, Homo sapiens
tcattcccttctctcagcctcc

SEQ ID NO: 6441418 - DNA, 19 bp, Homo sapiens
tcattccgagggtgaaaca

SEQ ID NO: 6441419 - DNA, 13 bp, Homo sapiens
tcattccggactg

SEQ ID NO: 6441420 - DNA, 21 bp, Homo sapiens
tcattccggactggcagaagc

SEQ ID NO: 6441421 - DNA, 19 bp, Homo sapiens
tcattccggccacatcatt

SEQ ID NO: 6441422 - DNA, 15 bp, Homo sapiens
tcattccgttaggaa

SEQ ID NO: 6441423 - DNA, 16 bp, Homo sapiens
tcattcctaatgcatt

SEQ ID NO: 6441424 - DNA, 18 bp, Homo sapiens
tcattcctcacaatgagg

SEQ ID NO: 6441425 - DNA, 14 bp, Homo sapiens
tcattcctgaaaga

SEQ ID NO: 6441426 - DNA, 17 bp, Homo sapiens
tcattccttcagatttg

SEQ ID NO: 6441427 - DNA, 18 bp, Homo sapiens
tcattccttgtcttgata

SEQ ID NO: 6441428 - DNA, 13 bp, Homo sapiens
tcattcctttcca

SEQ ID NO: 6441429 - DNA, 20 bp, Homo sapiens
tcattcctttttatttatat

SEQ ID NO: 6441430 - DNA, 23 bp, Homo sapiens
tcattcgctactatgatttaatt

SEQ ID NO: 6441431 - DNA, 15 bp, Homo sapiens
tcattcgctttgtct

SEQ ID NO: 6441432 - DNA, 21 bp, Homo sapiens
tcattcgggccccacctgcag

SEQ ID NO: 6441433 - DNA, 14 bp, Homo sapiens
tcattcggtgtgaa

SEQ ID NO: 6441434 - DNA, 15 bp, Homo sapiens
tcattcggtgtgaac

SEQ ID NO: 6441435 - DNA, 17 bp, Homo sapiens
tcattcgtggcatgttt

SEQ ID NO: 6441436 - DNA, 22 bp, Homo sapiens
tcattcgtgggcctgctgctct

SEQ ID NO: 6441437 - DNA, 14 bp, Homo sapiens
tcattctacagaat

SEQ ID NO: 6441438 - DNA, 18 bp, Homo sapiens
tcattctactaatgtgat

SEQ ID NO: 6441439 - DNA, 16 bp, Homo sapiens
tcattctaggatgtgg

SEQ ID NO: 6441440 - DNA, 15 bp, Homo sapiens
tcattctatcaagcc

SEQ ID NO: 6441441 - DNA, 18 bp, Homo sapiens
tcattctatgaacagtga

SEQ ID NO: 6441442 - DNA, 23 bp, Homo sapiens
tcattctcacctaaaccctctgt

SEQ ID NO: 6441443 - DNA, 18 bp, Homo sapiens
tcattctcagagtaaaat

SEQ ID NO: 6441444 - DNA, 21 bp, Homo sapiens
tcattctcccgcttcctggcc

SEQ ID NO: 6441445 - DNA, 13 bp, Homo sapiens
tcattctcctgcc

SEQ ID NO: 6441446 - DNA, 15 bp, Homo sapiens
tcattctcctgcctg

SEQ ID NO: 6441447 - DNA, 15 bp, Homo sapiens
tcattctctgtctca

SEQ ID NO: 6441448 - DNA, 19 bp, Homo sapiens
tcattctctgtctcatcca

SEQ ID NO: 6441449 - DNA, 14 bp, Homo sapiens
tcattctcttcttg

SEQ ID NO: 6441450 - DNA, 17 bp, Homo sapiens
tcattctcttcttgcta

SEQ ID NO: 6441451 - DNA, 20 bp, Homo sapiens
tcattctcttgaaggtgctg

SEQ ID NO: 6441452 - DNA, 11 bp, Homo sapiens
tcattctcttt

SEQ ID NO: 6441453 - DNA, 13 bp, Homo sapiens
tcattctgagccc

SEQ ID NO: 6441454 - DNA, 15 bp, Homo sapiens
tcattctgaggcctg

SEQ ID NO: 6441455 - DNA, 13 bp, Homo sapiens
tcattctgcattg

SEQ ID NO: 6441456 - DNA, 21 bp, Homo sapiens
tcattctgcattgagaaggaa

SEQ ID NO: 6441457 - DNA, 16 bp, Homo sapiens
tcattctgcattgcta

SEQ ID NO: 6441458 - DNA, 15 bp, Homo sapiens
tcattctgccaaagt

SEQ ID NO: 6441459 - DNA, 18 bp, Homo sapiens
tcattctgcctgccctga

SEQ ID NO: 6441460 - DNA, 14 bp, Homo sapiens
tcattctgcctgct

SEQ ID NO: 6441461 - DNA, 19 bp, Homo sapiens
tcattctgctaatttatga

SEQ ID NO: 6441462 - DNA, 20 bp, Homo sapiens
tcattctgctaatttatgaa

SEQ ID NO: 6441463 - DNA, 21 bp, Homo sapiens
tcattctgctaatttatgaag

SEQ ID NO: 6441464 - DNA, 21 bp, Homo sapiens
tcattctggtccttagtaaat

SEQ ID NO: 6441465 - DNA, 12 bp, Homo sapiens
tcattctgtgac

SEQ ID NO: 6441466 - DNA, 18 bp, Homo sapiens
tcattctgtgaccctagt

SEQ ID NO: 6441467 - DNA, 16 bp, Homo sapiens
tcattctgtgatcatt

SEQ ID NO: 6441468 - DNA, 13 bp, Homo sapiens
tcattctgtgtct

SEQ ID NO: 6441469 - DNA, 18 bp, Homo sapiens
tcattcttaacaagatat

SEQ ID NO: 6441470 - DNA, 22 bp, Homo sapiens
tcattcttaagatttctcctga

SEQ ID NO: 6441471 - DNA, 23 bp, Homo sapiens
tcattcttaccgagaaaaggaga

SEQ ID NO: 6441472 - DNA, 16 bp, Homo sapiens
tcattcttagctctta

SEQ ID NO: 6441473 - DNA, 16 bp, Homo sapiens
tcattcttcagttctc

SEQ ID NO: 6441474 - DNA, 21 bp, Homo sapiens
tcattcttccaagctgagagt

SEQ ID NO: 6441475 - DNA, 22 bp, Homo sapiens
tcattcttcggtctgaatttta

SEQ ID NO: 6441476 - DNA, 13 bp, Homo sapiens
tcattcttctaaa

SEQ ID NO: 6441477 - DNA, 18 bp, Homo sapiens
tcattcttctaaaactac

SEQ ID NO: 6441478 - DNA, 14 bp, Homo sapiens
tcattcttgtggga

SEQ ID NO: 6441479 - DNA, 19 bp, Homo sapiens
tcattcttgtgggagacag

SEQ ID NO: 6441480 - DNA, 22 bp, Homo sapiens
tcattcttgtgggagacagcag

SEQ ID NO: 6441481 - DNA, 13 bp, Homo sapiens
tcattctttattc

SEQ ID NO: 6441482 - DNA, 13 bp, Homo sapiens
tcattctttgtat

SEQ ID NO: 6441483 - DNA, 21 bp, Homo sapiens
tcttagctatcattgcttcct

SEQ ID NO: 6441484 - DNA, 15 bp, Homo sapiens
tcttagctcaatgag

SEQ ID NO: 6441485 - DNA, 16 bp, Homo sapiens
tcttagctcaatgagc

SEQ ID NO: 6441486 - DNA, 22 bp, Homo sapiens
tcttagctcaatgagcatgttt

SEQ ID NO: 6441487 - DNA, 13 bp, Homo sapiens
tcttagctcccct

SEQ ID NO: 6441488 - DNA, 17 bp, Homo sapiens
tcttagctgatgtcttt

SEQ ID NO: 6441489 - DNA, 15 bp, Homo sapiens
tcttagctgtctgct

SEQ ID NO: 6441490 - DNA, 13 bp, Homo sapiens
tcttagcttacag

SEQ ID NO: 6441491 - DNA, 12 bp, Homo sapiens
tcttagctttac

SEQ ID NO: 6441492 - DNA, 19 bp, Homo sapiens
tcttaggaagagaaaccag

SEQ ID NO: 6441493 - DNA, 23 bp, Homo sapiens
tcttaggatatttgagtcacttg

SEQ ID NO: 6441494 - DNA, 20 bp, Homo sapiens
tcttaggatgtttcaccaag

SEQ ID NO: 6441495 - DNA, 16 bp, Homo sapiens
tcttaggcaatcacat

SEQ ID NO: 6441496 - DNA, 16 bp, Homo sapiens
tcttaggcacatcaat

SEQ ID NO: 6441497 - DNA, 14 bp, Homo sapiens
tcttaggcactttg

SEQ ID NO: 6441498 - DNA, 17 bp, Homo sapiens
tcttaggcactttttaa

SEQ ID NO: 6441499 - DNA, 23 bp, Homo sapiens
tcttagggaactttgatacaaat

SEQ ID NO: 6441500 - DNA, 17 bp, Homo sapiens
tcttagggattaaatat

SEQ ID NO: 6441501 - DNA, 17 bp, Homo sapiens
tcttaggggagagcttt

SEQ ID NO: 6441502 - DNA, 19 bp, Homo sapiens
tcttagggtacagcccagg

SEQ ID NO: 6441503 - DNA, 21 bp, Homo sapiens
tcttaggtcttcctgtggctc

SEQ ID NO: 6441504 - DNA, 16 bp, Homo sapiens
tcttaggtgcgcagtg

SEQ ID NO: 6441505 - DNA, 13 bp, Homo sapiens
tcttaggtttact

SEQ ID NO: 6441506 - DNA, 15 bp, Homo sapiens
tcttaggtttactgt

SEQ ID NO: 6441507 - DNA, 17 bp, Homo sapiens
tcttaggtttactgtga

SEQ ID NO: 6441508 - DNA, 12 bp, Homo sapiens
tcttagtcccaa

SEQ ID NO: 6441509 - DNA, 22 bp, Homo sapiens
tcttagtcctccctgctcagct

SEQ ID NO: 6441510 - DNA, 14 bp, Homo sapiens
tcttagtgcctgag

SEQ ID NO: 6441511 - DNA, 19 bp, Homo sapiens
tcttagtgcttcagagttt

SEQ ID NO: 6441512 - DNA, 21 bp, Homo sapiens
tcttagtgcttcagagtttgt

SEQ ID NO: 6441513 - DNA, 14 bp, Homo sapiens
tcttagtgtatgat

SEQ ID NO: 6441514 - DNA, 14 bp, Homo sapiens
tcttagtgtgatga

SEQ ID NO: 6441515 - DNA, 14 bp, Homo sapiens
tcttagtgtgtgca

SEQ ID NO: 6441516 - DNA, 23 bp, Homo sapiens
tcttagttacatttctatcagta

SEQ ID NO: 6441517 - DNA, 15 bp, Homo sapiens
tcttagttctcactg

SEQ ID NO: 6441518 - DNA, 17 bp, Homo sapiens
tcttagtttcagaagta

SEQ ID NO: 6441519 - DNA, 13 bp, Homo sapiens
tcttagtttgaat

SEQ ID NO: 6441520 - DNA, 21 bp, Homo sapiens
tcttagtttggattcttatgt

SEQ ID NO: 6441521 - DNA, 16 bp, Homo sapiens
tcttagtttttaaaaa

SEQ ID NO: 6441522 - DNA, 23 bp, Homo sapiens
tcttagtttttaaaaaggccttt

SEQ ID NO: 6441523 - DNA, 21 bp, Homo sapiens
tcttataaagtggacttctga

SEQ ID NO: 6441524 - DNA, 12 bp, Homo sapiens
tcttataaatat

SEQ ID NO: 6441525 - DNA, 21 bp, Homo sapiens
tcttataaatatgaagctcac

SEQ ID NO: 6441526 - DNA, 22 bp, Homo sapiens
tcttataaattctgttagctgc

SEQ ID NO: 6441527 - DNA, 16 bp, Homo sapiens
tcttataacattgtat

SEQ ID NO: 6441528 - DNA, 19 bp, Homo sapiens
tcttataacttgtaagtct

SEQ ID NO: 6441529 - DNA, 24 bp, Homo sapiens
tcttataatgatttttttactaat

SEQ ID NO: 6441530 - DNA, 21 bp, Homo sapiens
tcttataattgttctcagaat

SEQ ID NO: 6441531 - DNA, 14 bp, Homo sapiens
tcttatacatttga

SEQ ID NO: 6441532 - DNA, 18 bp, Homo sapiens
tcttataccttctgacag

SEQ ID NO: 6441533 - DNA, 20 bp, Homo sapiens
tcttatacgcttttctttgt

SEQ ID NO: 6441534 - DNA, 14 bp, Homo sapiens
tcttatactgtaca

SEQ ID NO: 6441535 - DNA, 16 bp, Homo sapiens
tcttatactgtacaat

SEQ ID NO: 6441536 - DNA, 19 bp, Homo sapiens
tcttatagaagcttcagca

SEQ ID NO: 6441537 - DNA, 15 bp, Homo sapiens
tcttatagaataaaa

SEQ ID NO: 6441538 - DNA, 19 bp, Homo sapiens
tcttatagaataaaagctg

SEQ ID NO: 6441539 - DNA, 20 bp, Homo sapiens
tcttatagaatatttattac

SEQ ID NO: 6441540 - DNA, 20 bp, Homo sapiens
tcttatagattttttaaaaa

SEQ ID NO: 6441541 - DNA, 17 bp, Homo sapiens
tcttatagcactttgaa

SEQ ID NO: 6441542 - DNA, 19 bp, Homo sapiens
tcttatagcactttgaaat

SEQ ID NO: 6441543 - DNA, 13 bp, Homo sapiens
tcttatagttcta

SEQ ID NO: 6441544 - DNA, 13 bp, Homo sapiens
tcttatataagac

SEQ ID NO: 6441545 - DNA, 22 bp, Homo sapiens
tcttatatagcagcaaaaatat

SEQ ID NO: 6441546 - DNA, 20 bp, Homo sapiens
tcttatatatatttctttgt

SEQ ID NO: 6441547 - DNA, 17 bp, Homo sapiens
tcttatattaaagaagt

SEQ ID NO: 6441548 - DNA, 19 bp, Homo sapiens
tcttatattaaagaagttg

SEQ ID NO: 6441549 - DNA, 14 bp, Homo sapiens
tcttatattggttt

SEQ ID NO: 6441550 - DNA, 19 bp, Homo sapiens
tcttatattggtttgcaca

SEQ ID NO: 6441551 - DNA, 15 bp, Homo sapiens
tcttatattttatca

SEQ ID NO: 6441552 - DNA, 13 bp, Homo sapiens
tcttatcaagcag

SEQ ID NO: 6441553 - DNA, 16 bp, Homo sapiens
tcttatcaagcagcca

SEQ ID NO: 6441554 - DNA, 13 bp, Homo sapiens
tcttatcaagtgt

SEQ ID NO: 6441555 - DNA, 16 bp, Homo sapiens
tcttatcacacttgca

SEQ ID NO: 6441556 - DNA, 18 bp, Homo sapiens
tcttatcactaagaaaga

SEQ ID NO: 6441557 - DNA, 22 bp, Homo sapiens
tcttatccaacatcaacatctt

SEQ ID NO: 6441558 - DNA, 14 bp, Homo sapiens
tcttatccacaaag

SEQ ID NO: 6441559 - DNA, 16 bp, Homo sapiens
tcttatccacaaagta

SEQ ID NO: 6441560 - DNA, 16 bp, Homo sapiens
tcttatcctctctctc

SEQ ID NO: 6441561 - DNA, 18 bp, Homo sapiens
tcttatctagcaagaaga

SEQ ID NO: 6441562 - DNA, 12 bp, Homo sapiens
tcttatctcagt

SEQ ID NO: 6441563 - DNA, 14 bp, Homo sapiens
tcttatctcagtca

SEQ ID NO: 6441564 - DNA, 23 bp, Homo sapiens
tcttatctccaaaactagcattc

SEQ ID NO: 6441565 - DNA, 16 bp, Homo sapiens
tcttatctgctataaa

SEQ ID NO: 6441566 - DNA, 18 bp, Homo sapiens
tcttatcttttggcttct

SEQ ID NO: 6441567 - DNA, 13 bp, Homo sapiens
tcttatgaaatgg

SEQ ID NO: 6441568 - DNA, 13 bp, Homo sapiens
tcttatgaataag

SEQ ID NO: 6441569 - DNA, 22 bp, Homo sapiens
tcttatgaatagacataaattg

SEQ ID NO: 6441570 - DNA, 16 bp, Homo sapiens
tcttatgaggagggga

SEQ ID NO: 6441571 - DNA, 17 bp, Homo sapiens
tcttatgcaaaactttt

SEQ ID NO: 6441572 - DNA, 11 bp, Homo sapiens
tcttatgctta

SEQ ID NO: 6441573 - DNA, 17 bp, Homo sapiens
tcttatggaattgattt

SEQ ID NO: 6441574 - DNA, 18 bp, Homo sapiens
tcttatggaattgatttg

SEQ ID NO: 6441575 - DNA, 21 bp, Homo sapiens
tcttatggaattgatttgcat

SEQ ID NO: 6441576 - DNA, 22 bp, Homo sapiens
tcttatggaattgatttgcatt

SEQ ID NO: 6441577 - DNA, 18 bp, Homo sapiens
tcttatggatgtccccag

SEQ ID NO: 6441578 - DNA, 19 bp, Homo sapiens
tcttatggatgtccccagc

SEQ ID NO: 6441579 - DNA, 14 bp, Homo sapiens
tcttatgggctggg

SEQ ID NO: 6441580 - DNA, 14 bp, Homo sapiens
tcttatggggtgag

SEQ ID NO: 6441581 - DNA, 19 bp, Homo sapiens
tcttatgtaaagtatgttt

SEQ ID NO: 6441582 - DNA, 18 bp, Homo sapiens
tcttatgtagagttttta

SEQ ID NO: 6441583 - DNA, 17 bp, Homo sapiens
tcttatgtgaaaaatta

SEQ ID NO: 6441584 - DNA, 19 bp, Homo sapiens
tcttatgtgacattaacaa

SEQ ID NO: 6441585 - DNA, 23 bp, Homo sapiens
tcttatgttatcaccttccaaac

SEQ ID NO: 6441586 - DNA, 19 bp, Homo sapiens
tcttatgttgaatatgtta

SEQ ID NO: 6441587 - DNA, 17 bp, Homo sapiens
tcttattaaagtttcaa

SEQ ID NO: 6441588 - DNA, 19 bp, Homo sapiens
tcttattaaagtttcaaaa

SEQ ID NO: 6441589 - DNA, 16 bp, Homo sapiens
tcttattaaccaaatt

SEQ ID NO: 6441590 - DNA, 19 bp, Homo sapiens
tcttattaaggaaatactt

SEQ ID NO: 6441591 - DNA, 19 bp, Homo sapiens
tcttattactattattgtt

SEQ ID NO: 6441592 - DNA, 15 bp, Homo sapiens
tcttattactgttgg

SEQ ID NO: 6441593 - DNA, 22 bp, Homo sapiens
tcttattagaacaggcaagtga

SEQ ID NO: 6441594 - DNA, 21 bp, Homo sapiens
tcttattaggcctcagaaaga

SEQ ID NO: 6441595 - DNA, 21 bp, Homo sapiens
tcttattataaaatggacaca

SEQ ID NO: 6441596 - DNA, 22 bp, Homo sapiens
tcttattcatgctttctccttt

SEQ ID NO: 6441597 - DNA, 16 bp, Homo sapiens
tcttattcattttctc

SEQ ID NO: 6441598 - DNA, 17 bp, Homo sapiens
tcttattccaggagaag

SEQ ID NO: 6441599 - DNA, 18 bp, Homo sapiens
tcttattccatattagaa

SEQ ID NO: 6441600 - DNA, 18 bp, Homo sapiens
tcttattccgagcattcc

SEQ ID NO: 6441601 - DNA, 21 bp, Homo sapiens
tcttattccgagcattccagt

SEQ ID NO: 6441602 - DNA, 15 bp, Homo sapiens
tcttattcctctagg

SEQ ID NO: 6441603 - DNA, 18 bp, Homo sapiens
tcttattcctttaaagtg

SEQ ID NO: 6441604 - DNA, 13 bp, Homo sapiens
tcttattcttaag

SEQ ID NO: 6441605 - DNA, 22 bp, Homo sapiens
tcttattgcaaggcagtctcta

SEQ ID NO: 6441606 - DNA, 18 bp, Homo sapiens
tcttattgcccacgctgg

SEQ ID NO: 6441607 - DNA, 21 bp, Homo sapiens
tcttattgggatatcatttta

SEQ ID NO: 6441608 - DNA, 19 bp, Homo sapiens
tcttattgtttaatctttt

SEQ ID NO: 6441609 - DNA, 15 bp, Homo sapiens
tcttatttaaaattc

SEQ ID NO: 6441610 - DNA, 21 bp, Homo sapiens
tcttatttaaattttcagaaa

SEQ ID NO: 6441611 - DNA, 14 bp, Homo sapiens
tcttatttaccctt

SEQ ID NO: 6441612 - DNA, 17 bp, Homo sapiens
tcttatttacccttttc

SEQ ID NO: 6441613 - DNA, 15 bp, Homo sapiens
tcttatttatagaat

SEQ ID NO: 6441614 - DNA, 12 bp, Homo sapiens
tcttatttatgt

SEQ ID NO: 6441615 - DNA, 16 bp, Homo sapiens
tcttatttatgtaaca

SEQ ID NO: 6441616 - DNA, 18 bp, Homo sapiens
tcttatttatgtaacaaa

SEQ ID NO: 6441617 - DNA, 13 bp, Homo sapiens
tcttatttattat

SEQ ID NO: 6441618 - DNA, 12 bp, Homo sapiens
tcttatttattt

SEQ ID NO: 6441619 - DNA, 19 bp, Homo sapiens
tcttatttattttagcaaa

SEQ ID NO: 6441620 - DNA, 16 bp, Homo sapiens
tcttatttcatgaaaa

SEQ ID NO: 6441621 - DNA, 18 bp, Homo sapiens
tcttatttcatgaaaatt

SEQ ID NO: 6441622 - DNA, 15 bp, Homo sapiens
tcttatttcatttct

SEQ ID NO: 6441623 - DNA, 16 bp, Homo sapiens
tcttatttcatttctt

SEQ ID NO: 6441624 - DNA, 15 bp, Homo sapiens
tcttatttctgaatt

SEQ ID NO: 6441625 - DNA, 17 bp, Homo sapiens
tcttatttctgaattca

SEQ ID NO: 6441626 - DNA, 15 bp, Homo sapiens
tcttatttctttcct

SEQ ID NO: 6441627 - DNA, 19 bp, Homo sapiens
tcttatttggaattgacat

SEQ ID NO: 6441628 - DNA, 16 bp, Homo sapiens
tcttattttagtatac

SEQ ID NO: 6441629 - DNA, 14 bp, Homo sapiens
tcttattttattat

SEQ ID NO: 6441630 - DNA, 18 bp, Homo sapiens
tcttattttcttggaatt

SEQ ID NO: 6441631 - DNA, 20 bp, Homo sapiens
tcttattttgcattccagaa

SEQ ID NO: 6441632 - DNA, 22 bp, Homo sapiens
tcttattttgcattccagaatc

SEQ ID NO: 6441633 - DNA, 13 bp, Homo sapiens
tcttattttgtaa

SEQ ID NO: 6441634 - DNA, 14 bp, Homo sapiens
tcttattttgtaat

SEQ ID NO: 6441635 - DNA, 15 bp, Homo sapiens
tcttattttgtaata

SEQ ID NO: 6441636 - DNA, 18 bp, Homo sapiens
tcttattttgtaataaac

SEQ ID NO: 6441637 - DNA, 19 bp, Homo sapiens
tcttattttgtaataaact

SEQ ID NO: 6441638 - DNA, 22 bp, Homo sapiens
tcttattttgtaataaactctc

SEQ ID NO: 6441639 - DNA, 18 bp, Homo sapiens
tcttattttgtgaactat

SEQ ID NO: 6441640 - DNA, 14 bp, Homo sapiens
tcttattttgtggg

SEQ ID NO: 6441641 - DNA, 15 bp, Homo sapiens
tcttatttttcctgt

SEQ ID NO: 6441642 - DNA, 18 bp, Homo sapiens
tcttatttttcctgtcct

SEQ ID NO: 6441643 - DNA, 17 bp, Homo sapiens
tcttattttttaaaaag

SEQ ID NO: 6441644 - DNA, 22 bp, Homo sapiens
tcttcaaaatataaaatgccaa

SEQ ID NO: 6441645 - DNA, 16 bp, Homo sapiens
tcttcaaaatatcaag

SEQ ID NO: 6441646 - DNA, 14 bp, Homo sapiens
tcttcaaaatgtat

SEQ ID NO: 6441647 - DNA, 19 bp, Homo sapiens
tcttcaaaatgtatatatt

SEQ ID NO: 6441648 - DNA, 20 bp, Homo sapiens
tcttcaaaatgtatatattt

SEQ ID NO: 6441649 - DNA, 20 bp, Homo sapiens
tcttcaaacacccatttttg

SEQ ID NO: 6441650 - DNA, 20 bp, Homo sapiens
tcttcaaacaggaatttctg

SEQ ID NO: 6441651 - DNA, 23 bp, Homo sapiens
tcttcaaacagttccataccaag

SEQ ID NO: 6441652 - DNA, 17 bp, Homo sapiens
tcttcaaactttcactt

SEQ ID NO: 6441653 - DNA, 16 bp, Homo sapiens
tcttcaaagcagagtg

SEQ ID NO: 6441654 - DNA, 17 bp, Homo sapiens
tcttcaaagccttctcc

SEQ ID NO: 6441655 - DNA, 15 bp, Homo sapiens
tcttcaaatacaaag

SEQ ID NO: 6441656 - DNA, 16 bp, Homo sapiens
tcttcaaatacaaagt

SEQ ID NO: 6441657 - DNA, 15 bp, Homo sapiens
tcttcaaatatctct

SEQ ID NO: 6441658 - DNA, 13 bp, Homo sapiens
tcttcaaatcctt

SEQ ID NO: 6441659 - DNA, 18 bp, Homo sapiens
tcttcaaatctcagcaaa

SEQ ID NO: 6441660 - DNA, 20 bp, Homo sapiens
tcttcaaatcttaagagaat

SEQ ID NO: 6441661 - DNA, 20 bp, Homo sapiens
tcttcaaattagaagacatt

SEQ ID NO: 6441662 - DNA, 23 bp, Homo sapiens
tcattcttttcagcttgtttcta

SEQ ID NO: 6441663 - DNA, 16 bp, Homo sapiens
tcattcttttctttat

SEQ ID NO: 6441664 - DNA, 22 bp, Homo sapiens
tcattgaaaaaaatatatgatt

SEQ ID NO: 6441665 - DNA, 18 bp, Homo sapiens
tcattgaaatacttttta

SEQ ID NO: 6441666 - DNA, 17 bp, Homo sapiens
tcattgaaatgtcacgt

SEQ ID NO: 6441667 - DNA, 18 bp, Homo sapiens
tcattgaagtatattctt

SEQ ID NO: 6441668 - DNA, 18 bp, Homo sapiens
tcattgaattataaaagc

SEQ ID NO: 6441669 - DNA, 23 bp, Homo sapiens
tcattgacaccaaatattttcaa

SEQ ID NO: 6441670 - DNA, 18 bp, Homo sapiens
tcattgacctcatcatta

SEQ ID NO: 6441671 - DNA, 18 bp, Homo sapiens
tcattgacctctcagggc

SEQ ID NO: 6441672 - DNA, 23 bp, Homo sapiens
tcattgacctctcagggcctggc

SEQ ID NO: 6441673 - DNA, 22 bp, Homo sapiens
tcattgacctgaggcccttctc

SEQ ID NO: 6441674 - DNA, 21 bp, Homo sapiens
tcattgactgaactgcacgtt

SEQ ID NO: 6441675 - DNA, 18 bp, Homo sapiens
tcattgacttcattttat

SEQ ID NO: 6441676 - DNA, 14 bp, Homo sapiens
tcattgagagtttt

SEQ ID NO: 6441677 - DNA, 19 bp, Homo sapiens
tcattgaggacaaagaaaa

SEQ ID NO: 6441678 - DNA, 23 bp, Homo sapiens
tcattgagggaaaacataatatc

SEQ ID NO: 6441679 - DNA, 14 bp, Homo sapiens
tcattgagggacca

SEQ ID NO: 6441680 - DNA, 13 bp, Homo sapiens
tcattgatagaac

SEQ ID NO: 6441681 - DNA, 15 bp, Homo sapiens
tcattgatatgaaaa

SEQ ID NO: 6441682 - DNA, 16 bp, Homo sapiens
tcattgatatgaaaaa

SEQ ID NO: 6441683 - DNA, 18 bp, Homo sapiens
tcattgatcacagatgtg

SEQ ID NO: 6441684 - DNA, 16 bp, Homo sapiens
tcattgatggagcctg

SEQ ID NO: 6441685 - DNA, 20 bp, Homo sapiens
tcattgatggagcctgaacc

SEQ ID NO: 6441686 - DNA, 17 bp, Homo sapiens
tcattgattatatgggt

SEQ ID NO: 6441687 - DNA, 18 bp, Homo sapiens
tcattgattgtcagctac

SEQ ID NO: 6441688 - DNA, 15 bp, Homo sapiens
tcattgatttagtaa

SEQ ID NO: 6441689 - DNA, 15 bp, Homo sapiens
tcattgatttcctgt

SEQ ID NO: 6441690 - DNA, 18 bp, Homo sapiens
tcattgatttcctgtgtc

SEQ ID NO: 6441691 - DNA, 12 bp, Homo sapiens
tcattgatttta

SEQ ID NO: 6441692 - DNA, 20 bp, Homo sapiens
tcattgcaaacaactgaaat

SEQ ID NO: 6441693 - DNA, 20 bp, Homo sapiens
tcattgcaacctccaccttc

SEQ ID NO: 6441694 - DNA, 16 bp, Homo sapiens
tcattgcacctgcagg

SEQ ID NO: 6441695 - DNA, 15 bp, Homo sapiens
tcattgcactgcagt

SEQ ID NO: 6441696 - DNA, 16 bp, Homo sapiens
tcattgcactgcagtt

SEQ ID NO: 6441697 - DNA, 13 bp, Homo sapiens
tcattgcactttc

SEQ ID NO: 6441698 - DNA, 21 bp, Homo sapiens
tcattgcatttattgcagttt

SEQ ID NO: 6441699 - DNA, 17 bp, Homo sapiens
tcattgccaaggcatcc

SEQ ID NO: 6441700 - DNA, 17 bp, Homo sapiens
tcattgccacccctgtc

SEQ ID NO: 6441701 - DNA, 13 bp, Homo sapiens
tcattgccagtgt

SEQ ID NO: 6441702 - DNA, 17 bp, Homo sapiens
tcattgccagtgtcttt

SEQ ID NO: 6441703 - DNA, 18 bp, Homo sapiens
tcattgccagtgtctttc

SEQ ID NO: 6441704 - DNA, 21 bp, Homo sapiens
tcattgccagtgtctttcttt

SEQ ID NO: 6441705 - DNA, 22 bp, Homo sapiens
tcattgccagtgtctttctttg

SEQ ID NO: 6441706 - DNA, 21 bp, Homo sapiens
tcattgccatcaccatttggt

SEQ ID NO: 6441707 - DNA, 14 bp, Homo sapiens
tcattgcccacttc

SEQ ID NO: 6441708 - DNA, 20 bp, Homo sapiens
tcattgcccacttctgtgta

SEQ ID NO: 6441709 - DNA, 15 bp, Homo sapiens
tcattgcccccacct

SEQ ID NO: 6441710 - DNA, 18 bp, Homo sapiens
tcattgcccccacctctg

SEQ ID NO: 6441711 - DNA, 19 bp, Homo sapiens
tcattgcccccacctctgg

SEQ ID NO: 6441712 - DNA, 20 bp, Homo sapiens
tcattgcccccacctctggt

SEQ ID NO: 6441713 - DNA, 22 bp, Homo sapiens
tcattgcccccacctctggtcc

SEQ ID NO: 6441714 - DNA, 20 bp, Homo sapiens
tcattgcctcttctacttgt

SEQ ID NO: 6441715 - DNA, 17 bp, Homo sapiens
tcattgccttaactgga

SEQ ID NO: 6441716 - DNA, 12 bp, Homo sapiens
tcattgccttcc

SEQ ID NO: 6441717 - DNA, 13 bp, Homo sapiens
tcattgctaaaaa

SEQ ID NO: 6441718 - DNA, 20 bp, Homo sapiens
tcattgctaaaaaataaata

SEQ ID NO: 6441719 - DNA, 17 bp, Homo sapiens
tcattgctaaactgatg

SEQ ID NO: 6441720 - DNA, 23 bp, Homo sapiens
tcattgctgaaaatggtattttc

SEQ ID NO: 6441721 - DNA, 13 bp, Homo sapiens
tcattgctgctgc

SEQ ID NO: 6441722 - DNA, 20 bp, Homo sapiens
tcattgctgctgctaccagc

SEQ ID NO: 6441723 - DNA, 14 bp, Homo sapiens
tcattgctgtagga

SEQ ID NO: 6441724 - DNA, 21 bp, Homo sapiens
tcattgctgtctgcagccttg

SEQ ID NO: 6441725 - DNA, 16 bp, Homo sapiens
tcattgctgtcttgcc

SEQ ID NO: 6441726 - DNA, 13 bp, Homo sapiens
tcattgcttacaa

SEQ ID NO: 6441727 - DNA, 14 bp, Homo sapiens
tcattgcttcttct

SEQ ID NO: 6441728 - DNA, 15 bp, Homo sapiens
tcattgctttactgg

SEQ ID NO: 6441729 - DNA, 21 bp, Homo sapiens
tcattggaaatttagcattgt

SEQ ID NO: 6441730 - DNA, 12 bp, Homo sapiens
tcattggatgca

SEQ ID NO: 6441731 - DNA, 17 bp, Homo sapiens
tcattggatttttgtta

SEQ ID NO: 6441732 - DNA, 19 bp, Homo sapiens
tcattggcattctttgcaa

SEQ ID NO: 6441733 - DNA, 19 bp, Homo sapiens
tcattggccagctcataaa

SEQ ID NO: 6441734 - DNA, 22 bp, Homo sapiens
tcattggcctggcaaaataaaa

SEQ ID NO: 6441735 - DNA, 16 bp, Homo sapiens
tcattggctatataaa

SEQ ID NO: 6441736 - DNA, 16 bp, Homo sapiens
tcattggctttatcct

SEQ ID NO: 6441737 - DNA, 17 bp, Homo sapiens
tcattggctttatcctc

SEQ ID NO: 6441738 - DNA, 16 bp, Homo sapiens
tcattgggaagtatga

SEQ ID NO: 6441739 - DNA, 23 bp, Homo sapiens
tcattgggctgttttctcaacaa

SEQ ID NO: 6441740 - DNA, 17 bp, Homo sapiens
tcattggggttgcaaca

SEQ ID NO: 6441741 - DNA, 18 bp, Homo sapiens
tcattggggttgcaacaa

SEQ ID NO: 6441742 - DNA, 20 bp, Homo sapiens
tcattggggttgcaacaata

SEQ ID NO: 6441743 - DNA, 23 bp, Homo sapiens
tcattggttaaaatattactgat

SEQ ID NO: 6441744 - DNA, 15 bp, Homo sapiens
tcattggttacaaat

SEQ ID NO: 6441745 - DNA, 16 bp, Homo sapiens
tcattggttacaaatt

SEQ ID NO: 6441746 - DNA, 21 bp, Homo sapiens
tcattgtaaacaaactcttga

SEQ ID NO: 6441747 - DNA, 16 bp, Homo sapiens
tcattgtaaatcactt

SEQ ID NO: 6441748 - DNA, 22 bp, Homo sapiens
tcattgtaaatgaacataatga

SEQ ID NO: 6441749 - DNA, 24 bp, Homo sapiens
tcattgtaacactgtttattgaaa

SEQ ID NO: 6441750 - DNA, 22 bp, Homo sapiens
tcattgtaaccatttctcacta

SEQ ID NO: 6441751 - DNA, 13 bp, Homo sapiens
tcattgtaatcac

SEQ ID NO: 6441752 - DNA, 13 bp, Homo sapiens
tcattgtaatgtt

SEQ ID NO: 6441753 - DNA, 21 bp, Homo sapiens
tcattgtacaagtattacaac

SEQ ID NO: 6441754 - DNA, 12 bp, Homo sapiens
tcattgtagaaa

SEQ ID NO: 6441755 - DNA, 20 bp, Homo sapiens
tcattgtagagcacatttag

SEQ ID NO: 6441756 - DNA, 15 bp, Homo sapiens
tcattgtataaaaat

SEQ ID NO: 6441757 - DNA, 17 bp, Homo sapiens
tcattgtataaaaatag

SEQ ID NO: 6441758 - DNA, 15 bp, Homo sapiens
tcattgtatatatgt

SEQ ID NO: 6441759 - DNA, 17 bp, Homo sapiens
tcattgtatatatgtgt

SEQ ID NO: 6441760 - DNA, 18 bp, Homo sapiens
tcattgtatgatgtgttg

SEQ ID NO: 6441761 - DNA, 18 bp, Homo sapiens
tcattgtattcagataat

SEQ ID NO: 6441762 - DNA, 12 bp, Homo sapiens
tcattgtccagc

SEQ ID NO: 6441763 - DNA, 13 bp, Homo sapiens
tcattgtccctct

SEQ ID NO: 6441764 - DNA, 21 bp, Homo sapiens
tcattgtccctcttcactccc

SEQ ID NO: 6441765 - DNA, 20 bp, Homo sapiens
tcattgtctacatagtgaca

SEQ ID NO: 6441766 - DNA, 11 bp, Homo sapiens
tcattgtctca

SEQ ID NO: 6441767 - DNA, 22 bp, Homo sapiens
tcattgtctctcacagatgtga

SEQ ID NO: 6441768 - DNA, 17 bp, Homo sapiens
tcattgtgccaagcctt

SEQ ID NO: 6441769 - DNA, 20 bp, Homo sapiens
tcattgtgccaagccttctg

SEQ ID NO: 6441770 - DNA, 17 bp, Homo sapiens
tcattgtgcttaataat

SEQ ID NO: 6441771 - DNA, 22 bp, Homo sapiens
tcattgtggttatttttataca

SEQ ID NO: 6441772 - DNA, 14 bp, Homo sapiens
tcattgtgtctccc

SEQ ID NO: 6441773 - DNA, 14 bp, Homo sapiens
tcattgtgttacat

SEQ ID NO: 6441774 - DNA, 22 bp, Homo sapiens
tcattgttacaggtgtactatg

SEQ ID NO: 6441775 - DNA, 17 bp, Homo sapiens
tcattgttcaattccca

SEQ ID NO: 6441776 - DNA, 13 bp, Homo sapiens
tcattgttctgta

SEQ ID NO: 6441777 - DNA, 18 bp, Homo sapiens
tcattgttggacatttgg

SEQ ID NO: 6441778 - DNA, 20 bp, Homo sapiens
tcattgttggagtgtaaacc

SEQ ID NO: 6441779 - DNA, 20 bp, Homo sapiens
tcattgttggtgttaattga

SEQ ID NO: 6441780 - DNA, 23 bp, Homo sapiens
tcattgtttattaacaaattatg

SEQ ID NO: 6441781 - DNA, 23 bp, Homo sapiens
tcattgtttgatttggtcctgcc

SEQ ID NO: 6441782 - DNA, 13 bp, Homo sapiens
tcattgttttcag

SEQ ID NO: 6441783 - DNA, 12 bp, Homo sapiens
tcattgttttga

SEQ ID NO: 6441784 - DNA, 17 bp, Homo sapiens
tcattgttttgaatatt

SEQ ID NO: 6441785 - DNA, 15 bp, Homo sapiens
tcattgttttgcaaa

SEQ ID NO: 6441786 - DNA, 16 bp, Homo sapiens
tcattgttttgcaaaa

SEQ ID NO: 6441787 - DNA, 13 bp, Homo sapiens
tcatttaaaatga

SEQ ID NO: 6441788 - DNA, 15 bp, Homo sapiens
tcatttaaaatgatt

SEQ ID NO: 6441789 - DNA, 17 bp, Homo sapiens
tcatttaaaatgattag

SEQ ID NO: 6441790 - DNA, 22 bp, Homo sapiens
tcatttaaaatgtaaactcttc

SEQ ID NO: 6441791 - DNA, 16 bp, Homo sapiens
tcatttaaactaaatt

SEQ ID NO: 6441792 - DNA, 21 bp, Homo sapiens
tcatttaaactaaattactgt

SEQ ID NO: 6441793 - DNA, 22 bp, Homo sapiens
tcatttaaactaaattactgtt

SEQ ID NO: 6441794 - DNA, 18 bp, Homo sapiens
tcatttaaagctaaattt

SEQ ID NO: 6441795 - DNA, 13 bp, Homo sapiens
tcatttaaatatc

SEQ ID NO: 6441796 - DNA, 14 bp, Homo sapiens
tcatttaaatatct

SEQ ID NO: 6441797 - DNA, 22 bp, Homo sapiens
tcatttaactctttgaaactgt

SEQ ID NO: 6441798 - DNA, 14 bp, Homo sapiens
tcatttaactgaac

SEQ ID NO: 6441799 - DNA, 22 bp, Homo sapiens
tcatttaactgaagatgttgag

SEQ ID NO: 6441800 - DNA, 14 bp, Homo sapiens
tcatttaactttat

SEQ ID NO: 6441801 - DNA, 16 bp, Homo sapiens
tcatttaactttataa

SEQ ID NO: 6441802 - DNA, 21 bp, Homo sapiens
tcatttaactttataacttaa

SEQ ID NO: 6441803 - DNA, 23 bp, Homo sapiens
tcatttaagggaaaaatatatat

SEQ ID NO: 6441804 - DNA, 23 bp, Homo sapiens
tcatttaagtttcaaacttacta

SEQ ID NO: 6441805 - DNA, 14 bp, Homo sapiens
tcatttaataatat

SEQ ID NO: 6441806 - DNA, 20 bp, Homo sapiens
tcatttaataatatacttgt

SEQ ID NO: 6441807 - DNA, 21 bp, Homo sapiens
tcatttaataatatacttgtg

SEQ ID NO: 6441808 - DNA, 21 bp, Homo sapiens
tcatttaatatttttcaaaat

SEQ ID NO: 6441809 - DNA, 21 bp, Homo sapiens
tcatttaatttctaatttcaa

SEQ ID NO: 6441810 - DNA, 17 bp, Homo sapiens
tcatttaatttgttata

SEQ ID NO: 6441811 - DNA, 16 bp, Homo sapiens
tcatttacaactgaaa

SEQ ID NO: 6441812 - DNA, 18 bp, Homo sapiens
tcatttacaatttcaaaa

SEQ ID NO: 6441813 - DNA, 20 bp, Homo sapiens
tcatttacctcgcagtgtgt

SEQ ID NO: 6441814 - DNA, 15 bp, Homo sapiens
tcatttactaaacat

SEQ ID NO: 6441815 - DNA, 21 bp, Homo sapiens
tcatttactcaccatatttga

SEQ ID NO: 6441816 - DNA, 16 bp, Homo sapiens
tcatttactcttcttc

SEQ ID NO: 6441817 - DNA, 12 bp, Homo sapiens
tcatttagaact

SEQ ID NO: 6441818 - DNA, 22 bp, Homo sapiens
tcatttagaacttgcagctgat

SEQ ID NO: 6441819 - DNA, 13 bp, Homo sapiens
tcatttagagttt

SEQ ID NO: 6441820 - DNA, 18 bp, Homo sapiens
tcatttagataatttgaa

SEQ ID NO: 6441821 - DNA, 17 bp, Homo sapiens
tcatttagcctgtcctg

SEQ ID NO: 6441822 - DNA, 13 bp, Homo sapiens
tcatttagtgccc

SEQ ID NO: 6441823 - DNA, 14 bp, Homo sapiens
tcatttagttagaa

SEQ ID NO: 6441824 - DNA, 21 bp, Homo sapiens
tcatttataaaaccatcaaaa

SEQ ID NO: 6441825 - DNA, 18 bp, Homo sapiens
tcatttatcaagcagaga

SEQ ID NO: 6441826 - DNA, 23 bp, Homo sapiens
tcatttatcatcacaaatggcta

SEQ ID NO: 6441827 - DNA, 12 bp, Homo sapiens
tcatttatctat

SEQ ID NO: 6441828 - DNA, 19 bp, Homo sapiens
tcatttatctggattttta

SEQ ID NO: 6441829 - DNA, 15 bp, Homo sapiens
tcatttatgaaaaga

SEQ ID NO: 6441830 - DNA, 21 bp, Homo sapiens
tcatttatgttatttatgatg

SEQ ID NO: 6441831 - DNA, 16 bp, Homo sapiens
tcatttattctgcttc

SEQ ID NO: 6441832 - DNA, 15 bp, Homo sapiens
tcatttatttcatga

SEQ ID NO: 6441833 - DNA, 14 bp, Homo sapiens
tcatttatttccat

SEQ ID NO: 6441834 - DNA, 19 bp, Homo sapiens
tcatttatttccatattaa

SEQ ID NO: 6441835 - DNA, 20 bp, Homo sapiens
tcatttatttccatattaaa

SEQ ID NO: 6441836 - DNA, 22 bp, Homo sapiens
tcatttatttccatattaaaat

SEQ ID NO: 6441837 - DNA, 16 bp, Homo sapiens
tcatttattttaagca

SEQ ID NO: 6441838 - DNA, 21 bp, Homo sapiens
tcatttattttttgtttgttt

SEQ ID NO: 6441839 - DNA, 16 bp, Homo sapiens
tcttcaaatttgattc

SEQ ID NO: 6441840 - DNA, 22 bp, Homo sapiens
tcttcaacataacccacttgtc

SEQ ID NO: 6441841 - DNA, 19 bp, Homo sapiens
tcttcaacatcaatgttca

SEQ ID NO: 6441842 - DNA, 20 bp, Homo sapiens
tcttcaacatcaatgttcat

SEQ ID NO: 6441843 - DNA, 13 bp, Homo sapiens
tcttcaacatgac

SEQ ID NO: 6441844 - DNA, 20 bp, Homo sapiens
tcttcaacatgctccaaata

SEQ ID NO: 6441845 - DNA, 16 bp, Homo sapiens
tcttcaacatgtgtga

SEQ ID NO: 6441846 - DNA, 19 bp, Homo sapiens
tcttcaaccctgccctgca

SEQ ID NO: 6441847 - DNA, 14 bp, Homo sapiens
tcttcaagaaatct

SEQ ID NO: 6441848 - DNA, 11 bp, Homo sapiens
tcttcaagaga

SEQ ID NO: 6441849 - DNA, 17 bp, Homo sapiens
tcttcaagcacctgcag

SEQ ID NO: 6441850 - DNA, 18 bp, Homo sapiens
tcttcaagcatcctcaga

SEQ ID NO: 6441851 - DNA, 20 bp, Homo sapiens
tcttcaagccagctctaggc

SEQ ID NO: 6441852 - DNA, 17 bp, Homo sapiens
tcttcaagcctggccca

SEQ ID NO: 6441853 - DNA, 22 bp, Homo sapiens
tcttcaagctgtcccctctgtc

SEQ ID NO: 6441854 - DNA, 17 bp, Homo sapiens
tcttcaaggcttcagtc

SEQ ID NO: 6441855 - DNA, 15 bp, Homo sapiens
tcttcaagtagattg

SEQ ID NO: 6441856 - DNA, 16 bp, Homo sapiens
tcttcaagtgagtggc

SEQ ID NO: 6441857 - DNA, 13 bp, Homo sapiens
tcttcaataaacc

SEQ ID NO: 6441858 - DNA, 23 bp, Homo sapiens
tcttcaataaaccacaagcatct

SEQ ID NO: 6441859 - DNA, 14 bp, Homo sapiens
tcttcaatagctaa

SEQ ID NO: 6441860 - DNA, 13 bp, Homo sapiens
tcttcaatctctg

SEQ ID NO: 6441861 - DNA, 15 bp, Homo sapiens
tcttcaatctctgtt

SEQ ID NO: 6441862 - DNA, 19 bp, Homo sapiens
tcttcaatctctgttctgc

SEQ ID NO: 6441863 - DNA, 15 bp, Homo sapiens
tcttcaatgatcaaa

SEQ ID NO: 6441864 - DNA, 16 bp, Homo sapiens
tcttcaatggcacctt

SEQ ID NO: 6441865 - DNA, 23 bp, Homo sapiens
tcttcaattaatggaaaactgtt

SEQ ID NO: 6441866 - DNA, 18 bp, Homo sapiens
tcttcaatttattactga

SEQ ID NO: 6441867 - DNA, 22 bp, Homo sapiens
tcttcaatttgttaacagagca

SEQ ID NO: 6441868 - DNA, 14 bp, Homo sapiens
tcttcacaacctcc

SEQ ID NO: 6441869 - DNA, 22 bp, Homo sapiens
tcttcacaatggtgctcatttc

SEQ ID NO: 6441870 - DNA, 16 bp, Homo sapiens
tcttcacactgcgcag

SEQ ID NO: 6441871 - DNA, 14 bp, Homo sapiens
tcttcacatgtaac

SEQ ID NO: 6441872 - DNA, 16 bp, Homo sapiens
tcttcaccaaatcttg

SEQ ID NO: 6441873 - DNA, 18 bp, Homo sapiens
tcttcaccaagtgcaata

SEQ ID NO: 6441874 - DNA, 13 bp, Homo sapiens
tcttcaccactgt

SEQ ID NO: 6441875 - DNA, 13 bp, Homo sapiens
tcttcaccaggtg

SEQ ID NO: 6441876 - DNA, 19 bp, Homo sapiens
tcttcacccaccccatgga

SEQ ID NO: 6441877 - DNA, 19 bp, Homo sapiens
tcttcacccagctaatctg

SEQ ID NO: 6441878 - DNA, 19 bp, Homo sapiens
tcttcacccaggcctatgt

SEQ ID NO: 6441879 - DNA, 11 bp, Homo sapiens
tcttcaccccg

SEQ ID NO: 6441880 - DNA, 15 bp, Homo sapiens
tcttcaccccggcag

SEQ ID NO: 6441881 - DNA, 17 bp, Homo sapiens
tcttcaccccggcaggc

SEQ ID NO: 6441882 - DNA, 23 bp, Homo sapiens
tcttcaccccggcaggccctgca

SEQ ID NO: 6441883 - DNA, 16 bp, Homo sapiens
tcttcaccctcccctt

SEQ ID NO: 6441884 - DNA, 15 bp, Homo sapiens
tcttcacctcagagt

SEQ ID NO: 6441885 - DNA, 16 bp, Homo sapiens
tcttcacctctatcca

SEQ ID NO: 6441886 - DNA, 21 bp, Homo sapiens
tcttcacctgattcaactaaa

SEQ ID NO: 6441887 - DNA, 18 bp, Homo sapiens
tcttcacctgccaccaca

SEQ ID NO: 6441888 - DNA, 20 bp, Homo sapiens
tcttcacctgccaccacaca

SEQ ID NO: 6441889 - DNA, 12 bp, Homo sapiens
tcttcacctgtt

SEQ ID NO: 6441890 - DNA, 15 bp, Homo sapiens
tcttcacctgttatg

SEQ ID NO: 6441891 - DNA, 19 bp, Homo sapiens
tcttcaccttggtttatga

SEQ ID NO: 6441892 - DNA, 15 bp, Homo sapiens
tcttcacgcctgggt

SEQ ID NO: 6441893 - DNA, 13 bp, Homo sapiens
tcttcactcacag

SEQ ID NO: 6441894 - DNA, 12 bp, Homo sapiens
tcttcactcagc

SEQ ID NO: 6441895 - DNA, 20 bp, Homo sapiens
tcttcactcaggtctcagct

SEQ ID NO: 6441896 - DNA, 14 bp, Homo sapiens
tcttcactctggct

SEQ ID NO: 6441897 - DNA, 15 bp, Homo sapiens
tcttcactcttaggc

SEQ ID NO: 6441898 - DNA, 15 bp, Homo sapiens
tcttcactgaatatc

SEQ ID NO: 6441899 - DNA, 15 bp, Homo sapiens
tcttcactgcaattt

SEQ ID NO: 6441900 - DNA, 20 bp, Homo sapiens
tcttcactgccatgcctcaa

SEQ ID NO: 6441901 - DNA, 22 bp, Homo sapiens
tcttcactgtcttactcaagat

SEQ ID NO: 6441902 - DNA, 14 bp, Homo sapiens
tcttcactgtggcc

SEQ ID NO: 6441903 - DNA, 20 bp, Homo sapiens
tcttcactgtggccacagcc

SEQ ID NO: 6441904 - DNA, 17 bp, Homo sapiens
tcttcacttcaagctgt

SEQ ID NO: 6441905 - DNA, 12 bp, Homo sapiens
tcttcacttcct

SEQ ID NO: 6441906 - DNA, 16 bp, Homo sapiens
tcttcacttcctccag

SEQ ID NO: 6441907 - DNA, 16 bp, Homo sapiens
tcttcacttctgggaa

SEQ ID NO: 6441908 - DNA, 23 bp, Homo sapiens
tcttcagaaagtgtgctttatgc

SEQ ID NO: 6441909 - DNA, 22 bp, Homo sapiens
tcttcagaacacacagactttc

SEQ ID NO: 6441910 - DNA, 20 bp, Homo sapiens
tcttcagaactgcccttgct

SEQ ID NO: 6441911 - DNA, 22 bp, Homo sapiens
tcttcagaactgcccttgctgc

SEQ ID NO: 6441912 - DNA, 23 bp, Homo sapiens
tcttcagaactgcccttgctgcc

SEQ ID NO: 6441913 - DNA, 12 bp, Homo sapiens
tcttcagaactt

SEQ ID NO: 6441914 - DNA, 20 bp, Homo sapiens
tcttcagagactcctgcagg

SEQ ID NO: 6441915 - DNA, 13 bp, Homo sapiens
tcttcagagatca

SEQ ID NO: 6441916 - DNA, 18 bp, Homo sapiens
tcttcagagatcatggaa

SEQ ID NO: 6441917 - DNA, 12 bp, Homo sapiens
tcttcagagctg

SEQ ID NO: 6441918 - DNA, 13 bp, Homo sapiens
tcttcagagctga

SEQ ID NO: 6441919 - DNA, 21 bp, Homo sapiens
tcttcagaggtgctaaattgt

SEQ ID NO: 6441920 - DNA, 22 bp, Homo sapiens
tcttcagaggtgctaaattgtc

SEQ ID NO: 6441921 - DNA, 19 bp, Homo sapiens
tcttcagatacaaactgca

SEQ ID NO: 6441922 - DNA, 16 bp, Homo sapiens
tcttcagatcctgctg

SEQ ID NO: 6441923 - DNA, 18 bp, Homo sapiens
tcttcagatcctgctgcc

SEQ ID NO: 6441924 - DNA, 22 bp, Homo sapiens
tcttcagcaaaaatattttatg

SEQ ID NO: 6441925 - DNA, 23 bp, Homo sapiens
tcttcagcaaaaatattttatga

SEQ ID NO: 6441926 - DNA, 18 bp, Homo sapiens
tcttcagcagcatctact

SEQ ID NO: 6441927 - DNA, 19 bp, Homo sapiens
tcttcagcagcatctactc

SEQ ID NO: 6441928 - DNA, 19 bp, Homo sapiens
tcttcagccacctctcttt

SEQ ID NO: 6441929 - DNA, 21 bp, Homo sapiens
tcttcagcctagccgacctca

SEQ ID NO: 6441930 - DNA, 14 bp, Homo sapiens
tcttcagcctccct

SEQ ID NO: 6441931 - DNA, 17 bp, Homo sapiens
tcttcagcctccctcag

SEQ ID NO: 6441932 - DNA, 18 bp, Homo sapiens
tcttcagcctccctcagc

SEQ ID NO: 6441933 - DNA, 19 bp, Homo sapiens
tcttcagcctccctcagcc

SEQ ID NO: 6441934 - DNA, 19 bp, Homo sapiens
tcttcagcgtaaaatggtg

SEQ ID NO: 6441935 - DNA, 15 bp, Homo sapiens
tcttcagctcccata

SEQ ID NO: 6441936 - DNA, 13 bp, Homo sapiens
tcttcagctggga

SEQ ID NO: 6441937 - DNA, 21 bp, Homo sapiens
tcttcagctgtttcgcatcca

SEQ ID NO: 6441938 - DNA, 13 bp, Homo sapiens
tcttcagcttctt

SEQ ID NO: 6441939 - DNA, 16 bp, Homo sapiens
tcttcagcttcttcat

SEQ ID NO: 6441940 - DNA, 19 bp, Homo sapiens
tcttcaggaaaataaatat

SEQ ID NO: 6441941 - DNA, 20 bp, Homo sapiens
tcttcaggaaaataaatatc

SEQ ID NO: 6441942 - DNA, 14 bp, Homo sapiens
tcttcaggagaatg

SEQ ID NO: 6441943 - DNA, 13 bp, Homo sapiens
tcttcaggaggcc

SEQ ID NO: 6441944 - DNA, 20 bp, Homo sapiens
tcttcaggaggccctggtgt

SEQ ID NO: 6441945 - DNA, 14 bp, Homo sapiens
tcttcaggcctccc

SEQ ID NO: 6441946 - DNA, 18 bp, Homo sapiens
tcttcaggcctccctctc

SEQ ID NO: 6441947 - DNA, 18 bp, Homo sapiens
tcttcaggctctgcccag

SEQ ID NO: 6441948 - DNA, 16 bp, Homo sapiens
tcttcagggccagtcc

SEQ ID NO: 6441949 - DNA, 23 bp, Homo sapiens
tcttcagggcctggttgaagaag

SEQ ID NO: 6441950 - DNA, 18 bp, Homo sapiens
tcttcaggggtcacctcc

SEQ ID NO: 6441951 - DNA, 21 bp, Homo sapiens
tcttcagggtcctgagattta

SEQ ID NO: 6441952 - DNA, 17 bp, Homo sapiens
tcttcagggtgagtgaa

SEQ ID NO: 6441953 - DNA, 19 bp, Homo sapiens
tcttcaggtcgtagcattt

SEQ ID NO: 6441954 - DNA, 22 bp, Homo sapiens
tcttcaggtgaaaaaggcaagc

SEQ ID NO: 6441955 - DNA, 16 bp, Homo sapiens
tcttcaggtggaaaaa

SEQ ID NO: 6441956 - DNA, 15 bp, Homo sapiens
tcttcagtaagccgt

SEQ ID NO: 6441957 - DNA, 15 bp, Homo sapiens
tcttcagtcctttgt

SEQ ID NO: 6441958 - DNA, 22 bp, Homo sapiens
tcttcagtctggactatattgg

SEQ ID NO: 6441959 - DNA, 19 bp, Homo sapiens
tcttcagtgcaaattgtat

SEQ ID NO: 6441960 - DNA, 19 bp, Homo sapiens
tcttcagtggaacacaaat

SEQ ID NO: 6441961 - DNA, 19 bp, Homo sapiens
tcttcagtgtaatgtgact

SEQ ID NO: 6441962 - DNA, 16 bp, Homo sapiens
tcttcagtgtctctgt

SEQ ID NO: 6441963 - DNA, 22 bp, Homo sapiens
tcttcagtgtgttgacttctat

SEQ ID NO: 6441964 - DNA, 19 bp, Homo sapiens
tcttcagttaagcctttgg

SEQ ID NO: 6441965 - DNA, 13 bp, Homo sapiens
tcttcagttaatt

SEQ ID NO: 6441966 - DNA, 22 bp, Homo sapiens
tcttcagttggttgtgtctttt

SEQ ID NO: 6441967 - DNA, 16 bp, Homo sapiens
tcttcagttgtctctg

SEQ ID NO: 6441968 - DNA, 16 bp, Homo sapiens
tcttcagtttaatgca

SEQ ID NO: 6441969 - DNA, 17 bp, Homo sapiens
tcttcataataaacctt

SEQ ID NO: 6441970 - DNA, 15 bp, Homo sapiens
tcttcatactttttt

SEQ ID NO: 6441971 - DNA, 22 bp, Homo sapiens
tcttcatactttttttcacagt

SEQ ID NO: 6441972 - DNA, 22 bp, Homo sapiens
tcttcatagggacctttaaaaa

SEQ ID NO: 6441973 - DNA, 14 bp, Homo sapiens
tcttcatatttttg

SEQ ID NO: 6441974 - DNA, 18 bp, Homo sapiens
tcttcatcacttcttcca

SEQ ID NO: 6441975 - DNA, 23 bp, Homo sapiens
tcttcatcacttcttccactgtg

SEQ ID NO: 6441976 - DNA, 23 bp, Homo sapiens
tcttcatcagcatttaataaatg

SEQ ID NO: 6441977 - DNA, 15 bp, Homo sapiens
tcttcatccatagac

SEQ ID NO: 6441978 - DNA, 16 bp, Homo sapiens
tcttcatcccattcca

SEQ ID NO: 6441979 - DNA, 21 bp, Homo sapiens
tcttcatccttagcaacagcc

SEQ ID NO: 6441980 - DNA, 18 bp, Homo sapiens
tcttcatctccctgccat

SEQ ID NO: 6441981 - DNA, 21 bp, Homo sapiens
tcttcatctccctgccatccc

SEQ ID NO: 6441982 - DNA, 14 bp, Homo sapiens
tcttcatctgccca

SEQ ID NO: 6441983 - DNA, 15 bp, Homo sapiens
tcttcatctgcctgc

SEQ ID NO: 6441984 - DNA, 14 bp, Homo sapiens
tcttcatgaaatgc

SEQ ID NO: 6441985 - DNA, 16 bp, Homo sapiens
tcttcatgaaatgcta

SEQ ID NO: 6441986 - DNA, 17 bp, Homo sapiens
tcttcatgaaatgtgtt

SEQ ID NO: 6441987 - DNA, 20 bp, Homo sapiens
tcttcatgagtagtgggcta

SEQ ID NO: 6441988 - DNA, 18 bp, Homo sapiens
tcttcatgcctgatgaaa

SEQ ID NO: 6441989 - DNA, 22 bp, Homo sapiens
tcttcatggaattcacaaagta

SEQ ID NO: 6441990 - DNA, 21 bp, Homo sapiens
tcttcatggcatcttcaatat

SEQ ID NO: 6441991 - DNA, 20 bp, Homo sapiens
tcttcatgtaaattgactgt

SEQ ID NO: 6441992 - DNA, 17 bp, Homo sapiens
tcttcatgtccagtgag

SEQ ID NO: 6441993 - DNA, 19 bp, Homo sapiens
tcttcatgtctattccatt

SEQ ID NO: 6441994 - DNA, 19 bp, Homo sapiens
tcttcatgtgatgtcatga

SEQ ID NO: 6441995 - DNA, 16 bp, Homo sapiens
tcttcatgttcaatta

SEQ ID NO: 6441996 - DNA, 19 bp, Homo sapiens
tcttcatgttcccacttca

SEQ ID NO: 6441997 - DNA, 22 bp, Homo sapiens
tcttcattaagccctcttccat

SEQ ID NO: 6441998 - DNA, 19 bp, Homo sapiens
tcttcattcccactgcact

SEQ ID NO: 6441999 - DNA, 22 bp, Homo sapiens
tcttcattggctatataaaatg

SEQ ID NO: 6442000 - DNA, 12 bp, Homo sapiens
tcttcattgtaa

SEQ ID NO: 6442001 - DNA, 14 bp, Homo sapiens
tcttcatttcattg

SEQ ID NO: 6442002 - DNA, 20 bp, Homo sapiens
tcttcatttgaatgtcttct

SEQ ID NO: 6442003 - DNA, 20 bp, Homo sapiens
tcttcattttggtttatttt

SEQ ID NO: 6442004 - DNA, 22 bp, Homo sapiens
tcttcattttttaatgtgctct

SEQ ID NO: 6442005 - DNA, 18 bp, Homo sapiens
tcttccaaaggcagcgtg

SEQ ID NO: 6442006 - DNA, 19 bp, Homo sapiens
tcttccaaaggcagcgtgc

SEQ ID NO: 6442007 - DNA, 17 bp, Homo sapiens
tcttccaaccccagctg

SEQ ID NO: 6442008 - DNA, 21 bp, Homo sapiens
tcttccaagactccagccctg

SEQ ID NO: 6442009 - DNA, 18 bp, Homo sapiens
tcttccaagcaaaggtga

SEQ ID NO: 6442010 - DNA, 17 bp, Homo sapiens
tcttccaaggtagctct

SEQ ID NO: 6442011 - DNA, 22 bp, Homo sapiens
tcttccaatgatgcttactaca

SEQ ID NO: 6442012 - DNA, 21 bp, Homo sapiens
tcttccaatttagttgttgta

SEQ ID NO: 6442013 - DNA, 20 bp, Homo sapiens
tcttccacaaaaaatacttt

SEQ ID NO: 6442014 - DNA, 17 bp, Homo sapiens
tcttccacaaagaaaat

SEQ ID NO: 6442015 - DNA, 21 bp, Homo sapiens
tcttccacaagagcccaggcc

SEQ ID NO: 6442016 - DNA, 16 bp, Homo sapiens
tcatttcaaaatatgt

SEQ ID NO: 6442017 - DNA, 18 bp, Homo sapiens
tcatttcaaaatgcttca

SEQ ID NO: 6442018 - DNA, 20 bp, Homo sapiens
tcatttcaagttatgattca

SEQ ID NO: 6442019 - DNA, 15 bp, Homo sapiens
tcatttcaatcattg

SEQ ID NO: 6442020 - DNA, 12 bp, Homo sapiens
tcatttcaattt

SEQ ID NO: 6442021 - DNA, 18 bp, Homo sapiens
tcatttcacctgctgctt

SEQ ID NO: 6442022 - DNA, 21 bp, Homo sapiens
tcatttcactgtagctctaaa

SEQ ID NO: 6442023 - DNA, 14 bp, Homo sapiens
tcatttcactgtct

SEQ ID NO: 6442024 - DNA, 18 bp, Homo sapiens
tcatttcactttaaagtc

SEQ ID NO: 6442025 - DNA, 15 bp, Homo sapiens
tcatttcagccaaag

SEQ ID NO: 6442026 - DNA, 20 bp, Homo sapiens
tcatttcagtatcatctcca

SEQ ID NO: 6442027 - DNA, 13 bp, Homo sapiens
tcatttcataaaa

SEQ ID NO: 6442028 - DNA, 20 bp, Homo sapiens
tcatttcatacaaattttcc

SEQ ID NO: 6442029 - DNA, 15 bp, Homo sapiens
tcatttcatgaaaat

SEQ ID NO: 6442030 - DNA, 15 bp, Homo sapiens
tcatttcatgtcctg

SEQ ID NO: 6442031 - DNA, 14 bp, Homo sapiens
tcatttcattattt

SEQ ID NO: 6442032 - DNA, 21 bp, Homo sapiens
tcatttcattatttttcaatt

SEQ ID NO: 6442033 - DNA, 14 bp, Homo sapiens
tcatttcattccat

SEQ ID NO: 6442034 - DNA, 15 bp, Homo sapiens
tcatttcatttccta

SEQ ID NO: 6442035 - DNA, 19 bp, Homo sapiens
tcatttccaaattcctaga

SEQ ID NO: 6442036 - DNA, 16 bp, Homo sapiens
tcatttccaagcaagt

SEQ ID NO: 6442037 - DNA, 12 bp, Homo sapiens
tcatttccagca

SEQ ID NO: 6442038 - DNA, 20 bp, Homo sapiens
tcatttccagcaaaatatat

SEQ ID NO: 6442039 - DNA, 21 bp, Homo sapiens
tcatttccagcaaaatatatg

SEQ ID NO: 6442040 - DNA, 23 bp, Homo sapiens
tcatttccagcaaaatatatgtt

SEQ ID NO: 6442041 - DNA, 21 bp, Homo sapiens
tcatttccatgtatgcataat

SEQ ID NO: 6442042 - DNA, 18 bp, Homo sapiens
tcatttcccctcccgctt

SEQ ID NO: 6442043 - DNA, 20 bp, Homo sapiens
tcatttcccctcccgcttcc

SEQ ID NO: 6442044 - DNA, 22 bp, Homo sapiens
tcatttcccctcccgcttcctc

SEQ ID NO: 6442045 - DNA, 19 bp, Homo sapiens
tcatttcccctcccgtctt

SEQ ID NO: 6442046 - DNA, 17 bp, Homo sapiens
tcatttccctatcttct

SEQ ID NO: 6442047 - DNA, 19 bp, Homo sapiens
tcatttccgtcccccccca

SEQ ID NO: 6442048 - DNA, 20 bp, Homo sapiens
tcatttcctctgagctgtta

SEQ ID NO: 6442049 - DNA, 23 bp, Homo sapiens
tcatttcctgcccttcctcagtt

SEQ ID NO: 6442050 - DNA, 13 bp, Homo sapiens
tcatttcctgtgt

SEQ ID NO: 6442051 - DNA, 21 bp, Homo sapiens
tcatttcgggtgaatctgtct

SEQ ID NO: 6442052 - DNA, 22 bp, Homo sapiens
tcatttcgttccctgattattt

SEQ ID NO: 6442053 - DNA, 22 bp, Homo sapiens
tcatttctaattttaagttatt

SEQ ID NO: 6442054 - DNA, 14 bp, Homo sapiens
tcatttctactgaa

SEQ ID NO: 6442055 - DNA, 19 bp, Homo sapiens
tcatttctactgtgactga

SEQ ID NO: 6442056 - DNA, 15 bp, Homo sapiens
tcatttctagagaaa

SEQ ID NO: 6442057 - DNA, 21 bp, Homo sapiens
tcatttctatattcctccagc

SEQ ID NO: 6442058 - DNA, 22 bp, Homo sapiens
tcatttctatattcctccagct

SEQ ID NO: 6442059 - DNA, 13 bp, Homo sapiens
tcatttctatttc

SEQ ID NO: 6442060 - DNA, 24 bp, Homo sapiens
tcatttctcactgtgtacataatg

SEQ ID NO: 6442061 - DNA, 12 bp, Homo sapiens
tcatttctctgc

SEQ ID NO: 6442062 - DNA, 15 bp, Homo sapiens
tcatttctctttttt

SEQ ID NO: 6442063 - DNA, 16 bp, Homo sapiens
tcatttctgcatcagc

SEQ ID NO: 6442064 - DNA, 16 bp, Homo sapiens
tcatttctgccatgat

SEQ ID NO: 6442065 - DNA, 13 bp, Homo sapiens
tcatttctgtctc

SEQ ID NO: 6442066 - DNA, 14 bp, Homo sapiens
tcatttctgtctcc

SEQ ID NO: 6442067 - DNA, 16 bp, Homo sapiens
tcatttctttcaagac

SEQ ID NO: 6442068 - DNA, 23 bp, Homo sapiens
tcatttctttgtctttttcctac

SEQ ID NO: 6442069 - DNA, 23 bp, Homo sapiens
tcatttctttttgggagagactt

SEQ ID NO: 6442070 - DNA, 14 bp, Homo sapiens
tcatttgaaatgtt

SEQ ID NO: 6442071 - DNA, 17 bp, Homo sapiens
tcatttgacacaaagct

SEQ ID NO: 6442072 - DNA, 19 bp, Homo sapiens
tcatttgactgtctcactt

SEQ ID NO: 6442073 - DNA, 22 bp, Homo sapiens
tcatttgactgtctcacttttt

SEQ ID NO: 6442074 - DNA, 22 bp, Homo sapiens
tcatttgagctcatgagggccc

SEQ ID NO: 6442075 - DNA, 15 bp, Homo sapiens
tcatttgaggaagct

SEQ ID NO: 6442076 - DNA, 18 bp, Homo sapiens
tcatttgaggccaggagt

SEQ ID NO: 6442077 - DNA, 15 bp, Homo sapiens
tcatttgagtctctt

SEQ ID NO: 6442078 - DNA, 16 bp, Homo sapiens
tcatttgagtctctta

SEQ ID NO: 6442079 - DNA, 16 bp, Homo sapiens
tcatttgcaagctgag

SEQ ID NO: 6442080 - DNA, 18 bp, Homo sapiens
tcatttgcaattcatgta

SEQ ID NO: 6442081 - DNA, 15 bp, Homo sapiens
tcatttgcagctgct

SEQ ID NO: 6442082 - DNA, 16 bp, Homo sapiens
tcatttgcagctgctg

SEQ ID NO: 6442083 - DNA, 12 bp, Homo sapiens
tcatttgcatat

SEQ ID NO: 6442084 - DNA, 19 bp, Homo sapiens
tcatttgccaactaatttt

SEQ ID NO: 6442085 - DNA, 14 bp, Homo sapiens
tcatttgctaatga

SEQ ID NO: 6442086 - DNA, 16 bp, Homo sapiens
tcatttgctaatgaat

SEQ ID NO: 6442087 - DNA, 21 bp, Homo sapiens
tcatttgctgaccggaatggt

SEQ ID NO: 6442088 - DNA, 16 bp, Homo sapiens
tcatttgctgttcatc

SEQ ID NO: 6442089 - DNA, 21 bp, Homo sapiens
tcatttgcttcaggagtttca

SEQ ID NO: 6442090 - DNA, 20 bp, Homo sapiens
tcatttgcttgcaatctaat

SEQ ID NO: 6442091 - DNA, 14 bp, Homo sapiens
tcatttgctttgga

SEQ ID NO: 6442092 - DNA, 18 bp, Homo sapiens
tcatttgcttttgtcact

SEQ ID NO: 6442093 - DNA, 23 bp, Homo sapiens
tcatttggaggaaaaaaagcatg

SEQ ID NO: 6442094 - DNA, 18 bp, Homo sapiens
tcatttggatataaatct

SEQ ID NO: 6442095 - DNA, 16 bp, Homo sapiens
tcatttggcttgctgt

SEQ ID NO: 6442096 - DNA, 17 bp, Homo sapiens
tcatttggcttgctgtt

SEQ ID NO: 6442097 - DNA, 19 bp, Homo sapiens
tcatttggcttgctgttta

SEQ ID NO: 6442098 - DNA, 21 bp, Homo sapiens
tcatttggcttgctgtttact

SEQ ID NO: 6442099 - DNA, 22 bp, Homo sapiens
tcatttggggaccacagaggct

SEQ ID NO: 6442100 - DNA, 19 bp, Homo sapiens
tcatttggggcatttgtaa

SEQ ID NO: 6442101 - DNA, 23 bp, Homo sapiens
tcatttggggtagctagaggaac

SEQ ID NO: 6442102 - DNA, 19 bp, Homo sapiens
tcatttggtgttcctggaa

SEQ ID NO: 6442103 - DNA, 18 bp, Homo sapiens
tcatttggttcaggcata

SEQ ID NO: 6442104 - DNA, 15 bp, Homo sapiens
tcatttgtaaaaatg

SEQ ID NO: 6442105 - DNA, 12 bp, Homo sapiens
tcatttgtacaa

SEQ ID NO: 6442106 - DNA, 13 bp, Homo sapiens
tcatttgtacaag

SEQ ID NO: 6442107 - DNA, 23 bp, Homo sapiens
tcatttgtacaaggtaattgttt

SEQ ID NO: 6442108 - DNA, 19 bp, Homo sapiens
tcatttgtagatatatatt

SEQ ID NO: 6442109 - DNA, 20 bp, Homo sapiens
tcatttgtagatatatattt

SEQ ID NO: 6442110 - DNA, 23 bp, Homo sapiens
tcatttgtataagtccatgaatg

SEQ ID NO: 6442111 - DNA, 16 bp, Homo sapiens
tcatttgtattccatt

SEQ ID NO: 6442112 - DNA, 16 bp, Homo sapiens
tcatttgtcacacact

SEQ ID NO: 6442113 - DNA, 14 bp, Homo sapiens
tcatttgtgaagaa

SEQ ID NO: 6442114 - DNA, 13 bp, Homo sapiens
tcatttgtgccac

SEQ ID NO: 6442115 - DNA, 23 bp, Homo sapiens
tcatttgtgggtttttatttcct

SEQ ID NO: 6442116 - DNA, 21 bp, Homo sapiens
tcatttgtggtgatatagaat

SEQ ID NO: 6442117 - DNA, 12 bp, Homo sapiens
tcatttgttgtg

SEQ ID NO: 6442118 - DNA, 21 bp, Homo sapiens
tcatttgtttaaaaaggcagt

SEQ ID NO: 6442119 - DNA, 15 bp, Homo sapiens
tcatttgtttacatt

SEQ ID NO: 6442120 - DNA, 17 bp, Homo sapiens
tcatttgttttgctttt

SEQ ID NO: 6442121 - DNA, 13 bp, Homo sapiens
tcattttaaaaag

SEQ ID NO: 6442122 - DNA, 15 bp, Homo sapiens
tcattttaaaatctg

SEQ ID NO: 6442123 - DNA, 21 bp, Homo sapiens
tcattttaaaatctgatttaa

SEQ ID NO: 6442124 - DNA, 14 bp, Homo sapiens
tcattttaaacaac

SEQ ID NO: 6442125 - DNA, 21 bp, Homo sapiens
tcattttaaacaactttccac

SEQ ID NO: 6442126 - DNA, 21 bp, Homo sapiens
tcattttaaactcctgaaatt

SEQ ID NO: 6442127 - DNA, 12 bp, Homo sapiens
tcattttaagta

SEQ ID NO: 6442128 - DNA, 12 bp, Homo sapiens
tcattttaatat

SEQ ID NO: 6442129 - DNA, 17 bp, Homo sapiens
tcattttaatgtaaaga

SEQ ID NO: 6442130 - DNA, 14 bp, Homo sapiens
tcattttacagtta

SEQ ID NO: 6442131 - DNA, 19 bp, Homo sapiens
tcattttacagttactttt

SEQ ID NO: 6442132 - DNA, 22 bp, Homo sapiens
tcattttacagttacttttcct

SEQ ID NO: 6442133 - DNA, 15 bp, Homo sapiens
tcattttactaaaat

SEQ ID NO: 6442134 - DNA, 14 bp, Homo sapiens
tcattttactggta

SEQ ID NO: 6442135 - DNA, 14 bp, Homo sapiens
tcattttagtgact

SEQ ID NO: 6442136 - DNA, 16 bp, Homo sapiens
tcattttagtgactgt

SEQ ID NO: 6442137 - DNA, 20 bp, Homo sapiens
tcattttagtgtatctttaa

SEQ ID NO: 6442138 - DNA, 14 bp, Homo sapiens
tcattttatagaaa

SEQ ID NO: 6442139 - DNA, 15 bp, Homo sapiens
tcattttatagaaaa

SEQ ID NO: 6442140 - DNA, 20 bp, Homo sapiens
tcattttatataaagaaaat

SEQ ID NO: 6442141 - DNA, 16 bp, Homo sapiens
tcattttatattgaaa

SEQ ID NO: 6442142 - DNA, 23 bp, Homo sapiens
tcattttatcaggggaatttcag

SEQ ID NO: 6442143 - DNA, 12 bp, Homo sapiens
tcattttattca

SEQ ID NO: 6442144 - DNA, 14 bp, Homo sapiens
tcattttattcaca

SEQ ID NO: 6442145 - DNA, 16 bp, Homo sapiens
tcattttattcacata

SEQ ID NO: 6442146 - DNA, 17 bp, Homo sapiens
tcattttattttgtaat

SEQ ID NO: 6442147 - DNA, 13 bp, Homo sapiens
tcattttcagagt

SEQ ID NO: 6442148 - DNA, 18 bp, Homo sapiens
tcattttcagatccttcc

SEQ ID NO: 6442149 - DNA, 16 bp, Homo sapiens
tcattttcatctcatt

SEQ ID NO: 6442150 - DNA, 11 bp, Homo sapiens
tcattttcatt

SEQ ID NO: 6442151 - DNA, 14 bp, Homo sapiens
tcattttcattaaa

SEQ ID NO: 6442152 - DNA, 17 bp, Homo sapiens
tcattttcattagcaaa

SEQ ID NO: 6442153 - DNA, 14 bp, Homo sapiens
tcattttccaatta

SEQ ID NO: 6442154 - DNA, 15 bp, Homo sapiens
tcattttccccccac

SEQ ID NO: 6442155 - DNA, 19 bp, Homo sapiens
tcattttccccccactctc

SEQ ID NO: 6442156 - DNA, 13 bp, Homo sapiens
tcattttcctggg

SEQ ID NO: 6442157 - DNA, 13 bp, Homo sapiens
tcattttcctttc

SEQ ID NO: 6442158 - DNA, 14 bp, Homo sapiens
tcattttctagata

SEQ ID NO: 6442159 - DNA, 23 bp, Homo sapiens
tcattttctagatacaataaatt

SEQ ID NO: 6442160 - DNA, 16 bp, Homo sapiens
tcattttctataacag

SEQ ID NO: 6442161 - DNA, 15 bp, Homo sapiens
tcattttctccacct

SEQ ID NO: 6442162 - DNA, 11 bp, Homo sapiens
tcattttctct

SEQ ID NO: 6442163 - DNA, 16 bp, Homo sapiens
tcattttctctaatat

SEQ ID NO: 6442164 - DNA, 22 bp, Homo sapiens
tcattttctgacatgcattgtt

SEQ ID NO: 6442165 - DNA, 17 bp, Homo sapiens
tcattttctgatgccca

SEQ ID NO: 6442166 - DNA, 14 bp, Homo sapiens
tcattttctgcaag

SEQ ID NO: 6442167 - DNA, 20 bp, Homo sapiens
tcattttctgttatacacag

SEQ ID NO: 6442168 - DNA, 21 bp, Homo sapiens
tcattttcttatcttctgcaa

SEQ ID NO: 6442169 - DNA, 13 bp, Homo sapiens
tcattttctttcc

SEQ ID NO: 6442170 - DNA, 15 bp, Homo sapiens
tcattttctttcctt

SEQ ID NO: 6442171 - DNA, 18 bp, Homo sapiens
tcattttctttcctttcc

SEQ ID NO: 6442172 - DNA, 17 bp, Homo sapiens
tcattttgaagctaatt

SEQ ID NO: 6442173 - DNA, 13 bp, Homo sapiens
tcattttgagaac

SEQ ID NO: 6442174 - DNA, 12 bp, Homo sapiens
tcattttgaggg

SEQ ID NO: 6442175 - DNA, 20 bp, Homo sapiens
tcattttgagtttgcctcag

SEQ ID NO: 6442176 - DNA, 12 bp, Homo sapiens
tcattttgcaac

SEQ ID NO: 6442177 - DNA, 11 bp, Homo sapiens
tcattttgcac

SEQ ID NO: 6442178 - DNA, 22 bp, Homo sapiens
tcattttgcacctgcagccaag

SEQ ID NO: 6442179 - DNA, 24 bp, Homo sapiens
tcattttgcacctgcagccaagca

SEQ ID NO: 6442180 - DNA, 13 bp, Homo sapiens
tcattttgcacgt

SEQ ID NO: 6442181 - DNA, 14 bp, Homo sapiens
tcattttgcactgt

SEQ ID NO: 6442182 - DNA, 13 bp, Homo sapiens
tcattttgcagaa

SEQ ID NO: 6442183 - DNA, 16 bp, Homo sapiens
tcattttgcagaagga

SEQ ID NO: 6442184 - DNA, 20 bp, Homo sapiens
tcattttgcagaaggaaatg

SEQ ID NO: 6442185 - DNA, 22 bp, Homo sapiens
tcattttgcagaaggaaatgat

SEQ ID NO: 6442186 - DNA, 17 bp, Homo sapiens
tcattttgcctgagtgt

SEQ ID NO: 6442187 - DNA, 17 bp, Homo sapiens
tcattttgcttcatagc

SEQ ID NO: 6442188 - DNA, 12 bp, Homo sapiens
tcattttgcttt

SEQ ID NO: 6442189 - DNA, 18 bp, Homo sapiens
tcattttggcaagaagac

SEQ ID NO: 6442190 - DNA, 23 bp, Homo sapiens
tcattttgggacaattgttttaa

SEQ ID NO: 6442191 - DNA, 14 bp, Homo sapiens
tcattttggtactt

SEQ ID NO: 6442192 - DNA, 12 bp, Homo sapiens
tcattttgtaat

SEQ ID NO: 6442193 - DNA, 20 bp, Homo sapiens
tcattttgtatgtatgtgta

SEQ ID NO: 6442194 - DNA, 20 bp, Homo sapiens
tcattttgtccatgtccccc

SEQ ID NO: 6442195 - DNA, 22 bp, Homo sapiens
tcattttgtctctctcacatta

SEQ ID NO: 6442196 - DNA, 14 bp, Homo sapiens
tcttccacagtggc

SEQ ID NO: 6442197 - DNA, 23 bp, Homo sapiens
tcttccacagtggcgggcccact

SEQ ID NO: 6442198 - DNA, 14 bp, Homo sapiens
tcttccaccagagc

SEQ ID NO: 6442199 - DNA, 14 bp, Homo sapiens
tcttccacccacaa

SEQ ID NO: 6442200 - DNA, 23 bp, Homo sapiens
tcttccacccacaaactccaggc

SEQ ID NO: 6442201 - DNA, 14 bp, Homo sapiens
tcttccacctctgg

SEQ ID NO: 6442202 - DNA, 14 bp, Homo sapiens
tcttccacctggaa

SEQ ID NO: 6442203 - DNA, 21 bp, Homo sapiens
tcttccactccttctctcact

SEQ ID NO: 6442204 - DNA, 12 bp, Homo sapiens
tcttccagaaag

SEQ ID NO: 6442205 - DNA, 18 bp, Homo sapiens
tcttccagaagtgtgatt

SEQ ID NO: 6442206 - DNA, 12 bp, Homo sapiens
tcttccagacct

SEQ ID NO: 6442207 - DNA, 14 bp, Homo sapiens
tcttccagacctgc

SEQ ID NO: 6442208 - DNA, 19 bp, Homo sapiens
tcttccagagcctaagaaa

SEQ ID NO: 6442209 - DNA, 20 bp, Homo sapiens
tcttccagctgcttcaggga

SEQ ID NO: 6442210 - DNA, 20 bp, Homo sapiens
tcttccaggaagcacaggcc

SEQ ID NO: 6442211 - DNA, 22 bp, Homo sapiens
tcttccaggaagcacaggccag

SEQ ID NO: 6442212 - DNA, 20 bp, Homo sapiens
tcttccaggactctctgctt

SEQ ID NO: 6442213 - DNA, 13 bp, Homo sapiens
tcttccaggatgg

SEQ ID NO: 6442214 - DNA, 13 bp, Homo sapiens
tcttccaggcagc

SEQ ID NO: 6442215 - DNA, 23 bp, Homo sapiens
tcttccaggcccagtccactggg

SEQ ID NO: 6442216 - DNA, 17 bp, Homo sapiens
tcttccaggctgggaga

SEQ ID NO: 6442217 - DNA, 15 bp, Homo sapiens
tcttccaggtgccca

SEQ ID NO: 6442218 - DNA, 18 bp, Homo sapiens
tcttccagtgatgttgaa

SEQ ID NO: 6442219 - DNA, 18 bp, Homo sapiens
tcttccagtgcaacaaaa

SEQ ID NO: 6442220 - DNA, 17 bp, Homo sapiens
tcttccatcagcagtga

SEQ ID NO: 6442221 - DNA, 18 bp, Homo sapiens
tcttccatcagcagtgat

SEQ ID NO: 6442222 - DNA, 20 bp, Homo sapiens
tcttccatcatcactgtaaa

SEQ ID NO: 6442223 - DNA, 13 bp, Homo sapiens
tcttccatcatgg

SEQ ID NO: 6442224 - DNA, 17 bp, Homo sapiens
tcttccatctgcatctt

SEQ ID NO: 6442225 - DNA, 15 bp, Homo sapiens
tcttccatgctgtgc

SEQ ID NO: 6442226 - DNA, 22 bp, Homo sapiens
tcttccatgggatggttagtgt

SEQ ID NO: 6442227 - DNA, 16 bp, Homo sapiens
tcttccatgtatcttt

SEQ ID NO: 6442228 - DNA, 19 bp, Homo sapiens
tcttccatgtatcttttga

SEQ ID NO: 6442229 - DNA, 21 bp, Homo sapiens
tcttccatgtgaacagcataa

SEQ ID NO: 6442230 - DNA, 20 bp, Homo sapiens
tcttccattaaattgccttt

SEQ ID NO: 6442231 - DNA, 20 bp, Homo sapiens
tcttccattagaatgctaca

SEQ ID NO: 6442232 - DNA, 17 bp, Homo sapiens
tcttccattcccagaca

SEQ ID NO: 6442233 - DNA, 15 bp, Homo sapiens
tcttccatttcttcc

SEQ ID NO: 6442234 - DNA, 18 bp, Homo sapiens
tcttccatttcttccacg

SEQ ID NO: 6442235 - DNA, 22 bp, Homo sapiens
tcttcccaaagcaagcacctgg

SEQ ID NO: 6442236 - DNA, 20 bp, Homo sapiens
tcttcccaagtcctcgcccc

SEQ ID NO: 6442237 - DNA, 13 bp, Homo sapiens
tcttcccacagga

SEQ ID NO: 6442238 - DNA, 21 bp, Homo sapiens
tcttcccaccaactctctctg

SEQ ID NO: 6442239 - DNA, 23 bp, Homo sapiens
tcttcccaccaactctctctgcc

SEQ ID NO: 6442240 - DNA, 14 bp, Homo sapiens
tcttcccactccag

SEQ ID NO: 6442241 - DNA, 18 bp, Homo sapiens
tcttcccactccagctga

SEQ ID NO: 6442242 - DNA, 21 bp, Homo sapiens
tcttcccagaaaaccagtctg

SEQ ID NO: 6442243 - DNA, 14 bp, Homo sapiens
tcttcccagagtca

SEQ ID NO: 6442244 - DNA, 12 bp, Homo sapiens
tcttcccaggcc

SEQ ID NO: 6442245 - DNA, 18 bp, Homo sapiens
tcttcccaggctggggct

SEQ ID NO: 6442246 - DNA, 14 bp, Homo sapiens
tcttcccagggtag

SEQ ID NO: 6442247 - DNA, 18 bp, Homo sapiens
tcttcccataataaagca

SEQ ID NO: 6442248 - DNA, 20 bp, Homo sapiens
tcttcccataataaagcaat

SEQ ID NO: 6442249 - DNA, 13 bp, Homo sapiens
tcttcccatgcat

SEQ ID NO: 6442250 - DNA, 15 bp, Homo sapiens
tcttcccattctcca

SEQ ID NO: 6442251 - DNA, 19 bp, Homo sapiens
tcttcccattctccatttg

SEQ ID NO: 6442252 - DNA, 19 bp, Homo sapiens
tcttcccatttgtaatgta

SEQ ID NO: 6442253 - DNA, 13 bp, Homo sapiens
tcttccccaccct

SEQ ID NO: 6442254 - DNA, 14 bp, Homo sapiens
tcttccccaccctg

SEQ ID NO: 6442255 - DNA, 20 bp, Homo sapiens
tcttccccaccttcccccaa

SEQ ID NO: 6442256 - DNA, 19 bp, Homo sapiens
tcttccccactccccacct

SEQ ID NO: 6442257 - DNA, 14 bp, Homo sapiens
tcttccccagagag

SEQ ID NO: 6442258 - DNA, 23 bp, Homo sapiens
tcttccccagccctccccacctg

SEQ ID NO: 6442259 - DNA, 13 bp, Homo sapiens
tcttccccaggaa

SEQ ID NO: 6442260 - DNA, 23 bp, Homo sapiens
tcttcccccacccctaacctggc

SEQ ID NO: 6442261 - DNA, 18 bp, Homo sapiens
tcttcccccactcctctt

SEQ ID NO: 6442262 - DNA, 13 bp, Homo sapiens
tcttcccccctct

SEQ ID NO: 6442263 - DNA, 21 bp, Homo sapiens
tcttccccctctcccagttgt

SEQ ID NO: 6442264 - DNA, 12 bp, Homo sapiens
tcttcccccttc

SEQ ID NO: 6442265 - DNA, 13 bp, Homo sapiens
tcttcccccttcc

SEQ ID NO: 6442266 - DNA, 23 bp, Homo sapiens
tcttcccccttcccctgcgccct

SEQ ID NO: 6442267 - DNA, 24 bp, Homo sapiens
tcttcccccttcccctgcgccctc

SEQ ID NO: 6442268 - DNA, 21 bp, Homo sapiens
tcttcccctccctcccacact

SEQ ID NO: 6442269 - DNA, 17 bp, Homo sapiens
tcttcccctcctgtaag

SEQ ID NO: 6442270 - DNA, 14 bp, Homo sapiens
tcttcccctctcag

SEQ ID NO: 6442271 - DNA, 14 bp, Homo sapiens
tcttccccttccct

SEQ ID NO: 6442272 - DNA, 13 bp, Homo sapiens
tcttccccttgcc

SEQ ID NO: 6442273 - DNA, 13 bp, Homo sapiens
tcttcccctttcc

SEQ ID NO: 6442274 - DNA, 18 bp, Homo sapiens
tcttcccctttgtcctgc

SEQ ID NO: 6442275 - DNA, 17 bp, Homo sapiens
tcttcccgcctcagcct

SEQ ID NO: 6442276 - DNA, 23 bp, Homo sapiens
tcttcccgctccccacctaccca

SEQ ID NO: 6442277 - DNA, 18 bp, Homo sapiens
tcttcccgtgtgtatttc

SEQ ID NO: 6442278 - DNA, 20 bp, Homo sapiens
tcttcccgtgtgtatttcta

SEQ ID NO: 6442279 - DNA, 22 bp, Homo sapiens
tcttccctaaaatgtagaaatt

SEQ ID NO: 6442280 - DNA, 19 bp, Homo sapiens
tcttccctacagttgaaaa

SEQ ID NO: 6442281 - DNA, 19 bp, Homo sapiens
tcttccctacccttcctgc

SEQ ID NO: 6442282 - DNA, 14 bp, Homo sapiens
tcttccctacctca

SEQ ID NO: 6442283 - DNA, 21 bp, Homo sapiens
tcttccctacctcaggcagga

SEQ ID NO: 6442284 - DNA, 11 bp, Homo sapiens
tcttccctcag

SEQ ID NO: 6442285 - DNA, 12 bp, Homo sapiens
tcttccctcagt

SEQ ID NO: 6442286 - DNA, 18 bp, Homo sapiens
tcttccctcggggagcca

SEQ ID NO: 6442287 - DNA, 16 bp, Homo sapiens
tcttccctctccctct

SEQ ID NO: 6442288 - DNA, 15 bp, Homo sapiens
tcttccctctcgctc

SEQ ID NO: 6442289 - DNA, 15 bp, Homo sapiens
tcttccctctgggcc

SEQ ID NO: 6442290 - DNA, 18 bp, Homo sapiens
tcttccctctgggcctgt

SEQ ID NO: 6442291 - DNA, 19 bp, Homo sapiens
tcttccctgaacgttttct

SEQ ID NO: 6442292 - DNA, 22 bp, Homo sapiens
tcttccctgaacgttttcttct

SEQ ID NO: 6442293 - DNA, 21 bp, Homo sapiens
tcttccctgcccctgtgcctc

SEQ ID NO: 6442294 - DNA, 13 bp, Homo sapiens
tcttccctgcctg

SEQ ID NO: 6442295 - DNA, 16 bp, Homo sapiens
tcttccctgctttgca

SEQ ID NO: 6442296 - DNA, 22 bp, Homo sapiens
tcttccctgctttgcatctttg

SEQ ID NO: 6442297 - DNA, 23 bp, Homo sapiens
tcttccctggccaggggcttctc

SEQ ID NO: 6442298 - DNA, 11 bp, Homo sapiens
tcttccctggg

SEQ ID NO: 6442299 - DNA, 12 bp, Homo sapiens
tcttccctgggg

SEQ ID NO: 6442300 - DNA, 22 bp, Homo sapiens
tcttccctgggggtcccaggat

SEQ ID NO: 6442301 - DNA, 20 bp, Homo sapiens
tcttccctggtaagaaaaag

SEQ ID NO: 6442302 - DNA, 13 bp, Homo sapiens
tcttcccttaaaa

SEQ ID NO: 6442303 - DNA, 13 bp, Homo sapiens
tcttcccttccca

SEQ ID NO: 6442304 - DNA, 18 bp, Homo sapiens
tcttcccttcccagacca

SEQ ID NO: 6442305 - DNA, 11 bp, Homo sapiens
tcttcccttgc

SEQ ID NO: 6442306 - DNA, 19 bp, Homo sapiens
tcttcccttttttttctgg

SEQ ID NO: 6442307 - DNA, 21 bp, Homo sapiens
tcttccgaatgggttttctat

SEQ ID NO: 6442308 - DNA, 15 bp, Homo sapiens
tcttccgactctttc

SEQ ID NO: 6442309 - DNA, 16 bp, Homo sapiens
tcttccgcagcccctt

SEQ ID NO: 6442310 - DNA, 15 bp, Homo sapiens
tcttccgcccctgcc

SEQ ID NO: 6442311 - DNA, 16 bp, Homo sapiens
tcttccgcccctgcct

SEQ ID NO: 6442312 - DNA, 23 bp, Homo sapiens
tcttccgcccctgcctgccatgt

SEQ ID NO: 6442313 - DNA, 16 bp, Homo sapiens
tcttccggagatgtag

SEQ ID NO: 6442314 - DNA, 15 bp, Homo sapiens
tcttccgggcagaaa

SEQ ID NO: 6442315 - DNA, 17 bp, Homo sapiens
tcttccggttggaggct

SEQ ID NO: 6442316 - DNA, 15 bp, Homo sapiens
tcttccgtctccccc

SEQ ID NO: 6442317 - DNA, 21 bp, Homo sapiens
tcttccgtggtcagagtgcca

SEQ ID NO: 6442318 - DNA, 16 bp, Homo sapiens
tcttcctaatcgctaa

SEQ ID NO: 6442319 - DNA, 18 bp, Homo sapiens
tcttcctaattaacaaaa

SEQ ID NO: 6442320 - DNA, 22 bp, Homo sapiens
tcttcctacatcttcttcccag

SEQ ID NO: 6442321 - DNA, 17 bp, Homo sapiens
tcttcctaccaaatata

SEQ ID NO: 6442322 - DNA, 22 bp, Homo sapiens
tcttcctaccaaatataaactt

SEQ ID NO: 6442323 - DNA, 21 bp, Homo sapiens
tcttcctaccaagtcaaactt

SEQ ID NO: 6442324 - DNA, 17 bp, Homo sapiens
tcttcctacctatccca

SEQ ID NO: 6442325 - DNA, 13 bp, Homo sapiens
tcttcctagaatt

SEQ ID NO: 6442326 - DNA, 22 bp, Homo sapiens
tcttcctatcaaaaagatatca

SEQ ID NO: 6442327 - DNA, 22 bp, Homo sapiens
tcttcctatccctctcctaact

SEQ ID NO: 6442328 - DNA, 20 bp, Homo sapiens
tcttcctatttcagaagttt

SEQ ID NO: 6442329 - DNA, 21 bp, Homo sapiens
tcttcctatttgccatgggct

SEQ ID NO: 6442330 - DNA, 19 bp, Homo sapiens
tcttcctcaagtcttgaca

SEQ ID NO: 6442331 - DNA, 20 bp, Homo sapiens
tcttcctcacactgctgtcc

SEQ ID NO: 6442332 - DNA, 21 bp, Homo sapiens
tcttcctcacactgctgtcct

SEQ ID NO: 6442333 - DNA, 22 bp, Homo sapiens
tcttcctcacactgctgtcctc

SEQ ID NO: 6442334 - DNA, 12 bp, Homo sapiens
tcttcctcagcc

SEQ ID NO: 6442335 - DNA, 14 bp, Homo sapiens
tcttcctcagccag

SEQ ID NO: 6442336 - DNA, 13 bp, Homo sapiens
tcttcctcatcag

SEQ ID NO: 6442337 - DNA, 14 bp, Homo sapiens
tcttcctcatcctg

SEQ ID NO: 6442338 - DNA, 16 bp, Homo sapiens
tcttcctcatcctgct

SEQ ID NO: 6442339 - DNA, 22 bp, Homo sapiens
tcttcctccaaagcctgggcag

SEQ ID NO: 6442340 - DNA, 16 bp, Homo sapiens
tcttcctccaaggaca

SEQ ID NO: 6442341 - DNA, 13 bp, Homo sapiens
tcttcctccagct

SEQ ID NO: 6442342 - DNA, 14 bp, Homo sapiens
tcttcctccagctg

SEQ ID NO: 6442343 - DNA, 15 bp, Homo sapiens
tcttcctccagctgc

SEQ ID NO: 6442344 - DNA, 18 bp, Homo sapiens
tcttcctccagtctgttc

SEQ ID NO: 6442345 - DNA, 13 bp, Homo sapiens
tcttcctcccaag

SEQ ID NO: 6442346 - DNA, 16 bp, Homo sapiens
tcttcctccccaggac

SEQ ID NO: 6442347 - DNA, 16 bp, Homo sapiens
tcttcctcccctctca

SEQ ID NO: 6442348 - DNA, 13 bp, Homo sapiens
tcttcctccctcc

SEQ ID NO: 6442349 - DNA, 21 bp, Homo sapiens
tcttcctccctgggggcccca

SEQ ID NO: 6442350 - DNA, 14 bp, Homo sapiens
tcttcctcctccat

SEQ ID NO: 6442351 - DNA, 18 bp, Homo sapiens
tcttcctcctccatcacc

SEQ ID NO: 6442352 - DNA, 17 bp, Homo sapiens
tcttcctcctcccctgg

SEQ ID NO: 6442353 - DNA, 14 bp, Homo sapiens
tcttcctctccttc

SEQ ID NO: 6442354 - DNA, 16 bp, Homo sapiens
tcttcctctccttccc

SEQ ID NO: 6442355 - DNA, 18 bp, Homo sapiens
tcttcctctccttcccac

SEQ ID NO: 6442356 - DNA, 16 bp, Homo sapiens
tcttcctctgaggctg

SEQ ID NO: 6442357 - DNA, 13 bp, Homo sapiens
tcttcctctgcaa

SEQ ID NO: 6442358 - DNA, 14 bp, Homo sapiens
tcttcctctgcaag

SEQ ID NO: 6442359 - DNA, 19 bp, Homo sapiens
tcttcctctgctaaattga

SEQ ID NO: 6442360 - DNA, 21 bp, Homo sapiens
tcttcctctgctaaattgatg

SEQ ID NO: 6442361 - DNA, 14 bp, Homo sapiens
tcttcctctgctga

SEQ ID NO: 6442362 - DNA, 14 bp, Homo sapiens
tcttcctctggttc

SEQ ID NO: 6442363 - DNA, 20 bp, Homo sapiens
tcttcctctggtttctgtgt

SEQ ID NO: 6442364 - DNA, 19 bp, Homo sapiens
tcttcctcttagcctctgg

SEQ ID NO: 6442365 - DNA, 16 bp, Homo sapiens
tcttcctcttgaccct

SEQ ID NO: 6442366 - DNA, 20 bp, Homo sapiens
tcttcctcttgaccctgcac

SEQ ID NO: 6442367 - DNA, 11 bp, Homo sapiens
tcttcctgacg

SEQ ID NO: 6442368 - DNA, 18 bp, Homo sapiens
tcttcctgagtggtgcca

SEQ ID NO: 6442369 - DNA, 16 bp, Homo sapiens
tcttcctgattcccca

SEQ ID NO: 6442370 - DNA, 23 bp, Homo sapiens
tcttcctgcaaccactctgtggc

SEQ ID NO: 6442371 - DNA, 13 bp, Homo sapiens
tcttcctgcccct

SEQ ID NO: 6442372 - DNA, 14 bp, Homo sapiens
tcttcctgcccctc

SEQ ID NO: 6442373 - DNA, 16 bp, Homo sapiens
tcttcctgcccctctt

SEQ ID NO: 6442374 - DNA, 17 bp, Homo sapiens
tcttcctgcccctcttt

SEQ ID NO: 6442375 - DNA, 19 bp, Homo sapiens
tcttcctgcccctctttct

SEQ ID NO: 6442376 - DNA, 17 bp, Homo sapiens
tcattttgtgttgaaga

SEQ ID NO: 6442377 - DNA, 19 bp, Homo sapiens
tcatttttaaagcctggct

SEQ ID NO: 6442378 - DNA, 16 bp, Homo sapiens
tcatttttaacagcat

SEQ ID NO: 6442379 - DNA, 13 bp, Homo sapiens
tcatttttaacta

SEQ ID NO: 6442380 - DNA, 16 bp, Homo sapiens
tcatttttaagaaagg

SEQ ID NO: 6442381 - DNA, 12 bp, Homo sapiens
tcatttttaatc

SEQ ID NO: 6442382 - DNA, 15 bp, Homo sapiens
tcatttttaatgtat

SEQ ID NO: 6442383 - DNA, 12 bp, Homo sapiens
tcatttttaatt

SEQ ID NO: 6442384 - DNA, 13 bp, Homo sapiens
tcatttttacact

SEQ ID NO: 6442385 - DNA, 17 bp, Homo sapiens
tcatttttatcccttcc

SEQ ID NO: 6442386 - DNA, 13 bp, Homo sapiens
tcatttttcaaaa

SEQ ID NO: 6442387 - DNA, 14 bp, Homo sapiens
tcatttttcaaaaa

SEQ ID NO: 6442388 - DNA, 19 bp, Homo sapiens
tcatttttcaatagcacat

SEQ ID NO: 6442389 - DNA, 17 bp, Homo sapiens
tcatttttcactgtaca

SEQ ID NO: 6442390 - DNA, 18 bp, Homo sapiens
tcatttttcagacctttt

SEQ ID NO: 6442391 - DNA, 19 bp, Homo sapiens
tcatttttcatactgaaaa

SEQ ID NO: 6442392 - DNA, 11 bp, Homo sapiens
tcatttttcca

SEQ ID NO: 6442393 - DNA, 20 bp, Homo sapiens
tcatttttccatgacatttt

SEQ ID NO: 6442394 - DNA, 15 bp, Homo sapiens
tcatttttccgtaaa

SEQ ID NO: 6442395 - DNA, 22 bp, Homo sapiens
tcatttttccttcccttctcca

SEQ ID NO: 6442396 - DNA, 15 bp, Homo sapiens
tcatttttcctttag

SEQ ID NO: 6442397 - DNA, 12 bp, Homo sapiens
tcatttttgaat

SEQ ID NO: 6442398 - DNA, 13 bp, Homo sapiens
tcatttttgaatg

SEQ ID NO: 6442399 - DNA, 14 bp, Homo sapiens
tcatttttgagact

SEQ ID NO: 6442400 - DNA, 12 bp, Homo sapiens
tcatttttgctg

SEQ ID NO: 6442401 - DNA, 15 bp, Homo sapiens
tcatttttgtaataa

SEQ ID NO: 6442402 - DNA, 12 bp, Homo sapiens
tcatttttgtac

SEQ ID NO: 6442403 - DNA, 12 bp, Homo sapiens
tcatttttgtat

SEQ ID NO: 6442404 - DNA, 13 bp, Homo sapiens
tcatttttgtata

SEQ ID NO: 6442405 - DNA, 14 bp, Homo sapiens
tcatttttgtataa

SEQ ID NO: 6442406 - DNA, 23 bp, Homo sapiens
tcatttttgtataaaaaggaaat

SEQ ID NO: 6442407 - DNA, 22 bp, Homo sapiens
tcatttttgtgggggctagaaa

SEQ ID NO: 6442408 - DNA, 19 bp, Homo sapiens
tcatttttgtttctacctc

SEQ ID NO: 6442409 - DNA, 20 bp, Homo sapiens
tcatttttgtttctacctcc

SEQ ID NO: 6442410 - DNA, 15 bp, Homo sapiens
tcattttttaaaaaa

SEQ ID NO: 6442411 - DNA, 21 bp, Homo sapiens
tcattttttaatgtgctctgt

SEQ ID NO: 6442412 - DNA, 13 bp, Homo sapiens
tcattttttactt

SEQ ID NO: 6442413 - DNA, 14 bp, Homo sapiens
tcattttttacttg

SEQ ID NO: 6442414 - DNA, 17 bp, Homo sapiens
tcattttttacttgaat

SEQ ID NO: 6442415 - DNA, 16 bp, Homo sapiens
tcattttttatgtatt

SEQ ID NO: 6442416 - DNA, 23 bp, Homo sapiens
tcattttttcctgtttgggaaga

SEQ ID NO: 6442417 - DNA, 14 bp, Homo sapiens
tcattttttgtcta

SEQ ID NO: 6442418 - DNA, 15 bp, Homo sapiens
tcattttttgtttct

SEQ ID NO: 6442419 - DNA, 18 bp, Homo sapiens
tcatttttttccttgcaa

SEQ ID NO: 6442420 - DNA, 18 bp, Homo sapiens
tcatttttttctctctgg

SEQ ID NO: 6442421 - DNA, 17 bp, Homo sapiens
tcattttttttaagaaa

SEQ ID NO: 6442422 - DNA, 14 bp, Homo sapiens
tcattttttttccc

SEQ ID NO: 6442423 - DNA, 14 bp, Homo sapiens
tcattttttttcct

SEQ ID NO: 6442424 - DNA, 20 bp, Homo sapiens
tcattttttttctttgaata

SEQ ID NO: 6442425 - DNA, 22 bp, Homo sapiens
tcattttttttctttgaataaa

SEQ ID NO: 6442426 - DNA, 19 bp, Homo sapiens
tccaaaaaaaaaaaaaata

SEQ ID NO: 6442427 - DNA, 23 bp, Homo sapiens
tccaaaaaaaaaaaaaatacaat

SEQ ID NO: 6442428 - DNA, 14 bp, Homo sapiens
tccaaaaaaaggaa

SEQ ID NO: 6442429 - DNA, 21 bp, Homo sapiens
tccaaaaaagcaaacacaaga

SEQ ID NO: 6442430 - DNA, 18 bp, Homo sapiens
tccaaaaaaggctgccct

SEQ ID NO: 6442431 - DNA, 22 bp, Homo sapiens
tccaaaaacaaagtgcaaagct

SEQ ID NO: 6442432 - DNA, 23 bp, Homo sapiens
tccaaaaacaaagtgcaaagctg

SEQ ID NO: 6442433 - DNA, 20 bp, Homo sapiens
tccaaaaacagtaaaaataa

SEQ ID NO: 6442434 - DNA, 19 bp, Homo sapiens
tccaaaaacagtgattaaa

SEQ ID NO: 6442435 - DNA, 22 bp, Homo sapiens
tccaaaaacattttatttttaa

SEQ ID NO: 6442436 - DNA, 15 bp, Homo sapiens
tccaaaaagacaagt

SEQ ID NO: 6442437 - DNA, 20 bp, Homo sapiens
tccaaaaagacaagtgctca

SEQ ID NO: 6442438 - DNA, 22 bp, Homo sapiens
tccaaaaagattttcagaaaat

SEQ ID NO: 6442439 - DNA, 19 bp, Homo sapiens
tccaaaaagctctgaaaac

SEQ ID NO: 6442440 - DNA, 21 bp, Homo sapiens
tccaaaaatgtgtaagaacaa

SEQ ID NO: 6442441 - DNA, 23 bp, Homo sapiens
tccaaaacaaacatgcagtactt

SEQ ID NO: 6442442 - DNA, 12 bp, Homo sapiens
tccaaaacacaa

SEQ ID NO: 6442443 - DNA, 15 bp, Homo sapiens
tccaaaacacaaact

SEQ ID NO: 6442444 - DNA, 18 bp, Homo sapiens
tccaaaaccgccagctct

SEQ ID NO: 6442445 - DNA, 22 bp, Homo sapiens
tccaaaacctgcttccttcagt

SEQ ID NO: 6442446 - DNA, 15 bp, Homo sapiens
tccaaaactagcatt

SEQ ID NO: 6442447 - DNA, 17 bp, Homo sapiens
tccaaaactagcattct

SEQ ID NO: 6442448 - DNA, 15 bp, Homo sapiens
tccaaaagaagcccc

SEQ ID NO: 6442449 - DNA, 16 bp, Homo sapiens
tccaaaagattgctga

SEQ ID NO: 6442450 - DNA, 22 bp, Homo sapiens
tccaaaagcaggaacccatcta

SEQ ID NO: 6442451 - DNA, 19 bp, Homo sapiens
tccaaaagtactagcaata

SEQ ID NO: 6442452 - DNA, 22 bp, Homo sapiens
tccaaaagtactagcaataagt

SEQ ID NO: 6442453 - DNA, 19 bp, Homo sapiens
tccaaaagtggcctctttg

SEQ ID NO: 6442454 - DNA, 14 bp, Homo sapiens
tccaaaataaatgg

SEQ ID NO: 6442455 - DNA, 15 bp, Homo sapiens
tccaaaataatttta

SEQ ID NO: 6442456 - DNA, 23 bp, Homo sapiens
tccaaaatagtcatgtttctgca

SEQ ID NO: 6442457 - DNA, 18 bp, Homo sapiens
tccaaaatcttgatcagt

SEQ ID NO: 6442458 - DNA, 13 bp, Homo sapiens
tccaaaatgcttg

SEQ ID NO: 6442459 - DNA, 19 bp, Homo sapiens
tccaaaatgtgtatttctt

SEQ ID NO: 6442460 - DNA, 18 bp, Homo sapiens
tccaaaattcagggcttt

SEQ ID NO: 6442461 - DNA, 21 bp, Homo sapiens
tccaaaattcagggctttaaa

SEQ ID NO: 6442462 - DNA, 12 bp, Homo sapiens
tccaaaattctt

SEQ ID NO: 6442463 - DNA, 24 bp, Homo sapiens
tccaaaatttgtttgtcactgcca

SEQ ID NO: 6442464 - DNA, 21 bp, Homo sapiens
tccaaaatttttcaaccccac

SEQ ID NO: 6442465 - DNA, 11 bp, Homo sapiens
tccaaacaatt

SEQ ID NO: 6442466 - DNA, 15 bp, Homo sapiens
tccaaacaattctga

SEQ ID NO: 6442467 - DNA, 17 bp, Homo sapiens
tccaaacaattctgatg

SEQ ID NO: 6442468 - DNA, 18 bp, Homo sapiens
tccaaacaattctgatga

SEQ ID NO: 6442469 - DNA, 20 bp, Homo sapiens
tccaaacactgaggcagcct

SEQ ID NO: 6442470 - DNA, 13 bp, Homo sapiens
tccaaacactggg

SEQ ID NO: 6442471 - DNA, 21 bp, Homo sapiens
tccaaacaggtgctggcccag

SEQ ID NO: 6442472 - DNA, 22 bp, Homo sapiens
tccaaacatggtttattggtga

SEQ ID NO: 6442473 - DNA, 15 bp, Homo sapiens
tccaaacatgtattt

SEQ ID NO: 6442474 - DNA, 20 bp, Homo sapiens
tccaaacatgtatttatgta

SEQ ID NO: 6442475 - DNA, 22 bp, Homo sapiens
tccaaaccactttttgcagctt

SEQ ID NO: 6442476 - DNA, 16 bp, Homo sapiens
tccaaaccagtttatt

SEQ ID NO: 6442477 - DNA, 19 bp, Homo sapiens
tccaaacctaccttataga

SEQ ID NO: 6442478 - DNA, 22 bp, Homo sapiens
tccaaacctccagcctccctgt

SEQ ID NO: 6442479 - DNA, 12 bp, Homo sapiens
tccaaacctgtc

SEQ ID NO: 6442480 - DNA, 13 bp, Homo sapiens
tccaaaccttcac

SEQ ID NO: 6442481 - DNA, 21 bp, Homo sapiens
tccaaactaaaccctcacaag

SEQ ID NO: 6442482 - DNA, 17 bp, Homo sapiens
tccaaactcctgcctgt

SEQ ID NO: 6442483 - DNA, 20 bp, Homo sapiens
tccaaactgcctaagccctc

SEQ ID NO: 6442484 - DNA, 14 bp, Homo sapiens
tccaaactgctgtc

SEQ ID NO: 6442485 - DNA, 15 bp, Homo sapiens
tccaaactgctgtct

SEQ ID NO: 6442486 - DNA, 16 bp, Homo sapiens
tccaaactggaatgag

SEQ ID NO: 6442487 - DNA, 16 bp, Homo sapiens
tccaaacttaacagat

SEQ ID NO: 6442488 - DNA, 19 bp, Homo sapiens
tccaaacttctaaatgttg

SEQ ID NO: 6442489 - DNA, 23 bp, Homo sapiens
tccaaagaaaagtattgtttgga

SEQ ID NO: 6442490 - DNA, 22 bp, Homo sapiens
tccaaagaaatagggcatggct

SEQ ID NO: 6442491 - DNA, 20 bp, Homo sapiens
tccaaagaatgttagagcac

SEQ ID NO: 6442492 - DNA, 14 bp, Homo sapiens
tccaaagactccct

SEQ ID NO: 6442493 - DNA, 17 bp, Homo sapiens
tccaaagactgtactgg

SEQ ID NO: 6442494 - DNA, 13 bp, Homo sapiens
tccaaagagaaaa

SEQ ID NO: 6442495 - DNA, 23 bp, Homo sapiens
tccaaagagagttaaaagcagca

SEQ ID NO: 6442496 - DNA, 15 bp, Homo sapiens
tccaaagagccatgt

SEQ ID NO: 6442497 - DNA, 16 bp, Homo sapiens
tccaaagaggctgccc

SEQ ID NO: 6442498 - DNA, 13 bp, Homo sapiens
tccaaagagtgct

SEQ ID NO: 6442499 - DNA, 20 bp, Homo sapiens
tccaaagagtgctaagcatt

SEQ ID NO: 6442500 - DNA, 18 bp, Homo sapiens
tccaaagagtgtggaatt

SEQ ID NO: 6442501 - DNA, 20 bp, Homo sapiens
tccaaagatgacttcccctg

SEQ ID NO: 6442502 - DNA, 11 bp, Homo sapiens
tccaaagcaaa

SEQ ID NO: 6442503 - DNA, 19 bp, Homo sapiens
tccaaagcacattgaaaga

SEQ ID NO: 6442504 - DNA, 14 bp, Homo sapiens
tccaaagcagacag

SEQ ID NO: 6442505 - DNA, 12 bp, Homo sapiens
tccaaagcagag

SEQ ID NO: 6442506 - DNA, 17 bp, Homo sapiens
tccaaagccaatgtgaa

SEQ ID NO: 6442507 - DNA, 23 bp, Homo sapiens
tccaaagcctagacaacctttct

SEQ ID NO: 6442508 - DNA, 20 bp, Homo sapiens
tccaaagcttattttgtaag

SEQ ID NO: 6442509 - DNA, 16 bp, Homo sapiens
tccaaagcttcccacg

SEQ ID NO: 6442510 - DNA, 14 bp, Homo sapiens
tccaaagcttcccc

SEQ ID NO: 6442511 - DNA, 21 bp, Homo sapiens
tccaaagctttattaccagtg

SEQ ID NO: 6442512 - DNA, 17 bp, Homo sapiens
tccaaagctttcctgga

SEQ ID NO: 6442513 - DNA, 23 bp, Homo sapiens
tccaaaggaataacctttctgga

SEQ ID NO: 6442514 - DNA, 23 bp, Homo sapiens
tccaaaggaatctccagttttca

SEQ ID NO: 6442515 - DNA, 13 bp, Homo sapiens
tccaaaggaggct

SEQ ID NO: 6442516 - DNA, 16 bp, Homo sapiens
tccaaaggcactgacc

SEQ ID NO: 6442517 - DNA, 13 bp, Homo sapiens
tccaaaggcagcg

SEQ ID NO: 6442518 - DNA, 23 bp, Homo sapiens
tccaaaggcagcgtgccgagcca

SEQ ID NO: 6442519 - DNA, 21 bp, Homo sapiens
tccaaaggcattttattgctt

SEQ ID NO: 6442520 - DNA, 22 bp, Homo sapiens
tccaaaggccatggagagctgg

SEQ ID NO: 6442521 - DNA, 23 bp, Homo sapiens
tccaaaggccatggagagctgga

SEQ ID NO: 6442522 - DNA, 18 bp, Homo sapiens
tccaaaggctcctgagac

SEQ ID NO: 6442523 - DNA, 14 bp, Homo sapiens
tccaaaggctctgt

SEQ ID NO: 6442524 - DNA, 22 bp, Homo sapiens
tccaaagggaatactcacattt

SEQ ID NO: 6442525 - DNA, 16 bp, Homo sapiens
tccaaaggggctgctg

SEQ ID NO: 6442526 - DNA, 21 bp, Homo sapiens
tccaaaggggctgctggggca

SEQ ID NO: 6442527 - DNA, 16 bp, Homo sapiens
tccaaagtacactgtt

SEQ ID NO: 6442528 - DNA, 18 bp, Homo sapiens
tccaaagtcacaggaaga

SEQ ID NO: 6442529 - DNA, 15 bp, Homo sapiens
tccaaagtcataatt

SEQ ID NO: 6442530 - DNA, 18 bp, Homo sapiens
tccaaagtcataattgca

SEQ ID NO: 6442531 - DNA, 11 bp, Homo sapiens
tccaaagtcca

SEQ ID NO: 6442532 - DNA, 14 bp, Homo sapiens
tccaaagtctctaa

SEQ ID NO: 6442533 - DNA, 23 bp, Homo sapiens
tccaaagtctctggaatttgaaa

SEQ ID NO: 6442534 - DNA, 17 bp, Homo sapiens
tccaaagtgcatgtcac

SEQ ID NO: 6442535 - DNA, 20 bp, Homo sapiens
tccaaagtgcatgtcacatg

SEQ ID NO: 6442536 - DNA, 23 bp, Homo sapiens
tccaaagtgcatgtcacatgcca

SEQ ID NO: 6442537 - DNA, 13 bp, Homo sapiens
tccaaagtgtcac

SEQ ID NO: 6442538 - DNA, 10 bp, Homo sapiens
tccaaataaa

SEQ ID NO: 6442539 - DNA, 22 bp, Homo sapiens
tccaaataaaaataacatcatt

SEQ ID NO: 6442540 - DNA, 15 bp, Homo sapiens
tccaaataaacattt

SEQ ID NO: 6442541 - DNA, 16 bp, Homo sapiens
tccaaataaattcaat

SEQ ID NO: 6442542 - DNA, 15 bp, Homo sapiens
tccaaataataaagt

SEQ ID NO: 6442543 - DNA, 20 bp, Homo sapiens
tccaaataatatgtttcctt

SEQ ID NO: 6442544 - DNA, 22 bp, Homo sapiens
tccaaataattccacagtcctg

SEQ ID NO: 6442545 - DNA, 21 bp, Homo sapiens
tccaaataggagtcttctgcc

SEQ ID NO: 6442546 - DNA, 19 bp, Homo sapiens
tccaaatatgttaagggct

SEQ ID NO: 6442547 - DNA, 17 bp, Homo sapiens
tccaaatattctaaaaa

SEQ ID NO: 6442548 - DNA, 13 bp, Homo sapiens
tccaaatatttcc

SEQ ID NO: 6442549 - DNA, 13 bp, Homo sapiens
tccaaatccagga

SEQ ID NO: 6442550 - DNA, 16 bp, Homo sapiens
tccaaatccctttcat

SEQ ID NO: 6442551 - DNA, 18 bp, Homo sapiens
tccaaatctgatttcatt

SEQ ID NO: 6442552 - DNA, 17 bp, Homo sapiens
tccaaatctgtcctctg

SEQ ID NO: 6442553 - DNA, 21 bp, Homo sapiens
tccaaatctgtcctctgtagt

SEQ ID NO: 6442554 - DNA, 23 bp, Homo sapiens
tccaaatctgtcctctgtagtat

SEQ ID NO: 6442555 - DNA, 12 bp, Homo sapiens
tcttcctgccct

SEQ ID NO: 6442556 - DNA, 15 bp, Homo sapiens
tcttcctgctccttt

SEQ ID NO: 6442557 - DNA, 12 bp, Homo sapiens
tcttcctgctgc

SEQ ID NO: 6442558 - DNA, 15 bp, Homo sapiens
tcttcctgctgctgt

SEQ ID NO: 6442559 - DNA, 23 bp, Homo sapiens
tcttcctggacagtgagagcagg

SEQ ID NO: 6442560 - DNA, 20 bp, Homo sapiens
tcttcctggatggggcagag

SEQ ID NO: 6442561 - DNA, 13 bp, Homo sapiens
tcttcctggcaca

SEQ ID NO: 6442562 - DNA, 12 bp, Homo sapiens
tcttcctggccg

SEQ ID NO: 6442563 - DNA, 22 bp, Homo sapiens
tcttcctggctttttaactccc

SEQ ID NO: 6442564 - DNA, 13 bp, Homo sapiens
tcttcctgtaatc

SEQ ID NO: 6442565 - DNA, 21 bp, Homo sapiens
tcttcctgtggctccctctct

SEQ ID NO: 6442566 - DNA, 22 bp, Homo sapiens
tcttcctgtgtacctctagaat

SEQ ID NO: 6442567 - DNA, 13 bp, Homo sapiens
tcttcctgtgtcc

SEQ ID NO: 6442568 - DNA, 17 bp, Homo sapiens
tcttcctgttaatgtat

SEQ ID NO: 6442569 - DNA, 18 bp, Homo sapiens
tcttcctgttctgtgact

SEQ ID NO: 6442570 - DNA, 14 bp, Homo sapiens
tcttcctgttgtga

SEQ ID NO: 6442571 - DNA, 23 bp, Homo sapiens
tcttcctgttgtgactgccagga

SEQ ID NO: 6442572 - DNA, 23 bp, Homo sapiens
tcttccttaaatgacttttctta

SEQ ID NO: 6442573 - DNA, 17 bp, Homo sapiens
tcttccttacctggaaa

SEQ ID NO: 6442574 - DNA, 14 bp, Homo sapiens
tcttccttccctgc

SEQ ID NO: 6442575 - DNA, 22 bp, Homo sapiens
tcttccttcctttctctctttc

SEQ ID NO: 6442576 - DNA, 20 bp, Homo sapiens
tcttccttcggtcttttgta

SEQ ID NO: 6442577 - DNA, 23 bp, Homo sapiens
tcttccttctaccccaaggccag

SEQ ID NO: 6442578 - DNA, 15 bp, Homo sapiens
tcttccttctctact

SEQ ID NO: 6442579 - DNA, 14 bp, Homo sapiens
tcttccttctttct

SEQ ID NO: 6442580 - DNA, 21 bp, Homo sapiens
tcttccttgaagaactgcagg

SEQ ID NO: 6442581 - DNA, 18 bp, Homo sapiens
tcttccttgatgtttggg

SEQ ID NO: 6442582 - DNA, 17 bp, Homo sapiens
tcttccttgccacaatc

SEQ ID NO: 6442583 - DNA, 20 bp, Homo sapiens
tcttccttgccacaatcact

SEQ ID NO: 6442584 - DNA, 14 bp, Homo sapiens
tcttccttgtctct

SEQ ID NO: 6442585 - DNA, 20 bp, Homo sapiens
tcttcctttatcccctcctt

SEQ ID NO: 6442586 - DNA, 12 bp, Homo sapiens
tcttcctttcat

SEQ ID NO: 6442587 - DNA, 16 bp, Homo sapiens
tcttcctttctctttc

SEQ ID NO: 6442588 - DNA, 17 bp, Homo sapiens
tcttcctttctctttct

SEQ ID NO: 6442589 - DNA, 18 bp, Homo sapiens
tcttcctttctctttctc

SEQ ID NO: 6442590 - DNA, 16 bp, Homo sapiens
tcttcctttcttgtct

SEQ ID NO: 6442591 - DNA, 14 bp, Homo sapiens
tcttcctttgaaag

SEQ ID NO: 6442592 - DNA, 16 bp, Homo sapiens
tcttccttttttaaaa

SEQ ID NO: 6442593 - DNA, 20 bp, Homo sapiens
tcttcgacagctgggctgga

SEQ ID NO: 6442594 - DNA, 14 bp, Homo sapiens
tcttcgactgttgt

SEQ ID NO: 6442595 - DNA, 20 bp, Homo sapiens
tcttcgcgcccgcccctgca

SEQ ID NO: 6442596 - DNA, 20 bp, Homo sapiens
tcttcgctgctagagaaggg

SEQ ID NO: 6442597 - DNA, 20 bp, Homo sapiens
tcttcgctggactattgtgc

SEQ ID NO: 6442598 - DNA, 21 bp, Homo sapiens
tcttcgctggactattgtgcc

SEQ ID NO: 6442599 - DNA, 22 bp, Homo sapiens
tcttcgctgtgatgcatgagct

SEQ ID NO: 6442600 - DNA, 13 bp, Homo sapiens
tcttcggaggtgg

SEQ ID NO: 6442601 - DNA, 15 bp, Homo sapiens
tcttcggaggtggca

SEQ ID NO: 6442602 - DNA, 14 bp, Homo sapiens
tcttcggcagggag

SEQ ID NO: 6442603 - DNA, 22 bp, Homo sapiens
tcttcggccaatttatgcagag

SEQ ID NO: 6442604 - DNA, 14 bp, Homo sapiens
tcttcgggaagaga

SEQ ID NO: 6442605 - DNA, 17 bp, Homo sapiens
tcttcgggaccaggatt

SEQ ID NO: 6442606 - DNA, 17 bp, Homo sapiens
tcttcgggtgtgatcat

SEQ ID NO: 6442607 - DNA, 15 bp, Homo sapiens
tcttcggtggccttg

SEQ ID NO: 6442608 - DNA, 18 bp, Homo sapiens
tcttcggtggccttgagt

SEQ ID NO: 6442609 - DNA, 15 bp, Homo sapiens
tcttcggtgttcttc

SEQ ID NO: 6442610 - DNA, 18 bp, Homo sapiens
tcttcggtgtttaaagtc

SEQ ID NO: 6442611 - DNA, 14 bp, Homo sapiens
tcttcggtttctga

SEQ ID NO: 6442612 - DNA, 15 bp, Homo sapiens
tcttcggtttctgag

SEQ ID NO: 6442613 - DNA, 22 bp, Homo sapiens
tcttcgtaacttcatattaata

SEQ ID NO: 6442614 - DNA, 14 bp, Homo sapiens
tcttcgtacagttc

SEQ ID NO: 6442615 - DNA, 15 bp, Homo sapiens
tcttcgtacagttct

SEQ ID NO: 6442616 - DNA, 14 bp, Homo sapiens
tcttcgtcctgccc

SEQ ID NO: 6442617 - DNA, 13 bp, Homo sapiens
tcttcgtcctttt

SEQ ID NO: 6442618 - DNA, 16 bp, Homo sapiens
tcttcgtggttgtgtt

SEQ ID NO: 6442619 - DNA, 16 bp, Homo sapiens
tcttctaaaacttgta

SEQ ID NO: 6442620 - DNA, 14 bp, Homo sapiens
tcttctaaaatgct

SEQ ID NO: 6442621 - DNA, 16 bp, Homo sapiens
tcttctaaaatgcttt

SEQ ID NO: 6442622 - DNA, 21 bp, Homo sapiens
tcttctaaaatgcttttaatt

SEQ ID NO: 6442623 - DNA, 13 bp, Homo sapiens
tcttctaaacttc

SEQ ID NO: 6442624 - DNA, 19 bp, Homo sapiens
tcttctaaagaggaagcct

SEQ ID NO: 6442625 - DNA, 15 bp, Homo sapiens
tcttctaaatgccca

SEQ ID NO: 6442626 - DNA, 16 bp, Homo sapiens
tcttctaacacaaaat

SEQ ID NO: 6442627 - DNA, 11 bp, Homo sapiens
tcttctaacat

SEQ ID NO: 6442628 - DNA, 14 bp, Homo sapiens
tcttctaactcatg

SEQ ID NO: 6442629 - DNA, 16 bp, Homo sapiens
tcttctaagaagacat

SEQ ID NO: 6442630 - DNA, 13 bp, Homo sapiens
tcttctaattatt

SEQ ID NO: 6442631 - DNA, 15 bp, Homo sapiens
tcttctaattgctgt

SEQ ID NO: 6442632 - DNA, 15 bp, Homo sapiens
tcttctaatttcaaa

SEQ ID NO: 6442633 - DNA, 18 bp, Homo sapiens
tcttctacaaccagagcc

SEQ ID NO: 6442634 - DNA, 19 bp, Homo sapiens
tcttctacaaccagagccc

SEQ ID NO: 6442635 - DNA, 20 bp, Homo sapiens
tcttctacaaccagagcccc

SEQ ID NO: 6442636 - DNA, 19 bp, Homo sapiens
tcttctaccaaatgtgtaa

SEQ ID NO: 6442637 - DNA, 12 bp, Homo sapiens
tcttctaccaga

SEQ ID NO: 6442638 - DNA, 14 bp, Homo sapiens
tcttctaccctttt

SEQ ID NO: 6442639 - DNA, 17 bp, Homo sapiens
tcttctacctcttccag

SEQ ID NO: 6442640 - DNA, 20 bp, Homo sapiens
tcttctacctcttccaggaa

SEQ ID NO: 6442641 - DNA, 18 bp, Homo sapiens
tcttctacgtataaatat

SEQ ID NO: 6442642 - DNA, 19 bp, Homo sapiens
tcttctacttgtttaacat

SEQ ID NO: 6442643 - DNA, 18 bp, Homo sapiens
tcttctagaagataacat

SEQ ID NO: 6442644 - DNA, 19 bp, Homo sapiens
tcttctagaagataacatt

SEQ ID NO: 6442645 - DNA, 22 bp, Homo sapiens
tcttctagatggaccccagcat

SEQ ID NO: 6442646 - DNA, 17 bp, Homo sapiens
tcttctaggttctaaaa

SEQ ID NO: 6442647 - DNA, 14 bp, Homo sapiens
tcttctagtttaga

SEQ ID NO: 6442648 - DNA, 21 bp, Homo sapiens
tcttctataatatttcctttt

SEQ ID NO: 6442649 - DNA, 14 bp, Homo sapiens
tcttctatcattcc

SEQ ID NO: 6442650 - DNA, 15 bp, Homo sapiens
tcttctatcctgcaa

SEQ ID NO: 6442651 - DNA, 15 bp, Homo sapiens
tcttctattgcctct

SEQ ID NO: 6442652 - DNA, 14 bp, Homo sapiens
tcttctatttaaaa

SEQ ID NO: 6442653 - DNA, 15 bp, Homo sapiens
tcttctatttaaaaa

SEQ ID NO: 6442654 - DNA, 22 bp, Homo sapiens
tcttctatttaaaaaataaaaa

SEQ ID NO: 6442655 - DNA, 12 bp, Homo sapiens
tcttctatttat

SEQ ID NO: 6442656 - DNA, 22 bp, Homo sapiens
tcttctatttatttatttattc

SEQ ID NO: 6442657 - DNA, 15 bp, Homo sapiens
tcttctattttattc

SEQ ID NO: 6442658 - DNA, 15 bp, Homo sapiens
tcttctcaaaagaac

SEQ ID NO: 6442659 - DNA, 17 bp, Homo sapiens
tcttctcaaagctggga

SEQ ID NO: 6442660 - DNA, 15 bp, Homo sapiens
tcttctcaagtgcct

SEQ ID NO: 6442661 - DNA, 20 bp, Homo sapiens
tcttctcacagtcaaaagga

SEQ ID NO: 6442662 - DNA, 15 bp, Homo sapiens
tcttctcagagcagc

SEQ ID NO: 6442663 - DNA, 14 bp, Homo sapiens
tcttctcagccact

SEQ ID NO: 6442664 - DNA, 21 bp, Homo sapiens
tcttctcaggctctgccctgc

SEQ ID NO: 6442665 - DNA, 15 bp, Homo sapiens
tcttctcagtgtctg

SEQ ID NO: 6442666 - DNA, 17 bp, Homo sapiens
tcttctcatagcattaa

SEQ ID NO: 6442667 - DNA, 19 bp, Homo sapiens
tcttctcatagcattaact

SEQ ID NO: 6442668 - DNA, 20 bp, Homo sapiens
tcttctcatagcattaacta

SEQ ID NO: 6442669 - DNA, 22 bp, Homo sapiens
tcttctcatatccataaaattg

SEQ ID NO: 6442670 - DNA, 19 bp, Homo sapiens
tcttctcattcttctaaaa

SEQ ID NO: 6442671 - DNA, 19 bp, Homo sapiens
tcttctcatttcacccctc

SEQ ID NO: 6442672 - DNA, 22 bp, Homo sapiens
tcttctcatttcacccctccct

SEQ ID NO: 6442673 - DNA, 23 bp, Homo sapiens
tcttctccaattctgaaatactt

SEQ ID NO: 6442674 - DNA, 16 bp, Homo sapiens
tcttctccaccagccc

SEQ ID NO: 6442675 - DNA, 20 bp, Homo sapiens
tcttctccacgtctttcctg

SEQ ID NO: 6442676 - DNA, 21 bp, Homo sapiens
tcttctccacgtctttcctgc

SEQ ID NO: 6442677 - DNA, 23 bp, Homo sapiens
tcttctccagatttttcggaggc

SEQ ID NO: 6442678 - DNA, 12 bp, Homo sapiens
tcttctccaggc

SEQ ID NO: 6442679 - DNA, 12 bp, Homo sapiens
tcttctccatct

SEQ ID NO: 6442680 - DNA, 12 bp, Homo sapiens
tcttctcccaga

SEQ ID NO: 6442681 - DNA, 16 bp, Homo sapiens
tcttctcccagaatcc

SEQ ID NO: 6442682 - DNA, 21 bp, Homo sapiens
tcttctcccagaatcccagcc

SEQ ID NO: 6442683 - DNA, 22 bp, Homo sapiens
tcttctcccagaatcccagccg

SEQ ID NO: 6442684 - DNA, 14 bp, Homo sapiens
tcttctccccacag

SEQ ID NO: 6442685 - DNA, 19 bp, Homo sapiens
tcttctccccacagcctct

SEQ ID NO: 6442686 - DNA, 12 bp, Homo sapiens
tcttctccccca

SEQ ID NO: 6442687 - DNA, 16 bp, Homo sapiens
tcttctcccccatcct

SEQ ID NO: 6442688 - DNA, 17 bp, Homo sapiens
tcttctccccgaggctg

SEQ ID NO: 6442689 - DNA, 22 bp, Homo sapiens
tcttctccctcctcctcctttc

SEQ ID NO: 6442690 - DNA, 11 bp, Homo sapiens
tcttctccctg

SEQ ID NO: 6442691 - DNA, 16 bp, Homo sapiens
tcttctcccttgtcct

SEQ ID NO: 6442692 - DNA, 15 bp, Homo sapiens
tcttctccttggagg

SEQ ID NO: 6442693 - DNA, 14 bp, Homo sapiens
tcttctcctttcac

SEQ ID NO: 6442694 - DNA, 13 bp, Homo sapiens
tcttctcctttgt

SEQ ID NO: 6442695 - DNA, 13 bp, Homo sapiens
tcttctcggctca

SEQ ID NO: 6442696 - DNA, 18 bp, Homo sapiens
tcttctcggctcaggctc

SEQ ID NO: 6442697 - DNA, 16 bp, Homo sapiens
tcttctcgtccctcct

SEQ ID NO: 6442698 - DNA, 20 bp, Homo sapiens
tcttctctagctggtggttt

SEQ ID NO: 6442699 - DNA, 13 bp, Homo sapiens
tcttctctccact

SEQ ID NO: 6442700 - DNA, 14 bp, Homo sapiens
tcttctctccagct

SEQ ID NO: 6442701 - DNA, 14 bp, Homo sapiens
tcttctctccccag

SEQ ID NO: 6442702 - DNA, 12 bp, Homo sapiens
tcttctctcctc

SEQ ID NO: 6442703 - DNA, 13 bp, Homo sapiens
tcttctctccttt

SEQ ID NO: 6442704 - DNA, 14 bp, Homo sapiens
tcttctctctgctc

SEQ ID NO: 6442705 - DNA, 14 bp, Homo sapiens
tcttctctcttgat

SEQ ID NO: 6442706 - DNA, 14 bp, Homo sapiens
tcttctctctttgt

SEQ ID NO: 6442707 - DNA, 21 bp, Homo sapiens
tcttctctgcaatgcttctgt

SEQ ID NO: 6442708 - DNA, 12 bp, Homo sapiens
tcttctctggag

SEQ ID NO: 6442709 - DNA, 13 bp, Homo sapiens
tcttctctgtgaa

SEQ ID NO: 6442710 - DNA, 15 bp, Homo sapiens
tcttctcttcctgta

SEQ ID NO: 6442711 - DNA, 19 bp, Homo sapiens
tcttctcttccttttatca

SEQ ID NO: 6442712 - DNA, 18 bp, Homo sapiens
tcttctcttgacagtctg

SEQ ID NO: 6442713 - DNA, 15 bp, Homo sapiens
tcttctctttttcca

SEQ ID NO: 6442714 - DNA, 23 bp, Homo sapiens
tcttctgaagaggaaaagtcaaa

SEQ ID NO: 6442715 - DNA, 18 bp, Homo sapiens
tcttctgaagatcagaac

SEQ ID NO: 6442716 - DNA, 20 bp, Homo sapiens
tcttctgaagatcagaacat

SEQ ID NO: 6442717 - DNA, 12 bp, Homo sapiens
tcttctgaagct

SEQ ID NO: 6442718 - DNA, 22 bp, Homo sapiens
tcttctgaagctagaaacaatc

SEQ ID NO: 6442719 - DNA, 17 bp, Homo sapiens
tcttctgacgtgccttt

SEQ ID NO: 6442720 - DNA, 19 bp, Homo sapiens
tcttctgagcgagtgctct

SEQ ID NO: 6442721 - DNA, 21 bp, Homo sapiens
tcttctgagctatttcatcta

SEQ ID NO: 6442722 - DNA, 19 bp, Homo sapiens
tcttctgatcactgaaata

SEQ ID NO: 6442723 - DNA, 17 bp, Homo sapiens
tcttctgcaagcctcat

SEQ ID NO: 6442724 - DNA, 17 bp, Homo sapiens
tcttctgccagcctccc

SEQ ID NO: 6442725 - DNA, 19 bp, Homo sapiens
tcttctgcccctctactgt

SEQ ID NO: 6442726 - DNA, 12 bp, Homo sapiens
tcttctgcctgt

SEQ ID NO: 6442727 - DNA, 16 bp, Homo sapiens
tcttctgcctgttata

SEQ ID NO: 6442728 - DNA, 15 bp, Homo sapiens
tcttctgctccaccc

SEQ ID NO: 6442729 - DNA, 17 bp, Homo sapiens
tcttctgctccaccctt

SEQ ID NO: 6442730 - DNA, 22 bp, Homo sapiens
tcttctgctccacccttggcct

SEQ ID NO: 6442731 - DNA, 23 bp, Homo sapiens
tcttctgctccacccttggcctg

SEQ ID NO: 6442732 - DNA, 18 bp, Homo sapiens
tcttctgctctttcttct

SEQ ID NO: 6442733 - DNA, 22 bp, Homo sapiens
tcttctgctctttcttcttcca

SEQ ID NO: 6442734 - DNA, 17 bp, Homo sapiens
tcttctgctcttttcct

SEQ ID NO: 6442735 - DNA, 21 bp, Homo sapiens
tcttctgctttgttgtgtgcc

SEQ ID NO: 6442736 - DNA, 20 bp, Homo sapiens
tccaaatcttgaatttctgc

SEQ ID NO: 6442737 - DNA, 19 bp, Homo sapiens
tccaaatgaatgaccttgt

SEQ ID NO: 6442738 - DNA, 19 bp, Homo sapiens
tccaaatgattttcatcaa

SEQ ID NO: 6442739 - DNA, 21 bp, Homo sapiens
tccaaatgattttcatcaatt

SEQ ID NO: 6442740 - DNA, 22 bp, Homo sapiens
tccaaatgattttcatcaattt

SEQ ID NO: 6442741 - DNA, 14 bp, Homo sapiens
tccaaatgcagctt

SEQ ID NO: 6442742 - DNA, 17 bp, Homo sapiens
tccaaatgctgtgcaaa

SEQ ID NO: 6442743 - DNA, 14 bp, Homo sapiens
tccaaatggaatta

SEQ ID NO: 6442744 - DNA, 19 bp, Homo sapiens
tccaaatggagaagctgca

SEQ ID NO: 6442745 - DNA, 18 bp, Homo sapiens
tccaaatggcgtctggaa

SEQ ID NO: 6442746 - DNA, 23 bp, Homo sapiens
tccaaatggctattataaaaatg

SEQ ID NO: 6442747 - DNA, 21 bp, Homo sapiens
tccaaatgtccctccaacaca

SEQ ID NO: 6442748 - DNA, 19 bp, Homo sapiens
tccaaatgtcctccagaag

SEQ ID NO: 6442749 - DNA, 22 bp, Homo sapiens
tccaaatgtcctccagaagcct

SEQ ID NO: 6442750 - DNA, 11 bp, Homo sapiens
tccaaatgtct

SEQ ID NO: 6442751 - DNA, 16 bp, Homo sapiens
tccaaatgtgaaagat

SEQ ID NO: 6442752 - DNA, 18 bp, Homo sapiens
tccaaatgtgtcagaata

SEQ ID NO: 6442753 - DNA, 19 bp, Homo sapiens
tccaaattaggaagtgttt

SEQ ID NO: 6442754 - DNA, 12 bp, Homo sapiens
tccaaattatta

SEQ ID NO: 6442755 - DNA, 22 bp, Homo sapiens
tccaaattattaattgtcctgt

SEQ ID NO: 6442756 - DNA, 23 bp, Homo sapiens
tccaaattattaattgtcctgtg

SEQ ID NO: 6442757 - DNA, 17 bp, Homo sapiens
tccaaattatttcttaa

SEQ ID NO: 6442758 - DNA, 12 bp, Homo sapiens
tccaaattcagt

SEQ ID NO: 6442759 - DNA, 18 bp, Homo sapiens
tccaaattcagtttcata

SEQ ID NO: 6442760 - DNA, 14 bp, Homo sapiens
tccaaattccctct

SEQ ID NO: 6442761 - DNA, 19 bp, Homo sapiens
tccaaattcctagaaaagt

SEQ ID NO: 6442762 - DNA, 14 bp, Homo sapiens
tccaaattctctga

SEQ ID NO: 6442763 - DNA, 18 bp, Homo sapiens
tccaaattgatgggtggg

SEQ ID NO: 6442764 - DNA, 19 bp, Homo sapiens
tccaaattgatgggtgggc

SEQ ID NO: 6442765 - DNA, 15 bp, Homo sapiens
tccaaattgtgcttc

SEQ ID NO: 6442766 - DNA, 19 bp, Homo sapiens
tccaaattgtttgtacagt

SEQ ID NO: 6442767 - DNA, 22 bp, Homo sapiens
tccaaatttggctcacttgcct

SEQ ID NO: 6442768 - DNA, 15 bp, Homo sapiens
tccaacaactgtcag

SEQ ID NO: 6442769 - DNA, 13 bp, Homo sapiens
tccaacaagaaga

SEQ ID NO: 6442770 - DNA, 14 bp, Homo sapiens
tccaacaagaagaa

SEQ ID NO: 6442771 - DNA, 16 bp, Homo sapiens
tccaacaagaagaaat

SEQ ID NO: 6442772 - DNA, 18 bp, Homo sapiens
tccaacaagaagaaatat

SEQ ID NO: 6442773 - DNA, 23 bp, Homo sapiens
tccaacaagaagggactgagaga

SEQ ID NO: 6442774 - DNA, 12 bp, Homo sapiens
tccaacaataaa

SEQ ID NO: 6442775 - DNA, 16 bp, Homo sapiens
tccaacaataaacagg

SEQ ID NO: 6442776 - DNA, 23 bp, Homo sapiens
tccaacacaaggctccaagacct

SEQ ID NO: 6442777 - DNA, 17 bp, Homo sapiens
tccaacaccaagcacag

SEQ ID NO: 6442778 - DNA, 21 bp, Homo sapiens
tccaacaccaagcacagcagc

SEQ ID NO: 6442779 - DNA, 18 bp, Homo sapiens
tccaacaccacagacaca

SEQ ID NO: 6442780 - DNA, 21 bp, Homo sapiens
tccaacaccacagacacacac

SEQ ID NO: 6442781 - DNA, 20 bp, Homo sapiens
tccaacactgatttcccctt

SEQ ID NO: 6442782 - DNA, 20 bp, Homo sapiens
tccaacagaactaaatgttc

SEQ ID NO: 6442783 - DNA, 17 bp, Homo sapiens
tccaacagaagaactgt

SEQ ID NO: 6442784 - DNA, 17 bp, Homo sapiens
tccaacagacacaattt

SEQ ID NO: 6442785 - DNA, 18 bp, Homo sapiens
tccaacagacaccctcca

SEQ ID NO: 6442786 - DNA, 23 bp, Homo sapiens
tccaacagacaccctccactctg

SEQ ID NO: 6442787 - DNA, 21 bp, Homo sapiens
tccaacagacctggtgctcta

SEQ ID NO: 6442788 - DNA, 18 bp, Homo sapiens
tccaacagcttgaccaga

SEQ ID NO: 6442789 - DNA, 14 bp, Homo sapiens
tccaacaggagctg

SEQ ID NO: 6442790 - DNA, 17 bp, Homo sapiens
tccaacaggagctggga

SEQ ID NO: 6442791 - DNA, 21 bp, Homo sapiens
tccaacaggcgtgggatcaga

SEQ ID NO: 6442792 - DNA, 15 bp, Homo sapiens
tccaacagtttaatg

SEQ ID NO: 6442793 - DNA, 21 bp, Homo sapiens
tccaacagtttaatgaagatc

SEQ ID NO: 6442794 - DNA, 15 bp, Homo sapiens
tccaacatccactct

SEQ ID NO: 6442795 - DNA, 20 bp, Homo sapiens
tccaacatctttctttttaa

SEQ ID NO: 6442796 - DNA, 20 bp, Homo sapiens
tccaacattttttcccagtg

SEQ ID NO: 6442797 - DNA, 23 bp, Homo sapiens
tccaaccactgtgccactgactt

SEQ ID NO: 6442798 - DNA, 18 bp, Homo sapiens
tccaaccattcaaaaatt

SEQ ID NO: 6442799 - DNA, 16 bp, Homo sapiens
tccaaccattttcatt

SEQ ID NO: 6442800 - DNA, 17 bp, Homo sapiens
tccaaccattttcatta

SEQ ID NO: 6442801 - DNA, 15 bp, Homo sapiens
tccaacccaaagtat

SEQ ID NO: 6442802 - DNA, 23 bp, Homo sapiens
tccaacccaacccaatccctctc

SEQ ID NO: 6442803 - DNA, 17 bp, Homo sapiens
tccaacccatgcatggc

SEQ ID NO: 6442804 - DNA, 18 bp, Homo sapiens
tccaacccatgcatggcc

SEQ ID NO: 6442805 - DNA, 14 bp, Homo sapiens
tccaaccccaactc

SEQ ID NO: 6442806 - DNA, 13 bp, Homo sapiens
tccaaccccagct

SEQ ID NO: 6442807 - DNA, 14 bp, Homo sapiens
tccaaccccagctg

SEQ ID NO: 6442808 - DNA, 22 bp, Homo sapiens
tccaaccccccagcactgagga

SEQ ID NO: 6442809 - DNA, 23 bp, Homo sapiens
tccaaccccccagcactgaggaa

SEQ ID NO: 6442810 - DNA, 15 bp, Homo sapiens
tccaacccctccccc

SEQ ID NO: 6442811 - DNA, 17 bp, Homo sapiens
tccaacccctcccccac

SEQ ID NO: 6442812 - DNA, 18 bp, Homo sapiens
tccaacccctcgcccagt

SEQ ID NO: 6442813 - DNA, 16 bp, Homo sapiens
tccaacccgaggcccg

SEQ ID NO: 6442814 - DNA, 15 bp, Homo sapiens
tccaacccggggacc

SEQ ID NO: 6442815 - DNA, 19 bp, Homo sapiens
tccaacccggggaccccca

SEQ ID NO: 6442816 - DNA, 23 bp, Homo sapiens
tccaacccgtctggcccaccagg

SEQ ID NO: 6442817 - DNA, 21 bp, Homo sapiens
tccaacccgttgggtcccttg

SEQ ID NO: 6442818 - DNA, 13 bp, Homo sapiens
tccaaccctagca

SEQ ID NO: 6442819 - DNA, 14 bp, Homo sapiens
tccaaccctagcaa

SEQ ID NO: 6442820 - DNA, 14 bp, Homo sapiens
tccaaccctcatca

SEQ ID NO: 6442821 - DNA, 17 bp, Homo sapiens
tccaaccctcatcacca

SEQ ID NO: 6442822 - DNA, 21 bp, Homo sapiens
tccaaccctgccgtcaccacc

SEQ ID NO: 6442823 - DNA, 23 bp, Homo sapiens
tccaacctaacccctttcctgcg

SEQ ID NO: 6442824 - DNA, 16 bp, Homo sapiens
tccaacctaacctgtg

SEQ ID NO: 6442825 - DNA, 15 bp, Homo sapiens
tccaacctcacttcc

SEQ ID NO: 6442826 - DNA, 15 bp, Homo sapiens
tccaacctcctgctc

SEQ ID NO: 6442827 - DNA, 17 bp, Homo sapiens
tccaacctcctgctctg

SEQ ID NO: 6442828 - DNA, 20 bp, Homo sapiens
tccaacctcctgctctggga

SEQ ID NO: 6442829 - DNA, 21 bp, Homo sapiens
tccaacctgcaaagatctgtc

SEQ ID NO: 6442830 - DNA, 12 bp, Homo sapiens
tccaacctggag

SEQ ID NO: 6442831 - DNA, 21 bp, Homo sapiens
tccaacctggggggcagtggt

SEQ ID NO: 6442832 - DNA, 13 bp, Homo sapiens
tccaaccttcctt

SEQ ID NO: 6442833 - DNA, 16 bp, Homo sapiens
tccaaccttccttttt

SEQ ID NO: 6442834 - DNA, 17 bp, Homo sapiens
tccaaccttctgccctc

SEQ ID NO: 6442835 - DNA, 18 bp, Homo sapiens
tccaaccttctgccctcc

SEQ ID NO: 6442836 - DNA, 20 bp, Homo sapiens
tccaaccttctgccctcctg

SEQ ID NO: 6442837 - DNA, 22 bp, Homo sapiens
tccaacgaggctaagttaatgc

SEQ ID NO: 6442838 - DNA, 16 bp, Homo sapiens
tccaacgcccctgtgg

SEQ ID NO: 6442839 - DNA, 20 bp, Homo sapiens
tccaacgcccctgtggccaa

SEQ ID NO: 6442840 - DNA, 21 bp, Homo sapiens
tccaacgcccctgtggccaac

SEQ ID NO: 6442841 - DNA, 14 bp, Homo sapiens
tccaacgccgcctt

SEQ ID NO: 6442842 - DNA, 22 bp, Homo sapiens
tccaacgccgccttggccttgc

SEQ ID NO: 6442843 - DNA, 15 bp, Homo sapiens
tccaacgtttggaag

SEQ ID NO: 6442844 - DNA, 19 bp, Homo sapiens
tccaactaatgccttactc

SEQ ID NO: 6442845 - DNA, 20 bp, Homo sapiens
tccaactactaatagaataa

SEQ ID NO: 6442846 - DNA, 21 bp, Homo sapiens
tccaactactaatagaataaa

SEQ ID NO: 6442847 - DNA, 17 bp, Homo sapiens
tccaactcacttccagt

SEQ ID NO: 6442848 - DNA, 20 bp, Homo sapiens
tccaactcagagcacagcca

SEQ ID NO: 6442849 - DNA, 14 bp, Homo sapiens
tccaactcaggtta

SEQ ID NO: 6442850 - DNA, 21 bp, Homo sapiens
tccaactccaacatccactct

SEQ ID NO: 6442851 - DNA, 16 bp, Homo sapiens
tccaactccacaccct

SEQ ID NO: 6442852 - DNA, 11 bp, Homo sapiens
tccaactccag

SEQ ID NO: 6442853 - DNA, 20 bp, Homo sapiens
tccaactccagctgagtcct

SEQ ID NO: 6442854 - DNA, 19 bp, Homo sapiens
tccaactccgaaagtctga

SEQ ID NO: 6442855 - DNA, 15 bp, Homo sapiens
tccaactcctgatgc

SEQ ID NO: 6442856 - DNA, 20 bp, Homo sapiens
tccaactcctggagatttca

SEQ ID NO: 6442857 - DNA, 18 bp, Homo sapiens
tccaactcgaatctgtgt

SEQ ID NO: 6442858 - DNA, 19 bp, Homo sapiens
tccaactcgaatctgtgtg

SEQ ID NO: 6442859 - DNA, 14 bp, Homo sapiens
tccaactctgtatt

SEQ ID NO: 6442860 - DNA, 15 bp, Homo sapiens
tccaactctgtattt

SEQ ID NO: 6442861 - DNA, 19 bp, Homo sapiens
tccaactcttccacctctg

SEQ ID NO: 6442862 - DNA, 13 bp, Homo sapiens
tccaactggaaat

SEQ ID NO: 6442863 - DNA, 15 bp, Homo sapiens
tccaacttaggctac

SEQ ID NO: 6442864 - DNA, 15 bp, Homo sapiens
tccaactttattttg

SEQ ID NO: 6442865 - DNA, 20 bp, Homo sapiens
tccaactttcacagtgaagt

SEQ ID NO: 6442866 - DNA, 17 bp, Homo sapiens
tccaactttcaggggct

SEQ ID NO: 6442867 - DNA, 20 bp, Homo sapiens
tccaagaaacgtggatctcc

SEQ ID NO: 6442868 - DNA, 22 bp, Homo sapiens
tccaagaaacgtggatctcccc

SEQ ID NO: 6442869 - DNA, 23 bp, Homo sapiens
tccaagaaacgtggatctccccc

SEQ ID NO: 6442870 - DNA, 15 bp, Homo sapiens
tccaagaaattttag

SEQ ID NO: 6442871 - DNA, 12 bp, Homo sapiens
tccaagaagccc

SEQ ID NO: 6442872 - DNA, 22 bp, Homo sapiens
tccaagaagcccaggaaaggct

SEQ ID NO: 6442873 - DNA, 16 bp, Homo sapiens
tccaagaagccctcct

SEQ ID NO: 6442874 - DNA, 21 bp, Homo sapiens
tccaagaagccctccttgcca

SEQ ID NO: 6442875 - DNA, 19 bp, Homo sapiens
tccaagaatacagaaaatg

SEQ ID NO: 6442876 - DNA, 19 bp, Homo sapiens
tccaagaatagcatctgta

SEQ ID NO: 6442877 - DNA, 14 bp, Homo sapiens
tccaagaatccaca

SEQ ID NO: 6442878 - DNA, 22 bp, Homo sapiens
tccaagaatccacatttctaaa

SEQ ID NO: 6442879 - DNA, 12 bp, Homo sapiens
tccaagaatcta

SEQ ID NO: 6442880 - DNA, 13 bp, Homo sapiens
tccaagaatgctg

SEQ ID NO: 6442881 - DNA, 14 bp, Homo sapiens
tccaagaatgctga

SEQ ID NO: 6442882 - DNA, 16 bp, Homo sapiens
tccaagaatgctgaaa

SEQ ID NO: 6442883 - DNA, 18 bp, Homo sapiens
tccaagaatggaagcctg

SEQ ID NO: 6442884 - DNA, 19 bp, Homo sapiens
tccaagacaaactaaactt

SEQ ID NO: 6442885 - DNA, 17 bp, Homo sapiens
tccaagacagcagcagc

SEQ ID NO: 6442886 - DNA, 20 bp, Homo sapiens
tccaagacagcagcagcctg

SEQ ID NO: 6442887 - DNA, 22 bp, Homo sapiens
tccaagacagcagcagcctgca

SEQ ID NO: 6442888 - DNA, 18 bp, Homo sapiens
tccaagacagtatacagt

SEQ ID NO: 6442889 - DNA, 18 bp, Homo sapiens
tccaagaccaccagggtc

SEQ ID NO: 6442890 - DNA, 18 bp, Homo sapiens
tccaagaccatttgtagt

SEQ ID NO: 6442891 - DNA, 15 bp, Homo sapiens
tccaagacctggtgt

SEQ ID NO: 6442892 - DNA, 20 bp, Homo sapiens
tccaagaccttacaaccaca

SEQ ID NO: 6442893 - DNA, 20 bp, Homo sapiens
tccaagaccttctccttcac

SEQ ID NO: 6442894 - DNA, 14 bp, Homo sapiens
tccaagactctaga

SEQ ID NO: 6442895 - DNA, 16 bp, Homo sapiens
tccaagactgaagact

SEQ ID NO: 6442896 - DNA, 13 bp, Homo sapiens
tccaagagacatg

SEQ ID NO: 6442897 - DNA, 13 bp, Homo sapiens
tccaagaggctga

SEQ ID NO: 6442898 - DNA, 13 bp, Homo sapiens
tccaagaggctgt

SEQ ID NO: 6442899 - DNA, 16 bp, Homo sapiens
tccaagagggaatggt

SEQ ID NO: 6442900 - DNA, 19 bp, Homo sapiens
tccaagagggaatggtcaa

SEQ ID NO: 6442901 - DNA, 19 bp, Homo sapiens
tccaagagggtcctttagt

SEQ ID NO: 6442902 - DNA, 16 bp, Homo sapiens
tccaagagtctaaaga

SEQ ID NO: 6442903 - DNA, 17 bp, Homo sapiens
tccaagagtctgatgat

SEQ ID NO: 6442904 - DNA, 14 bp, Homo sapiens
tccaagataagcct

SEQ ID NO: 6442905 - DNA, 15 bp, Homo sapiens
tccaagataagcctg

SEQ ID NO: 6442906 - DNA, 19 bp, Homo sapiens
tccaagataagcctgagcc

SEQ ID NO: 6442907 - DNA, 20 bp, Homo sapiens
tccaagataagcctgagcct

SEQ ID NO: 6442908 - DNA, 13 bp, Homo sapiens
tccaagattccgg

SEQ ID NO: 6442909 - DNA, 17 bp, Homo sapiens
tccaagattctagatga

SEQ ID NO: 6442910 - DNA, 18 bp, Homo sapiens
tccaagattctagatgat

SEQ ID NO: 6442911 - DNA, 21 bp, Homo sapiens
tccaagcaaaatctaaaatgt

SEQ ID NO: 6442912 - DNA, 16 bp, Homo sapiens
tccaagcacagagcct

SEQ ID NO: 6442913 - DNA, 22 bp, Homo sapiens
tccaagcacagagcctggcccc

SEQ ID NO: 6442914 - DNA, 23 bp, Homo sapiens
tcttctgctttgttgtgtgcctc

SEQ ID NO: 6442915 - DNA, 17 bp, Homo sapiens
tcttctggacttggtct

SEQ ID NO: 6442916 - DNA, 19 bp, Homo sapiens
tcttctggacttggtcttg

SEQ ID NO: 6442917 - DNA, 20 bp, Homo sapiens
tcttctggagatggaagctt

SEQ ID NO: 6442918 - DNA, 19 bp, Homo sapiens
tcttctggagtctccagtg

SEQ ID NO: 6442919 - DNA, 12 bp, Homo sapiens
tcttctggagtt

SEQ ID NO: 6442920 - DNA, 20 bp, Homo sapiens
tcttctgggagggcagcagg

SEQ ID NO: 6442921 - DNA, 21 bp, Homo sapiens
tcttctgggcagagcctgtcc

SEQ ID NO: 6442922 - DNA, 20 bp, Homo sapiens
tcttctgggtagtcccctgt

SEQ ID NO: 6442923 - DNA, 18 bp, Homo sapiens
tcttctgggttccttcct

SEQ ID NO: 6442924 - DNA, 19 bp, Homo sapiens
tcttctggtctgtgtgtgt

SEQ ID NO: 6442925 - DNA, 21 bp, Homo sapiens
tcttctggtctgtgtgtgttc

SEQ ID NO: 6442926 - DNA, 22 bp, Homo sapiens
tcttctggtctgtgtgtgttct

SEQ ID NO: 6442927 - DNA, 19 bp, Homo sapiens
tcttctggtgagtgcaaga

SEQ ID NO: 6442928 - DNA, 15 bp, Homo sapiens
tcttctggtttccct

SEQ ID NO: 6442929 - DNA, 22 bp, Homo sapiens
tcttctgtaaaatgggtatatt

SEQ ID NO: 6442930 - DNA, 21 bp, Homo sapiens
tcttctgtacgtctgacaggc

SEQ ID NO: 6442931 - DNA, 23 bp, Homo sapiens
tcttctgtacgtctgacaggcaa

SEQ ID NO: 6442932 - DNA, 17 bp, Homo sapiens
tcttctgtatataaatg

SEQ ID NO: 6442933 - DNA, 20 bp, Homo sapiens
tcttctgtatataaatggga

SEQ ID NO: 6442934 - DNA, 14 bp, Homo sapiens
tcttctgtatttct

SEQ ID NO: 6442935 - DNA, 14 bp, Homo sapiens
tcttctgtattttt

SEQ ID NO: 6442936 - DNA, 22 bp, Homo sapiens
tcttctgtcatcccgctcctgc

SEQ ID NO: 6442937 - DNA, 17 bp, Homo sapiens
tcttctgtcatctacct

SEQ ID NO: 6442938 - DNA, 16 bp, Homo sapiens
tcttctgtccatcagt

SEQ ID NO: 6442939 - DNA, 12 bp, Homo sapiens
tcttctgtccct

SEQ ID NO: 6442940 - DNA, 20 bp, Homo sapiens
tcttctgtgccctggctcca

SEQ ID NO: 6442941 - DNA, 20 bp, Homo sapiens
tcttctgtgggtttctaaag

SEQ ID NO: 6442942 - DNA, 15 bp, Homo sapiens
tcttctgtgttaatt

SEQ ID NO: 6442943 - DNA, 12 bp, Homo sapiens
tcttctgtgttt

SEQ ID NO: 6442944 - DNA, 21 bp, Homo sapiens
tcttctgtgtttataaaatat

SEQ ID NO: 6442945 - DNA, 22 bp, Homo sapiens
tcttctgttaggggccaataaa

SEQ ID NO: 6442946 - DNA, 20 bp, Homo sapiens
tcttctgtttttctcaaata

SEQ ID NO: 6442947 - DNA, 13 bp, Homo sapiens
tcttcttaactta

SEQ ID NO: 6442948 - DNA, 16 bp, Homo sapiens
tcttcttaatgtacat

SEQ ID NO: 6442949 - DNA, 17 bp, Homo sapiens
tcttcttacacttctta

SEQ ID NO: 6442950 - DNA, 22 bp, Homo sapiens
tcttcttactcattactgcaaa

SEQ ID NO: 6442951 - DNA, 23 bp, Homo sapiens
tcttcttactcattactgcaaat

SEQ ID NO: 6442952 - DNA, 23 bp, Homo sapiens
tcttcttacttcacccggctggg

SEQ ID NO: 6442953 - DNA, 18 bp, Homo sapiens
tcttcttataacttgtaa

SEQ ID NO: 6442954 - DNA, 16 bp, Homo sapiens
tcttcttatcacactt

SEQ ID NO: 6442955 - DNA, 17 bp, Homo sapiens
tcttcttattacccaaa

SEQ ID NO: 6442956 - DNA, 19 bp, Homo sapiens
tcttcttattacccaaacc

SEQ ID NO: 6442957 - DNA, 21 bp, Homo sapiens
tcttcttattcatgctttctc

SEQ ID NO: 6442958 - DNA, 13 bp, Homo sapiens
tcttcttcaaacc

SEQ ID NO: 6442959 - DNA, 15 bp, Homo sapiens
tcttcttcaaacctt

SEQ ID NO: 6442960 - DNA, 13 bp, Homo sapiens
tcttcttcaccat

SEQ ID NO: 6442961 - DNA, 15 bp, Homo sapiens
tcttcttcaccattt

SEQ ID NO: 6442962 - DNA, 15 bp, Homo sapiens
tcttcttctcaagca

SEQ ID NO: 6442963 - DNA, 14 bp, Homo sapiens
tcttcttctgaaga

SEQ ID NO: 6442964 - DNA, 14 bp, Homo sapiens
tcttcttcttcaga

SEQ ID NO: 6442965 - DNA, 15 bp, Homo sapiens
tcttcttcttctttt

SEQ ID NO: 6442966 - DNA, 13 bp, Homo sapiens
tcttcttgaaaaa

SEQ ID NO: 6442967 - DNA, 13 bp, Homo sapiens
tcttcttgaaatt

SEQ ID NO: 6442968 - DNA, 21 bp, Homo sapiens
tcttcttgaaatttgtgatgg

SEQ ID NO: 6442969 - DNA, 17 bp, Homo sapiens
tcttcttgaaattttaa

SEQ ID NO: 6442970 - DNA, 22 bp, Homo sapiens
tcttcttgaacactcatgctga

SEQ ID NO: 6442971 - DNA, 20 bp, Homo sapiens
tcttcttgagcagaccgtga

SEQ ID NO: 6442972 - DNA, 21 bp, Homo sapiens
tcttcttgctacacccctttt

SEQ ID NO: 6442973 - DNA, 20 bp, Homo sapiens
tcttcttgctatatgattta

SEQ ID NO: 6442974 - DNA, 18 bp, Homo sapiens
tcttcttgctgcagcctg

SEQ ID NO: 6442975 - DNA, 14 bp, Homo sapiens
tcttcttggcagct

SEQ ID NO: 6442976 - DNA, 14 bp, Homo sapiens
tcttcttgggagta

SEQ ID NO: 6442977 - DNA, 22 bp, Homo sapiens
tcttcttgggcccggtccacag

SEQ ID NO: 6442978 - DNA, 20 bp, Homo sapiens
tcttcttggggcccagtgca

SEQ ID NO: 6442979 - DNA, 13 bp, Homo sapiens
tcttcttgtgaaa

SEQ ID NO: 6442980 - DNA, 19 bp, Homo sapiens
tcttcttgtggttgtatat

SEQ ID NO: 6442981 - DNA, 21 bp, Homo sapiens
tcttcttgtggttgtatatat

SEQ ID NO: 6442982 - DNA, 19 bp, Homo sapiens
tcttctttagatgccaaac

SEQ ID NO: 6442983 - DNA, 17 bp, Homo sapiens
tcttctttattgcacta

SEQ ID NO: 6442984 - DNA, 19 bp, Homo sapiens
tcttctttcagacttgcca

SEQ ID NO: 6442985 - DNA, 22 bp, Homo sapiens
tcttctttcatgtaagtagcaa

SEQ ID NO: 6442986 - DNA, 22 bp, Homo sapiens
tcttctttcccaaaattaggga

SEQ ID NO: 6442987 - DNA, 13 bp, Homo sapiens
tcttctttccctg

SEQ ID NO: 6442988 - DNA, 22 bp, Homo sapiens
tcttctttccctggacaggcag

SEQ ID NO: 6442989 - DNA, 13 bp, Homo sapiens
tcttctttctcca

SEQ ID NO: 6442990 - DNA, 13 bp, Homo sapiens
tcttctttctgaa

SEQ ID NO: 6442991 - DNA, 17 bp, Homo sapiens
tcttctttgtgcctttg

SEQ ID NO: 6442992 - DNA, 22 bp, Homo sapiens
tcttctttgtgcctttggcctg

SEQ ID NO: 6442993 - DNA, 21 bp, Homo sapiens
tcttcttttagcagtaaaata

SEQ ID NO: 6442994 - DNA, 15 bp, Homo sapiens
tcttcttttcccatt

SEQ ID NO: 6442995 - DNA, 19 bp, Homo sapiens
tcttcttttgagcaacttt

SEQ ID NO: 6442996 - DNA, 16 bp, Homo sapiens
tcttcttttggcttcc

SEQ ID NO: 6442997 - DNA, 20 bp, Homo sapiens
tcttcttttgtggtgtcttc

SEQ ID NO: 6442998 - DNA, 22 bp, Homo sapiens
tcttcttttttaagttgtcaaa

SEQ ID NO: 6442999 - DNA, 16 bp, Homo sapiens
tcttctttttttgtga

SEQ ID NO: 6443000 - DNA, 14 bp, Homo sapiens
tcttgaaaaaaaat

SEQ ID NO: 6443001 - DNA, 15 bp, Homo sapiens
tcttgaaaaaaaata

SEQ ID NO: 6443002 - DNA, 19 bp, Homo sapiens
tcttgaaaaaaaatagatg

SEQ ID NO: 6443003 - DNA, 21 bp, Homo sapiens
tcttgaaaaaaaatagatgtt

SEQ ID NO: 6443004 - DNA, 17 bp, Homo sapiens
tcttgaaaaacttacaa

SEQ ID NO: 6443005 - DNA, 12 bp, Homo sapiens
tcttgaaaaaga

SEQ ID NO: 6443006 - DNA, 21 bp, Homo sapiens
tcttgaaaactgggacgtgta

SEQ ID NO: 6443007 - DNA, 21 bp, Homo sapiens
tcttgaaaactgtgcaacttt

SEQ ID NO: 6443008 - DNA, 23 bp, Homo sapiens
tcttgaaaactgtgcaacttttt

SEQ ID NO: 6443009 - DNA, 20 bp, Homo sapiens
tcttgaaaagaatctagata

SEQ ID NO: 6443010 - DNA, 16 bp, Homo sapiens
tcttgaaaagccttgg

SEQ ID NO: 6443011 - DNA, 17 bp, Homo sapiens
tcttgaaaataaaaaat

SEQ ID NO: 6443012 - DNA, 13 bp, Homo sapiens
tcttgaaaatatt

SEQ ID NO: 6443013 - DNA, 14 bp, Homo sapiens
tcttgaaaatgcca

SEQ ID NO: 6443014 - DNA, 16 bp, Homo sapiens
tcttgaaaatgccacc

SEQ ID NO: 6443015 - DNA, 15 bp, Homo sapiens
tcttgaaacagcctg

SEQ ID NO: 6443016 - DNA, 20 bp, Homo sapiens
tcttgaaacctgttaaaaca

SEQ ID NO: 6443017 - DNA, 18 bp, Homo sapiens
tcttgaaagaagaatgtg

SEQ ID NO: 6443018 - DNA, 21 bp, Homo sapiens
tcttgaaaggtccaaatgttt

SEQ ID NO: 6443019 - DNA, 16 bp, Homo sapiens
tcttgaaatattcaga

SEQ ID NO: 6443020 - DNA, 17 bp, Homo sapiens
tcttgaaatgaaaggga

SEQ ID NO: 6443021 - DNA, 19 bp, Homo sapiens
tcttgaaatgaaagggaaa

SEQ ID NO: 6443022 - DNA, 23 bp, Homo sapiens
tcttgaaatgaaagtataactga

SEQ ID NO: 6443023 - DNA, 20 bp, Homo sapiens
tcttgaaattaagaaggcaa

SEQ ID NO: 6443024 - DNA, 21 bp, Homo sapiens
tcttgaaattaagaaggcaaa

SEQ ID NO: 6443025 - DNA, 16 bp, Homo sapiens
tcttgaaattgaagag

SEQ ID NO: 6443026 - DNA, 15 bp, Homo sapiens
tcttgaaatttgtga

SEQ ID NO: 6443027 - DNA, 20 bp, Homo sapiens
tcttgaacactcatgctgaa

SEQ ID NO: 6443028 - DNA, 18 bp, Homo sapiens
tcttgaacgagcagccca

SEQ ID NO: 6443029 - DNA, 19 bp, Homo sapiens
tcttgaacgttatgttcag

SEQ ID NO: 6443030 - DNA, 15 bp, Homo sapiens
tcttgaactcctaga

SEQ ID NO: 6443031 - DNA, 16 bp, Homo sapiens
tcttgaactcctggcc

SEQ ID NO: 6443032 - DNA, 19 bp, Homo sapiens
tcttgaactcttggcctca

SEQ ID NO: 6443033 - DNA, 14 bp, Homo sapiens
tcttgaactgggct

SEQ ID NO: 6443034 - DNA, 23 bp, Homo sapiens
tcttgaacttgaaaaaaaaaaac

SEQ ID NO: 6443035 - DNA, 21 bp, Homo sapiens
tcttgaagcatttcaaagccc

SEQ ID NO: 6443036 - DNA, 19 bp, Homo sapiens
tcttgaagcccccagccct

SEQ ID NO: 6443037 - DNA, 14 bp, Homo sapiens
tcttgaagctgggc

SEQ ID NO: 6443038 - DNA, 18 bp, Homo sapiens
tcttgaaggaaaaattca

SEQ ID NO: 6443039 - DNA, 22 bp, Homo sapiens
tcttgaaggccacatgtgaaaa

SEQ ID NO: 6443040 - DNA, 18 bp, Homo sapiens
tcttgaaggtgctgccac

SEQ ID NO: 6443041 - DNA, 14 bp, Homo sapiens
tcttgaagtactta

SEQ ID NO: 6443042 - DNA, 16 bp, Homo sapiens
tcttgaagtccagtgt

SEQ ID NO: 6443043 - DNA, 21 bp, Homo sapiens
tcttgaagtgatgttgtttaa

SEQ ID NO: 6443044 - DNA, 21 bp, Homo sapiens
tcttgaataaagtattctagt

SEQ ID NO: 6443045 - DNA, 23 bp, Homo sapiens
tcttgaataaagtattctagtgt

SEQ ID NO: 6443046 - DNA, 22 bp, Homo sapiens
tcttgaatagattttctctgga

SEQ ID NO: 6443047 - DNA, 16 bp, Homo sapiens
tcttgaatcctctatt

SEQ ID NO: 6443048 - DNA, 23 bp, Homo sapiens
tcttgaatggcaatgttttgctt

SEQ ID NO: 6443049 - DNA, 14 bp, Homo sapiens
tcttgaatgtcttt

SEQ ID NO: 6443050 - DNA, 22 bp, Homo sapiens
tcttgaatgttgaagaactcat

SEQ ID NO: 6443051 - DNA, 13 bp, Homo sapiens
tcttgaattatat

SEQ ID NO: 6443052 - DNA, 15 bp, Homo sapiens
tcttgaattcctctc

SEQ ID NO: 6443053 - DNA, 17 bp, Homo sapiens
tcttgaattgtaaggaa

SEQ ID NO: 6443054 - DNA, 14 bp, Homo sapiens
tcttgaatttctgc

SEQ ID NO: 6443055 - DNA, 22 bp, Homo sapiens
tcttgaatttttttctgcacag

SEQ ID NO: 6443056 - DNA, 23 bp, Homo sapiens
tcttgaatttttttctgcacagc

SEQ ID NO: 6443057 - DNA, 20 bp, Homo sapiens
tcttgacaccagctgttctg

SEQ ID NO: 6443058 - DNA, 16 bp, Homo sapiens
tcttgacacggtgaaa

SEQ ID NO: 6443059 - DNA, 21 bp, Homo sapiens
tcttgacacggtgaaatccag

SEQ ID NO: 6443060 - DNA, 19 bp, Homo sapiens
tcttgacaggcgccgcctc

SEQ ID NO: 6443061 - DNA, 23 bp, Homo sapiens
tcttgacaggcgccgcctcgccc

SEQ ID NO: 6443062 - DNA, 19 bp, Homo sapiens
tcttgacagtatatttgaa

SEQ ID NO: 6443063 - DNA, 23 bp, Homo sapiens
tcttgacagtatatttgaaactg

SEQ ID NO: 6443064 - DNA, 14 bp, Homo sapiens
tcttgacagtctga

SEQ ID NO: 6443065 - DNA, 18 bp, Homo sapiens
tcttgacatgtaatgaat

SEQ ID NO: 6443066 - DNA, 21 bp, Homo sapiens
tcttgaccaacagaaaccttt

SEQ ID NO: 6443067 - DNA, 19 bp, Homo sapiens
tcttgaccaagcaggaagc

SEQ ID NO: 6443068 - DNA, 21 bp, Homo sapiens
tcttgaccaagcaggaagctc

SEQ ID NO: 6443069 - DNA, 20 bp, Homo sapiens
tcttgaccatactaataaat

SEQ ID NO: 6443070 - DNA, 11 bp, Homo sapiens
tcttgacccta

SEQ ID NO: 6443071 - DNA, 14 bp, Homo sapiens
tcttgaccctgcac

SEQ ID NO: 6443072 - DNA, 16 bp, Homo sapiens
tcttgaccctgcaccc

SEQ ID NO: 6443073 - DNA, 17 bp, Homo sapiens
tcttgaccctgcaccct

SEQ ID NO: 6443074 - DNA, 19 bp, Homo sapiens
tcttgaccctgcaccctcc

SEQ ID NO: 6443075 - DNA, 16 bp, Homo sapiens
tcttgaccctgtcact

SEQ ID NO: 6443076 - DNA, 15 bp, Homo sapiens
tcttgacctctgcct

SEQ ID NO: 6443077 - DNA, 18 bp, Homo sapiens
tcttgacctgaactctgc

SEQ ID NO: 6443078 - DNA, 20 bp, Homo sapiens
tcttgacgagtgtgaagctt

SEQ ID NO: 6443079 - DNA, 16 bp, Homo sapiens
tcttgactacagtcag

SEQ ID NO: 6443080 - DNA, 17 bp, Homo sapiens
tcttgactctaaatgca

SEQ ID NO: 6443081 - DNA, 15 bp, Homo sapiens
tcttgactcttgcct

SEQ ID NO: 6443082 - DNA, 15 bp, Homo sapiens
tcttgacttagacct

SEQ ID NO: 6443083 - DNA, 24 bp, Homo sapiens
tcttgacttagacctatactgaaa

SEQ ID NO: 6443084 - DNA, 16 bp, Homo sapiens
tcttgactttctgatt

SEQ ID NO: 6443085 - DNA, 16 bp, Homo sapiens
tcttgagaagtaactg

SEQ ID NO: 6443086 - DNA, 14 bp, Homo sapiens
tcttgagaatgatt

SEQ ID NO: 6443087 - DNA, 19 bp, Homo sapiens
tcttgagaccagcctgcca

SEQ ID NO: 6443088 - DNA, 21 bp, Homo sapiens
tcttgagaccagcctgccagg

SEQ ID NO: 6443089 - DNA, 22 bp, Homo sapiens
tcttgagagagaaatgctgttc

SEQ ID NO: 6443090 - DNA, 13 bp, Homo sapiens
tccaagcagaagg

SEQ ID NO: 6443091 - DNA, 19 bp, Homo sapiens
tccaagcagactccagccc

SEQ ID NO: 6443092 - DNA, 16 bp, Homo sapiens
tccaagcagagtgttt

SEQ ID NO: 6443093 - DNA, 23 bp, Homo sapiens
tccaagcagcctgagcaactctt

SEQ ID NO: 6443094 - DNA, 23 bp, Homo sapiens
tccaagcataccaacacgagcag

SEQ ID NO: 6443095 - DNA, 20 bp, Homo sapiens
tccaagcatcaccctgggag

SEQ ID NO: 6443096 - DNA, 20 bp, Homo sapiens
tccaagcatttagatgtata

SEQ ID NO: 6443097 - DNA, 14 bp, Homo sapiens
tccaagcatttcat

SEQ ID NO: 6443098 - DNA, 17 bp, Homo sapiens
tccaagcatttcatgaa

SEQ ID NO: 6443099 - DNA, 20 bp, Homo sapiens
tccaagcatttcatgaaaaa

SEQ ID NO: 6443100 - DNA, 12 bp, Homo sapiens
tccaagccagag

SEQ ID NO: 6443101 - DNA, 22 bp, Homo sapiens
tccaagcccagttcagcttggg

SEQ ID NO: 6443102 - DNA, 18 bp, Homo sapiens
tccaagccccccacacct

SEQ ID NO: 6443103 - DNA, 14 bp, Homo sapiens
tccaagccccctgg

SEQ ID NO: 6443104 - DNA, 23 bp, Homo sapiens
tccaagccccctggcagctgccc

SEQ ID NO: 6443105 - DNA, 14 bp, Homo sapiens
tccaagccctgggg

SEQ ID NO: 6443106 - DNA, 19 bp, Homo sapiens
tccaagccctggggcaggg

SEQ ID NO: 6443107 - DNA, 17 bp, Homo sapiens
tccaagcctccacagcg

SEQ ID NO: 6443108 - DNA, 20 bp, Homo sapiens
tccaagcctccacagcgagg

SEQ ID NO: 6443109 - DNA, 21 bp, Homo sapiens
tccaagcctccacagcgaggg

SEQ ID NO: 6443110 - DNA, 23 bp, Homo sapiens
tccaagcctctctggcactttga

SEQ ID NO: 6443111 - DNA, 17 bp, Homo sapiens
tccaagcctgcctccca

SEQ ID NO: 6443112 - DNA, 13 bp, Homo sapiens
tccaagcctggca

SEQ ID NO: 6443113 - DNA, 23 bp, Homo sapiens
tccaagcctggcacccaccgtct

SEQ ID NO: 6443114 - DNA, 12 bp, Homo sapiens
tccaagcctggg

SEQ ID NO: 6443115 - DNA, 13 bp, Homo sapiens
tccaagcctgggc

SEQ ID NO: 6443116 - DNA, 14 bp, Homo sapiens
tccaagcctgggcc

SEQ ID NO: 6443117 - DNA, 21 bp, Homo sapiens
tccaagcctgggccactggca

SEQ ID NO: 6443118 - DNA, 14 bp, Homo sapiens
tccaagctaagcac

SEQ ID NO: 6443119 - DNA, 15 bp, Homo sapiens
tccaagctaatttct

SEQ ID NO: 6443120 - DNA, 17 bp, Homo sapiens
tccaagctcactcccca

SEQ ID NO: 6443121 - DNA, 22 bp, Homo sapiens
tccaagctcactccccaacccc

SEQ ID NO: 6443122 - DNA, 18 bp, Homo sapiens
tccaagctccatctccac

SEQ ID NO: 6443123 - DNA, 15 bp, Homo sapiens
tccaagctcccaggc

SEQ ID NO: 6443124 - DNA, 18 bp, Homo sapiens
tccaagctccctgcccca

SEQ ID NO: 6443125 - DNA, 20 bp, Homo sapiens
tccaagctggtcccactcag

SEQ ID NO: 6443126 - DNA, 13 bp, Homo sapiens
tccaagctgttaa

SEQ ID NO: 6443127 - DNA, 17 bp, Homo sapiens
tccaagcttcaagtgat

SEQ ID NO: 6443128 - DNA, 23 bp, Homo sapiens
tccaagcttcaagtgatatatgt

SEQ ID NO: 6443129 - DNA, 12 bp, Homo sapiens
tccaagcttcca

SEQ ID NO: 6443130 - DNA, 21 bp, Homo sapiens
tccaaggaaaattgaaagtat

SEQ ID NO: 6443131 - DNA, 23 bp, Homo sapiens
tccaaggaaaccacagctgctgg

SEQ ID NO: 6443132 - DNA, 19 bp, Homo sapiens
tccaaggaacctaattgaa

SEQ ID NO: 6443133 - DNA, 17 bp, Homo sapiens
tccaaggaacttcatgc

SEQ ID NO: 6443134 - DNA, 18 bp, Homo sapiens
tccaaggaacttcatgct

SEQ ID NO: 6443135 - DNA, 13 bp, Homo sapiens
tccaaggaagcag

SEQ ID NO: 6443136 - DNA, 15 bp, Homo sapiens
tccaaggaagcagaa

SEQ ID NO: 6443137 - DNA, 23 bp, Homo sapiens
tccaaggacagaaggctcctgcc

SEQ ID NO: 6443138 - DNA, 15 bp, Homo sapiens
tccaaggagaaacag

SEQ ID NO: 6443139 - DNA, 18 bp, Homo sapiens
tccaaggagcagagaggt

SEQ ID NO: 6443140 - DNA, 12 bp, Homo sapiens
tccaaggatcct

SEQ ID NO: 6443141 - DNA, 13 bp, Homo sapiens
tccaaggcaaaca

SEQ ID NO: 6443142 - DNA, 21 bp, Homo sapiens
tccaaggcaaatgtccaagca

SEQ ID NO: 6443143 - DNA, 15 bp, Homo sapiens
tccaaggcagttctg

SEQ ID NO: 6443144 - DNA, 16 bp, Homo sapiens
tccaaggccagtcccc

SEQ ID NO: 6443145 - DNA, 17 bp, Homo sapiens
tccaaggccgcggccca

SEQ ID NO: 6443146 - DNA, 15 bp, Homo sapiens
tccaaggcctttttc

SEQ ID NO: 6443147 - DNA, 22 bp, Homo sapiens
tccaaggctcccgtactgtctg

SEQ ID NO: 6443148 - DNA, 14 bp, Homo sapiens
tccaaggctttaaa

SEQ ID NO: 6443149 - DNA, 14 bp, Homo sapiens
tccaagggacaggt

SEQ ID NO: 6443150 - DNA, 17 bp, Homo sapiens
tccaagggacaggtggg

SEQ ID NO: 6443151 - DNA, 18 bp, Homo sapiens
tccaagggacaggtgggc

SEQ ID NO: 6443152 - DNA, 22 bp, Homo sapiens
tccaagggacaggtgggcctgg

SEQ ID NO: 6443153 - DNA, 13 bp, Homo sapiens
tccaagggcccag

SEQ ID NO: 6443154 - DNA, 14 bp, Homo sapiens
tccaagggccgtgc

SEQ ID NO: 6443155 - DNA, 23 bp, Homo sapiens
tccaagggccgtgcccttgccct

SEQ ID NO: 6443156 - DNA, 19 bp, Homo sapiens
tccaagggttgagagccag

SEQ ID NO: 6443157 - DNA, 24 bp, Homo sapiens
tccaagggtttcgactggtccagc

SEQ ID NO: 6443158 - DNA, 17 bp, Homo sapiens
tccaaggtcactcttgg

SEQ ID NO: 6443159 - DNA, 16 bp, Homo sapiens
tccaaggtgatgttgt

SEQ ID NO: 6443160 - DNA, 18 bp, Homo sapiens
tccaaggtgctctgtgtc

SEQ ID NO: 6443161 - DNA, 16 bp, Homo sapiens
tccaaggtggggtgga

SEQ ID NO: 6443162 - DNA, 23 bp, Homo sapiens
tccaaggtggtctgctcgggccc

SEQ ID NO: 6443163 - DNA, 13 bp, Homo sapiens
tccaaggtttaaa

SEQ ID NO: 6443164 - DNA, 19 bp, Homo sapiens
tccaaggtttaaagagtct

SEQ ID NO: 6443165 - DNA, 20 bp, Homo sapiens
tccaagtaccaatgctgttg

SEQ ID NO: 6443166 - DNA, 19 bp, Homo sapiens
tccaagtagtccaccttca

SEQ ID NO: 6443167 - DNA, 22 bp, Homo sapiens
tccaagtattttatctgtgttg

SEQ ID NO: 6443168 - DNA, 22 bp, Homo sapiens
tccaagtcaacactcttcttga

SEQ ID NO: 6443169 - DNA, 23 bp, Homo sapiens
tccaagtcacaaagagatgtcct

SEQ ID NO: 6443170 - DNA, 17 bp, Homo sapiens
tccaagtcactagaagt

SEQ ID NO: 6443171 - DNA, 18 bp, Homo sapiens
tccaagtcatgggagaag

SEQ ID NO: 6443172 - DNA, 19 bp, Homo sapiens
tccaagtcatgggagaaga

SEQ ID NO: 6443173 - DNA, 22 bp, Homo sapiens
tccaagtccaacctgcctgtgc

SEQ ID NO: 6443174 - DNA, 17 bp, Homo sapiens
tccaagtccaataagac

SEQ ID NO: 6443175 - DNA, 14 bp, Homo sapiens
tccaagtctccacc

SEQ ID NO: 6443176 - DNA, 19 bp, Homo sapiens
tccaagtctctctgtgaat

SEQ ID NO: 6443177 - DNA, 14 bp, Homo sapiens
tccaagtgccccct

SEQ ID NO: 6443178 - DNA, 15 bp, Homo sapiens
tccaagtgccccctc

SEQ ID NO: 6443179 - DNA, 20 bp, Homo sapiens
tccaagtggcctccgtcact

SEQ ID NO: 6443180 - DNA, 22 bp, Homo sapiens
tccaagtggcctccgtcactac

SEQ ID NO: 6443181 - DNA, 14 bp, Homo sapiens
tccaagtggctgtg

SEQ ID NO: 6443182 - DNA, 18 bp, Homo sapiens
tccaagtgtataatgttg

SEQ ID NO: 6443183 - DNA, 22 bp, Homo sapiens
tccaagtgtattttaaaataga

SEQ ID NO: 6443184 - DNA, 21 bp, Homo sapiens
tccaagtgtgcatattgtaca

SEQ ID NO: 6443185 - DNA, 12 bp, Homo sapiens
tccaagtgtgtg

SEQ ID NO: 6443186 - DNA, 13 bp, Homo sapiens
tccaagtgtgtgt

SEQ ID NO: 6443187 - DNA, 14 bp, Homo sapiens
tccaagtgtgtgtg

SEQ ID NO: 6443188 - DNA, 18 bp, Homo sapiens
tccaagtgtgtgtgcgtg

SEQ ID NO: 6443189 - DNA, 14 bp, Homo sapiens
tccaagtgtttctt

SEQ ID NO: 6443190 - DNA, 17 bp, Homo sapiens
tccaagtgtttcttgtt

SEQ ID NO: 6443191 - DNA, 17 bp, Homo sapiens
tccaagttaaatgtaga

SEQ ID NO: 6443192 - DNA, 21 bp, Homo sapiens
tccaagttatttgatctggtg

SEQ ID NO: 6443193 - DNA, 22 bp, Homo sapiens
tccaagttatttgatctggtgc

SEQ ID NO: 6443194 - DNA, 16 bp, Homo sapiens
tccaagttcattcata

SEQ ID NO: 6443195 - DNA, 21 bp, Homo sapiens
tccaagttcctgcactccaga

SEQ ID NO: 6443196 - DNA, 16 bp, Homo sapiens
tccaagttcttcacct

SEQ ID NO: 6443197 - DNA, 18 bp, Homo sapiens
tccaagttcttcacctct

SEQ ID NO: 6443198 - DNA, 20 bp, Homo sapiens
tccaagttcttcacctctat

SEQ ID NO: 6443199 - DNA, 21 bp, Homo sapiens
tccaataaaaacattttgaag

SEQ ID NO: 6443200 - DNA, 22 bp, Homo sapiens
tccaataaaaatcaggagcctg

SEQ ID NO: 6443201 - DNA, 13 bp, Homo sapiens
tccaataaacagg

SEQ ID NO: 6443202 - DNA, 14 bp, Homo sapiens
tccaataaacagga

SEQ ID NO: 6443203 - DNA, 14 bp, Homo sapiens
tccaataaaggaac

SEQ ID NO: 6443204 - DNA, 22 bp, Homo sapiens
tccaataaaggaacataaagat

SEQ ID NO: 6443205 - DNA, 18 bp, Homo sapiens
tccaataaagtgccttct

SEQ ID NO: 6443206 - DNA, 22 bp, Homo sapiens
tccaataccctagaagaaaacc

SEQ ID NO: 6443207 - DNA, 16 bp, Homo sapiens
tccaatacctcttgga

SEQ ID NO: 6443208 - DNA, 18 bp, Homo sapiens
tccaatatgactcagaga

SEQ ID NO: 6443209 - DNA, 14 bp, Homo sapiens
tccaatatgtgatt

SEQ ID NO: 6443210 - DNA, 16 bp, Homo sapiens
tccaatatgtgatttt

SEQ ID NO: 6443211 - DNA, 15 bp, Homo sapiens
tccaatatttataat

SEQ ID NO: 6443212 - DNA, 17 bp, Homo sapiens
tccaatatttataatta

SEQ ID NO: 6443213 - DNA, 13 bp, Homo sapiens
tccaatatttctg

SEQ ID NO: 6443214 - DNA, 15 bp, Homo sapiens
tccaatatttctgct

SEQ ID NO: 6443215 - DNA, 15 bp, Homo sapiens
tccaatattttaata

SEQ ID NO: 6443216 - DNA, 16 bp, Homo sapiens
tccaatattttaataa

SEQ ID NO: 6443217 - DNA, 17 bp, Homo sapiens
tccaatattttgccttt

SEQ ID NO: 6443218 - DNA, 20 bp, Homo sapiens
tccaatcaatcttgcatgta

SEQ ID NO: 6443219 - DNA, 21 bp, Homo sapiens
tccaatcaatttaaatgttta

SEQ ID NO: 6443220 - DNA, 23 bp, Homo sapiens
tccaatcaatttaaatgtttact

SEQ ID NO: 6443221 - DNA, 24 bp, Homo sapiens
tccaatcaatttaaatgtttacta

SEQ ID NO: 6443222 - DNA, 17 bp, Homo sapiens
tccaatcacccccagga

SEQ ID NO: 6443223 - DNA, 21 bp, Homo sapiens
tccaatcagagaccaggccct

SEQ ID NO: 6443224 - DNA, 22 bp, Homo sapiens
tccaatcccatagatgggtctg

SEQ ID NO: 6443225 - DNA, 15 bp, Homo sapiens
tccaatccccactcc

SEQ ID NO: 6443226 - DNA, 16 bp, Homo sapiens
tccaatcctatgtttt

SEQ ID NO: 6443227 - DNA, 11 bp, Homo sapiens
tccaatcctca

SEQ ID NO: 6443228 - DNA, 14 bp, Homo sapiens
tccaatcctcactg

SEQ ID NO: 6443229 - DNA, 16 bp, Homo sapiens
tccaatcctcactggg

SEQ ID NO: 6443230 - DNA, 17 bp, Homo sapiens
tccaatcctcactgggt

SEQ ID NO: 6443231 - DNA, 18 bp, Homo sapiens
tccaatcctcactgggtg

SEQ ID NO: 6443232 - DNA, 13 bp, Homo sapiens
tccaatcctcccc

SEQ ID NO: 6443233 - DNA, 21 bp, Homo sapiens
tccaatcctccccgctctgcc

SEQ ID NO: 6443234 - DNA, 14 bp, Homo sapiens
tccaatcctttcca

SEQ ID NO: 6443235 - DNA, 19 bp, Homo sapiens
tccaatctaaccacatcaa

SEQ ID NO: 6443236 - DNA, 17 bp, Homo sapiens
tccaatctcatctcttg

SEQ ID NO: 6443237 - DNA, 23 bp, Homo sapiens
tccaatctccggtgtgagcccac

SEQ ID NO: 6443238 - DNA, 19 bp, Homo sapiens
tccaatctgctcagcaggc

SEQ ID NO: 6443239 - DNA, 19 bp, Homo sapiens
tccaatctgtaatttcact

SEQ ID NO: 6443240 - DNA, 14 bp, Homo sapiens
tccaatctgtcaca

SEQ ID NO: 6443241 - DNA, 17 bp, Homo sapiens
tccaatctgtcacataa

SEQ ID NO: 6443242 - DNA, 15 bp, Homo sapiens
tccaatcttgctttg

SEQ ID NO: 6443243 - DNA, 19 bp, Homo sapiens
tccaatgaagataaatgct

SEQ ID NO: 6443244 - DNA, 20 bp, Homo sapiens
tccaatgaagataaatgctt

SEQ ID NO: 6443245 - DNA, 12 bp, Homo sapiens
tccaatgagctt

SEQ ID NO: 6443246 - DNA, 17 bp, Homo sapiens
tccaatgagctttctga

SEQ ID NO: 6443247 - DNA, 19 bp, Homo sapiens
tccaatgagctttctgaac

SEQ ID NO: 6443248 - DNA, 21 bp, Homo sapiens
tccaatgagctttctgaacag

SEQ ID NO: 6443249 - DNA, 16 bp, Homo sapiens
tccaatgatataggaa

SEQ ID NO: 6443250 - DNA, 22 bp, Homo sapiens
tccaatgatataggaaaataca

SEQ ID NO: 6443251 - DNA, 22 bp, Homo sapiens
tccaatgcacagttgccacatt

SEQ ID NO: 6443252 - DNA, 13 bp, Homo sapiens
tccaatgcattgg

SEQ ID NO: 6443253 - DNA, 19 bp, Homo sapiens
tccaatgcattggcctctg

SEQ ID NO: 6443254 - DNA, 14 bp, Homo sapiens
tccaatgccacaga

SEQ ID NO: 6443255 - DNA, 20 bp, Homo sapiens
tccaatgccacatacttgca

SEQ ID NO: 6443256 - DNA, 24 bp, Homo sapiens
tccaatgccacctagactctccct

SEQ ID NO: 6443257 - DNA, 17 bp, Homo sapiens
tccaatgcctcttgtct

SEQ ID NO: 6443258 - DNA, 21 bp, Homo sapiens
tccaatgcctcttgtcttcct

SEQ ID NO: 6443259 - DNA, 22 bp, Homo sapiens
tccaatgcctcttgtcttccta

SEQ ID NO: 6443260 - DNA, 14 bp, Homo sapiens
tccaatgctgtggg

SEQ ID NO: 6443261 - DNA, 15 bp, Homo sapiens
tccaatggaaagctt

SEQ ID NO: 6443262 - DNA, 18 bp, Homo sapiens
tccaatggagttcagaga

SEQ ID NO: 6443263 - DNA, 21 bp, Homo sapiens
tccaatggctgtaaactataa

SEQ ID NO: 6443264 - DNA, 15 bp, Homo sapiens
tccaatggggccagc

SEQ ID NO: 6443265 - DNA, 16 bp, Homo sapiens
tccaatggggccagca

SEQ ID NO: 6443266 - DNA, 17 bp, Homo sapiens
tccaatggggccagcac

SEQ ID NO: 6443267 - DNA, 14 bp, Homo sapiens
tcttgagagctgct

SEQ ID NO: 6443268 - DNA, 15 bp, Homo sapiens
tcttgagcagctgaa

SEQ ID NO: 6443269 - DNA, 22 bp, Homo sapiens
tcttgagcagtggctggtccag

SEQ ID NO: 6443270 - DNA, 14 bp, Homo sapiens
tcttgagcatcaat

SEQ ID NO: 6443271 - DNA, 18 bp, Homo sapiens
tcttgagcatcaatcttg

SEQ ID NO: 6443272 - DNA, 12 bp, Homo sapiens
tcttgagccaca

SEQ ID NO: 6443273 - DNA, 11 bp, Homo sapiens
tcttgagccag

SEQ ID NO: 6443274 - DNA, 21 bp, Homo sapiens
tcttgagccagccaggccctg

SEQ ID NO: 6443275 - DNA, 19 bp, Homo sapiens
tcttgagccctcctggaat

SEQ ID NO: 6443276 - DNA, 13 bp, Homo sapiens
tcttgagcctggg

SEQ ID NO: 6443277 - DNA, 16 bp, Homo sapiens
tcttgagctctattat

SEQ ID NO: 6443278 - DNA, 17 bp, Homo sapiens
tcttgagctggcctctc

SEQ ID NO: 6443279 - DNA, 19 bp, Homo sapiens
tcttgaggaataaatgcct

SEQ ID NO: 6443280 - DNA, 22 bp, Homo sapiens
tcttgaggagcattaaggtatt

SEQ ID NO: 6443281 - DNA, 19 bp, Homo sapiens
tcttgaggcagggtctcac

SEQ ID NO: 6443282 - DNA, 15 bp, Homo sapiens
tcttgaggccaggag

SEQ ID NO: 6443283 - DNA, 16 bp, Homo sapiens
tcttgaggcctgtgct

SEQ ID NO: 6443284 - DNA, 18 bp, Homo sapiens
tcttgaggcctgtgctct

SEQ ID NO: 6443285 - DNA, 14 bp, Homo sapiens
tcttgagggagctt

SEQ ID NO: 6443286 - DNA, 19 bp, Homo sapiens
tcttgagtgggccccctct

SEQ ID NO: 6443287 - DNA, 18 bp, Homo sapiens
tcttgagttcctctgcag

SEQ ID NO: 6443288 - DNA, 20 bp, Homo sapiens
tcttgagttcctctgcagtt

SEQ ID NO: 6443289 - DNA, 14 bp, Homo sapiens
tcttgataagacca

SEQ ID NO: 6443290 - DNA, 21 bp, Homo sapiens
tcttgataattttcctttaat

SEQ ID NO: 6443291 - DNA, 20 bp, Homo sapiens
tcttgatacccccctctgtc

SEQ ID NO: 6443292 - DNA, 20 bp, Homo sapiens
tcttgatcaacatcttttct

SEQ ID NO: 6443293 - DNA, 22 bp, Homo sapiens
tcttgatcagacattcagagat

SEQ ID NO: 6443294 - DNA, 17 bp, Homo sapiens
tcttgatcagttaagaa

SEQ ID NO: 6443295 - DNA, 20 bp, Homo sapiens
tcttgatcggaaagctcttc

SEQ ID NO: 6443296 - DNA, 14 bp, Homo sapiens
tcttgatctcctga

SEQ ID NO: 6443297 - DNA, 12 bp, Homo sapiens
tcttgatctcta

SEQ ID NO: 6443298 - DNA, 20 bp, Homo sapiens
tcttgatctgctcagccctg

SEQ ID NO: 6443299 - DNA, 21 bp, Homo sapiens
tcttgatctgctcagccctgg

SEQ ID NO: 6443300 - DNA, 15 bp, Homo sapiens
tcttgatcttaaaga

SEQ ID NO: 6443301 - DNA, 16 bp, Homo sapiens
tcttgatcttaaagat

SEQ ID NO: 6443302 - DNA, 18 bp, Homo sapiens
tcttgatgactggaattt

SEQ ID NO: 6443303 - DNA, 20 bp, Homo sapiens
tcttgatgactggaattttt

SEQ ID NO: 6443304 - DNA, 21 bp, Homo sapiens
tcttgatgcatgcactgttcc

SEQ ID NO: 6443305 - DNA, 21 bp, Homo sapiens
tcttgatgcctggcggggtgg

SEQ ID NO: 6443306 - DNA, 21 bp, Homo sapiens
tcttgatggagattaagatgc

SEQ ID NO: 6443307 - DNA, 14 bp, Homo sapiens
tcttgatgtatttc

SEQ ID NO: 6443308 - DNA, 12 bp, Homo sapiens
tcttgatgtgaa

SEQ ID NO: 6443309 - DNA, 21 bp, Homo sapiens
tcttgatgtgaagataatttg

SEQ ID NO: 6443310 - DNA, 18 bp, Homo sapiens
tcttgatgtggtgaggca

SEQ ID NO: 6443311 - DNA, 15 bp, Homo sapiens
tcttgattaaaagtt

SEQ ID NO: 6443312 - DNA, 15 bp, Homo sapiens
tcttgattataaatg

SEQ ID NO: 6443313 - DNA, 16 bp, Homo sapiens
tcttgattataaatgt

SEQ ID NO: 6443314 - DNA, 18 bp, Homo sapiens
tcttgattataaatgttt

SEQ ID NO: 6443315 - DNA, 23 bp, Homo sapiens
tcttgattatccatattgagtca

SEQ ID NO: 6443316 - DNA, 13 bp, Homo sapiens
tcttgattcataa

SEQ ID NO: 6443317 - DNA, 14 bp, Homo sapiens
tcttgattcctggt

SEQ ID NO: 6443318 - DNA, 15 bp, Homo sapiens
tcttgattcctggtt

SEQ ID NO: 6443319 - DNA, 18 bp, Homo sapiens
tcttgattgatttttaaa

SEQ ID NO: 6443320 - DNA, 19 bp, Homo sapiens
tcttgatttcacatttcta

SEQ ID NO: 6443321 - DNA, 20 bp, Homo sapiens
tcttgatttcacatttctac

SEQ ID NO: 6443322 - DNA, 13 bp, Homo sapiens
tcttgatttggat

SEQ ID NO: 6443323 - DNA, 21 bp, Homo sapiens
tcttgatttgttttagaatga

SEQ ID NO: 6443324 - DNA, 16 bp, Homo sapiens
tcttgcaaagccttta

SEQ ID NO: 6443325 - DNA, 18 bp, Homo sapiens
tcttgcaaagcgacagat

SEQ ID NO: 6443326 - DNA, 19 bp, Homo sapiens
tcttgcaaagcgacagatt

SEQ ID NO: 6443327 - DNA, 16 bp, Homo sapiens
tcttgcaagcaacaag

SEQ ID NO: 6443328 - DNA, 21 bp, Homo sapiens
tcttgcaagcaacaagctatt

SEQ ID NO: 6443329 - DNA, 15 bp, Homo sapiens
tcttgcaagctccag

SEQ ID NO: 6443330 - DNA, 20 bp, Homo sapiens
tcttgcaagttaaggcttcc

SEQ ID NO: 6443331 - DNA, 12 bp, Homo sapiens
tcttgcaataag

SEQ ID NO: 6443332 - DNA, 23 bp, Homo sapiens
tcttgcaatggcagccttggcaa

SEQ ID NO: 6443333 - DNA, 14 bp, Homo sapiens
tcttgcaatttgaa

SEQ ID NO: 6443334 - DNA, 22 bp, Homo sapiens
tcttgcaccaaattatcttgat

SEQ ID NO: 6443335 - DNA, 23 bp, Homo sapiens
tcttgcaccccaaagctttcctg

SEQ ID NO: 6443336 - DNA, 18 bp, Homo sapiens
tcttgcacccgcctctcc

SEQ ID NO: 6443337 - DNA, 19 bp, Homo sapiens
tcttgcactgtccagctgg

SEQ ID NO: 6443338 - DNA, 14 bp, Homo sapiens
tcttgcagcattta

SEQ ID NO: 6443339 - DNA, 18 bp, Homo sapiens
tcttgcagcatttactat

SEQ ID NO: 6443340 - DNA, 20 bp, Homo sapiens
tcttgcagtatcggcactgt

SEQ ID NO: 6443341 - DNA, 23 bp, Homo sapiens
tcttgcagttttgtaagccctct

SEQ ID NO: 6443342 - DNA, 19 bp, Homo sapiens
tcttgcataagcctcaggc

SEQ ID NO: 6443343 - DNA, 21 bp, Homo sapiens
tcttgcataggctcttaagca

SEQ ID NO: 6443344 - DNA, 20 bp, Homo sapiens
tcttgcatctaatgaaaaac

SEQ ID NO: 6443345 - DNA, 15 bp, Homo sapiens
tcttgcatgaggcta

SEQ ID NO: 6443346 - DNA, 23 bp, Homo sapiens
tcttgcatggcaaggactgcagg

SEQ ID NO: 6443347 - DNA, 19 bp, Homo sapiens
tcttgcattcaaaatcttc

SEQ ID NO: 6443348 - DNA, 13 bp, Homo sapiens
tcttgcattcatt

SEQ ID NO: 6443349 - DNA, 22 bp, Homo sapiens
tcttgcattgaatttagtcatt

SEQ ID NO: 6443350 - DNA, 20 bp, Homo sapiens
tcttgccaacctgtaataaa

SEQ ID NO: 6443351 - DNA, 13 bp, Homo sapiens
tcttgccacatct

SEQ ID NO: 6443352 - DNA, 15 bp, Homo sapiens
tcttgccacatttct

SEQ ID NO: 6443353 - DNA, 21 bp, Homo sapiens
tcttgccagcattttcacatt

SEQ ID NO: 6443354 - DNA, 14 bp, Homo sapiens
tcttgccagccaga

SEQ ID NO: 6443355 - DNA, 13 bp, Homo sapiens
tcttgccagcctc

SEQ ID NO: 6443356 - DNA, 14 bp, Homo sapiens
tcttgccagcctcc

SEQ ID NO: 6443357 - DNA, 14 bp, Homo sapiens
tcttgccagctcag

SEQ ID NO: 6443358 - DNA, 14 bp, Homo sapiens
tcttgccatcactg

SEQ ID NO: 6443359 - DNA, 13 bp, Homo sapiens
tcttgccatcctg

SEQ ID NO: 6443360 - DNA, 16 bp, Homo sapiens
tcttgccatctatagg

SEQ ID NO: 6443361 - DNA, 12 bp, Homo sapiens
tcttgcccactg

SEQ ID NO: 6443362 - DNA, 13 bp, Homo sapiens
tcttgcccatcct

SEQ ID NO: 6443363 - DNA, 14 bp, Homo sapiens
tcttgcccatcctg

SEQ ID NO: 6443364 - DNA, 17 bp, Homo sapiens
tcttgccccaaatcaca

SEQ ID NO: 6443365 - DNA, 18 bp, Homo sapiens
tcttgccccaacccccag

SEQ ID NO: 6443366 - DNA, 23 bp, Homo sapiens
tcttgccccctcatctcactgcc

SEQ ID NO: 6443367 - DNA, 16 bp, Homo sapiens
tcttgccccttgggcc

SEQ ID NO: 6443368 - DNA, 17 bp, Homo sapiens
tcttgcccgctcaggct

SEQ ID NO: 6443369 - DNA, 20 bp, Homo sapiens
tcttgccctattataattgt

SEQ ID NO: 6443370 - DNA, 17 bp, Homo sapiens
tcttgccctctcttttg

SEQ ID NO: 6443371 - DNA, 22 bp, Homo sapiens
tcttgccctgccgccgcctccc

SEQ ID NO: 6443372 - DNA, 13 bp, Homo sapiens
tcttgcccttccc

SEQ ID NO: 6443373 - DNA, 18 bp, Homo sapiens
tcttgcccttccctgtcc

SEQ ID NO: 6443374 - DNA, 21 bp, Homo sapiens
tcttgcccttcctactcctca

SEQ ID NO: 6443375 - DNA, 19 bp, Homo sapiens
tcttgccgtcactattcat

SEQ ID NO: 6443376 - DNA, 16 bp, Homo sapiens
tcttgcctacttttct

SEQ ID NO: 6443377 - DNA, 13 bp, Homo sapiens
tcttgcctaggcc

SEQ ID NO: 6443378 - DNA, 19 bp, Homo sapiens
tcttgcctccaggtgcaga

SEQ ID NO: 6443379 - DNA, 20 bp, Homo sapiens
tcttgcctccatggtgcctc

SEQ ID NO: 6443380 - DNA, 14 bp, Homo sapiens
tcttgcctctagag

SEQ ID NO: 6443381 - DNA, 16 bp, Homo sapiens
tcttgcctctgtcccc

SEQ ID NO: 6443382 - DNA, 21 bp, Homo sapiens
tcttgcctctgtccccttctc

SEQ ID NO: 6443383 - DNA, 13 bp, Homo sapiens
tcttgcctctgtg

SEQ ID NO: 6443384 - DNA, 14 bp, Homo sapiens
tcttgcctctgtgc

SEQ ID NO: 6443385 - DNA, 16 bp, Homo sapiens
tcttgcctctgtgctg

SEQ ID NO: 6443386 - DNA, 19 bp, Homo sapiens
tcttgcctctgtgctgtgt

SEQ ID NO: 6443387 - DNA, 16 bp, Homo sapiens
tcttgcctctttcctc

SEQ ID NO: 6443388 - DNA, 11 bp, Homo sapiens
tcttgcctgaa

SEQ ID NO: 6443389 - DNA, 13 bp, Homo sapiens
tcttgcctgaggc

SEQ ID NO: 6443390 - DNA, 16 bp, Homo sapiens
tcttgcctgtttccca

SEQ ID NO: 6443391 - DNA, 20 bp, Homo sapiens
tcttgccttaaccagtctct

SEQ ID NO: 6443392 - DNA, 12 bp, Homo sapiens
tcttgccttccc

SEQ ID NO: 6443393 - DNA, 14 bp, Homo sapiens
tcttgccttcccct

SEQ ID NO: 6443394 - DNA, 22 bp, Homo sapiens
tcttgcctttcttatttgcaat

SEQ ID NO: 6443395 - DNA, 15 bp, Homo sapiens
tcttgcctttttcat

SEQ ID NO: 6443396 - DNA, 16 bp, Homo sapiens
tcttgcctttttcatt

SEQ ID NO: 6443397 - DNA, 17 bp, Homo sapiens
tcttgcctttttcatta

SEQ ID NO: 6443398 - DNA, 19 bp, Homo sapiens
tcttgcgaatccaagctcc

SEQ ID NO: 6443399 - DNA, 23 bp, Homo sapiens
tcttgcgaatccaagctccctgc

SEQ ID NO: 6443400 - DNA, 22 bp, Homo sapiens
tcttgctaataaacactggctc

SEQ ID NO: 6443401 - DNA, 23 bp, Homo sapiens
tcttgctaataaacactggctct

SEQ ID NO: 6443402 - DNA, 15 bp, Homo sapiens
tcttgctaatcagtg

SEQ ID NO: 6443403 - DNA, 16 bp, Homo sapiens
tcttgctaatcagtgt

SEQ ID NO: 6443404 - DNA, 22 bp, Homo sapiens
tcttgctaatcagtgtctcaca

SEQ ID NO: 6443405 - DNA, 21 bp, Homo sapiens
tcttgctatcggggaagccag

SEQ ID NO: 6443406 - DNA, 18 bp, Homo sapiens
tcttgctcaaaaatctgt

SEQ ID NO: 6443407 - DNA, 14 bp, Homo sapiens
tcttgctcactccc

SEQ ID NO: 6443408 - DNA, 15 bp, Homo sapiens
tcttgctcctgcttc

SEQ ID NO: 6443409 - DNA, 16 bp, Homo sapiens
tcttgctcctggggag

SEQ ID NO: 6443410 - DNA, 12 bp, Homo sapiens
tcttgctctcac

SEQ ID NO: 6443411 - DNA, 18 bp, Homo sapiens
tcttgctctctctccctg

SEQ ID NO: 6443412 - DNA, 13 bp, Homo sapiens
tcttgctctgcat

SEQ ID NO: 6443413 - DNA, 14 bp, Homo sapiens
tcttgctctgctca

SEQ ID NO: 6443414 - DNA, 11 bp, Homo sapiens
tcttgctctgt

SEQ ID NO: 6443415 - DNA, 18 bp, Homo sapiens
tcttgctctgtctcccag

SEQ ID NO: 6443416 - DNA, 21 bp, Homo sapiens
tcttgctcttagattgggcca

SEQ ID NO: 6443417 - DNA, 14 bp, Homo sapiens
tcttgctctttcta

SEQ ID NO: 6443418 - DNA, 13 bp, Homo sapiens
tcttgctgagcac

SEQ ID NO: 6443419 - DNA, 15 bp, Homo sapiens
tcttgctgccctgcc

SEQ ID NO: 6443420 - DNA, 16 bp, Homo sapiens
tcttgctgctagaact

SEQ ID NO: 6443421 - DNA, 18 bp, Homo sapiens
tcttgctgctagaacttt

SEQ ID NO: 6443422 - DNA, 14 bp, Homo sapiens
tcttgctgcttcta

SEQ ID NO: 6443423 - DNA, 14 bp, Homo sapiens
tcttgctggaagac

SEQ ID NO: 6443424 - DNA, 21 bp, Homo sapiens
tcttgctggaagacagagaaa

SEQ ID NO: 6443425 - DNA, 19 bp, Homo sapiens
tcttgctggattaatgttt

SEQ ID NO: 6443426 - DNA, 13 bp, Homo sapiens
tcttgctgtccaa

SEQ ID NO: 6443427 - DNA, 19 bp, Homo sapiens
tcttgctgtccaatttcta

SEQ ID NO: 6443428 - DNA, 14 bp, Homo sapiens
tcttgctgtctctg

SEQ ID NO: 6443429 - DNA, 14 bp, Homo sapiens
tcttgctgtgcttt

SEQ ID NO: 6443430 - DNA, 23 bp, Homo sapiens
tcttgctgtgctttatttgtgaa

SEQ ID NO: 6443431 - DNA, 20 bp, Homo sapiens
tcttgctgttcagtgctttt

SEQ ID NO: 6443432 - DNA, 14 bp, Homo sapiens
tcttgctgttgaca

SEQ ID NO: 6443433 - DNA, 19 bp, Homo sapiens
tcttgctgtttaccgccca

SEQ ID NO: 6443434 - DNA, 22 bp, Homo sapiens
tcttgctgtttaccgcccaccc

SEQ ID NO: 6443435 - DNA, 15 bp, Homo sapiens
tcttgctgtttcttg

SEQ ID NO: 6443436 - DNA, 14 bp, Homo sapiens
tcttgcttgaactt

SEQ ID NO: 6443437 - DNA, 19 bp, Homo sapiens
tcttgcttgtaaaaatatg

SEQ ID NO: 6443438 - DNA, 12 bp, Homo sapiens
tcttgcttgtac

SEQ ID NO: 6443439 - DNA, 13 bp, Homo sapiens
tcttgcttgtacc

SEQ ID NO: 6443440 - DNA, 17 bp, Homo sapiens
tcttgcttgtacctctg

SEQ ID NO: 6443441 - DNA, 11 bp, Homo sapiens
tcttgcttgtc

SEQ ID NO: 6443442 - DNA, 12 bp, Homo sapiens
tcttgcttgtca

SEQ ID NO: 6443443 - DNA, 13 bp, Homo sapiens
tcttgcttgtcat

SEQ ID NO: 6443444 - DNA, 13 bp, Homo sapiens
tcttgctttcaca

SEQ ID NO: 6443445 - DNA, 18 bp, Homo sapiens
tcttgctttcacaaatat

SEQ ID NO: 6443446 - DNA, 21 bp, Homo sapiens
tcttgctttcacaaatatagt

SEQ ID NO: 6443447 - DNA, 20 bp, Homo sapiens
tccaatggggcggggcttct

SEQ ID NO: 6443448 - DNA, 17 bp, Homo sapiens
tccaatgggtgtgagta

SEQ ID NO: 6443449 - DNA, 19 bp, Homo sapiens
tccaatgtcgctgtaaatt

SEQ ID NO: 6443450 - DNA, 15 bp, Homo sapiens
tccaatgtctggaga

SEQ ID NO: 6443451 - DNA, 21 bp, Homo sapiens
tccaatgtctttttaagctta

SEQ ID NO: 6443452 - DNA, 20 bp, Homo sapiens
tccaatgtgcccagtcatga

SEQ ID NO: 6443453 - DNA, 14 bp, Homo sapiens
tccaatgtttcaag

SEQ ID NO: 6443454 - DNA, 17 bp, Homo sapiens
tccaattaaggatttta

SEQ ID NO: 6443455 - DNA, 18 bp, Homo sapiens
tccaattaatgaagttga

SEQ ID NO: 6443456 - DNA, 19 bp, Homo sapiens
tccaattaatgaagttgat

SEQ ID NO: 6443457 - DNA, 23 bp, Homo sapiens
tccaattactactttgttattgt

SEQ ID NO: 6443458 - DNA, 17 bp, Homo sapiens
tccaattagcttatgtt

SEQ ID NO: 6443459 - DNA, 20 bp, Homo sapiens
tccaattagtttccttttta

SEQ ID NO: 6443460 - DNA, 23 bp, Homo sapiens
tccaattatgtgacaacctttgt

SEQ ID NO: 6443461 - DNA, 20 bp, Homo sapiens
tccaattccacagtctctgg

SEQ ID NO: 6443462 - DNA, 13 bp, Homo sapiens
tccaattccactg

SEQ ID NO: 6443463 - DNA, 17 bp, Homo sapiens
tccaattctaaatccga

SEQ ID NO: 6443464 - DNA, 11 bp, Homo sapiens
tccaattctat

SEQ ID NO: 6443465 - DNA, 15 bp, Homo sapiens
tccaattctccttta

SEQ ID NO: 6443466 - DNA, 20 bp, Homo sapiens
tccaattctgaaatactttt

SEQ ID NO: 6443467 - DNA, 22 bp, Homo sapiens
tccaattgatgtatatgtttat

SEQ ID NO: 6443468 - DNA, 13 bp, Homo sapiens
tccaattggtgct

SEQ ID NO: 6443469 - DNA, 12 bp, Homo sapiens
tccaattgtaaa

SEQ ID NO: 6443470 - DNA, 14 bp, Homo sapiens
tccaattgtaaaaa

SEQ ID NO: 6443471 - DNA, 22 bp, Homo sapiens
tccaattgttgacagttctgaa

SEQ ID NO: 6443472 - DNA, 12 bp, Homo sapiens
tccaatttaagg

SEQ ID NO: 6443473 - DNA, 13 bp, Homo sapiens
tccaatttaagga

SEQ ID NO: 6443474 - DNA, 18 bp, Homo sapiens
tccaatttacatactctg

SEQ ID NO: 6443475 - DNA, 13 bp, Homo sapiens
tccaatttattat

SEQ ID NO: 6443476 - DNA, 22 bp, Homo sapiens
tccaatttgtaaaaacagcatt

SEQ ID NO: 6443477 - DNA, 23 bp, Homo sapiens
tccaatttgtaagtaacacagta

SEQ ID NO: 6443478 - DNA, 22 bp, Homo sapiens
tccaattttaaaatgaaatgca

SEQ ID NO: 6443479 - DNA, 15 bp, Homo sapiens
tccaattttaattta

SEQ ID NO: 6443480 - DNA, 23 bp, Homo sapiens
tccaattttaatttagtaaatgt

SEQ ID NO: 6443481 - DNA, 12 bp, Homo sapiens
tccaattttcct

SEQ ID NO: 6443482 - DNA, 15 bp, Homo sapiens
tccaattttcctaag

SEQ ID NO: 6443483 - DNA, 22 bp, Homo sapiens
tccaattttctggaatacatga

SEQ ID NO: 6443484 - DNA, 13 bp, Homo sapiens
tccaatttttact

SEQ ID NO: 6443485 - DNA, 17 bp, Homo sapiens
tccaattttttcttaaa

SEQ ID NO: 6443486 - DNA, 18 bp, Homo sapiens
tccaattttttttaagtt

SEQ ID NO: 6443487 - DNA, 16 bp, Homo sapiens
tccacaaaattagaaa

SEQ ID NO: 6443488 - DNA, 19 bp, Homo sapiens
tccacaaacacattataaa

SEQ ID NO: 6443489 - DNA, 21 bp, Homo sapiens
tccacaaacctggatttttta

SEQ ID NO: 6443490 - DNA, 21 bp, Homo sapiens
tccacaaagaaaattcctata

SEQ ID NO: 6443491 - DNA, 16 bp, Homo sapiens
tccacaaagcaaaggc

SEQ ID NO: 6443492 - DNA, 13 bp, Homo sapiens
tccacaaatatga

SEQ ID NO: 6443493 - DNA, 22 bp, Homo sapiens
tccacaaatctatattaaagtg

SEQ ID NO: 6443494 - DNA, 16 bp, Homo sapiens
tccacaaatcttcagt

SEQ ID NO: 6443495 - DNA, 14 bp, Homo sapiens
tccacaaatgatgt

SEQ ID NO: 6443496 - DNA, 22 bp, Homo sapiens
tccacaaatgatgttttcaggt

SEQ ID NO: 6443497 - DNA, 17 bp, Homo sapiens
tccacaaatgtcctcag

SEQ ID NO: 6443498 - DNA, 19 bp, Homo sapiens
tccacaaatgtcctcagag

SEQ ID NO: 6443499 - DNA, 20 bp, Homo sapiens
tccacaacactgtgtcacat

SEQ ID NO: 6443500 - DNA, 15 bp, Homo sapiens
tccacaacagcctgg

SEQ ID NO: 6443501 - DNA, 17 bp, Homo sapiens
tccacaagattcccaga

SEQ ID NO: 6443502 - DNA, 18 bp, Homo sapiens
tccacaagattcccagag

SEQ ID NO: 6443503 - DNA, 20 bp, Homo sapiens
tccacaagattcccagagac

SEQ ID NO: 6443504 - DNA, 21 bp, Homo sapiens
tccacaagattcccagagaca

SEQ ID NO: 6443505 - DNA, 14 bp, Homo sapiens
tccacaagcttctg

SEQ ID NO: 6443506 - DNA, 19 bp, Homo sapiens
tccacaagcttctgtcctg

SEQ ID NO: 6443507 - DNA, 12 bp, Homo sapiens
tccacaagggga

SEQ ID NO: 6443508 - DNA, 20 bp, Homo sapiens
tccacaaggggattttgctg

SEQ ID NO: 6443509 - DNA, 22 bp, Homo sapiens
tccacaagtgtgtggccccgcc

SEQ ID NO: 6443510 - DNA, 21 bp, Homo sapiens
tccacaatagtcagaaaacaa

SEQ ID NO: 6443511 - DNA, 18 bp, Homo sapiens
tccacaatcatctattga

SEQ ID NO: 6443512 - DNA, 20 bp, Homo sapiens
tccacaattattggcaaagt

SEQ ID NO: 6443513 - DNA, 16 bp, Homo sapiens
tccacaattttgtctc

SEQ ID NO: 6443514 - DNA, 15 bp, Homo sapiens
tccacacaacaccag

SEQ ID NO: 6443515 - DNA, 17 bp, Homo sapiens
tccacacaacaccagga

SEQ ID NO: 6443516 - DNA, 19 bp, Homo sapiens
tccacacaacaccaggact

SEQ ID NO: 6443517 - DNA, 14 bp, Homo sapiens
tccacacacacaaa

SEQ ID NO: 6443518 - DNA, 14 bp, Homo sapiens
tccacacacagagg

SEQ ID NO: 6443519 - DNA, 19 bp, Homo sapiens
tccacacacagaggaagag

SEQ ID NO: 6443520 - DNA, 23 bp, Homo sapiens
tccacacacagaggaagagcagg

SEQ ID NO: 6443521 - DNA, 16 bp, Homo sapiens
tccacacacagcagct

SEQ ID NO: 6443522 - DNA, 17 bp, Homo sapiens
tccacacacagcagctc

SEQ ID NO: 6443523 - DNA, 20 bp, Homo sapiens
tccacacacagcagctccaa

SEQ ID NO: 6443524 - DNA, 21 bp, Homo sapiens
tccacacacagcagctccaac

SEQ ID NO: 6443525 - DNA, 22 bp, Homo sapiens
tccacacacagcagctccaacc

SEQ ID NO: 6443526 - DNA, 14 bp, Homo sapiens
tccacacacgcagg

SEQ ID NO: 6443527 - DNA, 16 bp, Homo sapiens
tccacacagaatgcaa

SEQ ID NO: 6443528 - DNA, 13 bp, Homo sapiens
tccacacagcagt

SEQ ID NO: 6443529 - DNA, 21 bp, Homo sapiens
tccacacagcagtgtcccctg

SEQ ID NO: 6443530 - DNA, 23 bp, Homo sapiens
tccacacaggcccatgccctccg

SEQ ID NO: 6443531 - DNA, 23 bp, Homo sapiens
tccacacaggggtggagtttctg

SEQ ID NO: 6443532 - DNA, 14 bp, Homo sapiens
tccacacaggtttg

SEQ ID NO: 6443533 - DNA, 16 bp, Homo sapiens
tccacacattccagcc

SEQ ID NO: 6443534 - DNA, 19 bp, Homo sapiens
tccacacattccagccagg

SEQ ID NO: 6443535 - DNA, 20 bp, Homo sapiens
tccacacattccagccaggc

SEQ ID NO: 6443536 - DNA, 23 bp, Homo sapiens
tccacaccagtaataaaaagcca

SEQ ID NO: 6443537 - DNA, 16 bp, Homo sapiens
tccacaccagtggcct

SEQ ID NO: 6443538 - DNA, 16 bp, Homo sapiens
tccacacccaatgctg

SEQ ID NO: 6443539 - DNA, 15 bp, Homo sapiens
tccacacccatgact

SEQ ID NO: 6443540 - DNA, 15 bp, Homo sapiens
tccacacccccaccc

SEQ ID NO: 6443541 - DNA, 19 bp, Homo sapiens
tccacaccctctcccagga

SEQ ID NO: 6443542 - DNA, 20 bp, Homo sapiens
tccacaccctctcccaggac

SEQ ID NO: 6443543 - DNA, 20 bp, Homo sapiens
tccacacctcactctgctac

SEQ ID NO: 6443544 - DNA, 16 bp, Homo sapiens
tccacacctccacccg

SEQ ID NO: 6443545 - DNA, 18 bp, Homo sapiens
tccacacctgcggcccaa

SEQ ID NO: 6443546 - DNA, 14 bp, Homo sapiens
tccacaccttttat

SEQ ID NO: 6443547 - DNA, 22 bp, Homo sapiens
tccacacgccccggtcccccag

SEQ ID NO: 6443548 - DNA, 22 bp, Homo sapiens
tccacacggagctcctggcagc

SEQ ID NO: 6443549 - DNA, 23 bp, Homo sapiens
tccacacgtttgatttcttcctg

SEQ ID NO: 6443550 - DNA, 16 bp, Homo sapiens
tccacactagaaagaa

SEQ ID NO: 6443551 - DNA, 18 bp, Homo sapiens
tccacactatgtgtgttg

SEQ ID NO: 6443552 - DNA, 18 bp, Homo sapiens
tccacactccttgtcaac

SEQ ID NO: 6443553 - DNA, 15 bp, Homo sapiens
tccacactgaccaag

SEQ ID NO: 6443554 - DNA, 12 bp, Homo sapiens
tccacacttcca

SEQ ID NO: 6443555 - DNA, 15 bp, Homo sapiens
tccacacttctgggc

SEQ ID NO: 6443556 - DNA, 18 bp, Homo sapiens
tccacagaaaatgtaaac

SEQ ID NO: 6443557 - DNA, 20 bp, Homo sapiens
tccacagaaacattttcatt

SEQ ID NO: 6443558 - DNA, 21 bp, Homo sapiens
tccacagaagacacgtgtttt

SEQ ID NO: 6443559 - DNA, 22 bp, Homo sapiens
tccacagaagctttgtttcttg

SEQ ID NO: 6443560 - DNA, 23 bp, Homo sapiens
tccacagacggaagggtaaacaa

SEQ ID NO: 6443561 - DNA, 12 bp, Homo sapiens
tccacagagagg

SEQ ID NO: 6443562 - DNA, 22 bp, Homo sapiens
tccacagagagggagagcagag

SEQ ID NO: 6443563 - DNA, 21 bp, Homo sapiens
tccacagagagtcccactgcc

SEQ ID NO: 6443564 - DNA, 15 bp, Homo sapiens
tccacagaggacaca

SEQ ID NO: 6443565 - DNA, 17 bp, Homo sapiens
tccacagaggacacaga

SEQ ID NO: 6443566 - DNA, 15 bp, Homo sapiens
tccacagaggccagg

SEQ ID NO: 6443567 - DNA, 19 bp, Homo sapiens
tccacagagtaagacattg

SEQ ID NO: 6443568 - DNA, 14 bp, Homo sapiens
tccacagagtataa

SEQ ID NO: 6443569 - DNA, 18 bp, Homo sapiens
tccacagattcactttgt

SEQ ID NO: 6443570 - DNA, 16 bp, Homo sapiens
tccacagattgtttct

SEQ ID NO: 6443571 - DNA, 21 bp, Homo sapiens
tccacagcacaaacacacctc

SEQ ID NO: 6443572 - DNA, 17 bp, Homo sapiens
tccacagcagtgtcaca

SEQ ID NO: 6443573 - DNA, 11 bp, Homo sapiens
tccacagccaa

SEQ ID NO: 6443574 - DNA, 18 bp, Homo sapiens
tccacagccaacaaacat

SEQ ID NO: 6443575 - DNA, 21 bp, Homo sapiens
tccacagccccaacctcccac

SEQ ID NO: 6443576 - DNA, 23 bp, Homo sapiens
tccacagccgcctgaaagccaca

SEQ ID NO: 6443577 - DNA, 19 bp, Homo sapiens
tccacagcgagggcagctg

SEQ ID NO: 6443578 - DNA, 16 bp, Homo sapiens
tccacagctgcagctg

SEQ ID NO: 6443579 - DNA, 23 bp, Homo sapiens
tccacagctgcctcttccctctt

SEQ ID NO: 6443580 - DNA, 12 bp, Homo sapiens
tccacagctgga

SEQ ID NO: 6443581 - DNA, 23 bp, Homo sapiens
tccacagctggaaagttgggccc

SEQ ID NO: 6443582 - DNA, 12 bp, Homo sapiens
tccacagctggc

SEQ ID NO: 6443583 - DNA, 15 bp, Homo sapiens
tccacagcttcctgt

SEQ ID NO: 6443584 - DNA, 13 bp, Homo sapiens
tccacaggaagtg

SEQ ID NO: 6443585 - DNA, 22 bp, Homo sapiens
tccacaggacacgaaggctgcc

SEQ ID NO: 6443586 - DNA, 22 bp, Homo sapiens
tccacaggagggagagaactta

SEQ ID NO: 6443587 - DNA, 19 bp, Homo sapiens
tccacaggatcatcattta

SEQ ID NO: 6443588 - DNA, 14 bp, Homo sapiens
tccacagggaccag

SEQ ID NO: 6443589 - DNA, 18 bp, Homo sapiens
tccacagggaccagggcc

SEQ ID NO: 6443590 - DNA, 17 bp, Homo sapiens
tccacaggggcaggcct

SEQ ID NO: 6443591 - DNA, 22 bp, Homo sapiens
tccacaggggcaggcctgggac

SEQ ID NO: 6443592 - DNA, 18 bp, Homo sapiens
tccacaggggccaccacc

SEQ ID NO: 6443593 - DNA, 15 bp, Homo sapiens
tccacagggtcccac

SEQ ID NO: 6443594 - DNA, 16 bp, Homo sapiens
tccacagggtcccaca

SEQ ID NO: 6443595 - DNA, 17 bp, Homo sapiens
tccacagggtcccacag

SEQ ID NO: 6443596 - DNA, 20 bp, Homo sapiens
tccacagggtcccacagcca

SEQ ID NO: 6443597 - DNA, 21 bp, Homo sapiens
tccacagggtcccacagccac

SEQ ID NO: 6443598 - DNA, 21 bp, Homo sapiens
tccacaggtcatcagatgcct

SEQ ID NO: 6443599 - DNA, 17 bp, Homo sapiens
tccacaggtccaaggac

SEQ ID NO: 6443600 - DNA, 21 bp, Homo sapiens
tccacagtattgttcttgtaa

SEQ ID NO: 6443601 - DNA, 23 bp, Homo sapiens
tccacagtattgttcttgtaaaa

SEQ ID NO: 6443602 - DNA, 22 bp, Homo sapiens
tccacagtgctgcttctcttgg

SEQ ID NO: 6443603 - DNA, 20 bp, Homo sapiens
tccacagtggaaccagccca

SEQ ID NO: 6443604 - DNA, 17 bp, Homo sapiens
tccacagtggcgggccc

SEQ ID NO: 6443605 - DNA, 20 bp, Homo sapiens
tccacagtgtgaagacactg

SEQ ID NO: 6443606 - DNA, 19 bp, Homo sapiens
tccacagtgttcatttgaa

SEQ ID NO: 6443607 - DNA, 17 bp, Homo sapiens
tccacagtgttgtgccc

SEQ ID NO: 6443608 - DNA, 14 bp, Homo sapiens
tccacagttatctt

SEQ ID NO: 6443609 - DNA, 13 bp, Homo sapiens
tccacagttcagt

SEQ ID NO: 6443610 - DNA, 22 bp, Homo sapiens
tccacagttcgacctgcggctg

SEQ ID NO: 6443611 - DNA, 21 bp, Homo sapiens
tccacagttgccaccacctct

SEQ ID NO: 6443612 - DNA, 12 bp, Homo sapiens
tccacataaaag

SEQ ID NO: 6443613 - DNA, 16 bp, Homo sapiens
tccacataaattttaa

SEQ ID NO: 6443614 - DNA, 18 bp, Homo sapiens
tccacataaattttaatt

SEQ ID NO: 6443615 - DNA, 21 bp, Homo sapiens
tccacataaccctgtcaccca

SEQ ID NO: 6443616 - DNA, 16 bp, Homo sapiens
tccacataagcactcc

SEQ ID NO: 6443617 - DNA, 15 bp, Homo sapiens
tccacatacactgca

SEQ ID NO: 6443618 - DNA, 17 bp, Homo sapiens
tccacatacactgcatt

SEQ ID NO: 6443619 - DNA, 19 bp, Homo sapiens
tccacataccctgacctgg

SEQ ID NO: 6443620 - DNA, 14 bp, Homo sapiens
tccacatcagatgc

SEQ ID NO: 6443621 - DNA, 14 bp, Homo sapiens
tccacatcccagca

SEQ ID NO: 6443622 - DNA, 21 bp, Homo sapiens
tccacatccccaccctcccct

SEQ ID NO: 6443623 - DNA, 15 bp, Homo sapiens
tccacatccccacct

SEQ ID NO: 6443624 - DNA, 17 bp, Homo sapiens
aagacacagcctccccc

SEQ ID NO: 6443625 - DNA, 16 bp, Homo sapiens
aagacacaggaagaat

SEQ ID NO: 6443626 - DNA, 18 bp, Homo sapiens
aagacacatgctgaggtt

SEQ ID NO: 6443627 - DNA, 17 bp, Homo sapiens
aagacaccaaatataac

SEQ ID NO: 6443628 - DNA, 14 bp, Homo sapiens
aagacaccaaattc

SEQ ID NO: 6443629 - DNA, 22 bp, Homo sapiens
aagacaccagagcagatgcaga

SEQ ID NO: 6443630 - DNA, 19 bp, Homo sapiens
aagacacgtgtttttgtat

SEQ ID NO: 6443631 - DNA, 19 bp, Homo sapiens
aagacactaattccttaaa

SEQ ID NO: 6443632 - DNA, 17 bp, Homo sapiens
aagacactagttcagag

SEQ ID NO: 6443633 - DNA, 11 bp, Homo sapiens
aagacactgcc

SEQ ID NO: 6443634 - DNA, 12 bp, Homo sapiens
aagacactgcct

SEQ ID NO: 6443635 - DNA, 17 bp, Homo sapiens
aagacactgcctgggct

SEQ ID NO: 6443636 - DNA, 21 bp, Homo sapiens
aagacactggtgtatctcaga

SEQ ID NO: 6443637 - DNA, 21 bp, Homo sapiens
aagacactgtgagagttgtct

SEQ ID NO: 6443638 - DNA, 19 bp, Homo sapiens
aagacactgtgcaggccca

SEQ ID NO: 6443639 - DNA, 22 bp, Homo sapiens
aagacacttcagatctgaggtt

SEQ ID NO: 6443640 - DNA, 14 bp, Homo sapiens
aagacacttgctga

SEQ ID NO: 6443641 - DNA, 20 bp, Homo sapiens
aagacagaaaagtgcctgag

SEQ ID NO: 6443642 - DNA, 18 bp, Homo sapiens
aagacagagaaacagaca

SEQ ID NO: 6443643 - DNA, 18 bp, Homo sapiens
aagacagagatggcagag

SEQ ID NO: 6443644 - DNA, 12 bp, Homo sapiens
aagacagagcag

SEQ ID NO: 6443645 - DNA, 15 bp, Homo sapiens
aagacagagcaggct

SEQ ID NO: 6443646 - DNA, 12 bp, Homo sapiens
aagacagaggca

SEQ ID NO: 6443647 - DNA, 16 bp, Homo sapiens
aagacagaggggagca

SEQ ID NO: 6443648 - DNA, 17 bp, Homo sapiens
aagacagaggggagcag

SEQ ID NO: 6443649 - DNA, 23 bp, Homo sapiens
aagacagatactcctccaaggtt

SEQ ID NO: 6443650 - DNA, 18 bp, Homo sapiens
aagacagatgagcaggag

SEQ ID NO: 6443651 - DNA, 19 bp, Homo sapiens
aagacagatggacactgcc

SEQ ID NO: 6443652 - DNA, 21 bp, Homo sapiens
aagacagcactacagatatca

SEQ ID NO: 6443653 - DNA, 15 bp, Homo sapiens
aagacagcagaactg

SEQ ID NO: 6443654 - DNA, 21 bp, Homo sapiens
aagacagcagacaaaatgaaa

SEQ ID NO: 6443655 - DNA, 18 bp, Homo sapiens
aagacagccatacttcca

SEQ ID NO: 6443656 - DNA, 20 bp, Homo sapiens
aagacagctcttcttgaaaa

SEQ ID NO: 6443657 - DNA, 14 bp, Homo sapiens
aagacagctgacag

SEQ ID NO: 6443658 - DNA, 17 bp, Homo sapiens
aagacagctgacagata

SEQ ID NO: 6443659 - DNA, 22 bp, Homo sapiens
aagacagcttctcatcctgcag

SEQ ID NO: 6443660 - DNA, 18 bp, Homo sapiens
aagacaggaaagttcaga

SEQ ID NO: 6443661 - DNA, 18 bp, Homo sapiens
aagacaggagacaaaaga

SEQ ID NO: 6443662 - DNA, 19 bp, Homo sapiens
aagacaggagagattattt

SEQ ID NO: 6443663 - DNA, 18 bp, Homo sapiens
aagacaggagtttatcta

SEQ ID NO: 6443664 - DNA, 22 bp, Homo sapiens
aagacaggatgggggctggcct

SEQ ID NO: 6443665 - DNA, 14 bp, Homo sapiens
aagacaggcacaaa

SEQ ID NO: 6443666 - DNA, 15 bp, Homo sapiens
aagacaggctgagct

SEQ ID NO: 6443667 - DNA, 21 bp, Homo sapiens
aagacagggctcatttttgca

SEQ ID NO: 6443668 - DNA, 21 bp, Homo sapiens
aagacagggctgataagctaa

SEQ ID NO: 6443669 - DNA, 16 bp, Homo sapiens
aagacagggtcttgct

SEQ ID NO: 6443670 - DNA, 18 bp, Homo sapiens
aagacagtgcccatgaat

SEQ ID NO: 6443671 - DNA, 17 bp, Homo sapiens
aagacagtggatcatga

SEQ ID NO: 6443672 - DNA, 22 bp, Homo sapiens
aagacagtggcactaaaatgtt

SEQ ID NO: 6443673 - DNA, 13 bp, Homo sapiens
aagacagtgtaca

SEQ ID NO: 6443674 - DNA, 15 bp, Homo sapiens
aagacagtgtacaaa

SEQ ID NO: 6443675 - DNA, 22 bp, Homo sapiens
aagacagtgtataaggaacatc

SEQ ID NO: 6443676 - DNA, 15 bp, Homo sapiens
aagacagtgtgtgtg

SEQ ID NO: 6443677 - DNA, 13 bp, Homo sapiens
aagacagtttctt

SEQ ID NO: 6443678 - DNA, 14 bp, Homo sapiens
aagacagtttttat

SEQ ID NO: 6443679 - DNA, 13 bp, Homo sapiens
aagacataaaact

SEQ ID NO: 6443680 - DNA, 15 bp, Homo sapiens
aagacataaaacttt

SEQ ID NO: 6443681 - DNA, 13 bp, Homo sapiens
aagacataaacaa

SEQ ID NO: 6443682 - DNA, 18 bp, Homo sapiens
aagacataaacaaagaca

SEQ ID NO: 6443683 - DNA, 19 bp, Homo sapiens
aagacataacgtttttcct

SEQ ID NO: 6443684 - DNA, 23 bp, Homo sapiens
aagacatagccgattctctgccc

SEQ ID NO: 6443685 - DNA, 11 bp, Homo sapiens
aagacatcaat

SEQ ID NO: 6443686 - DNA, 14 bp, Homo sapiens
aagacatcaatgaa

SEQ ID NO: 6443687 - DNA, 17 bp, Homo sapiens
aagacatctgaggaaaa

SEQ ID NO: 6443688 - DNA, 23 bp, Homo sapiens
aagacatctgaggaaaatggaag

SEQ ID NO: 6443689 - DNA, 14 bp, Homo sapiens
aagacatctgcctg

SEQ ID NO: 6443690 - DNA, 13 bp, Homo sapiens
aagacatgaacca

SEQ ID NO: 6443691 - DNA, 23 bp, Homo sapiens
aagacatggaaggttaggtttgt

SEQ ID NO: 6443692 - DNA, 12 bp, Homo sapiens
aagacatgtctg

SEQ ID NO: 6443693 - DNA, 13 bp, Homo sapiens
aagacatgtctgt

SEQ ID NO: 6443694 - DNA, 16 bp, Homo sapiens
aagacatgtctgttct

SEQ ID NO: 6443695 - DNA, 17 bp, Homo sapiens
aagacatgtgaggagga

SEQ ID NO: 6443696 - DNA, 16 bp, Homo sapiens
aagacatgttgtaaat

SEQ ID NO: 6443697 - DNA, 14 bp, Homo sapiens
aagacatgtttaaa

SEQ ID NO: 6443698 - DNA, 13 bp, Homo sapiens
aagacatgtttta

SEQ ID NO: 6443699 - DNA, 17 bp, Homo sapiens
aagacatgttttagaca

SEQ ID NO: 6443700 - DNA, 13 bp, Homo sapiens
aagacattagaga

SEQ ID NO: 6443701 - DNA, 21 bp, Homo sapiens
aagacattagagaaaacctta

SEQ ID NO: 6443702 - DNA, 19 bp, Homo sapiens
aagacattcaccaacaaca

SEQ ID NO: 6443703 - DNA, 16 bp, Homo sapiens
aagacattcaggactg

SEQ ID NO: 6443704 - DNA, 21 bp, Homo sapiens
aagacattcttccaaaaagat

SEQ ID NO: 6443705 - DNA, 22 bp, Homo sapiens
aagacattgggtctattccagc

SEQ ID NO: 6443706 - DNA, 13 bp, Homo sapiens
aagacattgtcaa

SEQ ID NO: 6443707 - DNA, 17 bp, Homo sapiens
aagacattgtcaataaa

SEQ ID NO: 6443708 - DNA, 18 bp, Homo sapiens
aagacatttatactcttt

SEQ ID NO: 6443709 - DNA, 14 bp, Homo sapiens
aagacatttcaaat

SEQ ID NO: 6443710 - DNA, 19 bp, Homo sapiens
aagacatttcaaataactg

SEQ ID NO: 6443711 - DNA, 14 bp, Homo sapiens
aagacatttctttt

SEQ ID NO: 6443712 - DNA, 15 bp, Homo sapiens
aagacatttcttttc

SEQ ID NO: 6443713 - DNA, 22 bp, Homo sapiens
aagacatttcttttctttttac

SEQ ID NO: 6443714 - DNA, 22 bp, Homo sapiens
aagacatttgatagaaaggaac

SEQ ID NO: 6443715 - DNA, 16 bp, Homo sapiens
aagacatttgtttgct

SEQ ID NO: 6443716 - DNA, 22 bp, Homo sapiens
aagacattttaagtttgtagta

SEQ ID NO: 6443717 - DNA, 16 bp, Homo sapiens
aagacattttgttaca

SEQ ID NO: 6443718 - DNA, 20 bp, Homo sapiens
aagacattttgttacataag

SEQ ID NO: 6443719 - DNA, 17 bp, Homo sapiens
aagacattttgttttta

SEQ ID NO: 6443720 - DNA, 22 bp, Homo sapiens
aagacattttgtttttactgta

SEQ ID NO: 6443721 - DNA, 23 bp, Homo sapiens
aagacattttgtttttactgtat

SEQ ID NO: 6443722 - DNA, 18 bp, Homo sapiens
aagacatttttcattcat

SEQ ID NO: 6443723 - DNA, 16 bp, Homo sapiens
aagacattttttaaaa

SEQ ID NO: 6443724 - DNA, 21 bp, Homo sapiens
aagacattttttaaaagcctt

SEQ ID NO: 6443725 - DNA, 19 bp, Homo sapiens
aagaccaaaatgacaatga

SEQ ID NO: 6443726 - DNA, 13 bp, Homo sapiens
aagaccaaaatta

SEQ ID NO: 6443727 - DNA, 15 bp, Homo sapiens
aagaccaaaggaagg

SEQ ID NO: 6443728 - DNA, 21 bp, Homo sapiens
aagaccaagcttagtcctggg

SEQ ID NO: 6443729 - DNA, 21 bp, Homo sapiens
aagaccaataggtgcaaaaat

SEQ ID NO: 6443730 - DNA, 14 bp, Homo sapiens
aagaccaatcaaat

SEQ ID NO: 6443731 - DNA, 16 bp, Homo sapiens
aagaccaatgtgaaga

SEQ ID NO: 6443732 - DNA, 19 bp, Homo sapiens
aagaccaatttatgggaga

SEQ ID NO: 6443733 - DNA, 20 bp, Homo sapiens
aagaccaatttatgggagaa

SEQ ID NO: 6443734 - DNA, 17 bp, Homo sapiens
aagaccacaaaaattga

SEQ ID NO: 6443735 - DNA, 16 bp, Homo sapiens
aagaccaccacctcag

SEQ ID NO: 6443736 - DNA, 19 bp, Homo sapiens
aagaccaccacctcagagt

SEQ ID NO: 6443737 - DNA, 17 bp, Homo sapiens
aagaccacctcaaattt

SEQ ID NO: 6443738 - DNA, 19 bp, Homo sapiens
aagaccacctcaaatttaa

SEQ ID NO: 6443739 - DNA, 22 bp, Homo sapiens
aagaccacctccaacccaaccc

SEQ ID NO: 6443740 - DNA, 13 bp, Homo sapiens
aagaccaccttcc

SEQ ID NO: 6443741 - DNA, 21 bp, Homo sapiens
aagaccaccttcccttcctca

SEQ ID NO: 6443742 - DNA, 15 bp, Homo sapiens
aagaccacgtttcta

SEQ ID NO: 6443743 - DNA, 17 bp, Homo sapiens
aagaccacgtttctaaa

SEQ ID NO: 6443744 - DNA, 15 bp, Homo sapiens
aagaccactacagtc

SEQ ID NO: 6443745 - DNA, 23 bp, Homo sapiens
aagaccagaattcccttgaattg

SEQ ID NO: 6443746 - DNA, 23 bp, Homo sapiens
aagaccagagatagtggggagac

SEQ ID NO: 6443747 - DNA, 13 bp, Homo sapiens
aagaccagagcag

SEQ ID NO: 6443748 - DNA, 15 bp, Homo sapiens
aagaccagcctggcc

SEQ ID NO: 6443749 - DNA, 15 bp, Homo sapiens
aagaccaggctgcag

SEQ ID NO: 6443750 - DNA, 18 bp, Homo sapiens
aagaccaggctgcagcct

SEQ ID NO: 6443751 - DNA, 16 bp, Homo sapiens
aagaccatctctccct

SEQ ID NO: 6443752 - DNA, 20 bp, Homo sapiens
aagaccatctctccctcctg

SEQ ID NO: 6443753 - DNA, 22 bp, Homo sapiens
aagaccatttagtcctcacctt

SEQ ID NO: 6443754 - DNA, 14 bp, Homo sapiens
aagacccaacttgc

SEQ ID NO: 6443755 - DNA, 15 bp, Homo sapiens
aagacccactgaatc

SEQ ID NO: 6443756 - DNA, 22 bp, Homo sapiens
aagacccactgaatctgagaaa

SEQ ID NO: 6443757 - DNA, 14 bp, Homo sapiens
aagacccagacagg

SEQ ID NO: 6443758 - DNA, 13 bp, Homo sapiens
aagacccccagca

SEQ ID NO: 6443759 - DNA, 15 bp, Homo sapiens
aagacccccagcact

SEQ ID NO: 6443760 - DNA, 16 bp, Homo sapiens
aagacccccaggaagg

SEQ ID NO: 6443761 - DNA, 20 bp, Homo sapiens
aagaccccgcaggatccctc

SEQ ID NO: 6443762 - DNA, 15 bp, Homo sapiens
aagacccctgactca

SEQ ID NO: 6443763 - DNA, 15 bp, Homo sapiens
aagacccctgcccaa

SEQ ID NO: 6443764 - DNA, 14 bp, Homo sapiens
aagacccctgctcc

SEQ ID NO: 6443765 - DNA, 15 bp, Homo sapiens
aagacccgagctggg

SEQ ID NO: 6443766 - DNA, 18 bp, Homo sapiens
aagaccctaaacatccat

SEQ ID NO: 6443767 - DNA, 19 bp, Homo sapiens
aagaccctaggtgctcata

SEQ ID NO: 6443768 - DNA, 15 bp, Homo sapiens
aagaccctcccatgg

SEQ ID NO: 6443769 - DNA, 14 bp, Homo sapiens
aagaccctctcagg

SEQ ID NO: 6443770 - DNA, 16 bp, Homo sapiens
aagaccctcttgccca

SEQ ID NO: 6443771 - DNA, 22 bp, Homo sapiens
aagaccctcttgcccatcctga

SEQ ID NO: 6443772 - DNA, 14 bp, Homo sapiens
aagaccctgatgca

SEQ ID NO: 6443773 - DNA, 13 bp, Homo sapiens
aagaccctgcctc

SEQ ID NO: 6443774 - DNA, 13 bp, Homo sapiens
aagaccctgtctc

SEQ ID NO: 6443775 - DNA, 20 bp, Homo sapiens
aagaccctttgttgaaaaat

SEQ ID NO: 6443776 - DNA, 22 bp, Homo sapiens
aagaccctttgttgaaaaatgt

SEQ ID NO: 6443777 - DNA, 15 bp, Homo sapiens
aagaccgccccaggg

SEQ ID NO: 6443778 - DNA, 16 bp, Homo sapiens
aagaccgccccagggc

SEQ ID NO: 6443779 - DNA, 15 bp, Homo sapiens
aagaccgtgtcccaa

SEQ ID NO: 6443780 - DNA, 14 bp, Homo sapiens
aagacctaaatgac

SEQ ID NO: 6443781 - DNA, 18 bp, Homo sapiens
aagacctaaatgacctca

SEQ ID NO: 6443782 - DNA, 19 bp, Homo sapiens
aagacctaaatgacctcag

SEQ ID NO: 6443783 - DNA, 21 bp, Homo sapiens
aagacctaaatgacctcagca

SEQ ID NO: 6443784 - DNA, 21 bp, Homo sapiens
aagacctaaggcagacaggaa

SEQ ID NO: 6443785 - DNA, 17 bp, Homo sapiens
aagacctacattccctc

SEQ ID NO: 6443786 - DNA, 19 bp, Homo sapiens
aagacctacattccctctc

SEQ ID NO: 6443787 - DNA, 17 bp, Homo sapiens
aagacctactgttctaa

SEQ ID NO: 6443788 - DNA, 21 bp, Homo sapiens
aagacctactgttctaaagct

SEQ ID NO: 6443789 - DNA, 23 bp, Homo sapiens
aagacctaggctcatggacgaga

SEQ ID NO: 6443790 - DNA, 18 bp, Homo sapiens
aagacctagtgctcttaa

SEQ ID NO: 6443791 - DNA, 14 bp, Homo sapiens
aagacctcaagaaa

SEQ ID NO: 6443792 - DNA, 17 bp, Homo sapiens
aagacctcatctgcctg

SEQ ID NO: 6443793 - DNA, 21 bp, Homo sapiens
aagacctgaaagagaggactg

SEQ ID NO: 6443794 - DNA, 17 bp, Homo sapiens
aagacctgaataccact

SEQ ID NO: 6443795 - DNA, 15 bp, Homo sapiens
aagacctgcctgtgt

SEQ ID NO: 6443796 - DNA, 13 bp, Homo sapiens
aagacctggcctt

SEQ ID NO: 6443797 - DNA, 20 bp, Homo sapiens
aagacctggtgtgcggaggc

SEQ ID NO: 6443798 - DNA, 17 bp, Homo sapiens
aagacctgttggttcca

SEQ ID NO: 6443799 - DNA, 15 bp, Homo sapiens
aagaccttctgaaga

SEQ ID NO: 6443800 - DNA, 20 bp, Homo sapiens
aagaccttctgaagatctca

SEQ ID NO: 6443801 - DNA, 23 bp, Homo sapiens
aagaccttgcttatgattgcaga

SEQ ID NO: 6443802 - DNA, 22 bp, Homo sapiens
aagacctttattcacccctgcc

SEQ ID NO: 6443803 - DNA, 18 bp, Homo sapiens
tccacatccccagagccc

SEQ ID NO: 6443804 - DNA, 20 bp, Homo sapiens
tccacatccccagagcccag

SEQ ID NO: 6443805 - DNA, 13 bp, Homo sapiens
tccacatcctcca

SEQ ID NO: 6443806 - DNA, 22 bp, Homo sapiens
tccacatcctttctaaacaaga

SEQ ID NO: 6443807 - DNA, 17 bp, Homo sapiens
tccacatctgcctcctc

SEQ ID NO: 6443808 - DNA, 15 bp, Homo sapiens
tccacatctgcctta

SEQ ID NO: 6443809 - DNA, 16 bp, Homo sapiens
tccacatgacctccat

SEQ ID NO: 6443810 - DNA, 20 bp, Homo sapiens
tccacatgcacatgtattct

SEQ ID NO: 6443811 - DNA, 16 bp, Homo sapiens
tccacatgctgcctgg

SEQ ID NO: 6443812 - DNA, 16 bp, Homo sapiens
tccacatggcagatga

SEQ ID NO: 6443813 - DNA, 17 bp, Homo sapiens
tccacatggcagatgat

SEQ ID NO: 6443814 - DNA, 20 bp, Homo sapiens
tccacatggcagatgatttg

SEQ ID NO: 6443815 - DNA, 15 bp, Homo sapiens
tccacatgggagccg

SEQ ID NO: 6443816 - DNA, 24 bp, Homo sapiens
tccacatgggtactgtctcggcag

SEQ ID NO: 6443817 - DNA, 12 bp, Homo sapiens
tccacatgtgcc

SEQ ID NO: 6443818 - DNA, 22 bp, Homo sapiens
tccacattaattagattttctt

SEQ ID NO: 6443819 - DNA, 12 bp, Homo sapiens
tccacattctac

SEQ ID NO: 6443820 - DNA, 19 bp, Homo sapiens
tccacattctgctgccccc

SEQ ID NO: 6443821 - DNA, 18 bp, Homo sapiens
tccacattgtagcctaat

SEQ ID NO: 6443822 - DNA, 16 bp, Homo sapiens
tccacatttgtcacag

SEQ ID NO: 6443823 - DNA, 15 bp, Homo sapiens
tccacattttaacag

SEQ ID NO: 6443824 - DNA, 22 bp, Homo sapiens
tccacattttaacagtacctgt

SEQ ID NO: 6443825 - DNA, 13 bp, Homo sapiens
tccaccaaactcc

SEQ ID NO: 6443826 - DNA, 14 bp, Homo sapiens
tccaccaaatacaa

SEQ ID NO: 6443827 - DNA, 15 bp, Homo sapiens
tccaccaaatacaat

SEQ ID NO: 6443828 - DNA, 18 bp, Homo sapiens
tccaccaacccatcagaa

SEQ ID NO: 6443829 - DNA, 23 bp, Homo sapiens
tccaccaaccccgcggcccagac

SEQ ID NO: 6443830 - DNA, 11 bp, Homo sapiens
tccaccaactt

SEQ ID NO: 6443831 - DNA, 20 bp, Homo sapiens
tccaccaactttttccaagt

SEQ ID NO: 6443832 - DNA, 22 bp, Homo sapiens
tccaccaactttttccaagtcc

SEQ ID NO: 6443833 - DNA, 18 bp, Homo sapiens
tccaccaagcctggtcag

SEQ ID NO: 6443834 - DNA, 22 bp, Homo sapiens
tccaccaagcctggtcagccca

SEQ ID NO: 6443835 - DNA, 14 bp, Homo sapiens
tccaccaaggggct

SEQ ID NO: 6443836 - DNA, 14 bp, Homo sapiens
tccaccaagttctc

SEQ ID NO: 6443837 - DNA, 18 bp, Homo sapiens
tccaccacatctgccaga

SEQ ID NO: 6443838 - DNA, 13 bp, Homo sapiens
tccaccaccactg

SEQ ID NO: 6443839 - DNA, 18 bp, Homo sapiens
tccaccaccactggccac

SEQ ID NO: 6443840 - DNA, 21 bp, Homo sapiens
tccaccaccactggccaccag

SEQ ID NO: 6443841 - DNA, 23 bp, Homo sapiens
tccaccaccactggccaccaggc

SEQ ID NO: 6443842 - DNA, 23 bp, Homo sapiens
tccaccacccaacccaaaccatg

SEQ ID NO: 6443843 - DNA, 13 bp, Homo sapiens
tccaccaccccac

SEQ ID NO: 6443844 - DNA, 13 bp, Homo sapiens
tccaccaccgccc

SEQ ID NO: 6443845 - DNA, 16 bp, Homo sapiens
tccaccacctccctca

SEQ ID NO: 6443846 - DNA, 17 bp, Homo sapiens
tccaccacctccctcac

SEQ ID NO: 6443847 - DNA, 13 bp, Homo sapiens
tccaccaccttgc

SEQ ID NO: 6443848 - DNA, 15 bp, Homo sapiens
tccaccactgtgcac

SEQ ID NO: 6443849 - DNA, 17 bp, Homo sapiens
tccaccagacgccttcc

SEQ ID NO: 6443850 - DNA, 16 bp, Homo sapiens
tccaccagagcagggg

SEQ ID NO: 6443851 - DNA, 18 bp, Homo sapiens
tccaccagagcaggggct

SEQ ID NO: 6443852 - DNA, 13 bp, Homo sapiens
tccaccagcaagg

SEQ ID NO: 6443853 - DNA, 12 bp, Homo sapiens
tccaccagcatc

SEQ ID NO: 6443854 - DNA, 20 bp, Homo sapiens
tccaccagcatcacctgcct

SEQ ID NO: 6443855 - DNA, 20 bp, Homo sapiens
tccaccagccctactcctgc

SEQ ID NO: 6443856 - DNA, 16 bp, Homo sapiens
tccaccagcctgctga

SEQ ID NO: 6443857 - DNA, 18 bp, Homo sapiens
tccaccagcctgctgaca

SEQ ID NO: 6443858 - DNA, 16 bp, Homo sapiens
tccaccaggattaatc

SEQ ID NO: 6443859 - DNA, 20 bp, Homo sapiens
tccaccaggccgtgccttgt

SEQ ID NO: 6443860 - DNA, 12 bp, Homo sapiens
tccaccaggcct

SEQ ID NO: 6443861 - DNA, 17 bp, Homo sapiens
tccaccaggcctcactg

SEQ ID NO: 6443862 - DNA, 13 bp, Homo sapiens
tccaccagggcca

SEQ ID NO: 6443863 - DNA, 14 bp, Homo sapiens
tccaccagggccag

SEQ ID NO: 6443864 - DNA, 19 bp, Homo sapiens
tccaccagggccagagcag

SEQ ID NO: 6443865 - DNA, 15 bp, Homo sapiens
tccaccagtcatttt

SEQ ID NO: 6443866 - DNA, 22 bp, Homo sapiens
tccaccagtgtgtgggggagat

SEQ ID NO: 6443867 - DNA, 15 bp, Homo sapiens
tccaccagtttatac

SEQ ID NO: 6443868 - DNA, 18 bp, Homo sapiens
tccaccagtttatacaga

SEQ ID NO: 6443869 - DNA, 15 bp, Homo sapiens
tccaccatcaagcca

SEQ ID NO: 6443870 - DNA, 16 bp, Homo sapiens
tccaccatccccaccc

SEQ ID NO: 6443871 - DNA, 19 bp, Homo sapiens
tccaccatccccaccccac

SEQ ID NO: 6443872 - DNA, 22 bp, Homo sapiens
tccaccatgctctctcacctgc

SEQ ID NO: 6443873 - DNA, 21 bp, Homo sapiens
tccaccatggggtcctaccaa

SEQ ID NO: 6443874 - DNA, 23 bp, Homo sapiens
tccaccatggggtcctaccaata

SEQ ID NO: 6443875 - DNA, 22 bp, Homo sapiens
tccaccattcctttaaattctc

SEQ ID NO: 6443876 - DNA, 20 bp, Homo sapiens
tccacccacaaactccaggc

SEQ ID NO: 6443877 - DNA, 12 bp, Homo sapiens
tccacccaccag

SEQ ID NO: 6443878 - DNA, 13 bp, Homo sapiens
tccacccacctca

SEQ ID NO: 6443879 - DNA, 11 bp, Homo sapiens
tccacccagac

SEQ ID NO: 6443880 - DNA, 22 bp, Homo sapiens
tccacccagaccctccttcccc

SEQ ID NO: 6443881 - DNA, 12 bp, Homo sapiens
tccacccagagg

SEQ ID NO: 6443882 - DNA, 13 bp, Homo sapiens
tccacccagaggt

SEQ ID NO: 6443883 - DNA, 15 bp, Homo sapiens
tccacccagaggtct

SEQ ID NO: 6443884 - DNA, 11 bp, Homo sapiens
tccacccagcc

SEQ ID NO: 6443885 - DNA, 12 bp, Homo sapiens
tccacccagccc

SEQ ID NO: 6443886 - DNA, 14 bp, Homo sapiens
tccacccagcccac

SEQ ID NO: 6443887 - DNA, 14 bp, Homo sapiens
tccacccagcccat

SEQ ID NO: 6443888 - DNA, 14 bp, Homo sapiens
tccacccagcccct

SEQ ID NO: 6443889 - DNA, 14 bp, Homo sapiens
tccacccaggagcc

SEQ ID NO: 6443890 - DNA, 20 bp, Homo sapiens
tccacccaggagccccgagg

SEQ ID NO: 6443891 - DNA, 12 bp, Homo sapiens
tccacccaggct

SEQ ID NO: 6443892 - DNA, 14 bp, Homo sapiens
tccacccaggctgc

SEQ ID NO: 6443893 - DNA, 20 bp, Homo sapiens
tccacccaggctgcactgca

SEQ ID NO: 6443894 - DNA, 21 bp, Homo sapiens
tccacccaggctgcactgcag

SEQ ID NO: 6443895 - DNA, 23 bp, Homo sapiens
tccacccaggctgcactgcagtg

SEQ ID NO: 6443896 - DNA, 14 bp, Homo sapiens
tccacccagtgctg

SEQ ID NO: 6443897 - DNA, 15 bp, Homo sapiens
tccacccagtgctgc

SEQ ID NO: 6443898 - DNA, 16 bp, Homo sapiens
tccacccagtgctgcc

SEQ ID NO: 6443899 - DNA, 22 bp, Homo sapiens
tccacccataatcctttctgcc

SEQ ID NO: 6443900 - DNA, 22 bp, Homo sapiens
tccacccatcctaccaatgcat

SEQ ID NO: 6443901 - DNA, 18 bp, Homo sapiens
tccacccatgaccttttt

SEQ ID NO: 6443902 - DNA, 18 bp, Homo sapiens
tccacccatttgttttcg

SEQ ID NO: 6443903 - DNA, 23 bp, Homo sapiens
tccaccccaaaggggcctctcct

SEQ ID NO: 6443904 - DNA, 22 bp, Homo sapiens
tccaccccaattaactgaagca

SEQ ID NO: 6443905 - DNA, 20 bp, Homo sapiens
tccaccccactggatcttca

SEQ ID NO: 6443906 - DNA, 21 bp, Homo sapiens
tccaccccagccccactgccc

SEQ ID NO: 6443907 - DNA, 12 bp, Homo sapiens
tccaccccagga

SEQ ID NO: 6443908 - DNA, 13 bp, Homo sapiens
tccaccccagggt

SEQ ID NO: 6443909 - DNA, 15 bp, Homo sapiens
tccaccccagtcccc

SEQ ID NO: 6443910 - DNA, 15 bp, Homo sapiens
tccacccccaagaaa

SEQ ID NO: 6443911 - DNA, 18 bp, Homo sapiens
tccacccccaccactctt

SEQ ID NO: 6443912 - DNA, 16 bp, Homo sapiens
tccacccccagctcct

SEQ ID NO: 6443913 - DNA, 15 bp, Homo sapiens
tccacccccaggtgc

SEQ ID NO: 6443914 - DNA, 18 bp, Homo sapiens
tccacccccattgtgaat

SEQ ID NO: 6443915 - DNA, 17 bp, Homo sapiens
tccaccccccacacaca

SEQ ID NO: 6443916 - DNA, 19 bp, Homo sapiens
tccaccccccacacacact

SEQ ID NO: 6443917 - DNA, 17 bp, Homo sapiens
tccaccccccacgtctg

SEQ ID NO: 6443918 - DNA, 21 bp, Homo sapiens
tccaccccccacgtctgtcct

SEQ ID NO: 6443919 - DNA, 23 bp, Homo sapiens
tccaccccccacgtctgtcctcc

SEQ ID NO: 6443920 - DNA, 21 bp, Homo sapiens
tccacccccgccacggccacc

SEQ ID NO: 6443921 - DNA, 14 bp, Homo sapiens
tccaccccctccag

SEQ ID NO: 6443922 - DNA, 19 bp, Homo sapiens
tccaccccctccagctcca

SEQ ID NO: 6443923 - DNA, 19 bp, Homo sapiens
tccaccccctccctggcct

SEQ ID NO: 6443924 - DNA, 18 bp, Homo sapiens
tccaccccggctccccct

SEQ ID NO: 6443925 - DNA, 23 bp, Homo sapiens
tccaccccggctccccctgccag

SEQ ID NO: 6443926 - DNA, 14 bp, Homo sapiens
tccacccctcctcg

SEQ ID NO: 6443927 - DNA, 14 bp, Homo sapiens
tccacccctctggc

SEQ ID NO: 6443928 - DNA, 21 bp, Homo sapiens
tccacccctttctagaccaat

SEQ ID NO: 6443929 - DNA, 19 bp, Homo sapiens
tccacccgggggagcccag

SEQ ID NO: 6443930 - DNA, 20 bp, Homo sapiens
tccacccgggggagcccagt

SEQ ID NO: 6443931 - DNA, 15 bp, Homo sapiens
tccacccgtcctccc

SEQ ID NO: 6443932 - DNA, 21 bp, Homo sapiens
tccacccgtcctccctcagcc

SEQ ID NO: 6443933 - DNA, 18 bp, Homo sapiens
tccacccgtttccaagcc

SEQ ID NO: 6443934 - DNA, 18 bp, Homo sapiens
tccaccctaaagtctcag

SEQ ID NO: 6443935 - DNA, 13 bp, Homo sapiens
tccaccctagcct

SEQ ID NO: 6443936 - DNA, 14 bp, Homo sapiens
tccaccctatccct

SEQ ID NO: 6443937 - DNA, 22 bp, Homo sapiens
tccaccctcaaatgtcagagct

SEQ ID NO: 6443938 - DNA, 23 bp, Homo sapiens
tccaccctcaaatgtcagagcta

SEQ ID NO: 6443939 - DNA, 17 bp, Homo sapiens
tccaccctcccctcttc

SEQ ID NO: 6443940 - DNA, 20 bp, Homo sapiens
tccaccctcctcctcttcac

SEQ ID NO: 6443941 - DNA, 18 bp, Homo sapiens
tccaccctcctctagcca

SEQ ID NO: 6443942 - DNA, 12 bp, Homo sapiens
tccaccctctga

SEQ ID NO: 6443943 - DNA, 14 bp, Homo sapiens
tccaccctctgagc

SEQ ID NO: 6443944 - DNA, 16 bp, Homo sapiens
tccaccctctgagctt

SEQ ID NO: 6443945 - DNA, 12 bp, Homo sapiens
tccaccctgagg

SEQ ID NO: 6443946 - DNA, 17 bp, Homo sapiens
tccaccctgaggagtga

SEQ ID NO: 6443947 - DNA, 13 bp, Homo sapiens
tccaccctgccaa

SEQ ID NO: 6443948 - DNA, 14 bp, Homo sapiens
tccaccctgccaag

SEQ ID NO: 6443949 - DNA, 12 bp, Homo sapiens
tccaccctgccc

SEQ ID NO: 6443950 - DNA, 17 bp, Homo sapiens
tccaccctgccctggcc

SEQ ID NO: 6443951 - DNA, 18 bp, Homo sapiens
tccaccctgccctggcct

SEQ ID NO: 6443952 - DNA, 20 bp, Homo sapiens
tccaccctgccctggcctac

SEQ ID NO: 6443953 - DNA, 12 bp, Homo sapiens
tccaccctgctc

SEQ ID NO: 6443954 - DNA, 21 bp, Homo sapiens
tccaccctgctctccgaccag

SEQ ID NO: 6443955 - DNA, 14 bp, Homo sapiens
tccaccctgtcccc

SEQ ID NO: 6443956 - DNA, 22 bp, Homo sapiens
tccaccctgtcccccagctctg

SEQ ID NO: 6443957 - DNA, 15 bp, Homo sapiens
tccaccctgttagtt

SEQ ID NO: 6443958 - DNA, 17 bp, Homo sapiens
tccacccttggcctgtc

SEQ ID NO: 6443959 - DNA, 20 bp, Homo sapiens
tccacccttggcctgtctca

SEQ ID NO: 6443960 - DNA, 17 bp, Homo sapiens
tccaccgagccagcttg

SEQ ID NO: 6443961 - DNA, 16 bp, Homo sapiens
tccaccgccaccccac

SEQ ID NO: 6443962 - DNA, 20 bp, Homo sapiens
tccaccgcctatcccaaacc

SEQ ID NO: 6443963 - DNA, 15 bp, Homo sapiens
tccaccgctgctcca

SEQ ID NO: 6443964 - DNA, 21 bp, Homo sapiens
tccaccggtgcctcctctggg

SEQ ID NO: 6443965 - DNA, 22 bp, Homo sapiens
tccaccggtgcctcctctgggg

SEQ ID NO: 6443966 - DNA, 14 bp, Homo sapiens
tccacctacatgag

SEQ ID NO: 6443967 - DNA, 20 bp, Homo sapiens
tccacctagtggctgtccag

SEQ ID NO: 6443968 - DNA, 14 bp, Homo sapiens
tccacctcaactcc

SEQ ID NO: 6443969 - DNA, 18 bp, Homo sapiens
tccacctcacaactcctt

SEQ ID NO: 6443970 - DNA, 12 bp, Homo sapiens
tccacctcaccc

SEQ ID NO: 6443971 - DNA, 14 bp, Homo sapiens
tccacctcacccca

SEQ ID NO: 6443972 - DNA, 16 bp, Homo sapiens
tccacctcaccccact

SEQ ID NO: 6443973 - DNA, 18 bp, Homo sapiens
tccacctcactagctccc

SEQ ID NO: 6443974 - DNA, 15 bp, Homo sapiens
tccacctcagcctcc

SEQ ID NO: 6443975 - DNA, 15 bp, Homo sapiens
tccacctcatcactg

SEQ ID NO: 6443976 - DNA, 16 bp, Homo sapiens
tccacctcatcactgg

SEQ ID NO: 6443977 - DNA, 15 bp, Homo sapiens
tccacctccagcctc

SEQ ID NO: 6443978 - DNA, 13 bp, Homo sapiens
tccacctccatct

SEQ ID NO: 6443979 - DNA, 14 bp, Homo sapiens
tccacctccatctt

SEQ ID NO: 6443980 - DNA, 19 bp, Homo sapiens
tccacctcccaccctgacc

SEQ ID NO: 6443981 - DNA, 12 bp, Homo sapiens
tccacctccccc

SEQ ID NO: 6443982 - DNA, 14 bp, Homo sapiens
tccacctcccccaa

SEQ ID NO: 6443983 - DNA, 22 bp, Homo sapiens
tccacctcccccaaaccctgct

SEQ ID NO: 6443984 - DNA, 14 bp, Homo sapiens
tcttgctttcttta

SEQ ID NO: 6443985 - DNA, 17 bp, Homo sapiens
tcttgctttgaatgcat

SEQ ID NO: 6443986 - DNA, 21 bp, Homo sapiens
tcttgctttgtgtatctcatt

SEQ ID NO: 6443987 - DNA, 15 bp, Homo sapiens
tcttggaaaaaaatt

SEQ ID NO: 6443988 - DNA, 20 bp, Homo sapiens
tcttggaaaaaataaaaaca

SEQ ID NO: 6443989 - DNA, 14 bp, Homo sapiens
tcttggaaaaacag

SEQ ID NO: 6443990 - DNA, 21 bp, Homo sapiens
tcttggaaagaggttctgcac

SEQ ID NO: 6443991 - DNA, 17 bp, Homo sapiens
tcttggaaccaccagtc

SEQ ID NO: 6443992 - DNA, 19 bp, Homo sapiens
tcttggaactgcaccaccg

SEQ ID NO: 6443993 - DNA, 16 bp, Homo sapiens
tcttggaagtgtgtgg

SEQ ID NO: 6443994 - DNA, 21 bp, Homo sapiens
tcttggaattagatgtttata

SEQ ID NO: 6443995 - DNA, 18 bp, Homo sapiens
tcttggacaacagctctc

SEQ ID NO: 6443996 - DNA, 19 bp, Homo sapiens
tcttggacacttaattctg

SEQ ID NO: 6443997 - DNA, 21 bp, Homo sapiens
tcttggacccacctgtggggc

SEQ ID NO: 6443998 - DNA, 16 bp, Homo sapiens
tcttggaccctgggag

SEQ ID NO: 6443999 - DNA, 17 bp, Homo sapiens
tcttggaccctgggagt

SEQ ID NO: 6444000 - DNA, 22 bp, Homo sapiens
tcttggacctatcaaaaactga

SEQ ID NO: 6444001 - DNA, 18 bp, Homo sapiens
tcttggacctctgctctg

SEQ ID NO: 6444002 - DNA, 21 bp, Homo sapiens
tcttggacctctgctctgagg

SEQ ID NO: 6444003 - DNA, 23 bp, Homo sapiens
tcttggacctctgctctgaggct

SEQ ID NO: 6444004 - DNA, 15 bp, Homo sapiens
tcttggaccttggcg

SEQ ID NO: 6444005 - DNA, 18 bp, Homo sapiens
tcttggagaactttccat

SEQ ID NO: 6444006 - DNA, 17 bp, Homo sapiens
tcttggagaagtctcag

SEQ ID NO: 6444007 - DNA, 20 bp, Homo sapiens
tcttggagaagtctcagcta

SEQ ID NO: 6444008 - DNA, 14 bp, Homo sapiens
tcttggagaggagg

SEQ ID NO: 6444009 - DNA, 19 bp, Homo sapiens
tcttggagaggaggtgtgg

SEQ ID NO: 6444010 - DNA, 17 bp, Homo sapiens
tcttggagcctaaagag

SEQ ID NO: 6444011 - DNA, 13 bp, Homo sapiens
tcttggagcctgc

SEQ ID NO: 6444012 - DNA, 13 bp, Homo sapiens
tcttggagctgag

SEQ ID NO: 6444013 - DNA, 14 bp, Homo sapiens
tcttggagctgtga

SEQ ID NO: 6444014 - DNA, 15 bp, Homo sapiens
tcttggagtctagaa

SEQ ID NO: 6444015 - DNA, 20 bp, Homo sapiens
tcttggagtgcatttgactc

SEQ ID NO: 6444016 - DNA, 16 bp, Homo sapiens
tcttggataccagctc

SEQ ID NO: 6444017 - DNA, 19 bp, Homo sapiens
tcttggataccagctcagg

SEQ ID NO: 6444018 - DNA, 17 bp, Homo sapiens
tcttggatctttttgca

SEQ ID NO: 6444019 - DNA, 15 bp, Homo sapiens
tcttggattagcctt

SEQ ID NO: 6444020 - DNA, 21 bp, Homo sapiens
tcttggcaaaagccttgtgta

SEQ ID NO: 6444021 - DNA, 17 bp, Homo sapiens
tcttggcaataaatttt

SEQ ID NO: 6444022 - DNA, 22 bp, Homo sapiens
tcttggcaataaattttgaaaa

SEQ ID NO: 6444023 - DNA, 17 bp, Homo sapiens
tcttggcaataatgtca

SEQ ID NO: 6444024 - DNA, 17 bp, Homo sapiens
tcttggcaatattcctt

SEQ ID NO: 6444025 - DNA, 13 bp, Homo sapiens
tcttggcacctgc

SEQ ID NO: 6444026 - DNA, 21 bp, Homo sapiens
tcttggcagcttaacattgac

SEQ ID NO: 6444027 - DNA, 16 bp, Homo sapiens
tcttggcatgcatctt

SEQ ID NO: 6444028 - DNA, 13 bp, Homo sapiens
tcttggccagcca

SEQ ID NO: 6444029 - DNA, 18 bp, Homo sapiens
tcttggccatgatgtcct

SEQ ID NO: 6444030 - DNA, 17 bp, Homo sapiens
tcttggccgactcaggg

SEQ ID NO: 6444031 - DNA, 14 bp, Homo sapiens
tcttggcctcccag

SEQ ID NO: 6444032 - DNA, 11 bp, Homo sapiens
tcttggcctct

SEQ ID NO: 6444033 - DNA, 12 bp, Homo sapiens
tcttggcctctg

SEQ ID NO: 6444034 - DNA, 13 bp, Homo sapiens
tcttggcctctgc

SEQ ID NO: 6444035 - DNA, 16 bp, Homo sapiens
tcttggccttactgta

SEQ ID NO: 6444036 - DNA, 11 bp, Homo sapiens
tcttggccttt

SEQ ID NO: 6444037 - DNA, 17 bp, Homo sapiens
tcttggcgttcctgcca

SEQ ID NO: 6444038 - DNA, 21 bp, Homo sapiens
tcttggctattgaagatgctg

SEQ ID NO: 6444039 - DNA, 23 bp, Homo sapiens
tcttggctattgaagatgctgcc

SEQ ID NO: 6444040 - DNA, 16 bp, Homo sapiens
tcttggctatttctgt

SEQ ID NO: 6444041 - DNA, 17 bp, Homo sapiens
tcttggctatttctgtg

SEQ ID NO: 6444042 - DNA, 13 bp, Homo sapiens
tcttggctcactg

SEQ ID NO: 6444043 - DNA, 13 bp, Homo sapiens
tcttggctgaccc

SEQ ID NO: 6444044 - DNA, 14 bp, Homo sapiens
tcttggctggaccc

SEQ ID NO: 6444045 - DNA, 18 bp, Homo sapiens
tcttggctggacccagcc

SEQ ID NO: 6444046 - DNA, 20 bp, Homo sapiens
tcttggctggacccagccag

SEQ ID NO: 6444047 - DNA, 18 bp, Homo sapiens
tcttggcttaatcatttt

SEQ ID NO: 6444048 - DNA, 14 bp, Homo sapiens
tcttggcttccaga

SEQ ID NO: 6444049 - DNA, 21 bp, Homo sapiens
tcttggcttccagaaggcagc

SEQ ID NO: 6444050 - DNA, 13 bp, Homo sapiens
tcttggcttcctg

SEQ ID NO: 6444051 - DNA, 15 bp, Homo sapiens
tcttggcttcctggc

SEQ ID NO: 6444052 - DNA, 18 bp, Homo sapiens
tcttggcttcctggcgcc

SEQ ID NO: 6444053 - DNA, 19 bp, Homo sapiens
tcttggcttcctggcgccc

SEQ ID NO: 6444054 - DNA, 18 bp, Homo sapiens
tcttggcttctgggacct

SEQ ID NO: 6444055 - DNA, 13 bp, Homo sapiens
tcttggcttctta

SEQ ID NO: 6444056 - DNA, 15 bp, Homo sapiens
tcttggcttcttaaa

SEQ ID NO: 6444057 - DNA, 18 bp, Homo sapiens
tcttggcttcttaaaaac

SEQ ID NO: 6444058 - DNA, 19 bp, Homo sapiens
tcttggcttcttaaaaact

SEQ ID NO: 6444059 - DNA, 22 bp, Homo sapiens
tcttggcttcttaaaaactgtg

SEQ ID NO: 6444060 - DNA, 13 bp, Homo sapiens
tcttggctttgtt

SEQ ID NO: 6444061 - DNA, 21 bp, Homo sapiens
tcttgggaaaatatcactttg

SEQ ID NO: 6444062 - DNA, 16 bp, Homo sapiens
tcttgggaaagagaca

SEQ ID NO: 6444063 - DNA, 11 bp, Homo sapiens
tcttgggaaat

SEQ ID NO: 6444064 - DNA, 16 bp, Homo sapiens
tcttgggaacagggtt

SEQ ID NO: 6444065 - DNA, 22 bp, Homo sapiens
tcttgggaacagggttactgta

SEQ ID NO: 6444066 - DNA, 14 bp, Homo sapiens
tcttgggaactgaa

SEQ ID NO: 6444067 - DNA, 18 bp, Homo sapiens
tcttgggaagtgtgttta

SEQ ID NO: 6444068 - DNA, 21 bp, Homo sapiens
tcttgggacaacgtgctgctt

SEQ ID NO: 6444069 - DNA, 21 bp, Homo sapiens
tcttgggagtatgttgtcata

SEQ ID NO: 6444070 - DNA, 16 bp, Homo sapiens
tcttgggagtcttggg

SEQ ID NO: 6444071 - DNA, 21 bp, Homo sapiens
tcttgggatgagaatgaaagc

SEQ ID NO: 6444072 - DNA, 23 bp, Homo sapiens
tcttgggattcctcccctggaag

SEQ ID NO: 6444073 - DNA, 22 bp, Homo sapiens
tcttgggcaaaatgacaagggg

SEQ ID NO: 6444074 - DNA, 21 bp, Homo sapiens
tcttgggccaagccagctgcc

SEQ ID NO: 6444075 - DNA, 14 bp, Homo sapiens
tcttgggccccaga

SEQ ID NO: 6444076 - DNA, 20 bp, Homo sapiens
tcttgggcccggtccacagg

SEQ ID NO: 6444077 - DNA, 12 bp, Homo sapiens
tcttgggcctga

SEQ ID NO: 6444078 - DNA, 18 bp, Homo sapiens
tcttgggcctgacctcca

SEQ ID NO: 6444079 - DNA, 18 bp, Homo sapiens
tcttgggctactggcagc

SEQ ID NO: 6444080 - DNA, 19 bp, Homo sapiens
tcttgggctactggcagct

SEQ ID NO: 6444081 - DNA, 21 bp, Homo sapiens
tcttgggctactggcagctcc

SEQ ID NO: 6444082 - DNA, 19 bp, Homo sapiens
tcttgggctgagtgcagcc

SEQ ID NO: 6444083 - DNA, 21 bp, Homo sapiens
tcttgggctgagtgcagccaa

SEQ ID NO: 6444084 - DNA, 17 bp, Homo sapiens
tcttggggaaatagctt

SEQ ID NO: 6444085 - DNA, 13 bp, Homo sapiens
tcttggggaagat

SEQ ID NO: 6444086 - DNA, 12 bp, Homo sapiens
tcttggggaagg

SEQ ID NO: 6444087 - DNA, 21 bp, Homo sapiens
tcttggggacatctctttgaa

SEQ ID NO: 6444088 - DNA, 18 bp, Homo sapiens
tcttggggaccctgccta

SEQ ID NO: 6444089 - DNA, 22 bp, Homo sapiens
tcttggggactaacccaatgcc

SEQ ID NO: 6444090 - DNA, 22 bp, Homo sapiens
tcttggggactcgggggctggt

SEQ ID NO: 6444091 - DNA, 22 bp, Homo sapiens
tcttggggagtttagggtgggg

SEQ ID NO: 6444092 - DNA, 21 bp, Homo sapiens
tcttggggccactttcagagc

SEQ ID NO: 6444093 - DNA, 23 bp, Homo sapiens
tcttggggccactttcagagccc

SEQ ID NO: 6444094 - DNA, 16 bp, Homo sapiens
tcttggggctgatgaa

SEQ ID NO: 6444095 - DNA, 23 bp, Homo sapiens
tcttgggggacagggctggccca

SEQ ID NO: 6444096 - DNA, 17 bp, Homo sapiens
tcttgggggcagaccag

SEQ ID NO: 6444097 - DNA, 19 bp, Homo sapiens
tcttgggggccggggggaa

SEQ ID NO: 6444098 - DNA, 19 bp, Homo sapiens
tcttggggggatttggctg

SEQ ID NO: 6444099 - DNA, 16 bp, Homo sapiens
tcttgggggtcaccca

SEQ ID NO: 6444100 - DNA, 14 bp, Homo sapiens
tcttgggggtcagg

SEQ ID NO: 6444101 - DNA, 20 bp, Homo sapiens
tcttgggggtggggctgcat

SEQ ID NO: 6444102 - DNA, 22 bp, Homo sapiens
tcttggggtcatgaagggctgg

SEQ ID NO: 6444103 - DNA, 16 bp, Homo sapiens
tcttggggtcccaggg

SEQ ID NO: 6444104 - DNA, 15 bp, Homo sapiens
tcttgggtctgccct

SEQ ID NO: 6444105 - DNA, 20 bp, Homo sapiens
tcttgggtctgccctgccca

SEQ ID NO: 6444106 - DNA, 21 bp, Homo sapiens
tcttgggtgaaggtgcatctt

SEQ ID NO: 6444107 - DNA, 18 bp, Homo sapiens
tcttgggtggcgctggtg

SEQ ID NO: 6444108 - DNA, 18 bp, Homo sapiens
tcttgggtgggacagggc

SEQ ID NO: 6444109 - DNA, 18 bp, Homo sapiens
tcttgggtggttcctaag

SEQ ID NO: 6444110 - DNA, 15 bp, Homo sapiens
tcttgggttattatt

SEQ ID NO: 6444111 - DNA, 15 bp, Homo sapiens
tcttggtaaaacatt

SEQ ID NO: 6444112 - DNA, 22 bp, Homo sapiens
tcttggtaaatttccccaacag

SEQ ID NO: 6444113 - DNA, 14 bp, Homo sapiens
tcttggtagagatt

SEQ ID NO: 6444114 - DNA, 20 bp, Homo sapiens
tcttggtagattattcataa

SEQ ID NO: 6444115 - DNA, 22 bp, Homo sapiens
tcttggtagttctgtgcctccc

SEQ ID NO: 6444116 - DNA, 16 bp, Homo sapiens
tcttggtatgcatctt

SEQ ID NO: 6444117 - DNA, 21 bp, Homo sapiens
tcttggtatgggctgttctgt

SEQ ID NO: 6444118 - DNA, 23 bp, Homo sapiens
tcttggtatgggctgttctgttt

SEQ ID NO: 6444119 - DNA, 22 bp, Homo sapiens
tcttggtcaagtttttctctca

SEQ ID NO: 6444120 - DNA, 19 bp, Homo sapiens
tcttggtcacaaagctatt

SEQ ID NO: 6444121 - DNA, 17 bp, Homo sapiens
tcttggtcagatttgaa

SEQ ID NO: 6444122 - DNA, 13 bp, Homo sapiens
tcttggtcagctt

SEQ ID NO: 6444123 - DNA, 17 bp, Homo sapiens
tcttggtcctgctgcag

SEQ ID NO: 6444124 - DNA, 19 bp, Homo sapiens
tcttggtcctgctgcagtt

SEQ ID NO: 6444125 - DNA, 21 bp, Homo sapiens
tcttggtctctttctttccaa

SEQ ID NO: 6444126 - DNA, 23 bp, Homo sapiens
tcttggtgaaataataaaatgca

SEQ ID NO: 6444127 - DNA, 23 bp, Homo sapiens
tcttggtgccttttgtgtgatgc

SEQ ID NO: 6444128 - DNA, 20 bp, Homo sapiens
tcttggtgctgttgaaaata

SEQ ID NO: 6444129 - DNA, 22 bp, Homo sapiens
tcttggtggattagacaggtta

SEQ ID NO: 6444130 - DNA, 14 bp, Homo sapiens
tcttggtgtaactt

SEQ ID NO: 6444131 - DNA, 20 bp, Homo sapiens
tcttggtgtgattgcacaga

SEQ ID NO: 6444132 - DNA, 13 bp, Homo sapiens
tcttggttccagc

SEQ ID NO: 6444133 - DNA, 15 bp, Homo sapiens
tcttggttcctggga

SEQ ID NO: 6444134 - DNA, 14 bp, Homo sapiens
tcttggttcttatt

SEQ ID NO: 6444135 - DNA, 19 bp, Homo sapiens
tcttggttgaaaataaaaa

SEQ ID NO: 6444136 - DNA, 23 bp, Homo sapiens
tcttggttgaaaataaaaagatc

SEQ ID NO: 6444137 - DNA, 18 bp, Homo sapiens
tcttggtttatgtcttgt

SEQ ID NO: 6444138 - DNA, 17 bp, Homo sapiens
tcttggtttcagccaag

SEQ ID NO: 6444139 - DNA, 17 bp, Homo sapiens
tcttggtttggggagaa

SEQ ID NO: 6444140 - DNA, 20 bp, Homo sapiens
tcttggtttggggagaaata

SEQ ID NO: 6444141 - DNA, 15 bp, Homo sapiens
tcttgtaaaactgtg

SEQ ID NO: 6444142 - DNA, 16 bp, Homo sapiens
tcttgtaaaactgtga

SEQ ID NO: 6444143 - DNA, 23 bp, Homo sapiens
tcttgtaaaactgtgacattcca

SEQ ID NO: 6444144 - DNA, 15 bp, Homo sapiens
tcttgtaaacctgga

SEQ ID NO: 6444145 - DNA, 13 bp, Homo sapiens
tcttgtaaagact

SEQ ID NO: 6444146 - DNA, 13 bp, Homo sapiens
tcttgtaaataaa

SEQ ID NO: 6444147 - DNA, 18 bp, Homo sapiens
tcttgtaaataaagccct

SEQ ID NO: 6444148 - DNA, 22 bp, Homo sapiens
tcttgtaaataatgcttaacat

SEQ ID NO: 6444149 - DNA, 17 bp, Homo sapiens
tcttgtaaatgtgttgg

SEQ ID NO: 6444150 - DNA, 15 bp, Homo sapiens
tcttgtaactttctt

SEQ ID NO: 6444151 - DNA, 20 bp, Homo sapiens
tcttgtaagagctatacagt

SEQ ID NO: 6444152 - DNA, 22 bp, Homo sapiens
tcttgtaagtcatctacttaat

SEQ ID NO: 6444153 - DNA, 17 bp, Homo sapiens
tcttgtaatattttgta

SEQ ID NO: 6444154 - DNA, 19 bp, Homo sapiens
tcttgtaatccgaatctct

SEQ ID NO: 6444155 - DNA, 23 bp, Homo sapiens
tcttgtaatttaaacaggcccag

SEQ ID NO: 6444156 - DNA, 14 bp, Homo sapiens
tcttgtaatttcca

SEQ ID NO: 6444157 - DNA, 13 bp, Homo sapiens
tcttgtaatttta

SEQ ID NO: 6444158 - DNA, 19 bp, Homo sapiens
tcttgtaattttacacgct

SEQ ID NO: 6444159 - DNA, 15 bp, Homo sapiens
tcttgtacaaacttt

SEQ ID NO: 6444160 - DNA, 16 bp, Homo sapiens
tcttgtacaaactttg

SEQ ID NO: 6444161 - DNA, 14 bp, Homo sapiens
tccacctccctgca

SEQ ID NO: 6444162 - DNA, 15 bp, Homo sapiens
tccacctccgggttc

SEQ ID NO: 6444163 - DNA, 12 bp, Homo sapiens
tccacctcctgg

SEQ ID NO: 6444164 - DNA, 14 bp, Homo sapiens
tccacctcctgggt

SEQ ID NO: 6444165 - DNA, 16 bp, Homo sapiens
tccacctctccttgga

SEQ ID NO: 6444166 - DNA, 13 bp, Homo sapiens
tccacctctggtg

SEQ ID NO: 6444167 - DNA, 24 bp, Homo sapiens
tccacctctggtggctcctcctag

SEQ ID NO: 6444168 - DNA, 13 bp, Homo sapiens
tccacctgcacaa

SEQ ID NO: 6444169 - DNA, 14 bp, Homo sapiens
tccacctgcacaaa

SEQ ID NO: 6444170 - DNA, 16 bp, Homo sapiens
tccacctgcagcccca

SEQ ID NO: 6444171 - DNA, 23 bp, Homo sapiens
tccacctgccacaaaccaccagg

SEQ ID NO: 6444172 - DNA, 12 bp, Homo sapiens
tccacctgccag

SEQ ID NO: 6444173 - DNA, 13 bp, Homo sapiens
tccacctgccagg

SEQ ID NO: 6444174 - DNA, 17 bp, Homo sapiens
tccacctgccagggaca

SEQ ID NO: 6444175 - DNA, 18 bp, Homo sapiens
tccacctgccagggacag

SEQ ID NO: 6444176 - DNA, 20 bp, Homo sapiens
tccacctgccttggcctccc

SEQ ID NO: 6444177 - DNA, 17 bp, Homo sapiens
tccacctgctcccaggc

SEQ ID NO: 6444178 - DNA, 18 bp, Homo sapiens
tccacctgctctgctgat

SEQ ID NO: 6444179 - DNA, 20 bp, Homo sapiens
tccacctgctttctcctggg

SEQ ID NO: 6444180 - DNA, 17 bp, Homo sapiens
tccacctggaaagccag

SEQ ID NO: 6444181 - DNA, 22 bp, Homo sapiens
tccacctggagagtacatttgc

SEQ ID NO: 6444182 - DNA, 17 bp, Homo sapiens
tccacctggccccatgt

SEQ ID NO: 6444183 - DNA, 16 bp, Homo sapiens
tccacctgggagatgc

SEQ ID NO: 6444184 - DNA, 23 bp, Homo sapiens
tccacctgggagatgctgggacc

SEQ ID NO: 6444185 - DNA, 23 bp, Homo sapiens
tccacctgggcatatccaccacc

SEQ ID NO: 6444186 - DNA, 12 bp, Homo sapiens
tccacctggggt

SEQ ID NO: 6444187 - DNA, 16 bp, Homo sapiens
tccacctggtggccct

SEQ ID NO: 6444188 - DNA, 20 bp, Homo sapiens
tccacctggtggccctgcgg

SEQ ID NO: 6444189 - DNA, 13 bp, Homo sapiens
tccacctgtctca

SEQ ID NO: 6444190 - DNA, 16 bp, Homo sapiens
tccacctgtcttggcc

SEQ ID NO: 6444191 - DNA, 12 bp, Homo sapiens
tccacctgtgag

SEQ ID NO: 6444192 - DNA, 13 bp, Homo sapiens
tccacctgtgctt

SEQ ID NO: 6444193 - DNA, 14 bp, Homo sapiens
tccacctgtgcttg

SEQ ID NO: 6444194 - DNA, 21 bp, Homo sapiens
tccacctgtgcttggaaccag

SEQ ID NO: 6444195 - DNA, 13 bp, Homo sapiens
tccacctgtgggt

SEQ ID NO: 6444196 - DNA, 18 bp, Homo sapiens
tccaccttaaattaaaca

SEQ ID NO: 6444197 - DNA, 12 bp, Homo sapiens
tccaccttaact

SEQ ID NO: 6444198 - DNA, 15 bp, Homo sapiens
tccaccttagtactt

SEQ ID NO: 6444199 - DNA, 16 bp, Homo sapiens
tccaccttagtacttt

SEQ ID NO: 6444200 - DNA, 15 bp, Homo sapiens
tccaccttccaaaga

SEQ ID NO: 6444201 - DNA, 14 bp, Homo sapiens
tccaccttccaggc

SEQ ID NO: 6444202 - DNA, 15 bp, Homo sapiens
tccaccttcccatgc

SEQ ID NO: 6444203 - DNA, 18 bp, Homo sapiens
tccaccttcccatgccct

SEQ ID NO: 6444204 - DNA, 19 bp, Homo sapiens
tccaccttcccatgccctg

SEQ ID NO: 6444205 - DNA, 18 bp, Homo sapiens
tccaccttcctgcccagg

SEQ ID NO: 6444206 - DNA, 19 bp, Homo sapiens
tccaccttctgccaaggcc

SEQ ID NO: 6444207 - DNA, 15 bp, Homo sapiens
tccaccttctgggtt

SEQ ID NO: 6444208 - DNA, 18 bp, Homo sapiens
tccaccttgcacccgcaa

SEQ ID NO: 6444209 - DNA, 15 bp, Homo sapiens
tccaccttgctcttc

SEQ ID NO: 6444210 - DNA, 21 bp, Homo sapiens
tccaccttgctcttctttctg

SEQ ID NO: 6444211 - DNA, 19 bp, Homo sapiens
tccaccttggctctgccag

SEQ ID NO: 6444212 - DNA, 21 bp, Homo sapiens
tccacctttatgttttaatat

SEQ ID NO: 6444213 - DNA, 19 bp, Homo sapiens
tccacctttctgaatggaa

SEQ ID NO: 6444214 - DNA, 20 bp, Homo sapiens
tccacctttctgaatggaaa

SEQ ID NO: 6444215 - DNA, 12 bp, Homo sapiens
tccaccttttct

SEQ ID NO: 6444216 - DNA, 16 bp, Homo sapiens
tccacgactgtctcca

SEQ ID NO: 6444217 - DNA, 17 bp, Homo sapiens
tccacgactgtctccat

SEQ ID NO: 6444218 - DNA, 19 bp, Homo sapiens
tccacgactgtctccatgg

SEQ ID NO: 6444219 - DNA, 17 bp, Homo sapiens
tccacgagagcgcagca

SEQ ID NO: 6444220 - DNA, 19 bp, Homo sapiens
tccacgcacatgcgacccc

SEQ ID NO: 6444221 - DNA, 14 bp, Homo sapiens
tccacgcagcaccc

SEQ ID NO: 6444222 - DNA, 17 bp, Homo sapiens
tccacgcagttctttcc

SEQ ID NO: 6444223 - DNA, 20 bp, Homo sapiens
tccacgcccaccagccttgc

SEQ ID NO: 6444224 - DNA, 22 bp, Homo sapiens
tccacgcccaccagccttgctc

SEQ ID NO: 6444225 - DNA, 16 bp, Homo sapiens
tccacgccctggggag

SEQ ID NO: 6444226 - DNA, 15 bp, Homo sapiens
tccacgcctcctggc

SEQ ID NO: 6444227 - DNA, 17 bp, Homo sapiens
tccacgcctcctggcca

SEQ ID NO: 6444228 - DNA, 14 bp, Homo sapiens
tccacgcggccacc

SEQ ID NO: 6444229 - DNA, 19 bp, Homo sapiens
tccacgcggccacctcacc

SEQ ID NO: 6444230 - DNA, 15 bp, Homo sapiens
tccacgctcatcttg

SEQ ID NO: 6444231 - DNA, 15 bp, Homo sapiens
tccacgctgggccta

SEQ ID NO: 6444232 - DNA, 17 bp, Homo sapiens
tccacgctgtctccaga

SEQ ID NO: 6444233 - DNA, 19 bp, Homo sapiens
tccacgctgtctccagacc

SEQ ID NO: 6444234 - DNA, 20 bp, Homo sapiens
tccacgctgtctccagaccc

SEQ ID NO: 6444235 - DNA, 23 bp, Homo sapiens
tccacgctgtctccagaccccca

SEQ ID NO: 6444236 - DNA, 14 bp, Homo sapiens
tccacggagccact

SEQ ID NO: 6444237 - DNA, 19 bp, Homo sapiens
tccacggatgcgtgggcag

SEQ ID NO: 6444238 - DNA, 21 bp, Homo sapiens
tccacggatgcgtgggcagag

SEQ ID NO: 6444239 - DNA, 14 bp, Homo sapiens
tccacggctctagg

SEQ ID NO: 6444240 - DNA, 20 bp, Homo sapiens
tccacggctctaggtggggc

SEQ ID NO: 6444241 - DNA, 19 bp, Homo sapiens
tccacggggctcactctgg

SEQ ID NO: 6444242 - DNA, 20 bp, Homo sapiens
tccacggggctcactctggc

SEQ ID NO: 6444243 - DNA, 23 bp, Homo sapiens
tccacgggggctgtggctctggg

SEQ ID NO: 6444244 - DNA, 22 bp, Homo sapiens
tccacgggtctcacttatacca

SEQ ID NO: 6444245 - DNA, 18 bp, Homo sapiens
tccacggtccgcggcctg

SEQ ID NO: 6444246 - DNA, 21 bp, Homo sapiens
tccacggtccgcggcctgcac

SEQ ID NO: 6444247 - DNA, 15 bp, Homo sapiens
tccacggtcttctgc

SEQ ID NO: 6444248 - DNA, 13 bp, Homo sapiens
tccacggtgcgtg

SEQ ID NO: 6444249 - DNA, 15 bp, Homo sapiens
tccacggtgcgtggc

SEQ ID NO: 6444250 - DNA, 16 bp, Homo sapiens
tccacggtgcgtggct

SEQ ID NO: 6444251 - DNA, 22 bp, Homo sapiens
tccacggtgcgtggctgtggca

SEQ ID NO: 6444252 - DNA, 17 bp, Homo sapiens
tccacgtactgcagcct

SEQ ID NO: 6444253 - DNA, 21 bp, Homo sapiens
tccacgtacttaatttactta

SEQ ID NO: 6444254 - DNA, 21 bp, Homo sapiens
tccacgtagggggcaggggca

SEQ ID NO: 6444255 - DNA, 20 bp, Homo sapiens
tccacgtattccccttccca

SEQ ID NO: 6444256 - DNA, 14 bp, Homo sapiens
tccacgtctttcct

SEQ ID NO: 6444257 - DNA, 15 bp, Homo sapiens
tccacgtctttcctg

SEQ ID NO: 6444258 - DNA, 18 bp, Homo sapiens
tccacgtctttcctgcta

SEQ ID NO: 6444259 - DNA, 13 bp, Homo sapiens
tccacgtgtatgc

SEQ ID NO: 6444260 - DNA, 14 bp, Homo sapiens
tccacgtgtatgca

SEQ ID NO: 6444261 - DNA, 18 bp, Homo sapiens
tccacgtgtatgcaagtg

SEQ ID NO: 6444262 - DNA, 13 bp, Homo sapiens
tccacgtgtgtgt

SEQ ID NO: 6444263 - DNA, 14 bp, Homo sapiens
tccacgtttgtgcc

SEQ ID NO: 6444264 - DNA, 19 bp, Homo sapiens
tccactaaatgagctcctg

SEQ ID NO: 6444265 - DNA, 19 bp, Homo sapiens
tccactaaccccgggcggg

SEQ ID NO: 6444266 - DNA, 18 bp, Homo sapiens
tccactaatactggttat

SEQ ID NO: 6444267 - DNA, 21 bp, Homo sapiens
tccactaccccacaccagcct

SEQ ID NO: 6444268 - DNA, 22 bp, Homo sapiens
tccactaccccacaccagcctt

SEQ ID NO: 6444269 - DNA, 23 bp, Homo sapiens
tccactaccccacaccagccttg

SEQ ID NO: 6444270 - DNA, 17 bp, Homo sapiens
tccactacccggcaggg

SEQ ID NO: 6444271 - DNA, 13 bp, Homo sapiens
tccactactccgt

SEQ ID NO: 6444272 - DNA, 13 bp, Homo sapiens
tccactactgcta

SEQ ID NO: 6444273 - DNA, 19 bp, Homo sapiens
tccactatacaattcagta

SEQ ID NO: 6444274 - DNA, 19 bp, Homo sapiens
tccactatgacatctaagt

SEQ ID NO: 6444275 - DNA, 22 bp, Homo sapiens
tccactatgggaagctctgtgt

SEQ ID NO: 6444276 - DNA, 21 bp, Homo sapiens
tccactattatagaaattctg

SEQ ID NO: 6444277 - DNA, 18 bp, Homo sapiens
tccactatttgcagaggc

SEQ ID NO: 6444278 - DNA, 19 bp, Homo sapiens
tccactatttgcagaggct

SEQ ID NO: 6444279 - DNA, 17 bp, Homo sapiens
tccactattttcaaaga

SEQ ID NO: 6444280 - DNA, 18 bp, Homo sapiens
tccactattttcaaagaa

SEQ ID NO: 6444281 - DNA, 14 bp, Homo sapiens
tccactcactccag

SEQ ID NO: 6444282 - DNA, 17 bp, Homo sapiens
tccactcactccagccc

SEQ ID NO: 6444283 - DNA, 18 bp, Homo sapiens
tccactcactccagccca

SEQ ID NO: 6444284 - DNA, 15 bp, Homo sapiens
tccactcagcactct

SEQ ID NO: 6444285 - DNA, 22 bp, Homo sapiens
tccactcagctgtcctgcagca

SEQ ID NO: 6444286 - DNA, 19 bp, Homo sapiens
tccactccaagatgccctc

SEQ ID NO: 6444287 - DNA, 18 bp, Homo sapiens
tccactccaagtgcccca

SEQ ID NO: 6444288 - DNA, 17 bp, Homo sapiens
tccactccacctccacc

SEQ ID NO: 6444289 - DNA, 16 bp, Homo sapiens
tccactccatatttat

SEQ ID NO: 6444290 - DNA, 23 bp, Homo sapiens
tccactccatatttatttaaaca

SEQ ID NO: 6444291 - DNA, 18 bp, Homo sapiens
tccactcccacctcaccc

SEQ ID NO: 6444292 - DNA, 18 bp, Homo sapiens
tccactcccactgccagg

SEQ ID NO: 6444293 - DNA, 13 bp, Homo sapiens
tccactcccagca

SEQ ID NO: 6444294 - DNA, 13 bp, Homo sapiens
tccactcccagtg

SEQ ID NO: 6444295 - DNA, 17 bp, Homo sapiens
tccactcccccacctga

SEQ ID NO: 6444296 - DNA, 18 bp, Homo sapiens
tccactcccccacctgac

SEQ ID NO: 6444297 - DNA, 16 bp, Homo sapiens
tccactcccctcatcc

SEQ ID NO: 6444298 - DNA, 16 bp, Homo sapiens
tccactccctgctcca

SEQ ID NO: 6444299 - DNA, 13 bp, Homo sapiens
tccactcctccca

SEQ ID NO: 6444300 - DNA, 23 bp, Homo sapiens
tccactcctcccaactctggcct

SEQ ID NO: 6444301 - DNA, 18 bp, Homo sapiens
tccactcctcctagccac

SEQ ID NO: 6444302 - DNA, 14 bp, Homo sapiens
tccactcctctcaa

SEQ ID NO: 6444303 - DNA, 14 bp, Homo sapiens
tccactccttcctg

SEQ ID NO: 6444304 - DNA, 16 bp, Homo sapiens
tccactcgtgtgtttc

SEQ ID NO: 6444305 - DNA, 18 bp, Homo sapiens
tccactctaccctcccac

SEQ ID NO: 6444306 - DNA, 12 bp, Homo sapiens
tccactctcagg

SEQ ID NO: 6444307 - DNA, 23 bp, Homo sapiens
tccactctgaggtctcaccttcg

SEQ ID NO: 6444308 - DNA, 21 bp, Homo sapiens
tccactctgcttctctgactt

SEQ ID NO: 6444309 - DNA, 22 bp, Homo sapiens
tccactctggattcagccttct

SEQ ID NO: 6444310 - DNA, 22 bp, Homo sapiens
tccactcttctctcctttctcc

SEQ ID NO: 6444311 - DNA, 16 bp, Homo sapiens
tccactcttgatctct

SEQ ID NO: 6444312 - DNA, 19 bp, Homo sapiens
tccactgaaaatttaacag

SEQ ID NO: 6444313 - DNA, 16 bp, Homo sapiens
tccactgagactttcc

SEQ ID NO: 6444314 - DNA, 22 bp, Homo sapiens
tccactgagactttcccctctc

SEQ ID NO: 6444315 - DNA, 22 bp, Homo sapiens
tccactgagcatcacaataaag

SEQ ID NO: 6444316 - DNA, 23 bp, Homo sapiens
tccactgcaaagttttctttcca

SEQ ID NO: 6444317 - DNA, 17 bp, Homo sapiens
tccactgcaaataaagc

SEQ ID NO: 6444318 - DNA, 20 bp, Homo sapiens
tccactgcaaataaagcctt

SEQ ID NO: 6444319 - DNA, 15 bp, Homo sapiens
tccactgcaagaggg

SEQ ID NO: 6444320 - DNA, 18 bp, Homo sapiens
tccactgccaaaacaatg

SEQ ID NO: 6444321 - DNA, 12 bp, Homo sapiens
tccactgccctc

SEQ ID NO: 6444322 - DNA, 13 bp, Homo sapiens
tccactgccctgg

SEQ ID NO: 6444323 - DNA, 12 bp, Homo sapiens
tccactgcctgg

SEQ ID NO: 6444324 - DNA, 13 bp, Homo sapiens
tccactgccttcg

SEQ ID NO: 6444325 - DNA, 22 bp, Homo sapiens
tccactgccttcgatacaccgg

SEQ ID NO: 6444326 - DNA, 14 bp, Homo sapiens
tccactgcctttgg

SEQ ID NO: 6444327 - DNA, 21 bp, Homo sapiens
tccactgctactgacccagag

SEQ ID NO: 6444328 - DNA, 12 bp, Homo sapiens
tccactgctgga

SEQ ID NO: 6444329 - DNA, 15 bp, Homo sapiens
tccactgctggacat

SEQ ID NO: 6444330 - DNA, 10 bp, Homo sapiens
tccactggac

SEQ ID NO: 6444331 - DNA, 22 bp, Homo sapiens
tccactggacagacccaggtct

SEQ ID NO: 6444332 - DNA, 22 bp, Homo sapiens
tccactggccggagtcagtgcc

SEQ ID NO: 6444333 - DNA, 17 bp, Homo sapiens
tccactggcctgcccgt

SEQ ID NO: 6444334 - DNA, 16 bp, Homo sapiens
tccactggctccacat

SEQ ID NO: 6444335 - DNA, 21 bp, Homo sapiens
tccactggggaatgctcccag

SEQ ID NO: 6444336 - DNA, 22 bp, Homo sapiens
tccactggggaatgctcccagc

SEQ ID NO: 6444337 - DNA, 18 bp, Homo sapiens
tccactggggtggcctga

SEQ ID NO: 6444338 - DNA, 19 bp, Homo sapiens
tccactggtttcaggccaa

SEQ ID NO: 6444339 - DNA, 16 bp, Homo sapiens
tccactgtaattaaaa

SEQ ID NO: 6444340 - DNA, 22 bp, Homo sapiens
tcttgtacagttaactctccca

SEQ ID NO: 6444341 - DNA, 17 bp, Homo sapiens
tcttgtacatgtgtagc

SEQ ID NO: 6444342 - DNA, 15 bp, Homo sapiens
tcttgtacttctgtg

SEQ ID NO: 6444343 - DNA, 18 bp, Homo sapiens
tcttgtacttctgtgttc

SEQ ID NO: 6444344 - DNA, 19 bp, Homo sapiens
tcttgtacttctgtgttca

SEQ ID NO: 6444345 - DNA, 17 bp, Homo sapiens
tcttgtagcccaggctg

SEQ ID NO: 6444346 - DNA, 16 bp, Homo sapiens
tcttgtagtagtctca

SEQ ID NO: 6444347 - DNA, 16 bp, Homo sapiens
tcttgtattaaactct

SEQ ID NO: 6444348 - DNA, 14 bp, Homo sapiens
tcttgtattaagaa

SEQ ID NO: 6444349 - DNA, 21 bp, Homo sapiens
tcttgtattatctcctttgaa

SEQ ID NO: 6444350 - DNA, 16 bp, Homo sapiens
tcttgtattgctccat

SEQ ID NO: 6444351 - DNA, 19 bp, Homo sapiens
tcttgtatttaaaaacatt

SEQ ID NO: 6444352 - DNA, 22 bp, Homo sapiens
tcttgtatttattggttttgca

SEQ ID NO: 6444353 - DNA, 23 bp, Homo sapiens
tcttgtatttgggccaaggtgtt

SEQ ID NO: 6444354 - DNA, 13 bp, Homo sapiens
tcttgtattttct

SEQ ID NO: 6444355 - DNA, 20 bp, Homo sapiens
tcttgtattttcttcccatt

SEQ ID NO: 6444356 - DNA, 15 bp, Homo sapiens
tcttgtcacaataaa

SEQ ID NO: 6444357 - DNA, 19 bp, Homo sapiens
tcttgtcacccaggctgga

SEQ ID NO: 6444358 - DNA, 24 bp, Homo sapiens
tcttgtcacccaggctggagtgca

SEQ ID NO: 6444359 - DNA, 13 bp, Homo sapiens
tcttgtcagacat

SEQ ID NO: 6444360 - DNA, 21 bp, Homo sapiens
tcttgtcagacataaagccat

SEQ ID NO: 6444361 - DNA, 22 bp, Homo sapiens
tcttgtcaggtggaccctgtaa

SEQ ID NO: 6444362 - DNA, 17 bp, Homo sapiens
tcttgtcagtgtagaca

SEQ ID NO: 6444363 - DNA, 21 bp, Homo sapiens
tcttgtcagtgtagacacagg

SEQ ID NO: 6444364 - DNA, 17 bp, Homo sapiens
tcttgtcataaaatgca

SEQ ID NO: 6444365 - DNA, 21 bp, Homo sapiens
tcttgtcatacaaatttataa

SEQ ID NO: 6444366 - DNA, 13 bp, Homo sapiens
tcttgtcatcttt

SEQ ID NO: 6444367 - DNA, 13 bp, Homo sapiens
tcttgtcatgtgt

SEQ ID NO: 6444368 - DNA, 15 bp, Homo sapiens
tcttgtcatgtgtat

SEQ ID NO: 6444369 - DNA, 15 bp, Homo sapiens
tcttgtcattctcat

SEQ ID NO: 6444370 - DNA, 19 bp, Homo sapiens
tcttgtcatttttaatatt

SEQ ID NO: 6444371 - DNA, 20 bp, Homo sapiens
tcttgtccacagtctcccat

SEQ ID NO: 6444372 - DNA, 22 bp, Homo sapiens
tcttgtccacagtctcccattc

SEQ ID NO: 6444373 - DNA, 14 bp, Homo sapiens
tcttgtccacattc

SEQ ID NO: 6444374 - DNA, 17 bp, Homo sapiens
tcttgtccacattctac

SEQ ID NO: 6444375 - DNA, 23 bp, Homo sapiens
tcttgtccacattctacttcagc

SEQ ID NO: 6444376 - DNA, 23 bp, Homo sapiens
tcttgtccatgtggttcttcaaa

SEQ ID NO: 6444377 - DNA, 18 bp, Homo sapiens
tcttgtcccaattaaaat

SEQ ID NO: 6444378 - DNA, 17 bp, Homo sapiens
tcttgtcctcagtccat

SEQ ID NO: 6444379 - DNA, 15 bp, Homo sapiens
tcttgtcctcctgtt

SEQ ID NO: 6444380 - DNA, 16 bp, Homo sapiens
tcttgtcctcttctgc

SEQ ID NO: 6444381 - DNA, 15 bp, Homo sapiens
tcttgtcctggccct

SEQ ID NO: 6444382 - DNA, 19 bp, Homo sapiens
tcttgtctaagacccccat

SEQ ID NO: 6444383 - DNA, 13 bp, Homo sapiens
tcttgtctataaa

SEQ ID NO: 6444384 - DNA, 15 bp, Homo sapiens
tcttgtctcaatgct

SEQ ID NO: 6444385 - DNA, 17 bp, Homo sapiens
tcttgtctcagatttta

SEQ ID NO: 6444386 - DNA, 19 bp, Homo sapiens
tcttgtctcagattttatt

SEQ ID NO: 6444387 - DNA, 14 bp, Homo sapiens
tcttgtctccacta

SEQ ID NO: 6444388 - DNA, 11 bp, Homo sapiens
tcttgtctccc

SEQ ID NO: 6444389 - DNA, 12 bp, Homo sapiens
tcttgtctcccc

SEQ ID NO: 6444390 - DNA, 15 bp, Homo sapiens
tcttgtctcccctgt

SEQ ID NO: 6444391 - DNA, 12 bp, Homo sapiens
tcttgtctctgg

SEQ ID NO: 6444392 - DNA, 14 bp, Homo sapiens
tcttgtctctgggc

SEQ ID NO: 6444393 - DNA, 15 bp, Homo sapiens
tcttgtctctgggct

SEQ ID NO: 6444394 - DNA, 17 bp, Homo sapiens
tcttgtctgagggacat

SEQ ID NO: 6444395 - DNA, 13 bp, Homo sapiens
tcttgtctggctg

SEQ ID NO: 6444396 - DNA, 11 bp, Homo sapiens
tcttgtgaagg

SEQ ID NO: 6444397 - DNA, 16 bp, Homo sapiens
tcttgtgactagtgct

SEQ ID NO: 6444398 - DNA, 23 bp, Homo sapiens
tcttgtgactagtgctgaagctt

SEQ ID NO: 6444399 - DNA, 21 bp, Homo sapiens
tcttgtgactcagcagaggca

SEQ ID NO: 6444400 - DNA, 14 bp, Homo sapiens
tcttgtgaggccct

SEQ ID NO: 6444401 - DNA, 20 bp, Homo sapiens
tcttgtgcaaggtggccttt

SEQ ID NO: 6444402 - DNA, 22 bp, Homo sapiens
tcttgtgcactggcaccaagtg

SEQ ID NO: 6444403 - DNA, 11 bp, Homo sapiens
tcttgtgcatg

SEQ ID NO: 6444404 - DNA, 19 bp, Homo sapiens
tcttgtgcatgcaaaaatg

SEQ ID NO: 6444405 - DNA, 13 bp, Homo sapiens
tcttgtgcatgtt

SEQ ID NO: 6444406 - DNA, 20 bp, Homo sapiens
tcttgtgccctgggccaaaa

SEQ ID NO: 6444407 - DNA, 17 bp, Homo sapiens
tcttgtgcctcggcctc

SEQ ID NO: 6444408 - DNA, 14 bp, Homo sapiens
tcttgtgctagaat

SEQ ID NO: 6444409 - DNA, 17 bp, Homo sapiens
tcttgtgctagaatact

SEQ ID NO: 6444410 - DNA, 18 bp, Homo sapiens
tcttgtgctatgaaacaa

SEQ ID NO: 6444411 - DNA, 18 bp, Homo sapiens
tcttgtgctcacgctccc

SEQ ID NO: 6444412 - DNA, 22 bp, Homo sapiens
tcttgtgctggatggagcccag

SEQ ID NO: 6444413 - DNA, 13 bp, Homo sapiens
tcttgtgcttctt

SEQ ID NO: 6444414 - DNA, 13 bp, Homo sapiens
tcttgtggaagac

SEQ ID NO: 6444415 - DNA, 21 bp, Homo sapiens
tcttgtggaagacacttgctg

SEQ ID NO: 6444416 - DNA, 22 bp, Homo sapiens
tcttgtggaagtgcatctactt

SEQ ID NO: 6444417 - DNA, 23 bp, Homo sapiens
tcttgtggaagtgcatctacttg

SEQ ID NO: 6444418 - DNA, 24 bp, Homo sapiens
tcttgtggatggaaatgtagtgct

SEQ ID NO: 6444419 - DNA, 23 bp, Homo sapiens
tcttgtggatgttttaattccat

SEQ ID NO: 6444420 - DNA, 15 bp, Homo sapiens
tcttgtggcaagagc

SEQ ID NO: 6444421 - DNA, 20 bp, Homo sapiens
tcttgtgggagacagcagcc

SEQ ID NO: 6444422 - DNA, 17 bp, Homo sapiens
tcttgtggtgtaaagct

SEQ ID NO: 6444423 - DNA, 20 bp, Homo sapiens
tcttgtggttaaaaacctgc

SEQ ID NO: 6444424 - DNA, 16 bp, Homo sapiens
tcttgtggttgtagga

SEQ ID NO: 6444425 - DNA, 21 bp, Homo sapiens
tcttgtgtagatttgaaaatt

SEQ ID NO: 6444426 - DNA, 15 bp, Homo sapiens
tcttgtgtatggata

SEQ ID NO: 6444427 - DNA, 19 bp, Homo sapiens
tcttgtgtatttctctgtg

SEQ ID NO: 6444428 - DNA, 13 bp, Homo sapiens
tcttgtgtcctga

SEQ ID NO: 6444429 - DNA, 15 bp, Homo sapiens
tcttgtgtctttgga

SEQ ID NO: 6444430 - DNA, 12 bp, Homo sapiens
tcttgtgtgttt

SEQ ID NO: 6444431 - DNA, 13 bp, Homo sapiens
tcttgtgtgttta

SEQ ID NO: 6444432 - DNA, 18 bp, Homo sapiens
tcttgtgttctgtagact

SEQ ID NO: 6444433 - DNA, 15 bp, Homo sapiens
tcttgtgttgtcctt

SEQ ID NO: 6444434 - DNA, 15 bp, Homo sapiens
tcttgtgttgttttc

SEQ ID NO: 6444435 - DNA, 18 bp, Homo sapiens
tcttgtgttgttttctct

SEQ ID NO: 6444436 - DNA, 22 bp, Homo sapiens
tcttgtgtttccacagcctgca

SEQ ID NO: 6444437 - DNA, 16 bp, Homo sapiens
tcttgttaaatgagct

SEQ ID NO: 6444438 - DNA, 13 bp, Homo sapiens
tcttgttaatatt

SEQ ID NO: 6444439 - DNA, 18 bp, Homo sapiens
tcttgttaatgtcattgc

SEQ ID NO: 6444440 - DNA, 15 bp, Homo sapiens
tcttgttagaaaaca

SEQ ID NO: 6444441 - DNA, 17 bp, Homo sapiens
tcttgttagaaaacaaa

SEQ ID NO: 6444442 - DNA, 18 bp, Homo sapiens
tcttgttagagagctttt

SEQ ID NO: 6444443 - DNA, 15 bp, Homo sapiens
tcttgttatgtacaa

SEQ ID NO: 6444444 - DNA, 20 bp, Homo sapiens
tcttgttattaccaaaacag

SEQ ID NO: 6444445 - DNA, 17 bp, Homo sapiens
tcttgttattgaagtgt

SEQ ID NO: 6444446 - DNA, 14 bp, Homo sapiens
tcttgttcaaaaag

SEQ ID NO: 6444447 - DNA, 23 bp, Homo sapiens
tcttgttcgcacaatctacactg

SEQ ID NO: 6444448 - DNA, 15 bp, Homo sapiens
tcttgttctgtccct

SEQ ID NO: 6444449 - DNA, 16 bp, Homo sapiens
tcttgttctgttttgt

SEQ ID NO: 6444450 - DNA, 20 bp, Homo sapiens
tcttgttgaagtgctgtttt

SEQ ID NO: 6444451 - DNA, 14 bp, Homo sapiens
tcttgttgataaaa

SEQ ID NO: 6444452 - DNA, 16 bp, Homo sapiens
tcttgttgcatctttt

SEQ ID NO: 6444453 - DNA, 11 bp, Homo sapiens
tcttgttgctt

SEQ ID NO: 6444454 - DNA, 16 bp, Homo sapiens
tcttgttggtgcacag

SEQ ID NO: 6444455 - DNA, 13 bp, Homo sapiens
tcttgttgttatt

SEQ ID NO: 6444456 - DNA, 20 bp, Homo sapiens
tcttgtttaaaaaaagaaaa

SEQ ID NO: 6444457 - DNA, 16 bp, Homo sapiens
tcttgtttaccaaaga

SEQ ID NO: 6444458 - DNA, 23 bp, Homo sapiens
tcttgtttacgatttcactagga

SEQ ID NO: 6444459 - DNA, 14 bp, Homo sapiens
tcttgtttcaattc

SEQ ID NO: 6444460 - DNA, 16 bp, Homo sapiens
tcttgtttctcatgaa

SEQ ID NO: 6444461 - DNA, 14 bp, Homo sapiens
tcttgtttctcccg

SEQ ID NO: 6444462 - DNA, 14 bp, Homo sapiens
tcttgtttctgttt

SEQ ID NO: 6444463 - DNA, 21 bp, Homo sapiens
tcttgtttctgtttagtccgt

SEQ ID NO: 6444464 - DNA, 22 bp, Homo sapiens
tcttgtttcttttcacatagct

SEQ ID NO: 6444465 - DNA, 12 bp, Homo sapiens
tcttgtttgtca

SEQ ID NO: 6444466 - DNA, 14 bp, Homo sapiens
tcttgtttgtcagc

SEQ ID NO: 6444467 - DNA, 18 bp, Homo sapiens
tcttgtttgtcagcatct

SEQ ID NO: 6444468 - DNA, 19 bp, Homo sapiens
tcttgtttgtcagcatctg

SEQ ID NO: 6444469 - DNA, 17 bp, Homo sapiens
tcttgttttaagcaaat

SEQ ID NO: 6444470 - DNA, 14 bp, Homo sapiens
tcttgttttcagtt

SEQ ID NO: 6444471 - DNA, 16 bp, Homo sapiens
tcttgttttgcttccc

SEQ ID NO: 6444472 - DNA, 14 bp, Homo sapiens
tcttgttttgttat

SEQ ID NO: 6444473 - DNA, 19 bp, Homo sapiens
tcttgttttgttatataaa

SEQ ID NO: 6444474 - DNA, 20 bp, Homo sapiens
tcttgttttgttatataaaa

SEQ ID NO: 6444475 - DNA, 22 bp, Homo sapiens
tcttgttttgtttgcttccatt

SEQ ID NO: 6444476 - DNA, 21 bp, Homo sapiens
tcttgtttttaagtttgcact

SEQ ID NO: 6444477 - DNA, 13 bp, Homo sapiens
tcttgtttttcca

SEQ ID NO: 6444478 - DNA, 18 bp, Homo sapiens
tctttaaaaaaaaaattg

SEQ ID NO: 6444479 - DNA, 19 bp, Homo sapiens
tctttaaaaaaaaaattgg

SEQ ID NO: 6444480 - DNA, 20 bp, Homo sapiens
tctttaaaaaaaaatcttgt

SEQ ID NO: 6444481 - DNA, 14 bp, Homo sapiens
tctttaaaaaagaa

SEQ ID NO: 6444482 - DNA, 18 bp, Homo sapiens
tctttaaaaaagaaatta

SEQ ID NO: 6444483 - DNA, 16 bp, Homo sapiens
tctttaaaaaagactg

SEQ ID NO: 6444484 - DNA, 15 bp, Homo sapiens
tctttaaaaacattt

SEQ ID NO: 6444485 - DNA, 14 bp, Homo sapiens
tctttaaaaactgt

SEQ ID NO: 6444486 - DNA, 16 bp, Homo sapiens
tctttaaaagaaagtt

SEQ ID NO: 6444487 - DNA, 19 bp, Homo sapiens
tctttaaaagaaagttagg

SEQ ID NO: 6444488 - DNA, 19 bp, Homo sapiens
tctttaaaagatgctttta

SEQ ID NO: 6444489 - DNA, 13 bp, Homo sapiens
tctttaaaagtca

SEQ ID NO: 6444490 - DNA, 16 bp, Homo sapiens
tctttaaaatatttgt

SEQ ID NO: 6444491 - DNA, 20 bp, Homo sapiens
tctttaaaattacaactaag

SEQ ID NO: 6444492 - DNA, 23 bp, Homo sapiens
tctttaaacagtatttcattgcc

SEQ ID NO: 6444493 - DNA, 12 bp, Homo sapiens
tctttaaaccac

SEQ ID NO: 6444494 - DNA, 15 bp, Homo sapiens
tctttaaactgtcgt

SEQ ID NO: 6444495 - DNA, 15 bp, Homo sapiens
tctttaaagaagaat

SEQ ID NO: 6444496 - DNA, 23 bp, Homo sapiens
tctttaaagaggagcctttccag

SEQ ID NO: 6444497 - DNA, 14 bp, Homo sapiens
tctttaaagccagt

SEQ ID NO: 6444498 - DNA, 15 bp, Homo sapiens
tctttaaaggcccag

SEQ ID NO: 6444499 - DNA, 18 bp, Homo sapiens
tctttaaagtcaggtcca

SEQ ID NO: 6444500 - DNA, 14 bp, Homo sapiens
tctttaaatataat

SEQ ID NO: 6444501 - DNA, 15 bp, Homo sapiens
tctttaaatgtgtat

SEQ ID NO: 6444502 - DNA, 12 bp, Homo sapiens
tctttaaatgtt

SEQ ID NO: 6444503 - DNA, 19 bp, Homo sapiens
tctttaaatgttttataag

SEQ ID NO: 6444504 - DNA, 14 bp, Homo sapiens
tctttaaattatga

SEQ ID NO: 6444505 - DNA, 17 bp, Homo sapiens
tctttaaatttcaaatg

SEQ ID NO: 6444506 - DNA, 14 bp, Homo sapiens
tctttaacaattgt

SEQ ID NO: 6444507 - DNA, 19 bp, Homo sapiens
tctttaacagcttacactg

SEQ ID NO: 6444508 - DNA, 16 bp, Homo sapiens
tctttaacatacatct

SEQ ID NO: 6444509 - DNA, 22 bp, Homo sapiens
tctttaacatacatctaagtca

SEQ ID NO: 6444510 - DNA, 22 bp, Homo sapiens
tctttaacatagtcctgttact

SEQ ID NO: 6444511 - DNA, 21 bp, Homo sapiens
tctttaaccactcctcaggaa

SEQ ID NO: 6444512 - DNA, 21 bp, Homo sapiens
tctttaaccctcactgggact

SEQ ID NO: 6444513 - DNA, 15 bp, Homo sapiens
tctttaactcataaa

SEQ ID NO: 6444514 - DNA, 20 bp, Homo sapiens
tctttaacttaattgctatg

SEQ ID NO: 6444515 - DNA, 14 bp, Homo sapiens
tctttaagaaagta

SEQ ID NO: 6444516 - DNA, 21 bp, Homo sapiens
tctttaagaatgcttaaaaaa

SEQ ID NO: 6444517 - DNA, 12 bp, Homo sapiens
tctttaagagac

SEQ ID NO: 6444518 - DNA, 13 bp, Homo sapiens
tctttaagccata

SEQ ID NO: 6444519 - DNA, 14 bp, Homo sapiens
tctttaagccatag

SEQ ID NO: 6444520 - DNA, 12 bp, Homo sapiens
tccactgtcacc

SEQ ID NO: 6444521 - DNA, 23 bp, Homo sapiens
tccactgtcataatctctttcca

SEQ ID NO: 6444522 - DNA, 19 bp, Homo sapiens
tccactgtctttaaaagtc

SEQ ID NO: 6444523 - DNA, 14 bp, Homo sapiens
tccactgtgcacac

SEQ ID NO: 6444524 - DNA, 17 bp, Homo sapiens
tccactgtgcctttgca

SEQ ID NO: 6444525 - DNA, 19 bp, Homo sapiens
tccactgtgctattacaaa

SEQ ID NO: 6444526 - DNA, 17 bp, Homo sapiens
tccactgtggcactggc

SEQ ID NO: 6444527 - DNA, 22 bp, Homo sapiens
tccactgttgagccccagtgct

SEQ ID NO: 6444528 - DNA, 23 bp, Homo sapiens
tccactgttgagccccagtgctg

SEQ ID NO: 6444529 - DNA, 15 bp, Homo sapiens
tccactgtttattca

SEQ ID NO: 6444530 - DNA, 12 bp, Homo sapiens
tccactgtttca

SEQ ID NO: 6444531 - DNA, 19 bp, Homo sapiens
tccactgtttcatgagccc

SEQ ID NO: 6444532 - DNA, 15 bp, Homo sapiens
tccacttaagttctt

SEQ ID NO: 6444533 - DNA, 16 bp, Homo sapiens
tccacttaagttcttt

SEQ ID NO: 6444534 - DNA, 21 bp, Homo sapiens
tccacttagaaattgcatttc

SEQ ID NO: 6444535 - DNA, 23 bp, Homo sapiens
tccacttagaaattgcatttcct

SEQ ID NO: 6444536 - DNA, 16 bp, Homo sapiens
tccacttatagcctct

SEQ ID NO: 6444537 - DNA, 14 bp, Homo sapiens
tccacttcaatctg

SEQ ID NO: 6444538 - DNA, 15 bp, Homo sapiens
tccacttcaggagcc

SEQ ID NO: 6444539 - DNA, 18 bp, Homo sapiens
tccacttcaggagcccta

SEQ ID NO: 6444540 - DNA, 23 bp, Homo sapiens
tccacttcagggttctaaccttt

SEQ ID NO: 6444541 - DNA, 22 bp, Homo sapiens
tccacttcattttgtataatca

SEQ ID NO: 6444542 - DNA, 17 bp, Homo sapiens
tccacttccagaggggg

SEQ ID NO: 6444543 - DNA, 21 bp, Homo sapiens
tccacttccaggtctgcctgg

SEQ ID NO: 6444544 - DNA, 16 bp, Homo sapiens
tccacttccccacact

SEQ ID NO: 6444545 - DNA, 21 bp, Homo sapiens
tccacttccccacacttccca

SEQ ID NO: 6444546 - DNA, 12 bp, Homo sapiens
tccacttcccgt

SEQ ID NO: 6444547 - DNA, 13 bp, Homo sapiens
tccacttcccgtc

SEQ ID NO: 6444548 - DNA, 18 bp, Homo sapiens
tccacttcccgtctcaga

SEQ ID NO: 6444549 - DNA, 12 bp, Homo sapiens
tccacttctccc

SEQ ID NO: 6444550 - DNA, 17 bp, Homo sapiens
tccacttctctagagaa

SEQ ID NO: 6444551 - DNA, 16 bp, Homo sapiens
tccacttctctgggtc

SEQ ID NO: 6444552 - DNA, 12 bp, Homo sapiens
tccacttctggt

SEQ ID NO: 6444553 - DNA, 15 bp, Homo sapiens
tccacttctggtata

SEQ ID NO: 6444554 - DNA, 20 bp, Homo sapiens
tccacttctggtcccctgtg

SEQ ID NO: 6444555 - DNA, 14 bp, Homo sapiens
tccacttcttcctt

SEQ ID NO: 6444556 - DNA, 20 bp, Homo sapiens
tccacttcttggttcctggg

SEQ ID NO: 6444557 - DNA, 23 bp, Homo sapiens
tccacttcttggttcctgggatg

SEQ ID NO: 6444558 - DNA, 13 bp, Homo sapiens
tccacttgccagg

SEQ ID NO: 6444559 - DNA, 16 bp, Homo sapiens
tccacttgccagggct

SEQ ID NO: 6444560 - DNA, 17 bp, Homo sapiens
tccacttgccagggctc

SEQ ID NO: 6444561 - DNA, 18 bp, Homo sapiens
tccacttgccctgtgttc

SEQ ID NO: 6444562 - DNA, 14 bp, Homo sapiens
tccacttggaaatg

SEQ ID NO: 6444563 - DNA, 16 bp, Homo sapiens
tccacttggtctgtga

SEQ ID NO: 6444564 - DNA, 11 bp, Homo sapiens
tccacttgtat

SEQ ID NO: 6444565 - DNA, 22 bp, Homo sapiens
tccacttgtatatatggatcag

SEQ ID NO: 6444566 - DNA, 16 bp, Homo sapiens
tccacttgtgggcttc

SEQ ID NO: 6444567 - DNA, 14 bp, Homo sapiens
tccacttgttcagg

SEQ ID NO: 6444568 - DNA, 20 bp, Homo sapiens
tccacttgttcattctgtga

SEQ ID NO: 6444569 - DNA, 19 bp, Homo sapiens
tccactttctagccagagg

SEQ ID NO: 6444570 - DNA, 21 bp, Homo sapiens
tccactttctagccagaggag

SEQ ID NO: 6444571 - DNA, 20 bp, Homo sapiens
tccactttggtaatgtgtca

SEQ ID NO: 6444572 - DNA, 12 bp, Homo sapiens
tccactttgtat

SEQ ID NO: 6444573 - DNA, 15 bp, Homo sapiens
tccactttgtataaa

SEQ ID NO: 6444574 - DNA, 13 bp, Homo sapiens
tccactttgttct

SEQ ID NO: 6444575 - DNA, 23 bp, Homo sapiens
tccactttgtttcgtggggaggt

SEQ ID NO: 6444576 - DNA, 14 bp, Homo sapiens
tccacttttcttct

SEQ ID NO: 6444577 - DNA, 17 bp, Homo sapiens
tccactttttccagaat

SEQ ID NO: 6444578 - DNA, 19 bp, Homo sapiens
tccagaaaaatcaatcatt

SEQ ID NO: 6444579 - DNA, 14 bp, Homo sapiens
tccagaaaaatgaa

SEQ ID NO: 6444580 - DNA, 18 bp, Homo sapiens
tccagaaaaccccagcat

SEQ ID NO: 6444581 - DNA, 21 bp, Homo sapiens
tccagaaaacctctcctgacc

SEQ ID NO: 6444582 - DNA, 23 bp, Homo sapiens
tccagaaaactgtgatttcagga

SEQ ID NO: 6444583 - DNA, 20 bp, Homo sapiens
tccagaaaatataaatgcat

SEQ ID NO: 6444584 - DNA, 16 bp, Homo sapiens
tccagaaacagctgct

SEQ ID NO: 6444585 - DNA, 19 bp, Homo sapiens
tccagaaacagctgcttct

SEQ ID NO: 6444586 - DNA, 23 bp, Homo sapiens
tccagaaacagctgcttctcccc

SEQ ID NO: 6444587 - DNA, 21 bp, Homo sapiens
tccagaaacggccattcagca

SEQ ID NO: 6444588 - DNA, 16 bp, Homo sapiens
tccagaaacttgttct

SEQ ID NO: 6444589 - DNA, 16 bp, Homo sapiens
tccagaaagcaggagc

SEQ ID NO: 6444590 - DNA, 19 bp, Homo sapiens
tccagaaagcaggagcagc

SEQ ID NO: 6444591 - DNA, 23 bp, Homo sapiens
tccagaaagccccacccaggcca

SEQ ID NO: 6444592 - DNA, 14 bp, Homo sapiens
tccagaaaggatat

SEQ ID NO: 6444593 - DNA, 18 bp, Homo sapiens
tccagaaaggatatttaa

SEQ ID NO: 6444594 - DNA, 22 bp, Homo sapiens
tccagaaaggatatttaagaaa

SEQ ID NO: 6444595 - DNA, 22 bp, Homo sapiens
tccagaaataaaacaactctga

SEQ ID NO: 6444596 - DNA, 19 bp, Homo sapiens
tccagaaatacaattttag

SEQ ID NO: 6444597 - DNA, 19 bp, Homo sapiens
tccagaaatacctgtctag

SEQ ID NO: 6444598 - DNA, 19 bp, Homo sapiens
tccagaaatgtccctttct

SEQ ID NO: 6444599 - DNA, 22 bp, Homo sapiens
tccagaaatgtccctttcttct

SEQ ID NO: 6444600 - DNA, 14 bp, Homo sapiens
tccagaaattcttc

SEQ ID NO: 6444601 - DNA, 15 bp, Homo sapiens
tccagaacagccctc

SEQ ID NO: 6444602 - DNA, 22 bp, Homo sapiens
tccagaacagccctcggcctcc

SEQ ID NO: 6444603 - DNA, 17 bp, Homo sapiens
tccagaacgccctgtgt

SEQ ID NO: 6444604 - DNA, 18 bp, Homo sapiens
tccagaactcttcctcca

SEQ ID NO: 6444605 - DNA, 19 bp, Homo sapiens
tccagaagaagagaagctg

SEQ ID NO: 6444606 - DNA, 20 bp, Homo sapiens
tccagaagaatattcaggac

SEQ ID NO: 6444607 - DNA, 21 bp, Homo sapiens
tccagaagaatattcaggact

SEQ ID NO: 6444608 - DNA, 22 bp, Homo sapiens
tccagaagaatattcaggactt

SEQ ID NO: 6444609 - DNA, 18 bp, Homo sapiens
tccagaagaccccacttc

SEQ ID NO: 6444610 - DNA, 14 bp, Homo sapiens
tccagaagagccca

SEQ ID NO: 6444611 - DNA, 15 bp, Homo sapiens
tccagaagagcccat

SEQ ID NO: 6444612 - DNA, 14 bp, Homo sapiens
tccagaagcagcag

SEQ ID NO: 6444613 - DNA, 16 bp, Homo sapiens
tccagaagcagcagct

SEQ ID NO: 6444614 - DNA, 12 bp, Homo sapiens
tccagaagctgc

SEQ ID NO: 6444615 - DNA, 13 bp, Homo sapiens
tccagaaggaagc

SEQ ID NO: 6444616 - DNA, 17 bp, Homo sapiens
tccagaaggagcaggcc

SEQ ID NO: 6444617 - DNA, 18 bp, Homo sapiens
tccagaaggagcaggccc

SEQ ID NO: 6444618 - DNA, 19 bp, Homo sapiens
tccagaaggatccaagaca

SEQ ID NO: 6444619 - DNA, 15 bp, Homo sapiens
tccagaaggatttct

SEQ ID NO: 6444620 - DNA, 18 bp, Homo sapiens
tccagaaggcaataccaa

SEQ ID NO: 6444621 - DNA, 23 bp, Homo sapiens
tccagaaggggtttggtctggga

SEQ ID NO: 6444622 - DNA, 18 bp, Homo sapiens
tccagaagtattgtttac

SEQ ID NO: 6444623 - DNA, 20 bp, Homo sapiens
tccagaagtattgtttacat

SEQ ID NO: 6444624 - DNA, 21 bp, Homo sapiens
tccagaagtattgtttacatt

SEQ ID NO: 6444625 - DNA, 23 bp, Homo sapiens
tccagaagtggggctctgggagg

SEQ ID NO: 6444626 - DNA, 14 bp, Homo sapiens
tccagaagtgtgac

SEQ ID NO: 6444627 - DNA, 19 bp, Homo sapiens
tccagaagtgtgactggct

SEQ ID NO: 6444628 - DNA, 22 bp, Homo sapiens
tccagaagtttgagatcagcct

SEQ ID NO: 6444629 - DNA, 20 bp, Homo sapiens
tccagaagttttaacttcca

SEQ ID NO: 6444630 - DNA, 21 bp, Homo sapiens
tccagaagttttaacttccag

SEQ ID NO: 6444631 - DNA, 22 bp, Homo sapiens
tccagaataaaacgcaaagggc

SEQ ID NO: 6444632 - DNA, 16 bp, Homo sapiens
tccagaataagtgctg

SEQ ID NO: 6444633 - DNA, 18 bp, Homo sapiens
tccagaataagtgctgtt

SEQ ID NO: 6444634 - DNA, 23 bp, Homo sapiens
tccagaatatctgggattctact

SEQ ID NO: 6444635 - DNA, 19 bp, Homo sapiens
tccagaatgaagaattcag

SEQ ID NO: 6444636 - DNA, 18 bp, Homo sapiens
tccagaatgaccttgagt

SEQ ID NO: 6444637 - DNA, 13 bp, Homo sapiens
tccagaatgctgt

SEQ ID NO: 6444638 - DNA, 22 bp, Homo sapiens
tccagaatgtatagacaggaaa

SEQ ID NO: 6444639 - DNA, 17 bp, Homo sapiens
tccagaatgtgctgcct

SEQ ID NO: 6444640 - DNA, 18 bp, Homo sapiens
tccagaatgtgctgcctt

SEQ ID NO: 6444641 - DNA, 19 bp, Homo sapiens
tccagaatgtgctgccttt

SEQ ID NO: 6444642 - DNA, 23 bp, Homo sapiens
tccagaattaaggtttgttttcc

SEQ ID NO: 6444643 - DNA, 18 bp, Homo sapiens
tccagaattacccttcct

SEQ ID NO: 6444644 - DNA, 20 bp, Homo sapiens
tccagaattacccttcctca

SEQ ID NO: 6444645 - DNA, 13 bp, Homo sapiens
tccagaattgaga

SEQ ID NO: 6444646 - DNA, 21 bp, Homo sapiens
tccagaattttccttcttcag

SEQ ID NO: 6444647 - DNA, 19 bp, Homo sapiens
tccagacaaaccagaagca

SEQ ID NO: 6444648 - DNA, 12 bp, Homo sapiens
tccagacaaatt

SEQ ID NO: 6444649 - DNA, 21 bp, Homo sapiens
tccagacaagccctgcttgct

SEQ ID NO: 6444650 - DNA, 14 bp, Homo sapiens
tccagacaccatca

SEQ ID NO: 6444651 - DNA, 10 bp, Homo sapiens
tccagacaga

SEQ ID NO: 6444652 - DNA, 22 bp, Homo sapiens
tccagacagagtggatctggag

SEQ ID NO: 6444653 - DNA, 23 bp, Homo sapiens
tccagacagagtggatctggagt

SEQ ID NO: 6444654 - DNA, 16 bp, Homo sapiens
tccagacagcctgtat

SEQ ID NO: 6444655 - DNA, 18 bp, Homo sapiens
tccagacagcctgtatct

SEQ ID NO: 6444656 - DNA, 14 bp, Homo sapiens
tccagacaggagga

SEQ ID NO: 6444657 - DNA, 12 bp, Homo sapiens
tccagacagtcg

SEQ ID NO: 6444658 - DNA, 21 bp, Homo sapiens
tccagacagtcgctcagtctg

SEQ ID NO: 6444659 - DNA, 20 bp, Homo sapiens
tccagaccaaaataatacaa

SEQ ID NO: 6444660 - DNA, 16 bp, Homo sapiens
tccagaccaaagcaat

SEQ ID NO: 6444661 - DNA, 13 bp, Homo sapiens
tccagaccacctg

SEQ ID NO: 6444662 - DNA, 22 bp, Homo sapiens
tccagaccacctgccagccatc

SEQ ID NO: 6444663 - DNA, 19 bp, Homo sapiens
tccagaccattgtcttcca

SEQ ID NO: 6444664 - DNA, 20 bp, Homo sapiens
tccagaccattgtcttccaa

SEQ ID NO: 6444665 - DNA, 12 bp, Homo sapiens
tccagacccaga

SEQ ID NO: 6444666 - DNA, 14 bp, Homo sapiens
tccagacccagagg

SEQ ID NO: 6444667 - DNA, 18 bp, Homo sapiens
tccagacccagaggccct

SEQ ID NO: 6444668 - DNA, 21 bp, Homo sapiens
tccagacccagaggccctgaa

SEQ ID NO: 6444669 - DNA, 22 bp, Homo sapiens
tccagacccagaggccctgaag

SEQ ID NO: 6444670 - DNA, 13 bp, Homo sapiens
tccagacccccac

SEQ ID NO: 6444671 - DNA, 16 bp, Homo sapiens
tccagacccccacccc

SEQ ID NO: 6444672 - DNA, 21 bp, Homo sapiens
tccagacccccaccccttccc

SEQ ID NO: 6444673 - DNA, 15 bp, Homo sapiens
tccagacccccagca

SEQ ID NO: 6444674 - DNA, 16 bp, Homo sapiens
tccagacccccagcaa

SEQ ID NO: 6444675 - DNA, 21 bp, Homo sapiens
tccagacccccagcaaccctc

SEQ ID NO: 6444676 - DNA, 13 bp, Homo sapiens
tccagacccccca

SEQ ID NO: 6444677 - DNA, 14 bp, Homo sapiens
tccagaccccccag

SEQ ID NO: 6444678 - DNA, 15 bp, Homo sapiens
tccagaccccccagc

SEQ ID NO: 6444679 - DNA, 20 bp, Homo sapiens
tccagaccccccagcccctc

SEQ ID NO: 6444680 - DNA, 16 bp, Homo sapiens
tccagacccctggctt

SEQ ID NO: 6444681 - DNA, 23 bp, Homo sapiens
tccagacccctggcttttcactg

SEQ ID NO: 6444682 - DNA, 21 bp, Homo sapiens
tccagacccctgtggcagacc

SEQ ID NO: 6444683 - DNA, 16 bp, Homo sapiens
tccagaccctgcctga

SEQ ID NO: 6444684 - DNA, 22 bp, Homo sapiens
tccagaccctgcctgagcccag

SEQ ID NO: 6444685 - DNA, 11 bp, Homo sapiens
tccagacctga

SEQ ID NO: 6444686 - DNA, 13 bp, Homo sapiens
tccagacctgagc

SEQ ID NO: 6444687 - DNA, 15 bp, Homo sapiens
tccagacctgaggcg

SEQ ID NO: 6444688 - DNA, 15 bp, Homo sapiens
tccagacctgggccc

SEQ ID NO: 6444689 - DNA, 14 bp, Homo sapiens
tccagactcagcag

SEQ ID NO: 6444690 - DNA, 16 bp, Homo sapiens
tccagactcgagaggg

SEQ ID NO: 6444691 - DNA, 14 bp, Homo sapiens
tccagactctgggg

SEQ ID NO: 6444692 - DNA, 23 bp, Homo sapiens
tccagactgcttccaattttctg

SEQ ID NO: 6444693 - DNA, 20 bp, Homo sapiens
tccagacttccttgagacac

SEQ ID NO: 6444694 - DNA, 21 bp, Homo sapiens
tccagacttcgctattcccag

SEQ ID NO: 6444695 - DNA, 17 bp, Homo sapiens
tccagactttctattaa

SEQ ID NO: 6444696 - DNA, 13 bp, Homo sapiens
tccagactttctt

SEQ ID NO: 6444697 - DNA, 19 bp, Homo sapiens
tccagactttctttttcta

SEQ ID NO: 6444698 - DNA, 17 bp, Homo sapiens
tctttaaggaagaataa

SEQ ID NO: 6444699 - DNA, 19 bp, Homo sapiens
tctttaagggcatgccttg

SEQ ID NO: 6444700 - DNA, 19 bp, Homo sapiens
tctttaaggtattgtgcat

SEQ ID NO: 6444701 - DNA, 14 bp, Homo sapiens
tctttaataaaaca

SEQ ID NO: 6444702 - DNA, 15 bp, Homo sapiens
tctttaataaataac

SEQ ID NO: 6444703 - DNA, 16 bp, Homo sapiens
tctttaataaattgct

SEQ ID NO: 6444704 - DNA, 13 bp, Homo sapiens
tctttaataacaa

SEQ ID NO: 6444705 - DNA, 21 bp, Homo sapiens
tctttaatcaatgtgacatgt

SEQ ID NO: 6444706 - DNA, 15 bp, Homo sapiens
tctttaatctgttgt

SEQ ID NO: 6444707 - DNA, 14 bp, Homo sapiens
tctttaatcttcag

SEQ ID NO: 6444708 - DNA, 11 bp, Homo sapiens
tctttaatgct

SEQ ID NO: 6444709 - DNA, 19 bp, Homo sapiens
tctttaatgctgtctttgt

SEQ ID NO: 6444710 - DNA, 22 bp, Homo sapiens
tctttaatggttaataggatga

SEQ ID NO: 6444711 - DNA, 15 bp, Homo sapiens
tctttaatgtcacag

SEQ ID NO: 6444712 - DNA, 18 bp, Homo sapiens
tctttaatgtcacaggca

SEQ ID NO: 6444713 - DNA, 20 bp, Homo sapiens
tctttaattaaaacctggga

SEQ ID NO: 6444714 - DNA, 13 bp, Homo sapiens
tctttaattcctt

SEQ ID NO: 6444715 - DNA, 15 bp, Homo sapiens
tctttaattgtatct

SEQ ID NO: 6444716 - DNA, 15 bp, Homo sapiens
tctttaattgttgct

SEQ ID NO: 6444717 - DNA, 20 bp, Homo sapiens
tctttaattgttgcttttac

SEQ ID NO: 6444718 - DNA, 17 bp, Homo sapiens
tctttaattttggaatt

SEQ ID NO: 6444719 - DNA, 16 bp, Homo sapiens
tctttaatttttctgt

SEQ ID NO: 6444720 - DNA, 13 bp, Homo sapiens
tctttacaataaa

SEQ ID NO: 6444721 - DNA, 21 bp, Homo sapiens
tctttacatctatgtgtatgt

SEQ ID NO: 6444722 - DNA, 21 bp, Homo sapiens
tctttacatttcttttaaaat

SEQ ID NO: 6444723 - DNA, 19 bp, Homo sapiens
tctttaccaaaaaccatgt

SEQ ID NO: 6444724 - DNA, 16 bp, Homo sapiens
tctttacccaaggatt

SEQ ID NO: 6444725 - DNA, 16 bp, Homo sapiens
tctttacccttgagcc

SEQ ID NO: 6444726 - DNA, 13 bp, Homo sapiens
tctttacctgaga

SEQ ID NO: 6444727 - DNA, 19 bp, Homo sapiens
tctttacctgtatacagtg

SEQ ID NO: 6444728 - DNA, 20 bp, Homo sapiens
tctttaccttcatttcatcc

SEQ ID NO: 6444729 - DNA, 20 bp, Homo sapiens
tctttaccttctaaaagcca

SEQ ID NO: 6444730 - DNA, 14 bp, Homo sapiens
tctttactaacact

SEQ ID NO: 6444731 - DNA, 18 bp, Homo sapiens
tctttactattaaaatat

SEQ ID NO: 6444732 - DNA, 19 bp, Homo sapiens
tctttactattaaaatatt

SEQ ID NO: 6444733 - DNA, 22 bp, Homo sapiens
tctttactcgtcccctttcatc

SEQ ID NO: 6444734 - DNA, 17 bp, Homo sapiens
tctttactggacctgaa

SEQ ID NO: 6444735 - DNA, 19 bp, Homo sapiens
tctttactgggtctaaagg

SEQ ID NO: 6444736 - DNA, 15 bp, Homo sapiens
tctttacttcatgga

SEQ ID NO: 6444737 - DNA, 22 bp, Homo sapiens
tctttactttctcccagtatgt

SEQ ID NO: 6444738 - DNA, 22 bp, Homo sapiens
tctttagacaaccctgaggtat

SEQ ID NO: 6444739 - DNA, 19 bp, Homo sapiens
tctttagagaactgaaaag

SEQ ID NO: 6444740 - DNA, 18 bp, Homo sapiens
tctttagagcaacagtaa

SEQ ID NO: 6444741 - DNA, 14 bp, Homo sapiens
tctttagaggcttt

SEQ ID NO: 6444742 - DNA, 23 bp, Homo sapiens
tctttagaggctttcaaatgtac

SEQ ID NO: 6444743 - DNA, 15 bp, Homo sapiens
tctttagatgccaaa

SEQ ID NO: 6444744 - DNA, 19 bp, Homo sapiens
tctttagatttttaaattg

SEQ ID NO: 6444745 - DNA, 19 bp, Homo sapiens
tctttagcagtttcctcag

SEQ ID NO: 6444746 - DNA, 12 bp, Homo sapiens
tctttagcccca

SEQ ID NO: 6444747 - DNA, 16 bp, Homo sapiens
tctttagcttacctgg

SEQ ID NO: 6444748 - DNA, 20 bp, Homo sapiens
tctttagcttacctgggcac

SEQ ID NO: 6444749 - DNA, 18 bp, Homo sapiens
tctttaggacataaagag

SEQ ID NO: 6444750 - DNA, 22 bp, Homo sapiens
tctttaggagaaattatagtta

SEQ ID NO: 6444751 - DNA, 16 bp, Homo sapiens
tctttaggagatttat

SEQ ID NO: 6444752 - DNA, 16 bp, Homo sapiens
tctttaggccaggctt

SEQ ID NO: 6444753 - DNA, 17 bp, Homo sapiens
tctttaggtctttgtaa

SEQ ID NO: 6444754 - DNA, 20 bp, Homo sapiens
tctttaggtgcctcctgtct

SEQ ID NO: 6444755 - DNA, 20 bp, Homo sapiens
tctttagtatagccacaaat

SEQ ID NO: 6444756 - DNA, 12 bp, Homo sapiens
tctttagtcatt

SEQ ID NO: 6444757 - DNA, 17 bp, Homo sapiens
tctttagtgttcaaata

SEQ ID NO: 6444758 - DNA, 20 bp, Homo sapiens
tctttagttgaattccaagt

SEQ ID NO: 6444759 - DNA, 23 bp, Homo sapiens
tctttagttttattttaagaggg

SEQ ID NO: 6444760 - DNA, 17 bp, Homo sapiens
tctttataaaaagtgaa

SEQ ID NO: 6444761 - DNA, 14 bp, Homo sapiens
tctttataaaatgt

SEQ ID NO: 6444762 - DNA, 15 bp, Homo sapiens
tctttataaaatgta

SEQ ID NO: 6444763 - DNA, 23 bp, Homo sapiens
tctttataaagctgttcttgaaa

SEQ ID NO: 6444764 - DNA, 15 bp, Homo sapiens
tctttataagaaagc

SEQ ID NO: 6444765 - DNA, 20 bp, Homo sapiens
tctttataattctactttga

SEQ ID NO: 6444766 - DNA, 14 bp, Homo sapiens
tctttatacaacag

SEQ ID NO: 6444767 - DNA, 17 bp, Homo sapiens
tctttatacaacagtgc

SEQ ID NO: 6444768 - DNA, 14 bp, Homo sapiens
tctttatacagatt

SEQ ID NO: 6444769 - DNA, 16 bp, Homo sapiens
tctttatacagatttt

SEQ ID NO: 6444770 - DNA, 16 bp, Homo sapiens
tctttatacagctgta

SEQ ID NO: 6444771 - DNA, 17 bp, Homo sapiens
tctttatactctcttcc

SEQ ID NO: 6444772 - DNA, 16 bp, Homo sapiens
tctttatacttaaaca

SEQ ID NO: 6444773 - DNA, 20 bp, Homo sapiens
tctttatagaaggaatttgt

SEQ ID NO: 6444774 - DNA, 15 bp, Homo sapiens
tctttatagatgtac

SEQ ID NO: 6444775 - DNA, 17 bp, Homo sapiens
tctttatagtgcacaaa

SEQ ID NO: 6444776 - DNA, 15 bp, Homo sapiens
tctttatagttgtag

SEQ ID NO: 6444777 - DNA, 22 bp, Homo sapiens
tctttatatacaataatggaaa

SEQ ID NO: 6444778 - DNA, 21 bp, Homo sapiens
tctttatatatggacagcttt

SEQ ID NO: 6444779 - DNA, 11 bp, Homo sapiens
tctttatatga

SEQ ID NO: 6444780 - DNA, 12 bp, Homo sapiens
tctttatatgaa

SEQ ID NO: 6444781 - DNA, 18 bp, Homo sapiens
tctttatattgtcattgt

SEQ ID NO: 6444782 - DNA, 17 bp, Homo sapiens
tctttatcccattttat

SEQ ID NO: 6444783 - DNA, 13 bp, Homo sapiens
tctttatctacta

SEQ ID NO: 6444784 - DNA, 19 bp, Homo sapiens
tctttatgagctaaaaata

SEQ ID NO: 6444785 - DNA, 13 bp, Homo sapiens
tctttatgatttc

SEQ ID NO: 6444786 - DNA, 16 bp, Homo sapiens
tctttatgatttcatg

SEQ ID NO: 6444787 - DNA, 16 bp, Homo sapiens
tctttatgatttttaa

SEQ ID NO: 6444788 - DNA, 20 bp, Homo sapiens
tctttatgctgtattttaac

SEQ ID NO: 6444789 - DNA, 17 bp, Homo sapiens
tctttatggttctactt

SEQ ID NO: 6444790 - DNA, 21 bp, Homo sapiens
tctttatgtatttgttaaaga

SEQ ID NO: 6444791 - DNA, 16 bp, Homo sapiens
tctttattaaaacagt

SEQ ID NO: 6444792 - DNA, 16 bp, Homo sapiens
tctttattaacctcag

SEQ ID NO: 6444793 - DNA, 13 bp, Homo sapiens
tctttattagctt

SEQ ID NO: 6444794 - DNA, 20 bp, Homo sapiens
tctttattatggaaaacatt

SEQ ID NO: 6444795 - DNA, 19 bp, Homo sapiens
tctttattatttttctctc

SEQ ID NO: 6444796 - DNA, 13 bp, Homo sapiens
tctttattcctcc

SEQ ID NO: 6444797 - DNA, 12 bp, Homo sapiens
tctttattgaaa

SEQ ID NO: 6444798 - DNA, 14 bp, Homo sapiens
tctttattgaaatt

SEQ ID NO: 6444799 - DNA, 15 bp, Homo sapiens
tctttattgaaattc

SEQ ID NO: 6444800 - DNA, 21 bp, Homo sapiens
tctttattgaacttgaaatct

SEQ ID NO: 6444801 - DNA, 13 bp, Homo sapiens
tctttattgagaa

SEQ ID NO: 6444802 - DNA, 19 bp, Homo sapiens
tctttattgagaaagagca

SEQ ID NO: 6444803 - DNA, 20 bp, Homo sapiens
tctttattgcactaggaatt

SEQ ID NO: 6444804 - DNA, 19 bp, Homo sapiens
tctttattgcttactgtgt

SEQ ID NO: 6444805 - DNA, 21 bp, Homo sapiens
tctttattggtgaccttttgt

SEQ ID NO: 6444806 - DNA, 15 bp, Homo sapiens
tctttatttctagca

SEQ ID NO: 6444807 - DNA, 14 bp, Homo sapiens
tctttatttctgtc

SEQ ID NO: 6444808 - DNA, 15 bp, Homo sapiens
tctttattttactag

SEQ ID NO: 6444809 - DNA, 19 bp, Homo sapiens
tctttattttcttctccag

SEQ ID NO: 6444810 - DNA, 19 bp, Homo sapiens
tctttatttttctctttct

SEQ ID NO: 6444811 - DNA, 22 bp, Homo sapiens
tctttatttttgttaatattaa

SEQ ID NO: 6444812 - DNA, 20 bp, Homo sapiens
tctttatttttttcccatga

SEQ ID NO: 6444813 - DNA, 23 bp, Homo sapiens
tctttcaaaaccttttgaaatta

SEQ ID NO: 6444814 - DNA, 13 bp, Homo sapiens
tctttcaaagaaa

SEQ ID NO: 6444815 - DNA, 20 bp, Homo sapiens
tctttcaaaggtagccatca

SEQ ID NO: 6444816 - DNA, 23 bp, Homo sapiens
tctttcaaattatatgctaatta

SEQ ID NO: 6444817 - DNA, 18 bp, Homo sapiens
tctttcaaattgagagaa

SEQ ID NO: 6444818 - DNA, 19 bp, Homo sapiens
tctttcaaattgagagaat

SEQ ID NO: 6444819 - DNA, 21 bp, Homo sapiens
tctttcaaatttactgtctta

SEQ ID NO: 6444820 - DNA, 20 bp, Homo sapiens
tctttcaacagtttcaaaat

SEQ ID NO: 6444821 - DNA, 23 bp, Homo sapiens
tctttcaacttgcaatttgcaag

SEQ ID NO: 6444822 - DNA, 15 bp, Homo sapiens
tctttcaacttgcat

SEQ ID NO: 6444823 - DNA, 20 bp, Homo sapiens
tctttcaataaactaaagaa

SEQ ID NO: 6444824 - DNA, 21 bp, Homo sapiens
tctttcaataaactaaagaaa

SEQ ID NO: 6444825 - DNA, 20 bp, Homo sapiens
tctttcaatccacagtattg

SEQ ID NO: 6444826 - DNA, 14 bp, Homo sapiens
tctttcaattctgt

SEQ ID NO: 6444827 - DNA, 15 bp, Homo sapiens
tctttcaattcttca

SEQ ID NO: 6444828 - DNA, 15 bp, Homo sapiens
tctttcacaaaaaag

SEQ ID NO: 6444829 - DNA, 19 bp, Homo sapiens
tctttcacaaggtataata

SEQ ID NO: 6444830 - DNA, 20 bp, Homo sapiens
tctttcacaaggtataataa

SEQ ID NO: 6444831 - DNA, 21 bp, Homo sapiens
tctttcacacttccaccagcc

SEQ ID NO: 6444832 - DNA, 23 bp, Homo sapiens
tctttcacacttccaccagcctg

SEQ ID NO: 6444833 - DNA, 18 bp, Homo sapiens
tctttcacagctcctccc

SEQ ID NO: 6444834 - DNA, 10 bp, Homo sapiens
tctttcacat

SEQ ID NO: 6444835 - DNA, 23 bp, Homo sapiens
tctttcacccacagaaagagagc

SEQ ID NO: 6444836 - DNA, 14 bp, Homo sapiens
tctttcaccctgcc

SEQ ID NO: 6444837 - DNA, 12 bp, Homo sapiens
tctttcaccttt

SEQ ID NO: 6444838 - DNA, 14 bp, Homo sapiens
tctttcacctttct

SEQ ID NO: 6444839 - DNA, 18 bp, Homo sapiens
tctttcactcacatcttt

SEQ ID NO: 6444840 - DNA, 17 bp, Homo sapiens
tctttcactggaatgaa

SEQ ID NO: 6444841 - DNA, 16 bp, Homo sapiens
tctttcagaaaacaga

SEQ ID NO: 6444842 - DNA, 23 bp, Homo sapiens
tctttcagaaatataacacattt

SEQ ID NO: 6444843 - DNA, 21 bp, Homo sapiens
tctttcagaaggaaaccgaaa

SEQ ID NO: 6444844 - DNA, 23 bp, Homo sapiens
tctttcagacttgccatgtgact

SEQ ID NO: 6444845 - DNA, 14 bp, Homo sapiens
tctttcagatgttt

SEQ ID NO: 6444846 - DNA, 19 bp, Homo sapiens
tctttcagccaagaattct

SEQ ID NO: 6444847 - DNA, 21 bp, Homo sapiens
tctttcagccaagaattctta

SEQ ID NO: 6444848 - DNA, 18 bp, Homo sapiens
tctttcagcctgcttctt

SEQ ID NO: 6444849 - DNA, 13 bp, Homo sapiens
tctttcagctcct

SEQ ID NO: 6444850 - DNA, 15 bp, Homo sapiens
tctttcagctcctga

SEQ ID NO: 6444851 - DNA, 11 bp, Homo sapiens
tctttcaggaa

SEQ ID NO: 6444852 - DNA, 22 bp, Homo sapiens
tctttcaggaatacttggacct

SEQ ID NO: 6444853 - DNA, 23 bp, Homo sapiens
tctttcagtacttttttaaatat

SEQ ID NO: 6444854 - DNA, 23 bp, Homo sapiens
tctttcagtattaaactctcctt

SEQ ID NO: 6444855 - DNA, 17 bp, Homo sapiens
tctttcatacattatat

SEQ ID NO: 6444856 - DNA, 16 bp, Homo sapiens
tctttcatagttctgt

SEQ ID NO: 6444857 - DNA, 19 bp, Homo sapiens
tctttcatagttctgttaa

SEQ ID NO: 6444858 - DNA, 22 bp, Homo sapiens
tctttcatagttctgttaaata

SEQ ID NO: 6444859 - DNA, 13 bp, Homo sapiens
tctttcatccact

SEQ ID NO: 6444860 - DNA, 21 bp, Homo sapiens
tctttcatccactagtgcaaa

SEQ ID NO: 6444861 - DNA, 14 bp, Homo sapiens
tctttcatctcctg

SEQ ID NO: 6444862 - DNA, 12 bp, Homo sapiens
tctttcatcttt

SEQ ID NO: 6444863 - DNA, 21 bp, Homo sapiens
tctttcatgtaagtagcaaac

SEQ ID NO: 6444864 - DNA, 14 bp, Homo sapiens
tctttcatgtcttg

SEQ ID NO: 6444865 - DNA, 18 bp, Homo sapiens
tctttcattctctcttcc

SEQ ID NO: 6444866 - DNA, 23 bp, Homo sapiens
tctttcattctctcttcctgcag

SEQ ID NO: 6444867 - DNA, 16 bp, Homo sapiens
tctttcattgctaaga

SEQ ID NO: 6444868 - DNA, 15 bp, Homo sapiens
tctttccaaaacatt

SEQ ID NO: 6444869 - DNA, 21 bp, Homo sapiens
tctttccaaagcgctgaggct

SEQ ID NO: 6444870 - DNA, 22 bp, Homo sapiens
tctttccaaagcgctgaggctg

SEQ ID NO: 6444871 - DNA, 11 bp, Homo sapiens
tctttccaaat

SEQ ID NO: 6444872 - DNA, 12 bp, Homo sapiens
tctttccaaatt

SEQ ID NO: 6444873 - DNA, 15 bp, Homo sapiens
tctttccaaattaaa

SEQ ID NO: 6444874 - DNA, 22 bp, Homo sapiens
tctttccaaattaaaacaaata

SEQ ID NO: 6444875 - DNA, 22 bp, Homo sapiens
tctttccaccataccttagaga

SEQ ID NO: 6444876 - DNA, 17 bp, Homo sapiens
tccagagaaacccaggg

SEQ ID NO: 6444877 - DNA, 18 bp, Homo sapiens
tccagagaaacccaggga

SEQ ID NO: 6444878 - DNA, 17 bp, Homo sapiens
tccagagaactgcagac

SEQ ID NO: 6444879 - DNA, 22 bp, Homo sapiens
tccagagaagcctatttttata

SEQ ID NO: 6444880 - DNA, 14 bp, Homo sapiens
tccagagacaacag

SEQ ID NO: 6444881 - DNA, 15 bp, Homo sapiens
tccagagacactgag

SEQ ID NO: 6444882 - DNA, 16 bp, Homo sapiens
tccagagacactgagc

SEQ ID NO: 6444883 - DNA, 12 bp, Homo sapiens
tccagagacagg

SEQ ID NO: 6444884 - DNA, 20 bp, Homo sapiens
tccagagacatgtggcagca

SEQ ID NO: 6444885 - DNA, 15 bp, Homo sapiens
tccagagacccctca

SEQ ID NO: 6444886 - DNA, 16 bp, Homo sapiens
tccagagacccctcaa

SEQ ID NO: 6444887 - DNA, 15 bp, Homo sapiens
tccagagacctgctc

SEQ ID NO: 6444888 - DNA, 18 bp, Homo sapiens
tccagagacctgctccag

SEQ ID NO: 6444889 - DNA, 20 bp, Homo sapiens
tccagagactcgagtcccca

SEQ ID NO: 6444890 - DNA, 22 bp, Homo sapiens
tccagagagaaatcaggcctga

SEQ ID NO: 6444891 - DNA, 13 bp, Homo sapiens
tccagagagaagc

SEQ ID NO: 6444892 - DNA, 19 bp, Homo sapiens
tccagagagagaagtgccc

SEQ ID NO: 6444893 - DNA, 23 bp, Homo sapiens
tccagagagagaagtgcccctgc

SEQ ID NO: 6444894 - DNA, 18 bp, Homo sapiens
tccagagagcaaacatag

SEQ ID NO: 6444895 - DNA, 13 bp, Homo sapiens
tccagagaggctg

SEQ ID NO: 6444896 - DNA, 19 bp, Homo sapiens
tccagagagtcctctggat

SEQ ID NO: 6444897 - DNA, 19 bp, Homo sapiens
tccagagagtggctcctcc

SEQ ID NO: 6444898 - DNA, 23 bp, Homo sapiens
tccagagataaaaatcatataga

SEQ ID NO: 6444899 - DNA, 16 bp, Homo sapiens
tccagagattcatttt

SEQ ID NO: 6444900 - DNA, 19 bp, Homo sapiens
tccagagattcattttcta

SEQ ID NO: 6444901 - DNA, 20 bp, Homo sapiens
tccagagattcattttctag

SEQ ID NO: 6444902 - DNA, 21 bp, Homo sapiens
tccagagattcattttctaga

SEQ ID NO: 6444903 - DNA, 23 bp, Homo sapiens
tccagagattcattttctagata

SEQ ID NO: 6444904 - DNA, 20 bp, Homo sapiens
tccagagcaaccagaaggag

SEQ ID NO: 6444905 - DNA, 15 bp, Homo sapiens
tccagagcagagttt

SEQ ID NO: 6444906 - DNA, 13 bp, Homo sapiens
tccagagccagcc

SEQ ID NO: 6444907 - DNA, 16 bp, Homo sapiens
tccagagccagcctgg

SEQ ID NO: 6444908 - DNA, 17 bp, Homo sapiens
tccagagccagcctggg

SEQ ID NO: 6444909 - DNA, 20 bp, Homo sapiens
tccagagccagcctgggact

SEQ ID NO: 6444910 - DNA, 23 bp, Homo sapiens
tccagagccggcatccttgcctg

SEQ ID NO: 6444911 - DNA, 18 bp, Homo sapiens
tccagagcctaagaaaat

SEQ ID NO: 6444912 - DNA, 15 bp, Homo sapiens
tccagagctgcttcc

SEQ ID NO: 6444913 - DNA, 19 bp, Homo sapiens
tccagagctgcttctgtct

SEQ ID NO: 6444914 - DNA, 16 bp, Homo sapiens
tccagagctggccagg

SEQ ID NO: 6444915 - DNA, 13 bp, Homo sapiens
tccagagcttttc

SEQ ID NO: 6444916 - DNA, 17 bp, Homo sapiens
tccagaggaacaagcat

SEQ ID NO: 6444917 - DNA, 16 bp, Homo sapiens
tccagaggaataaaaa

SEQ ID NO: 6444918 - DNA, 18 bp, Homo sapiens
tccagaggacagctctgg

SEQ ID NO: 6444919 - DNA, 21 bp, Homo sapiens
tccagaggacagctctggggt

SEQ ID NO: 6444920 - DNA, 15 bp, Homo sapiens
tccagaggagagtgg

SEQ ID NO: 6444921 - DNA, 19 bp, Homo sapiens
tccagaggagagtggcctg

SEQ ID NO: 6444922 - DNA, 22 bp, Homo sapiens
tccagaggagagtggcctgggt

SEQ ID NO: 6444923 - DNA, 21 bp, Homo sapiens
tccagaggaggggtggtgtcc

SEQ ID NO: 6444924 - DNA, 16 bp, Homo sapiens
tccagagggacagggt

SEQ ID NO: 6444925 - DNA, 20 bp, Homo sapiens
tccagagggacagtcagttt

SEQ ID NO: 6444926 - DNA, 15 bp, Homo sapiens
tccagagggactgga

SEQ ID NO: 6444927 - DNA, 19 bp, Homo sapiens
tccagagggactggacagc

SEQ ID NO: 6444928 - DNA, 20 bp, Homo sapiens
tccagagggactggacagcc

SEQ ID NO: 6444929 - DNA, 22 bp, Homo sapiens
tccagagggactggacagccag

SEQ ID NO: 6444930 - DNA, 21 bp, Homo sapiens
tccagagggggccagagggac

SEQ ID NO: 6444931 - DNA, 20 bp, Homo sapiens
tccagagggttgtgattttg

SEQ ID NO: 6444932 - DNA, 21 bp, Homo sapiens
tccagaggtgagggaggcctg

SEQ ID NO: 6444933 - DNA, 18 bp, Homo sapiens
tccagagtccctgcctgg

SEQ ID NO: 6444934 - DNA, 20 bp, Homo sapiens
tccagagtccctgcctggac

SEQ ID NO: 6444935 - DNA, 21 bp, Homo sapiens
tccagagtccctgcctggacc

SEQ ID NO: 6444936 - DNA, 16 bp, Homo sapiens
tccagagtcctggccc

SEQ ID NO: 6444937 - DNA, 16 bp, Homo sapiens
tccagagtctgagccc

SEQ ID NO: 6444938 - DNA, 22 bp, Homo sapiens
tccagagtctgagcccccggct

SEQ ID NO: 6444939 - DNA, 13 bp, Homo sapiens
tccagagtgctga

SEQ ID NO: 6444940 - DNA, 17 bp, Homo sapiens
tccagataaaaacaata

SEQ ID NO: 6444941 - DNA, 23 bp, Homo sapiens
tccagataactctctttccttga

SEQ ID NO: 6444942 - DNA, 14 bp, Homo sapiens
tccagatagagaaa

SEQ ID NO: 6444943 - DNA, 15 bp, Homo sapiens
tccagatcactgcca

SEQ ID NO: 6444944 - DNA, 16 bp, Homo sapiens
tccagatccagactgt

SEQ ID NO: 6444945 - DNA, 16 bp, Homo sapiens
tccagatcctggaaat

SEQ ID NO: 6444946 - DNA, 18 bp, Homo sapiens
tccagatctgcagtcact

SEQ ID NO: 6444947 - DNA, 17 bp, Homo sapiens
tccagatgcagggcagt

SEQ ID NO: 6444948 - DNA, 15 bp, Homo sapiens
tccagatgccacaat

SEQ ID NO: 6444949 - DNA, 14 bp, Homo sapiens
tccagatgccttcc

SEQ ID NO: 6444950 - DNA, 19 bp, Homo sapiens
tccagatgccttcctgtct

SEQ ID NO: 6444951 - DNA, 20 bp, Homo sapiens
tccagatgccttcctgtctt

SEQ ID NO: 6444952 - DNA, 18 bp, Homo sapiens
tccagatggcaggctaca

SEQ ID NO: 6444953 - DNA, 14 bp, Homo sapiens
tccagatggccccc

SEQ ID NO: 6444954 - DNA, 18 bp, Homo sapiens
tccagatggtcatccaga

SEQ ID NO: 6444955 - DNA, 14 bp, Homo sapiens
tccagatggtggga

SEQ ID NO: 6444956 - DNA, 13 bp, Homo sapiens
tccagatgtctaa

SEQ ID NO: 6444957 - DNA, 22 bp, Homo sapiens
tccagattattggctgctttgc

SEQ ID NO: 6444958 - DNA, 18 bp, Homo sapiens
tccagattattttctata

SEQ ID NO: 6444959 - DNA, 16 bp, Homo sapiens
tccagattcccaggcc

SEQ ID NO: 6444960 - DNA, 18 bp, Homo sapiens
tccagattcccaggccag

SEQ ID NO: 6444961 - DNA, 19 bp, Homo sapiens
tccagattcccaggccagg

SEQ ID NO: 6444962 - DNA, 13 bp, Homo sapiens
tccagattcttcc

SEQ ID NO: 6444963 - DNA, 18 bp, Homo sapiens
tccagattcttccactgg

SEQ ID NO: 6444964 - DNA, 15 bp, Homo sapiens
tccagattgggggcc

SEQ ID NO: 6444965 - DNA, 12 bp, Homo sapiens
tccagattggtg

SEQ ID NO: 6444966 - DNA, 19 bp, Homo sapiens
tccagatttacactgggag

SEQ ID NO: 6444967 - DNA, 14 bp, Homo sapiens
tccagcaaaatcca

SEQ ID NO: 6444968 - DNA, 17 bp, Homo sapiens
tccagcaaaatccaaac

SEQ ID NO: 6444969 - DNA, 21 bp, Homo sapiens
tccagcaaaatccaaactgct

SEQ ID NO: 6444970 - DNA, 14 bp, Homo sapiens
tccagcaaaatgga

SEQ ID NO: 6444971 - DNA, 18 bp, Homo sapiens
tccagcaaaatggaagca

SEQ ID NO: 6444972 - DNA, 18 bp, Homo sapiens
tccagcaaatcaagctga

SEQ ID NO: 6444973 - DNA, 15 bp, Homo sapiens
tccagcaactgccct

SEQ ID NO: 6444974 - DNA, 18 bp, Homo sapiens
tccagcaactgcccttcc

SEQ ID NO: 6444975 - DNA, 19 bp, Homo sapiens
tccagcaactgcccttcca

SEQ ID NO: 6444976 - DNA, 20 bp, Homo sapiens
tccagcaactgcccttccag

SEQ ID NO: 6444977 - DNA, 23 bp, Homo sapiens
tccagcaagcaaacagggtggcc

SEQ ID NO: 6444978 - DNA, 16 bp, Homo sapiens
tccagcaataagaaat

SEQ ID NO: 6444979 - DNA, 18 bp, Homo sapiens
tccagcaataagaaatga

SEQ ID NO: 6444980 - DNA, 22 bp, Homo sapiens
tccagcaataagaaatgaacaa

SEQ ID NO: 6444981 - DNA, 23 bp, Homo sapiens
tccagcaataagaaatgaacaaa

SEQ ID NO: 6444982 - DNA, 19 bp, Homo sapiens
tccagcaattctcctgcct

SEQ ID NO: 6444983 - DNA, 20 bp, Homo sapiens
tccagcaattctcctgcctc

SEQ ID NO: 6444984 - DNA, 15 bp, Homo sapiens
tccagcaattgtgtg

SEQ ID NO: 6444985 - DNA, 15 bp, Homo sapiens
tccagcacaactcag

SEQ ID NO: 6444986 - DNA, 23 bp, Homo sapiens
tccagcacagaaggaatctgtgc

SEQ ID NO: 6444987 - DNA, 13 bp, Homo sapiens
tccagcacagact

SEQ ID NO: 6444988 - DNA, 21 bp, Homo sapiens
tccagcacatccccctctcct

SEQ ID NO: 6444989 - DNA, 19 bp, Homo sapiens
tccagcaccttctttctgg

SEQ ID NO: 6444990 - DNA, 23 bp, Homo sapiens
tccagcaccttctttctggactg

SEQ ID NO: 6444991 - DNA, 14 bp, Homo sapiens
tccagcaccttgtg

SEQ ID NO: 6444992 - DNA, 15 bp, Homo sapiens
tccagcaccttgtgc

SEQ ID NO: 6444993 - DNA, 17 bp, Homo sapiens
tccagcagaagacaaaa

SEQ ID NO: 6444994 - DNA, 18 bp, Homo sapiens
tccagcagactcctgctc

SEQ ID NO: 6444995 - DNA, 15 bp, Homo sapiens
tccagcagataaggc

SEQ ID NO: 6444996 - DNA, 18 bp, Homo sapiens
tccagcagataaggccga

SEQ ID NO: 6444997 - DNA, 16 bp, Homo sapiens
tccagcagattattca

SEQ ID NO: 6444998 - DNA, 22 bp, Homo sapiens
tccagcagattattcactgatt

SEQ ID NO: 6444999 - DNA, 20 bp, Homo sapiens
tccagcagcacacctcagcc

SEQ ID NO: 6445000 - DNA, 21 bp, Homo sapiens
tccagcagcacacctcagccc

SEQ ID NO: 6445001 - DNA, 22 bp, Homo sapiens
tccagcagcacacctcagcccc

SEQ ID NO: 6445002 - DNA, 13 bp, Homo sapiens
tccagcagcagca

SEQ ID NO: 6445003 - DNA, 13 bp, Homo sapiens
tccagcagctgcg

SEQ ID NO: 6445004 - DNA, 14 bp, Homo sapiens
tccagcagctgcgg

SEQ ID NO: 6445005 - DNA, 15 bp, Homo sapiens
tccagcaggcccatg

SEQ ID NO: 6445006 - DNA, 18 bp, Homo sapiens
tccagcaggggtctccca

SEQ ID NO: 6445007 - DNA, 21 bp, Homo sapiens
tccagcaggggtctcccaaca

SEQ ID NO: 6445008 - DNA, 23 bp, Homo sapiens
tccagcaggtagtgggtgaatgt

SEQ ID NO: 6445009 - DNA, 14 bp, Homo sapiens
tccagcagtcactt

SEQ ID NO: 6445010 - DNA, 20 bp, Homo sapiens
tccagcagtcacttcggcca

SEQ ID NO: 6445011 - DNA, 18 bp, Homo sapiens
tccagcagtctctgcctt

SEQ ID NO: 6445012 - DNA, 15 bp, Homo sapiens
tccagcagtgaaact

SEQ ID NO: 6445013 - DNA, 15 bp, Homo sapiens
tccagcagtgctggg

SEQ ID NO: 6445014 - DNA, 18 bp, Homo sapiens
tccagcagtgctgggccc

SEQ ID NO: 6445015 - DNA, 20 bp, Homo sapiens
tccagcagtgctgggcccag

SEQ ID NO: 6445016 - DNA, 21 bp, Homo sapiens
tccagcagtgctgggcccagc

SEQ ID NO: 6445017 - DNA, 22 bp, Homo sapiens
tccagcagtgctgggcccagcc

SEQ ID NO: 6445018 - DNA, 12 bp, Homo sapiens
tccagcagtgtt

SEQ ID NO: 6445019 - DNA, 15 bp, Homo sapiens
tccagcagtgttgct

SEQ ID NO: 6445020 - DNA, 12 bp, Homo sapiens
tccagcagttgt

SEQ ID NO: 6445021 - DNA, 16 bp, Homo sapiens
tccagcatccagcctg

SEQ ID NO: 6445022 - DNA, 13 bp, Homo sapiens
tccagcatcccag

SEQ ID NO: 6445023 - DNA, 13 bp, Homo sapiens
tccagcatcctgc

SEQ ID NO: 6445024 - DNA, 13 bp, Homo sapiens
tccagcatgtaaa

SEQ ID NO: 6445025 - DNA, 11 bp, Homo sapiens
tccagcatgtg

SEQ ID NO: 6445026 - DNA, 20 bp, Homo sapiens
tccagcatgtgtgtgtctct

SEQ ID NO: 6445027 - DNA, 22 bp, Homo sapiens
tccagcatgtgtgtgtctctat

SEQ ID NO: 6445028 - DNA, 16 bp, Homo sapiens
tccagcattcccaggt

SEQ ID NO: 6445029 - DNA, 16 bp, Homo sapiens
tccagcattgaagaga

SEQ ID NO: 6445030 - DNA, 17 bp, Homo sapiens
tccagcattgctggact

SEQ ID NO: 6445031 - DNA, 21 bp, Homo sapiens
tccagcatttagctggccaca

SEQ ID NO: 6445032 - DNA, 17 bp, Homo sapiens
tccagccaaacgggagc

SEQ ID NO: 6445033 - DNA, 22 bp, Homo sapiens
tccagccaaagaaatgggcctg

SEQ ID NO: 6445034 - DNA, 14 bp, Homo sapiens
tccagccaacccct

SEQ ID NO: 6445035 - DNA, 16 bp, Homo sapiens
tccagccaacccctgt

SEQ ID NO: 6445036 - DNA, 9 bp, Homo sapiens
tccagccac

SEQ ID NO: 6445037 - DNA, 20 bp, Homo sapiens
tccagccaccaaggctgcct

SEQ ID NO: 6445038 - DNA, 17 bp, Homo sapiens
tccagccacccagccag

SEQ ID NO: 6445039 - DNA, 18 bp, Homo sapiens
tccagccacccagccagg

SEQ ID NO: 6445040 - DNA, 21 bp, Homo sapiens
tccagccacccagccaggagg

SEQ ID NO: 6445041 - DNA, 18 bp, Homo sapiens
tccagccacccccaggca

SEQ ID NO: 6445042 - DNA, 23 bp, Homo sapiens
tccagccaccccgcagtcacttt

SEQ ID NO: 6445043 - DNA, 13 bp, Homo sapiens
tccagccacctag

SEQ ID NO: 6445044 - DNA, 16 bp, Homo sapiens
tccagccacggaggga

SEQ ID NO: 6445045 - DNA, 20 bp, Homo sapiens
tccagccacggagggaggca

SEQ ID NO: 6445046 - DNA, 20 bp, Homo sapiens
tccagccactggctgctaac

SEQ ID NO: 6445047 - DNA, 10 bp, Homo sapiens
tccagccagc

SEQ ID NO: 6445048 - DNA, 23 bp, Homo sapiens
tccagccagccaaatccatcctg

SEQ ID NO: 6445049 - DNA, 12 bp, Homo sapiens
tccagccagcgc

SEQ ID NO: 6445050 - DNA, 19 bp, Homo sapiens
tccagccagcgcctccctc

SEQ ID NO: 6445051 - DNA, 13 bp, Homo sapiens
tccagccagctcc

SEQ ID NO: 6445052 - DNA, 14 bp, Homo sapiens
tccagccagctcct

SEQ ID NO: 6445053 - DNA, 19 bp, Homo sapiens
tccagccagctcctgcaca

SEQ ID NO: 6445054 - DNA, 23 bp, Homo sapiens
tctttccactctggattcagcct

SEQ ID NO: 6445055 - DNA, 14 bp, Homo sapiens
tctttccactttgt

SEQ ID NO: 6445056 - DNA, 17 bp, Homo sapiens
tctttccagaaaccaaa

SEQ ID NO: 6445057 - DNA, 15 bp, Homo sapiens
tctttccagacccca

SEQ ID NO: 6445058 - DNA, 14 bp, Homo sapiens
tctttccagaggag

SEQ ID NO: 6445059 - DNA, 21 bp, Homo sapiens
tctttccagtggatcataaga

SEQ ID NO: 6445060 - DNA, 18 bp, Homo sapiens
tctttccatctcattaca

SEQ ID NO: 6445061 - DNA, 20 bp, Homo sapiens
tctttccatgacacccaagg

SEQ ID NO: 6445062 - DNA, 16 bp, Homo sapiens
tctttccatgcagtta

SEQ ID NO: 6445063 - DNA, 22 bp, Homo sapiens
tctttccattcttcttgctaca

SEQ ID NO: 6445064 - DNA, 20 bp, Homo sapiens
tctttccattggatctcatt

SEQ ID NO: 6445065 - DNA, 24 bp, Homo sapiens
tctttccatttctctctccagtct

SEQ ID NO: 6445066 - DNA, 16 bp, Homo sapiens
tctttcccaccctcca

SEQ ID NO: 6445067 - DNA, 14 bp, Homo sapiens
tctttcccagcctc

SEQ ID NO: 6445068 - DNA, 12 bp, Homo sapiens
tctttcccagga

SEQ ID NO: 6445069 - DNA, 14 bp, Homo sapiens
tctttcccaggccg

SEQ ID NO: 6445070 - DNA, 23 bp, Homo sapiens
tctttccccaaggacccagccct

SEQ ID NO: 6445071 - DNA, 13 bp, Homo sapiens
tctttccccacct

SEQ ID NO: 6445072 - DNA, 19 bp, Homo sapiens
tctttccccacctcttcct

SEQ ID NO: 6445073 - DNA, 11 bp, Homo sapiens
tctttccccag

SEQ ID NO: 6445074 - DNA, 12 bp, Homo sapiens
tctttccccaga

SEQ ID NO: 6445075 - DNA, 14 bp, Homo sapiens
tctttccccagcag

SEQ ID NO: 6445076 - DNA, 24 bp, Homo sapiens
tctttccccagcagtttctgtcct

SEQ ID NO: 6445077 - DNA, 13 bp, Homo sapiens
tctttcccccagg

SEQ ID NO: 6445078 - DNA, 16 bp, Homo sapiens
tctttcccccaggaaa

SEQ ID NO: 6445079 - DNA, 16 bp, Homo sapiens
tctttcccccctccct

SEQ ID NO: 6445080 - DNA, 19 bp, Homo sapiens
tctttcccctcagagctct

SEQ ID NO: 6445081 - DNA, 17 bp, Homo sapiens
tctttcccctcctttgt

SEQ ID NO: 6445082 - DNA, 18 bp, Homo sapiens
tctttcccctcctttgtc

SEQ ID NO: 6445083 - DNA, 19 bp, Homo sapiens
tctttcccctcctttgtct

SEQ ID NO: 6445084 - DNA, 20 bp, Homo sapiens
tctttcccctcctttgtctt

SEQ ID NO: 6445085 - DNA, 14 bp, Homo sapiens
tctttcccctttct

SEQ ID NO: 6445086 - DNA, 22 bp, Homo sapiens
tctttccctcatgtatacttca

SEQ ID NO: 6445087 - DNA, 23 bp, Homo sapiens
tctttccctcccttcctctttcc

SEQ ID NO: 6445088 - DNA, 20 bp, Homo sapiens
tctttccctgcttaatgaaa

SEQ ID NO: 6445089 - DNA, 11 bp, Homo sapiens
tctttccctgg

SEQ ID NO: 6445090 - DNA, 12 bp, Homo sapiens
tctttccctgga

SEQ ID NO: 6445091 - DNA, 14 bp, Homo sapiens
tctttccctggtcc

SEQ ID NO: 6445092 - DNA, 14 bp, Homo sapiens
tctttcccttactc

SEQ ID NO: 6445093 - DNA, 15 bp, Homo sapiens
tctttcccttccagt

SEQ ID NO: 6445094 - DNA, 15 bp, Homo sapiens
tctttcccttcctcc

SEQ ID NO: 6445095 - DNA, 17 bp, Homo sapiens
tctttcccttctttttc

SEQ ID NO: 6445096 - DNA, 15 bp, Homo sapiens
tctttcccttttctg

SEQ ID NO: 6445097 - DNA, 16 bp, Homo sapiens
tctttccgactgccca

SEQ ID NO: 6445098 - DNA, 21 bp, Homo sapiens
tctttccgtcaccctggggat

SEQ ID NO: 6445099 - DNA, 15 bp, Homo sapiens
tctttcctacaagtt

SEQ ID NO: 6445100 - DNA, 23 bp, Homo sapiens
tctttcctacacactctgagtct

SEQ ID NO: 6445101 - DNA, 17 bp, Homo sapiens
tctttcctatttgcaca

SEQ ID NO: 6445102 - DNA, 14 bp, Homo sapiens
tctttcctccaccc

SEQ ID NO: 6445103 - DNA, 17 bp, Homo sapiens
tctttcctcctcatgaa

SEQ ID NO: 6445104 - DNA, 22 bp, Homo sapiens
tctttcctcttccccttgccct

SEQ ID NO: 6445105 - DNA, 15 bp, Homo sapiens
tctttcctctttctg

SEQ ID NO: 6445106 - DNA, 13 bp, Homo sapiens
tctttcctgaggc

SEQ ID NO: 6445107 - DNA, 14 bp, Homo sapiens
tctttcctgccctg

SEQ ID NO: 6445108 - DNA, 17 bp, Homo sapiens
tctttcctgcccttttc

SEQ ID NO: 6445109 - DNA, 20 bp, Homo sapiens
tctttcctgcccttttcctg

SEQ ID NO: 6445110 - DNA, 14 bp, Homo sapiens
tctttcctgctaca

SEQ ID NO: 6445111 - DNA, 15 bp, Homo sapiens
tctttccttcttgcc

SEQ ID NO: 6445112 - DNA, 16 bp, Homo sapiens
tctttccttgttcagc

SEQ ID NO: 6445113 - DNA, 17 bp, Homo sapiens
tctttcctttaaaaata

SEQ ID NO: 6445114 - DNA, 18 bp, Homo sapiens
tctttcctttactcctgg

SEQ ID NO: 6445115 - DNA, 19 bp, Homo sapiens
tctttcctttactcctggc

SEQ ID NO: 6445116 - DNA, 22 bp, Homo sapiens
tctttcctttcatcctcagcaa

SEQ ID NO: 6445117 - DNA, 22 bp, Homo sapiens
tctttcggaatttttaaaataa

SEQ ID NO: 6445118 - DNA, 19 bp, Homo sapiens
tctttcgttggttgtttct

SEQ ID NO: 6445119 - DNA, 21 bp, Homo sapiens
tctttctaactccagtgaagt

SEQ ID NO: 6445120 - DNA, 16 bp, Homo sapiens
tctttctaactgtagc

SEQ ID NO: 6445121 - DNA, 19 bp, Homo sapiens
tctttctaactgtagctat

SEQ ID NO: 6445122 - DNA, 16 bp, Homo sapiens
tctttctaactttctt

SEQ ID NO: 6445123 - DNA, 14 bp, Homo sapiens
tctttctaagaaat

SEQ ID NO: 6445124 - DNA, 19 bp, Homo sapiens
tctttctaatgtagctatt

SEQ ID NO: 6445125 - DNA, 19 bp, Homo sapiens
tctttctaatgtgtgaatc

SEQ ID NO: 6445126 - DNA, 15 bp, Homo sapiens
tctttctacagagat

SEQ ID NO: 6445127 - DNA, 15 bp, Homo sapiens
tctttctacagccta

SEQ ID NO: 6445128 - DNA, 18 bp, Homo sapiens
tctttctacatagttatt

SEQ ID NO: 6445129 - DNA, 21 bp, Homo sapiens
tctttctacatgactgggcct

SEQ ID NO: 6445130 - DNA, 19 bp, Homo sapiens
tctttctactctgaactaa

SEQ ID NO: 6445131 - DNA, 23 bp, Homo sapiens
tctttctagcctggggcttgaat

SEQ ID NO: 6445132 - DNA, 20 bp, Homo sapiens
tctttctagtggtctttgta

SEQ ID NO: 6445133 - DNA, 22 bp, Homo sapiens
tctttctagtggtctttgtaag

SEQ ID NO: 6445134 - DNA, 18 bp, Homo sapiens
tctttctatgctgctttt

SEQ ID NO: 6445135 - DNA, 21 bp, Homo sapiens
tctttctatgctgcttttata

SEQ ID NO: 6445136 - DNA, 12 bp, Homo sapiens
tctttctatgta

SEQ ID NO: 6445137 - DNA, 17 bp, Homo sapiens
tctttctattcataata

SEQ ID NO: 6445138 - DNA, 15 bp, Homo sapiens
tctttctattccaaa

SEQ ID NO: 6445139 - DNA, 15 bp, Homo sapiens
tctttctcaaagaaa

SEQ ID NO: 6445140 - DNA, 22 bp, Homo sapiens
tctttctcattagagatctgaa

SEQ ID NO: 6445141 - DNA, 17 bp, Homo sapiens
tctttctccaaagttat

SEQ ID NO: 6445142 - DNA, 13 bp, Homo sapiens
tctttctcccttt

SEQ ID NO: 6445143 - DNA, 15 bp, Homo sapiens
tctttctcctcagga

SEQ ID NO: 6445144 - DNA, 13 bp, Homo sapiens
tctttctcctctt

SEQ ID NO: 6445145 - DNA, 15 bp, Homo sapiens
tctttctcctggtga

SEQ ID NO: 6445146 - DNA, 14 bp, Homo sapiens
tctttctctaaata

SEQ ID NO: 6445147 - DNA, 20 bp, Homo sapiens
tctttctctaatgttgtatc

SEQ ID NO: 6445148 - DNA, 12 bp, Homo sapiens
tctttctctcag

SEQ ID NO: 6445149 - DNA, 12 bp, Homo sapiens
tctttctctcct

SEQ ID NO: 6445150 - DNA, 15 bp, Homo sapiens
tctttctctcctttc

SEQ ID NO: 6445151 - DNA, 13 bp, Homo sapiens
tctttctctctgt

SEQ ID NO: 6445152 - DNA, 14 bp, Homo sapiens
tctttctctctgtg

SEQ ID NO: 6445153 - DNA, 13 bp, Homo sapiens
tctttctctgagg

SEQ ID NO: 6445154 - DNA, 15 bp, Homo sapiens
tctttctctgaggac

SEQ ID NO: 6445155 - DNA, 17 bp, Homo sapiens
tctttctctgccagtga

SEQ ID NO: 6445156 - DNA, 14 bp, Homo sapiens
tctttctctggtgg

SEQ ID NO: 6445157 - DNA, 12 bp, Homo sapiens
tctttctctttc

SEQ ID NO: 6445158 - DNA, 16 bp, Homo sapiens
tctttctctttccctg

SEQ ID NO: 6445159 - DNA, 17 bp, Homo sapiens
tctttctctttcttcct

SEQ ID NO: 6445160 - DNA, 22 bp, Homo sapiens
tctttctgagtgccttctgtgg

SEQ ID NO: 6445161 - DNA, 14 bp, Homo sapiens
tctttctgataact

SEQ ID NO: 6445162 - DNA, 20 bp, Homo sapiens
tctttctgataactagatgg

SEQ ID NO: 6445163 - DNA, 23 bp, Homo sapiens
tctttctgataactagatggtgc

SEQ ID NO: 6445164 - DNA, 22 bp, Homo sapiens
tctttctgcagaaacagaaagg

SEQ ID NO: 6445165 - DNA, 20 bp, Homo sapiens
tctttctgctctgccatctt

SEQ ID NO: 6445166 - DNA, 12 bp, Homo sapiens
tctttctgctgg

SEQ ID NO: 6445167 - DNA, 16 bp, Homo sapiens
tctttctgctggctga

SEQ ID NO: 6445168 - DNA, 17 bp, Homo sapiens
tctttctgctggctgat

SEQ ID NO: 6445169 - DNA, 10 bp, Homo sapiens
tctttctgga

SEQ ID NO: 6445170 - DNA, 12 bp, Homo sapiens
tctttctggact

SEQ ID NO: 6445171 - DNA, 21 bp, Homo sapiens
tctttctggctatgcatttga

SEQ ID NO: 6445172 - DNA, 10 bp, Homo sapiens
tctttctgta

SEQ ID NO: 6445173 - DNA, 13 bp, Homo sapiens
tctttctgtacaa

SEQ ID NO: 6445174 - DNA, 14 bp, Homo sapiens
tctttctgtattga

SEQ ID NO: 6445175 - DNA, 14 bp, Homo sapiens
tctttctgtccctt

SEQ ID NO: 6445176 - DNA, 12 bp, Homo sapiens
tctttctgtctc

SEQ ID NO: 6445177 - DNA, 14 bp, Homo sapiens
tctttctgtctccc

SEQ ID NO: 6445178 - DNA, 17 bp, Homo sapiens
tctttctgtctcccttc

SEQ ID NO: 6445179 - DNA, 20 bp, Homo sapiens
tctttctgtcttgttaatgc

SEQ ID NO: 6445180 - DNA, 20 bp, Homo sapiens
tctttctgtgtggtgaaaac

SEQ ID NO: 6445181 - DNA, 13 bp, Homo sapiens
tctttctgttatt

SEQ ID NO: 6445182 - DNA, 17 bp, Homo sapiens
tctttctgttgaaaagc

SEQ ID NO: 6445183 - DNA, 19 bp, Homo sapiens
tctttctgtttcctggcct

SEQ ID NO: 6445184 - DNA, 12 bp, Homo sapiens
tctttctgtttt

SEQ ID NO: 6445185 - DNA, 13 bp, Homo sapiens
tctttctgttttt

SEQ ID NO: 6445186 - DNA, 22 bp, Homo sapiens
tctttcttaatagaaagtcaga

SEQ ID NO: 6445187 - DNA, 15 bp, Homo sapiens
tctttcttactattg

SEQ ID NO: 6445188 - DNA, 14 bp, Homo sapiens
tctttcttagaaat

SEQ ID NO: 6445189 - DNA, 15 bp, Homo sapiens
tctttcttagaaatt

SEQ ID NO: 6445190 - DNA, 16 bp, Homo sapiens
tctttcttagaaattt

SEQ ID NO: 6445191 - DNA, 20 bp, Homo sapiens
tctttcttattttgtaataa

SEQ ID NO: 6445192 - DNA, 13 bp, Homo sapiens
tctttcttcaaat

SEQ ID NO: 6445193 - DNA, 15 bp, Homo sapiens
tctttcttcactctg

SEQ ID NO: 6445194 - DNA, 10 bp, Homo sapiens
tctttcttcc

SEQ ID NO: 6445195 - DNA, 13 bp, Homo sapiens
tctttcttccaaa

SEQ ID NO: 6445196 - DNA, 16 bp, Homo sapiens
tctttcttccattcct

SEQ ID NO: 6445197 - DNA, 20 bp, Homo sapiens
tctttcttcccgtgtgtatt

SEQ ID NO: 6445198 - DNA, 14 bp, Homo sapiens
tctttcttcctctt

SEQ ID NO: 6445199 - DNA, 15 bp, Homo sapiens
tctttcttcctcttc

SEQ ID NO: 6445200 - DNA, 16 bp, Homo sapiens
tctttcttcctcttct

SEQ ID NO: 6445201 - DNA, 14 bp, Homo sapiens
tctttcttcctttc

SEQ ID NO: 6445202 - DNA, 14 bp, Homo sapiens
tctttcttctcgcc

SEQ ID NO: 6445203 - DNA, 12 bp, Homo sapiens
tctttcttgaaa

SEQ ID NO: 6445204 - DNA, 15 bp, Homo sapiens
tctttcttgaaattg

SEQ ID NO: 6445205 - DNA, 21 bp, Homo sapiens
tctttcttgctggctctgaga

SEQ ID NO: 6445206 - DNA, 18 bp, Homo sapiens
tctttcttggtgcattcg

SEQ ID NO: 6445207 - DNA, 21 bp, Homo sapiens
tctttctttacctgagaccag

SEQ ID NO: 6445208 - DNA, 13 bp, Homo sapiens
tctttctttattt

SEQ ID NO: 6445209 - DNA, 13 bp, Homo sapiens
tctttctttccat

SEQ ID NO: 6445210 - DNA, 12 bp, Homo sapiens
tctttctttgct

SEQ ID NO: 6445211 - DNA, 14 bp, Homo sapiens
tctttctttgctgc

SEQ ID NO: 6445212 - DNA, 12 bp, Homo sapiens
tctttctttgga

SEQ ID NO: 6445213 - DNA, 23 bp, Homo sapiens
tctttctttgggaatatttgaat

SEQ ID NO: 6445214 - DNA, 19 bp, Homo sapiens
tctttctttggggaaaaat

SEQ ID NO: 6445215 - DNA, 19 bp, Homo sapiens
tctttctttggtgcctttc

SEQ ID NO: 6445216 - DNA, 18 bp, Homo sapiens
tctttctttgtcattcag

SEQ ID NO: 6445217 - DNA, 18 bp, Homo sapiens
tctttctttgtttctttc

SEQ ID NO: 6445218 - DNA, 16 bp, Homo sapiens
tctttcttttaagcag

SEQ ID NO: 6445219 - DNA, 17 bp, Homo sapiens
tctttcttttcttttta

SEQ ID NO: 6445220 - DNA, 22 bp, Homo sapiens
tctttcttttgattcttcctaa

SEQ ID NO: 6445221 - DNA, 13 bp, Homo sapiens
tctttctttttaa

SEQ ID NO: 6445222 - DNA, 15 bp, Homo sapiens
tctttctttttctgg

SEQ ID NO: 6445223 - DNA, 18 bp, Homo sapiens
tctttctttttctgtctc

SEQ ID NO: 6445224 - DNA, 18 bp, Homo sapiens
tctttgaaaaataaagtt

SEQ ID NO: 6445225 - DNA, 20 bp, Homo sapiens
tctttgaaaatagttattca

SEQ ID NO: 6445226 - DNA, 16 bp, Homo sapiens
tctttgaaacaacttt

SEQ ID NO: 6445227 - DNA, 19 bp, Homo sapiens
tctttgaaacatgcttgtg

SEQ ID NO: 6445228 - DNA, 15 bp, Homo sapiens
tctttgaaataaaaa

SEQ ID NO: 6445229 - DNA, 15 bp, Homo sapiens
tctttgaaatgctaa

SEQ ID NO: 6445230 - DNA, 17 bp, Homo sapiens
tctttgaaatgctaaac

SEQ ID NO: 6445231 - DNA, 15 bp, Homo sapiens
tctttgaaattatgt

SEQ ID NO: 6445232 - DNA, 16 bp, Homo sapiens
tctttgaaattatgta

SEQ ID NO: 6445233 - DNA, 14 bp, Homo sapiens
tctttgaacatgaa

SEQ ID NO: 6445234 - DNA, 22 bp, Homo sapiens
tctttgaagaaaagaaaaaaca

SEQ ID NO: 6445235 - DNA, 14 bp, Homo sapiens
tctttgaaggttta

SEQ ID NO: 6445236 - DNA, 13 bp, Homo sapiens
tctttgaataaag

SEQ ID NO: 6445237 - DNA, 21 bp, Homo sapiens
tccagccagctcctgggcagc

SEQ ID NO: 6445238 - DNA, 16 bp, Homo sapiens
tccagccaggcccagg

SEQ ID NO: 6445239 - DNA, 17 bp, Homo sapiens
tccagccagggctgcta

SEQ ID NO: 6445240 - DNA, 20 bp, Homo sapiens
tccagccatagagattttaa

SEQ ID NO: 6445241 - DNA, 21 bp, Homo sapiens
tccagccatcaagagactgag

SEQ ID NO: 6445242 - DNA, 24 bp, Homo sapiens
tccagccatcaagagactgagtca

SEQ ID NO: 6445243 - DNA, 15 bp, Homo sapiens
tccagccatcacctt

SEQ ID NO: 6445244 - DNA, 13 bp, Homo sapiens
tccagcccacacc

SEQ ID NO: 6445245 - DNA, 18 bp, Homo sapiens
tccagcccacacccctcc

SEQ ID NO: 6445246 - DNA, 18 bp, Homo sapiens
tccagcccacagtgctca

SEQ ID NO: 6445247 - DNA, 19 bp, Homo sapiens
tccagcccacagtgctcag

SEQ ID NO: 6445248 - DNA, 22 bp, Homo sapiens
tccagcccacagtgctcagttg

SEQ ID NO: 6445249 - DNA, 12 bp, Homo sapiens
tccagcccaccc

SEQ ID NO: 6445250 - DNA, 12 bp, Homo sapiens
tccagcccagac

SEQ ID NO: 6445251 - DNA, 21 bp, Homo sapiens
tccagcccagacccccagtgt

SEQ ID NO: 6445252 - DNA, 15 bp, Homo sapiens
tccagcccagcccgc

SEQ ID NO: 6445253 - DNA, 12 bp, Homo sapiens
tccagcccattg

SEQ ID NO: 6445254 - DNA, 15 bp, Homo sapiens
tccagcccctcctcc

SEQ ID NO: 6445255 - DNA, 18 bp, Homo sapiens
tccagcccctcctccctc

SEQ ID NO: 6445256 - DNA, 21 bp, Homo sapiens
tccagcccctcttggagaagt

SEQ ID NO: 6445257 - DNA, 12 bp, Homo sapiens
tccagcccctgg

SEQ ID NO: 6445258 - DNA, 14 bp, Homo sapiens
tccagcccctggac

SEQ ID NO: 6445259 - DNA, 14 bp, Homo sapiens
tccagcccctggat

SEQ ID NO: 6445260 - DNA, 16 bp, Homo sapiens
tccagcccctggatgc

SEQ ID NO: 6445261 - DNA, 17 bp, Homo sapiens
tccagcccctggatgca

SEQ ID NO: 6445262 - DNA, 21 bp, Homo sapiens
tccagcccctggatgcagcct

SEQ ID NO: 6445263 - DNA, 23 bp, Homo sapiens
tccagcccctgtcccaccccctt

SEQ ID NO: 6445264 - DNA, 22 bp, Homo sapiens
tccagccccttcaattatttcc

SEQ ID NO: 6445265 - DNA, 17 bp, Homo sapiens
tccagccccttctcaga

SEQ ID NO: 6445266 - DNA, 22 bp, Homo sapiens
tccagccccttctcagaatcta

SEQ ID NO: 6445267 - DNA, 20 bp, Homo sapiens
tccagcccctttgcctctgt

SEQ ID NO: 6445268 - DNA, 21 bp, Homo sapiens
tccagcccgagtggtctcctc

SEQ ID NO: 6445269 - DNA, 20 bp, Homo sapiens
tccagcccgggagcctagga

SEQ ID NO: 6445270 - DNA, 23 bp, Homo sapiens
tccagcccgggagcctaggacca

SEQ ID NO: 6445271 - DNA, 15 bp, Homo sapiens
tccagccctccgcca

SEQ ID NO: 6445272 - DNA, 22 bp, Homo sapiens
tccagccctccgccagccctgt

SEQ ID NO: 6445273 - DNA, 19 bp, Homo sapiens
tccagccctgactaaacta

SEQ ID NO: 6445274 - DNA, 20 bp, Homo sapiens
tccagccctgagttcctagc

SEQ ID NO: 6445275 - DNA, 20 bp, Homo sapiens
tccagccctgcccaccctcc

SEQ ID NO: 6445276 - DNA, 15 bp, Homo sapiens
tccagccctgggcac

SEQ ID NO: 6445277 - DNA, 19 bp, Homo sapiens
tccagcccttcagacgaga

SEQ ID NO: 6445278 - DNA, 15 bp, Homo sapiens
tccagccgaagctgc

SEQ ID NO: 6445279 - DNA, 19 bp, Homo sapiens
tccagccgaagctgcaggg

SEQ ID NO: 6445280 - DNA, 21 bp, Homo sapiens
tccagccgcaaatccataccc

SEQ ID NO: 6445281 - DNA, 18 bp, Homo sapiens
tccagccgccattgccac

SEQ ID NO: 6445282 - DNA, 20 bp, Homo sapiens
tccagccgccattgccacca

SEQ ID NO: 6445283 - DNA, 22 bp, Homo sapiens
tccagccgccattgccaccagg

SEQ ID NO: 6445284 - DNA, 24 bp, Homo sapiens
tccagccgccggctgtgcagtcct

SEQ ID NO: 6445285 - DNA, 20 bp, Homo sapiens
tccagccggcatggctggga

SEQ ID NO: 6445286 - DNA, 11 bp, Homo sapiens
tccagccgtgt

SEQ ID NO: 6445287 - DNA, 15 bp, Homo sapiens
tccagccgtgtgtgc

SEQ ID NO: 6445288 - DNA, 16 bp, Homo sapiens
tccagccgtgtgtgca

SEQ ID NO: 6445289 - DNA, 18 bp, Homo sapiens
tccagccgtgtgtgcatg

SEQ ID NO: 6445290 - DNA, 19 bp, Homo sapiens
tccagccgtgtgtgcatgt

SEQ ID NO: 6445291 - DNA, 14 bp, Homo sapiens
tccagcctcagctc

SEQ ID NO: 6445292 - DNA, 13 bp, Homo sapiens
tccagcctccagg

SEQ ID NO: 6445293 - DNA, 16 bp, Homo sapiens
tccagcctccagggca

SEQ ID NO: 6445294 - DNA, 19 bp, Homo sapiens
tccagcctccctgtctcca

SEQ ID NO: 6445295 - DNA, 22 bp, Homo sapiens
tccagcctccctgtctccagct

SEQ ID NO: 6445296 - DNA, 13 bp, Homo sapiens
tccagcctctccc

SEQ ID NO: 6445297 - DNA, 15 bp, Homo sapiens
tccagcctctcccgg

SEQ ID NO: 6445298 - DNA, 16 bp, Homo sapiens
tccagcctctcccggc

SEQ ID NO: 6445299 - DNA, 21 bp, Homo sapiens
tccagcctctcccggctgcct

SEQ ID NO: 6445300 - DNA, 16 bp, Homo sapiens
tccagcctctgccgct

SEQ ID NO: 6445301 - DNA, 18 bp, Homo sapiens
tccagcctctgccgctgc

SEQ ID NO: 6445302 - DNA, 23 bp, Homo sapiens
tccagcctctgccgctgccatgc

SEQ ID NO: 6445303 - DNA, 14 bp, Homo sapiens
tccagcctctggtc

SEQ ID NO: 6445304 - DNA, 12 bp, Homo sapiens
tccagcctctgt

SEQ ID NO: 6445305 - DNA, 16 bp, Homo sapiens
tccagcctctgttccc

SEQ ID NO: 6445306 - DNA, 11 bp, Homo sapiens
tccagcctgac

SEQ ID NO: 6445307 - DNA, 14 bp, Homo sapiens
tccagcctgacaac

SEQ ID NO: 6445308 - DNA, 13 bp, Homo sapiens
tccagcctgacat

SEQ ID NO: 6445309 - DNA, 15 bp, Homo sapiens
tccagcctgacgcct

SEQ ID NO: 6445310 - DNA, 11 bp, Homo sapiens
tccagcctgcc

SEQ ID NO: 6445311 - DNA, 16 bp, Homo sapiens
tccagcctgcctggca

SEQ ID NO: 6445312 - DNA, 19 bp, Homo sapiens
tccagcctgcctggcaggc

SEQ ID NO: 6445313 - DNA, 11 bp, Homo sapiens
tccagcctgct

SEQ ID NO: 6445314 - DNA, 13 bp, Homo sapiens
tccagcctggacc

SEQ ID NO: 6445315 - DNA, 20 bp, Homo sapiens
tccagcctggacccccagct

SEQ ID NO: 6445316 - DNA, 11 bp, Homo sapiens
tccagcctggg

SEQ ID NO: 6445317 - DNA, 13 bp, Homo sapiens
tccagcctgggac

SEQ ID NO: 6445318 - DNA, 15 bp, Homo sapiens
tccagcctgggacac

SEQ ID NO: 6445319 - DNA, 20 bp, Homo sapiens
tccagcctgggacacacaca

SEQ ID NO: 6445320 - DNA, 19 bp, Homo sapiens
tccagcctgggaggcacag

SEQ ID NO: 6445321 - DNA, 13 bp, Homo sapiens
tccagcctgggca

SEQ ID NO: 6445322 - DNA, 18 bp, Homo sapiens
tccagcctgggcaacaag

SEQ ID NO: 6445323 - DNA, 21 bp, Homo sapiens
tccagcctgggcaacaagagc

SEQ ID NO: 6445324 - DNA, 19 bp, Homo sapiens
tccagcctgggcagccagg

SEQ ID NO: 6445325 - DNA, 23 bp, Homo sapiens
tccagcctgggcagccaggctgc

SEQ ID NO: 6445326 - DNA, 17 bp, Homo sapiens
tccagcctgggcgacag

SEQ ID NO: 6445327 - DNA, 22 bp, Homo sapiens
tccagcctgggcgacagagcaa

SEQ ID NO: 6445328 - DNA, 23 bp, Homo sapiens
tccagcctgggcgacagagcaag

SEQ ID NO: 6445329 - DNA, 16 bp, Homo sapiens
tccagcctggggaccc

SEQ ID NO: 6445330 - DNA, 22 bp, Homo sapiens
tccagcctggggaccccacttc

SEQ ID NO: 6445331 - DNA, 17 bp, Homo sapiens
tccagcctgggtcacag

SEQ ID NO: 6445332 - DNA, 18 bp, Homo sapiens
tccagcctgggtgacaga

SEQ ID NO: 6445333 - DNA, 22 bp, Homo sapiens
tccagcctgggtgacagagcga

SEQ ID NO: 6445334 - DNA, 23 bp, Homo sapiens
tccagcctgggtgacagagcgag

SEQ ID NO: 6445335 - DNA, 16 bp, Homo sapiens
tccagcctggtggccc

SEQ ID NO: 6445336 - DNA, 20 bp, Homo sapiens
tccagcctggtggcccagct

SEQ ID NO: 6445337 - DNA, 21 bp, Homo sapiens
tccagcctggtggcccagcta

SEQ ID NO: 6445338 - DNA, 18 bp, Homo sapiens
tccagcctgtcggccaca

SEQ ID NO: 6445339 - DNA, 19 bp, Homo sapiens
tccagccttcttcccccag

SEQ ID NO: 6445340 - DNA, 22 bp, Homo sapiens
tccagccttcttcccccagggt

SEQ ID NO: 6445341 - DNA, 14 bp, Homo sapiens
tccagcctttgctc

SEQ ID NO: 6445342 - DNA, 17 bp, Homo sapiens
tccagcgagagagtttc

SEQ ID NO: 6445343 - DNA, 21 bp, Homo sapiens
tccagcgagagagtttcaaaa

SEQ ID NO: 6445344 - DNA, 15 bp, Homo sapiens
tccagcgatggtgct

SEQ ID NO: 6445345 - DNA, 19 bp, Homo sapiens
tccagcgatggtgctgccc

SEQ ID NO: 6445346 - DNA, 21 bp, Homo sapiens
tccagcgatggtgctgcccag

SEQ ID NO: 6445347 - DNA, 22 bp, Homo sapiens
tccagcgatggtgctgcccagg

SEQ ID NO: 6445348 - DNA, 22 bp, Homo sapiens
tccagcgcctgccctccctggg

SEQ ID NO: 6445349 - DNA, 14 bp, Homo sapiens
tccagcgcggctcc

SEQ ID NO: 6445350 - DNA, 14 bp, Homo sapiens
tccagcggccctgt

SEQ ID NO: 6445351 - DNA, 15 bp, Homo sapiens
tccagcgggccctct

SEQ ID NO: 6445352 - DNA, 21 bp, Homo sapiens
tccagcggggcttctgggcgc

SEQ ID NO: 6445353 - DNA, 22 bp, Homo sapiens
tccagcggttgccttttttatc

SEQ ID NO: 6445354 - DNA, 15 bp, Homo sapiens
tccagcgtcactcca

SEQ ID NO: 6445355 - DNA, 16 bp, Homo sapiens
tccagcgtcactccag

SEQ ID NO: 6445356 - DNA, 17 bp, Homo sapiens
tccagcgtcactccagt

SEQ ID NO: 6445357 - DNA, 13 bp, Homo sapiens
tccagcgtcctca

SEQ ID NO: 6445358 - DNA, 22 bp, Homo sapiens
tccagcgtcctcagcaccccac

SEQ ID NO: 6445359 - DNA, 22 bp, Homo sapiens
tccagctaaacaccaacccctg

SEQ ID NO: 6445360 - DNA, 22 bp, Homo sapiens
tccagctaagcctgatgatgga

SEQ ID NO: 6445361 - DNA, 22 bp, Homo sapiens
tccagctacttagctggccaag

SEQ ID NO: 6445362 - DNA, 18 bp, Homo sapiens
tccagctagtgccaaata

SEQ ID NO: 6445363 - DNA, 16 bp, Homo sapiens
tccagctcaccagccc

SEQ ID NO: 6445364 - DNA, 21 bp, Homo sapiens
tccagctcaccccccacactc

SEQ ID NO: 6445365 - DNA, 15 bp, Homo sapiens
tccagctcagaaccc

SEQ ID NO: 6445366 - DNA, 19 bp, Homo sapiens
tccagctcagaacccaggg

SEQ ID NO: 6445367 - DNA, 16 bp, Homo sapiens
tccagctcagtcccac

SEQ ID NO: 6445368 - DNA, 18 bp, Homo sapiens
tccagctcagtcccacag

SEQ ID NO: 6445369 - DNA, 18 bp, Homo sapiens
tccagctcattcatttta

SEQ ID NO: 6445370 - DNA, 19 bp, Homo sapiens
tccagctccaacctgcaaa

SEQ ID NO: 6445371 - DNA, 22 bp, Homo sapiens
tccagctccaagacctgttggt

SEQ ID NO: 6445372 - DNA, 22 bp, Homo sapiens
tccagctcccactccctttcca

SEQ ID NO: 6445373 - DNA, 15 bp, Homo sapiens
tccagctccctcccc

SEQ ID NO: 6445374 - DNA, 19 bp, Homo sapiens
tccagctccctcccctgct

SEQ ID NO: 6445375 - DNA, 20 bp, Homo sapiens
tccagctccctcccctgctc

SEQ ID NO: 6445376 - DNA, 21 bp, Homo sapiens
tccagctccctcccctgctca

SEQ ID NO: 6445377 - DNA, 17 bp, Homo sapiens
tccagctccgtgtttct

SEQ ID NO: 6445378 - DNA, 23 bp, Homo sapiens
tccagctcctcatccagggctct

SEQ ID NO: 6445379 - DNA, 14 bp, Homo sapiens
tccagctcctctag

SEQ ID NO: 6445380 - DNA, 23 bp, Homo sapiens
tccagctcctctaggggcagcct

SEQ ID NO: 6445381 - DNA, 21 bp, Homo sapiens
tccagctcctctccagacaca

SEQ ID NO: 6445382 - DNA, 15 bp, Homo sapiens
tccagctcctgcccc

SEQ ID NO: 6445383 - DNA, 12 bp, Homo sapiens
tccagctctgac

SEQ ID NO: 6445384 - DNA, 16 bp, Homo sapiens
tccagctctgacatcc

SEQ ID NO: 6445385 - DNA, 22 bp, Homo sapiens
tccagctctgacatcccttcct

SEQ ID NO: 6445386 - DNA, 14 bp, Homo sapiens
tccagctctgcccc

SEQ ID NO: 6445387 - DNA, 16 bp, Homo sapiens
tccagctctggcacag

SEQ ID NO: 6445388 - DNA, 12 bp, Homo sapiens
tccagctctgtg

SEQ ID NO: 6445389 - DNA, 18 bp, Homo sapiens
tccagctgacagccacac

SEQ ID NO: 6445390 - DNA, 23 bp, Homo sapiens
tccagctgaccctggttctctct

SEQ ID NO: 6445391 - DNA, 13 bp, Homo sapiens
tccagctgagtcc

SEQ ID NO: 6445392 - DNA, 14 bp, Homo sapiens
tccagctgagtcct

SEQ ID NO: 6445393 - DNA, 18 bp, Homo sapiens
tccagctgagtcctgggg

SEQ ID NO: 6445394 - DNA, 21 bp, Homo sapiens
tccagctgcccttccgcagtg

SEQ ID NO: 6445395 - DNA, 14 bp, Homo sapiens
tccagctgcctggg

SEQ ID NO: 6445396 - DNA, 16 bp, Homo sapiens
tccagctgcctgggag

SEQ ID NO: 6445397 - DNA, 18 bp, Homo sapiens
tccagctgctgagatcct

SEQ ID NO: 6445398 - DNA, 22 bp, Homo sapiens
tccagctgctgagatcctggac

SEQ ID NO: 6445399 - DNA, 12 bp, Homo sapiens
tccagctgctgt

SEQ ID NO: 6445400 - DNA, 14 bp, Homo sapiens
tccagctgctgtct

SEQ ID NO: 6445401 - DNA, 12 bp, Homo sapiens
tccagctggcct

SEQ ID NO: 6445402 - DNA, 13 bp, Homo sapiens
tccagctggcctg

SEQ ID NO: 6445403 - DNA, 12 bp, Homo sapiens
tccagctgggac

SEQ ID NO: 6445404 - DNA, 18 bp, Homo sapiens
tccagctgggacctaatg

SEQ ID NO: 6445405 - DNA, 21 bp, Homo sapiens
tccagctgggcctcctgcctc

SEQ ID NO: 6445406 - DNA, 18 bp, Homo sapiens
tccagctggggccagagg

SEQ ID NO: 6445407 - DNA, 21 bp, Homo sapiens
tccagctggggccagaggctg

SEQ ID NO: 6445408 - DNA, 19 bp, Homo sapiens
tccagctggtgcccccaga

SEQ ID NO: 6445409 - DNA, 12 bp, Homo sapiens
tccagctgtcag

SEQ ID NO: 6445410 - DNA, 15 bp, Homo sapiens
tccagctgtcagcct

SEQ ID NO: 6445411 - DNA, 17 bp, Homo sapiens
tccagctgtccccccac

SEQ ID NO: 6445412 - DNA, 21 bp, Homo sapiens
tccagctgtccccccactccc

SEQ ID NO: 6445413 - DNA, 18 bp, Homo sapiens
tccagctgtcgtctgact

SEQ ID NO: 6445414 - DNA, 17 bp, Homo sapiens
tctttgaataaagtctg

SEQ ID NO: 6445415 - DNA, 15 bp, Homo sapiens
tctttgaattttcat

SEQ ID NO: 6445416 - DNA, 16 bp, Homo sapiens
tctttgaattttcatt

SEQ ID NO: 6445417 - DNA, 19 bp, Homo sapiens
tctttgaattttcatttta

SEQ ID NO: 6445418 - DNA, 20 bp, Homo sapiens
tctttgacaattctgggtgc

SEQ ID NO: 6445419 - DNA, 21 bp, Homo sapiens
tctttgacaattgggagctgc

SEQ ID NO: 6445420 - DNA, 16 bp, Homo sapiens
tctttgacactctgca

SEQ ID NO: 6445421 - DNA, 16 bp, Homo sapiens
tctttgacatttttgc

SEQ ID NO: 6445422 - DNA, 19 bp, Homo sapiens
tctttgacatttttgccaa

SEQ ID NO: 6445423 - DNA, 11 bp, Homo sapiens
tctttgaccaa

SEQ ID NO: 6445424 - DNA, 16 bp, Homo sapiens
tctttgaccagatctt

SEQ ID NO: 6445425 - DNA, 20 bp, Homo sapiens
tctttgacgggaggcctcag

SEQ ID NO: 6445426 - DNA, 13 bp, Homo sapiens
tctttgactgaaa

SEQ ID NO: 6445427 - DNA, 23 bp, Homo sapiens
tctttgagaactgcttctaagat

SEQ ID NO: 6445428 - DNA, 21 bp, Homo sapiens
tctttgagagagtttatcatt

SEQ ID NO: 6445429 - DNA, 18 bp, Homo sapiens
tctttgagatagaagaac

SEQ ID NO: 6445430 - DNA, 23 bp, Homo sapiens
tctttgagggactgcctctgcca

SEQ ID NO: 6445431 - DNA, 22 bp, Homo sapiens
tctttgagtcaatagcttgtct

SEQ ID NO: 6445432 - DNA, 14 bp, Homo sapiens
tctttgataacaaa

SEQ ID NO: 6445433 - DNA, 16 bp, Homo sapiens
tctttgataacaaaaa

SEQ ID NO: 6445434 - DNA, 18 bp, Homo sapiens
tctttgataacaaaaaat

SEQ ID NO: 6445435 - DNA, 22 bp, Homo sapiens
tctttgataagatgaggaaata

SEQ ID NO: 6445436 - DNA, 14 bp, Homo sapiens
tctttgatatcagc

SEQ ID NO: 6445437 - DNA, 20 bp, Homo sapiens
tctttgatatgttgatgaaa

SEQ ID NO: 6445438 - DNA, 14 bp, Homo sapiens
tctttgatcatgaa

SEQ ID NO: 6445439 - DNA, 20 bp, Homo sapiens
tctttgatcatgaataactg

SEQ ID NO: 6445440 - DNA, 21 bp, Homo sapiens
tctttgatccttctgagctcc

SEQ ID NO: 6445441 - DNA, 20 bp, Homo sapiens
tctttgatcgcctctttgac

SEQ ID NO: 6445442 - DNA, 21 bp, Homo sapiens
tctttgatcgcctctttgaca

SEQ ID NO: 6445443 - DNA, 22 bp, Homo sapiens
tctttgatcgcctctttgacat

SEQ ID NO: 6445444 - DNA, 21 bp, Homo sapiens
tctttgatcgtatatttctca

SEQ ID NO: 6445445 - DNA, 22 bp, Homo sapiens
tctttgatcgtatatttctcat

SEQ ID NO: 6445446 - DNA, 13 bp, Homo sapiens
tctttgatgtgtt

SEQ ID NO: 6445447 - DNA, 21 bp, Homo sapiens
tctttgattatgacagtaaca

SEQ ID NO: 6445448 - DNA, 18 bp, Homo sapiens
tctttgattatttgcatg

SEQ ID NO: 6445449 - DNA, 16 bp, Homo sapiens
tctttgatttgtacca

SEQ ID NO: 6445450 - DNA, 21 bp, Homo sapiens
tctttgcaacaataataaatg

SEQ ID NO: 6445451 - DNA, 13 bp, Homo sapiens
tctttgcaactgt

SEQ ID NO: 6445452 - DNA, 20 bp, Homo sapiens
tctttgcacaatcaataaaa

SEQ ID NO: 6445453 - DNA, 15 bp, Homo sapiens
tctttgcaccaaaga

SEQ ID NO: 6445454 - DNA, 18 bp, Homo sapiens
tctttgcaccaaagacat

SEQ ID NO: 6445455 - DNA, 22 bp, Homo sapiens
tctttgcaccaaagatgtcctg

SEQ ID NO: 6445456 - DNA, 22 bp, Homo sapiens
tctttgcaccagatactcatca

SEQ ID NO: 6445457 - DNA, 20 bp, Homo sapiens
tctttgcactttttcttaat

SEQ ID NO: 6445458 - DNA, 17 bp, Homo sapiens
tctttgcagacaggcaa

SEQ ID NO: 6445459 - DNA, 22 bp, Homo sapiens
tctttgcaggaggcccaacctc

SEQ ID NO: 6445460 - DNA, 13 bp, Homo sapiens
tctttgcagggct

SEQ ID NO: 6445461 - DNA, 12 bp, Homo sapiens
tctttgcagtga

SEQ ID NO: 6445462 - DNA, 13 bp, Homo sapiens
tctttgcagtgaa

SEQ ID NO: 6445463 - DNA, 22 bp, Homo sapiens
tctttgcagtgaagatgtgtaa

SEQ ID NO: 6445464 - DNA, 18 bp, Homo sapiens
tctttgcagttcccatct

SEQ ID NO: 6445465 - DNA, 23 bp, Homo sapiens
tctttgcattccttacttgcact

SEQ ID NO: 6445466 - DNA, 12 bp, Homo sapiens
tctttgccaagt

SEQ ID NO: 6445467 - DNA, 16 bp, Homo sapiens
tctttgccaccctcat

SEQ ID NO: 6445468 - DNA, 21 bp, Homo sapiens
tctttgccagtcattcagcag

SEQ ID NO: 6445469 - DNA, 18 bp, Homo sapiens
tctttgccagtctcattt

SEQ ID NO: 6445470 - DNA, 16 bp, Homo sapiens
tctttgccatctctgc

SEQ ID NO: 6445471 - DNA, 16 bp, Homo sapiens
tctttgccatttcttc

SEQ ID NO: 6445472 - DNA, 11 bp, Homo sapiens
tctttgcctct

SEQ ID NO: 6445473 - DNA, 13 bp, Homo sapiens
tctttgcctctgc

SEQ ID NO: 6445474 - DNA, 12 bp, Homo sapiens
tctttgcctggt

SEQ ID NO: 6445475 - DNA, 15 bp, Homo sapiens
tctttgcctgtgtga

SEQ ID NO: 6445476 - DNA, 14 bp, Homo sapiens
tctttgccttctct

SEQ ID NO: 6445477 - DNA, 18 bp, Homo sapiens
tctttgcgtttccttttt

SEQ ID NO: 6445478 - DNA, 21 bp, Homo sapiens
tctttgctacaataaatgctg

SEQ ID NO: 6445479 - DNA, 20 bp, Homo sapiens
tctttgctcaacagaacata

SEQ ID NO: 6445480 - DNA, 23 bp, Homo sapiens
tctttgctcagtgtccagcttcc

SEQ ID NO: 6445481 - DNA, 13 bp, Homo sapiens
tctttgctccaga

SEQ ID NO: 6445482 - DNA, 14 bp, Homo sapiens
tctttgctgaagaa

SEQ ID NO: 6445483 - DNA, 22 bp, Homo sapiens
tctttgctgcagtcatctactt

SEQ ID NO: 6445484 - DNA, 18 bp, Homo sapiens
tctttgctgcagtcttct

SEQ ID NO: 6445485 - DNA, 17 bp, Homo sapiens
tctttgctgcccctgtc

SEQ ID NO: 6445486 - DNA, 20 bp, Homo sapiens
tctttgctgcccctgtctgg

SEQ ID NO: 6445487 - DNA, 21 bp, Homo sapiens
tctttgctgcccctgtctgga

SEQ ID NO: 6445488 - DNA, 14 bp, Homo sapiens
tctttgctgtaaga

SEQ ID NO: 6445489 - DNA, 14 bp, Homo sapiens
tctttgctgtgcca

SEQ ID NO: 6445490 - DNA, 12 bp, Homo sapiens
tctttgctgtta

SEQ ID NO: 6445491 - DNA, 13 bp, Homo sapiens
tctttgctgttga

SEQ ID NO: 6445492 - DNA, 19 bp, Homo sapiens
tctttgctgtttatatata

SEQ ID NO: 6445493 - DNA, 15 bp, Homo sapiens
tctttgcttccttgc

SEQ ID NO: 6445494 - DNA, 21 bp, Homo sapiens
tctttgcttgaacacagtatt

SEQ ID NO: 6445495 - DNA, 11 bp, Homo sapiens
tctttgctttg

SEQ ID NO: 6445496 - DNA, 13 bp, Homo sapiens
tctttgctttgcc

SEQ ID NO: 6445497 - DNA, 18 bp, Homo sapiens
tctttggaaaaatgtttg

SEQ ID NO: 6445498 - DNA, 19 bp, Homo sapiens
tctttggaaaaatgtttgt

SEQ ID NO: 6445499 - DNA, 15 bp, Homo sapiens
tctttggaaaattca

SEQ ID NO: 6445500 - DNA, 16 bp, Homo sapiens
tctttggaaatagcat

SEQ ID NO: 6445501 - DNA, 20 bp, Homo sapiens
tctttggaatgaaattcctc

SEQ ID NO: 6445502 - DNA, 14 bp, Homo sapiens
tctttggaatgaac

SEQ ID NO: 6445503 - DNA, 15 bp, Homo sapiens
tctttggaccctgag

SEQ ID NO: 6445504 - DNA, 22 bp, Homo sapiens
tctttggactctcccctcttat

SEQ ID NO: 6445505 - DNA, 17 bp, Homo sapiens
tctttggacttctgaag

SEQ ID NO: 6445506 - DNA, 22 bp, Homo sapiens
tctttggagaaatgcttagaaa

SEQ ID NO: 6445507 - DNA, 14 bp, Homo sapiens
tctttggagttaaa

SEQ ID NO: 6445508 - DNA, 22 bp, Homo sapiens
tctttggagttggaatttcatt

SEQ ID NO: 6445509 - DNA, 21 bp, Homo sapiens
tctttggataataggaattca

SEQ ID NO: 6445510 - DNA, 15 bp, Homo sapiens
tctttggattctaaa

SEQ ID NO: 6445511 - DNA, 16 bp, Homo sapiens
tctttggccagaacac

SEQ ID NO: 6445512 - DNA, 20 bp, Homo sapiens
tctttggccccttgctggag

SEQ ID NO: 6445513 - DNA, 12 bp, Homo sapiens
tctttggctgca

SEQ ID NO: 6445514 - DNA, 13 bp, Homo sapiens
tctttggctgcag

SEQ ID NO: 6445515 - DNA, 18 bp, Homo sapiens
tctttgggaatatttgaa

SEQ ID NO: 6445516 - DNA, 18 bp, Homo sapiens
tctttgggaatgtttgtc

SEQ ID NO: 6445517 - DNA, 20 bp, Homo sapiens
tctttgggacacctcagaaa

SEQ ID NO: 6445518 - DNA, 14 bp, Homo sapiens
tctttggggaaact

SEQ ID NO: 6445519 - DNA, 18 bp, Homo sapiens
tctttggggagagctggc

SEQ ID NO: 6445520 - DNA, 21 bp, Homo sapiens
tctttgggggattcaaatgca

SEQ ID NO: 6445521 - DNA, 17 bp, Homo sapiens
tctttgggggtggaaaa

SEQ ID NO: 6445522 - DNA, 21 bp, Homo sapiens
tctttggggtcagccagggcc

SEQ ID NO: 6445523 - DNA, 23 bp, Homo sapiens
tctttggggtctacactgcaatc

SEQ ID NO: 6445524 - DNA, 19 bp, Homo sapiens
tctttgggtacctattttc

SEQ ID NO: 6445525 - DNA, 22 bp, Homo sapiens
tctttggtctacactgtgctga

SEQ ID NO: 6445526 - DNA, 17 bp, Homo sapiens
tctttggtggctttgca

SEQ ID NO: 6445527 - DNA, 19 bp, Homo sapiens
tctttggtgttctggcctc

SEQ ID NO: 6445528 - DNA, 14 bp, Homo sapiens
tctttggttctaag

SEQ ID NO: 6445529 - DNA, 15 bp, Homo sapiens
tctttggttctaagg

SEQ ID NO: 6445530 - DNA, 11 bp, Homo sapiens
tctttgtaaat

SEQ ID NO: 6445531 - DNA, 20 bp, Homo sapiens
tctttgtaagaactaaagaa

SEQ ID NO: 6445532 - DNA, 19 bp, Homo sapiens
tctttgtaagagtgtagaa

SEQ ID NO: 6445533 - DNA, 24 bp, Homo sapiens
tctttgtaagagtgtagaagcatt

SEQ ID NO: 6445534 - DNA, 21 bp, Homo sapiens
tctttgtaagtaaactgccct

SEQ ID NO: 6445535 - DNA, 22 bp, Homo sapiens
tctttgtaagtaaactgccctg

SEQ ID NO: 6445536 - DNA, 12 bp, Homo sapiens
tctttgtaagtc

SEQ ID NO: 6445537 - DNA, 15 bp, Homo sapiens
tctttgtaataaaat

SEQ ID NO: 6445538 - DNA, 23 bp, Homo sapiens
tctttgtaatcgttatgtgtgta

SEQ ID NO: 6445539 - DNA, 16 bp, Homo sapiens
tctttgtaatgaaaac

SEQ ID NO: 6445540 - DNA, 23 bp, Homo sapiens
tctttgtaatgtcaccaccttcc

SEQ ID NO: 6445541 - DNA, 14 bp, Homo sapiens
tctttgtaattatt

SEQ ID NO: 6445542 - DNA, 20 bp, Homo sapiens
tctttgtacagacaacaaac

SEQ ID NO: 6445543 - DNA, 22 bp, Homo sapiens
tctttgtaccacagtttcttct

SEQ ID NO: 6445544 - DNA, 20 bp, Homo sapiens
tctttgtatcttaaatctgt

SEQ ID NO: 6445545 - DNA, 18 bp, Homo sapiens
tctttgtattcttcatga

SEQ ID NO: 6445546 - DNA, 21 bp, Homo sapiens
tctttgtatttattttaatgt

SEQ ID NO: 6445547 - DNA, 11 bp, Homo sapiens
tctttgtcaaa

SEQ ID NO: 6445548 - DNA, 13 bp, Homo sapiens
tctttgtcaaact

SEQ ID NO: 6445549 - DNA, 21 bp, Homo sapiens
tctttgtcagggagtgttccc

SEQ ID NO: 6445550 - DNA, 17 bp, Homo sapiens
tctttgtcattcagttc

SEQ ID NO: 6445551 - DNA, 13 bp, Homo sapiens
tctttgtccctgt

SEQ ID NO: 6445552 - DNA, 15 bp, Homo sapiens
tctttgtctaaaaca

SEQ ID NO: 6445553 - DNA, 19 bp, Homo sapiens
tctttgtctaaaacaataa

SEQ ID NO: 6445554 - DNA, 16 bp, Homo sapiens
tctttgtctaaacaag

SEQ ID NO: 6445555 - DNA, 18 bp, Homo sapiens
tctttgtctaaacaaggt

SEQ ID NO: 6445556 - DNA, 17 bp, Homo sapiens
tctttgtctacaccatt

SEQ ID NO: 6445557 - DNA, 18 bp, Homo sapiens
tctttgtctcaccagctc

SEQ ID NO: 6445558 - DNA, 20 bp, Homo sapiens
tctttgtcttatctggccct

SEQ ID NO: 6445559 - DNA, 14 bp, Homo sapiens
tctttgtctttttc

SEQ ID NO: 6445560 - DNA, 12 bp, Homo sapiens
tctttgtgaaat

SEQ ID NO: 6445561 - DNA, 16 bp, Homo sapiens
tctttgtgaacattct

SEQ ID NO: 6445562 - DNA, 11 bp, Homo sapiens
tctttgtgaag

SEQ ID NO: 6445563 - DNA, 22 bp, Homo sapiens
tctttgtgacaggaaagccctc

SEQ ID NO: 6445564 - DNA, 19 bp, Homo sapiens
tctttgtgataacaaagag

SEQ ID NO: 6445565 - DNA, 14 bp, Homo sapiens
tctttgtgataatt

SEQ ID NO: 6445566 - DNA, 23 bp, Homo sapiens
tctttgtgataatttaagagcta

SEQ ID NO: 6445567 - DNA, 14 bp, Homo sapiens
tctttgtgcctgag

SEQ ID NO: 6445568 - DNA, 22 bp, Homo sapiens
tctttgtgcctgagtggcctgt

SEQ ID NO: 6445569 - DNA, 14 bp, Homo sapiens
tctttgtgcctttg

SEQ ID NO: 6445570 - DNA, 17 bp, Homo sapiens
tctttgtggactgtggg

SEQ ID NO: 6445571 - DNA, 19 bp, Homo sapiens
tctttgtgggagggtaaga

SEQ ID NO: 6445572 - DNA, 21 bp, Homo sapiens
tctttgtgggagggtaagaca

SEQ ID NO: 6445573 - DNA, 16 bp, Homo sapiens
tctttgtggggaagag

SEQ ID NO: 6445574 - DNA, 22 bp, Homo sapiens
tctttgtggggcttggcgtgga

SEQ ID NO: 6445575 - DNA, 12 bp, Homo sapiens
tctttgtgtatg

SEQ ID NO: 6445576 - DNA, 13 bp, Homo sapiens
tctttgtgtatgg

SEQ ID NO: 6445577 - DNA, 14 bp, Homo sapiens
tctttgttaaaata

SEQ ID NO: 6445578 - DNA, 21 bp, Homo sapiens
tctttgttatcaaacttcagc

SEQ ID NO: 6445579 - DNA, 14 bp, Homo sapiens
tctttgttcaagat

SEQ ID NO: 6445580 - DNA, 19 bp, Homo sapiens
tctttgttcagttgactta

SEQ ID NO: 6445581 - DNA, 23 bp, Homo sapiens
tctttgttcatagcccagtagac

SEQ ID NO: 6445582 - DNA, 13 bp, Homo sapiens
tctttgttcatca

SEQ ID NO: 6445583 - DNA, 17 bp, Homo sapiens
tctttgttccactggaa

SEQ ID NO: 6445584 - DNA, 17 bp, Homo sapiens
tctttgttcctgctttc

SEQ ID NO: 6445585 - DNA, 17 bp, Homo sapiens
tctttgttctcagctcc

SEQ ID NO: 6445586 - DNA, 14 bp, Homo sapiens
tctttgttctgttt

SEQ ID NO: 6445587 - DNA, 19 bp, Homo sapiens
tctttgttcttcaatgtga

SEQ ID NO: 6445588 - DNA, 14 bp, Homo sapiens
tctttgttgcttaa

SEQ ID NO: 6445589 - DNA, 19 bp, Homo sapiens
tctttgttggctcagaaaa

SEQ ID NO: 6445590 - DNA, 15 bp, Homo sapiens
tctttgtttaaatgc

SEQ ID NO: 6445591 - DNA, 14 bp, Homo sapiens
tctttgtttaacaa

SEQ ID NO: 6445592 - DNA, 13 bp, Homo sapiens
tccagctgtgcag

SEQ ID NO: 6445593 - DNA, 22 bp, Homo sapiens
tccagctgttacctgagatact

SEQ ID NO: 6445594 - DNA, 17 bp, Homo sapiens
tccagctgttcagctgg

SEQ ID NO: 6445595 - DNA, 23 bp, Homo sapiens
tccagcttcaggcaccagcatcc

SEQ ID NO: 6445596 - DNA, 14 bp, Homo sapiens
tccagcttccaaag

SEQ ID NO: 6445597 - DNA, 17 bp, Homo sapiens
tccagcttcctctgagc

SEQ ID NO: 6445598 - DNA, 19 bp, Homo sapiens
tccagcttcctctgagccg

SEQ ID NO: 6445599 - DNA, 23 bp, Homo sapiens
tccagcttcggagggcccctgcg

SEQ ID NO: 6445600 - DNA, 15 bp, Homo sapiens
tccagcttctcttga

SEQ ID NO: 6445601 - DNA, 19 bp, Homo sapiens
tccagcttctggtactctc

SEQ ID NO: 6445602 - DNA, 21 bp, Homo sapiens
tccagcttctggtactctcct

SEQ ID NO: 6445603 - DNA, 23 bp, Homo sapiens
tccagcttgccagatgctgcaga

SEQ ID NO: 6445604 - DNA, 17 bp, Homo sapiens
tccagcttgcctgtttc

SEQ ID NO: 6445605 - DNA, 17 bp, Homo sapiens
tccagcttgtggagccc

SEQ ID NO: 6445606 - DNA, 16 bp, Homo sapiens
tccagctttactgtgg

SEQ ID NO: 6445607 - DNA, 13 bp, Homo sapiens
tccagctttcccc

SEQ ID NO: 6445608 - DNA, 15 bp, Homo sapiens
tccagctttccttct

SEQ ID NO: 6445609 - DNA, 19 bp, Homo sapiens
tccagctttccttctgccc

SEQ ID NO: 6445610 - DNA, 13 bp, Homo sapiens
tccagctttctct

SEQ ID NO: 6445611 - DNA, 18 bp, Homo sapiens
tccagctttctctttgtt

SEQ ID NO: 6445612 - DNA, 22 bp, Homo sapiens
tccagctttctctttgttcttc

SEQ ID NO: 6445613 - DNA, 17 bp, Homo sapiens
tccagcttttcctcagg

SEQ ID NO: 6445614 - DNA, 13 bp, Homo sapiens
tccaggaaaaaat

SEQ ID NO: 6445615 - DNA, 15 bp, Homo sapiens
tccaggaaaaaataa

SEQ ID NO: 6445616 - DNA, 20 bp, Homo sapiens
tccaggaaaaaataaaaaga

SEQ ID NO: 6445617 - DNA, 16 bp, Homo sapiens
tccaggaaaaaggaca

SEQ ID NO: 6445618 - DNA, 17 bp, Homo sapiens
tccaggaaaaaggacag

SEQ ID NO: 6445619 - DNA, 15 bp, Homo sapiens
tccaggaaaactgtt

SEQ ID NO: 6445620 - DNA, 23 bp, Homo sapiens
tccaggaaactccacatctgcct

SEQ ID NO: 6445621 - DNA, 22 bp, Homo sapiens
tccaggaaagtggccaagaagc

SEQ ID NO: 6445622 - DNA, 13 bp, Homo sapiens
tccaggaaagtgt

SEQ ID NO: 6445623 - DNA, 23 bp, Homo sapiens
tccaggaacacatgcacacacac

SEQ ID NO: 6445624 - DNA, 16 bp, Homo sapiens
tccaggaactgcctgg

SEQ ID NO: 6445625 - DNA, 14 bp, Homo sapiens
tccaggaagcacag

SEQ ID NO: 6445626 - DNA, 10 bp, Homo sapiens
tccaggaagt

SEQ ID NO: 6445627 - DNA, 16 bp, Homo sapiens
tccaggaataggcatt

SEQ ID NO: 6445628 - DNA, 22 bp, Homo sapiens
tccaggaatgcctcctccctgg

SEQ ID NO: 6445629 - DNA, 16 bp, Homo sapiens
tccaggaatgctgggc

SEQ ID NO: 6445630 - DNA, 23 bp, Homo sapiens
tccaggaccttgcttccttctca

SEQ ID NO: 6445631 - DNA, 16 bp, Homo sapiens
tccaggacgaggagga

SEQ ID NO: 6445632 - DNA, 20 bp, Homo sapiens
tccaggactatatttgggcc

SEQ ID NO: 6445633 - DNA, 18 bp, Homo sapiens
tccaggactccactggac

SEQ ID NO: 6445634 - DNA, 20 bp, Homo sapiens
tccaggactccactggacag

SEQ ID NO: 6445635 - DNA, 15 bp, Homo sapiens
tccaggactgggtct

SEQ ID NO: 6445636 - DNA, 22 bp, Homo sapiens
tccaggactgggtctgacctgg

SEQ ID NO: 6445637 - DNA, 19 bp, Homo sapiens
tccaggactgtttcaaaca

SEQ ID NO: 6445638 - DNA, 12 bp, Homo sapiens
tccaggagaagg

SEQ ID NO: 6445639 - DNA, 16 bp, Homo sapiens
tccaggagaaggccaa

SEQ ID NO: 6445640 - DNA, 20 bp, Homo sapiens
tccaggagaaggggcccaag

SEQ ID NO: 6445641 - DNA, 22 bp, Homo sapiens
tccaggagaagtgctccctgga

SEQ ID NO: 6445642 - DNA, 18 bp, Homo sapiens
tccaggagaccttccaca

SEQ ID NO: 6445643 - DNA, 17 bp, Homo sapiens
tccaggagagagccagg

SEQ ID NO: 6445644 - DNA, 23 bp, Homo sapiens
tccaggagattggatttgctgtg

SEQ ID NO: 6445645 - DNA, 21 bp, Homo sapiens
tccaggagcacacggccctgc

SEQ ID NO: 6445646 - DNA, 14 bp, Homo sapiens
tccaggagcagcca

SEQ ID NO: 6445647 - DNA, 18 bp, Homo sapiens
tccaggagcagccacatt

SEQ ID NO: 6445648 - DNA, 16 bp, Homo sapiens
tccaggagcagcgtgc

SEQ ID NO: 6445649 - DNA, 21 bp, Homo sapiens
tccaggagcatagaagccaca

SEQ ID NO: 6445650 - DNA, 23 bp, Homo sapiens
tccaggagcatagaagccacatc

SEQ ID NO: 6445651 - DNA, 14 bp, Homo sapiens
tccaggagcccaga

SEQ ID NO: 6445652 - DNA, 13 bp, Homo sapiens
tccaggagcccca

SEQ ID NO: 6445653 - DNA, 13 bp, Homo sapiens
tccaggagcctca

SEQ ID NO: 6445654 - DNA, 14 bp, Homo sapiens
tccaggagcctggc

SEQ ID NO: 6445655 - DNA, 23 bp, Homo sapiens
tccaggagcctggctccgtccag

SEQ ID NO: 6445656 - DNA, 18 bp, Homo sapiens
tccaggagcctgtgcctc

SEQ ID NO: 6445657 - DNA, 15 bp, Homo sapiens
tccaggagctcagga

SEQ ID NO: 6445658 - DNA, 21 bp, Homo sapiens
tccaggagctcaggaagaaga

SEQ ID NO: 6445659 - DNA, 17 bp, Homo sapiens
tccaggagctccagtgt

SEQ ID NO: 6445660 - DNA, 20 bp, Homo sapiens
tccaggagctccagtgtcct

SEQ ID NO: 6445661 - DNA, 21 bp, Homo sapiens
tccaggagctccagtgtcctg

SEQ ID NO: 6445662 - DNA, 22 bp, Homo sapiens
tccaggagctccagtgtcctga

SEQ ID NO: 6445663 - DNA, 16 bp, Homo sapiens
tccaggagcttcttgt

SEQ ID NO: 6445664 - DNA, 20 bp, Homo sapiens
tccaggaggagttagccaaa

SEQ ID NO: 6445665 - DNA, 21 bp, Homo sapiens
tccaggaggagttagccaaac

SEQ ID NO: 6445666 - DNA, 19 bp, Homo sapiens
tccaggagggaccaccctc

SEQ ID NO: 6445667 - DNA, 21 bp, Homo sapiens
tccaggagggaccaccctccc

SEQ ID NO: 6445668 - DNA, 13 bp, Homo sapiens
tccaggagggctt

SEQ ID NO: 6445669 - DNA, 16 bp, Homo sapiens
tccaggatcaggggtt

SEQ ID NO: 6445670 - DNA, 15 bp, Homo sapiens
tccaggatccagaag

SEQ ID NO: 6445671 - DNA, 16 bp, Homo sapiens
tccaggatcctcctgg

SEQ ID NO: 6445672 - DNA, 19 bp, Homo sapiens
tccaggatcctcctggagc

SEQ ID NO: 6445673 - DNA, 23 bp, Homo sapiens
tccaggatcctcctggagcagca

SEQ ID NO: 6445674 - DNA, 17 bp, Homo sapiens
tccaggatcctgcagga

SEQ ID NO: 6445675 - DNA, 19 bp, Homo sapiens
tccaggatcctgcaggaac

SEQ ID NO: 6445676 - DNA, 22 bp, Homo sapiens
tccaggatgctaacatctaaaa

SEQ ID NO: 6445677 - DNA, 21 bp, Homo sapiens
tccaggatggaattcttcctc

SEQ ID NO: 6445678 - DNA, 19 bp, Homo sapiens
tccaggatggggaggggct

SEQ ID NO: 6445679 - DNA, 22 bp, Homo sapiens
tccaggatggggaggggctctg

SEQ ID NO: 6445680 - DNA, 20 bp, Homo sapiens
tccaggatgttattcttcct

SEQ ID NO: 6445681 - DNA, 15 bp, Homo sapiens
tccaggattccaaag

SEQ ID NO: 6445682 - DNA, 18 bp, Homo sapiens
tccaggattcctcttttc

SEQ ID NO: 6445683 - DNA, 22 bp, Homo sapiens
tccaggattcctcttttctctg

SEQ ID NO: 6445684 - DNA, 16 bp, Homo sapiens
tccaggattgtccaca

SEQ ID NO: 6445685 - DNA, 17 bp, Homo sapiens
tccaggattgtccacaa

SEQ ID NO: 6445686 - DNA, 16 bp, Homo sapiens
tccaggattttaattt

SEQ ID NO: 6445687 - DNA, 23 bp, Homo sapiens
tccaggcaatcgttctgctggcc

SEQ ID NO: 6445688 - DNA, 12 bp, Homo sapiens
tccaggcacagg

SEQ ID NO: 6445689 - DNA, 13 bp, Homo sapiens
tccaggcaccagg

SEQ ID NO: 6445690 - DNA, 21 bp, Homo sapiens
tccaggcaccaggactagggc

SEQ ID NO: 6445691 - DNA, 22 bp, Homo sapiens
tccaggcaccctcagggagcct

SEQ ID NO: 6445692 - DNA, 16 bp, Homo sapiens
tccaggcacccttctt

SEQ ID NO: 6445693 - DNA, 20 bp, Homo sapiens
tccaggcacccttctttcct

SEQ ID NO: 6445694 - DNA, 13 bp, Homo sapiens
tccaggcaccgcc

SEQ ID NO: 6445695 - DNA, 22 bp, Homo sapiens
tccaggcaccgcctgcccccag

SEQ ID NO: 6445696 - DNA, 23 bp, Homo sapiens
tccaggcaccgcctgcccccagc

SEQ ID NO: 6445697 - DNA, 17 bp, Homo sapiens
tccaggcacgtcccgga

SEQ ID NO: 6445698 - DNA, 17 bp, Homo sapiens
tccaggcagaaggagag

SEQ ID NO: 6445699 - DNA, 19 bp, Homo sapiens
tccaggcagatccaggact

SEQ ID NO: 6445700 - DNA, 12 bp, Homo sapiens
tccaggcagcac

SEQ ID NO: 6445701 - DNA, 12 bp, Homo sapiens
tccaggcaggag

SEQ ID NO: 6445702 - DNA, 13 bp, Homo sapiens
tccaggcaggagg

SEQ ID NO: 6445703 - DNA, 22 bp, Homo sapiens
tccaggcaggaggatcacttgg

SEQ ID NO: 6445704 - DNA, 14 bp, Homo sapiens
tccaggcaggctaa

SEQ ID NO: 6445705 - DNA, 23 bp, Homo sapiens
tccaggcagtcgggggctggcct

SEQ ID NO: 6445706 - DNA, 19 bp, Homo sapiens
tccaggcatgctggcctcc

SEQ ID NO: 6445707 - DNA, 22 bp, Homo sapiens
tccaggcatgtgtctggcccta

SEQ ID NO: 6445708 - DNA, 23 bp, Homo sapiens
tccaggccaggcctcatcctcct

SEQ ID NO: 6445709 - DNA, 16 bp, Homo sapiens
tccaggccagggggcc

SEQ ID NO: 6445710 - DNA, 18 bp, Homo sapiens
tccaggccagggggccag

SEQ ID NO: 6445711 - DNA, 20 bp, Homo sapiens
tccaggccagtgggcctggt

SEQ ID NO: 6445712 - DNA, 21 bp, Homo sapiens
tccaggccagtgggcctggta

SEQ ID NO: 6445713 - DNA, 16 bp, Homo sapiens
tccaggccatgatggc

SEQ ID NO: 6445714 - DNA, 11 bp, Homo sapiens
tccaggcccaa

SEQ ID NO: 6445715 - DNA, 14 bp, Homo sapiens
tccaggcccatctc

SEQ ID NO: 6445716 - DNA, 20 bp, Homo sapiens
tccaggccccaccggccagg

SEQ ID NO: 6445717 - DNA, 13 bp, Homo sapiens
tccaggccccagg

SEQ ID NO: 6445718 - DNA, 23 bp, Homo sapiens
tccaggccccaggctggatgctg

SEQ ID NO: 6445719 - DNA, 23 bp, Homo sapiens
tccaggcccccaacccctcctcc

SEQ ID NO: 6445720 - DNA, 14 bp, Homo sapiens
tccaggcccccagc

SEQ ID NO: 6445721 - DNA, 19 bp, Homo sapiens
tccaggcccggtgaggcca

SEQ ID NO: 6445722 - DNA, 15 bp, Homo sapiens
tccaggcccgtctgt

SEQ ID NO: 6445723 - DNA, 16 bp, Homo sapiens
tccaggccctccagtg

SEQ ID NO: 6445724 - DNA, 16 bp, Homo sapiens
tccaggccctgccccc

SEQ ID NO: 6445725 - DNA, 20 bp, Homo sapiens
tccaggccgcgccctttccc

SEQ ID NO: 6445726 - DNA, 21 bp, Homo sapiens
tccaggccgcgccctttcccc

SEQ ID NO: 6445727 - DNA, 16 bp, Homo sapiens
tccaggcctactcctg

SEQ ID NO: 6445728 - DNA, 20 bp, Homo sapiens
tccaggcctctctctgctcc

SEQ ID NO: 6445729 - DNA, 21 bp, Homo sapiens
tccaggcctctctctgctcca

SEQ ID NO: 6445730 - DNA, 14 bp, Homo sapiens
tccaggcctgacca

SEQ ID NO: 6445731 - DNA, 16 bp, Homo sapiens
tccaggcctgaggctg

SEQ ID NO: 6445732 - DNA, 13 bp, Homo sapiens
tccaggcctgcag

SEQ ID NO: 6445733 - DNA, 20 bp, Homo sapiens
tccaggcctgcagcaggagt

SEQ ID NO: 6445734 - DNA, 13 bp, Homo sapiens
tccaggcctgcct

SEQ ID NO: 6445735 - DNA, 19 bp, Homo sapiens
tccaggcctgcctcccact

SEQ ID NO: 6445736 - DNA, 16 bp, Homo sapiens
tccaggcctgggtcac

SEQ ID NO: 6445737 - DNA, 19 bp, Homo sapiens
tccaggcgatgtgcaagtg

SEQ ID NO: 6445738 - DNA, 22 bp, Homo sapiens
tccaggcgcgccgacgcctgtg

SEQ ID NO: 6445739 - DNA, 17 bp, Homo sapiens
tccaggcgtagggccag

SEQ ID NO: 6445740 - DNA, 19 bp, Homo sapiens
tccaggcgtagggccaggg

SEQ ID NO: 6445741 - DNA, 19 bp, Homo sapiens
tccaggctatgtataaaat

SEQ ID NO: 6445742 - DNA, 20 bp, Homo sapiens
tccaggctatgtataaaata

SEQ ID NO: 6445743 - DNA, 22 bp, Homo sapiens
tccaggctcacctttagaacag

SEQ ID NO: 6445744 - DNA, 13 bp, Homo sapiens
tccaggctccctc

SEQ ID NO: 6445745 - DNA, 23 bp, Homo sapiens
tccaggctccctccctcccagat

SEQ ID NO: 6445746 - DNA, 22 bp, Homo sapiens
tccaggctctgggcacagtgct

SEQ ID NO: 6445747 - DNA, 19 bp, Homo sapiens
tccaggctcttcctggacc

SEQ ID NO: 6445748 - DNA, 20 bp, Homo sapiens
tccaggctcttcctggacct

SEQ ID NO: 6445749 - DNA, 23 bp, Homo sapiens
tccaggctctttggggtcagcca

SEQ ID NO: 6445750 - DNA, 18 bp, Homo sapiens
tccaggctgactgggggc

SEQ ID NO: 6445751 - DNA, 15 bp, Homo sapiens
tccaggctgagagcc

SEQ ID NO: 6445752 - DNA, 15 bp, Homo sapiens
tccaggctgagccat

SEQ ID NO: 6445753 - DNA, 19 bp, Homo sapiens
tccaggctgagccatgagg

SEQ ID NO: 6445754 - DNA, 13 bp, Homo sapiens
tccaggctggcca

SEQ ID NO: 6445755 - DNA, 18 bp, Homo sapiens
tccaggctgggagagcct

SEQ ID NO: 6445756 - DNA, 13 bp, Homo sapiens
tccaggctggggc

SEQ ID NO: 6445757 - DNA, 14 bp, Homo sapiens
tccaggctgtatcc

SEQ ID NO: 6445758 - DNA, 20 bp, Homo sapiens
tccaggctgtctttcactga

SEQ ID NO: 6445759 - DNA, 13 bp, Homo sapiens
tccaggctgtgtg

SEQ ID NO: 6445760 - DNA, 14 bp, Homo sapiens
tccaggctgttctc

SEQ ID NO: 6445761 - DNA, 15 bp, Homo sapiens
tccaggctgtttctt

SEQ ID NO: 6445762 - DNA, 13 bp, Homo sapiens
tccaggcttcaca

SEQ ID NO: 6445763 - DNA, 17 bp, Homo sapiens
tccaggcttcacagtct

SEQ ID NO: 6445764 - DNA, 19 bp, Homo sapiens
tccaggcttcacagtctgg

SEQ ID NO: 6445765 - DNA, 23 bp, Homo sapiens
tccaggcttcacagtctggtgct

SEQ ID NO: 6445766 - DNA, 19 bp, Homo sapiens
tccaggcttccacacttct

SEQ ID NO: 6445767 - DNA, 18 bp, Homo sapiens
tccaggcttcctgcccta

SEQ ID NO: 6445768 - DNA, 16 bp, Homo sapiens
tccaggcttctcccgg

SEQ ID NO: 6445769 - DNA, 15 bp, Homo sapiens
tctttgtttacatga

SEQ ID NO: 6445770 - DNA, 20 bp, Homo sapiens
tctttgtttccagcttgcat

SEQ ID NO: 6445771 - DNA, 15 bp, Homo sapiens
tctttgtttctttct

SEQ ID NO: 6445772 - DNA, 23 bp, Homo sapiens
tctttgtttctttttacagcatt

SEQ ID NO: 6445773 - DNA, 16 bp, Homo sapiens
tctttgttttatttag

SEQ ID NO: 6445774 - DNA, 16 bp, Homo sapiens
tctttgttttgtgtct

SEQ ID NO: 6445775 - DNA, 21 bp, Homo sapiens
tcttttaaaaaattcttgtat

SEQ ID NO: 6445776 - DNA, 13 bp, Homo sapiens
tcttttaaaaatg

SEQ ID NO: 6445777 - DNA, 15 bp, Homo sapiens
tcttttaaaaatgat

SEQ ID NO: 6445778 - DNA, 19 bp, Homo sapiens
tcttttaaaaattcaaatg

SEQ ID NO: 6445779 - DNA, 13 bp, Homo sapiens
tcttttaaaagac

SEQ ID NO: 6445780 - DNA, 16 bp, Homo sapiens
tcttttaaaagacaag

SEQ ID NO: 6445781 - DNA, 18 bp, Homo sapiens
tcttttaaaatatcctgt

SEQ ID NO: 6445782 - DNA, 11 bp, Homo sapiens
tcttttaaact

SEQ ID NO: 6445783 - DNA, 18 bp, Homo sapiens
tcttttaaagaccctcct

SEQ ID NO: 6445784 - DNA, 23 bp, Homo sapiens
tcttttaaatatttgtgactctt

SEQ ID NO: 6445785 - DNA, 20 bp, Homo sapiens
tcttttaaattagaaaatat

SEQ ID NO: 6445786 - DNA, 21 bp, Homo sapiens
tcttttaaattagaaaatatt

SEQ ID NO: 6445787 - DNA, 12 bp, Homo sapiens
tcttttaactgc

SEQ ID NO: 6445788 - DNA, 18 bp, Homo sapiens
tcttttaagatcttgtta

SEQ ID NO: 6445789 - DNA, 11 bp, Homo sapiens
tcttttaagca

SEQ ID NO: 6445790 - DNA, 23 bp, Homo sapiens
tcttttaagcatttgtatattaa

SEQ ID NO: 6445791 - DNA, 17 bp, Homo sapiens
tcttttaagccctgctc

SEQ ID NO: 6445792 - DNA, 19 bp, Homo sapiens
tcttttaataaaaaggaaa

SEQ ID NO: 6445793 - DNA, 19 bp, Homo sapiens
tcttttaatcatgagcctg

SEQ ID NO: 6445794 - DNA, 20 bp, Homo sapiens
tcttttaatcatgagcctgt

SEQ ID NO: 6445795 - DNA, 21 bp, Homo sapiens
tcttttaattgaaattaactt

SEQ ID NO: 6445796 - DNA, 12 bp, Homo sapiens
tcttttacaact

SEQ ID NO: 6445797 - DNA, 13 bp, Homo sapiens
tcttttacagact

SEQ ID NO: 6445798 - DNA, 14 bp, Homo sapiens
tcttttacattctg

SEQ ID NO: 6445799 - DNA, 21 bp, Homo sapiens
tcttttaccccacgaagacat

SEQ ID NO: 6445800 - DNA, 13 bp, Homo sapiens
tcttttaccctgg

SEQ ID NO: 6445801 - DNA, 17 bp, Homo sapiens
tcttttaccctgtgtca

SEQ ID NO: 6445802 - DNA, 13 bp, Homo sapiens
tcttttacctgct

SEQ ID NO: 6445803 - DNA, 15 bp, Homo sapiens
tcttttactaagaca

SEQ ID NO: 6445804 - DNA, 16 bp, Homo sapiens
tcttttactctgtgta

SEQ ID NO: 6445805 - DNA, 12 bp, Homo sapiens
tcttttactgtg

SEQ ID NO: 6445806 - DNA, 16 bp, Homo sapiens
tcttttagacacatta

SEQ ID NO: 6445807 - DNA, 15 bp, Homo sapiens
tcttttagagtaaac

SEQ ID NO: 6445808 - DNA, 17 bp, Homo sapiens
tcttttaggggaagtga

SEQ ID NO: 6445809 - DNA, 15 bp, Homo sapiens
tcttttagtcagaaa

SEQ ID NO: 6445810 - DNA, 18 bp, Homo sapiens
tcttttagtcattttgct

SEQ ID NO: 6445811 - DNA, 16 bp, Homo sapiens
tcttttagttttagtt

SEQ ID NO: 6445812 - DNA, 15 bp, Homo sapiens
tcttttataataatg

SEQ ID NO: 6445813 - DNA, 11 bp, Homo sapiens
tcttttatagg

SEQ ID NO: 6445814 - DNA, 20 bp, Homo sapiens
tcttttatagtggaaaaaca

SEQ ID NO: 6445815 - DNA, 13 bp, Homo sapiens
tcttttatatata

SEQ ID NO: 6445816 - DNA, 17 bp, Homo sapiens
tcttttatatataaaat

SEQ ID NO: 6445817 - DNA, 20 bp, Homo sapiens
tcttttatatataaaataaa

SEQ ID NO: 6445818 - DNA, 21 bp, Homo sapiens
tcttttatatataaaataaat

SEQ ID NO: 6445819 - DNA, 15 bp, Homo sapiens
tcttttatatctgta

SEQ ID NO: 6445820 - DNA, 19 bp, Homo sapiens
tcttttatatctgtaaatt

SEQ ID NO: 6445821 - DNA, 23 bp, Homo sapiens
tcttttatatctgtaaatttaac

SEQ ID NO: 6445822 - DNA, 14 bp, Homo sapiens
tcttttatcctggg

SEQ ID NO: 6445823 - DNA, 12 bp, Homo sapiens
tcttttatctgt

SEQ ID NO: 6445824 - DNA, 16 bp, Homo sapiens
tcttttattatcagtt

SEQ ID NO: 6445825 - DNA, 12 bp, Homo sapiens
tcttttattctt

SEQ ID NO: 6445826 - DNA, 15 bp, Homo sapiens
tcttttatttaacaa

SEQ ID NO: 6445827 - DNA, 16 bp, Homo sapiens
tcttttatttaacaaa

SEQ ID NO: 6445828 - DNA, 22 bp, Homo sapiens
tcttttatttagggccttttct

SEQ ID NO: 6445829 - DNA, 14 bp, Homo sapiens
tcttttatttcatt

SEQ ID NO: 6445830 - DNA, 16 bp, Homo sapiens
tcttttattttggaac

SEQ ID NO: 6445831 - DNA, 17 bp, Homo sapiens
tcttttcaaataatgct

SEQ ID NO: 6445832 - DNA, 14 bp, Homo sapiens
tcttttcacaaata

SEQ ID NO: 6445833 - DNA, 16 bp, Homo sapiens
tcttttcacattctta

SEQ ID NO: 6445834 - DNA, 22 bp, Homo sapiens
tcttttcagaagcaagccagac

SEQ ID NO: 6445835 - DNA, 20 bp, Homo sapiens
tcttttcagatcatggcatc

SEQ ID NO: 6445836 - DNA, 16 bp, Homo sapiens
tcttttcagcttgttt

SEQ ID NO: 6445837 - DNA, 19 bp, Homo sapiens
tcttttcagcttgtttcta

SEQ ID NO: 6445838 - DNA, 24 bp, Homo sapiens
tcttttcagcttgtttctatactg

SEQ ID NO: 6445839 - DNA, 13 bp, Homo sapiens
tcttttcatacat

SEQ ID NO: 6445840 - DNA, 23 bp, Homo sapiens
tcttttcatacattttctaagaa

SEQ ID NO: 6445841 - DNA, 19 bp, Homo sapiens
tcttttcatctgggaaaga

SEQ ID NO: 6445842 - DNA, 22 bp, Homo sapiens
tcttttccaaaataaaacaaag

SEQ ID NO: 6445843 - DNA, 15 bp, Homo sapiens
tcttttccacaaata

SEQ ID NO: 6445844 - DNA, 15 bp, Homo sapiens
tcttttccatcctga

SEQ ID NO: 6445845 - DNA, 19 bp, Homo sapiens
tcttttcccactgtttaag

SEQ ID NO: 6445846 - DNA, 19 bp, Homo sapiens
tcttttcccccattaatca

SEQ ID NO: 6445847 - DNA, 15 bp, Homo sapiens
tcttttcccctcatt

SEQ ID NO: 6445848 - DNA, 15 bp, Homo sapiens
tcttttccctctcta

SEQ ID NO: 6445849 - DNA, 22 bp, Homo sapiens
tcttttcctcgcagatgataaa

SEQ ID NO: 6445850 - DNA, 17 bp, Homo sapiens
tcttttcctctctgtct

SEQ ID NO: 6445851 - DNA, 13 bp, Homo sapiens
tcttttcctgctc

SEQ ID NO: 6445852 - DNA, 22 bp, Homo sapiens
tcttttcctgggaatggaataa

SEQ ID NO: 6445853 - DNA, 18 bp, Homo sapiens
tcttttcctgggtgctca

SEQ ID NO: 6445854 - DNA, 22 bp, Homo sapiens
tcttttcctgtttttgttaact

SEQ ID NO: 6445855 - DNA, 11 bp, Homo sapiens
tcttttccttt

SEQ ID NO: 6445856 - DNA, 22 bp, Homo sapiens
tcttttcgccgtggctgcggca

SEQ ID NO: 6445857 - DNA, 19 bp, Homo sapiens
tcttttctaaatgttatta

SEQ ID NO: 6445858 - DNA, 17 bp, Homo sapiens
tcttttctacacattga

SEQ ID NO: 6445859 - DNA, 16 bp, Homo sapiens
tcttttctacagcaaa

SEQ ID NO: 6445860 - DNA, 19 bp, Homo sapiens
tcttttctacagcaaattt

SEQ ID NO: 6445861 - DNA, 12 bp, Homo sapiens
tcttttctaccc

SEQ ID NO: 6445862 - DNA, 14 bp, Homo sapiens
tcttttctagtttg

SEQ ID NO: 6445863 - DNA, 13 bp, Homo sapiens
tcttttctattta

SEQ ID NO: 6445864 - DNA, 15 bp, Homo sapiens
tcttttctcatgtgt

SEQ ID NO: 6445865 - DNA, 13 bp, Homo sapiens
tcttttctcctcc

SEQ ID NO: 6445866 - DNA, 14 bp, Homo sapiens
tcttttctcctccg

SEQ ID NO: 6445867 - DNA, 12 bp, Homo sapiens
tcttttctctac

SEQ ID NO: 6445868 - DNA, 13 bp, Homo sapiens
tcttttctctgaa

SEQ ID NO: 6445869 - DNA, 14 bp, Homo sapiens
tcttttctctgaaa

SEQ ID NO: 6445870 - DNA, 17 bp, Homo sapiens
tcttttctctgtgcttc

SEQ ID NO: 6445871 - DNA, 13 bp, Homo sapiens
tcttttctcttct

SEQ ID NO: 6445872 - DNA, 16 bp, Homo sapiens
tcttttctctttttag

SEQ ID NO: 6445873 - DNA, 13 bp, Homo sapiens
tcttttctgctga

SEQ ID NO: 6445874 - DNA, 19 bp, Homo sapiens
tcttttctggaatgtaatc

SEQ ID NO: 6445875 - DNA, 23 bp, Homo sapiens
tcttttctgggatgtggtattgg

SEQ ID NO: 6445876 - DNA, 19 bp, Homo sapiens
tcttttctggtaggttctg

SEQ ID NO: 6445877 - DNA, 12 bp, Homo sapiens
tcttttcttatt

SEQ ID NO: 6445878 - DNA, 15 bp, Homo sapiens
tcttttcttcctggc

SEQ ID NO: 6445879 - DNA, 12 bp, Homo sapiens
tcttttcttggc

SEQ ID NO: 6445880 - DNA, 15 bp, Homo sapiens
tcttttcttggcaaa

SEQ ID NO: 6445881 - DNA, 13 bp, Homo sapiens
tcttttctttaga

SEQ ID NO: 6445882 - DNA, 15 bp, Homo sapiens
tcttttctttagaga

SEQ ID NO: 6445883 - DNA, 17 bp, Homo sapiens
tcttttctttagagaac

SEQ ID NO: 6445884 - DNA, 21 bp, Homo sapiens
tcttttctttagagaactgaa

SEQ ID NO: 6445885 - DNA, 13 bp, Homo sapiens
tcttttctttgta

SEQ ID NO: 6445886 - DNA, 20 bp, Homo sapiens
tcttttctttgtatcattca

SEQ ID NO: 6445887 - DNA, 17 bp, Homo sapiens
tcttttctttttacata

SEQ ID NO: 6445888 - DNA, 20 bp, Homo sapiens
tcttttgaataatgtagtgc

SEQ ID NO: 6445889 - DNA, 22 bp, Homo sapiens
tcttttgaatgttaagaataac

SEQ ID NO: 6445890 - DNA, 14 bp, Homo sapiens
tcttttgaattgtt

SEQ ID NO: 6445891 - DNA, 18 bp, Homo sapiens
tcttttgaattgttacat

SEQ ID NO: 6445892 - DNA, 15 bp, Homo sapiens
tcttttgaattgttt

SEQ ID NO: 6445893 - DNA, 15 bp, Homo sapiens
tcttttgacatgtgg

SEQ ID NO: 6445894 - DNA, 20 bp, Homo sapiens
tcttttgacatgtggaaagt

SEQ ID NO: 6445895 - DNA, 18 bp, Homo sapiens
tcttttgaccccttcctg

SEQ ID NO: 6445896 - DNA, 22 bp, Homo sapiens
tcttttgaggatgggatgtatt

SEQ ID NO: 6445897 - DNA, 12 bp, Homo sapiens
tcttttgataca

SEQ ID NO: 6445898 - DNA, 22 bp, Homo sapiens
tcttttgatagtatttataata

SEQ ID NO: 6445899 - DNA, 16 bp, Homo sapiens
tcttttgattatgttt

SEQ ID NO: 6445900 - DNA, 19 bp, Homo sapiens
tcttttgcacaaggaaata

SEQ ID NO: 6445901 - DNA, 14 bp, Homo sapiens
tcttttgcaggagt

SEQ ID NO: 6445902 - DNA, 20 bp, Homo sapiens
tcttttgcattttgccgctg

SEQ ID NO: 6445903 - DNA, 20 bp, Homo sapiens
tcttttgctgaacaggaaag

SEQ ID NO: 6445904 - DNA, 14 bp, Homo sapiens
tcttttgctttcct

SEQ ID NO: 6445905 - DNA, 16 bp, Homo sapiens
tcttttgctttccttt

SEQ ID NO: 6445906 - DNA, 12 bp, Homo sapiens
tcttttgctttt

SEQ ID NO: 6445907 - DNA, 18 bp, Homo sapiens
tcttttgcttttggcaaa

SEQ ID NO: 6445908 - DNA, 15 bp, Homo sapiens
tcttttggaaagtac

SEQ ID NO: 6445909 - DNA, 17 bp, Homo sapiens
tcttttggattgctacg

SEQ ID NO: 6445910 - DNA, 13 bp, Homo sapiens
tcttttggcttcc

SEQ ID NO: 6445911 - DNA, 19 bp, Homo sapiens
tcttttgggaggatttgat

SEQ ID NO: 6445912 - DNA, 22 bp, Homo sapiens
tcttttgggatctaactgttgt

SEQ ID NO: 6445913 - DNA, 20 bp, Homo sapiens
tcttttggttatgaatactt

SEQ ID NO: 6445914 - DNA, 14 bp, Homo sapiens
tcttttgtaaatta

SEQ ID NO: 6445915 - DNA, 11 bp, Homo sapiens
tcttttgtaag

SEQ ID NO: 6445916 - DNA, 21 bp, Homo sapiens
tcttttgtaattgtgtaaaaa

SEQ ID NO: 6445917 - DNA, 11 bp, Homo sapiens
tcttttgtagt

SEQ ID NO: 6445918 - DNA, 14 bp, Homo sapiens
tcttttgtatatct

SEQ ID NO: 6445919 - DNA, 16 bp, Homo sapiens
tcttttgtatatctaa

SEQ ID NO: 6445920 - DNA, 20 bp, Homo sapiens
tcttttgtattgtttctaca

SEQ ID NO: 6445921 - DNA, 15 bp, Homo sapiens
tcttttgtgtcagtg

SEQ ID NO: 6445922 - DNA, 15 bp, Homo sapiens
tcttttgttaaataa

SEQ ID NO: 6445923 - DNA, 19 bp, Homo sapiens
tcttttgttctcctatatc

SEQ ID NO: 6445924 - DNA, 13 bp, Homo sapiens
tcttttgttctct

SEQ ID NO: 6445925 - DNA, 12 bp, Homo sapiens
tcttttgtttca

SEQ ID NO: 6445926 - DNA, 23 bp, Homo sapiens
tcttttgtttcattaagttgtaa

SEQ ID NO: 6445927 - DNA, 14 bp, Homo sapiens
tcttttgtttcctt

SEQ ID NO: 6445928 - DNA, 18 bp, Homo sapiens
tcttttgttttttgaagt

SEQ ID NO: 6445929 - DNA, 18 bp, Homo sapiens
tctttttaaaaactcttc

SEQ ID NO: 6445930 - DNA, 21 bp, Homo sapiens
tctttttaaaaactcttcagt

SEQ ID NO: 6445931 - DNA, 21 bp, Homo sapiens
tctttttaaaaagttgcacat

SEQ ID NO: 6445932 - DNA, 22 bp, Homo sapiens
tctttttaaaaagttgcacatt

SEQ ID NO: 6445933 - DNA, 13 bp, Homo sapiens
tctttttaaagct

SEQ ID NO: 6445934 - DNA, 14 bp, Homo sapiens
tctttttaaagctt

SEQ ID NO: 6445935 - DNA, 14 bp, Homo sapiens
tctttttaaagttc

SEQ ID NO: 6445936 - DNA, 21 bp, Homo sapiens
tctttttaaagtttgttcact

SEQ ID NO: 6445937 - DNA, 13 bp, Homo sapiens
tctttttaaatgt

SEQ ID NO: 6445938 - DNA, 15 bp, Homo sapiens
tctttttaataaaaa

SEQ ID NO: 6445939 - DNA, 21 bp, Homo sapiens
tctttttaattattttaaaat

SEQ ID NO: 6445940 - DNA, 15 bp, Homo sapiens
tctttttacagcatt

SEQ ID NO: 6445941 - DNA, 17 bp, Homo sapiens
tctttttacagcattgt

SEQ ID NO: 6445942 - DNA, 21 bp, Homo sapiens
tctttttacccatttgttcat

SEQ ID NO: 6445943 - DNA, 19 bp, Homo sapiens
tctttttacctttcataca

SEQ ID NO: 6445944 - DNA, 14 bp, Homo sapiens
tctttttataggtt

SEQ ID NO: 6445945 - DNA, 12 bp, Homo sapiens
tctttttattga

SEQ ID NO: 6445946 - DNA, 13 bp, Homo sapiens
tctttttcaaaaa

SEQ ID NO: 6445947 - DNA, 21 bp, Homo sapiens
tctttttcaaaactagttctt

SEQ ID NO: 6445948 - DNA, 15 bp, Homo sapiens
tctttttcaataaat

SEQ ID NO: 6445949 - DNA, 15 bp, Homo sapiens
tctttttcactctgt

SEQ ID NO: 6445950 - DNA, 22 bp, Homo sapiens
tctttttcaggctcgccaaggc

SEQ ID NO: 6445951 - DNA, 17 bp, Homo sapiens
tccaggcttctcccgga

SEQ ID NO: 6445952 - DNA, 17 bp, Homo sapiens
tccaggcttctgctggg

SEQ ID NO: 6445953 - DNA, 19 bp, Homo sapiens
tccaggcttgattccaaca

SEQ ID NO: 6445954 - DNA, 20 bp, Homo sapiens
tccaggctttcccacttccc

SEQ ID NO: 6445955 - DNA, 22 bp, Homo sapiens
tccaggctttcccacttcccac

SEQ ID NO: 6445956 - DNA, 22 bp, Homo sapiens
tccaggctttctggagttccca

SEQ ID NO: 6445957 - DNA, 16 bp, Homo sapiens
tccagggaaccagagc

SEQ ID NO: 6445958 - DNA, 17 bp, Homo sapiens
tccagggaagctggccg

SEQ ID NO: 6445959 - DNA, 18 bp, Homo sapiens
tccagggaatcagaaagg

SEQ ID NO: 6445960 - DNA, 14 bp, Homo sapiens
tccagggaatccaa

SEQ ID NO: 6445961 - DNA, 20 bp, Homo sapiens
tccagggaatccaagcctcc

SEQ ID NO: 6445962 - DNA, 12 bp, Homo sapiens
tccagggacaga

SEQ ID NO: 6445963 - DNA, 15 bp, Homo sapiens
tccagggacccttgc

SEQ ID NO: 6445964 - DNA, 23 bp, Homo sapiens
tccagggacccttgcctgcctcc

SEQ ID NO: 6445965 - DNA, 21 bp, Homo sapiens
tccagggacgaagaagagcca

SEQ ID NO: 6445966 - DNA, 14 bp, Homo sapiens
tccagggactgaag

SEQ ID NO: 6445967 - DNA, 17 bp, Homo sapiens
tccagggagcttattca

SEQ ID NO: 6445968 - DNA, 15 bp, Homo sapiens
tccagggaggcgatg

SEQ ID NO: 6445969 - DNA, 22 bp, Homo sapiens
tccagggaggcgatgccagcct

SEQ ID NO: 6445970 - DNA, 19 bp, Homo sapiens
tccagggagggtatttatt

SEQ ID NO: 6445971 - DNA, 18 bp, Homo sapiens
tccagggagtggggagga

SEQ ID NO: 6445972 - DNA, 21 bp, Homo sapiens
tccagggagtggggaggagag

SEQ ID NO: 6445973 - DNA, 17 bp, Homo sapiens
tccagggatggagatgg

SEQ ID NO: 6445974 - DNA, 21 bp, Homo sapiens
tccagggcagcaggccagaga

SEQ ID NO: 6445975 - DNA, 19 bp, Homo sapiens
tccagggcattgctcagcc

SEQ ID NO: 6445976 - DNA, 10 bp, Homo sapiens
tccagggcca

SEQ ID NO: 6445977 - DNA, 14 bp, Homo sapiens
tccagggcccaggt

SEQ ID NO: 6445978 - DNA, 13 bp, Homo sapiens
tccagggccccca

SEQ ID NO: 6445979 - DNA, 21 bp, Homo sapiens
tccagggcctctccttggaag

SEQ ID NO: 6445980 - DNA, 20 bp, Homo sapiens
tccagggcgagcactttcca

SEQ ID NO: 6445981 - DNA, 17 bp, Homo sapiens
tccagggctcaacactg

SEQ ID NO: 6445982 - DNA, 20 bp, Homo sapiens
tccagggctcaacactgtga

SEQ ID NO: 6445983 - DNA, 11 bp, Homo sapiens
tccagggctcc

SEQ ID NO: 6445984 - DNA, 17 bp, Homo sapiens
tccagggctcttccaga

SEQ ID NO: 6445985 - DNA, 14 bp, Homo sapiens
tccagggctgccag

SEQ ID NO: 6445986 - DNA, 15 bp, Homo sapiens
tccagggctgccagg

SEQ ID NO: 6445987 - DNA, 11 bp, Homo sapiens
tccagggctgg

SEQ ID NO: 6445988 - DNA, 17 bp, Homo sapiens
tccagggctggactgag

SEQ ID NO: 6445989 - DNA, 19 bp, Homo sapiens
tccagggctggactgaggc

SEQ ID NO: 6445990 - DNA, 22 bp, Homo sapiens
tccagggctggactgaggcctg

SEQ ID NO: 6445991 - DNA, 23 bp, Homo sapiens
tccagggctggactgaggcctga

SEQ ID NO: 6445992 - DNA, 18 bp, Homo sapiens
tccaggggagatggggag

SEQ ID NO: 6445993 - DNA, 23 bp, Homo sapiens
tccaggggagggaaaagctaaga

SEQ ID NO: 6445994 - DNA, 18 bp, Homo sapiens
tccaggggcccctccagc

SEQ ID NO: 6445995 - DNA, 21 bp, Homo sapiens
tccaggggcctgcagaaggaa

SEQ ID NO: 6445996 - DNA, 15 bp, Homo sapiens
tccaggggctcctgg

SEQ ID NO: 6445997 - DNA, 18 bp, Homo sapiens
tccaggggctcctgggtt

SEQ ID NO: 6445998 - DNA, 18 bp, Homo sapiens
tccagggggaaggccaag

SEQ ID NO: 6445999 - DNA, 18 bp, Homo sapiens
tccagggggagaaggaag

SEQ ID NO: 6446000 - DNA, 23 bp, Homo sapiens
tccaggggtcaccttgagaggca

SEQ ID NO: 6446001 - DNA, 19 bp, Homo sapiens
tccaggggtgggacaccct

SEQ ID NO: 6446002 - DNA, 23 bp, Homo sapiens
tccaggggtgggacaccctgtga

SEQ ID NO: 6446003 - DNA, 14 bp, Homo sapiens
tccaggggtttaca

SEQ ID NO: 6446004 - DNA, 21 bp, Homo sapiens
tccagggtaggcaaggctgcc

SEQ ID NO: 6446005 - DNA, 15 bp, Homo sapiens
tccagggtcccctgc

SEQ ID NO: 6446006 - DNA, 17 bp, Homo sapiens
tccagggtcccctgcca

SEQ ID NO: 6446007 - DNA, 18 bp, Homo sapiens
tccagggtcccctgccac

SEQ ID NO: 6446008 - DNA, 19 bp, Homo sapiens
tccagggtcccctgccacc

SEQ ID NO: 6446009 - DNA, 15 bp, Homo sapiens
tccagggtcctctag

SEQ ID NO: 6446010 - DNA, 18 bp, Homo sapiens
tccagggtcctctcttcc

SEQ ID NO: 6446011 - DNA, 15 bp, Homo sapiens
tccagggtctggcag

SEQ ID NO: 6446012 - DNA, 19 bp, Homo sapiens
tccagggtctggcagagcc

SEQ ID NO: 6446013 - DNA, 13 bp, Homo sapiens
tccagggtcttgg

SEQ ID NO: 6446014 - DNA, 21 bp, Homo sapiens
tccagggtcttgggctactgg

SEQ ID NO: 6446015 - DNA, 14 bp, Homo sapiens
tccagggtggcagc

SEQ ID NO: 6446016 - DNA, 17 bp, Homo sapiens
tccagggtgtgtgctcg

SEQ ID NO: 6446017 - DNA, 18 bp, Homo sapiens
tccagggttgatcacact

SEQ ID NO: 6446018 - DNA, 16 bp, Homo sapiens
tccagggtttctctgc

SEQ ID NO: 6446019 - DNA, 23 bp, Homo sapiens
tccaggtaccttgacctttgtac

SEQ ID NO: 6446020 - DNA, 23 bp, Homo sapiens
tccaggtagctcggcaccaacta

SEQ ID NO: 6446021 - DNA, 15 bp, Homo sapiens
tccaggtatctccag

SEQ ID NO: 6446022 - DNA, 16 bp, Homo sapiens
tccaggtatctccagg

SEQ ID NO: 6446023 - DNA, 14 bp, Homo sapiens
tccaggtcacaggc

SEQ ID NO: 6446024 - DNA, 15 bp, Homo sapiens
tccaggtcacaggca

SEQ ID NO: 6446025 - DNA, 16 bp, Homo sapiens
tccaggtcacaggcat

SEQ ID NO: 6446026 - DNA, 22 bp, Homo sapiens
tccaggtcaccagcctgactgc

SEQ ID NO: 6446027 - DNA, 18 bp, Homo sapiens
tccaggtcagcctggaag

SEQ ID NO: 6446028 - DNA, 16 bp, Homo sapiens
tccaggtcaggatgca

SEQ ID NO: 6446029 - DNA, 14 bp, Homo sapiens
tccaggtcccagcc

SEQ ID NO: 6446030 - DNA, 15 bp, Homo sapiens
tccaggtcccagccc

SEQ ID NO: 6446031 - DNA, 18 bp, Homo sapiens
tccaggtcccagcccctc

SEQ ID NO: 6446032 - DNA, 16 bp, Homo sapiens
tccaggtcctttcctt

SEQ ID NO: 6446033 - DNA, 22 bp, Homo sapiens
tccaggtcggagtgcctggagt

SEQ ID NO: 6446034 - DNA, 18 bp, Homo sapiens
tccaggtctagaaggcca

SEQ ID NO: 6446035 - DNA, 16 bp, Homo sapiens
tccaggtctcactgct

SEQ ID NO: 6446036 - DNA, 15 bp, Homo sapiens
tccaggtctcgggtc

SEQ ID NO: 6446037 - DNA, 23 bp, Homo sapiens
tccaggtcttgactcatggcagc

SEQ ID NO: 6446038 - DNA, 18 bp, Homo sapiens
tccaggtgagaacatcca

SEQ ID NO: 6446039 - DNA, 22 bp, Homo sapiens
tccaggtgcacaagctccaagc

SEQ ID NO: 6446040 - DNA, 14 bp, Homo sapiens
tccaggtgcagagg

SEQ ID NO: 6446041 - DNA, 17 bp, Homo sapiens
tccaggtgccctgtggg

SEQ ID NO: 6446042 - DNA, 18 bp, Homo sapiens
tccaggtgctcattgtaa

SEQ ID NO: 6446043 - DNA, 20 bp, Homo sapiens
tccaggtggaacaaacagaa

SEQ ID NO: 6446044 - DNA, 21 bp, Homo sapiens
tccaggtggcccttcccggca

SEQ ID NO: 6446045 - DNA, 17 bp, Homo sapiens
tccaggtgggagagaca

SEQ ID NO: 6446046 - DNA, 21 bp, Homo sapiens
tccaggtggggtgaggcagtg

SEQ ID NO: 6446047 - DNA, 17 bp, Homo sapiens
tccaggtggtgaatttt

SEQ ID NO: 6446048 - DNA, 20 bp, Homo sapiens
tccaggtgtgcacagaaaac

SEQ ID NO: 6446049 - DNA, 15 bp, Homo sapiens
tccaggtgtgcccct

SEQ ID NO: 6446050 - DNA, 18 bp, Homo sapiens
tccaggttccatccacca

SEQ ID NO: 6446051 - DNA, 19 bp, Homo sapiens
tccaggttccatccaccac

SEQ ID NO: 6446052 - DNA, 17 bp, Homo sapiens
tccaggttccctcccag

SEQ ID NO: 6446053 - DNA, 13 bp, Homo sapiens
tccaggttcctca

SEQ ID NO: 6446054 - DNA, 18 bp, Homo sapiens
tccaggttcgtatagaaa

SEQ ID NO: 6446055 - DNA, 20 bp, Homo sapiens
tccaggttcgtatagaaaaa

SEQ ID NO: 6446056 - DNA, 23 bp, Homo sapiens
tccaggttcgtatagaaaaagca

SEQ ID NO: 6446057 - DNA, 14 bp, Homo sapiens
tccaggttctgtct

SEQ ID NO: 6446058 - DNA, 21 bp, Homo sapiens
tccaggttgatcttgaactcc

SEQ ID NO: 6446059 - DNA, 14 bp, Homo sapiens
tccaggttgcctca

SEQ ID NO: 6446060 - DNA, 17 bp, Homo sapiens
tccaggttggttttgct

SEQ ID NO: 6446061 - DNA, 18 bp, Homo sapiens
tccaggttggttttgctg

SEQ ID NO: 6446062 - DNA, 17 bp, Homo sapiens
tccaggtttgctgtgtc

SEQ ID NO: 6446063 - DNA, 15 bp, Homo sapiens
tccaggtttttcaat

SEQ ID NO: 6446064 - DNA, 16 bp, Homo sapiens
tccaggtttttcaatt

SEQ ID NO: 6446065 - DNA, 18 bp, Homo sapiens
tccaggtttttcaattaa

SEQ ID NO: 6446066 - DNA, 14 bp, Homo sapiens
tccagtaaaataat

SEQ ID NO: 6446067 - DNA, 19 bp, Homo sapiens
tccagtaacttttttgtgt

SEQ ID NO: 6446068 - DNA, 15 bp, Homo sapiens
tccagtaagatcact

SEQ ID NO: 6446069 - DNA, 17 bp, Homo sapiens
tccagtaagatcactgt

SEQ ID NO: 6446070 - DNA, 14 bp, Homo sapiens
tccagtaagcacat

SEQ ID NO: 6446071 - DNA, 21 bp, Homo sapiens
tccagtaccataatcttagag

SEQ ID NO: 6446072 - DNA, 17 bp, Homo sapiens
tccagtaccttctgcca

SEQ ID NO: 6446073 - DNA, 19 bp, Homo sapiens
tccagtaccttctgccaga

SEQ ID NO: 6446074 - DNA, 19 bp, Homo sapiens
tccagtacgtcccgctgct

SEQ ID NO: 6446075 - DNA, 15 bp, Homo sapiens
tccagtagagcttct

SEQ ID NO: 6446076 - DNA, 16 bp, Homo sapiens
tccagtagctcctgga

SEQ ID NO: 6446077 - DNA, 22 bp, Homo sapiens
tccagtaggaaattgattttga

SEQ ID NO: 6446078 - DNA, 22 bp, Homo sapiens
tccagtaggtaatgattatgtg

SEQ ID NO: 6446079 - DNA, 20 bp, Homo sapiens
tccagtagtggacaacaggt

SEQ ID NO: 6446080 - DNA, 14 bp, Homo sapiens
tccagtataaatta

SEQ ID NO: 6446081 - DNA, 19 bp, Homo sapiens
tccagtatcctgaaacagt

SEQ ID NO: 6446082 - DNA, 16 bp, Homo sapiens
tccagtatcttgaaga

SEQ ID NO: 6446083 - DNA, 18 bp, Homo sapiens
tccagtatcttgaagact

SEQ ID NO: 6446084 - DNA, 14 bp, Homo sapiens
tccagtatcttgtt

SEQ ID NO: 6446085 - DNA, 17 bp, Homo sapiens
tccagtatgacagagga

SEQ ID NO: 6446086 - DNA, 15 bp, Homo sapiens
tccagtatggaagaa

SEQ ID NO: 6446087 - DNA, 19 bp, Homo sapiens
tccagtattcttgtcaaaa

SEQ ID NO: 6446088 - DNA, 15 bp, Homo sapiens
tccagtattgctgat

SEQ ID NO: 6446089 - DNA, 16 bp, Homo sapiens
tccagtcaaagacgct

SEQ ID NO: 6446090 - DNA, 18 bp, Homo sapiens
tccagtcaaatctgggct

SEQ ID NO: 6446091 - DNA, 13 bp, Homo sapiens
tccagtcaacaaa

SEQ ID NO: 6446092 - DNA, 21 bp, Homo sapiens
tccagtcaagctctgggtact

SEQ ID NO: 6446093 - DNA, 14 bp, Homo sapiens
tccagtcacactcc

SEQ ID NO: 6446094 - DNA, 16 bp, Homo sapiens
tccagtcacactcccc

SEQ ID NO: 6446095 - DNA, 15 bp, Homo sapiens
tccagtcacatgccc

SEQ ID NO: 6446096 - DNA, 13 bp, Homo sapiens
tccagtcaggatg

SEQ ID NO: 6446097 - DNA, 14 bp, Homo sapiens
tccagtcatcctgc

SEQ ID NO: 6446098 - DNA, 20 bp, Homo sapiens
tccagtcatcctgccctgca

SEQ ID NO: 6446099 - DNA, 23 bp, Homo sapiens
tccagtcatcctgccctgcagca

SEQ ID NO: 6446100 - DNA, 19 bp, Homo sapiens
tccagtcatggtactaccc

SEQ ID NO: 6446101 - DNA, 23 bp, Homo sapiens
tccagtcatggtactaccccagc

SEQ ID NO: 6446102 - DNA, 16 bp, Homo sapiens
tccagtccaaggaaac

SEQ ID NO: 6446103 - DNA, 17 bp, Homo sapiens
tccagtccaatctcatg

SEQ ID NO: 6446104 - DNA, 14 bp, Homo sapiens
tccagtccagtttc

SEQ ID NO: 6446105 - DNA, 12 bp, Homo sapiens
tccagtccccag

SEQ ID NO: 6446106 - DNA, 15 bp, Homo sapiens
tccagtccccagaac

SEQ ID NO: 6446107 - DNA, 16 bp, Homo sapiens
tccagtccccagaact

SEQ ID NO: 6446108 - DNA, 20 bp, Homo sapiens
tccagtccccagaagcagag

SEQ ID NO: 6446109 - DNA, 19 bp, Homo sapiens
tccagtcctatctgggctt

SEQ ID NO: 6446110 - DNA, 17 bp, Homo sapiens
tccagtcctgctctcta

SEQ ID NO: 6446111 - DNA, 21 bp, Homo sapiens
tccagtcctgctctctaccca

SEQ ID NO: 6446112 - DNA, 15 bp, Homo sapiens
tccagtcctgctggc

SEQ ID NO: 6446113 - DNA, 20 bp, Homo sapiens
tccagtcctgctggcctgct

SEQ ID NO: 6446114 - DNA, 17 bp, Homo sapiens
tccagtcctttgttgct

SEQ ID NO: 6446115 - DNA, 15 bp, Homo sapiens
tccagtcgttatttc

SEQ ID NO: 6446116 - DNA, 13 bp, Homo sapiens
tccagtctattca

SEQ ID NO: 6446117 - DNA, 16 bp, Homo sapiens
tccagtctcactgaca

SEQ ID NO: 6446118 - DNA, 16 bp, Homo sapiens
tccagtctccaccagg

SEQ ID NO: 6446119 - DNA, 19 bp, Homo sapiens
tccagtctccaccaggaac

SEQ ID NO: 6446120 - DNA, 13 bp, Homo sapiens
tccagtctgcaga

SEQ ID NO: 6446121 - DNA, 14 bp, Homo sapiens
tccagtctgctctc

SEQ ID NO: 6446122 - DNA, 19 bp, Homo sapiens
tccagtctgctctcagctt

SEQ ID NO: 6446123 - DNA, 14 bp, Homo sapiens
tccagtctgctgcc

SEQ ID NO: 6446124 - DNA, 16 bp, Homo sapiens
tccagtctgctgccct

SEQ ID NO: 6446125 - DNA, 14 bp, Homo sapiens
tccagtctggaaaa

SEQ ID NO: 6446126 - DNA, 21 bp, Homo sapiens
tccagtctggaaaacagaaac

SEQ ID NO: 6446127 - DNA, 15 bp, Homo sapiens
tccagtctgtgatcc

SEQ ID NO: 6446128 - DNA, 15 bp, Homo sapiens
tccagtctgttctca

SEQ ID NO: 6446129 - DNA, 17 bp, Homo sapiens
tccagtctgttctcaca

SEQ ID NO: 6446130 - DNA, 20 bp, Homo sapiens
tccagtcttccacctggaag

SEQ ID NO: 6446131 - DNA, 19 bp, Homo sapiens
tccagtcttcctgacactt

SEQ ID NO: 6446132 - DNA, 23 bp, Homo sapiens
tccagtgaacattcccagcccag

SEQ ID NO: 6446133 - DNA, 19 bp, Homo sapiens
tccagtgaagtagcctctt

SEQ ID NO: 6446134 - DNA, 22 bp, Homo sapiens
tccagtgacacaactcatccag

SEQ ID NO: 6446135 - DNA, 17 bp, Homo sapiens
tccagtgaccctggagc

SEQ ID NO: 6446136 - DNA, 14 bp, Homo sapiens
tccagtgacttgca

SEQ ID NO: 6446137 - DNA, 23 bp, Homo sapiens
tccagtgacttgcaatccaggct

SEQ ID NO: 6446138 - DNA, 19 bp, Homo sapiens
tccagtgacttgttctgag

SEQ ID NO: 6446139 - DNA, 14 bp, Homo sapiens
tccagtgagacagc

SEQ ID NO: 6446140 - DNA, 18 bp, Homo sapiens
tccagtgagacagctctg

SEQ ID NO: 6446141 - DNA, 12 bp, Homo sapiens
tccagtgagccg

SEQ ID NO: 6446142 - DNA, 22 bp, Homo sapiens
tccagtgagccgagatggcgct

SEQ ID NO: 6446143 - DNA, 14 bp, Homo sapiens
tccagtgagctgga

SEQ ID NO: 6446144 - DNA, 23 bp, Homo sapiens
tccagtgaggccaagattgaaat

SEQ ID NO: 6446145 - DNA, 17 bp, Homo sapiens
tccagtgaggctctgcc

SEQ ID NO: 6446146 - DNA, 18 bp, Homo sapiens
tccagtgaggctctgccc

SEQ ID NO: 6446147 - DNA, 20 bp, Homo sapiens
tccagtgaggctctgccctt

SEQ ID NO: 6446148 - DNA, 15 bp, Homo sapiens
tccagtgagtgtaaa

SEQ ID NO: 6446149 - DNA, 17 bp, Homo sapiens
tccagtgcaaccacaca

SEQ ID NO: 6446150 - DNA, 14 bp, Homo sapiens
tccagtgcatgttg

SEQ ID NO: 6446151 - DNA, 19 bp, Homo sapiens
tccagtgccaacaatccta

SEQ ID NO: 6446152 - DNA, 14 bp, Homo sapiens
tccagtgccagcaa

SEQ ID NO: 6446153 - DNA, 17 bp, Homo sapiens
tccagtgccgctcctgc

SEQ ID NO: 6446154 - DNA, 13 bp, Homo sapiens
tccagtgctccca

SEQ ID NO: 6446155 - DNA, 14 bp, Homo sapiens
tccagtgctctgcc

SEQ ID NO: 6446156 - DNA, 16 bp, Homo sapiens
tccagtgctctgcctc

SEQ ID NO: 6446157 - DNA, 17 bp, Homo sapiens
tccagtgctctgcctca

SEQ ID NO: 6446158 - DNA, 18 bp, Homo sapiens
tccagtgctctgcctcag

SEQ ID NO: 6446159 - DNA, 16 bp, Homo sapiens
tccagtgctgctccct

SEQ ID NO: 6446160 - DNA, 12 bp, Homo sapiens
tccagtgctggc

SEQ ID NO: 6446161 - DNA, 16 bp, Homo sapiens
tccagtgctggctgct

SEQ ID NO: 6446162 - DNA, 15 bp, Homo sapiens
tccagtgcttccaca

SEQ ID NO: 6446163 - DNA, 22 bp, Homo sapiens
tccagtgcttggctgccccaca

SEQ ID NO: 6446164 - DNA, 21 bp, Homo sapiens
tccagtgctttatccacattg

SEQ ID NO: 6446165 - DNA, 22 bp, Homo sapiens
tccagtgctttatccacattgt

SEQ ID NO: 6446166 - DNA, 18 bp, Homo sapiens
tccagtggacctgaagga

SEQ ID NO: 6446167 - DNA, 17 bp, Homo sapiens
tccagtggaggtttgtc

SEQ ID NO: 6446168 - DNA, 17 bp, Homo sapiens
tccagtggatcataaga

SEQ ID NO: 6446169 - DNA, 16 bp, Homo sapiens
tccagtggcagacaaa

SEQ ID NO: 6446170 - DNA, 18 bp, Homo sapiens
tccagtggcttctcccaa

SEQ ID NO: 6446171 - DNA, 13 bp, Homo sapiens
tccagtgggctga

SEQ ID NO: 6446172 - DNA, 22 bp, Homo sapiens
tccagtgggctgatgctgggac

SEQ ID NO: 6446173 - DNA, 20 bp, Homo sapiens
tccagtggggcaagattttc

SEQ ID NO: 6446174 - DNA, 17 bp, Homo sapiens
tccagtggtcatgctca

SEQ ID NO: 6446175 - DNA, 19 bp, Homo sapiens
tccagtgtattttctgtgt

SEQ ID NO: 6446176 - DNA, 15 bp, Homo sapiens
tccagtgtcacctct

SEQ ID NO: 6446177 - DNA, 15 bp, Homo sapiens
tccagtgtcctgagc

SEQ ID NO: 6446178 - DNA, 17 bp, Homo sapiens
tccagtgtcctgagctc

SEQ ID NO: 6446179 - DNA, 23 bp, Homo sapiens
tccagtgtctataaaagaaacac

SEQ ID NO: 6446180 - DNA, 15 bp, Homo sapiens
tccagtgtctgtctg

SEQ ID NO: 6446181 - DNA, 19 bp, Homo sapiens
tccagtgtgagatactgtg

SEQ ID NO: 6446182 - DNA, 20 bp, Homo sapiens
tccagtgtgagatactgtgt

SEQ ID NO: 6446183 - DNA, 13 bp, Homo sapiens
tccagtgtgcacc

SEQ ID NO: 6446184 - DNA, 21 bp, Homo sapiens
tccagtgtgcacccctcccca

SEQ ID NO: 6446185 - DNA, 20 bp, Homo sapiens
tccagtgtggctcccacagg

SEQ ID NO: 6446186 - DNA, 22 bp, Homo sapiens
tccagtgtggtcttgtttaata

SEQ ID NO: 6446187 - DNA, 21 bp, Homo sapiens
tccagtgttcccttctggctg

SEQ ID NO: 6446188 - DNA, 14 bp, Homo sapiens
tccagtgttctatt

SEQ ID NO: 6446189 - DNA, 19 bp, Homo sapiens
tccagtgttgcctcctccc

SEQ ID NO: 6446190 - DNA, 18 bp, Homo sapiens
tccagtgttggctgtgtg

SEQ ID NO: 6446191 - DNA, 15 bp, Homo sapiens
tccagtgtttccacg

SEQ ID NO: 6446192 - DNA, 19 bp, Homo sapiens
tccagtgtttccacggctg

SEQ ID NO: 6446193 - DNA, 19 bp, Homo sapiens
tccagttaaaaaaaatttt

SEQ ID NO: 6446194 - DNA, 21 bp, Homo sapiens
tccagttaaaaaaaattttaa

SEQ ID NO: 6446195 - DNA, 14 bp, Homo sapiens
tccagttaaccaag

SEQ ID NO: 6446196 - DNA, 18 bp, Homo sapiens
tccagttagagcccatta

SEQ ID NO: 6446197 - DNA, 16 bp, Homo sapiens
tccagttataagaaga

SEQ ID NO: 6446198 - DNA, 13 bp, Homo sapiens
tccagttccagga

SEQ ID NO: 6446199 - DNA, 16 bp, Homo sapiens
tccagttccagttccc

SEQ ID NO: 6446200 - DNA, 14 bp, Homo sapiens
tccagttcctgctc

SEQ ID NO: 6446201 - DNA, 18 bp, Homo sapiens
tccagttcctgctctctg

SEQ ID NO: 6446202 - DNA, 21 bp, Homo sapiens
tccagttcctgctctctgctc

SEQ ID NO: 6446203 - DNA, 22 bp, Homo sapiens
tccagttcctgctctctgctca

SEQ ID NO: 6446204 - DNA, 13 bp, Homo sapiens
tccagttcttccc

SEQ ID NO: 6446205 - DNA, 21 bp, Homo sapiens
tccagttcttcgactgttgtt

SEQ ID NO: 6446206 - DNA, 21 bp, Homo sapiens
tccagttgaagttagtggaaa

SEQ ID NO: 6446207 - DNA, 15 bp, Homo sapiens
tccagttgcaataaa

SEQ ID NO: 6446208 - DNA, 21 bp, Homo sapiens
tccagttgcaataaaatagta

SEQ ID NO: 6446209 - DNA, 12 bp, Homo sapiens
tccagttgctgt

SEQ ID NO: 6446210 - DNA, 15 bp, Homo sapiens
tccagttgctgtgga

SEQ ID NO: 6446211 - DNA, 16 bp, Homo sapiens
tccagttgctgtggac

SEQ ID NO: 6446212 - DNA, 22 bp, Homo sapiens
tccagtttaagtaattgcctac

SEQ ID NO: 6446213 - DNA, 21 bp, Homo sapiens
tccagtttagcccttccctgc

SEQ ID NO: 6446214 - DNA, 22 bp, Homo sapiens
tccagtttaggagctcagttga

SEQ ID NO: 6446215 - DNA, 15 bp, Homo sapiens
tccagtttattccag

SEQ ID NO: 6446216 - DNA, 14 bp, Homo sapiens
tccagtttccaaag

SEQ ID NO: 6446217 - DNA, 14 bp, Homo sapiens
tccagtttcccacc

SEQ ID NO: 6446218 - DNA, 12 bp, Homo sapiens
tccagtttccgg

SEQ ID NO: 6446219 - DNA, 21 bp, Homo sapiens
tccagtttctcttaagctgcc

SEQ ID NO: 6446220 - DNA, 14 bp, Homo sapiens
tccagtttctgtaa

SEQ ID NO: 6446221 - DNA, 14 bp, Homo sapiens
tccagtttctttcc

SEQ ID NO: 6446222 - DNA, 19 bp, Homo sapiens
tccagtttgaagaccaatc

SEQ ID NO: 6446223 - DNA, 19 bp, Homo sapiens
tccagtttgcacctgtccc

SEQ ID NO: 6446224 - DNA, 21 bp, Homo sapiens
tccagtttgcccaccacaact

SEQ ID NO: 6446225 - DNA, 19 bp, Homo sapiens
tccagtttgtgtttttcta

SEQ ID NO: 6446226 - DNA, 13 bp, Homo sapiens
tccagttttctct

SEQ ID NO: 6446227 - DNA, 16 bp, Homo sapiens
tccagttttgcctgag

SEQ ID NO: 6446228 - DNA, 20 bp, Homo sapiens
tccagttttggatcttttta

SEQ ID NO: 6446229 - DNA, 15 bp, Homo sapiens
tccagttttgtgtgc

SEQ ID NO: 6446230 - DNA, 12 bp, Homo sapiens
tccagttttgtt

SEQ ID NO: 6446231 - DNA, 17 bp, Homo sapiens
tccagttttgtttggac

SEQ ID NO: 6446232 - DNA, 14 bp, Homo sapiens
tccagtttttcata

SEQ ID NO: 6446233 - DNA, 22 bp, Homo sapiens
tccataaactaagagaaactgt

SEQ ID NO: 6446234 - DNA, 22 bp, Homo sapiens
tccataaagacaatcactgcca

SEQ ID NO: 6446235 - DNA, 15 bp, Homo sapiens
tccataaagcaagct

SEQ ID NO: 6446236 - DNA, 21 bp, Homo sapiens
tccataaagtaattttgtgaa

SEQ ID NO: 6446237 - DNA, 18 bp, Homo sapiens
tccataaagtacaaatga

SEQ ID NO: 6446238 - DNA, 18 bp, Homo sapiens
tccataaatctattgtct

SEQ ID NO: 6446239 - DNA, 16 bp, Homo sapiens
tccataaatgtgttcc

SEQ ID NO: 6446240 - DNA, 14 bp, Homo sapiens
tccataaccccacc

SEQ ID NO: 6446241 - DNA, 16 bp, Homo sapiens
tccataagtaagaaat

SEQ ID NO: 6446242 - DNA, 16 bp, Homo sapiens
tccataagtggagaaa

SEQ ID NO: 6446243 - DNA, 12 bp, Homo sapiens
tccataagttta

SEQ ID NO: 6446244 - DNA, 12 bp, Homo sapiens
tccataatcact

SEQ ID NO: 6446245 - DNA, 21 bp, Homo sapiens
tccataatctggactcctctg

SEQ ID NO: 6446246 - DNA, 23 bp, Homo sapiens
tccataatctggactcctctgtc

SEQ ID NO: 6446247 - DNA, 22 bp, Homo sapiens
tccataatgatggatttaacag

SEQ ID NO: 6446248 - DNA, 14 bp, Homo sapiens
tccataatgccact

SEQ ID NO: 6446249 - DNA, 16 bp, Homo sapiens
tccataatgccactgg

SEQ ID NO: 6446250 - DNA, 20 bp, Homo sapiens
tccataatgtataaagaaca

SEQ ID NO: 6446251 - DNA, 15 bp, Homo sapiens
tccataatgttctgc

SEQ ID NO: 6446252 - DNA, 16 bp, Homo sapiens
tccataatgttctgct

SEQ ID NO: 6446253 - DNA, 19 bp, Homo sapiens
tccataattatgacagtta

SEQ ID NO: 6446254 - DNA, 14 bp, Homo sapiens
tccatacacacgct

SEQ ID NO: 6446255 - DNA, 18 bp, Homo sapiens
tccatacacacgctgcct

SEQ ID NO: 6446256 - DNA, 14 bp, Homo sapiens
tccatacacagagg

SEQ ID NO: 6446257 - DNA, 22 bp, Homo sapiens
tccatacactttgttgcaagat

SEQ ID NO: 6446258 - DNA, 13 bp, Homo sapiens
tccatacagctct

SEQ ID NO: 6446259 - DNA, 22 bp, Homo sapiens
tccatacagggtctcttccttc

SEQ ID NO: 6446260 - DNA, 15 bp, Homo sapiens
tccatacagtcaaga

SEQ ID NO: 6446261 - DNA, 21 bp, Homo sapiens
tccatacagtcaagatacata

SEQ ID NO: 6446262 - DNA, 22 bp, Homo sapiens
tccataccagctcgcacccccc

SEQ ID NO: 6446263 - DNA, 13 bp, Homo sapiens
tccataccccctg

SEQ ID NO: 6446264 - DNA, 18 bp, Homo sapiens
tccataccccctgcccca

SEQ ID NO: 6446265 - DNA, 20 bp, Homo sapiens
tccataccccctgccccaga

SEQ ID NO: 6446266 - DNA, 22 bp, Homo sapiens
tccatacgtgcccatttcacac

SEQ ID NO: 6446267 - DNA, 23 bp, Homo sapiens
tccatacgtgcccatttcacaca

SEQ ID NO: 6446268 - DNA, 23 bp, Homo sapiens
tccatactgaaaaaatgctgagc

SEQ ID NO: 6446269 - DNA, 15 bp, Homo sapiens
tccatactgtagaca

SEQ ID NO: 6446270 - DNA, 23 bp, Homo sapiens
tccatactgtagacactctgaca

SEQ ID NO: 6446271 - DNA, 12 bp, Homo sapiens
tccatactgttt

SEQ ID NO: 6446272 - DNA, 14 bp, Homo sapiens
tccatactttggat

SEQ ID NO: 6446273 - DNA, 13 bp, Homo sapiens
tccatagacacag

SEQ ID NO: 6446274 - DNA, 14 bp, Homo sapiens
tccatagacacagt

SEQ ID NO: 6446275 - DNA, 16 bp, Homo sapiens
tccatagacacagtat

SEQ ID NO: 6446276 - DNA, 17 bp, Homo sapiens
tccatagacacagtatt

SEQ ID NO: 6446277 - DNA, 23 bp, Homo sapiens
tccatagacacagtattgacttc

SEQ ID NO: 6446278 - DNA, 15 bp, Homo sapiens
tccatagagagcaag

SEQ ID NO: 6446279 - DNA, 17 bp, Homo sapiens
tccatagagagcaagac

SEQ ID NO: 6446280 - DNA, 17 bp, Homo sapiens
tccatagcacaagataa

SEQ ID NO: 6446281 - DNA, 22 bp, Homo sapiens
tccatagcacaagataaattga

SEQ ID NO: 6446282 - DNA, 16 bp, Homo sapiens
tccatagctcaataaa

SEQ ID NO: 6446283 - DNA, 15 bp, Homo sapiens
tccatagctgctgcc

SEQ ID NO: 6446284 - DNA, 15 bp, Homo sapiens
tccatagctgtggtg

SEQ ID NO: 6446285 - DNA, 15 bp, Homo sapiens
tccataggaatcatg

SEQ ID NO: 6446286 - DNA, 23 bp, Homo sapiens
tccataggactaccgcaggcccg

SEQ ID NO: 6446287 - DNA, 15 bp, Homo sapiens
tccatagtaactgac

SEQ ID NO: 6446288 - DNA, 18 bp, Homo sapiens
tccatagtagtatgatga

SEQ ID NO: 6446289 - DNA, 19 bp, Homo sapiens
tccatagtagtattgattt

SEQ ID NO: 6446290 - DNA, 16 bp, Homo sapiens
tccatagtatattaaa

SEQ ID NO: 6446291 - DNA, 20 bp, Homo sapiens
tccatagtatattaaaaatg

SEQ ID NO: 6446292 - DNA, 14 bp, Homo sapiens
tccatagtgacttt

SEQ ID NO: 6446293 - DNA, 15 bp, Homo sapiens
tccatagtgactttt

SEQ ID NO: 6446294 - DNA, 19 bp, Homo sapiens
tccatagtttggcatttgc

SEQ ID NO: 6446295 - DNA, 20 bp, Homo sapiens
tccatagtttggcatttgca

SEQ ID NO: 6446296 - DNA, 15 bp, Homo sapiens
tccatagttttgatg

SEQ ID NO: 6446297 - DNA, 13 bp, Homo sapiens
tccatataaatat

SEQ ID NO: 6446298 - DNA, 19 bp, Homo sapiens
tccatataaatattagaaa

SEQ ID NO: 6446299 - DNA, 20 bp, Homo sapiens
tccatatagtctattcatta

SEQ ID NO: 6446300 - DNA, 20 bp, Homo sapiens
tccatatagtttgttttctt

SEQ ID NO: 6446301 - DNA, 20 bp, Homo sapiens
tccatatatccttttcttct

SEQ ID NO: 6446302 - DNA, 18 bp, Homo sapiens
tccatatattagcattta

SEQ ID NO: 6446303 - DNA, 16 bp, Homo sapiens
tccatatcagacctct

SEQ ID NO: 6446304 - DNA, 14 bp, Homo sapiens
tccatatcagctct

SEQ ID NO: 6446305 - DNA, 15 bp, Homo sapiens
tccatatccctgccc

SEQ ID NO: 6446306 - DNA, 19 bp, Homo sapiens
tccatatccctgcccagcc

SEQ ID NO: 6446307 - DNA, 17 bp, Homo sapiens
tccatatctaaccagtg

SEQ ID NO: 6446308 - DNA, 23 bp, Homo sapiens
tctttttcaggctcgccaaggcc

SEQ ID NO: 6446309 - DNA, 12 bp, Homo sapiens
tctttttcagtt

SEQ ID NO: 6446310 - DNA, 12 bp, Homo sapiens
tctttttcatta

SEQ ID NO: 6446311 - DNA, 14 bp, Homo sapiens
tctttttcctactc

SEQ ID NO: 6446312 - DNA, 12 bp, Homo sapiens
tctttttcctcc

SEQ ID NO: 6446313 - DNA, 14 bp, Homo sapiens
tctttttccttctt

SEQ ID NO: 6446314 - DNA, 13 bp, Homo sapiens
tctttttccttta

SEQ ID NO: 6446315 - DNA, 18 bp, Homo sapiens
tctttttcgtctatatat

SEQ ID NO: 6446316 - DNA, 15 bp, Homo sapiens
tctttttctcttctg

SEQ ID NO: 6446317 - DNA, 20 bp, Homo sapiens
tctttttctgaagcctctaa

SEQ ID NO: 6446318 - DNA, 13 bp, Homo sapiens
tctttttctggaa

SEQ ID NO: 6446319 - DNA, 14 bp, Homo sapiens
tctttttctggact

SEQ ID NO: 6446320 - DNA, 14 bp, Homo sapiens
tctttttctgttgt

SEQ ID NO: 6446321 - DNA, 17 bp, Homo sapiens
tctttttcttcttccct

SEQ ID NO: 6446322 - DNA, 12 bp, Homo sapiens
tctttttgaagt

SEQ ID NO: 6446323 - DNA, 14 bp, Homo sapiens
tctttttgaagtat

SEQ ID NO: 6446324 - DNA, 17 bp, Homo sapiens
tctttttgaagtattta

SEQ ID NO: 6446325 - DNA, 19 bp, Homo sapiens
tctttttgactcttgcaat

SEQ ID NO: 6446326 - DNA, 12 bp, Homo sapiens
tctttttgactg

SEQ ID NO: 6446327 - DNA, 22 bp, Homo sapiens
tctttttgataagcacattaaa

SEQ ID NO: 6446328 - DNA, 16 bp, Homo sapiens
tctttttgctttgctt

SEQ ID NO: 6446329 - DNA, 11 bp, Homo sapiens
tctttttgggg

SEQ ID NO: 6446330 - DNA, 12 bp, Homo sapiens
tctttttgggga

SEQ ID NO: 6446331 - DNA, 13 bp, Homo sapiens
tctttttgtactt

SEQ ID NO: 6446332 - DNA, 20 bp, Homo sapiens
tctttttgtagctggggctt

SEQ ID NO: 6446333 - DNA, 13 bp, Homo sapiens
tctttttgtataa

SEQ ID NO: 6446334 - DNA, 17 bp, Homo sapiens
tctttttgtgtgtgcca

SEQ ID NO: 6446335 - DNA, 15 bp, Homo sapiens
tctttttgtgtgtgt

SEQ ID NO: 6446336 - DNA, 17 bp, Homo sapiens
tctttttgtttgtttgt

SEQ ID NO: 6446337 - DNA, 14 bp, Homo sapiens
tcttttttaaaaac

SEQ ID NO: 6446338 - DNA, 19 bp, Homo sapiens
tcttttttaaaagagatgt

SEQ ID NO: 6446339 - DNA, 15 bp, Homo sapiens
tcttttttaaaatca

SEQ ID NO: 6446340 - DNA, 13 bp, Homo sapiens
tcttttttaaagt

SEQ ID NO: 6446341 - DNA, 14 bp, Homo sapiens
tcttttttaaatga

SEQ ID NO: 6446342 - DNA, 17 bp, Homo sapiens
tcttttttaaattttct

SEQ ID NO: 6446343 - DNA, 22 bp, Homo sapiens
tcttttttaaattttcttcagt

SEQ ID NO: 6446344 - DNA, 12 bp, Homo sapiens
tcttttttaacc

SEQ ID NO: 6446345 - DNA, 16 bp, Homo sapiens
tcttttttaagttgtc

SEQ ID NO: 6446346 - DNA, 19 bp, Homo sapiens
tcttttttactcattgaaa

SEQ ID NO: 6446347 - DNA, 22 bp, Homo sapiens
tcttttttactcattgaaatgt

SEQ ID NO: 6446348 - DNA, 15 bp, Homo sapiens
tcttttttagcataa

SEQ ID NO: 6446349 - DNA, 18 bp, Homo sapiens
tcttttttagtgttaaag

SEQ ID NO: 6446350 - DNA, 13 bp, Homo sapiens
tcttttttataac

SEQ ID NO: 6446351 - DNA, 13 bp, Homo sapiens
tcttttttatgtg

SEQ ID NO: 6446352 - DNA, 16 bp, Homo sapiens
tcttttttctctctta

SEQ ID NO: 6446353 - DNA, 16 bp, Homo sapiens
tcttttttgctttctt

SEQ ID NO: 6446354 - DNA, 20 bp, Homo sapiens
tcttttttgtaaaaactttt

SEQ ID NO: 6446355 - DNA, 22 bp, Homo sapiens
tcttttttgtttgtttctttgt

SEQ ID NO: 6446356 - DNA, 13 bp, Homo sapiens
tctttttttaaaa

SEQ ID NO: 6446357 - DNA, 22 bp, Homo sapiens
tctttttttaagtgttctgtgg

SEQ ID NO: 6446358 - DNA, 23 bp, Homo sapiens
tctttttttaagtgttctgtggc

SEQ ID NO: 6446359 - DNA, 16 bp, Homo sapiens
tctttttttccttcca

SEQ ID NO: 6446360 - DNA, 17 bp, Homo sapiens
tctttttttgagtgaca

SEQ ID NO: 6446361 - DNA, 17 bp, Homo sapiens
tctttttttgcatatta

SEQ ID NO: 6446362 - DNA, 22 bp, Homo sapiens
tctttttttggcaacctggctc

SEQ ID NO: 6446363 - DNA, 17 bp, Homo sapiens
tctttttttggcccagg

SEQ ID NO: 6446364 - DNA, 22 bp, Homo sapiens
tctttttttggtaaatttttga

SEQ ID NO: 6446365 - DNA, 22 bp, Homo sapiens
tctttttttggtgattcaaatg

SEQ ID NO: 6446366 - DNA, 23 bp, Homo sapiens
tctttttttgtatagttaacaca

SEQ ID NO: 6446367 - DNA, 14 bp, Homo sapiens
tctttttttgtgat

SEQ ID NO: 6446368 - DNA, 19 bp, Homo sapiens
tcttttttttaatgtgctg

SEQ ID NO: 6446369 - DNA, 20 bp, Homo sapiens
tcttttttttatataaatat

SEQ ID NO: 6446370 - DNA, 17 bp, Homo sapiens
tcttttttttcctttga

SEQ ID NO: 6446371 - DNA, 20 bp, Homo sapiens
tcttttttttctatttcact

SEQ ID NO: 6446372 - DNA, 19 bp, Homo sapiens
tcttttttttttaagtgaa

SEQ ID NO: 6446373 - DNA, 20 bp, Homo sapiens
tcttttttttttattatggt

SEQ ID NO: 6446374 - DNA, 17 bp, Homo sapiens
tcttttttttttcgtct

SEQ ID NO: 6446375 - DNA, 21 bp, Homo sapiens
tcttttttttttctgttgaag

SEQ ID NO: 6446376 - DNA, 21 bp, Homo sapiens
tctttttttttttgagacagt

SEQ ID NO: 6446377 - DNA, 23 bp, Homo sapiens
tctttttttttttttaataaatt

SEQ ID NO: 6446378 - DNA, 23 bp, Homo sapiens
tcttttttttttttttacagtat

SEQ ID NO: 6446379 - DNA, 23 bp, Homo sapiens
tctttttttttttttttttaatt

SEQ ID NO: 6446380 - DNA, 21 bp, Homo sapiens
tgaaaaaaaaaaacacaaaaa

SEQ ID NO: 6446381 - DNA, 18 bp, Homo sapiens
tgaaaaaaaaaaaccctt

SEQ ID NO: 6446382 - DNA, 18 bp, Homo sapiens
tgaaaaaaaaaatgttga

SEQ ID NO: 6446383 - DNA, 16 bp, Homo sapiens
tgaaaaaaaacagtgg

SEQ ID NO: 6446384 - DNA, 21 bp, Homo sapiens
tgaaaaaaaacctgagattta

SEQ ID NO: 6446385 - DNA, 15 bp, Homo sapiens
tgaaaaaaaagtttt

SEQ ID NO: 6446386 - DNA, 16 bp, Homo sapiens
tgaaaaaaaataaatt

SEQ ID NO: 6446387 - DNA, 14 bp, Homo sapiens
tgaaaaaaaataga

SEQ ID NO: 6446388 - DNA, 18 bp, Homo sapiens
tgaaaaaaaatagatgtt

SEQ ID NO: 6446389 - DNA, 14 bp, Homo sapiens
tgaaaaaaaatttg

SEQ ID NO: 6446390 - DNA, 11 bp, Homo sapiens
tgaaaaaaaga

SEQ ID NO: 6446391 - DNA, 19 bp, Homo sapiens
tgaaaaaaagttgctttgt

SEQ ID NO: 6446392 - DNA, 24 bp, Homo sapiens
tgaaaaaaatatatgattgtataa

SEQ ID NO: 6446393 - DNA, 13 bp, Homo sapiens
tgaaaaaaattat

SEQ ID NO: 6446394 - DNA, 18 bp, Homo sapiens
tgaaaaaaattattcatg

SEQ ID NO: 6446395 - DNA, 21 bp, Homo sapiens
tgaaaaaaattgaaataaata

SEQ ID NO: 6446396 - DNA, 20 bp, Homo sapiens
tgaaaaaaattggcattaaa

SEQ ID NO: 6446397 - DNA, 23 bp, Homo sapiens
tgaaaaaaccgttcaaattctct

SEQ ID NO: 6446398 - DNA, 20 bp, Homo sapiens
tgaaaaaagaaaatggctaa

SEQ ID NO: 6446399 - DNA, 12 bp, Homo sapiens
tgaaaaaagaag

SEQ ID NO: 6446400 - DNA, 16 bp, Homo sapiens
tgaaaaaagcagttct

SEQ ID NO: 6446401 - DNA, 11 bp, Homo sapiens
tgaaaaaagct

SEQ ID NO: 6446402 - DNA, 13 bp, Homo sapiens
tgaaaaaagctca

SEQ ID NO: 6446403 - DNA, 14 bp, Homo sapiens
tgaaaaaagctcat

SEQ ID NO: 6446404 - DNA, 18 bp, Homo sapiens
tgaaaaaaggacaatttc

SEQ ID NO: 6446405 - DNA, 17 bp, Homo sapiens
tgaaaaaatactaccta

SEQ ID NO: 6446406 - DNA, 23 bp, Homo sapiens
tgaaaaaatatatatcaaatata

SEQ ID NO: 6446407 - DNA, 19 bp, Homo sapiens
tgaaaaaatattaaatcaa

SEQ ID NO: 6446408 - DNA, 13 bp, Homo sapiens
tgaaaaaatgtaa

SEQ ID NO: 6446409 - DNA, 18 bp, Homo sapiens
tgaaaaaatgtatatgca

SEQ ID NO: 6446410 - DNA, 16 bp, Homo sapiens
tgaaaaaatgttcaaa

SEQ ID NO: 6446411 - DNA, 11 bp, Homo sapiens
tgaaaaaatta

SEQ ID NO: 6446412 - DNA, 14 bp, Homo sapiens
tgaaaaacaaacaa

SEQ ID NO: 6446413 - DNA, 17 bp, Homo sapiens
tgaaaaacaacaacaca

SEQ ID NO: 6446414 - DNA, 17 bp, Homo sapiens
tgaaaaacacggcagct

SEQ ID NO: 6446415 - DNA, 18 bp, Homo sapiens
tgaaaaacacggcagctg

SEQ ID NO: 6446416 - DNA, 22 bp, Homo sapiens
tgaaaaacacggcagctgtagc

SEQ ID NO: 6446417 - DNA, 19 bp, Homo sapiens
tgaaaaacatcccaaactt

SEQ ID NO: 6446418 - DNA, 20 bp, Homo sapiens
tgaaaaacatcccaaacttt

SEQ ID NO: 6446419 - DNA, 13 bp, Homo sapiens
tgaaaaacattag

SEQ ID NO: 6446420 - DNA, 18 bp, Homo sapiens
tgaaaaactagtaatact

SEQ ID NO: 6446421 - DNA, 11 bp, Homo sapiens
tgaaaaagaaa

SEQ ID NO: 6446422 - DNA, 13 bp, Homo sapiens
tgaaaaagaataa

SEQ ID NO: 6446423 - DNA, 20 bp, Homo sapiens
tgaaaaagaataaaaacttt

SEQ ID NO: 6446424 - DNA, 17 bp, Homo sapiens
tgaaaaagaatgaaaac

SEQ ID NO: 6446425 - DNA, 20 bp, Homo sapiens
tgaaaaagacataaaacaga

SEQ ID NO: 6446426 - DNA, 18 bp, Homo sapiens
tgaaaaagacttcaaatg

SEQ ID NO: 6446427 - DNA, 13 bp, Homo sapiens
tgaaaaagatggc

SEQ ID NO: 6446428 - DNA, 21 bp, Homo sapiens
tgaaaaagatggcttatgtca

SEQ ID NO: 6446429 - DNA, 23 bp, Homo sapiens
tgaaaaagcatgtacagtgttct

SEQ ID NO: 6446430 - DNA, 17 bp, Homo sapiens
tgaaaaagcctaagaaa

SEQ ID NO: 6446431 - DNA, 21 bp, Homo sapiens
tgaaaaaggaaaaatgtagac

SEQ ID NO: 6446432 - DNA, 16 bp, Homo sapiens
tgaaaaagtaggctgc

SEQ ID NO: 6446433 - DNA, 22 bp, Homo sapiens
tgaaaaagtatcctgcttctga

SEQ ID NO: 6446434 - DNA, 17 bp, Homo sapiens
tgaaaaagtgtacatga

SEQ ID NO: 6446435 - DNA, 12 bp, Homo sapiens
tgaaaaagtgtt

SEQ ID NO: 6446436 - DNA, 22 bp, Homo sapiens
tgaaaaagttctgcagataaac

SEQ ID NO: 6446437 - DNA, 15 bp, Homo sapiens
tgaaaaagtttgttt

SEQ ID NO: 6446438 - DNA, 15 bp, Homo sapiens
tgaaaaagttttaca

SEQ ID NO: 6446439 - DNA, 16 bp, Homo sapiens
tgaaaaagttttacaa

SEQ ID NO: 6446440 - DNA, 13 bp, Homo sapiens
tgaaaaataaaaa

SEQ ID NO: 6446441 - DNA, 13 bp, Homo sapiens
tgaaaaataaata

SEQ ID NO: 6446442 - DNA, 21 bp, Homo sapiens
tgaaaaatacgttttgtgtat

SEQ ID NO: 6446443 - DNA, 19 bp, Homo sapiens
tgaaaaatagcatatgcct

SEQ ID NO: 6446444 - DNA, 20 bp, Homo sapiens
tgaaaaatagtgtgtccatg

SEQ ID NO: 6446445 - DNA, 19 bp, Homo sapiens
tgaaaaatataaaattatg

SEQ ID NO: 6446446 - DNA, 12 bp, Homo sapiens
tgaaaaatatag

SEQ ID NO: 6446447 - DNA, 16 bp, Homo sapiens
tgaaaaatatgttgag

SEQ ID NO: 6446448 - DNA, 17 bp, Homo sapiens
tgaaaaatcagatgaat

SEQ ID NO: 6446449 - DNA, 20 bp, Homo sapiens
tgaaaaatcagatgaattga

SEQ ID NO: 6446450 - DNA, 13 bp, Homo sapiens
tgaaaaatctttt

SEQ ID NO: 6446451 - DNA, 18 bp, Homo sapiens
tgaaaaatgaaagatgat

SEQ ID NO: 6446452 - DNA, 16 bp, Homo sapiens
tgaaaaatgtaaatac

SEQ ID NO: 6446453 - DNA, 21 bp, Homo sapiens
tgaaaaatgtaatttagaaac

SEQ ID NO: 6446454 - DNA, 15 bp, Homo sapiens
tgaaaaatgtcacta

SEQ ID NO: 6446455 - DNA, 12 bp, Homo sapiens
tgaaaaattaac

SEQ ID NO: 6446456 - DNA, 16 bp, Homo sapiens
tgaaaaattaactttt

SEQ ID NO: 6446457 - DNA, 13 bp, Homo sapiens
tgaaaaattccta

SEQ ID NO: 6446458 - DNA, 20 bp, Homo sapiens
tgaaaaattcctattgtgat

SEQ ID NO: 6446459 - DNA, 19 bp, Homo sapiens
tgaaaaattcctttgtgtt

SEQ ID NO: 6446460 - DNA, 16 bp, Homo sapiens
tgaaaacaaacttctc

SEQ ID NO: 6446461 - DNA, 21 bp, Homo sapiens
tgaaaacaaataaaagttgaa

SEQ ID NO: 6446462 - DNA, 22 bp, Homo sapiens
tgaaaacaagaaagaaatggct

SEQ ID NO: 6446463 - DNA, 15 bp, Homo sapiens
tgaaaacaagagact

SEQ ID NO: 6446464 - DNA, 18 bp, Homo sapiens
tgaaaacaagcctccact

SEQ ID NO: 6446465 - DNA, 12 bp, Homo sapiens
tgaaaacaagtg

SEQ ID NO: 6446466 - DNA, 18 bp, Homo sapiens
tgaaaacaagtgctggca

SEQ ID NO: 6446467 - DNA, 18 bp, Homo sapiens
tgaaaacaagttccaaat

SEQ ID NO: 6446468 - DNA, 19 bp, Homo sapiens
tgaaaacaatactaaataa

SEQ ID NO: 6446469 - DNA, 16 bp, Homo sapiens
tgaaaacacactcaaa

SEQ ID NO: 6446470 - DNA, 22 bp, Homo sapiens
tgaaaacacactcaaaagacaa

SEQ ID NO: 6446471 - DNA, 13 bp, Homo sapiens
tgaaaacacattt

SEQ ID NO: 6446472 - DNA, 21 bp, Homo sapiens
tgaaaacacatttttcttagg

SEQ ID NO: 6446473 - DNA, 15 bp, Homo sapiens
tgaaaacaccaagag

SEQ ID NO: 6446474 - DNA, 19 bp, Homo sapiens
tgaaaacaccactgaacag

SEQ ID NO: 6446475 - DNA, 11 bp, Homo sapiens
tgaaaacactt

SEQ ID NO: 6446476 - DNA, 19 bp, Homo sapiens
tgaaaacacttattttaca

SEQ ID NO: 6446477 - DNA, 19 bp, Homo sapiens
tgaaaacacttgatgatgt

SEQ ID NO: 6446478 - DNA, 14 bp, Homo sapiens
tgaaaacagaaatt

SEQ ID NO: 6446479 - DNA, 21 bp, Homo sapiens
tgaaaacagaaattggtacct

SEQ ID NO: 6446480 - DNA, 15 bp, Homo sapiens
tgaaaacagaatcag

SEQ ID NO: 6446481 - DNA, 22 bp, Homo sapiens
tgaaaacagaatcagtgttaaa

SEQ ID NO: 6446482 - DNA, 19 bp, Homo sapiens
tgaaaacagtgtgtaaaca

SEQ ID NO: 6446483 - DNA, 20 bp, Homo sapiens
tgaaaacagtgtgtaaacaa

SEQ ID NO: 6446484 - DNA, 13 bp, Homo sapiens
tgaaaacatgtac

SEQ ID NO: 6446485 - DNA, 24 bp, Homo sapiens
tgaaaacatgtactacagctatat

SEQ ID NO: 6446486 - DNA, 19 bp, Homo sapiens
tgaaaacatttcaaagctg

SEQ ID NO: 6446487 - DNA, 17 bp, Homo sapiens
tgaaaacatttcttaaa

SEQ ID NO: 6446488 - DNA, 24 bp, Homo sapiens
tccatatctccttcccctacacct

SEQ ID NO: 6446489 - DNA, 23 bp, Homo sapiens
tccatatcttaaagaaacagctt

SEQ ID NO: 6446490 - DNA, 13 bp, Homo sapiens
tccatatgctctt

SEQ ID NO: 6446491 - DNA, 16 bp, Homo sapiens
tccatatggagcattt

SEQ ID NO: 6446492 - DNA, 21 bp, Homo sapiens
tccatatggatccactggctg

SEQ ID NO: 6446493 - DNA, 22 bp, Homo sapiens
tccatatgtgagcactatcttt

SEQ ID NO: 6446494 - DNA, 20 bp, Homo sapiens
tccatattacgttgtttctt

SEQ ID NO: 6446495 - DNA, 13 bp, Homo sapiens
tccatattagaaa

SEQ ID NO: 6446496 - DNA, 18 bp, Homo sapiens
tccatattagaaaacttt

SEQ ID NO: 6446497 - DNA, 11 bp, Homo sapiens
tccatatttac

SEQ ID NO: 6446498 - DNA, 14 bp, Homo sapiens
tccatatttattca

SEQ ID NO: 6446499 - DNA, 16 bp, Homo sapiens
tccatatttgatttct

SEQ ID NO: 6446500 - DNA, 18 bp, Homo sapiens
tccatatttgatttctaa

SEQ ID NO: 6446501 - DNA, 19 bp, Homo sapiens
tccatatttgatttctaat

SEQ ID NO: 6446502 - DNA, 14 bp, Homo sapiens
tccatatttgctaa

SEQ ID NO: 6446503 - DNA, 14 bp, Homo sapiens
tccatatttggaag

SEQ ID NO: 6446504 - DNA, 19 bp, Homo sapiens
tccatattttattactgtt

SEQ ID NO: 6446505 - DNA, 23 bp, Homo sapiens
tccatattttattactgtttatt

SEQ ID NO: 6446506 - DNA, 23 bp, Homo sapiens
tccatatttttttccttacataa

SEQ ID NO: 6446507 - DNA, 13 bp, Homo sapiens
tccatcaataaat

SEQ ID NO: 6446508 - DNA, 14 bp, Homo sapiens
tccatcacagccag

SEQ ID NO: 6446509 - DNA, 21 bp, Homo sapiens
tccatcaccatttcttggcat

SEQ ID NO: 6446510 - DNA, 16 bp, Homo sapiens
tccatcacccctggtg

SEQ ID NO: 6446511 - DNA, 23 bp, Homo sapiens
tccatcacccctggtggctgcag

SEQ ID NO: 6446512 - DNA, 15 bp, Homo sapiens
tccatcaccctttcc

SEQ ID NO: 6446513 - DNA, 19 bp, Homo sapiens
tccatcaccctttccggca

SEQ ID NO: 6446514 - DNA, 20 bp, Homo sapiens
tccatcacctgaaacactgg

SEQ ID NO: 6446515 - DNA, 16 bp, Homo sapiens
tccatcactataataa

SEQ ID NO: 6446516 - DNA, 15 bp, Homo sapiens
tccatcagaatgaaa

SEQ ID NO: 6446517 - DNA, 22 bp, Homo sapiens
tccatcagagatgggaaaacca

SEQ ID NO: 6446518 - DNA, 12 bp, Homo sapiens
tccatcagcagt

SEQ ID NO: 6446519 - DNA, 16 bp, Homo sapiens
tccatcagctctctgc

SEQ ID NO: 6446520 - DNA, 13 bp, Homo sapiens
tccatcaggactt

SEQ ID NO: 6446521 - DNA, 15 bp, Homo sapiens
tccatcaggcagata

SEQ ID NO: 6446522 - DNA, 14 bp, Homo sapiens
tccatcaggccact

SEQ ID NO: 6446523 - DNA, 17 bp, Homo sapiens
tccatcagttagagctg

SEQ ID NO: 6446524 - DNA, 15 bp, Homo sapiens
tccatcatcactgta

SEQ ID NO: 6446525 - DNA, 16 bp, Homo sapiens
tccatcatctcttttc

SEQ ID NO: 6446526 - DNA, 18 bp, Homo sapiens
tccatcatctcttttccc

SEQ ID NO: 6446527 - DNA, 15 bp, Homo sapiens
tccatcatgtcccca

SEQ ID NO: 6446528 - DNA, 16 bp, Homo sapiens
tccatcatgtccccaa

SEQ ID NO: 6446529 - DNA, 15 bp, Homo sapiens
tccatcatgtctgta

SEQ ID NO: 6446530 - DNA, 13 bp, Homo sapiens
tccatcatttctg

SEQ ID NO: 6446531 - DNA, 13 bp, Homo sapiens
tccatccaaggcc

SEQ ID NO: 6446532 - DNA, 19 bp, Homo sapiens
tccatccacccctctggca

SEQ ID NO: 6446533 - DNA, 12 bp, Homo sapiens
tccatccatcct

SEQ ID NO: 6446534 - DNA, 15 bp, Homo sapiens
tccatccatctccag

SEQ ID NO: 6446535 - DNA, 15 bp, Homo sapiens
tccatccatctgtcc

SEQ ID NO: 6446536 - DNA, 18 bp, Homo sapiens
tccatccatctgtccgtc

SEQ ID NO: 6446537 - DNA, 15 bp, Homo sapiens
tccatccatggccag

SEQ ID NO: 6446538 - DNA, 16 bp, Homo sapiens
tccatccatggccagc

SEQ ID NO: 6446539 - DNA, 17 bp, Homo sapiens
tccatccatggccagca

SEQ ID NO: 6446540 - DNA, 19 bp, Homo sapiens
tccatccatggccagcagc

SEQ ID NO: 6446541 - DNA, 21 bp, Homo sapiens
tccatccattacctccatcca

SEQ ID NO: 6446542 - DNA, 22 bp, Homo sapiens
tccatcccaaccagtgccaagg

SEQ ID NO: 6446543 - DNA, 15 bp, Homo sapiens
tccatcccagcggct

SEQ ID NO: 6446544 - DNA, 17 bp, Homo sapiens
tccatccccctctgtct

SEQ ID NO: 6446545 - DNA, 17 bp, Homo sapiens
tccatcccccttcttcc

SEQ ID NO: 6446546 - DNA, 18 bp, Homo sapiens
tccatcccccttcttcct

SEQ ID NO: 6446547 - DNA, 19 bp, Homo sapiens
tccatcccccttcttcctc

SEQ ID NO: 6446548 - DNA, 20 bp, Homo sapiens
tccatcccccttcttcctcc

SEQ ID NO: 6446549 - DNA, 17 bp, Homo sapiens
tccatcccctccctgcc

SEQ ID NO: 6446550 - DNA, 21 bp, Homo sapiens
tccatcccctccctgcctgct

SEQ ID NO: 6446551 - DNA, 23 bp, Homo sapiens
tccatcccctccctgcctgctcc

SEQ ID NO: 6446552 - DNA, 23 bp, Homo sapiens
tccatccccttcccccatcccta

SEQ ID NO: 6446553 - DNA, 22 bp, Homo sapiens
tccatccctagaagagcacaga

SEQ ID NO: 6446554 - DNA, 18 bp, Homo sapiens
tccatccctccattcatc

SEQ ID NO: 6446555 - DNA, 12 bp, Homo sapiens
tccatccctcta

SEQ ID NO: 6446556 - DNA, 23 bp, Homo sapiens
tccatccctctaatgagactgac

SEQ ID NO: 6446557 - DNA, 18 bp, Homo sapiens
tccatccctctcctctgc

SEQ ID NO: 6446558 - DNA, 13 bp, Homo sapiens
tccatccctgctc

SEQ ID NO: 6446559 - DNA, 14 bp, Homo sapiens
tccatccctggccc

SEQ ID NO: 6446560 - DNA, 23 bp, Homo sapiens
tccatccctggccccctccctgg

SEQ ID NO: 6446561 - DNA, 20 bp, Homo sapiens
tccatccctggtgaaagagt

SEQ ID NO: 6446562 - DNA, 16 bp, Homo sapiens
tccatcccttccccag

SEQ ID NO: 6446563 - DNA, 22 bp, Homo sapiens
tccatccctttccctcgctcga

SEQ ID NO: 6446564 - DNA, 14 bp, Homo sapiens
tccatcccttttcc

SEQ ID NO: 6446565 - DNA, 23 bp, Homo sapiens
tccatcccttttcctgtcagtgt

SEQ ID NO: 6446566 - DNA, 18 bp, Homo sapiens
tccatccgactgcccctg

SEQ ID NO: 6446567 - DNA, 19 bp, Homo sapiens
tccatccgtctctgtccgc

SEQ ID NO: 6446568 - DNA, 15 bp, Homo sapiens
tccatcctcccagga

SEQ ID NO: 6446569 - DNA, 14 bp, Homo sapiens
tccatcctcctctc

SEQ ID NO: 6446570 - DNA, 17 bp, Homo sapiens
tccatcctcctctccat

SEQ ID NO: 6446571 - DNA, 12 bp, Homo sapiens
tccatcctgagg

SEQ ID NO: 6446572 - DNA, 13 bp, Homo sapiens
tccatcctgagga

SEQ ID NO: 6446573 - DNA, 22 bp, Homo sapiens
tccatcctgaggaccgccccaa

SEQ ID NO: 6446574 - DNA, 19 bp, Homo sapiens
tccatcctgaggctccact

SEQ ID NO: 6446575 - DNA, 23 bp, Homo sapiens
tccatcctgcaaaggcccttgtc

SEQ ID NO: 6446576 - DNA, 14 bp, Homo sapiens
tccatcctgccagg

SEQ ID NO: 6446577 - DNA, 15 bp, Homo sapiens
tccatcctgccagga

SEQ ID NO: 6446578 - DNA, 17 bp, Homo sapiens
tccatcctgctcttcca

SEQ ID NO: 6446579 - DNA, 17 bp, Homo sapiens
tccatcctgtacaagtg

SEQ ID NO: 6446580 - DNA, 23 bp, Homo sapiens
tccatcctgtacaagtgctcagt

SEQ ID NO: 6446581 - DNA, 18 bp, Homo sapiens
tccatccttccaacatat

SEQ ID NO: 6446582 - DNA, 16 bp, Homo sapiens
tccatccttctcccca

SEQ ID NO: 6446583 - DNA, 17 bp, Homo sapiens
tccatcctttctgcctc

SEQ ID NO: 6446584 - DNA, 17 bp, Homo sapiens
tccatcctttgcatttc

SEQ ID NO: 6446585 - DNA, 17 bp, Homo sapiens
tccatcctttgtcttgg

SEQ ID NO: 6446586 - DNA, 17 bp, Homo sapiens
tccatccttttgcttca

SEQ ID NO: 6446587 - DNA, 20 bp, Homo sapiens
tccatccttttgcttcatct

SEQ ID NO: 6446588 - DNA, 23 bp, Homo sapiens
tccatcgcgccagcgacctctct

SEQ ID NO: 6446589 - DNA, 15 bp, Homo sapiens
tccatcggggcaggg

SEQ ID NO: 6446590 - DNA, 16 bp, Homo sapiens
tccatcgtctcatcct

SEQ ID NO: 6446591 - DNA, 21 bp, Homo sapiens
tccatcgtctcatcctccttt

SEQ ID NO: 6446592 - DNA, 23 bp, Homo sapiens
tccatcgtctcatcctcctttca

SEQ ID NO: 6446593 - DNA, 14 bp, Homo sapiens
tccatctaaaaata

SEQ ID NO: 6446594 - DNA, 22 bp, Homo sapiens
tccatctaaaatactcaccaaa

SEQ ID NO: 6446595 - DNA, 21 bp, Homo sapiens
tccatctaaatacctgccctg

SEQ ID NO: 6446596 - DNA, 19 bp, Homo sapiens
tccatctagcagctggcct

SEQ ID NO: 6446597 - DNA, 17 bp, Homo sapiens
tccatctatcactgcat

SEQ ID NO: 6446598 - DNA, 16 bp, Homo sapiens
tccatctcaaaacaaa

SEQ ID NO: 6446599 - DNA, 17 bp, Homo sapiens
tccatctcaaaacaaaa

SEQ ID NO: 6446600 - DNA, 16 bp, Homo sapiens
tccatctcaaaagtat

SEQ ID NO: 6446601 - DNA, 21 bp, Homo sapiens
tccatctcagactgtggaacc

SEQ ID NO: 6446602 - DNA, 16 bp, Homo sapiens
tccatctccaagaatg

SEQ ID NO: 6446603 - DNA, 21 bp, Homo sapiens
tccatctccaagaatgctgaa

SEQ ID NO: 6446604 - DNA, 13 bp, Homo sapiens
tccatctccaggg

SEQ ID NO: 6446605 - DNA, 21 bp, Homo sapiens
tccatctcccaaggctgccag

SEQ ID NO: 6446606 - DNA, 13 bp, Homo sapiens
tccatctccgcct

SEQ ID NO: 6446607 - DNA, 22 bp, Homo sapiens
tccatctccgcctccacactga

SEQ ID NO: 6446608 - DNA, 16 bp, Homo sapiens
tccatctctctccctt

SEQ ID NO: 6446609 - DNA, 16 bp, Homo sapiens
tccatctctctcttgc

SEQ ID NO: 6446610 - DNA, 17 bp, Homo sapiens
tccatctctctcttgcc

SEQ ID NO: 6446611 - DNA, 17 bp, Homo sapiens
tccatctctctggccct

SEQ ID NO: 6446612 - DNA, 14 bp, Homo sapiens
tccatctctgaaaa

SEQ ID NO: 6446613 - DNA, 12 bp, Homo sapiens
tccatctctgcc

SEQ ID NO: 6446614 - DNA, 12 bp, Homo sapiens
tccatctctggt

SEQ ID NO: 6446615 - DNA, 13 bp, Homo sapiens
tccatctcttcct

SEQ ID NO: 6446616 - DNA, 15 bp, Homo sapiens
tccatctcttccttc

SEQ ID NO: 6446617 - DNA, 16 bp, Homo sapiens
tccatctcttccttca

SEQ ID NO: 6446618 - DNA, 20 bp, Homo sapiens
tccatctcttgcttgttcct

SEQ ID NO: 6446619 - DNA, 13 bp, Homo sapiens
tccatctgacaaa

SEQ ID NO: 6446620 - DNA, 12 bp, Homo sapiens
tccatctgagga

SEQ ID NO: 6446621 - DNA, 13 bp, Homo sapiens
tccatctgaggac

SEQ ID NO: 6446622 - DNA, 20 bp, Homo sapiens
tccatctgggctaccccacc

SEQ ID NO: 6446623 - DNA, 22 bp, Homo sapiens
tccatctggtagaagggaaagc

SEQ ID NO: 6446624 - DNA, 14 bp, Homo sapiens
tccatctgtacttg

SEQ ID NO: 6446625 - DNA, 17 bp, Homo sapiens
tccatctgtacttggtc

SEQ ID NO: 6446626 - DNA, 16 bp, Homo sapiens
tccatctgtctgtcct

SEQ ID NO: 6446627 - DNA, 19 bp, Homo sapiens
tccatctgtgccatacttg

SEQ ID NO: 6446628 - DNA, 19 bp, Homo sapiens
tccatctgtggaaatgaca

SEQ ID NO: 6446629 - DNA, 23 bp, Homo sapiens
tccatcttcagcttcttcatctt

SEQ ID NO: 6446630 - DNA, 16 bp, Homo sapiens
tccatcttcagtttct

SEQ ID NO: 6446631 - DNA, 22 bp, Homo sapiens
tccatcttccctacccttcctg

SEQ ID NO: 6446632 - DNA, 18 bp, Homo sapiens
tccatcttctccccacag

SEQ ID NO: 6446633 - DNA, 21 bp, Homo sapiens
tccatcttctccccacagcct

SEQ ID NO: 6446634 - DNA, 14 bp, Homo sapiens
tccatcttgctttt

SEQ ID NO: 6446635 - DNA, 22 bp, Homo sapiens
tccatcttggtagttctgtgcc

SEQ ID NO: 6446636 - DNA, 18 bp, Homo sapiens
tccatcttgtttcatttg

SEQ ID NO: 6446637 - DNA, 15 bp, Homo sapiens
tccatctttttcttg

SEQ ID NO: 6446638 - DNA, 15 bp, Homo sapiens
tccatgaaaaacagc

SEQ ID NO: 6446639 - DNA, 18 bp, Homo sapiens
tccatgaaaaacagcaga

SEQ ID NO: 6446640 - DNA, 11 bp, Homo sapiens
tccatgaaaac

SEQ ID NO: 6446641 - DNA, 22 bp, Homo sapiens
tccatgaaaacgttttattgtg

SEQ ID NO: 6446642 - DNA, 15 bp, Homo sapiens
tccatgaaaatacca

SEQ ID NO: 6446643 - DNA, 12 bp, Homo sapiens
tccatgaaaatg

SEQ ID NO: 6446644 - DNA, 18 bp, Homo sapiens
tccatgaaccctgcccca

SEQ ID NO: 6446645 - DNA, 17 bp, Homo sapiens
tccatgaagacacgctt

SEQ ID NO: 6446646 - DNA, 20 bp, Homo sapiens
tccatgaagaccacatccac

SEQ ID NO: 6446647 - DNA, 21 bp, Homo sapiens
tccatgaagaccacatccaca

SEQ ID NO: 6446648 - DNA, 20 bp, Homo sapiens
tccatgaagagcttgtgtcc

SEQ ID NO: 6446649 - DNA, 12 bp, Homo sapiens
tccatgaatgta

SEQ ID NO: 6446650 - DNA, 13 bp, Homo sapiens
tccatgaatgtat

SEQ ID NO: 6446651 - DNA, 15 bp, Homo sapiens
tccatgaatgtatca

SEQ ID NO: 6446652 - DNA, 15 bp, Homo sapiens
tccatgaatgttcct

SEQ ID NO: 6446653 - DNA, 19 bp, Homo sapiens
tccatgaatgttcctgcct

SEQ ID NO: 6446654 - DNA, 23 bp, Homo sapiens
tccatgaattaaatctgtttcct

SEQ ID NO: 6446655 - DNA, 23 bp, Homo sapiens
tccatgacaatatgccctttctg

SEQ ID NO: 6446656 - DNA, 20 bp, Homo sapiens
tccatgacaggcctgaagat

SEQ ID NO: 6446657 - DNA, 14 bp, Homo sapiens
tccatgacatcaag

SEQ ID NO: 6446658 - DNA, 15 bp, Homo sapiens
tccatgacatcaaga

SEQ ID NO: 6446659 - DNA, 15 bp, Homo sapiens
tccatgaccaggcca

SEQ ID NO: 6446660 - DNA, 16 bp, Homo sapiens
tccatgaccaggccac

SEQ ID NO: 6446661 - DNA, 15 bp, Homo sapiens
tccatgactggctgt

SEQ ID NO: 6446662 - DNA, 15 bp, Homo sapiens
tccatgagcacccca

SEQ ID NO: 6446663 - DNA, 14 bp, Homo sapiens
tccatgagctgctc

SEQ ID NO: 6446664 - DNA, 23 bp, Homo sapiens
tccatgagggcaggcacatgttg

SEQ ID NO: 6446665 - DNA, 23 bp, Homo sapiens
tccatgagttttttctcttgggc

SEQ ID NO: 6446666 - DNA, 15 bp, Homo sapiens
tccatgatacaaaga

SEQ ID NO: 6446667 - DNA, 23 bp, Homo sapiens
tgaaaaccaaattttaaaagcca

SEQ ID NO: 6446668 - DNA, 18 bp, Homo sapiens
tgaaaaccaacaccatca

SEQ ID NO: 6446669 - DNA, 17 bp, Homo sapiens
tgaaaaccacagtcagt

SEQ ID NO: 6446670 - DNA, 22 bp, Homo sapiens
tgaaaaccatattttattgtat

SEQ ID NO: 6446671 - DNA, 16 bp, Homo sapiens
tgaaaacccaaggcca

SEQ ID NO: 6446672 - DNA, 13 bp, Homo sapiens
tgaaaacccagac

SEQ ID NO: 6446673 - DNA, 14 bp, Homo sapiens
tgaaaacccagaga

SEQ ID NO: 6446674 - DNA, 22 bp, Homo sapiens
tgaaaaccctcgatgttcatgg

SEQ ID NO: 6446675 - DNA, 16 bp, Homo sapiens
tgaaaaccgtaaagtg

SEQ ID NO: 6446676 - DNA, 20 bp, Homo sapiens
tgaaaaccgtaaagtgcctt

SEQ ID NO: 6446677 - DNA, 15 bp, Homo sapiens
tgaaaacctgtcact

SEQ ID NO: 6446678 - DNA, 20 bp, Homo sapiens
tgaaaacgcttaggccatga

SEQ ID NO: 6446679 - DNA, 16 bp, Homo sapiens
tgaaaacgttttattg

SEQ ID NO: 6446680 - DNA, 18 bp, Homo sapiens
tgaaaacgttttattgtg

SEQ ID NO: 6446681 - DNA, 18 bp, Homo sapiens
tgaaaactaatgtactgt

SEQ ID NO: 6446682 - DNA, 15 bp, Homo sapiens
tgaaaactacatttt

SEQ ID NO: 6446683 - DNA, 21 bp, Homo sapiens
tgaaaactacattttaacatg

SEQ ID NO: 6446684 - DNA, 14 bp, Homo sapiens
tgaaaactagcatt

SEQ ID NO: 6446685 - DNA, 20 bp, Homo sapiens
tgaaaactagggctcatttt

SEQ ID NO: 6446686 - DNA, 13 bp, Homo sapiens
tgaaaactataca

SEQ ID NO: 6446687 - DNA, 14 bp, Homo sapiens
tgaaaactatacaa

SEQ ID NO: 6446688 - DNA, 15 bp, Homo sapiens
tgaaaactattttaa

SEQ ID NO: 6446689 - DNA, 19 bp, Homo sapiens
tgaaaactcattacttttc

SEQ ID NO: 6446690 - DNA, 13 bp, Homo sapiens
tgaaaactctggt

SEQ ID NO: 6446691 - DNA, 18 bp, Homo sapiens
tgaaaactctttgctgct

SEQ ID NO: 6446692 - DNA, 17 bp, Homo sapiens
tgaaaactgacatcaga

SEQ ID NO: 6446693 - DNA, 23 bp, Homo sapiens
tgaaaactggaataagaagcaaa

SEQ ID NO: 6446694 - DNA, 13 bp, Homo sapiens
tgaaaactgtaaa

SEQ ID NO: 6446695 - DNA, 17 bp, Homo sapiens
tgaaaactgtaaataca

SEQ ID NO: 6446696 - DNA, 18 bp, Homo sapiens
tgaaaactgtaaatacaa

SEQ ID NO: 6446697 - DNA, 20 bp, Homo sapiens
tgaaaactgtaaatacaaaa

SEQ ID NO: 6446698 - DNA, 19 bp, Homo sapiens
tgaaaactgtgcaactttt

SEQ ID NO: 6446699 - DNA, 21 bp, Homo sapiens
tgaaaactgtgcaacttttta

SEQ ID NO: 6446700 - DNA, 17 bp, Homo sapiens
tgaaaacttagccagag

SEQ ID NO: 6446701 - DNA, 19 bp, Homo sapiens
tgaaaacttcaaagctgaa

SEQ ID NO: 6446702 - DNA, 23 bp, Homo sapiens
tgaaaacttgctgaaaaacacaa

SEQ ID NO: 6446703 - DNA, 21 bp, Homo sapiens
tgaaaactttggagaactcat

SEQ ID NO: 6446704 - DNA, 17 bp, Homo sapiens
tgaaaacttttctcaga

SEQ ID NO: 6446705 - DNA, 16 bp, Homo sapiens
tgaaaacttttgtaaa

SEQ ID NO: 6446706 - DNA, 19 bp, Homo sapiens
tgaaaacttttgtaaatta

SEQ ID NO: 6446707 - DNA, 15 bp, Homo sapiens
tgaaaactttttaat

SEQ ID NO: 6446708 - DNA, 20 bp, Homo sapiens
tgaaaagaaaaatgagcctg

SEQ ID NO: 6446709 - DNA, 23 bp, Homo sapiens
tgaaaagaaaacttaaagaggaa

SEQ ID NO: 6446710 - DNA, 13 bp, Homo sapiens
tgaaaagaaataa

SEQ ID NO: 6446711 - DNA, 16 bp, Homo sapiens
tgaaaagaaataataa

SEQ ID NO: 6446712 - DNA, 17 bp, Homo sapiens
tgaaaagaaatgctaat

SEQ ID NO: 6446713 - DNA, 22 bp, Homo sapiens
tgaaaagaagaaagtctatgct

SEQ ID NO: 6446714 - DNA, 15 bp, Homo sapiens
tgaaaagaaggaata

SEQ ID NO: 6446715 - DNA, 13 bp, Homo sapiens
tgaaaagaattgt

SEQ ID NO: 6446716 - DNA, 18 bp, Homo sapiens
tgaaaagacatcaagcac

SEQ ID NO: 6446717 - DNA, 18 bp, Homo sapiens
tgaaaagacgctaataaa

SEQ ID NO: 6446718 - DNA, 16 bp, Homo sapiens
tgaaaagactccaaag

SEQ ID NO: 6446719 - DNA, 14 bp, Homo sapiens
tgaaaagagaaact

SEQ ID NO: 6446720 - DNA, 21 bp, Homo sapiens
tgaaaagagaatgatgctcaa

SEQ ID NO: 6446721 - DNA, 13 bp, Homo sapiens
tgaaaagaggtgt

SEQ ID NO: 6446722 - DNA, 18 bp, Homo sapiens
tgaaaagagtatgtagtg

SEQ ID NO: 6446723 - DNA, 16 bp, Homo sapiens
tgaaaagataaattat

SEQ ID NO: 6446724 - DNA, 16 bp, Homo sapiens
tgaaaagatcccaaga

SEQ ID NO: 6446725 - DNA, 21 bp, Homo sapiens
tgaaaagatcccaagatggag

SEQ ID NO: 6446726 - DNA, 14 bp, Homo sapiens
tgaaaagattcttc

SEQ ID NO: 6446727 - DNA, 14 bp, Homo sapiens
tgaaaagattgcaa

SEQ ID NO: 6446728 - DNA, 15 bp, Homo sapiens
tgaaaagattgcaaa

SEQ ID NO: 6446729 - DNA, 16 bp, Homo sapiens
tgaaaagattttattt

SEQ ID NO: 6446730 - DNA, 14 bp, Homo sapiens
tgaaaagcaataca

SEQ ID NO: 6446731 - DNA, 13 bp, Homo sapiens
tgaaaagcacaca

SEQ ID NO: 6446732 - DNA, 13 bp, Homo sapiens
tgaaaagcacaga

SEQ ID NO: 6446733 - DNA, 20 bp, Homo sapiens
tgaaaagcacagctgtatat

SEQ ID NO: 6446734 - DNA, 19 bp, Homo sapiens
tgaaaagccatgtttaaga

SEQ ID NO: 6446735 - DNA, 22 bp, Homo sapiens
tgaaaagccatgtttaagattt

SEQ ID NO: 6446736 - DNA, 23 bp, Homo sapiens
tgaaaagccatgtttaagattta

SEQ ID NO: 6446737 - DNA, 19 bp, Homo sapiens
tgaaaagcctctgttttga

SEQ ID NO: 6446738 - DNA, 15 bp, Homo sapiens
tgaaaagctaccctg

SEQ ID NO: 6446739 - DNA, 17 bp, Homo sapiens
tgaaaagctagaattga

SEQ ID NO: 6446740 - DNA, 22 bp, Homo sapiens
tgaaaagctatcttaaaatata

SEQ ID NO: 6446741 - DNA, 17 bp, Homo sapiens
tgaaaagctattagcca

SEQ ID NO: 6446742 - DNA, 20 bp, Homo sapiens
tgaaaagctattagccagga

SEQ ID NO: 6446743 - DNA, 20 bp, Homo sapiens
tgaaaagctcacttcaagct

SEQ ID NO: 6446744 - DNA, 20 bp, Homo sapiens
tgaaaagctccatttttagt

SEQ ID NO: 6446745 - DNA, 22 bp, Homo sapiens
tgaaaagctgcatttaaatcaa

SEQ ID NO: 6446746 - DNA, 16 bp, Homo sapiens
tgaaaagcttcttaat

SEQ ID NO: 6446747 - DNA, 17 bp, Homo sapiens
tgaaaagcttcttaatt

SEQ ID NO: 6446748 - DNA, 17 bp, Homo sapiens
tgaaaagctttgtttgt

SEQ ID NO: 6446749 - DNA, 22 bp, Homo sapiens
tgaaaaggacaaataaagcaat

SEQ ID NO: 6446750 - DNA, 15 bp, Homo sapiens
tgaaaaggactcttg

SEQ ID NO: 6446751 - DNA, 21 bp, Homo sapiens
tgaaaaggactcttgagccct

SEQ ID NO: 6446752 - DNA, 19 bp, Homo sapiens
tgaaaaggcagcatttgaa

SEQ ID NO: 6446753 - DNA, 23 bp, Homo sapiens
tgaaaaggcagcatttgaatact

SEQ ID NO: 6446754 - DNA, 14 bp, Homo sapiens
tgaaaaggccaaga

SEQ ID NO: 6446755 - DNA, 19 bp, Homo sapiens
tgaaaagggtcagaaggat

SEQ ID NO: 6446756 - DNA, 20 bp, Homo sapiens
tgaaaagggtgttgggaggg

SEQ ID NO: 6446757 - DNA, 23 bp, Homo sapiens
tgaaaaggtgaccttgcaacttc

SEQ ID NO: 6446758 - DNA, 18 bp, Homo sapiens
tgaaaaggtgtccttttc

SEQ ID NO: 6446759 - DNA, 17 bp, Homo sapiens
tgaaaaggttgcctgaa

SEQ ID NO: 6446760 - DNA, 22 bp, Homo sapiens
tgaaaaggtttatgaaaaagaa

SEQ ID NO: 6446761 - DNA, 21 bp, Homo sapiens
tgaaaagtaatatttattaaa

SEQ ID NO: 6446762 - DNA, 20 bp, Homo sapiens
tgaaaagtagcaattatgga

SEQ ID NO: 6446763 - DNA, 20 bp, Homo sapiens
tgaaaagtatcactctaaaa

SEQ ID NO: 6446764 - DNA, 18 bp, Homo sapiens
tgaaaagtattggttact

SEQ ID NO: 6446765 - DNA, 22 bp, Homo sapiens
tgaaaagtcgttttccaaactg

SEQ ID NO: 6446766 - DNA, 12 bp, Homo sapiens
tgaaaagtttag

SEQ ID NO: 6446767 - DNA, 14 bp, Homo sapiens
tgaaaataaaataa

SEQ ID NO: 6446768 - DNA, 15 bp, Homo sapiens
tgaaaataaaataaa

SEQ ID NO: 6446769 - DNA, 16 bp, Homo sapiens
tgaaaataaagaatgg

SEQ ID NO: 6446770 - DNA, 20 bp, Homo sapiens
tgaaaataaagcagaagcaa

SEQ ID NO: 6446771 - DNA, 15 bp, Homo sapiens
tgaaaataactgaac

SEQ ID NO: 6446772 - DNA, 18 bp, Homo sapiens
tgaaaataagccatgaga

SEQ ID NO: 6446773 - DNA, 13 bp, Homo sapiens
tgaaaataataaa

SEQ ID NO: 6446774 - DNA, 15 bp, Homo sapiens
tgaaaataataaagt

SEQ ID NO: 6446775 - DNA, 19 bp, Homo sapiens
tgaaaataatttgttgtac

SEQ ID NO: 6446776 - DNA, 14 bp, Homo sapiens
tgaaaataattttc

SEQ ID NO: 6446777 - DNA, 23 bp, Homo sapiens
tgaaaatacaacttaaataataa

SEQ ID NO: 6446778 - DNA, 14 bp, Homo sapiens
tgaaaatacatttc

SEQ ID NO: 6446779 - DNA, 18 bp, Homo sapiens
tgaaaataccatcaggcc

SEQ ID NO: 6446780 - DNA, 19 bp, Homo sapiens
tgaaaatacttttgcattt

SEQ ID NO: 6446781 - DNA, 22 bp, Homo sapiens
tgaaaatagctatttttttcct

SEQ ID NO: 6446782 - DNA, 22 bp, Homo sapiens
tgaaaatagtgtaagaactgta

SEQ ID NO: 6446783 - DNA, 14 bp, Homo sapiens
tgaaaatataacca

SEQ ID NO: 6446784 - DNA, 23 bp, Homo sapiens
tgaaaatatacttgactctaata

SEQ ID NO: 6446785 - DNA, 21 bp, Homo sapiens
tgaaaatatagacattctcac

SEQ ID NO: 6446786 - DNA, 23 bp, Homo sapiens
tgaaaatatagacattctcacat

SEQ ID NO: 6446787 - DNA, 13 bp, Homo sapiens
tgaaaatatatac

SEQ ID NO: 6446788 - DNA, 16 bp, Homo sapiens
tgaaaatatgtactgt

SEQ ID NO: 6446789 - DNA, 23 bp, Homo sapiens
tgaaaatatgtctgcaggtttct

SEQ ID NO: 6446790 - DNA, 16 bp, Homo sapiens
tgaaaatattctactg

SEQ ID NO: 6446791 - DNA, 22 bp, Homo sapiens
tgaaaatattctgattggtctg

SEQ ID NO: 6446792 - DNA, 20 bp, Homo sapiens
tgaaaatattgttttacaat

SEQ ID NO: 6446793 - DNA, 14 bp, Homo sapiens
tgaaaatatttaca

SEQ ID NO: 6446794 - DNA, 22 bp, Homo sapiens
tgaaaatatttctatgtaaatt

SEQ ID NO: 6446795 - DNA, 17 bp, Homo sapiens
tgaaaatatttgtatca

SEQ ID NO: 6446796 - DNA, 22 bp, Homo sapiens
tgaaaatatttgtatcacaaat

SEQ ID NO: 6446797 - DNA, 17 bp, Homo sapiens
tgaaaatattttaccca

SEQ ID NO: 6446798 - DNA, 23 bp, Homo sapiens
tgaaaatattttttatatataca

SEQ ID NO: 6446799 - DNA, 21 bp, Homo sapiens
tgaaaatatttttttctagct

SEQ ID NO: 6446800 - DNA, 22 bp, Homo sapiens
tgaaaatatttttttctagcta

SEQ ID NO: 6446801 - DNA, 13 bp, Homo sapiens
tgaaaatcaaagt

SEQ ID NO: 6446802 - DNA, 12 bp, Homo sapiens
tgaaaatcaaat

SEQ ID NO: 6446803 - DNA, 15 bp, Homo sapiens
tgaaaatcctaccaa

SEQ ID NO: 6446804 - DNA, 16 bp, Homo sapiens
tgaaaatcctatatct

SEQ ID NO: 6446805 - DNA, 17 bp, Homo sapiens
tgaaaatcctatatctg

SEQ ID NO: 6446806 - DNA, 16 bp, Homo sapiens
tgaaaatcctgaataa

SEQ ID NO: 6446807 - DNA, 17 bp, Homo sapiens
tgaaaatcctgaataaa

SEQ ID NO: 6446808 - DNA, 14 bp, Homo sapiens
tgaaaatctaatat

SEQ ID NO: 6446809 - DNA, 17 bp, Homo sapiens
tgaaaatctaatattaa

SEQ ID NO: 6446810 - DNA, 14 bp, Homo sapiens
tgaaaatgaagaag

SEQ ID NO: 6446811 - DNA, 16 bp, Homo sapiens
tgaaaatgaagaagga

SEQ ID NO: 6446812 - DNA, 12 bp, Homo sapiens
tgaaaatgaata

SEQ ID NO: 6446813 - DNA, 23 bp, Homo sapiens
tgaaaatgaatatctattaatat

SEQ ID NO: 6446814 - DNA, 22 bp, Homo sapiens
tgaaaatgaatgccgaatttgg

SEQ ID NO: 6446815 - DNA, 19 bp, Homo sapiens
tgaaaatgagcatcagaga

SEQ ID NO: 6446816 - DNA, 14 bp, Homo sapiens
tgaaaatgagccct

SEQ ID NO: 6446817 - DNA, 17 bp, Homo sapiens
tgaaaatgagcctgtaa

SEQ ID NO: 6446818 - DNA, 18 bp, Homo sapiens
tgaaaatgagcctgtaat

SEQ ID NO: 6446819 - DNA, 17 bp, Homo sapiens
tgaaaatgatgtagaca

SEQ ID NO: 6446820 - DNA, 19 bp, Homo sapiens
tgaaaatgccacattttgc

SEQ ID NO: 6446821 - DNA, 14 bp, Homo sapiens
tgaaaatgccacca

SEQ ID NO: 6446822 - DNA, 21 bp, Homo sapiens
tgaaaatgctcttaaaatatc

SEQ ID NO: 6446823 - DNA, 22 bp, Homo sapiens
tgaaaatgctcttaaaatatct

SEQ ID NO: 6446824 - DNA, 13 bp, Homo sapiens
tgaaaatgctggc

SEQ ID NO: 6446825 - DNA, 11 bp, Homo sapiens
tgaaaatggaa

SEQ ID NO: 6446826 - DNA, 17 bp, Homo sapiens
tgaaaatggctgaagaa

SEQ ID NO: 6446827 - DNA, 20 bp, Homo sapiens
tgaaaatgggatgaattctt

SEQ ID NO: 6446828 - DNA, 22 bp, Homo sapiens
tgaaaatggtttcaagttattc

SEQ ID NO: 6446829 - DNA, 12 bp, Homo sapiens
tgaaaatgtaac

SEQ ID NO: 6446830 - DNA, 19 bp, Homo sapiens
tgaaaatgtaagctgttta

SEQ ID NO: 6446831 - DNA, 20 bp, Homo sapiens
tgaaaatgtattcctttaaa

SEQ ID NO: 6446832 - DNA, 21 bp, Homo sapiens
tgaaaatgtattcctttaaaa

SEQ ID NO: 6446833 - DNA, 16 bp, Homo sapiens
tgaaaatgtatttcct

SEQ ID NO: 6446834 - DNA, 18 bp, Homo sapiens
tgaaaatgtatttcctga

SEQ ID NO: 6446835 - DNA, 14 bp, Homo sapiens
tgaaaatgtcaaag

SEQ ID NO: 6446836 - DNA, 13 bp, Homo sapiens
tgaaaatgtcact

SEQ ID NO: 6446837 - DNA, 15 bp, Homo sapiens
tgaaaatgtcactgt

SEQ ID NO: 6446838 - DNA, 21 bp, Homo sapiens
tgaaaatgtcactgttataaa

SEQ ID NO: 6446839 - DNA, 14 bp, Homo sapiens
tgaaaatgtccttg

SEQ ID NO: 6446840 - DNA, 17 bp, Homo sapiens
tgaaaatgtccttgtga

SEQ ID NO: 6446841 - DNA, 20 bp, Homo sapiens
tgaaaatgtctcagtatttt

SEQ ID NO: 6446842 - DNA, 15 bp, Homo sapiens
tgaaaatgtcttgtg

SEQ ID NO: 6446843 - DNA, 16 bp, Homo sapiens
tgaaaatgtcttgtgt

SEQ ID NO: 6446844 - DNA, 17 bp, Homo sapiens
tccatgatagatataaa

SEQ ID NO: 6446845 - DNA, 20 bp, Homo sapiens
tccatgatcaaaatgcatac

SEQ ID NO: 6446846 - DNA, 16 bp, Homo sapiens
tccatgatgatagttg

SEQ ID NO: 6446847 - DNA, 14 bp, Homo sapiens
tccatgatgcacag

SEQ ID NO: 6446848 - DNA, 14 bp, Homo sapiens
tccatgatgctggg

SEQ ID NO: 6446849 - DNA, 15 bp, Homo sapiens
tccatgatggagtca

SEQ ID NO: 6446850 - DNA, 17 bp, Homo sapiens
tccatgattctctgagt

SEQ ID NO: 6446851 - DNA, 18 bp, Homo sapiens
tccatgatttagcaagca

SEQ ID NO: 6446852 - DNA, 14 bp, Homo sapiens
tccatgattttaca

SEQ ID NO: 6446853 - DNA, 15 bp, Homo sapiens
tccatgcaagtgctg

SEQ ID NO: 6446854 - DNA, 16 bp, Homo sapiens
tccatgcaagtgctgt

SEQ ID NO: 6446855 - DNA, 13 bp, Homo sapiens
tccatgcaccaaa

SEQ ID NO: 6446856 - DNA, 14 bp, Homo sapiens
tccatgcaccaaac

SEQ ID NO: 6446857 - DNA, 21 bp, Homo sapiens
tccatgcaccctcatacacag

SEQ ID NO: 6446858 - DNA, 19 bp, Homo sapiens
tccatgcagactcctcaga

SEQ ID NO: 6446859 - DNA, 23 bp, Homo sapiens
tccatgcagataacagctggttg

SEQ ID NO: 6446860 - DNA, 10 bp, Homo sapiens
tccatgccca

SEQ ID NO: 6446861 - DNA, 14 bp, Homo sapiens
tccatgcccaacct

SEQ ID NO: 6446862 - DNA, 15 bp, Homo sapiens
tccatgcccactgct

SEQ ID NO: 6446863 - DNA, 17 bp, Homo sapiens
tccatgcccactgctgg

SEQ ID NO: 6446864 - DNA, 20 bp, Homo sapiens
tccatgcccactgctggtgc

SEQ ID NO: 6446865 - DNA, 19 bp, Homo sapiens
tccatgccccagctctgga

SEQ ID NO: 6446866 - DNA, 14 bp, Homo sapiens
tccatgccccagga

SEQ ID NO: 6446867 - DNA, 18 bp, Homo sapiens
tccatgccctgggatgcc

SEQ ID NO: 6446868 - DNA, 15 bp, Homo sapiens
tccatgcctacagat

SEQ ID NO: 6446869 - DNA, 21 bp, Homo sapiens
tccatgcctatttactggaaa

SEQ ID NO: 6446870 - DNA, 21 bp, Homo sapiens
tccatgcctgagggtggagac

SEQ ID NO: 6446871 - DNA, 15 bp, Homo sapiens
tccatgcgctcaggg

SEQ ID NO: 6446872 - DNA, 19 bp, Homo sapiens
tccatgcggccggcctggg

SEQ ID NO: 6446873 - DNA, 19 bp, Homo sapiens
tccatgcgtgtttctgact

SEQ ID NO: 6446874 - DNA, 21 bp, Homo sapiens
tccatgctcctcactgcccgc

SEQ ID NO: 6446875 - DNA, 17 bp, Homo sapiens
tccatgctgcaaaggag

SEQ ID NO: 6446876 - DNA, 14 bp, Homo sapiens
tccatgctgggtct

SEQ ID NO: 6446877 - DNA, 16 bp, Homo sapiens
tccatgctgggtctga

SEQ ID NO: 6446878 - DNA, 21 bp, Homo sapiens
tccatgctgtgcgcccagggc

SEQ ID NO: 6446879 - DNA, 20 bp, Homo sapiens
tccatgcttagtcactgcct

SEQ ID NO: 6446880 - DNA, 22 bp, Homo sapiens
tccatgctttgctctcaaggct

SEQ ID NO: 6446881 - DNA, 23 bp, Homo sapiens
tccatggaaataaaaagtatgtt

SEQ ID NO: 6446882 - DNA, 16 bp, Homo sapiens
tccatggaatgcttga

SEQ ID NO: 6446883 - DNA, 13 bp, Homo sapiens
tccatggactttg

SEQ ID NO: 6446884 - DNA, 15 bp, Homo sapiens
tccatggactttgtt

SEQ ID NO: 6446885 - DNA, 19 bp, Homo sapiens
tccatggagcctacctctg

SEQ ID NO: 6446886 - DNA, 22 bp, Homo sapiens
tccatggaggaggtgtcccaag

SEQ ID NO: 6446887 - DNA, 15 bp, Homo sapiens
tccatggatcttgct

SEQ ID NO: 6446888 - DNA, 19 bp, Homo sapiens
tccatggatgcagaaatga

SEQ ID NO: 6446889 - DNA, 17 bp, Homo sapiens
tccatggcaaatgggca

SEQ ID NO: 6446890 - DNA, 13 bp, Homo sapiens
tccatggcaccag

SEQ ID NO: 6446891 - DNA, 16 bp, Homo sapiens
tccatggcaccagccc

SEQ ID NO: 6446892 - DNA, 19 bp, Homo sapiens
tccatggcactaaaccact

SEQ ID NO: 6446893 - DNA, 17 bp, Homo sapiens
tccatggcagcagccag

SEQ ID NO: 6446894 - DNA, 21 bp, Homo sapiens
tccatggcagcagccagggac

SEQ ID NO: 6446895 - DNA, 12 bp, Homo sapiens
tccatggccacc

SEQ ID NO: 6446896 - DNA, 21 bp, Homo sapiens
tccatggccaccccgtgccac

SEQ ID NO: 6446897 - DNA, 14 bp, Homo sapiens
tccatggccagcag

SEQ ID NO: 6446898 - DNA, 15 bp, Homo sapiens
tccatggccagcagc

SEQ ID NO: 6446899 - DNA, 16 bp, Homo sapiens
tccatggccctgtccc

SEQ ID NO: 6446900 - DNA, 17 bp, Homo sapiens
tccatggccctgtccca

SEQ ID NO: 6446901 - DNA, 15 bp, Homo sapiens
tccatggcttcctga

SEQ ID NO: 6446902 - DNA, 19 bp, Homo sapiens
tccatgggaaactttccct

SEQ ID NO: 6446903 - DNA, 15 bp, Homo sapiens
tccatgggagccagc

SEQ ID NO: 6446904 - DNA, 19 bp, Homo sapiens
tccatgggagccagctgct

SEQ ID NO: 6446905 - DNA, 18 bp, Homo sapiens
tccatgggattttatctg

SEQ ID NO: 6446906 - DNA, 16 bp, Homo sapiens
tccatgggcagagccc

SEQ ID NO: 6446907 - DNA, 23 bp, Homo sapiens
tccatgggccccaccatttatgt

SEQ ID NO: 6446908 - DNA, 19 bp, Homo sapiens
tccatgggcccgctgcctc

SEQ ID NO: 6446909 - DNA, 20 bp, Homo sapiens
tccatgggcccgctgcctct

SEQ ID NO: 6446910 - DNA, 17 bp, Homo sapiens
tccatggggtgggggtg

SEQ ID NO: 6446911 - DNA, 19 bp, Homo sapiens
tccatggtaaaaactagtt

SEQ ID NO: 6446912 - DNA, 21 bp, Homo sapiens
tccatggtactgtagcagggg

SEQ ID NO: 6446913 - DNA, 21 bp, Homo sapiens
tccatggtagcccatctctcc

SEQ ID NO: 6446914 - DNA, 15 bp, Homo sapiens
tccatggtcctgtct

SEQ ID NO: 6446915 - DNA, 16 bp, Homo sapiens
tccatggtgaactgaa

SEQ ID NO: 6446916 - DNA, 17 bp, Homo sapiens
tccatggtgaactgaag

SEQ ID NO: 6446917 - DNA, 15 bp, Homo sapiens
tccatggtgcctctg

SEQ ID NO: 6446918 - DNA, 16 bp, Homo sapiens
tccatggtgcctctgg

SEQ ID NO: 6446919 - DNA, 12 bp, Homo sapiens
tccatggtgcta

SEQ ID NO: 6446920 - DNA, 15 bp, Homo sapiens
tccatggtgctgcat

SEQ ID NO: 6446921 - DNA, 14 bp, Homo sapiens
tccatggtggaagg

SEQ ID NO: 6446922 - DNA, 15 bp, Homo sapiens
tccatgtaactgcct

SEQ ID NO: 6446923 - DNA, 22 bp, Homo sapiens
tccatgtaactgcctagaaaca

SEQ ID NO: 6446924 - DNA, 24 bp, Homo sapiens
tccatgtaactgcctagaaacaac

SEQ ID NO: 6446925 - DNA, 18 bp, Homo sapiens
tccatgtaataagcactt

SEQ ID NO: 6446926 - DNA, 20 bp, Homo sapiens
tccatgtaccttgtgtactt

SEQ ID NO: 6446927 - DNA, 21 bp, Homo sapiens
tccatgtactgtagtttttct

SEQ ID NO: 6446928 - DNA, 22 bp, Homo sapiens
tccatgtacttccctcttgaaa

SEQ ID NO: 6446929 - DNA, 18 bp, Homo sapiens
tccatgtagaagagggag

SEQ ID NO: 6446930 - DNA, 15 bp, Homo sapiens
tccatgtagcaggac

SEQ ID NO: 6446931 - DNA, 20 bp, Homo sapiens
tccatgtatgcataataatc

SEQ ID NO: 6446932 - DNA, 21 bp, Homo sapiens
tccatgtattcacacacccct

SEQ ID NO: 6446933 - DNA, 22 bp, Homo sapiens
tccatgtattcacacacccctc

SEQ ID NO: 6446934 - DNA, 23 bp, Homo sapiens
tccatgtattcacacacccctca

SEQ ID NO: 6446935 - DNA, 16 bp, Homo sapiens
tccatgtcaagattca

SEQ ID NO: 6446936 - DNA, 20 bp, Homo sapiens
tccatgtcaagattcagcta

SEQ ID NO: 6446937 - DNA, 23 bp, Homo sapiens
tccatgtcaagattcagctagtg

SEQ ID NO: 6446938 - DNA, 18 bp, Homo sapiens
tccatgtcagataagtgt

SEQ ID NO: 6446939 - DNA, 16 bp, Homo sapiens
tccatgtcccctccca

SEQ ID NO: 6446940 - DNA, 17 bp, Homo sapiens
tccatgtcctatgtgtg

SEQ ID NO: 6446941 - DNA, 16 bp, Homo sapiens
tccatgtcgcctctgc

SEQ ID NO: 6446942 - DNA, 19 bp, Homo sapiens
tccatgtcgcctctgcatt

SEQ ID NO: 6446943 - DNA, 14 bp, Homo sapiens
tccatgtcggcctc

SEQ ID NO: 6446944 - DNA, 19 bp, Homo sapiens
tccatgtgaccattctgcc

SEQ ID NO: 6446945 - DNA, 16 bp, Homo sapiens
tccatgtgataattgt

SEQ ID NO: 6446946 - DNA, 18 bp, Homo sapiens
tccatgtgattaatgttt

SEQ ID NO: 6446947 - DNA, 17 bp, Homo sapiens
tccatgtgcacccggcc

SEQ ID NO: 6446948 - DNA, 21 bp, Homo sapiens
tccatgtgcacccggcctgga

SEQ ID NO: 6446949 - DNA, 19 bp, Homo sapiens
tccatgtgcatataaaggt

SEQ ID NO: 6446950 - DNA, 20 bp, Homo sapiens
tccatgtgcctttctttgcc

SEQ ID NO: 6446951 - DNA, 23 bp, Homo sapiens
tccatgtgctagtcactggcagc

SEQ ID NO: 6446952 - DNA, 21 bp, Homo sapiens
tccatgtgcttccctaggctg

SEQ ID NO: 6446953 - DNA, 16 bp, Homo sapiens
tccatgtggactgtgc

SEQ ID NO: 6446954 - DNA, 13 bp, Homo sapiens
tccatgtggagaa

SEQ ID NO: 6446955 - DNA, 20 bp, Homo sapiens
tccatgtgggctagttgggc

SEQ ID NO: 6446956 - DNA, 18 bp, Homo sapiens
tccatgtggttcttcaaa

SEQ ID NO: 6446957 - DNA, 14 bp, Homo sapiens
tccatgtgtatcca

SEQ ID NO: 6446958 - DNA, 18 bp, Homo sapiens
tccatgtgtcccccctgt

SEQ ID NO: 6446959 - DNA, 19 bp, Homo sapiens
tccatgtgtcccccctgtg

SEQ ID NO: 6446960 - DNA, 17 bp, Homo sapiens
tccatgtgtggactcaa

SEQ ID NO: 6446961 - DNA, 20 bp, Homo sapiens
tccatgtgtggtggtgtttt

SEQ ID NO: 6446962 - DNA, 13 bp, Homo sapiens
tccatgtgtgtgc

SEQ ID NO: 6446963 - DNA, 22 bp, Homo sapiens
tccatgtgtgtgccaagccctg

SEQ ID NO: 6446964 - DNA, 16 bp, Homo sapiens
tccatgtgttttgctt

SEQ ID NO: 6446965 - DNA, 19 bp, Homo sapiens
tccatgtgttttgctttta

SEQ ID NO: 6446966 - DNA, 23 bp, Homo sapiens
tccatgttagtaatggcagagca

SEQ ID NO: 6446967 - DNA, 18 bp, Homo sapiens
tccatgttagtttttact

SEQ ID NO: 6446968 - DNA, 19 bp, Homo sapiens
tccatgttagtttttactt

SEQ ID NO: 6446969 - DNA, 15 bp, Homo sapiens
tccatgttctcccaa

SEQ ID NO: 6446970 - DNA, 14 bp, Homo sapiens
tccatgttctgggt

SEQ ID NO: 6446971 - DNA, 19 bp, Homo sapiens
tccatgttctgggtgatgg

SEQ ID NO: 6446972 - DNA, 12 bp, Homo sapiens
tccatgttgact

SEQ ID NO: 6446973 - DNA, 13 bp, Homo sapiens
tccatgttgctga

SEQ ID NO: 6446974 - DNA, 14 bp, Homo sapiens
tccatgttgctgcc

SEQ ID NO: 6446975 - DNA, 17 bp, Homo sapiens
tccatgttgctgccaac

SEQ ID NO: 6446976 - DNA, 22 bp, Homo sapiens
tccatgtttagaaataaatgaa

SEQ ID NO: 6446977 - DNA, 21 bp, Homo sapiens
tccatgtttatccatgtactt

SEQ ID NO: 6446978 - DNA, 22 bp, Homo sapiens
tccatgtttctcacattgctgt

SEQ ID NO: 6446979 - DNA, 13 bp, Homo sapiens
tccatgtttgtaa

SEQ ID NO: 6446980 - DNA, 15 bp, Homo sapiens
tccatgttttaaaat

SEQ ID NO: 6446981 - DNA, 17 bp, Homo sapiens
tccatgttttgttttct

SEQ ID NO: 6446982 - DNA, 22 bp, Homo sapiens
tccatgttttgttttcttggga

SEQ ID NO: 6446983 - DNA, 22 bp, Homo sapiens
tccatgttttttcttcaaatgt

SEQ ID NO: 6446984 - DNA, 13 bp, Homo sapiens
tccattaaacttc

SEQ ID NO: 6446985 - DNA, 20 bp, Homo sapiens
tccattaaacttctactgag

SEQ ID NO: 6446986 - DNA, 19 bp, Homo sapiens
tccattaaagtctgaatca

SEQ ID NO: 6446987 - DNA, 16 bp, Homo sapiens
tccattaaattgcctt

SEQ ID NO: 6446988 - DNA, 23 bp, Homo sapiens
tccattaaattgcctttgtaata

SEQ ID NO: 6446989 - DNA, 20 bp, Homo sapiens
tccattaacttagcatgtgt

SEQ ID NO: 6446990 - DNA, 14 bp, Homo sapiens
tccattaatacttc

SEQ ID NO: 6446991 - DNA, 13 bp, Homo sapiens
tccattaatttaa

SEQ ID NO: 6446992 - DNA, 15 bp, Homo sapiens
tccattaatttaaat

SEQ ID NO: 6446993 - DNA, 19 bp, Homo sapiens
tccattaatttaaatgatt

SEQ ID NO: 6446994 - DNA, 15 bp, Homo sapiens
tccattacaccacag

SEQ ID NO: 6446995 - DNA, 14 bp, Homo sapiens
tccattacctccat

SEQ ID NO: 6446996 - DNA, 16 bp, Homo sapiens
tccattacctccatcc

SEQ ID NO: 6446997 - DNA, 21 bp, Homo sapiens
tccattacctccatccatcct

SEQ ID NO: 6446998 - DNA, 14 bp, Homo sapiens
tccattacgtgcat

SEQ ID NO: 6446999 - DNA, 16 bp, Homo sapiens
tccattacgtgcattt

SEQ ID NO: 6447000 - DNA, 17 bp, Homo sapiens
tccattacgtgcattta

SEQ ID NO: 6447001 - DNA, 23 bp, Homo sapiens
tccattacgtgcatttaaactct

SEQ ID NO: 6447002 - DNA, 13 bp, Homo sapiens
tccattactgtga

SEQ ID NO: 6447003 - DNA, 18 bp, Homo sapiens
tccattactgtgatttct

SEQ ID NO: 6447004 - DNA, 21 bp, Homo sapiens
tccattagaaaattttgtaaa

SEQ ID NO: 6447005 - DNA, 14 bp, Homo sapiens
tccattaggatttg

SEQ ID NO: 6447006 - DNA, 14 bp, Homo sapiens
tccattataaacaa

SEQ ID NO: 6447007 - DNA, 13 bp, Homo sapiens
tccattatcatgt

SEQ ID NO: 6447008 - DNA, 19 bp, Homo sapiens
tccattatctgctgttcct

SEQ ID NO: 6447009 - DNA, 18 bp, Homo sapiens
tccattatgaaaatctta

SEQ ID NO: 6447010 - DNA, 23 bp, Homo sapiens
tccattatgactgttgttcttat

SEQ ID NO: 6447011 - DNA, 14 bp, Homo sapiens
tccattatttatat

SEQ ID NO: 6447012 - DNA, 22 bp, Homo sapiens
tccattatttgagtttgacatt

SEQ ID NO: 6447013 - DNA, 19 bp, Homo sapiens
tccattcacaagcctcctg

SEQ ID NO: 6447014 - DNA, 22 bp, Homo sapiens
tccattcacagttctttgggcc

SEQ ID NO: 6447015 - DNA, 13 bp, Homo sapiens
tccattcactccc

SEQ ID NO: 6447016 - DNA, 14 bp, Homo sapiens
tccattcagaaagc

SEQ ID NO: 6447017 - DNA, 18 bp, Homo sapiens
tccattcagtctgcagct

SEQ ID NO: 6447018 - DNA, 22 bp, Homo sapiens
tccattccacacagaatgcaac

SEQ ID NO: 6447019 - DNA, 20 bp, Homo sapiens
tccattccagagctgcagaa

SEQ ID NO: 6447020 - DNA, 19 bp, Homo sapiens
tccattccatggaaataaa

SEQ ID NO: 6447021 - DNA, 19 bp, Homo sapiens
tccattcccaagatgcctg

SEQ ID NO: 6447022 - DNA, 17 bp, Homo sapiens
tgaaaatgtgctatact

SEQ ID NO: 6447023 - DNA, 19 bp, Homo sapiens
tgaaaatgtgctatactgc

SEQ ID NO: 6447024 - DNA, 14 bp, Homo sapiens
tgaaaatgtgtata

SEQ ID NO: 6447025 - DNA, 16 bp, Homo sapiens
tgaaaatgtgtttgct

SEQ ID NO: 6447026 - DNA, 16 bp, Homo sapiens
tgaaaatgttgttatg

SEQ ID NO: 6447027 - DNA, 22 bp, Homo sapiens
tgaaaatgtttaagtattaact

SEQ ID NO: 6447028 - DNA, 20 bp, Homo sapiens
tgaaaatgtttttaagtgct

SEQ ID NO: 6447029 - DNA, 15 bp, Homo sapiens
tgaaaattaaatttt

SEQ ID NO: 6447030 - DNA, 16 bp, Homo sapiens
tgaaaattaacactgc

SEQ ID NO: 6447031 - DNA, 14 bp, Homo sapiens
tgaaaattaacatg

SEQ ID NO: 6447032 - DNA, 20 bp, Homo sapiens
tgaaaattacacccatgcac

SEQ ID NO: 6447033 - DNA, 21 bp, Homo sapiens
tgaaaattacagtccaaaata

SEQ ID NO: 6447034 - DNA, 13 bp, Homo sapiens
tgaaaattatgca

SEQ ID NO: 6447035 - DNA, 16 bp, Homo sapiens
tgaaaattatgcaaaa

SEQ ID NO: 6447036 - DNA, 17 bp, Homo sapiens
tgaaaattatgcaaaag

SEQ ID NO: 6447037 - DNA, 13 bp, Homo sapiens
tgaaaattattta

SEQ ID NO: 6447038 - DNA, 15 bp, Homo sapiens
tgaaaattatttgaa

SEQ ID NO: 6447039 - DNA, 16 bp, Homo sapiens
tgaaaattatttgaaa

SEQ ID NO: 6447040 - DNA, 16 bp, Homo sapiens
tgaaaattattttaaa

SEQ ID NO: 6447041 - DNA, 19 bp, Homo sapiens
tgaaaattcaaaaagtgtt

SEQ ID NO: 6447042 - DNA, 11 bp, Homo sapiens
tgaaaattcca

SEQ ID NO: 6447043 - DNA, 12 bp, Homo sapiens
tgaaaattccaa

SEQ ID NO: 6447044 - DNA, 20 bp, Homo sapiens
tgaaaattccagaaaggata

SEQ ID NO: 6447045 - DNA, 21 bp, Homo sapiens
tgaaaattcgcccgagctgtt

SEQ ID NO: 6447046 - DNA, 15 bp, Homo sapiens
tgaaaattctggaag

SEQ ID NO: 6447047 - DNA, 16 bp, Homo sapiens
tgaaaattgaaaagta

SEQ ID NO: 6447048 - DNA, 17 bp, Homo sapiens
tgaaaattggacagatt

SEQ ID NO: 6447049 - DNA, 17 bp, Homo sapiens
tgaaaattgtataaatt

SEQ ID NO: 6447050 - DNA, 16 bp, Homo sapiens
tgaaaattgtatacca

SEQ ID NO: 6447051 - DNA, 22 bp, Homo sapiens
tgaaaattgtataccaatgtgt

SEQ ID NO: 6447052 - DNA, 22 bp, Homo sapiens
tgaaaattgtttagtgatatta

SEQ ID NO: 6447053 - DNA, 13 bp, Homo sapiens
tgaaaatttaaca

SEQ ID NO: 6447054 - DNA, 22 bp, Homo sapiens
tgaaaatttgagactatttaaa

SEQ ID NO: 6447055 - DNA, 16 bp, Homo sapiens
tgaaaattttaagaag

SEQ ID NO: 6447056 - DNA, 18 bp, Homo sapiens
tgaaaattttattgaata

SEQ ID NO: 6447057 - DNA, 13 bp, Homo sapiens
tgaaaattttgat

SEQ ID NO: 6447058 - DNA, 14 bp, Homo sapiens
tgaaacaaagaagg

SEQ ID NO: 6447059 - DNA, 23 bp, Homo sapiens
tgaaacaaagagttcaagaaata

SEQ ID NO: 6447060 - DNA, 18 bp, Homo sapiens
tgaaacaaataatcacat

SEQ ID NO: 6447061 - DNA, 18 bp, Homo sapiens
tgaaacaaatatactcat

SEQ ID NO: 6447062 - DNA, 14 bp, Homo sapiens
tgaaacaactcctt

SEQ ID NO: 6447063 - DNA, 16 bp, Homo sapiens
tgaaacaacttggaaa

SEQ ID NO: 6447064 - DNA, 20 bp, Homo sapiens
tgaaacaagtctagtcttct

SEQ ID NO: 6447065 - DNA, 22 bp, Homo sapiens
tgaaacaagtctagtcttctgg

SEQ ID NO: 6447066 - DNA, 19 bp, Homo sapiens
tgaaacaatgttgtccaac

SEQ ID NO: 6447067 - DNA, 16 bp, Homo sapiens
tgaaacacaataccta

SEQ ID NO: 6447068 - DNA, 14 bp, Homo sapiens
tgaaacacaatatc

SEQ ID NO: 6447069 - DNA, 16 bp, Homo sapiens
tgaaacacacagtgac

SEQ ID NO: 6447070 - DNA, 22 bp, Homo sapiens
tgaaacacaccaggctgtgggc

SEQ ID NO: 6447071 - DNA, 15 bp, Homo sapiens
tgaaacacagctgtt

SEQ ID NO: 6447072 - DNA, 14 bp, Homo sapiens
tgaaacactggacc

SEQ ID NO: 6447073 - DNA, 16 bp, Homo sapiens
tgaaacacttctcatc

SEQ ID NO: 6447074 - DNA, 15 bp, Homo sapiens
tgaaacacttgcttg

SEQ ID NO: 6447075 - DNA, 16 bp, Homo sapiens
tgaaacactttgcata

SEQ ID NO: 6447076 - DNA, 13 bp, Homo sapiens
tgaaacacttttt

SEQ ID NO: 6447077 - DNA, 12 bp, Homo sapiens
tgaaacagaaaa

SEQ ID NO: 6447078 - DNA, 14 bp, Homo sapiens
tgaaacagaaaaat

SEQ ID NO: 6447079 - DNA, 17 bp, Homo sapiens
tgaaacagaaaaataag

SEQ ID NO: 6447080 - DNA, 14 bp, Homo sapiens
tgaaacagaaacaa

SEQ ID NO: 6447081 - DNA, 19 bp, Homo sapiens
tgaaacagaaagttggaaa

SEQ ID NO: 6447082 - DNA, 14 bp, Homo sapiens
tgaaacagacttgt

SEQ ID NO: 6447083 - DNA, 12 bp, Homo sapiens
tgaaacagagaa

SEQ ID NO: 6447084 - DNA, 15 bp, Homo sapiens
tgaaacagagaaaga

SEQ ID NO: 6447085 - DNA, 17 bp, Homo sapiens
tgaaacagagaaagaaa

SEQ ID NO: 6447086 - DNA, 18 bp, Homo sapiens
tgaaacagagaaagaaaa

SEQ ID NO: 6447087 - DNA, 20 bp, Homo sapiens
tgaaacagagaaagaaaagg

SEQ ID NO: 6447088 - DNA, 16 bp, Homo sapiens
tgaaacagatgataaa

SEQ ID NO: 6447089 - DNA, 18 bp, Homo sapiens
tgaaacagatgataaata

SEQ ID NO: 6447090 - DNA, 19 bp, Homo sapiens
tgaaacagatgataaatat

SEQ ID NO: 6447091 - DNA, 14 bp, Homo sapiens
tgaaacagatttca

SEQ ID NO: 6447092 - DNA, 9 bp, Homo sapiens
tgaaacagc

SEQ ID NO: 6447093 - DNA, 12 bp, Homo sapiens
tgaaacagcagc

SEQ ID NO: 6447094 - DNA, 17 bp, Homo sapiens
tgaaacagcctctgcaa

SEQ ID NO: 6447095 - DNA, 22 bp, Homo sapiens
tgaaacagcctctgcaagattt

SEQ ID NO: 6447096 - DNA, 13 bp, Homo sapiens
tgaaacagcctgg

SEQ ID NO: 6447097 - DNA, 23 bp, Homo sapiens
tgaaacagctgccttagcttcag

SEQ ID NO: 6447098 - DNA, 17 bp, Homo sapiens
tgaaacagttgctgtga

SEQ ID NO: 6447099 - DNA, 18 bp, Homo sapiens
tgaaacagttgctgtgaa

SEQ ID NO: 6447100 - DNA, 16 bp, Homo sapiens
tgaaacatatcatggt

SEQ ID NO: 6447101 - DNA, 19 bp, Homo sapiens
tgaaacatatcatggtaat

SEQ ID NO: 6447102 - DNA, 19 bp, Homo sapiens
tgaaacatcattacagatt

SEQ ID NO: 6447103 - DNA, 12 bp, Homo sapiens
tgaaacatgctt

SEQ ID NO: 6447104 - DNA, 19 bp, Homo sapiens
tgaaacatgggctgtgatt

SEQ ID NO: 6447105 - DNA, 20 bp, Homo sapiens
tgaaacatgggctgtgatta

SEQ ID NO: 6447106 - DNA, 17 bp, Homo sapiens
tgaaacatgtgcccctg

SEQ ID NO: 6447107 - DNA, 13 bp, Homo sapiens
tgaaacatgtttc

SEQ ID NO: 6447108 - DNA, 18 bp, Homo sapiens
tgaaacattttctccctg

SEQ ID NO: 6447109 - DNA, 14 bp, Homo sapiens
tgaaacattttgtc

SEQ ID NO: 6447110 - DNA, 13 bp, Homo sapiens
tgaaaccaaaaag

SEQ ID NO: 6447111 - DNA, 22 bp, Homo sapiens
tgaaaccaaaacataaaaacca

SEQ ID NO: 6447112 - DNA, 23 bp, Homo sapiens
tgaaaccaaaacataaaaaccaa

SEQ ID NO: 6447113 - DNA, 20 bp, Homo sapiens
tgaaaccaattaagcagctt

SEQ ID NO: 6447114 - DNA, 20 bp, Homo sapiens
tgaaaccaccgtgaaccaga

SEQ ID NO: 6447115 - DNA, 23 bp, Homo sapiens
tgaaaccagcttccttcatctct

SEQ ID NO: 6447116 - DNA, 17 bp, Homo sapiens
tgaaaccagtatttaag

SEQ ID NO: 6447117 - DNA, 15 bp, Homo sapiens
tgaaaccatgactgt

SEQ ID NO: 6447118 - DNA, 14 bp, Homo sapiens
tgaaacccacagtt

SEQ ID NO: 6447119 - DNA, 17 bp, Homo sapiens
tgaaacccacagtttta

SEQ ID NO: 6447120 - DNA, 20 bp, Homo sapiens
tgaaacccacagttttagtt

SEQ ID NO: 6447121 - DNA, 20 bp, Homo sapiens
tgaaacccagatcgctgtgt

SEQ ID NO: 6447122 - DNA, 17 bp, Homo sapiens
tgaaacccatttactta

SEQ ID NO: 6447123 - DNA, 17 bp, Homo sapiens
tgaaaccccaaacagtg

SEQ ID NO: 6447124 - DNA, 19 bp, Homo sapiens
tgaaaccccaaacagtgac

SEQ ID NO: 6447125 - DNA, 18 bp, Homo sapiens
tgaaacccccacacacac

SEQ ID NO: 6447126 - DNA, 16 bp, Homo sapiens
tgaaacccccatctct

SEQ ID NO: 6447127 - DNA, 23 bp, Homo sapiens
tgaaaccctgtctctactaaaag

SEQ ID NO: 6447128 - DNA, 11 bp, Homo sapiens
tgaaacccttt

SEQ ID NO: 6447129 - DNA, 15 bp, Homo sapiens
tgaaaccgtccctga

SEQ ID NO: 6447130 - DNA, 21 bp, Homo sapiens
tgaaacctacagcatattctt

SEQ ID NO: 6447131 - DNA, 18 bp, Homo sapiens
tgaaacctagtactgccc

SEQ ID NO: 6447132 - DNA, 19 bp, Homo sapiens
tgaaacctagtactgcccc

SEQ ID NO: 6447133 - DNA, 16 bp, Homo sapiens
tgaaacctcagggctg

SEQ ID NO: 6447134 - DNA, 16 bp, Homo sapiens
tgaaacctctgttctc

SEQ ID NO: 6447135 - DNA, 15 bp, Homo sapiens
tgaaacctcttccta

SEQ ID NO: 6447136 - DNA, 13 bp, Homo sapiens
tgaaacctgatgt

SEQ ID NO: 6447137 - DNA, 13 bp, Homo sapiens
tgaaacctgtata

SEQ ID NO: 6447138 - DNA, 18 bp, Homo sapiens
tgaaacctgttaaaacaa

SEQ ID NO: 6447139 - DNA, 19 bp, Homo sapiens
tgaaacctgttctaccaat

SEQ ID NO: 6447140 - DNA, 20 bp, Homo sapiens
tgaaaccttattttttccca

SEQ ID NO: 6447141 - DNA, 12 bp, Homo sapiens
tgaaaccttcct

SEQ ID NO: 6447142 - DNA, 21 bp, Homo sapiens
tgaaacctttagggcagcttg

SEQ ID NO: 6447143 - DNA, 17 bp, Homo sapiens
tgaaacctttttctagt

SEQ ID NO: 6447144 - DNA, 16 bp, Homo sapiens
tgaaacgactcaaaat

SEQ ID NO: 6447145 - DNA, 19 bp, Homo sapiens
tgaaacgactcaaaatgac

SEQ ID NO: 6447146 - DNA, 20 bp, Homo sapiens
tgaaacgactcaaaatgaca

SEQ ID NO: 6447147 - DNA, 14 bp, Homo sapiens
tgaaacgagaagtg

SEQ ID NO: 6447148 - DNA, 18 bp, Homo sapiens
tgaaacgagaagtgccct

SEQ ID NO: 6447149 - DNA, 15 bp, Homo sapiens
tgaaacgcatctagt

SEQ ID NO: 6447150 - DNA, 14 bp, Homo sapiens
tgaaacgccttgca

SEQ ID NO: 6447151 - DNA, 19 bp, Homo sapiens
tgaaacggatgatttctat

SEQ ID NO: 6447152 - DNA, 20 bp, Homo sapiens
tgaaacggatgatttctatg

SEQ ID NO: 6447153 - DNA, 16 bp, Homo sapiens
tgaaacgtattcagag

SEQ ID NO: 6447154 - DNA, 22 bp, Homo sapiens
tgaaacgtggatacagagccac

SEQ ID NO: 6447155 - DNA, 22 bp, Homo sapiens
tgaaactaaagcaatagaaaca

SEQ ID NO: 6447156 - DNA, 17 bp, Homo sapiens
tgaaactaagagctctc

SEQ ID NO: 6447157 - DNA, 14 bp, Homo sapiens
tgaaactaatgaaa

SEQ ID NO: 6447158 - DNA, 18 bp, Homo sapiens
tgaaactagaagtcaaaa

SEQ ID NO: 6447159 - DNA, 19 bp, Homo sapiens
tgaaactaggcttctgtaa

SEQ ID NO: 6447160 - DNA, 14 bp, Homo sapiens
tgaaactagttatt

SEQ ID NO: 6447161 - DNA, 17 bp, Homo sapiens
tgaaactagttatttta

SEQ ID NO: 6447162 - DNA, 17 bp, Homo sapiens
tgaaactatagaataaa

SEQ ID NO: 6447163 - DNA, 22 bp, Homo sapiens
tgaaactatagtggccacactc

SEQ ID NO: 6447164 - DNA, 21 bp, Homo sapiens
tgaaactatattttgtcatat

SEQ ID NO: 6447165 - DNA, 16 bp, Homo sapiens
tgaaactcatctcatt

SEQ ID NO: 6447166 - DNA, 17 bp, Homo sapiens
tgaaactccagatgcca

SEQ ID NO: 6447167 - DNA, 16 bp, Homo sapiens
tgaaactcccttgtgt

SEQ ID NO: 6447168 - DNA, 22 bp, Homo sapiens
tgaaactcctgattttgtagtt

SEQ ID NO: 6447169 - DNA, 21 bp, Homo sapiens
tgaaactcgcgagtgtaactt

SEQ ID NO: 6447170 - DNA, 16 bp, Homo sapiens
tgaaactctacattta

SEQ ID NO: 6447171 - DNA, 11 bp, Homo sapiens
tgaaactctct

SEQ ID NO: 6447172 - DNA, 13 bp, Homo sapiens
tgaaactctttca

SEQ ID NO: 6447173 - DNA, 22 bp, Homo sapiens
tgaaactctttcattcttctca

SEQ ID NO: 6447174 - DNA, 22 bp, Homo sapiens
tgaaactgaaggtcaataaatt

SEQ ID NO: 6447175 - DNA, 17 bp, Homo sapiens
tgaaactgacttgctgt

SEQ ID NO: 6447176 - DNA, 19 bp, Homo sapiens
tgaaactgagtctgtggac

SEQ ID NO: 6447177 - DNA, 22 bp, Homo sapiens
tgaaactgcccactctgcaaga

SEQ ID NO: 6447178 - DNA, 16 bp, Homo sapiens
tgaaactgcctattca

SEQ ID NO: 6447179 - DNA, 18 bp, Homo sapiens
tgaaactgctaattacac

SEQ ID NO: 6447180 - DNA, 16 bp, Homo sapiens
tgaaactgctgttttc

SEQ ID NO: 6447181 - DNA, 18 bp, Homo sapiens
tgaaactgcttgtttcct

SEQ ID NO: 6447182 - DNA, 18 bp, Homo sapiens
tgaaactggcactgaatt

SEQ ID NO: 6447183 - DNA, 16 bp, Homo sapiens
tgaaactggcttcccc

SEQ ID NO: 6447184 - DNA, 23 bp, Homo sapiens
tgaaactggggcttgcaagagga

SEQ ID NO: 6447185 - DNA, 18 bp, Homo sapiens
tgaaactggttcctacat

SEQ ID NO: 6447186 - DNA, 20 bp, Homo sapiens
tgaaactggtttataataaa

SEQ ID NO: 6447187 - DNA, 13 bp, Homo sapiens
tgaaactggtttt

SEQ ID NO: 6447188 - DNA, 22 bp, Homo sapiens
tgaaactggttttaagtgcttt

SEQ ID NO: 6447189 - DNA, 15 bp, Homo sapiens
tgaaactgtatttac

SEQ ID NO: 6447190 - DNA, 20 bp, Homo sapiens
tgaaactgtatttacttgtt

SEQ ID NO: 6447191 - DNA, 16 bp, Homo sapiens
tgaaacttacacacaa

SEQ ID NO: 6447192 - DNA, 19 bp, Homo sapiens
tgaaacttacctgagaacc

SEQ ID NO: 6447193 - DNA, 21 bp, Homo sapiens
tgaaacttatttttttctgat

SEQ ID NO: 6447194 - DNA, 18 bp, Homo sapiens
tgaaacttcaagcaccag

SEQ ID NO: 6447195 - DNA, 16 bp, Homo sapiens
tgaaacttcagccctg

SEQ ID NO: 6447196 - DNA, 15 bp, Homo sapiens
tgaaacttctcagtc

SEQ ID NO: 6447197 - DNA, 23 bp, Homo sapiens
tgaaacttctcagtccagcagtt

SEQ ID NO: 6447198 - DNA, 12 bp, Homo sapiens
tgaaacttggat

SEQ ID NO: 6447199 - DNA, 18 bp, Homo sapiens
tgaaactttctttctaaa

SEQ ID NO: 6447200 - DNA, 22 bp, Homo sapiens
tgaaactttgagatctaaaaat

SEQ ID NO: 6447201 - DNA, 21 bp, Homo sapiens
tgaaactttgaggataacttt

SEQ ID NO: 6447202 - DNA, 15 bp, Homo sapiens
tccattcccacccct

SEQ ID NO: 6447203 - DNA, 20 bp, Homo sapiens
tccattccctggagtttggg

SEQ ID NO: 6447204 - DNA, 20 bp, Homo sapiens
tccattcctaatcaaattct

SEQ ID NO: 6447205 - DNA, 20 bp, Homo sapiens
tccattcctaggtcacttga

SEQ ID NO: 6447206 - DNA, 15 bp, Homo sapiens
tccattcctcaggga

SEQ ID NO: 6447207 - DNA, 14 bp, Homo sapiens
tccattcctgagta

SEQ ID NO: 6447208 - DNA, 19 bp, Homo sapiens
tccattctacctgtcctcc

SEQ ID NO: 6447209 - DNA, 14 bp, Homo sapiens
tccattctcagccc

SEQ ID NO: 6447210 - DNA, 16 bp, Homo sapiens
tccattctcccaggta

SEQ ID NO: 6447211 - DNA, 14 bp, Homo sapiens
tccattctcctcag

SEQ ID NO: 6447212 - DNA, 17 bp, Homo sapiens
tccattctctctgccca

SEQ ID NO: 6447213 - DNA, 19 bp, Homo sapiens
tccattctgggtgttttca

SEQ ID NO: 6447214 - DNA, 15 bp, Homo sapiens
tccattcttcttgct

SEQ ID NO: 6447215 - DNA, 16 bp, Homo sapiens
tccattcttcttgcta

SEQ ID NO: 6447216 - DNA, 19 bp, Homo sapiens
tccattcttcttgctacac

SEQ ID NO: 6447217 - DNA, 14 bp, Homo sapiens
tccattcttggcat

SEQ ID NO: 6447218 - DNA, 21 bp, Homo sapiens
tccattcttggcatctactct

SEQ ID NO: 6447219 - DNA, 22 bp, Homo sapiens
tccattcttggcatctactctg

SEQ ID NO: 6447220 - DNA, 12 bp, Homo sapiens
tccattctttct

SEQ ID NO: 6447221 - DNA, 19 bp, Homo sapiens
tccattcttttaaatgggt

SEQ ID NO: 6447222 - DNA, 14 bp, Homo sapiens
tccattgacatgta

SEQ ID NO: 6447223 - DNA, 15 bp, Homo sapiens
tccattgacatgtac

SEQ ID NO: 6447224 - DNA, 17 bp, Homo sapiens
tccattgacatgtacag

SEQ ID NO: 6447225 - DNA, 19 bp, Homo sapiens
tccattgacatgtacagag

SEQ ID NO: 6447226 - DNA, 12 bp, Homo sapiens
tccattgcaaaa

SEQ ID NO: 6447227 - DNA, 15 bp, Homo sapiens
tccattgcaaaatag

SEQ ID NO: 6447228 - DNA, 18 bp, Homo sapiens
tccattgcaaaatagaag

SEQ ID NO: 6447229 - DNA, 20 bp, Homo sapiens
tccattgcaaaatagaagaa

SEQ ID NO: 6447230 - DNA, 22 bp, Homo sapiens
tccattgcaaaatagaagaaga

SEQ ID NO: 6447231 - DNA, 14 bp, Homo sapiens
tccattgccacggc

SEQ ID NO: 6447232 - DNA, 17 bp, Homo sapiens
tccattgccatcagtga

SEQ ID NO: 6447233 - DNA, 16 bp, Homo sapiens
tccattggatctcatt

SEQ ID NO: 6447234 - DNA, 20 bp, Homo sapiens
tccattggcttcctcactcc

SEQ ID NO: 6447235 - DNA, 16 bp, Homo sapiens
tccattggtccaagat

SEQ ID NO: 6447236 - DNA, 22 bp, Homo sapiens
tccattgtagtggcctgtgctt

SEQ ID NO: 6447237 - DNA, 13 bp, Homo sapiens
tccattgtattgt

SEQ ID NO: 6447238 - DNA, 23 bp, Homo sapiens
tccattgtgccttactaaatatg

SEQ ID NO: 6447239 - DNA, 19 bp, Homo sapiens
tccattgtgtggcctggtg

SEQ ID NO: 6447240 - DNA, 20 bp, Homo sapiens
tccattgtgtggcctggtgg

SEQ ID NO: 6447241 - DNA, 23 bp, Homo sapiens
tccattgtgtggcctggtgggtc

SEQ ID NO: 6447242 - DNA, 16 bp, Homo sapiens
tccattgttgtgtctg

SEQ ID NO: 6447243 - DNA, 12 bp, Homo sapiens
tccattgtttaa

SEQ ID NO: 6447244 - DNA, 19 bp, Homo sapiens
tccattgtttaaaaataca

SEQ ID NO: 6447245 - DNA, 14 bp, Homo sapiens
tccattgtttaaag

SEQ ID NO: 6447246 - DNA, 15 bp, Homo sapiens
tccattgtttaaaga

SEQ ID NO: 6447247 - DNA, 19 bp, Homo sapiens
tccattgtttggagacatt

SEQ ID NO: 6447248 - DNA, 18 bp, Homo sapiens
tccatttaaacagatgtc

SEQ ID NO: 6447249 - DNA, 13 bp, Homo sapiens
tccatttaaatgc

SEQ ID NO: 6447250 - DNA, 23 bp, Homo sapiens
tccatttaatcaatatttaagag

SEQ ID NO: 6447251 - DNA, 23 bp, Homo sapiens
tccatttacagtctctttcttcc

SEQ ID NO: 6447252 - DNA, 15 bp, Homo sapiens
tccatttacctggaa

SEQ ID NO: 6447253 - DNA, 21 bp, Homo sapiens
tccatttacctggaaaccaga

SEQ ID NO: 6447254 - DNA, 15 bp, Homo sapiens
tccatttatatatga

SEQ ID NO: 6447255 - DNA, 18 bp, Homo sapiens
tccatttatgttttttct

SEQ ID NO: 6447256 - DNA, 21 bp, Homo sapiens
tccatttattgtttgaaatgt

SEQ ID NO: 6447257 - DNA, 16 bp, Homo sapiens
tccatttatttatgaa

SEQ ID NO: 6447258 - DNA, 20 bp, Homo sapiens
tccatttcaactccagaagt

SEQ ID NO: 6447259 - DNA, 14 bp, Homo sapiens
tccatttcacgggc

SEQ ID NO: 6447260 - DNA, 21 bp, Homo sapiens
tccatttcaggactctctcca

SEQ ID NO: 6447261 - DNA, 23 bp, Homo sapiens
tccatttcaggactctctccagg

SEQ ID NO: 6447262 - DNA, 23 bp, Homo sapiens
tccatttcatctatttctgagaa

SEQ ID NO: 6447263 - DNA, 12 bp, Homo sapiens
tccatttccagt

SEQ ID NO: 6447264 - DNA, 15 bp, Homo sapiens
tccatttccattgct

SEQ ID NO: 6447265 - DNA, 22 bp, Homo sapiens
tccatttcccaaagtcctctgc

SEQ ID NO: 6447266 - DNA, 13 bp, Homo sapiens
tccatttcccact

SEQ ID NO: 6447267 - DNA, 14 bp, Homo sapiens
tccatttcccctct

SEQ ID NO: 6447268 - DNA, 20 bp, Homo sapiens
tccatttcgcccctcattta

SEQ ID NO: 6447269 - DNA, 12 bp, Homo sapiens
tccatttctaat

SEQ ID NO: 6447270 - DNA, 15 bp, Homo sapiens
tccatttctactgta

SEQ ID NO: 6447271 - DNA, 20 bp, Homo sapiens
tccatttctcaatcagtgca

SEQ ID NO: 6447272 - DNA, 14 bp, Homo sapiens
tccatttctcatgt

SEQ ID NO: 6447273 - DNA, 16 bp, Homo sapiens
tccatttctctcctta

SEQ ID NO: 6447274 - DNA, 16 bp, Homo sapiens
tccatttcttatttaa

SEQ ID NO: 6447275 - DNA, 15 bp, Homo sapiens
tccatttcttccacg

SEQ ID NO: 6447276 - DNA, 16 bp, Homo sapiens
tccatttcttcctcac

SEQ ID NO: 6447277 - DNA, 16 bp, Homo sapiens
tccatttcttttactc

SEQ ID NO: 6447278 - DNA, 16 bp, Homo sapiens
tccatttgaacacatt

SEQ ID NO: 6447279 - DNA, 18 bp, Homo sapiens
tccatttgaataaaatga

SEQ ID NO: 6447280 - DNA, 13 bp, Homo sapiens
tccatttgagaaa

SEQ ID NO: 6447281 - DNA, 14 bp, Homo sapiens
tccatttgagaaaa

SEQ ID NO: 6447282 - DNA, 23 bp, Homo sapiens
tccatttgcctttctgggagcag

SEQ ID NO: 6447283 - DNA, 13 bp, Homo sapiens
tccatttgctgat

SEQ ID NO: 6447284 - DNA, 11 bp, Homo sapiens
tccatttgctt

SEQ ID NO: 6447285 - DNA, 19 bp, Homo sapiens
tccatttggaaatctttaa

SEQ ID NO: 6447286 - DNA, 11 bp, Homo sapiens
tccatttggat

SEQ ID NO: 6447287 - DNA, 18 bp, Homo sapiens
tccatttggattttaaac

SEQ ID NO: 6447288 - DNA, 13 bp, Homo sapiens
tccatttggcaga

SEQ ID NO: 6447289 - DNA, 19 bp, Homo sapiens
tccatttggcagaactgct

SEQ ID NO: 6447290 - DNA, 21 bp, Homo sapiens
tccatttggcagaactgctgg

SEQ ID NO: 6447291 - DNA, 17 bp, Homo sapiens
tccatttggtcctttct

SEQ ID NO: 6447292 - DNA, 18 bp, Homo sapiens
tccatttgttttcacact

SEQ ID NO: 6447293 - DNA, 15 bp, Homo sapiens
tccattttacacttg

SEQ ID NO: 6447294 - DNA, 13 bp, Homo sapiens
tccattttataaa

SEQ ID NO: 6447295 - DNA, 15 bp, Homo sapiens
tccattttatgcaga

SEQ ID NO: 6447296 - DNA, 14 bp, Homo sapiens
tccattttcaagct

SEQ ID NO: 6447297 - DNA, 14 bp, Homo sapiens
tccattttcactaa

SEQ ID NO: 6447298 - DNA, 16 bp, Homo sapiens
tccattttcactaaaa

SEQ ID NO: 6447299 - DNA, 14 bp, Homo sapiens
tccattttccccca

SEQ ID NO: 6447300 - DNA, 22 bp, Homo sapiens
tccattttcctaaccacaagat

SEQ ID NO: 6447301 - DNA, 23 bp, Homo sapiens
tccattttcctacaggcagtctc

SEQ ID NO: 6447302 - DNA, 16 bp, Homo sapiens
tccattttctaaactg

SEQ ID NO: 6447303 - DNA, 17 bp, Homo sapiens
tccattttctaaactgt

SEQ ID NO: 6447304 - DNA, 19 bp, Homo sapiens
tccattttctaaactgttt

SEQ ID NO: 6447305 - DNA, 23 bp, Homo sapiens
tccattttctaaactgttttcat

SEQ ID NO: 6447306 - DNA, 22 bp, Homo sapiens
tccattttcttattgcgctgct

SEQ ID NO: 6447307 - DNA, 19 bp, Homo sapiens
tccattttcttctctgtga

SEQ ID NO: 6447308 - DNA, 22 bp, Homo sapiens
tccattttggtgtctttctctt

SEQ ID NO: 6447309 - DNA, 14 bp, Homo sapiens
tccattttgtgaag

SEQ ID NO: 6447310 - DNA, 17 bp, Homo sapiens
tccattttgtgaagccc

SEQ ID NO: 6447311 - DNA, 21 bp, Homo sapiens
tccatttttaaggctgtgtga

SEQ ID NO: 6447312 - DNA, 24 bp, Homo sapiens
tccatttttacaagttatagtact

SEQ ID NO: 6447313 - DNA, 18 bp, Homo sapiens
tccatttttactaaagca

SEQ ID NO: 6447314 - DNA, 18 bp, Homo sapiens
tccatttttcctctgttc

SEQ ID NO: 6447315 - DNA, 20 bp, Homo sapiens
tccatttttcctctgttcac

SEQ ID NO: 6447316 - DNA, 21 bp, Homo sapiens
tccatttttctcccaagaaac

SEQ ID NO: 6447317 - DNA, 17 bp, Homo sapiens
tccattttttaaatgtt

SEQ ID NO: 6447318 - DNA, 15 bp, Homo sapiens
tccattttttatatt

SEQ ID NO: 6447319 - DNA, 20 bp, Homo sapiens
tccatttttttctttactta

SEQ ID NO: 6447320 - DNA, 23 bp, Homo sapiens
tcccaaaaagatgctttaattgt

SEQ ID NO: 6447321 - DNA, 16 bp, Homo sapiens
tcccaaaacaatctat

SEQ ID NO: 6447322 - DNA, 23 bp, Homo sapiens
tcccaaaacagcctttttgtaat

SEQ ID NO: 6447323 - DNA, 23 bp, Homo sapiens
tcccaaaacattttaaatgaaag

SEQ ID NO: 6447324 - DNA, 21 bp, Homo sapiens
tcccaaaagagggacaacgaa

SEQ ID NO: 6447325 - DNA, 23 bp, Homo sapiens
tcccaaaagtatcgggggctggg

SEQ ID NO: 6447326 - DNA, 15 bp, Homo sapiens
tcccaaaatactaca

SEQ ID NO: 6447327 - DNA, 21 bp, Homo sapiens
tcccaaaatactgggattaca

SEQ ID NO: 6447328 - DNA, 17 bp, Homo sapiens
tcccaaaatcaccgtac

SEQ ID NO: 6447329 - DNA, 15 bp, Homo sapiens
tcccaaaatcccctc

SEQ ID NO: 6447330 - DNA, 20 bp, Homo sapiens
tcccaaaatcccctcagcct

SEQ ID NO: 6447331 - DNA, 18 bp, Homo sapiens
tcccaaaattagggagct

SEQ ID NO: 6447332 - DNA, 19 bp, Homo sapiens
tcccaaacacataatttct

SEQ ID NO: 6447333 - DNA, 14 bp, Homo sapiens
tcccaaacccagtc

SEQ ID NO: 6447334 - DNA, 18 bp, Homo sapiens
tcccaaacccttcagtgc

SEQ ID NO: 6447335 - DNA, 21 bp, Homo sapiens
tcccaaactaagctatgtgaa

SEQ ID NO: 6447336 - DNA, 17 bp, Homo sapiens
tcccaaactgacaattt

SEQ ID NO: 6447337 - DNA, 19 bp, Homo sapiens
tcccaaactgacaatttta

SEQ ID NO: 6447338 - DNA, 21 bp, Homo sapiens
tcccaaagacctccacttgct

SEQ ID NO: 6447339 - DNA, 13 bp, Homo sapiens
tcccaaagagctg

SEQ ID NO: 6447340 - DNA, 19 bp, Homo sapiens
tcccaaagcaagcacctgg

SEQ ID NO: 6447341 - DNA, 19 bp, Homo sapiens
tcccaaagcacttttaaaa

SEQ ID NO: 6447342 - DNA, 16 bp, Homo sapiens
tcccaaagcagtgcat

SEQ ID NO: 6447343 - DNA, 18 bp, Homo sapiens
tcccaaagcagtgcatgc

SEQ ID NO: 6447344 - DNA, 16 bp, Homo sapiens
tcccaaaggactccac

SEQ ID NO: 6447345 - DNA, 14 bp, Homo sapiens
tcccaaagggaggg

SEQ ID NO: 6447346 - DNA, 19 bp, Homo sapiens
tcccaaagtcctctgctcc

SEQ ID NO: 6447347 - DNA, 23 bp, Homo sapiens
tcccaaagtcctctgctccagca

SEQ ID NO: 6447348 - DNA, 14 bp, Homo sapiens
tcccaaagtgcctt

SEQ ID NO: 6447349 - DNA, 13 bp, Homo sapiens
tcccaaagtgctg

SEQ ID NO: 6447350 - DNA, 18 bp, Homo sapiens
tcccaaagtgctgagatt

SEQ ID NO: 6447351 - DNA, 20 bp, Homo sapiens
tcccaaagtgctgagattac

SEQ ID NO: 6447352 - DNA, 23 bp, Homo sapiens
tcccaaagtgctgagattacagg

SEQ ID NO: 6447353 - DNA, 12 bp, Homo sapiens
tcccaaagtgtt

SEQ ID NO: 6447354 - DNA, 20 bp, Homo sapiens
tcccaaagtgttaggattac

SEQ ID NO: 6447355 - DNA, 13 bp, Homo sapiens
tcccaaagtgttg

SEQ ID NO: 6447356 - DNA, 16 bp, Homo sapiens
tcccaaataaactcct

SEQ ID NO: 6447357 - DNA, 14 bp, Homo sapiens
tcccaaataaattt

SEQ ID NO: 6447358 - DNA, 17 bp, Homo sapiens
tcccaaatatgcccctc

SEQ ID NO: 6447359 - DNA, 17 bp, Homo sapiens
tcccaaatcaaaataaa

SEQ ID NO: 6447360 - DNA, 15 bp, Homo sapiens
tcccaaatcctagac

SEQ ID NO: 6447361 - DNA, 19 bp, Homo sapiens
tcccaaatctatagcattt

SEQ ID NO: 6447362 - DNA, 16 bp, Homo sapiens
tcccaaatgcagcttc

SEQ ID NO: 6447363 - DNA, 21 bp, Homo sapiens
tcccaaatgtgtgcccagctt

SEQ ID NO: 6447364 - DNA, 22 bp, Homo sapiens
tcccaaattggtgtttctgaat

SEQ ID NO: 6447365 - DNA, 16 bp, Homo sapiens
tcccaacaaaaaaaat

SEQ ID NO: 6447366 - DNA, 16 bp, Homo sapiens
tcccaacaacatgaaa

SEQ ID NO: 6447367 - DNA, 15 bp, Homo sapiens
tcccaacaagcagct

SEQ ID NO: 6447368 - DNA, 19 bp, Homo sapiens
tcccaacaatactttgtgt

SEQ ID NO: 6447369 - DNA, 15 bp, Homo sapiens
tcccaacactgccag

SEQ ID NO: 6447370 - DNA, 23 bp, Homo sapiens
tcccaacacttttgggaggtcca

SEQ ID NO: 6447371 - DNA, 15 bp, Homo sapiens
tcccaacagccatgc

SEQ ID NO: 6447372 - DNA, 16 bp, Homo sapiens
tcccaacagccatgcc

SEQ ID NO: 6447373 - DNA, 18 bp, Homo sapiens
tcccaacaggaggacaat

SEQ ID NO: 6447374 - DNA, 20 bp, Homo sapiens
tcccaacaggaggacaattc

SEQ ID NO: 6447375 - DNA, 21 bp, Homo sapiens
tcccaacaggaggacaattca

SEQ ID NO: 6447376 - DNA, 22 bp, Homo sapiens
tcccaacaggaggacaattcat

SEQ ID NO: 6447377 - DNA, 23 bp, Homo sapiens
tcccaacaggaggacaattcatg

SEQ ID NO: 6447378 - DNA, 17 bp, Homo sapiens
tcccaacagttttacct

SEQ ID NO: 6447379 - DNA, 13 bp, Homo sapiens
tcccaacatggga

SEQ ID NO: 6447380 - DNA, 16 bp, Homo sapiens
tgaaactttgctttgg

SEQ ID NO: 6447381 - DNA, 23 bp, Homo sapiens
tgaaactttgggaaaacatgtta

SEQ ID NO: 6447382 - DNA, 14 bp, Homo sapiens
tgaaacttttcaag

SEQ ID NO: 6447383 - DNA, 14 bp, Homo sapiens
tgaaacttttctaa

SEQ ID NO: 6447384 - DNA, 12 bp, Homo sapiens
tgaaagaaaata

SEQ ID NO: 6447385 - DNA, 17 bp, Homo sapiens
tgaaagaaaattgagtt

SEQ ID NO: 6447386 - DNA, 22 bp, Homo sapiens
tgaaagaaaattgagttgcact

SEQ ID NO: 6447387 - DNA, 20 bp, Homo sapiens
tgaaagaaacagttaacttt

SEQ ID NO: 6447388 - DNA, 16 bp, Homo sapiens
tgaaagaaaggactct

SEQ ID NO: 6447389 - DNA, 13 bp, Homo sapiens
tgaaagaaaggga

SEQ ID NO: 6447390 - DNA, 17 bp, Homo sapiens
tgaaagaaagggaccca

SEQ ID NO: 6447391 - DNA, 16 bp, Homo sapiens
tgaaagaaatcatgtt

SEQ ID NO: 6447392 - DNA, 22 bp, Homo sapiens
tgaaagaaatcatgttatgata

SEQ ID NO: 6447393 - DNA, 20 bp, Homo sapiens
tgaaagaacatggacttgta

SEQ ID NO: 6447394 - DNA, 20 bp, Homo sapiens
tgaaagaagaaaacagtaca

SEQ ID NO: 6447395 - DNA, 12 bp, Homo sapiens
tgaaagaagcaa

SEQ ID NO: 6447396 - DNA, 13 bp, Homo sapiens
tgaaagaagcaag

SEQ ID NO: 6447397 - DNA, 16 bp, Homo sapiens
tgaaagaagcaagaca

SEQ ID NO: 6447398 - DNA, 18 bp, Homo sapiens
tgaaagaatatatttatt

SEQ ID NO: 6447399 - DNA, 23 bp, Homo sapiens
tgaaagaatcagtaggaccaggc

SEQ ID NO: 6447400 - DNA, 14 bp, Homo sapiens
tgaaagaatgtaaa

SEQ ID NO: 6447401 - DNA, 15 bp, Homo sapiens
tgaaagaatgtaaag

SEQ ID NO: 6447402 - DNA, 17 bp, Homo sapiens
tgaaagacagaatgtca

SEQ ID NO: 6447403 - DNA, 22 bp, Homo sapiens
tgaaagacaggagtttatctat

SEQ ID NO: 6447404 - DNA, 12 bp, Homo sapiens
tgaaagacatca

SEQ ID NO: 6447405 - DNA, 21 bp, Homo sapiens
tgaaagacctgaataccactt

SEQ ID NO: 6447406 - DNA, 15 bp, Homo sapiens
tgaaagactgaagaa

SEQ ID NO: 6447407 - DNA, 22 bp, Homo sapiens
tgaaagactgaagaaagtgtag

SEQ ID NO: 6447408 - DNA, 13 bp, Homo sapiens
tgaaagagaaaat

SEQ ID NO: 6447409 - DNA, 15 bp, Homo sapiens
tgaaagagaaaatat

SEQ ID NO: 6447410 - DNA, 17 bp, Homo sapiens
tgaaagagaaaatgctt

SEQ ID NO: 6447411 - DNA, 13 bp, Homo sapiens
tgaaagagaacca

SEQ ID NO: 6447412 - DNA, 16 bp, Homo sapiens
tgaaagagaaccagtt

SEQ ID NO: 6447413 - DNA, 14 bp, Homo sapiens
tgaaagagagctct

SEQ ID NO: 6447414 - DNA, 22 bp, Homo sapiens
tgaaagagcaaacctaacagga

SEQ ID NO: 6447415 - DNA, 18 bp, Homo sapiens
tgaaagagccagactctg

SEQ ID NO: 6447416 - DNA, 17 bp, Homo sapiens
tgaaagaggaatgaagt

SEQ ID NO: 6447417 - DNA, 21 bp, Homo sapiens
tgaaagaggtaaaattctcta

SEQ ID NO: 6447418 - DNA, 15 bp, Homo sapiens
tgaaagagtctttct

SEQ ID NO: 6447419 - DNA, 16 bp, Homo sapiens
tgaaagagttaagaat

SEQ ID NO: 6447420 - DNA, 17 bp, Homo sapiens
tgaaagagttctggatt

SEQ ID NO: 6447421 - DNA, 14 bp, Homo sapiens
tgaaagataaatga

SEQ ID NO: 6447422 - DNA, 19 bp, Homo sapiens
tgaaagataaatgggttta

SEQ ID NO: 6447423 - DNA, 22 bp, Homo sapiens
tgaaagatatgtatatttttga

SEQ ID NO: 6447424 - DNA, 11 bp, Homo sapiens
tgaaagatgat

SEQ ID NO: 6447425 - DNA, 17 bp, Homo sapiens
tgaaagatgatttgcaa

SEQ ID NO: 6447426 - DNA, 18 bp, Homo sapiens
tgaaagatgatttgcaat

SEQ ID NO: 6447427 - DNA, 22 bp, Homo sapiens
tgaaagatgatttgcaatggga

SEQ ID NO: 6447428 - DNA, 15 bp, Homo sapiens
tgaaagatgcatgtt

SEQ ID NO: 6447429 - DNA, 18 bp, Homo sapiens
tgaaagatggctgtgcct

SEQ ID NO: 6447430 - DNA, 23 bp, Homo sapiens
tgaaagatggctgtgcctctgcc

SEQ ID NO: 6447431 - DNA, 15 bp, Homo sapiens
tgaaagatggtaatc

SEQ ID NO: 6447432 - DNA, 13 bp, Homo sapiens
tgaaagattaaac

SEQ ID NO: 6447433 - DNA, 18 bp, Homo sapiens
tgaaagattatttaaatg

SEQ ID NO: 6447434 - DNA, 20 bp, Homo sapiens
tgaaagattatttaaatgct

SEQ ID NO: 6447435 - DNA, 14 bp, Homo sapiens
tgaaagattgtggg

SEQ ID NO: 6447436 - DNA, 13 bp, Homo sapiens
tgaaagattttta

SEQ ID NO: 6447437 - DNA, 12 bp, Homo sapiens
tgaaagcaaaaa

SEQ ID NO: 6447438 - DNA, 21 bp, Homo sapiens
tgaaagcacaggagacactgt

SEQ ID NO: 6447439 - DNA, 21 bp, Homo sapiens
tgaaagcaggatgaattttct

SEQ ID NO: 6447440 - DNA, 22 bp, Homo sapiens
tgaaagcaggatgaattttctg

SEQ ID NO: 6447441 - DNA, 19 bp, Homo sapiens
tgaaagcagggaatttcta

SEQ ID NO: 6447442 - DNA, 18 bp, Homo sapiens
tgaaagcagggacttgaa

SEQ ID NO: 6447443 - DNA, 15 bp, Homo sapiens
tgaaagcatccatgt

SEQ ID NO: 6447444 - DNA, 17 bp, Homo sapiens
tgaaagcatccatgtgt

SEQ ID NO: 6447445 - DNA, 17 bp, Homo sapiens
tgaaagccaaatttata

SEQ ID NO: 6447446 - DNA, 21 bp, Homo sapiens
tgaaagccaacaactctgcct

SEQ ID NO: 6447447 - DNA, 22 bp, Homo sapiens
tgaaagccaacaactctgcctt

SEQ ID NO: 6447448 - DNA, 23 bp, Homo sapiens
tgaaagccaaggcagctcttctg

SEQ ID NO: 6447449 - DNA, 23 bp, Homo sapiens
tgaaagccagctgccgaccagag

SEQ ID NO: 6447450 - DNA, 14 bp, Homo sapiens
tgaaagccatttgt

SEQ ID NO: 6447451 - DNA, 16 bp, Homo sapiens
tgaaagccccagaaat

SEQ ID NO: 6447452 - DNA, 17 bp, Homo sapiens
tgaaagccctggaattt

SEQ ID NO: 6447453 - DNA, 15 bp, Homo sapiens
tgaaagcctctggaa

SEQ ID NO: 6447454 - DNA, 12 bp, Homo sapiens
tgaaagcctgtc

SEQ ID NO: 6447455 - DNA, 16 bp, Homo sapiens
tgaaagcctgtctctt

SEQ ID NO: 6447456 - DNA, 17 bp, Homo sapiens
tgaaagccttagggaag

SEQ ID NO: 6447457 - DNA, 17 bp, Homo sapiens
tgaaagcggctgcctcc

SEQ ID NO: 6447458 - DNA, 22 bp, Homo sapiens
tgaaagctcctcgagggcaggg

SEQ ID NO: 6447459 - DNA, 12 bp, Homo sapiens
tgaaagctgaat

SEQ ID NO: 6447460 - DNA, 20 bp, Homo sapiens
tgaaagctgaatccttccat

SEQ ID NO: 6447461 - DNA, 21 bp, Homo sapiens
tgaaagctgagaactcctgac

SEQ ID NO: 6447462 - DNA, 21 bp, Homo sapiens
tgaaagctgattactgtcaat

SEQ ID NO: 6447463 - DNA, 22 bp, Homo sapiens
tgaaagctgattactgtcaata

SEQ ID NO: 6447464 - DNA, 16 bp, Homo sapiens
tgaaagctgatttttt

SEQ ID NO: 6447465 - DNA, 10 bp, Homo sapiens
tgaaagctgt

SEQ ID NO: 6447466 - DNA, 15 bp, Homo sapiens
tgaaagctgtttcat

SEQ ID NO: 6447467 - DNA, 19 bp, Homo sapiens
tgaaagcttcaaagtttat

SEQ ID NO: 6447468 - DNA, 18 bp, Homo sapiens
tgaaagcttccatgttta

SEQ ID NO: 6447469 - DNA, 14 bp, Homo sapiens
tgaaaggaaaaatg

SEQ ID NO: 6447470 - DNA, 18 bp, Homo sapiens
tgaaaggaaatacacttc

SEQ ID NO: 6447471 - DNA, 18 bp, Homo sapiens
tgaaaggaagctccactg

SEQ ID NO: 6447472 - DNA, 21 bp, Homo sapiens
tgaaaggacctcttctgaagc

SEQ ID NO: 6447473 - DNA, 16 bp, Homo sapiens
tgaaaggatgtagaaa

SEQ ID NO: 6447474 - DNA, 16 bp, Homo sapiens
tgaaaggcaacataat

SEQ ID NO: 6447475 - DNA, 15 bp, Homo sapiens
tgaaaggcaggaagg

SEQ ID NO: 6447476 - DNA, 22 bp, Homo sapiens
tgaaaggcaggaagggaagcgt

SEQ ID NO: 6447477 - DNA, 16 bp, Homo sapiens
tgaaaggccagcagct

SEQ ID NO: 6447478 - DNA, 21 bp, Homo sapiens
tgaaaggctatcctgctgaaa

SEQ ID NO: 6447479 - DNA, 15 bp, Homo sapiens
tgaaaggcttttcaa

SEQ ID NO: 6447480 - DNA, 21 bp, Homo sapiens
tgaaaggcttttcaaccacaa

SEQ ID NO: 6447481 - DNA, 21 bp, Homo sapiens
tgaaagggaaggacagctgtg

SEQ ID NO: 6447482 - DNA, 16 bp, Homo sapiens
tgaaagggacaagtat

SEQ ID NO: 6447483 - DNA, 23 bp, Homo sapiens
tgaaagggcaatatgaagttact

SEQ ID NO: 6447484 - DNA, 21 bp, Homo sapiens
tgaaagggcacttaatttgta

SEQ ID NO: 6447485 - DNA, 13 bp, Homo sapiens
tgaaagggcccag

SEQ ID NO: 6447486 - DNA, 15 bp, Homo sapiens
tgaaagggcccagag

SEQ ID NO: 6447487 - DNA, 18 bp, Homo sapiens
tgaaagggcccagagagg

SEQ ID NO: 6447488 - DNA, 23 bp, Homo sapiens
tgaaaggggaaacgtctcccaga

SEQ ID NO: 6447489 - DNA, 19 bp, Homo sapiens
tgaaaggggacacctgtac

SEQ ID NO: 6447490 - DNA, 15 bp, Homo sapiens
tgaaaggtactatat

SEQ ID NO: 6447491 - DNA, 18 bp, Homo sapiens
tgaaaggtagacttttat

SEQ ID NO: 6447492 - DNA, 21 bp, Homo sapiens
tgaaaggtgccatggaagagg

SEQ ID NO: 6447493 - DNA, 17 bp, Homo sapiens
tgaaaggtgctgatggc

SEQ ID NO: 6447494 - DNA, 16 bp, Homo sapiens
tgaaaggtgctttctc

SEQ ID NO: 6447495 - DNA, 17 bp, Homo sapiens
tgaaaggtgctttctcc

SEQ ID NO: 6447496 - DNA, 18 bp, Homo sapiens
tgaaaggtgctttctcca

SEQ ID NO: 6447497 - DNA, 17 bp, Homo sapiens
tgaaaggtgtgaacagc

SEQ ID NO: 6447498 - DNA, 14 bp, Homo sapiens
tgaaaggtgtgcta

SEQ ID NO: 6447499 - DNA, 19 bp, Homo sapiens
tgaaaggttagagaataaa

SEQ ID NO: 6447500 - DNA, 15 bp, Homo sapiens
tgaaaggtttacatt

SEQ ID NO: 6447501 - DNA, 18 bp, Homo sapiens
tgaaaggttttttttcag

SEQ ID NO: 6447502 - DNA, 23 bp, Homo sapiens
tgaaagtaactgttttcttcttg

SEQ ID NO: 6447503 - DNA, 21 bp, Homo sapiens
tgaaagtaatttcaagaatgt

SEQ ID NO: 6447504 - DNA, 18 bp, Homo sapiens
tgaaagtagattcatgaa

SEQ ID NO: 6447505 - DNA, 20 bp, Homo sapiens
tgaaagtagcagtgtgaagt

SEQ ID NO: 6447506 - DNA, 21 bp, Homo sapiens
tgaaagtatattttcctccca

SEQ ID NO: 6447507 - DNA, 21 bp, Homo sapiens
tgaaagtatcaccaaaaaatc

SEQ ID NO: 6447508 - DNA, 22 bp, Homo sapiens
tgaaagtatcactggactagga

SEQ ID NO: 6447509 - DNA, 15 bp, Homo sapiens
tgaaagtattcagaa

SEQ ID NO: 6447510 - DNA, 18 bp, Homo sapiens
tgaaagtattcagaaatt

SEQ ID NO: 6447511 - DNA, 16 bp, Homo sapiens
tgaaagtcaaatttac

SEQ ID NO: 6447512 - DNA, 21 bp, Homo sapiens
tgaaagtcaagtctacctgcc

SEQ ID NO: 6447513 - DNA, 18 bp, Homo sapiens
tgaaagtcagatgcccag

SEQ ID NO: 6447514 - DNA, 17 bp, Homo sapiens
tgaaagtcatgaacaca

SEQ ID NO: 6447515 - DNA, 18 bp, Homo sapiens
tgaaagtcatgaacacat

SEQ ID NO: 6447516 - DNA, 19 bp, Homo sapiens
tgaaagtcatgaacacatc

SEQ ID NO: 6447517 - DNA, 18 bp, Homo sapiens
tgaaagtccagaaactgt

SEQ ID NO: 6447518 - DNA, 20 bp, Homo sapiens
tgaaagtctcctgtatcatt

SEQ ID NO: 6447519 - DNA, 16 bp, Homo sapiens
tgaaagtctgtgtcca

SEQ ID NO: 6447520 - DNA, 17 bp, Homo sapiens
tgaaagtcttgtgacta

SEQ ID NO: 6447521 - DNA, 22 bp, Homo sapiens
tgaaagtcttgtgactagtgct

SEQ ID NO: 6447522 - DNA, 18 bp, Homo sapiens
tgaaagtgaataaacttc

SEQ ID NO: 6447523 - DNA, 16 bp, Homo sapiens
tgaaagtgactttaaa

SEQ ID NO: 6447524 - DNA, 20 bp, Homo sapiens
tgaaagtgatgacatatttt

SEQ ID NO: 6447525 - DNA, 14 bp, Homo sapiens
tgaaagtgccaaaa

SEQ ID NO: 6447526 - DNA, 17 bp, Homo sapiens
tgaaagtgccaaaataa

SEQ ID NO: 6447527 - DNA, 14 bp, Homo sapiens
tgaaagtgcctttg

SEQ ID NO: 6447528 - DNA, 17 bp, Homo sapiens
tgaaagtggcaagctct

SEQ ID NO: 6447529 - DNA, 22 bp, Homo sapiens
tgaaagtggggtgttgaagacc

SEQ ID NO: 6447530 - DNA, 22 bp, Homo sapiens
tgaaagtgttgggattggttaa

SEQ ID NO: 6447531 - DNA, 21 bp, Homo sapiens
tgaaagtgtttttctttaatc

SEQ ID NO: 6447532 - DNA, 15 bp, Homo sapiens
tgaaagttacccact

SEQ ID NO: 6447533 - DNA, 22 bp, Homo sapiens
tgaaagttacccactgaagccc

SEQ ID NO: 6447534 - DNA, 20 bp, Homo sapiens
tgaaagttcatatctggagc

SEQ ID NO: 6447535 - DNA, 13 bp, Homo sapiens
tgaaagttccttc

SEQ ID NO: 6447536 - DNA, 13 bp, Homo sapiens
tgaaagttgcttt

SEQ ID NO: 6447537 - DNA, 13 bp, Homo sapiens
tgaaagttgtaca

SEQ ID NO: 6447538 - DNA, 20 bp, Homo sapiens
tgaaagttgtacatgataag

SEQ ID NO: 6447539 - DNA, 11 bp, Homo sapiens
tgaaagttgtg

SEQ ID NO: 6447540 - DNA, 15 bp, Homo sapiens
tgaaagttgtgatct

SEQ ID NO: 6447541 - DNA, 21 bp, Homo sapiens
tgaaagtttccttattttcat

SEQ ID NO: 6447542 - DNA, 16 bp, Homo sapiens
tgaaagtttgttctgc

SEQ ID NO: 6447543 - DNA, 18 bp, Homo sapiens
tgaaagttttcagaacct

SEQ ID NO: 6447544 - DNA, 17 bp, Homo sapiens
tgaaagttttccagtat

SEQ ID NO: 6447545 - DNA, 13 bp, Homo sapiens
tgaaagttttgta

SEQ ID NO: 6447546 - DNA, 23 bp, Homo sapiens
tgaaagtttttaatatttattga

SEQ ID NO: 6447547 - DNA, 21 bp, Homo sapiens
tgaaagtttttaattcatatt

SEQ ID NO: 6447548 - DNA, 19 bp, Homo sapiens
tgaaagtttttctgaaagt

SEQ ID NO: 6447549 - DNA, 22 bp, Homo sapiens
tgaaagtttttctgaaagtgtt

SEQ ID NO: 6447550 - DNA, 22 bp, Homo sapiens
tgaaataaaaattatgaaatat

SEQ ID NO: 6447551 - DNA, 17 bp, Homo sapiens
tgaaataaaactggctt

SEQ ID NO: 6447552 - DNA, 22 bp, Homo sapiens
tgaaataaaactggctttggct

SEQ ID NO: 6447553 - DNA, 21 bp, Homo sapiens
tgaaataaaatgattaatgca

SEQ ID NO: 6447554 - DNA, 19 bp, Homo sapiens
tgaaataaaattacacagt

SEQ ID NO: 6447555 - DNA, 15 bp, Homo sapiens
tgaaataaaatttga

SEQ ID NO: 6447556 - DNA, 16 bp, Homo sapiens
tgaaataaaatttgaa

SEQ ID NO: 6447557 - DNA, 14 bp, Homo sapiens
tcccaacatgggag

SEQ ID NO: 6447558 - DNA, 16 bp, Homo sapiens
tcccaacatgggaggg

SEQ ID NO: 6447559 - DNA, 17 bp, Homo sapiens
tcccaaccagtgccaag

SEQ ID NO: 6447560 - DNA, 19 bp, Homo sapiens
tcccaaccagtgccaagga

SEQ ID NO: 6447561 - DNA, 22 bp, Homo sapiens
tcccaacccaattcaggactgg

SEQ ID NO: 6447562 - DNA, 13 bp, Homo sapiens
tcccaaccccagc

SEQ ID NO: 6447563 - DNA, 13 bp, Homo sapiens
tcccaacccccag

SEQ ID NO: 6447564 - DNA, 22 bp, Homo sapiens
tcccaaccccttaagccctggc

SEQ ID NO: 6447565 - DNA, 15 bp, Homo sapiens
tcccaaccctggctt

SEQ ID NO: 6447566 - DNA, 16 bp, Homo sapiens
tcccaacctcctgtgg

SEQ ID NO: 6447567 - DNA, 22 bp, Homo sapiens
tcccaacctcctgtgggcctca

SEQ ID NO: 6447568 - DNA, 18 bp, Homo sapiens
tcccaacgagcctcctca

SEQ ID NO: 6447569 - DNA, 14 bp, Homo sapiens
tcccaacgctgaag

SEQ ID NO: 6447570 - DNA, 20 bp, Homo sapiens
tcccaacgctgaagcggtca

SEQ ID NO: 6447571 - DNA, 21 bp, Homo sapiens
tcccaacgctgaagcggtcag

SEQ ID NO: 6447572 - DNA, 14 bp, Homo sapiens
tcccaacgtactcc

SEQ ID NO: 6447573 - DNA, 22 bp, Homo sapiens
tcccaacgtgcaaagccaaggc

SEQ ID NO: 6447574 - DNA, 15 bp, Homo sapiens
tcccaactactcaga

SEQ ID NO: 6447575 - DNA, 18 bp, Homo sapiens
tcccaactactcagaagg

SEQ ID NO: 6447576 - DNA, 17 bp, Homo sapiens
tcccaactcaccccagc

SEQ ID NO: 6447577 - DNA, 16 bp, Homo sapiens
tcccaactcactgtgc

SEQ ID NO: 6447578 - DNA, 18 bp, Homo sapiens
tcccaactcactgtgctc

SEQ ID NO: 6447579 - DNA, 16 bp, Homo sapiens
tcccaactcagcctgt

SEQ ID NO: 6447580 - DNA, 21 bp, Homo sapiens
tcccaactcagcctgttcctt

SEQ ID NO: 6447581 - DNA, 17 bp, Homo sapiens
tcccaactcccttctgc

SEQ ID NO: 6447582 - DNA, 18 bp, Homo sapiens
tcccaactcccttctgct

SEQ ID NO: 6447583 - DNA, 17 bp, Homo sapiens
tcccaactctagctggg

SEQ ID NO: 6447584 - DNA, 14 bp, Homo sapiens
tcccaactctggcc

SEQ ID NO: 6447585 - DNA, 14 bp, Homo sapiens
tcccaactgcaagt

SEQ ID NO: 6447586 - DNA, 14 bp, Homo sapiens
tcccaactgctgct

SEQ ID NO: 6447587 - DNA, 22 bp, Homo sapiens
tcccaacttcatactggcagga

SEQ ID NO: 6447588 - DNA, 21 bp, Homo sapiens
tcccaacttctcttgctttct

SEQ ID NO: 6447589 - DNA, 15 bp, Homo sapiens
tcccaacttcttcct

SEQ ID NO: 6447590 - DNA, 17 bp, Homo sapiens
tcccaacttcttcctgt

SEQ ID NO: 6447591 - DNA, 20 bp, Homo sapiens
tcccaacttgcctttgaaga

SEQ ID NO: 6447592 - DNA, 14 bp, Homo sapiens
tcccaacttgtaaa

SEQ ID NO: 6447593 - DNA, 15 bp, Homo sapiens
tcccaactttggaaa

SEQ ID NO: 6447594 - DNA, 13 bp, Homo sapiens
tcccaagaaatgc

SEQ ID NO: 6447595 - DNA, 18 bp, Homo sapiens
tcccaagaacagcaggcc

SEQ ID NO: 6447596 - DNA, 22 bp, Homo sapiens
tcccaagaacagcaggcccacc

SEQ ID NO: 6447597 - DNA, 22 bp, Homo sapiens
tcccaagacagtgagacagtct

SEQ ID NO: 6447598 - DNA, 17 bp, Homo sapiens
tcccaagaccctgcccc

SEQ ID NO: 6447599 - DNA, 24 bp, Homo sapiens
tcccaagaccctgccccctgccag

SEQ ID NO: 6447600 - DNA, 19 bp, Homo sapiens
tcccaagacctcatctgcc

SEQ ID NO: 6447601 - DNA, 23 bp, Homo sapiens
tcccaagacctcatctgcctgca

SEQ ID NO: 6447602 - DNA, 22 bp, Homo sapiens
tcccaagagcatcatgcctctg

SEQ ID NO: 6447603 - DNA, 18 bp, Homo sapiens
tcccaagagccataaggg

SEQ ID NO: 6447604 - DNA, 13 bp, Homo sapiens
tcccaagagctac

SEQ ID NO: 6447605 - DNA, 13 bp, Homo sapiens
tcccaagaggcca

SEQ ID NO: 6447606 - DNA, 20 bp, Homo sapiens
tcccaagagtggtggcagct

SEQ ID NO: 6447607 - DNA, 13 bp, Homo sapiens
tcccaagatgcct

SEQ ID NO: 6447608 - DNA, 18 bp, Homo sapiens
tcccaagatggagaggaa

SEQ ID NO: 6447609 - DNA, 21 bp, Homo sapiens
tcccaagatggagaggaagaa

SEQ ID NO: 6447610 - DNA, 14 bp, Homo sapiens
tcccaagatttttt

SEQ ID NO: 6447611 - DNA, 18 bp, Homo sapiens
tcccaagcagctgaaggg

SEQ ID NO: 6447612 - DNA, 17 bp, Homo sapiens
tcccaagccgggagcca

SEQ ID NO: 6447613 - DNA, 16 bp, Homo sapiens
tcccaagcggtgtctc

SEQ ID NO: 6447614 - DNA, 21 bp, Homo sapiens
tcccaagcgttcctggccttc

SEQ ID NO: 6447615 - DNA, 20 bp, Homo sapiens
tcccaagctagactgtgtct

SEQ ID NO: 6447616 - DNA, 18 bp, Homo sapiens
tcccaagctcccaagagc

SEQ ID NO: 6447617 - DNA, 19 bp, Homo sapiens
tcccaagctcccaagagct

SEQ ID NO: 6447618 - DNA, 18 bp, Homo sapiens
tcccaagctgaatgttct

SEQ ID NO: 6447619 - DNA, 20 bp, Homo sapiens
tcccaagctggagtgcagtg

SEQ ID NO: 6447620 - DNA, 15 bp, Homo sapiens
tcccaagctggctgg

SEQ ID NO: 6447621 - DNA, 17 bp, Homo sapiens
tcccaagctgggcccca

SEQ ID NO: 6447622 - DNA, 18 bp, Homo sapiens
tcccaagctgggccccag

SEQ ID NO: 6447623 - DNA, 19 bp, Homo sapiens
tcccaagctgggccccagc

SEQ ID NO: 6447624 - DNA, 22 bp, Homo sapiens
tcccaaggacttccacattttt

SEQ ID NO: 6447625 - DNA, 16 bp, Homo sapiens
tcccaaggagaacaaa

SEQ ID NO: 6447626 - DNA, 18 bp, Homo sapiens
tcccaaggagaacaaata

SEQ ID NO: 6447627 - DNA, 15 bp, Homo sapiens
tcccaaggagctgat

SEQ ID NO: 6447628 - DNA, 22 bp, Homo sapiens
tcccaaggagctgatttccagg

SEQ ID NO: 6447629 - DNA, 19 bp, Homo sapiens
tcccaaggcaagcatgaat

SEQ ID NO: 6447630 - DNA, 21 bp, Homo sapiens
tcccaaggcaagcatgaataa

SEQ ID NO: 6447631 - DNA, 23 bp, Homo sapiens
tcccaaggccaagattgtccttt

SEQ ID NO: 6447632 - DNA, 22 bp, Homo sapiens
tcccaaggctctgagcaaatgt

SEQ ID NO: 6447633 - DNA, 15 bp, Homo sapiens
tcccaaggctgccag

SEQ ID NO: 6447634 - DNA, 22 bp, Homo sapiens
tcccaagggacagcaagtgagc

SEQ ID NO: 6447635 - DNA, 18 bp, Homo sapiens
tcccaagggatggtgccc

SEQ ID NO: 6447636 - DNA, 17 bp, Homo sapiens
tcccaaggggcctgagc

SEQ ID NO: 6447637 - DNA, 18 bp, Homo sapiens
tcccaaggggcctgagca

SEQ ID NO: 6447638 - DNA, 21 bp, Homo sapiens
tcccaaggtacagctgtatat

SEQ ID NO: 6447639 - DNA, 24 bp, Homo sapiens
tcccaaggtgaaatgaagcaacag

SEQ ID NO: 6447640 - DNA, 20 bp, Homo sapiens
tcccaaggtgctaggattac

SEQ ID NO: 6447641 - DNA, 16 bp, Homo sapiens
tcccaaggttacttaa

SEQ ID NO: 6447642 - DNA, 20 bp, Homo sapiens
tcccaaggttacttaattca

SEQ ID NO: 6447643 - DNA, 20 bp, Homo sapiens
tcccaaggttggagcccagg

SEQ ID NO: 6447644 - DNA, 19 bp, Homo sapiens
tcccaagtagaatctcagt

SEQ ID NO: 6447645 - DNA, 20 bp, Homo sapiens
tcccaagtagctgggactac

SEQ ID NO: 6447646 - DNA, 20 bp, Homo sapiens
tcccaagtagtagtgtcttc

SEQ ID NO: 6447647 - DNA, 15 bp, Homo sapiens
tcccaagtatgcctt

SEQ ID NO: 6447648 - DNA, 18 bp, Homo sapiens
tcccaagtcaaacagtgt

SEQ ID NO: 6447649 - DNA, 21 bp, Homo sapiens
tcccaagtcaaacagtgtggc

SEQ ID NO: 6447650 - DNA, 15 bp, Homo sapiens
tcccaagtcagacag

SEQ ID NO: 6447651 - DNA, 20 bp, Homo sapiens
tcccaagtctccagagagaa

SEQ ID NO: 6447652 - DNA, 17 bp, Homo sapiens
tcccaagtgccagtctt

SEQ ID NO: 6447653 - DNA, 12 bp, Homo sapiens
tcccaagtggtg

SEQ ID NO: 6447654 - DNA, 16 bp, Homo sapiens
tcccaagtggtgccta

SEQ ID NO: 6447655 - DNA, 13 bp, Homo sapiens
tcccaagtgtctc

SEQ ID NO: 6447656 - DNA, 13 bp, Homo sapiens
tcccaataaaagt

SEQ ID NO: 6447657 - DNA, 16 bp, Homo sapiens
tcccaataaaagtgac

SEQ ID NO: 6447658 - DNA, 12 bp, Homo sapiens
tcccaataaagc

SEQ ID NO: 6447659 - DNA, 13 bp, Homo sapiens
tcccaataaagct

SEQ ID NO: 6447660 - DNA, 17 bp, Homo sapiens
tcccaataaagctggac

SEQ ID NO: 6447661 - DNA, 16 bp, Homo sapiens
tcccaataaagtcctc

SEQ ID NO: 6447662 - DNA, 12 bp, Homo sapiens
tcccaatacaaa

SEQ ID NO: 6447663 - DNA, 18 bp, Homo sapiens
tcccaatacaaagatgac

SEQ ID NO: 6447664 - DNA, 18 bp, Homo sapiens
tcccaatagaatacctcc

SEQ ID NO: 6447665 - DNA, 17 bp, Homo sapiens
tcccaatagctctactg

SEQ ID NO: 6447666 - DNA, 22 bp, Homo sapiens
tcccaatagctctactgccctc

SEQ ID NO: 6447667 - DNA, 19 bp, Homo sapiens
tcccaatcaaagaattaca

SEQ ID NO: 6447668 - DNA, 19 bp, Homo sapiens
tcccaatcagcactgaaaa

SEQ ID NO: 6447669 - DNA, 16 bp, Homo sapiens
tcccaatcagcttttg

SEQ ID NO: 6447670 - DNA, 22 bp, Homo sapiens
tcccaatcagcttttgttctag

SEQ ID NO: 6447671 - DNA, 20 bp, Homo sapiens
tcccaatctctacccctttc

SEQ ID NO: 6447672 - DNA, 22 bp, Homo sapiens
tcccaatcttctttttcaggct

SEQ ID NO: 6447673 - DNA, 24 bp, Homo sapiens
tcccaatctttctatataaaatgt

SEQ ID NO: 6447674 - DNA, 22 bp, Homo sapiens
tcccaatgcacatccattccca

SEQ ID NO: 6447675 - DNA, 17 bp, Homo sapiens
tcccaatggtgcttgga

SEQ ID NO: 6447676 - DNA, 21 bp, Homo sapiens
tcccaatggtgcttggagggg

SEQ ID NO: 6447677 - DNA, 22 bp, Homo sapiens
tcccaatggtgtttttcttgta

SEQ ID NO: 6447678 - DNA, 13 bp, Homo sapiens
tcccaattaaaag

SEQ ID NO: 6447679 - DNA, 21 bp, Homo sapiens
tcccaattatcaaaaaacaga

SEQ ID NO: 6447680 - DNA, 12 bp, Homo sapiens
tcccaattcatt

SEQ ID NO: 6447681 - DNA, 13 bp, Homo sapiens
tcccaattcattt

SEQ ID NO: 6447682 - DNA, 16 bp, Homo sapiens
tcccaattcatttcat

SEQ ID NO: 6447683 - DNA, 17 bp, Homo sapiens
tcccaatttcagactcc

SEQ ID NO: 6447684 - DNA, 13 bp, Homo sapiens
tcccaattttctg

SEQ ID NO: 6447685 - DNA, 22 bp, Homo sapiens
tcccacaagactggtattctct

SEQ ID NO: 6447686 - DNA, 23 bp, Homo sapiens
tcccacaagactggtattctctt

SEQ ID NO: 6447687 - DNA, 15 bp, Homo sapiens
tcccacaagcctgag

SEQ ID NO: 6447688 - DNA, 23 bp, Homo sapiens
tcccacaatataaaactgtactt

SEQ ID NO: 6447689 - DNA, 23 bp, Homo sapiens
tcccacaatcttaaggggcagct

SEQ ID NO: 6447690 - DNA, 17 bp, Homo sapiens
tcccacacaagacccaa

SEQ ID NO: 6447691 - DNA, 11 bp, Homo sapiens
tcccacacagg

SEQ ID NO: 6447692 - DNA, 16 bp, Homo sapiens
tcccacacccaccctt

SEQ ID NO: 6447693 - DNA, 15 bp, Homo sapiens
tcccacacccacctc

SEQ ID NO: 6447694 - DNA, 13 bp, Homo sapiens
tcccacaccctgg

SEQ ID NO: 6447695 - DNA, 20 bp, Homo sapiens
tcccacaccgcgtcccagct

SEQ ID NO: 6447696 - DNA, 13 bp, Homo sapiens
tcccacaccgctg

SEQ ID NO: 6447697 - DNA, 14 bp, Homo sapiens
tcccacacctgcct

SEQ ID NO: 6447698 - DNA, 20 bp, Homo sapiens
tcccacacgattagctttat

SEQ ID NO: 6447699 - DNA, 17 bp, Homo sapiens
tcccacacggcagcccc

SEQ ID NO: 6447700 - DNA, 18 bp, Homo sapiens
tcccacactcccccagac

SEQ ID NO: 6447701 - DNA, 14 bp, Homo sapiens
tcccacactcgcca

SEQ ID NO: 6447702 - DNA, 22 bp, Homo sapiens
tcccacactgctaggtgggcca

SEQ ID NO: 6447703 - DNA, 14 bp, Homo sapiens
tcccacactgtgaa

SEQ ID NO: 6447704 - DNA, 14 bp, Homo sapiens
tcccacactgtggc

SEQ ID NO: 6447705 - DNA, 21 bp, Homo sapiens
tcccacacttcccacccccag

SEQ ID NO: 6447706 - DNA, 15 bp, Homo sapiens
tcccacactttgaag

SEQ ID NO: 6447707 - DNA, 22 bp, Homo sapiens
tcccacactttgaagcaaatac

SEQ ID NO: 6447708 - DNA, 12 bp, Homo sapiens
tcccacagacct

SEQ ID NO: 6447709 - DNA, 14 bp, Homo sapiens
tcccacagacctgc

SEQ ID NO: 6447710 - DNA, 16 bp, Homo sapiens
tcccacagagtgctgg

SEQ ID NO: 6447711 - DNA, 22 bp, Homo sapiens
tcccacagcacaaccggtccct

SEQ ID NO: 6447712 - DNA, 21 bp, Homo sapiens
tcccacagcagccccaggaga

SEQ ID NO: 6447713 - DNA, 19 bp, Homo sapiens
tcccacagcattcctccat

SEQ ID NO: 6447714 - DNA, 11 bp, Homo sapiens
tcccacagccc

SEQ ID NO: 6447715 - DNA, 14 bp, Homo sapiens
tcccacagccctga

SEQ ID NO: 6447716 - DNA, 13 bp, Homo sapiens
tcccacagcctcc

SEQ ID NO: 6447717 - DNA, 16 bp, Homo sapiens
tcccacagcttcctga

SEQ ID NO: 6447718 - DNA, 21 bp, Homo sapiens
tcccacaggacatttctctaa

SEQ ID NO: 6447719 - DNA, 16 bp, Homo sapiens
tcccacaggagggcca

SEQ ID NO: 6447720 - DNA, 17 bp, Homo sapiens
tcccacaggagggccag

SEQ ID NO: 6447721 - DNA, 17 bp, Homo sapiens
tcccacaggcagcttta

SEQ ID NO: 6447722 - DNA, 15 bp, Homo sapiens
tcccacagggaccac

SEQ ID NO: 6447723 - DNA, 21 bp, Homo sapiens
tcccacagtcccatctgcttc

SEQ ID NO: 6447724 - DNA, 20 bp, Homo sapiens
tcccacagtgctgggattac

SEQ ID NO: 6447725 - DNA, 21 bp, Homo sapiens
tcccacagtgctgggattaca

SEQ ID NO: 6447726 - DNA, 20 bp, Homo sapiens
tcccacatacgcagggggaa

SEQ ID NO: 6447727 - DNA, 22 bp, Homo sapiens
tcccacatccaactccagcaac

SEQ ID NO: 6447728 - DNA, 14 bp, Homo sapiens
tcccacatcccact

SEQ ID NO: 6447729 - DNA, 16 bp, Homo sapiens
tcccacatcccactgg

SEQ ID NO: 6447730 - DNA, 20 bp, Homo sapiens
tcccacatccctgggcctgc

SEQ ID NO: 6447731 - DNA, 21 bp, Homo sapiens
tcccacatccctgggcctgct

SEQ ID NO: 6447732 - DNA, 13 bp, Homo sapiens
tcccacatctttc

SEQ ID NO: 6447733 - DNA, 13 bp, Homo sapiens
tcccacatgggcc

SEQ ID NO: 6447734 - DNA, 18 bp, Homo sapiens
tgaaataaaatttgaaac

SEQ ID NO: 6447735 - DNA, 19 bp, Homo sapiens
tgaaataaaatttgaaact

SEQ ID NO: 6447736 - DNA, 12 bp, Homo sapiens
tgaaataaacac

SEQ ID NO: 6447737 - DNA, 16 bp, Homo sapiens
tgaaataaacactggt

SEQ ID NO: 6447738 - DNA, 17 bp, Homo sapiens
tgaaataaacctgcact

SEQ ID NO: 6447739 - DNA, 21 bp, Homo sapiens
tgaaataaacctgcactgaaa

SEQ ID NO: 6447740 - DNA, 13 bp, Homo sapiens
tgaaataaacgtc

SEQ ID NO: 6447741 - DNA, 20 bp, Homo sapiens
tgaaataaagaaccagtccc

SEQ ID NO: 6447742 - DNA, 15 bp, Homo sapiens
tgaaataaagagttc

SEQ ID NO: 6447743 - DNA, 13 bp, Homo sapiens
tgaaataaagtat

SEQ ID NO: 6447744 - DNA, 19 bp, Homo sapiens
tgaaataaagtcaaatcaa

SEQ ID NO: 6447745 - DNA, 21 bp, Homo sapiens
tgaaataaatttttaaaaaga

SEQ ID NO: 6447746 - DNA, 15 bp, Homo sapiens
tgaaataagaattca

SEQ ID NO: 6447747 - DNA, 13 bp, Homo sapiens
tgaaataagagaa

SEQ ID NO: 6447748 - DNA, 16 bp, Homo sapiens
tgaaataagctatttg

SEQ ID NO: 6447749 - DNA, 18 bp, Homo sapiens
tgaaataaggaatgatat

SEQ ID NO: 6447750 - DNA, 13 bp, Homo sapiens
tgaaataagtaaa

SEQ ID NO: 6447751 - DNA, 18 bp, Homo sapiens
tgaaataataaaatgcaa

SEQ ID NO: 6447752 - DNA, 23 bp, Homo sapiens
tgaaataataaaatgcaaatgaa

SEQ ID NO: 6447753 - DNA, 14 bp, Homo sapiens
tgaaataataaatc

SEQ ID NO: 6447754 - DNA, 21 bp, Homo sapiens
tgaaataatatatttcttctt

SEQ ID NO: 6447755 - DNA, 13 bp, Homo sapiens
tgaaataatgtgt

SEQ ID NO: 6447756 - DNA, 13 bp, Homo sapiens
tgaaataattaaa

SEQ ID NO: 6447757 - DNA, 18 bp, Homo sapiens
tgaaataattaaaaacca

SEQ ID NO: 6447758 - DNA, 19 bp, Homo sapiens
tgaaataattaaaaaccac

SEQ ID NO: 6447759 - DNA, 11 bp, Homo sapiens
tgaaatacctc

SEQ ID NO: 6447760 - DNA, 17 bp, Homo sapiens
tgaaatacctcatgttt

SEQ ID NO: 6447761 - DNA, 22 bp, Homo sapiens
tgaaatacctcatgtttatgaa

SEQ ID NO: 6447762 - DNA, 18 bp, Homo sapiens
tgaaatacctttgtagtt

SEQ ID NO: 6447763 - DNA, 19 bp, Homo sapiens
tgaaatacctttgtagtta

SEQ ID NO: 6447764 - DNA, 17 bp, Homo sapiens
tgaaataccttttctca

SEQ ID NO: 6447765 - DNA, 23 bp, Homo sapiens
tgaaataccttttctcacaaaaa

SEQ ID NO: 6447766 - DNA, 22 bp, Homo sapiens
tgaaatactaaaagcaaatcta

SEQ ID NO: 6447767 - DNA, 17 bp, Homo sapiens
tgaaatactgagatgct

SEQ ID NO: 6447768 - DNA, 14 bp, Homo sapiens
tgaaatacttgaaa

SEQ ID NO: 6447769 - DNA, 23 bp, Homo sapiens
tgaaatagacccacaagaggcag

SEQ ID NO: 6447770 - DNA, 21 bp, Homo sapiens
tgaaatagctttactgtttct

SEQ ID NO: 6447771 - DNA, 22 bp, Homo sapiens
tgaaataggagggaaacctttg

SEQ ID NO: 6447772 - DNA, 14 bp, Homo sapiens
tgaaatagtataca

SEQ ID NO: 6447773 - DNA, 15 bp, Homo sapiens
tgaaatagtatacat

SEQ ID NO: 6447774 - DNA, 16 bp, Homo sapiens
tgaaatagtatacatt

SEQ ID NO: 6447775 - DNA, 18 bp, Homo sapiens
tgaaatagtctgtgtgaa

SEQ ID NO: 6447776 - DNA, 16 bp, Homo sapiens
tgaaatagttatttta

SEQ ID NO: 6447777 - DNA, 19 bp, Homo sapiens
tgaaatagttattttaata

SEQ ID NO: 6447778 - DNA, 22 bp, Homo sapiens
tgaaatagtttccaagaaattt

SEQ ID NO: 6447779 - DNA, 18 bp, Homo sapiens
tgaaatataaactgtgag

SEQ ID NO: 6447780 - DNA, 19 bp, Homo sapiens
tgaaatataaactgtgaga

SEQ ID NO: 6447781 - DNA, 23 bp, Homo sapiens
tgaaatataaactgtgagataaa

SEQ ID NO: 6447782 - DNA, 22 bp, Homo sapiens
tgaaatataaattatctgaata

SEQ ID NO: 6447783 - DNA, 11 bp, Homo sapiens
tgaaatataat

SEQ ID NO: 6447784 - DNA, 16 bp, Homo sapiens
tgaaatatacacacag

SEQ ID NO: 6447785 - DNA, 19 bp, Homo sapiens
tgaaatatatgtgaaagga

SEQ ID NO: 6447786 - DNA, 14 bp, Homo sapiens
tgaaatatatttaa

SEQ ID NO: 6447787 - DNA, 15 bp, Homo sapiens
tgaaatatattttaa

SEQ ID NO: 6447788 - DNA, 18 bp, Homo sapiens
tgaaatatattttctctt

SEQ ID NO: 6447789 - DNA, 15 bp, Homo sapiens
tgaaatatcctgctt

SEQ ID NO: 6447790 - DNA, 20 bp, Homo sapiens
tgaaatatgcatactaattt

SEQ ID NO: 6447791 - DNA, 18 bp, Homo sapiens
tgaaatatgcatgtactt

SEQ ID NO: 6447792 - DNA, 17 bp, Homo sapiens
tgaaatattaaaatcac

SEQ ID NO: 6447793 - DNA, 18 bp, Homo sapiens
tgaaatattaaaatcact

SEQ ID NO: 6447794 - DNA, 18 bp, Homo sapiens
tgaaatattatgttaaaa

SEQ ID NO: 6447795 - DNA, 14 bp, Homo sapiens
tgaaatattcagaa

SEQ ID NO: 6447796 - DNA, 15 bp, Homo sapiens
tgaaatattcagaaa

SEQ ID NO: 6447797 - DNA, 16 bp, Homo sapiens
tgaaatattcagaaat

SEQ ID NO: 6447798 - DNA, 17 bp, Homo sapiens
tgaaatattcagaaatt

SEQ ID NO: 6447799 - DNA, 16 bp, Homo sapiens
tgaaatattgactttt

SEQ ID NO: 6447800 - DNA, 13 bp, Homo sapiens
tgaaatattgtaa

SEQ ID NO: 6447801 - DNA, 19 bp, Homo sapiens
tgaaatatttaagtatata

SEQ ID NO: 6447802 - DNA, 14 bp, Homo sapiens
tgaaatatttgctt

SEQ ID NO: 6447803 - DNA, 16 bp, Homo sapiens
tgaaatatttgcttat

SEQ ID NO: 6447804 - DNA, 18 bp, Homo sapiens
tgaaatatttgcttattt

SEQ ID NO: 6447805 - DNA, 22 bp, Homo sapiens
tgaaatatttgcttatttatat

SEQ ID NO: 6447806 - DNA, 16 bp, Homo sapiens
tgaaatattttacagt

SEQ ID NO: 6447807 - DNA, 16 bp, Homo sapiens
tgaaatattttctact

SEQ ID NO: 6447808 - DNA, 17 bp, Homo sapiens
tgaaatattttcttcct

SEQ ID NO: 6447809 - DNA, 18 bp, Homo sapiens
tgaaatattttgaataca

SEQ ID NO: 6447810 - DNA, 17 bp, Homo sapiens
tgaaatcaccttttcta

SEQ ID NO: 6447811 - DNA, 18 bp, Homo sapiens
tgaaatcaccttttctaa

SEQ ID NO: 6447812 - DNA, 14 bp, Homo sapiens
tgaaatcagcatga

SEQ ID NO: 6447813 - DNA, 19 bp, Homo sapiens
tgaaatcagcatgacaaaa

SEQ ID NO: 6447814 - DNA, 19 bp, Homo sapiens
tgaaatcagtatcagaata

SEQ ID NO: 6447815 - DNA, 22 bp, Homo sapiens
tgaaatcatatagaaaggctgg

SEQ ID NO: 6447816 - DNA, 15 bp, Homo sapiens
tgaaatcatcaaaaa

SEQ ID NO: 6447817 - DNA, 19 bp, Homo sapiens
tgaaatcatcaaaaagaaa

SEQ ID NO: 6447818 - DNA, 14 bp, Homo sapiens
tgaaatccaaaata

SEQ ID NO: 6447819 - DNA, 15 bp, Homo sapiens
tgaaatccaaaatag

SEQ ID NO: 6447820 - DNA, 14 bp, Homo sapiens
tgaaatccaggaat

SEQ ID NO: 6447821 - DNA, 22 bp, Homo sapiens
tgaaatccataaactaagagaa

SEQ ID NO: 6447822 - DNA, 22 bp, Homo sapiens
tgaaatccatactgtagacact

SEQ ID NO: 6447823 - DNA, 19 bp, Homo sapiens
tgaaatcccatcaggtcac

SEQ ID NO: 6447824 - DNA, 20 bp, Homo sapiens
tgaaatcccatcaggtcacc

SEQ ID NO: 6447825 - DNA, 20 bp, Homo sapiens
tgaaatcccatctgcatttg

SEQ ID NO: 6447826 - DNA, 14 bp, Homo sapiens
tgaaatccctctac

SEQ ID NO: 6447827 - DNA, 17 bp, Homo sapiens
tgaaatccgtgaagtca

SEQ ID NO: 6447828 - DNA, 19 bp, Homo sapiens
tgaaatccgtgaagtcaca

SEQ ID NO: 6447829 - DNA, 21 bp, Homo sapiens
tgaaatcctggaaaattctat

SEQ ID NO: 6447830 - DNA, 22 bp, Homo sapiens
tgaaatcctgggttttcttaac

SEQ ID NO: 6447831 - DNA, 16 bp, Homo sapiens
tgaaatcctggttcct

SEQ ID NO: 6447832 - DNA, 22 bp, Homo sapiens
tgaaatcggaagggacttcctc

SEQ ID NO: 6447833 - DNA, 12 bp, Homo sapiens
tgaaatctacaa

SEQ ID NO: 6447834 - DNA, 13 bp, Homo sapiens
tgaaatctacaac

SEQ ID NO: 6447835 - DNA, 15 bp, Homo sapiens
tgaaatctacaacat

SEQ ID NO: 6447836 - DNA, 20 bp, Homo sapiens
tgaaatctacaacataatga

SEQ ID NO: 6447837 - DNA, 20 bp, Homo sapiens
tgaaatctacaggcctcagg

SEQ ID NO: 6447838 - DNA, 15 bp, Homo sapiens
tgaaatctaggaaaa

SEQ ID NO: 6447839 - DNA, 19 bp, Homo sapiens
tgaaatctgctagaaagtt

SEQ ID NO: 6447840 - DNA, 19 bp, Homo sapiens
tgaaatctgctctgtacat

SEQ ID NO: 6447841 - DNA, 23 bp, Homo sapiens
tgaaatctgtttgttgacttatt

SEQ ID NO: 6447842 - DNA, 19 bp, Homo sapiens
tgaaatcttcccatgcatt

SEQ ID NO: 6447843 - DNA, 22 bp, Homo sapiens
tgaaatcttcccatgcattctg

SEQ ID NO: 6447844 - DNA, 13 bp, Homo sapiens
tgaaatcttgttt

SEQ ID NO: 6447845 - DNA, 14 bp, Homo sapiens
tgaaatctttcaag

SEQ ID NO: 6447846 - DNA, 13 bp, Homo sapiens
tgaaatctttctt

SEQ ID NO: 6447847 - DNA, 17 bp, Homo sapiens
tgaaatctttttgcttt

SEQ ID NO: 6447848 - DNA, 20 bp, Homo sapiens
tgaaatgaaaacatgtaata

SEQ ID NO: 6447849 - DNA, 13 bp, Homo sapiens
tgaaatgaaaggg

SEQ ID NO: 6447850 - DNA, 16 bp, Homo sapiens
tgaaatgaaagggaaa

SEQ ID NO: 6447851 - DNA, 13 bp, Homo sapiens
tgaaatgaaattt

SEQ ID NO: 6447852 - DNA, 13 bp, Homo sapiens
tgaaatgaacaca

SEQ ID NO: 6447853 - DNA, 22 bp, Homo sapiens
tgaaatgaacacaaattatgct

SEQ ID NO: 6447854 - DNA, 21 bp, Homo sapiens
tgaaatgacatgttcctttaa

SEQ ID NO: 6447855 - DNA, 16 bp, Homo sapiens
tgaaatgacatttcac

SEQ ID NO: 6447856 - DNA, 18 bp, Homo sapiens
tgaaatgacatttcacta

SEQ ID NO: 6447857 - DNA, 16 bp, Homo sapiens
tgaaatgactgtctaa

SEQ ID NO: 6447858 - DNA, 21 bp, Homo sapiens
tgaaatgagcacctccattaa

SEQ ID NO: 6447859 - DNA, 16 bp, Homo sapiens
tgaaatgagcatgcat

SEQ ID NO: 6447860 - DNA, 20 bp, Homo sapiens
tgaaatgagcatgcattttc

SEQ ID NO: 6447861 - DNA, 21 bp, Homo sapiens
tgaaatgaggcctactctaaa

SEQ ID NO: 6447862 - DNA, 20 bp, Homo sapiens
tgaaatgaggtcagagcctg

SEQ ID NO: 6447863 - DNA, 21 bp, Homo sapiens
tgaaatgaggtcagagcctgc

SEQ ID NO: 6447864 - DNA, 22 bp, Homo sapiens
tgaaatgaggtcagagcctgca

SEQ ID NO: 6447865 - DNA, 23 bp, Homo sapiens
tgaaatgaggtcagagcctgcag

SEQ ID NO: 6447866 - DNA, 13 bp, Homo sapiens
tgaaatgagtaaa

SEQ ID NO: 6447867 - DNA, 17 bp, Homo sapiens
tgaaatgataaagactt

SEQ ID NO: 6447868 - DNA, 18 bp, Homo sapiens
tgaaatgataaagacttt

SEQ ID NO: 6447869 - DNA, 14 bp, Homo sapiens
tgaaatgatagatt

SEQ ID NO: 6447870 - DNA, 22 bp, Homo sapiens
tgaaatgatagatttgacctcc

SEQ ID NO: 6447871 - DNA, 21 bp, Homo sapiens
tgaaatgattcatctttcaga

SEQ ID NO: 6447872 - DNA, 15 bp, Homo sapiens
tgaaatgattggaat

SEQ ID NO: 6447873 - DNA, 20 bp, Homo sapiens
tgaaatgattggtaggaaat

SEQ ID NO: 6447874 - DNA, 18 bp, Homo sapiens
tgaaatgcatcattcttg

SEQ ID NO: 6447875 - DNA, 13 bp, Homo sapiens
tgaaatgcatttt

SEQ ID NO: 6447876 - DNA, 15 bp, Homo sapiens
tgaaatgcattttgc

SEQ ID NO: 6447877 - DNA, 22 bp, Homo sapiens
tgaaatgccaaaggaagtttta

SEQ ID NO: 6447878 - DNA, 23 bp, Homo sapiens
tgaaatgccaagactctatgctc

SEQ ID NO: 6447879 - DNA, 12 bp, Homo sapiens
tgaaatgccaga

SEQ ID NO: 6447880 - DNA, 13 bp, Homo sapiens
tgaaatgccagac

SEQ ID NO: 6447881 - DNA, 20 bp, Homo sapiens
tgaaatgccttactttgtat

SEQ ID NO: 6447882 - DNA, 22 bp, Homo sapiens
tgaaatgccttactttgtatga

SEQ ID NO: 6447883 - DNA, 14 bp, Homo sapiens
tgaaatgctaaact

SEQ ID NO: 6447884 - DNA, 18 bp, Homo sapiens
tgaaatgctatgtcattt

SEQ ID NO: 6447885 - DNA, 20 bp, Homo sapiens
tgaaatgctatgtcatttca

SEQ ID NO: 6447886 - DNA, 16 bp, Homo sapiens
tgaaatgctctccttt

SEQ ID NO: 6447887 - DNA, 13 bp, Homo sapiens
tgaaatgctcttt

SEQ ID NO: 6447888 - DNA, 18 bp, Homo sapiens
tgaaatgctcttttgcac

SEQ ID NO: 6447889 - DNA, 19 bp, Homo sapiens
tgaaatgctgaaaattgcc

SEQ ID NO: 6447890 - DNA, 15 bp, Homo sapiens
tgaaatgctgcattt

SEQ ID NO: 6447891 - DNA, 17 bp, Homo sapiens
tgaaatgctgttagtaa

SEQ ID NO: 6447892 - DNA, 13 bp, Homo sapiens
tgaaatgctttta

SEQ ID NO: 6447893 - DNA, 19 bp, Homo sapiens
tgaaatgcttttatattct

SEQ ID NO: 6447894 - DNA, 21 bp, Homo sapiens
tgaaatgcttttatattctaa

SEQ ID NO: 6447895 - DNA, 22 bp, Homo sapiens
tgaaatgcttttatattctaat

SEQ ID NO: 6447896 - DNA, 16 bp, Homo sapiens
tgaaatggaggtcctt

SEQ ID NO: 6447897 - DNA, 17 bp, Homo sapiens
tgaaatggatactacat

SEQ ID NO: 6447898 - DNA, 17 bp, Homo sapiens
tgaaatggatacttata

SEQ ID NO: 6447899 - DNA, 20 bp, Homo sapiens
tgaaatggcctgtccctagg

SEQ ID NO: 6447900 - DNA, 21 bp, Homo sapiens
tgaaatggctggggccgctgg

SEQ ID NO: 6447901 - DNA, 15 bp, Homo sapiens
tgaaatgggagatgg

SEQ ID NO: 6447902 - DNA, 16 bp, Homo sapiens
tgaaatgggcatttat

SEQ ID NO: 6447903 - DNA, 17 bp, Homo sapiens
tgaaatgggcatttatt

SEQ ID NO: 6447904 - DNA, 12 bp, Homo sapiens
tgaaatggttgt

SEQ ID NO: 6447905 - DNA, 19 bp, Homo sapiens
tgaaatgtaacatgaagca

SEQ ID NO: 6447906 - DNA, 12 bp, Homo sapiens
tgaaatgtaagg

SEQ ID NO: 6447907 - DNA, 12 bp, Homo sapiens
tgaaatgtacat

SEQ ID NO: 6447908 - DNA, 10 bp, Homo sapiens
tgaaatgtat

SEQ ID NO: 6447909 - DNA, 18 bp, Homo sapiens
tgaaatgtataattaact

SEQ ID NO: 6447910 - DNA, 20 bp, Homo sapiens
tgaaatgtataattaactta

SEQ ID NO: 6447911 - DNA, 22 bp, Homo sapiens
tgaaatgtataattaacttaac

SEQ ID NO: 6447912 - DNA, 21 bp, Homo sapiens
tgaaatgtcaaattgatgtgc

SEQ ID NO: 6447913 - DNA, 15 bp, Homo sapiens
tcccacattaaagaa

SEQ ID NO: 6447914 - DNA, 22 bp, Homo sapiens
tcccacattaaagaagacctga

SEQ ID NO: 6447915 - DNA, 23 bp, Homo sapiens
tcccacattcccatgaatatcaa

SEQ ID NO: 6447916 - DNA, 20 bp, Homo sapiens
tcccacattcggaccctgcc

SEQ ID NO: 6447917 - DNA, 18 bp, Homo sapiens
tcccacattttagaatac

SEQ ID NO: 6447918 - DNA, 19 bp, Homo sapiens
tcccaccaaccctcagagc

SEQ ID NO: 6447919 - DNA, 17 bp, Homo sapiens
tcccaccaacctccagt

SEQ ID NO: 6447920 - DNA, 13 bp, Homo sapiens
tcccaccaactct

SEQ ID NO: 6447921 - DNA, 14 bp, Homo sapiens
tcccaccaactctc

SEQ ID NO: 6447922 - DNA, 20 bp, Homo sapiens
tcccaccaactctctctgcc

SEQ ID NO: 6447923 - DNA, 19 bp, Homo sapiens
tcccaccaactctgcactc

SEQ ID NO: 6447924 - DNA, 21 bp, Homo sapiens
tcccaccaactctgcactcca

SEQ ID NO: 6447925 - DNA, 22 bp, Homo sapiens
tcccaccaactctgcactccat

SEQ ID NO: 6447926 - DNA, 18 bp, Homo sapiens
tcccaccaatcctcacct

SEQ ID NO: 6447927 - DNA, 11 bp, Homo sapiens
tcccaccaccc

SEQ ID NO: 6447928 - DNA, 14 bp, Homo sapiens
tcccaccaccccat

SEQ ID NO: 6447929 - DNA, 20 bp, Homo sapiens
tcccaccaccttggactcct

SEQ ID NO: 6447930 - DNA, 15 bp, Homo sapiens
tcccaccactccctg

SEQ ID NO: 6447931 - DNA, 19 bp, Homo sapiens
tcccaccagaacgcacccc

SEQ ID NO: 6447932 - DNA, 22 bp, Homo sapiens
tcccaccagaacgcaccccact

SEQ ID NO: 6447933 - DNA, 13 bp, Homo sapiens
tcccaccagcatg

SEQ ID NO: 6447934 - DNA, 19 bp, Homo sapiens
tcccaccagcatgtcactc

SEQ ID NO: 6447935 - DNA, 13 bp, Homo sapiens
tcccaccagccca

SEQ ID NO: 6447936 - DNA, 20 bp, Homo sapiens
tcccaccaggcagctccagc

SEQ ID NO: 6447937 - DNA, 20 bp, Homo sapiens
tcccaccatgcgctgctcaa

SEQ ID NO: 6447938 - DNA, 16 bp, Homo sapiens
tcccaccattcctgcc

SEQ ID NO: 6447939 - DNA, 23 bp, Homo sapiens
tcccacccaacagctcagagatg

SEQ ID NO: 6447940 - DNA, 21 bp, Homo sapiens
tcccacccacacagctgccct

SEQ ID NO: 6447941 - DNA, 15 bp, Homo sapiens
tcccacccacagcca

SEQ ID NO: 6447942 - DNA, 15 bp, Homo sapiens
tcccacccacatgtg

SEQ ID NO: 6447943 - DNA, 15 bp, Homo sapiens
tcccacccacccgcc

SEQ ID NO: 6447944 - DNA, 20 bp, Homo sapiens
tcccacccactagccctctt

SEQ ID NO: 6447945 - DNA, 13 bp, Homo sapiens
tcccacccaggaa

SEQ ID NO: 6447946 - DNA, 20 bp, Homo sapiens
tcccaccccaacctgctctc

SEQ ID NO: 6447947 - DNA, 15 bp, Homo sapiens
tcccaccccacacac

SEQ ID NO: 6447948 - DNA, 13 bp, Homo sapiens
tcccaccccaccc

SEQ ID NO: 6447949 - DNA, 16 bp, Homo sapiens
tcccaccccaccccct

SEQ ID NO: 6447950 - DNA, 17 bp, Homo sapiens
tcccaccccacctcttg

SEQ ID NO: 6447951 - DNA, 18 bp, Homo sapiens
tcccaccccacctcttgt

SEQ ID NO: 6447952 - DNA, 13 bp, Homo sapiens
tcccaccccactc

SEQ ID NO: 6447953 - DNA, 16 bp, Homo sapiens
tcccaccccactccag

SEQ ID NO: 6447954 - DNA, 18 bp, Homo sapiens
tcccaccccactccagcc

SEQ ID NO: 6447955 - DNA, 17 bp, Homo sapiens
tcccaccccagaaatca

SEQ ID NO: 6447956 - DNA, 19 bp, Homo sapiens
tcccaccccagaaatcact

SEQ ID NO: 6447957 - DNA, 20 bp, Homo sapiens
tcccaccccagaaatcactg

SEQ ID NO: 6447958 - DNA, 22 bp, Homo sapiens
tcccaccccagaaatcactgtg

SEQ ID NO: 6447959 - DNA, 21 bp, Homo sapiens
tcccaccccagcctcaagtag

SEQ ID NO: 6447960 - DNA, 22 bp, Homo sapiens
tcccaccccatgaggctcactc

SEQ ID NO: 6447961 - DNA, 12 bp, Homo sapiens
tcccacccccaa

SEQ ID NO: 6447962 - DNA, 15 bp, Homo sapiens
tcccacccccaaccc

SEQ ID NO: 6447963 - DNA, 17 bp, Homo sapiens
tcccacccccagccccg

SEQ ID NO: 6447964 - DNA, 19 bp, Homo sapiens
tcccacccccgaccctgcc

SEQ ID NO: 6447965 - DNA, 16 bp, Homo sapiens
tcccaccccctccccg

SEQ ID NO: 6447966 - DNA, 22 bp, Homo sapiens
tcccaccccctccccgggcagc

SEQ ID NO: 6447967 - DNA, 19 bp, Homo sapiens
tcccaccccctcctccccc

SEQ ID NO: 6447968 - DNA, 20 bp, Homo sapiens
tcccaccccctcctccccca

SEQ ID NO: 6447969 - DNA, 17 bp, Homo sapiens
tcccaccccctccttct

SEQ ID NO: 6447970 - DNA, 17 bp, Homo sapiens
tcccacccccttctctg

SEQ ID NO: 6447971 - DNA, 19 bp, Homo sapiens
tcccacccccttctctgct

SEQ ID NO: 6447972 - DNA, 20 bp, Homo sapiens
tcccacccccttctctgctc

SEQ ID NO: 6447973 - DNA, 17 bp, Homo sapiens
tcccacccctacacaca

SEQ ID NO: 6447974 - DNA, 22 bp, Homo sapiens
tcccacccctacacacacactc

SEQ ID NO: 6447975 - DNA, 23 bp, Homo sapiens
tcccacccctacacacacactcc

SEQ ID NO: 6447976 - DNA, 12 bp, Homo sapiens
tcccacccctat

SEQ ID NO: 6447977 - DNA, 19 bp, Homo sapiens
tcccacccctgcctcccat

SEQ ID NO: 6447978 - DNA, 15 bp, Homo sapiens
tcccaccccttggcc

SEQ ID NO: 6447979 - DNA, 18 bp, Homo sapiens
tcccaccccttggcccct

SEQ ID NO: 6447980 - DNA, 20 bp, Homo sapiens
tcccaccccttggcccctca

SEQ ID NO: 6447981 - DNA, 18 bp, Homo sapiens
tcccacccgatgctgctt

SEQ ID NO: 6447982 - DNA, 20 bp, Homo sapiens
tcccacccgatgctgctttc

SEQ ID NO: 6447983 - DNA, 14 bp, Homo sapiens
tcccacccggccac

SEQ ID NO: 6447984 - DNA, 23 bp, Homo sapiens
tcccacccggccacagctgctgg

SEQ ID NO: 6447985 - DNA, 15 bp, Homo sapiens
tcccaccctaagggc

SEQ ID NO: 6447986 - DNA, 19 bp, Homo sapiens
tcccaccctaagggcagcc

SEQ ID NO: 6447987 - DNA, 20 bp, Homo sapiens
tcccaccctaagggcagccc

SEQ ID NO: 6447988 - DNA, 21 bp, Homo sapiens
tcccaccctaagggcagccct

SEQ ID NO: 6447989 - DNA, 13 bp, Homo sapiens
tcccaccctaccc

SEQ ID NO: 6447990 - DNA, 14 bp, Homo sapiens
tcccaccctacccc

SEQ ID NO: 6447991 - DNA, 20 bp, Homo sapiens
tcccaccctacccccttttt

SEQ ID NO: 6447992 - DNA, 13 bp, Homo sapiens
tcccaccctccac

SEQ ID NO: 6447993 - DNA, 15 bp, Homo sapiens
tcccaccctccctag

SEQ ID NO: 6447994 - DNA, 21 bp, Homo sapiens
tcccaccctcctgccccacac

SEQ ID NO: 6447995 - DNA, 12 bp, Homo sapiens
tcccaccctctt

SEQ ID NO: 6447996 - DNA, 20 bp, Homo sapiens
tcccaccctgacccccttcc

SEQ ID NO: 6447997 - DNA, 17 bp, Homo sapiens
tcccaccctgctgctgc

SEQ ID NO: 6447998 - DNA, 20 bp, Homo sapiens
tcccaccctgtacctcatcc

SEQ ID NO: 6447999 - DNA, 15 bp, Homo sapiens
tcccaccctttctgc

SEQ ID NO: 6448000 - DNA, 18 bp, Homo sapiens
tcccaccctttctgccag

SEQ ID NO: 6448001 - DNA, 24 bp, Homo sapiens
tcccaccgcccagcggcttgcctg

SEQ ID NO: 6448002 - DNA, 21 bp, Homo sapiens
tcccaccgggagcctccccct

SEQ ID NO: 6448003 - DNA, 18 bp, Homo sapiens
tcccaccggttgcttctg

SEQ ID NO: 6448004 - DNA, 19 bp, Homo sapiens
tcccaccggttgcttctgg

SEQ ID NO: 6448005 - DNA, 16 bp, Homo sapiens
tcccacctactgcact

SEQ ID NO: 6448006 - DNA, 16 bp, Homo sapiens
tcccacctagcagcac

SEQ ID NO: 6448007 - DNA, 15 bp, Homo sapiens
tcccacctagtgccc

SEQ ID NO: 6448008 - DNA, 18 bp, Homo sapiens
tcccacctagtgccccag

SEQ ID NO: 6448009 - DNA, 17 bp, Homo sapiens
tcccacctcacccggcc

SEQ ID NO: 6448010 - DNA, 20 bp, Homo sapiens
tcccacctcacccggcctct

SEQ ID NO: 6448011 - DNA, 15 bp, Homo sapiens
tcccacctcagcctc

SEQ ID NO: 6448012 - DNA, 14 bp, Homo sapiens
tcccacctccagcc

SEQ ID NO: 6448013 - DNA, 15 bp, Homo sapiens
tcccacctccagccc

SEQ ID NO: 6448014 - DNA, 16 bp, Homo sapiens
tcccacctccagccca

SEQ ID NO: 6448015 - DNA, 17 bp, Homo sapiens
tcccacctccatcccag

SEQ ID NO: 6448016 - DNA, 17 bp, Homo sapiens
tcccacctccccttggg

SEQ ID NO: 6448017 - DNA, 15 bp, Homo sapiens
tcccacctccctgcc

SEQ ID NO: 6448018 - DNA, 19 bp, Homo sapiens
tcccacctccctgcccagg

SEQ ID NO: 6448019 - DNA, 14 bp, Homo sapiens
tcccacctcccttc

SEQ ID NO: 6448020 - DNA, 20 bp, Homo sapiens
tcccacctcctgacaccctt

SEQ ID NO: 6448021 - DNA, 21 bp, Homo sapiens
tcccacctcctgacacccttc

SEQ ID NO: 6448022 - DNA, 15 bp, Homo sapiens
tcccacctctccttt

SEQ ID NO: 6448023 - DNA, 23 bp, Homo sapiens
tcccacctctccttttgaggctt

SEQ ID NO: 6448024 - DNA, 13 bp, Homo sapiens
tcccacctctcta

SEQ ID NO: 6448025 - DNA, 22 bp, Homo sapiens
tcccacctctctcactccttga

SEQ ID NO: 6448026 - DNA, 14 bp, Homo sapiens
tcccacctctgagg

SEQ ID NO: 6448027 - DNA, 20 bp, Homo sapiens
tcccacctctgaggactctg

SEQ ID NO: 6448028 - DNA, 18 bp, Homo sapiens
tcccacctctgtgacctc

SEQ ID NO: 6448029 - DNA, 19 bp, Homo sapiens
tcccacctgcatctggggc

SEQ ID NO: 6448030 - DNA, 20 bp, Homo sapiens
tcccacctgcatctggggcc

SEQ ID NO: 6448031 - DNA, 15 bp, Homo sapiens
tcccacctggctccc

SEQ ID NO: 6448032 - DNA, 19 bp, Homo sapiens
tcccacctggctctgtggc

SEQ ID NO: 6448033 - DNA, 16 bp, Homo sapiens
tcccacctgtcaacct

SEQ ID NO: 6448034 - DNA, 13 bp, Homo sapiens
tcccaccttccca

SEQ ID NO: 6448035 - DNA, 14 bp, Homo sapiens
tcccaccttcccac

SEQ ID NO: 6448036 - DNA, 21 bp, Homo sapiens
tcccaccttcctcccacctca

SEQ ID NO: 6448037 - DNA, 16 bp, Homo sapiens
tcccaccttgccaaag

SEQ ID NO: 6448038 - DNA, 17 bp, Homo sapiens
tcccaccttggagcatt

SEQ ID NO: 6448039 - DNA, 16 bp, Homo sapiens
tcccaccttggctgca

SEQ ID NO: 6448040 - DNA, 20 bp, Homo sapiens
tcccacgaatttgctgggga

SEQ ID NO: 6448041 - DNA, 21 bp, Homo sapiens
tcccacgaatttgctggggaa

SEQ ID NO: 6448042 - DNA, 18 bp, Homo sapiens
tcccacgagggtgccgtg

SEQ ID NO: 6448043 - DNA, 15 bp, Homo sapiens
tcccacgccaggcca

SEQ ID NO: 6448044 - DNA, 21 bp, Homo sapiens
tcccacgcctcaccagccccc

SEQ ID NO: 6448045 - DNA, 14 bp, Homo sapiens
tcccacgcctgctt

SEQ ID NO: 6448046 - DNA, 23 bp, Homo sapiens
tcccacgcctgtcctcctggaag

SEQ ID NO: 6448047 - DNA, 18 bp, Homo sapiens
tcccacgcttctctttgg

SEQ ID NO: 6448048 - DNA, 14 bp, Homo sapiens
tcccacggccactg

SEQ ID NO: 6448049 - DNA, 15 bp, Homo sapiens
tcccacggccactgc

SEQ ID NO: 6448050 - DNA, 16 bp, Homo sapiens
tcccacggccactgca

SEQ ID NO: 6448051 - DNA, 19 bp, Homo sapiens
tcccacggccactgcagtc

SEQ ID NO: 6448052 - DNA, 22 bp, Homo sapiens
tcccacggctctgtgcccggtg

SEQ ID NO: 6448053 - DNA, 18 bp, Homo sapiens
tcccacgggacctggggc

SEQ ID NO: 6448054 - DNA, 16 bp, Homo sapiens
tcccacgtctggccag

SEQ ID NO: 6448055 - DNA, 17 bp, Homo sapiens
tcccacgtctggccagg

SEQ ID NO: 6448056 - DNA, 18 bp, Homo sapiens
tcccacgtgggcctccca

SEQ ID NO: 6448057 - DNA, 17 bp, Homo sapiens
tcccacgtgtcttccac

SEQ ID NO: 6448058 - DNA, 15 bp, Homo sapiens
tcccacgttctgtta

SEQ ID NO: 6448059 - DNA, 22 bp, Homo sapiens
tcccactaaaggggttccaaat

SEQ ID NO: 6448060 - DNA, 20 bp, Homo sapiens
tcccactaagctttctcctt

SEQ ID NO: 6448061 - DNA, 15 bp, Homo sapiens
tcccactatctgggt

SEQ ID NO: 6448062 - DNA, 13 bp, Homo sapiens
tcccactcacccc

SEQ ID NO: 6448063 - DNA, 17 bp, Homo sapiens
tcccactcagggctggg

SEQ ID NO: 6448064 - DNA, 14 bp, Homo sapiens
tcccactcagtcca

SEQ ID NO: 6448065 - DNA, 12 bp, Homo sapiens
tcccactccaag

SEQ ID NO: 6448066 - DNA, 13 bp, Homo sapiens
tcccactccaagc

SEQ ID NO: 6448067 - DNA, 14 bp, Homo sapiens
tcccactccaagcc

SEQ ID NO: 6448068 - DNA, 18 bp, Homo sapiens
tcccactccaagccagca

SEQ ID NO: 6448069 - DNA, 22 bp, Homo sapiens
tcccactccaagcccagcccat

SEQ ID NO: 6448070 - DNA, 15 bp, Homo sapiens
tcccactccagctga

SEQ ID NO: 6448071 - DNA, 11 bp, Homo sapiens
tcccactccca

SEQ ID NO: 6448072 - DNA, 13 bp, Homo sapiens
tcccactcccatc

SEQ ID NO: 6448073 - DNA, 16 bp, Homo sapiens
tcccactcccatctcc

SEQ ID NO: 6448074 - DNA, 17 bp, Homo sapiens
tcccactcccatctcct

SEQ ID NO: 6448075 - DNA, 14 bp, Homo sapiens
tcccactccctttg

SEQ ID NO: 6448076 - DNA, 15 bp, Homo sapiens
tcccactcctgctgc

SEQ ID NO: 6448077 - DNA, 22 bp, Homo sapiens
tcccactctagggcagtggagt

SEQ ID NO: 6448078 - DNA, 13 bp, Homo sapiens
tcccactctccta

SEQ ID NO: 6448079 - DNA, 16 bp, Homo sapiens
tcccactctcctaggc

SEQ ID NO: 6448080 - DNA, 13 bp, Homo sapiens
tcccactcttctc

SEQ ID NO: 6448081 - DNA, 15 bp, Homo sapiens
tcccactcttctcat

SEQ ID NO: 6448082 - DNA, 14 bp, Homo sapiens
tcccactcttgaag

SEQ ID NO: 6448083 - DNA, 15 bp, Homo sapiens
tcccactgagtctca

SEQ ID NO: 6448084 - DNA, 13 bp, Homo sapiens
tcccactgcaccc

SEQ ID NO: 6448085 - DNA, 18 bp, Homo sapiens
tcccactgcacccccctg

SEQ ID NO: 6448086 - DNA, 18 bp, Homo sapiens
tcccactgcaccccctcc

SEQ ID NO: 6448087 - DNA, 21 bp, Homo sapiens
tcccactgcaccccctcctgc

SEQ ID NO: 6448088 - DNA, 17 bp, Homo sapiens
tcccactgcactccagc

SEQ ID NO: 6448089 - DNA, 19 bp, Homo sapiens
tcccactgcactccagcct

SEQ ID NO: 6448090 - DNA, 12 bp, Homo sapiens
tcccactgccag

SEQ ID NO: 6448091 - DNA, 13 bp, Homo sapiens
tcccactgcccac

SEQ ID NO: 6448092 - DNA, 18 bp, Homo sapiens
tgaaatgtcagttctgat

SEQ ID NO: 6448093 - DNA, 17 bp, Homo sapiens
tgaaatgtcgatcaaga

SEQ ID NO: 6448094 - DNA, 18 bp, Homo sapiens
tgaaatgtcgatcaagag

SEQ ID NO: 6448095 - DNA, 23 bp, Homo sapiens
tgaaatgtcgatcaagagaatca

SEQ ID NO: 6448096 - DNA, 11 bp, Homo sapiens
tgaaatgtgaa

SEQ ID NO: 6448097 - DNA, 13 bp, Homo sapiens
tgaaatgtgaagg

SEQ ID NO: 6448098 - DNA, 17 bp, Homo sapiens
tgaaatgtggttttcct

SEQ ID NO: 6448099 - DNA, 16 bp, Homo sapiens
tgaaatgtgtgtgatg

SEQ ID NO: 6448100 - DNA, 17 bp, Homo sapiens
tgaaatgtgtgtgatgt

SEQ ID NO: 6448101 - DNA, 19 bp, Homo sapiens
tgaaatgtgtgtgatgtga

SEQ ID NO: 6448102 - DNA, 21 bp, Homo sapiens
tgaaatgtgtgtgatgtgaca

SEQ ID NO: 6448103 - DNA, 24 bp, Homo sapiens
tgaaatgtgtgtgatgtgacattt

SEQ ID NO: 6448104 - DNA, 19 bp, Homo sapiens
tgaaatgtgtttctgtata

SEQ ID NO: 6448105 - DNA, 13 bp, Homo sapiens
tgaaatgttacaa

SEQ ID NO: 6448106 - DNA, 20 bp, Homo sapiens
tgaaatgttacaaaaataaa

SEQ ID NO: 6448107 - DNA, 20 bp, Homo sapiens
tgaaatgtttaataaagctt

SEQ ID NO: 6448108 - DNA, 22 bp, Homo sapiens
tgaaatgtttactaagtggact

SEQ ID NO: 6448109 - DNA, 15 bp, Homo sapiens
tgaaatgtttcacta

SEQ ID NO: 6448110 - DNA, 16 bp, Homo sapiens
tgaaatgtttcactat

SEQ ID NO: 6448111 - DNA, 17 bp, Homo sapiens
tgaaatgtttccaggca

SEQ ID NO: 6448112 - DNA, 18 bp, Homo sapiens
tgaaatgtttccaggcat

SEQ ID NO: 6448113 - DNA, 18 bp, Homo sapiens
tgaaatgttttaaggctt

SEQ ID NO: 6448114 - DNA, 13 bp, Homo sapiens
tgaaattaaaaat

SEQ ID NO: 6448115 - DNA, 17 bp, Homo sapiens
tgaaattaaagaaatga

SEQ ID NO: 6448116 - DNA, 20 bp, Homo sapiens
tgaaattaacacaaaggaag

SEQ ID NO: 6448117 - DNA, 19 bp, Homo sapiens
tgaaattaagaaggcaaaa

SEQ ID NO: 6448118 - DNA, 23 bp, Homo sapiens
tgaaattaagaaggcaaaaatgt

SEQ ID NO: 6448119 - DNA, 13 bp, Homo sapiens
tgaaattaagcat

SEQ ID NO: 6448120 - DNA, 20 bp, Homo sapiens
tgaaattaatttgtgaattt

SEQ ID NO: 6448121 - DNA, 14 bp, Homo sapiens
tgaaattactgtgt

SEQ ID NO: 6448122 - DNA, 18 bp, Homo sapiens
tgaaattactgtgtaaat

SEQ ID NO: 6448123 - DNA, 15 bp, Homo sapiens
tgaaattaggaaagt

SEQ ID NO: 6448124 - DNA, 23 bp, Homo sapiens
tgaaattagggcccaattaataa

SEQ ID NO: 6448125 - DNA, 23 bp, Homo sapiens
tgaaattagtagtgtgttgataa

SEQ ID NO: 6448126 - DNA, 14 bp, Homo sapiens
tgaaattagtattt

SEQ ID NO: 6448127 - DNA, 17 bp, Homo sapiens
tgaaattataactatta

SEQ ID NO: 6448128 - DNA, 19 bp, Homo sapiens
tgaaattatataaggcatt

SEQ ID NO: 6448129 - DNA, 15 bp, Homo sapiens
tgaaattatatctgt

SEQ ID NO: 6448130 - DNA, 13 bp, Homo sapiens
tgaaattatgtaa

SEQ ID NO: 6448131 - DNA, 19 bp, Homo sapiens
tgaaattatgtatgtttac

SEQ ID NO: 6448132 - DNA, 15 bp, Homo sapiens
tgaaattatgtcaaa

SEQ ID NO: 6448133 - DNA, 20 bp, Homo sapiens
tgaaattatgtcaaatggat

SEQ ID NO: 6448134 - DNA, 14 bp, Homo sapiens
tgaaattattttct

SEQ ID NO: 6448135 - DNA, 17 bp, Homo sapiens
tgaaattattttctcca

SEQ ID NO: 6448136 - DNA, 23 bp, Homo sapiens
tgaaattcaattcatagaataac

SEQ ID NO: 6448137 - DNA, 13 bp, Homo sapiens
tgaaattcacaga

SEQ ID NO: 6448138 - DNA, 16 bp, Homo sapiens
tgaaattcaccaagaa

SEQ ID NO: 6448139 - DNA, 23 bp, Homo sapiens
tgaaattcaggatgctgtgatac

SEQ ID NO: 6448140 - DNA, 16 bp, Homo sapiens
tgaaattccaaagtct

SEQ ID NO: 6448141 - DNA, 17 bp, Homo sapiens
tgaaattccagcaataa

SEQ ID NO: 6448142 - DNA, 22 bp, Homo sapiens
tgaaattccagcaataagaaat

SEQ ID NO: 6448143 - DNA, 23 bp, Homo sapiens
tgaaattccagcaataagaaatg

SEQ ID NO: 6448144 - DNA, 15 bp, Homo sapiens
tgaaattccagttta

SEQ ID NO: 6448145 - DNA, 19 bp, Homo sapiens
tgaaattccagtttaggag

SEQ ID NO: 6448146 - DNA, 16 bp, Homo sapiens
tgaaattccatttgta

SEQ ID NO: 6448147 - DNA, 14 bp, Homo sapiens
tgaaattcccccac

SEQ ID NO: 6448148 - DNA, 17 bp, Homo sapiens
tgaaattcccccacttg

SEQ ID NO: 6448149 - DNA, 14 bp, Homo sapiens
tgaaattcctcctt

SEQ ID NO: 6448150 - DNA, 19 bp, Homo sapiens
tgaaattcctctgtagaat

SEQ ID NO: 6448151 - DNA, 13 bp, Homo sapiens
tgaaattctaaat

SEQ ID NO: 6448152 - DNA, 13 bp, Homo sapiens
tgaaattctcaga

SEQ ID NO: 6448153 - DNA, 16 bp, Homo sapiens
tgaaattctcctggag

SEQ ID NO: 6448154 - DNA, 11 bp, Homo sapiens
tgaaattctga

SEQ ID NO: 6448155 - DNA, 12 bp, Homo sapiens
tgaaattctgaa

SEQ ID NO: 6448156 - DNA, 20 bp, Homo sapiens
tgaaattctgaatttgcaaa

SEQ ID NO: 6448157 - DNA, 17 bp, Homo sapiens
tgaaattcttatgttga

SEQ ID NO: 6448158 - DNA, 13 bp, Homo sapiens
tgaaattctttta

SEQ ID NO: 6448159 - DNA, 22 bp, Homo sapiens
tgaaattgaacctttgtgccct

SEQ ID NO: 6448160 - DNA, 19 bp, Homo sapiens
tgaaattgactgatgattt

SEQ ID NO: 6448161 - DNA, 22 bp, Homo sapiens
tgaaattgataatgctttcaca

SEQ ID NO: 6448162 - DNA, 17 bp, Homo sapiens
tgaaattggaaaggact

SEQ ID NO: 6448163 - DNA, 18 bp, Homo sapiens
tgaaattggaaaggactt

SEQ ID NO: 6448164 - DNA, 14 bp, Homo sapiens
tgaaattgtaatta

SEQ ID NO: 6448165 - DNA, 14 bp, Homo sapiens
tgaaattgtacata

SEQ ID NO: 6448166 - DNA, 23 bp, Homo sapiens
tgaaattgtacatatttgtggaa

SEQ ID NO: 6448167 - DNA, 15 bp, Homo sapiens
tgaaattgtattaca

SEQ ID NO: 6448168 - DNA, 14 bp, Homo sapiens
tgaaatttaaaaat

SEQ ID NO: 6448169 - DNA, 17 bp, Homo sapiens
tgaaatttaaaaataaa

SEQ ID NO: 6448170 - DNA, 15 bp, Homo sapiens
tgaaatttaaaaatc

SEQ ID NO: 6448171 - DNA, 19 bp, Homo sapiens
tgaaatttaaataatagac

SEQ ID NO: 6448172 - DNA, 11 bp, Homo sapiens
tgaaatttaag

SEQ ID NO: 6448173 - DNA, 16 bp, Homo sapiens
tgaaatttaattacaa

SEQ ID NO: 6448174 - DNA, 19 bp, Homo sapiens
tgaaatttaattacaaaca

SEQ ID NO: 6448175 - DNA, 13 bp, Homo sapiens
tgaaatttacaaa

SEQ ID NO: 6448176 - DNA, 14 bp, Homo sapiens
tgaaatttatgact

SEQ ID NO: 6448177 - DNA, 22 bp, Homo sapiens
tgaaatttattagttaatatat

SEQ ID NO: 6448178 - DNA, 21 bp, Homo sapiens
tgaaatttattcacatatatc

SEQ ID NO: 6448179 - DNA, 17 bp, Homo sapiens
tgaaatttattgaggaa

SEQ ID NO: 6448180 - DNA, 22 bp, Homo sapiens
tgaaatttattgaggaaaaata

SEQ ID NO: 6448181 - DNA, 21 bp, Homo sapiens
tgaaatttatttaatgtgagt

SEQ ID NO: 6448182 - DNA, 23 bp, Homo sapiens
tgaaatttcccacaccccagcgc

SEQ ID NO: 6448183 - DNA, 16 bp, Homo sapiens
tgaaatttctagcctg

SEQ ID NO: 6448184 - DNA, 21 bp, Homo sapiens
tgaaatttctagcctgcactt

SEQ ID NO: 6448185 - DNA, 14 bp, Homo sapiens
tgaaatttgaattt

SEQ ID NO: 6448186 - DNA, 18 bp, Homo sapiens
tgaaatttgataaactga

SEQ ID NO: 6448187 - DNA, 12 bp, Homo sapiens
tgaaatttgcaa

SEQ ID NO: 6448188 - DNA, 13 bp, Homo sapiens
tgaaatttgcaaa

SEQ ID NO: 6448189 - DNA, 16 bp, Homo sapiens
tgaaatttgcctctgt

SEQ ID NO: 6448190 - DNA, 17 bp, Homo sapiens
tgaaatttgcctctgtc

SEQ ID NO: 6448191 - DNA, 21 bp, Homo sapiens
tgaaatttgttatacttcaaa

SEQ ID NO: 6448192 - DNA, 13 bp, Homo sapiens
tgaaattttaaat

SEQ ID NO: 6448193 - DNA, 20 bp, Homo sapiens
tgaaattttaacctatgata

SEQ ID NO: 6448194 - DNA, 15 bp, Homo sapiens
tgaaattttaccaag

SEQ ID NO: 6448195 - DNA, 17 bp, Homo sapiens
tgaaattttaccaagtt

SEQ ID NO: 6448196 - DNA, 19 bp, Homo sapiens
tgaaattttaccaagttat

SEQ ID NO: 6448197 - DNA, 14 bp, Homo sapiens
tgaaattttagaaa

SEQ ID NO: 6448198 - DNA, 16 bp, Homo sapiens
tgaaattttatatgct

SEQ ID NO: 6448199 - DNA, 20 bp, Homo sapiens
tgaaattttatttattttaa

SEQ ID NO: 6448200 - DNA, 21 bp, Homo sapiens
tgaaattttatttattttaat

SEQ ID NO: 6448201 - DNA, 18 bp, Homo sapiens
tgaaattttcaggtagtc

SEQ ID NO: 6448202 - DNA, 12 bp, Homo sapiens
tgaaattttcta

SEQ ID NO: 6448203 - DNA, 20 bp, Homo sapiens
tgaaattttctagaatacta

SEQ ID NO: 6448204 - DNA, 20 bp, Homo sapiens
tgaaattttctagactttct

SEQ ID NO: 6448205 - DNA, 17 bp, Homo sapiens
tgaaattttctgtacag

SEQ ID NO: 6448206 - DNA, 22 bp, Homo sapiens
tgaaattttgcaaatataaaca

SEQ ID NO: 6448207 - DNA, 22 bp, Homo sapiens
tgaaatttttaaaaatacactt

SEQ ID NO: 6448208 - DNA, 16 bp, Homo sapiens
tgaaatttttaaatca

SEQ ID NO: 6448209 - DNA, 20 bp, Homo sapiens
tgaaatttttaaatcatttc

SEQ ID NO: 6448210 - DNA, 20 bp, Homo sapiens
tgaaatttttattaaattat

SEQ ID NO: 6448211 - DNA, 14 bp, Homo sapiens
tgaaatttttcata

SEQ ID NO: 6448212 - DNA, 18 bp, Homo sapiens
tgaaatttttcatatttt

SEQ ID NO: 6448213 - DNA, 16 bp, Homo sapiens
tgaaatttttgatgcc

SEQ ID NO: 6448214 - DNA, 20 bp, Homo sapiens
tgaaatttttggttataaat

SEQ ID NO: 6448215 - DNA, 23 bp, Homo sapiens
tgaaattttttttcatgctttat

SEQ ID NO: 6448216 - DNA, 18 bp, Homo sapiens
tgaacaaaaatgtttcca

SEQ ID NO: 6448217 - DNA, 21 bp, Homo sapiens
tgaacaaaaatgtttccactg

SEQ ID NO: 6448218 - DNA, 18 bp, Homo sapiens
tgaacaaaacctacacac

SEQ ID NO: 6448219 - DNA, 12 bp, Homo sapiens
tgaacaaaagct

SEQ ID NO: 6448220 - DNA, 14 bp, Homo sapiens
tgaacaaaagggtc

SEQ ID NO: 6448221 - DNA, 15 bp, Homo sapiens
tgaacaaaagggtca

SEQ ID NO: 6448222 - DNA, 14 bp, Homo sapiens
tgaacaaaatctgt

SEQ ID NO: 6448223 - DNA, 13 bp, Homo sapiens
tgaacaaaattat

SEQ ID NO: 6448224 - DNA, 17 bp, Homo sapiens
tgaacaaacctgtgatc

SEQ ID NO: 6448225 - DNA, 20 bp, Homo sapiens
tgaacaaagaaaaaaatata

SEQ ID NO: 6448226 - DNA, 15 bp, Homo sapiens
tgaacaaagacattt

SEQ ID NO: 6448227 - DNA, 17 bp, Homo sapiens
tgaacaaagcagccacg

SEQ ID NO: 6448228 - DNA, 20 bp, Homo sapiens
tgaacaaagctcaaagtatg

SEQ ID NO: 6448229 - DNA, 22 bp, Homo sapiens
tgaacaaagggattctccagga

SEQ ID NO: 6448230 - DNA, 16 bp, Homo sapiens
tgaacaaatatgcttt

SEQ ID NO: 6448231 - DNA, 20 bp, Homo sapiens
tgaacaaatcttgggtgggt

SEQ ID NO: 6448232 - DNA, 15 bp, Homo sapiens
tgaacaaattcttta

SEQ ID NO: 6448233 - DNA, 20 bp, Homo sapiens
tgaacaaatttacagagaca

SEQ ID NO: 6448234 - DNA, 17 bp, Homo sapiens
tgaacaaattttctggt

SEQ ID NO: 6448235 - DNA, 19 bp, Homo sapiens
tgaacaaccaaatgtgcat

SEQ ID NO: 6448236 - DNA, 21 bp, Homo sapiens
tgaacaacccaatctggctgg

SEQ ID NO: 6448237 - DNA, 22 bp, Homo sapiens
tgaacaacccaatctggctggt

SEQ ID NO: 6448238 - DNA, 14 bp, Homo sapiens
tgaacaactggaaa

SEQ ID NO: 6448239 - DNA, 13 bp, Homo sapiens
tgaacaagaaaga

SEQ ID NO: 6448240 - DNA, 11 bp, Homo sapiens
tgaacaagaat

SEQ ID NO: 6448241 - DNA, 12 bp, Homo sapiens
tgaacaagaatt

SEQ ID NO: 6448242 - DNA, 18 bp, Homo sapiens
tgaacaagaattggaagc

SEQ ID NO: 6448243 - DNA, 18 bp, Homo sapiens
tgaacaagagaagcattc

SEQ ID NO: 6448244 - DNA, 12 bp, Homo sapiens
tgaacaaggtaa

SEQ ID NO: 6448245 - DNA, 21 bp, Homo sapiens
tgaacaagttagtttctcata

SEQ ID NO: 6448246 - DNA, 20 bp, Homo sapiens
tgaacaagttgtttcattga

SEQ ID NO: 6448247 - DNA, 19 bp, Homo sapiens
tgaacaagttttaatgtat

SEQ ID NO: 6448248 - DNA, 16 bp, Homo sapiens
tgaacaatattttctc

SEQ ID NO: 6448249 - DNA, 19 bp, Homo sapiens
tgaacaatgtatacaatgc

SEQ ID NO: 6448250 - DNA, 21 bp, Homo sapiens
tgaacaattgtcgaaaagagt

SEQ ID NO: 6448251 - DNA, 19 bp, Homo sapiens
tgaacacaaactgtaaata

SEQ ID NO: 6448252 - DNA, 11 bp, Homo sapiens
tgaacacacac

SEQ ID NO: 6448253 - DNA, 22 bp, Homo sapiens
tgaacacacacgccagctcctc

SEQ ID NO: 6448254 - DNA, 23 bp, Homo sapiens
tgaacacacacgccagctcctct

SEQ ID NO: 6448255 - DNA, 21 bp, Homo sapiens
tgaacacacacgctccctgga

SEQ ID NO: 6448256 - DNA, 23 bp, Homo sapiens
tgaacacactgtgtcctggtgct

SEQ ID NO: 6448257 - DNA, 16 bp, Homo sapiens
tgaacacagctgctga

SEQ ID NO: 6448258 - DNA, 23 bp, Homo sapiens
tgaacacaggcaatgactgcgca

SEQ ID NO: 6448259 - DNA, 13 bp, Homo sapiens
tgaacacaggcag

SEQ ID NO: 6448260 - DNA, 23 bp, Homo sapiens
tgaacacaggcagctttctagaa

SEQ ID NO: 6448261 - DNA, 15 bp, Homo sapiens
tgaacacagtatttt

SEQ ID NO: 6448262 - DNA, 22 bp, Homo sapiens
tgaacacatctcttagtccctc

SEQ ID NO: 6448263 - DNA, 23 bp, Homo sapiens
tgaacacatctcttagtccctct

SEQ ID NO: 6448264 - DNA, 23 bp, Homo sapiens
tgaacaccaacttttatttggaa

SEQ ID NO: 6448265 - DNA, 16 bp, Homo sapiens
tgaacaccactttgtc

SEQ ID NO: 6448266 - DNA, 17 bp, Homo sapiens
tgaacaccattgaaggc

SEQ ID NO: 6448267 - DNA, 23 bp, Homo sapiens
tgaacactcatgcggcccagcca

SEQ ID NO: 6448268 - DNA, 18 bp, Homo sapiens
tgaacactcatgctgaaa

SEQ ID NO: 6448269 - DNA, 14 bp, Homo sapiens
tgaacactgcaccc

SEQ ID NO: 6448270 - DNA, 15 bp, Homo sapiens
tcccactgcccctgc

SEQ ID NO: 6448271 - DNA, 14 bp, Homo sapiens
tcccactggctcct

SEQ ID NO: 6448272 - DNA, 18 bp, Homo sapiens
tcccactggctcctccag

SEQ ID NO: 6448273 - DNA, 19 bp, Homo sapiens
tcccactggctcctcccag

SEQ ID NO: 6448274 - DNA, 21 bp, Homo sapiens
tcccactggctcctcccagca

SEQ ID NO: 6448275 - DNA, 14 bp, Homo sapiens
tcccactgggactc

SEQ ID NO: 6448276 - DNA, 22 bp, Homo sapiens
tcccactggggtccagggagca

SEQ ID NO: 6448277 - DNA, 15 bp, Homo sapiens
tcccactgtcctttc

SEQ ID NO: 6448278 - DNA, 22 bp, Homo sapiens
tcccacttagccgcaccctgca

SEQ ID NO: 6448279 - DNA, 18 bp, Homo sapiens
tcccacttatcaaatcat

SEQ ID NO: 6448280 - DNA, 21 bp, Homo sapiens
tcccacttcagcctcccaagc

SEQ ID NO: 6448281 - DNA, 18 bp, Homo sapiens
tcccacttccccatctgt

SEQ ID NO: 6448282 - DNA, 13 bp, Homo sapiens
tcccacttcctcc

SEQ ID NO: 6448283 - DNA, 16 bp, Homo sapiens
tcccacttcctcctac

SEQ ID NO: 6448284 - DNA, 22 bp, Homo sapiens
tcccacttcctcctacctgggg

SEQ ID NO: 6448285 - DNA, 14 bp, Homo sapiens
tcccacttctcatc

SEQ ID NO: 6448286 - DNA, 19 bp, Homo sapiens
tcccacttctcatcttaaa

SEQ ID NO: 6448287 - DNA, 22 bp, Homo sapiens
tcccacttgcaacttctttctg

SEQ ID NO: 6448288 - DNA, 23 bp, Homo sapiens
tcccacttgcagtcttgtagcta

SEQ ID NO: 6448289 - DNA, 21 bp, Homo sapiens
tcccacttggcatcagctggc

SEQ ID NO: 6448290 - DNA, 14 bp, Homo sapiens
tcccacttggccaa

SEQ ID NO: 6448291 - DNA, 23 bp, Homo sapiens
tcccacttggccaagcagggagg

SEQ ID NO: 6448292 - DNA, 13 bp, Homo sapiens
tcccactttcatt

SEQ ID NO: 6448293 - DNA, 16 bp, Homo sapiens
tcccactttctgttcc

SEQ ID NO: 6448294 - DNA, 21 bp, Homo sapiens
tcccactttctgttccttcct

SEQ ID NO: 6448295 - DNA, 12 bp, Homo sapiens
tcccactttctt

SEQ ID NO: 6448296 - DNA, 13 bp, Homo sapiens
tcccactttgggg

SEQ ID NO: 6448297 - DNA, 20 bp, Homo sapiens
tcccactttgtctgtacata

SEQ ID NO: 6448298 - DNA, 18 bp, Homo sapiens
tcccagaaaaactggctc

SEQ ID NO: 6448299 - DNA, 22 bp, Homo sapiens
tcccagaaaaactggctctgat

SEQ ID NO: 6448300 - DNA, 19 bp, Homo sapiens
tcccagaaaaagtaactca

SEQ ID NO: 6448301 - DNA, 23 bp, Homo sapiens
tcccagaaacatctctggcccag

SEQ ID NO: 6448302 - DNA, 16 bp, Homo sapiens
tcccagaaccacactg

SEQ ID NO: 6448303 - DNA, 17 bp, Homo sapiens
tcccagaaccacactgt

SEQ ID NO: 6448304 - DNA, 17 bp, Homo sapiens
tcccagaacctcagcat

SEQ ID NO: 6448305 - DNA, 22 bp, Homo sapiens
tcccagaacctctaagtgctgc

SEQ ID NO: 6448306 - DNA, 23 bp, Homo sapiens
tcccagaactttgggaggccaag

SEQ ID NO: 6448307 - DNA, 20 bp, Homo sapiens
tcccagaagatgaaaaaaat

SEQ ID NO: 6448308 - DNA, 17 bp, Homo sapiens
tcccagaagatgactga

SEQ ID NO: 6448309 - DNA, 20 bp, Homo sapiens
tcccagaagatgactgaggg

SEQ ID NO: 6448310 - DNA, 18 bp, Homo sapiens
tcccagaaggacctcctg

SEQ ID NO: 6448311 - DNA, 19 bp, Homo sapiens
tcccagaatcaaagcaatg

SEQ ID NO: 6448312 - DNA, 23 bp, Homo sapiens
tcccagaatcaaagcaatgcatt

SEQ ID NO: 6448313 - DNA, 17 bp, Homo sapiens
tcccagaatctctgagc

SEQ ID NO: 6448314 - DNA, 19 bp, Homo sapiens
tcccagaattttctggcct

SEQ ID NO: 6448315 - DNA, 20 bp, Homo sapiens
tcccagacagcagtgtgagg

SEQ ID NO: 6448316 - DNA, 18 bp, Homo sapiens
tcccagacagctttttag

SEQ ID NO: 6448317 - DNA, 15 bp, Homo sapiens
tcccagacaggccct

SEQ ID NO: 6448318 - DNA, 22 bp, Homo sapiens
tcccagacagtggatatgaccc

SEQ ID NO: 6448319 - DNA, 17 bp, Homo sapiens
tcccagacatgctgccc

SEQ ID NO: 6448320 - DNA, 18 bp, Homo sapiens
tcccagacatgctgccca

SEQ ID NO: 6448321 - DNA, 19 bp, Homo sapiens
tcccagacatgctgcccac

SEQ ID NO: 6448322 - DNA, 13 bp, Homo sapiens
tcccagaccagcc

SEQ ID NO: 6448323 - DNA, 16 bp, Homo sapiens
tcccagaccaggaaag

SEQ ID NO: 6448324 - DNA, 15 bp, Homo sapiens
tcccagaccatggga

SEQ ID NO: 6448325 - DNA, 13 bp, Homo sapiens
tcccagaccccct

SEQ ID NO: 6448326 - DNA, 22 bp, Homo sapiens
tcccagacccccttgcccaggc

SEQ ID NO: 6448327 - DNA, 23 bp, Homo sapiens
tcccagacccccttgcccaggcc

SEQ ID NO: 6448328 - DNA, 18 bp, Homo sapiens
tcccagaccccgcagcac

SEQ ID NO: 6448329 - DNA, 21 bp, Homo sapiens
tcccagaccccgcagcacgcc

SEQ ID NO: 6448330 - DNA, 21 bp, Homo sapiens
tcccagaccttaagacactgt

SEQ ID NO: 6448331 - DNA, 16 bp, Homo sapiens
tcccagactactattt

SEQ ID NO: 6448332 - DNA, 23 bp, Homo sapiens
tcccagactactattttcttttt

SEQ ID NO: 6448333 - DNA, 12 bp, Homo sapiens
tcccagactaga

SEQ ID NO: 6448334 - DNA, 19 bp, Homo sapiens
tcccagactgacagactta

SEQ ID NO: 6448335 - DNA, 18 bp, Homo sapiens
tcccagacttgtttcctg

SEQ ID NO: 6448336 - DNA, 14 bp, Homo sapiens
tcccagagaacaat

SEQ ID NO: 6448337 - DNA, 16 bp, Homo sapiens
tcccagagacaggaaa

SEQ ID NO: 6448338 - DNA, 21 bp, Homo sapiens
tcccagagacccggggatgga

SEQ ID NO: 6448339 - DNA, 15 bp, Homo sapiens
tcccagagagcccga

SEQ ID NO: 6448340 - DNA, 15 bp, Homo sapiens
tcccagagcacctca

SEQ ID NO: 6448341 - DNA, 15 bp, Homo sapiens
tcccagagcacctgc

SEQ ID NO: 6448342 - DNA, 12 bp, Homo sapiens
tcccagagcagg

SEQ ID NO: 6448343 - DNA, 22 bp, Homo sapiens
tcccagagctggtggacccagg

SEQ ID NO: 6448344 - DNA, 15 bp, Homo sapiens
tcccagagcttccca

SEQ ID NO: 6448345 - DNA, 18 bp, Homo sapiens
tcccagagcttcccagga

SEQ ID NO: 6448346 - DNA, 16 bp, Homo sapiens
tcccagaggagccacc

SEQ ID NO: 6448347 - DNA, 14 bp, Homo sapiens
tcccagaggcaggc

SEQ ID NO: 6448348 - DNA, 17 bp, Homo sapiens
tcccagaggccgctgcc

SEQ ID NO: 6448349 - DNA, 19 bp, Homo sapiens
tcccagaggccgctgcccc

SEQ ID NO: 6448350 - DNA, 22 bp, Homo sapiens
tcccagaggccgctgcccctga

SEQ ID NO: 6448351 - DNA, 16 bp, Homo sapiens
tcccagagggagcagg

SEQ ID NO: 6448352 - DNA, 22 bp, Homo sapiens
tcccagaggtccagcccatctc

SEQ ID NO: 6448353 - DNA, 23 bp, Homo sapiens
tcccagaggtccagcccatctcg

SEQ ID NO: 6448354 - DNA, 22 bp, Homo sapiens
tcccagaggtgggatcctccct

SEQ ID NO: 6448355 - DNA, 20 bp, Homo sapiens
tcccagagtcagaggagaag

SEQ ID NO: 6448356 - DNA, 20 bp, Homo sapiens
tcccagagtgctgggattac

SEQ ID NO: 6448357 - DNA, 11 bp, Homo sapiens
tcccagagtgg

SEQ ID NO: 6448358 - DNA, 18 bp, Homo sapiens
tcccagatacttgggggg

SEQ ID NO: 6448359 - DNA, 21 bp, Homo sapiens
tcccagatcaagcctgcctca

SEQ ID NO: 6448360 - DNA, 21 bp, Homo sapiens
tcccagatccaggaacacatg

SEQ ID NO: 6448361 - DNA, 16 bp, Homo sapiens
tcccagatcctctgct

SEQ ID NO: 6448362 - DNA, 13 bp, Homo sapiens
tcccagatcctgg

SEQ ID NO: 6448363 - DNA, 15 bp, Homo sapiens
tcccagatcctggaa

SEQ ID NO: 6448364 - DNA, 17 bp, Homo sapiens
tcccagatcggatctgt

SEQ ID NO: 6448365 - DNA, 16 bp, Homo sapiens
tcccagatcgtctcca

SEQ ID NO: 6448366 - DNA, 18 bp, Homo sapiens
tcccagatcgtctccaat

SEQ ID NO: 6448367 - DNA, 21 bp, Homo sapiens
tcccagatggcttcggagggc

SEQ ID NO: 6448368 - DNA, 22 bp, Homo sapiens
tcccagatggcttcggagggcc

SEQ ID NO: 6448369 - DNA, 14 bp, Homo sapiens
tcccagatgtaaag

SEQ ID NO: 6448370 - DNA, 16 bp, Homo sapiens
tcccagatgtaaagaa

SEQ ID NO: 6448371 - DNA, 20 bp, Homo sapiens
tcccagattggctcacactg

SEQ ID NO: 6448372 - DNA, 20 bp, Homo sapiens
tcccagatttttactttttc

SEQ ID NO: 6448373 - DNA, 17 bp, Homo sapiens
tcccagcacaggcacct

SEQ ID NO: 6448374 - DNA, 19 bp, Homo sapiens
tcccagcacctgccagggc

SEQ ID NO: 6448375 - DNA, 21 bp, Homo sapiens
tcccagcacctggcacaccag

SEQ ID NO: 6448376 - DNA, 15 bp, Homo sapiens
tcccagcactcccct

SEQ ID NO: 6448377 - DNA, 23 bp, Homo sapiens
tcccagcactccccttgccttcc

SEQ ID NO: 6448378 - DNA, 14 bp, Homo sapiens
tcccagcactgcct

SEQ ID NO: 6448379 - DNA, 17 bp, Homo sapiens
tcccagcactgcctcct

SEQ ID NO: 6448380 - DNA, 22 bp, Homo sapiens
tcccagcactttgggaggccta

SEQ ID NO: 6448381 - DNA, 22 bp, Homo sapiens
tcccagcactttgggaggctga

SEQ ID NO: 6448382 - DNA, 23 bp, Homo sapiens
tcccagcactttgggaggctgag

SEQ ID NO: 6448383 - DNA, 17 bp, Homo sapiens
tcccagcagaagaggga

SEQ ID NO: 6448384 - DNA, 21 bp, Homo sapiens
tcccagcagagcccaccagcc

SEQ ID NO: 6448385 - DNA, 20 bp, Homo sapiens
tcccagcagcagagaaccat

SEQ ID NO: 6448386 - DNA, 13 bp, Homo sapiens
tcccagcagccct

SEQ ID NO: 6448387 - DNA, 22 bp, Homo sapiens
tcccagcagctcaacctaccct

SEQ ID NO: 6448388 - DNA, 18 bp, Homo sapiens
tcccagcagggccactcc

SEQ ID NO: 6448389 - DNA, 15 bp, Homo sapiens
tcccagcatccctgg

SEQ ID NO: 6448390 - DNA, 23 bp, Homo sapiens
tcccagcatccctggagcaggag

SEQ ID NO: 6448391 - DNA, 11 bp, Homo sapiens
tcccagcatct

SEQ ID NO: 6448392 - DNA, 20 bp, Homo sapiens
tcccagcatgttgagaggct

SEQ ID NO: 6448393 - DNA, 14 bp, Homo sapiens
tcccagcatttgtc

SEQ ID NO: 6448394 - DNA, 22 bp, Homo sapiens
tcccagcattttgagaggctga

SEQ ID NO: 6448395 - DNA, 24 bp, Homo sapiens
tcccagccaccaccactgtcccta

SEQ ID NO: 6448396 - DNA, 14 bp, Homo sapiens
tcccagccacgcag

SEQ ID NO: 6448397 - DNA, 19 bp, Homo sapiens
tcccagccacgcagggcca

SEQ ID NO: 6448398 - DNA, 16 bp, Homo sapiens
tcccagccactcggga

SEQ ID NO: 6448399 - DNA, 20 bp, Homo sapiens
tcccagccactcgggaggct

SEQ ID NO: 6448400 - DNA, 18 bp, Homo sapiens
tcccagccagcagttcag

SEQ ID NO: 6448401 - DNA, 22 bp, Homo sapiens
tcccagccagcccgccgcccgc

SEQ ID NO: 6448402 - DNA, 23 bp, Homo sapiens
tcccagccagcccgccgcccgcc

SEQ ID NO: 6448403 - DNA, 15 bp, Homo sapiens
tcccagccaggccct

SEQ ID NO: 6448404 - DNA, 11 bp, Homo sapiens
tcccagcccaa

SEQ ID NO: 6448405 - DNA, 15 bp, Homo sapiens
tcccagcccaaagct

SEQ ID NO: 6448406 - DNA, 16 bp, Homo sapiens
tcccagcccaatccag

SEQ ID NO: 6448407 - DNA, 14 bp, Homo sapiens
tcccagcccaccct

SEQ ID NO: 6448408 - DNA, 22 bp, Homo sapiens
tcccagcccacctcaacccaga

SEQ ID NO: 6448409 - DNA, 23 bp, Homo sapiens
tcccagcccacctcaacccagag

SEQ ID NO: 6448410 - DNA, 19 bp, Homo sapiens
tcccagcccattgctgcca

SEQ ID NO: 6448411 - DNA, 14 bp, Homo sapiens
tcccagccccaggc

SEQ ID NO: 6448412 - DNA, 19 bp, Homo sapiens
tcccagccccaggcctggc

SEQ ID NO: 6448413 - DNA, 23 bp, Homo sapiens
tcccagccccggcaagccacagg

SEQ ID NO: 6448414 - DNA, 16 bp, Homo sapiens
tcccagcccctacctt

SEQ ID NO: 6448415 - DNA, 14 bp, Homo sapiens
tcccagcccctcct

SEQ ID NO: 6448416 - DNA, 17 bp, Homo sapiens
tcccagcccctcctccc

SEQ ID NO: 6448417 - DNA, 16 bp, Homo sapiens
tcccagcccctgcaga

SEQ ID NO: 6448418 - DNA, 19 bp, Homo sapiens
tcccagcccctgcccctca

SEQ ID NO: 6448419 - DNA, 19 bp, Homo sapiens
tcccagcccctggtactcc

SEQ ID NO: 6448420 - DNA, 23 bp, Homo sapiens
tcccagcccctggtactccccca

SEQ ID NO: 6448421 - DNA, 17 bp, Homo sapiens
tcccagccctatggatg

SEQ ID NO: 6448422 - DNA, 14 bp, Homo sapiens
tcccagccctcagc

SEQ ID NO: 6448423 - DNA, 14 bp, Homo sapiens
tcccagccctcatc

SEQ ID NO: 6448424 - DNA, 14 bp, Homo sapiens
tcccagccctgcca

SEQ ID NO: 6448425 - DNA, 14 bp, Homo sapiens
tcccagccctgggg

SEQ ID NO: 6448426 - DNA, 18 bp, Homo sapiens
tcccagccctttccaggg

SEQ ID NO: 6448427 - DNA, 22 bp, Homo sapiens
tcccagccctttgggaggctga

SEQ ID NO: 6448428 - DNA, 19 bp, Homo sapiens
tcccagccggccaatggaa

SEQ ID NO: 6448429 - DNA, 21 bp, Homo sapiens
tcccagccggccaatggaaac

SEQ ID NO: 6448430 - DNA, 22 bp, Homo sapiens
tcccagccggccaatggaaacc

SEQ ID NO: 6448431 - DNA, 13 bp, Homo sapiens
tcccagcctcaga

SEQ ID NO: 6448432 - DNA, 19 bp, Homo sapiens
tcccagcctcagaagcctt

SEQ ID NO: 6448433 - DNA, 20 bp, Homo sapiens
tcccagcctcagaagccttc

SEQ ID NO: 6448434 - DNA, 24 bp, Homo sapiens
tcccagcctcagaagccttcttgc

SEQ ID NO: 6448435 - DNA, 15 bp, Homo sapiens
tcccagcctcagcgc

SEQ ID NO: 6448436 - DNA, 18 bp, Homo sapiens
tcccagcctcttccattc

SEQ ID NO: 6448437 - DNA, 22 bp, Homo sapiens
tcccagcctcttccattccctt

SEQ ID NO: 6448438 - DNA, 22 bp, Homo sapiens
tcccagcctcttgctcagagct

SEQ ID NO: 6448439 - DNA, 19 bp, Homo sapiens
tcccagcctgccctccagc

SEQ ID NO: 6448440 - DNA, 22 bp, Homo sapiens
tcccagcctgccctccagctgc

SEQ ID NO: 6448441 - DNA, 23 bp, Homo sapiens
tcccagcctgccctccagctgct

SEQ ID NO: 6448442 - DNA, 14 bp, Homo sapiens
tcccagcctgggct

SEQ ID NO: 6448443 - DNA, 21 bp, Homo sapiens
tcccagcctgggctcctctgc

SEQ ID NO: 6448444 - DNA, 14 bp, Homo sapiens
tcccagcctggggc

SEQ ID NO: 6448445 - DNA, 15 bp, Homo sapiens
tgaacactgcaccct

SEQ ID NO: 6448446 - DNA, 16 bp, Homo sapiens
tgaacactgggggagg

SEQ ID NO: 6448447 - DNA, 17 bp, Homo sapiens
tgaacactgggggaggg

SEQ ID NO: 6448448 - DNA, 12 bp, Homo sapiens
tgaacactgtga

SEQ ID NO: 6448449 - DNA, 13 bp, Homo sapiens
tgaacactgtgac

SEQ ID NO: 6448450 - DNA, 16 bp, Homo sapiens
tgaacactgtgaccag

SEQ ID NO: 6448451 - DNA, 18 bp, Homo sapiens
tgaacacttagtgatcat

SEQ ID NO: 6448452 - DNA, 18 bp, Homo sapiens
tgaacacttattgctttg

SEQ ID NO: 6448453 - DNA, 19 bp, Homo sapiens
tgaacacttggtgctggga

SEQ ID NO: 6448454 - DNA, 20 bp, Homo sapiens
tgaacagaaaacattctgat

SEQ ID NO: 6448455 - DNA, 23 bp, Homo sapiens
tgaacagaactgccgtgggaatt

SEQ ID NO: 6448456 - DNA, 17 bp, Homo sapiens
tgaacagactgaccttg

SEQ ID NO: 6448457 - DNA, 13 bp, Homo sapiens
tgaacagagagaa

SEQ ID NO: 6448458 - DNA, 19 bp, Homo sapiens
tgaacagaggccacattac

SEQ ID NO: 6448459 - DNA, 20 bp, Homo sapiens
tgaacagagggagagactaa

SEQ ID NO: 6448460 - DNA, 17 bp, Homo sapiens
tgaacagatgtaaatcg

SEQ ID NO: 6448461 - DNA, 21 bp, Homo sapiens
tgaacagattgctacacacac

SEQ ID NO: 6448462 - DNA, 18 bp, Homo sapiens
tgaacagccaaaagctat

SEQ ID NO: 6448463 - DNA, 16 bp, Homo sapiens
tgaacagccctctctc

SEQ ID NO: 6448464 - DNA, 15 bp, Homo sapiens
tgaacagctctgaga

SEQ ID NO: 6448465 - DNA, 13 bp, Homo sapiens
tgaacagctggtg

SEQ ID NO: 6448466 - DNA, 12 bp, Homo sapiens
tgaacagctgtg

SEQ ID NO: 6448467 - DNA, 23 bp, Homo sapiens
tgaacagctgtgagccatgcctc

SEQ ID NO: 6448468 - DNA, 17 bp, Homo sapiens
tgaacagctgtgtctgc

SEQ ID NO: 6448469 - DNA, 20 bp, Homo sapiens
tgaacagctgtgtctgccaa

SEQ ID NO: 6448470 - DNA, 18 bp, Homo sapiens
tgaacagcttgccaggga

SEQ ID NO: 6448471 - DNA, 14 bp, Homo sapiens
tgaacagcttgctg

SEQ ID NO: 6448472 - DNA, 15 bp, Homo sapiens
tgaacagcttgctgt

SEQ ID NO: 6448473 - DNA, 22 bp, Homo sapiens
tgaacagctttgtatgtttatg

SEQ ID NO: 6448474 - DNA, 22 bp, Homo sapiens
tgaacaggaatccttactgata

SEQ ID NO: 6448475 - DNA, 20 bp, Homo sapiens
tgaacaggccgcacatctca

SEQ ID NO: 6448476 - DNA, 14 bp, Homo sapiens
tgaacagggcccag

SEQ ID NO: 6448477 - DNA, 15 bp, Homo sapiens
tgaacagggcccagg

SEQ ID NO: 6448478 - DNA, 16 bp, Homo sapiens
tgaacagggtccctgg

SEQ ID NO: 6448479 - DNA, 15 bp, Homo sapiens
tgaacagtacagtat

SEQ ID NO: 6448480 - DNA, 19 bp, Homo sapiens
tgaacagtgctctgcctct

SEQ ID NO: 6448481 - DNA, 18 bp, Homo sapiens
tgaacagttgctgttctt

SEQ ID NO: 6448482 - DNA, 19 bp, Homo sapiens
tgaacagttgctgttctta

SEQ ID NO: 6448483 - DNA, 24 bp, Homo sapiens
tgaacagttggctgtatgactgaa

SEQ ID NO: 6448484 - DNA, 21 bp, Homo sapiens
tgaacagtttggatgtcctca

SEQ ID NO: 6448485 - DNA, 23 bp, Homo sapiens
tgaacatacaaatgcatctttga

SEQ ID NO: 6448486 - DNA, 12 bp, Homo sapiens
tgaacatattca

SEQ ID NO: 6448487 - DNA, 16 bp, Homo sapiens
tgaacatcagaaggta

SEQ ID NO: 6448488 - DNA, 19 bp, Homo sapiens
tgaacatcagaaggtattt

SEQ ID NO: 6448489 - DNA, 16 bp, Homo sapiens
tgaacatccaagtctt

SEQ ID NO: 6448490 - DNA, 22 bp, Homo sapiens
tgaacatccaagtctttcttct

SEQ ID NO: 6448491 - DNA, 18 bp, Homo sapiens
tgaacatccttccttccc

SEQ ID NO: 6448492 - DNA, 20 bp, Homo sapiens
tgaacatccttccttcccac

SEQ ID NO: 6448493 - DNA, 15 bp, Homo sapiens
tgaacatctgtgtgt

SEQ ID NO: 6448494 - DNA, 15 bp, Homo sapiens
tgaacatgatagtta

SEQ ID NO: 6448495 - DNA, 19 bp, Homo sapiens
tgaacatgatagttaaact

SEQ ID NO: 6448496 - DNA, 18 bp, Homo sapiens
tgaacatgcctcctcctg

SEQ ID NO: 6448497 - DNA, 19 bp, Homo sapiens
tgaacatgcctcctcctgc

SEQ ID NO: 6448498 - DNA, 20 bp, Homo sapiens
tgaacatgcctcctcctgcc

SEQ ID NO: 6448499 - DNA, 15 bp, Homo sapiens
tgaacatgcctgcca

SEQ ID NO: 6448500 - DNA, 22 bp, Homo sapiens
tgaacatggagaggacttttgg

SEQ ID NO: 6448501 - DNA, 19 bp, Homo sapiens
tgaacatggtcagaacctt

SEQ ID NO: 6448502 - DNA, 20 bp, Homo sapiens
tgaacatgtgccttttctga

SEQ ID NO: 6448503 - DNA, 12 bp, Homo sapiens
tgaacatgttta

SEQ ID NO: 6448504 - DNA, 22 bp, Homo sapiens
tgaacattaatccacatgtttc

SEQ ID NO: 6448505 - DNA, 13 bp, Homo sapiens
tgaacattaatgt

SEQ ID NO: 6448506 - DNA, 16 bp, Homo sapiens
tgaacattaatgttga

SEQ ID NO: 6448507 - DNA, 18 bp, Homo sapiens
tgaacattaatgttgaaa

SEQ ID NO: 6448508 - DNA, 17 bp, Homo sapiens
tgaacattacattgcca

SEQ ID NO: 6448509 - DNA, 22 bp, Homo sapiens
tgaacattagttgcactaactg

SEQ ID NO: 6448510 - DNA, 23 bp, Homo sapiens
tgaacattattaaatcagaatct

SEQ ID NO: 6448511 - DNA, 19 bp, Homo sapiens
tgaacattctcctgtggaa

SEQ ID NO: 6448512 - DNA, 20 bp, Homo sapiens
tgaacatttagtaccctgca

SEQ ID NO: 6448513 - DNA, 15 bp, Homo sapiens
tgaacatttcaaatt

SEQ ID NO: 6448514 - DNA, 23 bp, Homo sapiens
tgaacatttctaactaaggacag

SEQ ID NO: 6448515 - DNA, 20 bp, Homo sapiens
tgaacatttgctttgttttc

SEQ ID NO: 6448516 - DNA, 22 bp, Homo sapiens
tgaacatttggaaaccatgcac

SEQ ID NO: 6448517 - DNA, 19 bp, Homo sapiens
tgaacatttgggtaaatca

SEQ ID NO: 6448518 - DNA, 11 bp, Homo sapiens
tgaacatttta

SEQ ID NO: 6448519 - DNA, 22 bp, Homo sapiens
tgaacattttgtggagtttgta

SEQ ID NO: 6448520 - DNA, 14 bp, Homo sapiens
tgaaccaaaacata

SEQ ID NO: 6448521 - DNA, 21 bp, Homo sapiens
tgaaccaaaacattccgttta

SEQ ID NO: 6448522 - DNA, 15 bp, Homo sapiens
tgaaccaaagcctct

SEQ ID NO: 6448523 - DNA, 11 bp, Homo sapiens
tgaaccaaatt

SEQ ID NO: 6448524 - DNA, 16 bp, Homo sapiens
tgaaccaacagaagca

SEQ ID NO: 6448525 - DNA, 16 bp, Homo sapiens
tgaaccaactgcctta

SEQ ID NO: 6448526 - DNA, 14 bp, Homo sapiens
tgaaccaagggatc

SEQ ID NO: 6448527 - DNA, 14 bp, Homo sapiens
tgaaccaatagaaa

SEQ ID NO: 6448528 - DNA, 19 bp, Homo sapiens
tgaaccaatagaaagcaaa

SEQ ID NO: 6448529 - DNA, 14 bp, Homo sapiens
tgaaccaatgcaag

SEQ ID NO: 6448530 - DNA, 14 bp, Homo sapiens
tgaaccacaacttt

SEQ ID NO: 6448531 - DNA, 23 bp, Homo sapiens
tgaaccacaagtgaatctttctc

SEQ ID NO: 6448532 - DNA, 14 bp, Homo sapiens
tgaaccacagaaat

SEQ ID NO: 6448533 - DNA, 13 bp, Homo sapiens
tgaaccacaggtt

SEQ ID NO: 6448534 - DNA, 14 bp, Homo sapiens
tgaaccacaggttt

SEQ ID NO: 6448535 - DNA, 15 bp, Homo sapiens
tgaaccacaggtttt

SEQ ID NO: 6448536 - DNA, 20 bp, Homo sapiens
tgaaccacatcttgctctgc

SEQ ID NO: 6448537 - DNA, 22 bp, Homo sapiens
tgaaccaccacacccagcccac

SEQ ID NO: 6448538 - DNA, 12 bp, Homo sapiens
tgaaccaccgcg

SEQ ID NO: 6448539 - DNA, 16 bp, Homo sapiens
tgaaccacgcgggggc

SEQ ID NO: 6448540 - DNA, 17 bp, Homo sapiens
tgaaccacgtgaaactg

SEQ ID NO: 6448541 - DNA, 19 bp, Homo sapiens
tgaaccactgcttctcttt

SEQ ID NO: 6448542 - DNA, 14 bp, Homo sapiens
tgaaccacttccct

SEQ ID NO: 6448543 - DNA, 23 bp, Homo sapiens
tgaaccacttccctcatctctcc

SEQ ID NO: 6448544 - DNA, 15 bp, Homo sapiens
tgaaccacttgtaga

SEQ ID NO: 6448545 - DNA, 16 bp, Homo sapiens
tgaaccacttgtagat

SEQ ID NO: 6448546 - DNA, 21 bp, Homo sapiens
tgaaccacttgtagatttgat

SEQ ID NO: 6448547 - DNA, 20 bp, Homo sapiens
tgaaccagagggtgtggctt

SEQ ID NO: 6448548 - DNA, 13 bp, Homo sapiens
tgaaccagccacg

SEQ ID NO: 6448549 - DNA, 22 bp, Homo sapiens
tgaaccaggaatatttcctcca

SEQ ID NO: 6448550 - DNA, 21 bp, Homo sapiens
tgaaccaggccagagcaaaca

SEQ ID NO: 6448551 - DNA, 22 bp, Homo sapiens
tgaaccagtcctgctgcctgga

SEQ ID NO: 6448552 - DNA, 15 bp, Homo sapiens
tgaaccataaaatgt

SEQ ID NO: 6448553 - DNA, 15 bp, Homo sapiens
tgaaccatccttccc

SEQ ID NO: 6448554 - DNA, 14 bp, Homo sapiens
tgaacccacacctg

SEQ ID NO: 6448555 - DNA, 19 bp, Homo sapiens
tgaacccagaactaggagt

SEQ ID NO: 6448556 - DNA, 12 bp, Homo sapiens
tgaacccaggag

SEQ ID NO: 6448557 - DNA, 13 bp, Homo sapiens
tgaacccaggaga

SEQ ID NO: 6448558 - DNA, 21 bp, Homo sapiens
tgaacccaggagagtggaaga

SEQ ID NO: 6448559 - DNA, 17 bp, Homo sapiens
tgaacccaggaggtgga

SEQ ID NO: 6448560 - DNA, 19 bp, Homo sapiens
tgaacccaggaggtggagg

SEQ ID NO: 6448561 - DNA, 12 bp, Homo sapiens
tgaacccaggca

SEQ ID NO: 6448562 - DNA, 13 bp, Homo sapiens
tgaacccaggcag

SEQ ID NO: 6448563 - DNA, 18 bp, Homo sapiens
tgaacccaggcagctggc

SEQ ID NO: 6448564 - DNA, 14 bp, Homo sapiens
tgaacccatatttt

SEQ ID NO: 6448565 - DNA, 13 bp, Homo sapiens
tgaaccccagagg

SEQ ID NO: 6448566 - DNA, 20 bp, Homo sapiens
tgaaccccagaggcagaggt

SEQ ID NO: 6448567 - DNA, 16 bp, Homo sapiens
tgaaccccatgggctt

SEQ ID NO: 6448568 - DNA, 19 bp, Homo sapiens
tgaaccccatgggcttgga

SEQ ID NO: 6448569 - DNA, 21 bp, Homo sapiens
tgaaccccatgggcttggact

SEQ ID NO: 6448570 - DNA, 23 bp, Homo sapiens
tgaaccccccgcccatgctgtcc

SEQ ID NO: 6448571 - DNA, 13 bp, Homo sapiens
tgaacccccctcc

SEQ ID NO: 6448572 - DNA, 20 bp, Homo sapiens
tgaacccccgccatccttca

SEQ ID NO: 6448573 - DNA, 22 bp, Homo sapiens
tgaacccccgccatccttcacc

SEQ ID NO: 6448574 - DNA, 22 bp, Homo sapiens
tgaaccccctccctgtcccagg

SEQ ID NO: 6448575 - DNA, 17 bp, Homo sapiens
tgaacccctggccagct

SEQ ID NO: 6448576 - DNA, 20 bp, Homo sapiens
tgaacccctggccagctctg

SEQ ID NO: 6448577 - DNA, 23 bp, Homo sapiens
tgaacccctggccagctctgagg

SEQ ID NO: 6448578 - DNA, 14 bp, Homo sapiens
tgaacccctgtgtc

SEQ ID NO: 6448579 - DNA, 20 bp, Homo sapiens
tgaacccgggggacagaggt

SEQ ID NO: 6448580 - DNA, 14 bp, Homo sapiens
tgaaccctaataag

SEQ ID NO: 6448581 - DNA, 23 bp, Homo sapiens
tgaaccctaataagaccccactg

SEQ ID NO: 6448582 - DNA, 12 bp, Homo sapiens
tgaaccctcagc

SEQ ID NO: 6448583 - DNA, 13 bp, Homo sapiens
tgaaccctccaaa

SEQ ID NO: 6448584 - DNA, 14 bp, Homo sapiens
tgaaccctccaaag

SEQ ID NO: 6448585 - DNA, 14 bp, Homo sapiens
tgaaccctcctcct

SEQ ID NO: 6448586 - DNA, 15 bp, Homo sapiens
tgaaccctgccccac

SEQ ID NO: 6448587 - DNA, 13 bp, Homo sapiens
tgaacccttgctt

SEQ ID NO: 6448588 - DNA, 16 bp, Homo sapiens
tgaacccttgtgcttg

SEQ ID NO: 6448589 - DNA, 22 bp, Homo sapiens
tgaaccgacttttctaaagctc

SEQ ID NO: 6448590 - DNA, 22 bp, Homo sapiens
tgaaccgccggttcattttgca

SEQ ID NO: 6448591 - DNA, 17 bp, Homo sapiens
tgaaccggctcccaccc

SEQ ID NO: 6448592 - DNA, 22 bp, Homo sapiens
tgaaccgtcaatgtgaaataaa

SEQ ID NO: 6448593 - DNA, 14 bp, Homo sapiens
tgaaccgtgtgctc

SEQ ID NO: 6448594 - DNA, 23 bp, Homo sapiens
tgaacctattttcatttgtacaa

SEQ ID NO: 6448595 - DNA, 15 bp, Homo sapiens
tgaacctcagtttcc

SEQ ID NO: 6448596 - DNA, 18 bp, Homo sapiens
tgaacctcagtttcctca

SEQ ID NO: 6448597 - DNA, 18 bp, Homo sapiens
tgaacctgatgaaaataa

SEQ ID NO: 6448598 - DNA, 23 bp, Homo sapiens
tgaacctgatgaaaataaagaat

SEQ ID NO: 6448599 - DNA, 19 bp, Homo sapiens
tgaacctgatgagcaagaa

SEQ ID NO: 6448600 - DNA, 16 bp, Homo sapiens
tgaacctggaaatgat

SEQ ID NO: 6448601 - DNA, 19 bp, Homo sapiens
tgaacctggaaatgatgtt

SEQ ID NO: 6448602 - DNA, 12 bp, Homo sapiens
tgaacctggagg

SEQ ID NO: 6448603 - DNA, 18 bp, Homo sapiens
tgaacctgggaggcagag

SEQ ID NO: 6448604 - DNA, 17 bp, Homo sapiens
tgaacctgtctcctccc

SEQ ID NO: 6448605 - DNA, 23 bp, Homo sapiens
tgaacctgtgagtaaatattgag

SEQ ID NO: 6448606 - DNA, 14 bp, Homo sapiens
tgaacctgtgcaat

SEQ ID NO: 6448607 - DNA, 13 bp, Homo sapiens
tgaacctgtgctc

SEQ ID NO: 6448608 - DNA, 17 bp, Homo sapiens
tgaaccttgagcaaatt

SEQ ID NO: 6448609 - DNA, 22 bp, Homo sapiens
tgaaccttgctatcaagaaatg

SEQ ID NO: 6448610 - DNA, 18 bp, Homo sapiens
tgaacctttaaagtaaag

SEQ ID NO: 6448611 - DNA, 15 bp, Homo sapiens
tgaacctttcaaaat

SEQ ID NO: 6448612 - DNA, 16 bp, Homo sapiens
tgaacctttcaaaatg

SEQ ID NO: 6448613 - DNA, 20 bp, Homo sapiens
tgaacctttcaaaatggaaa

SEQ ID NO: 6448614 - DNA, 17 bp, Homo sapiens
tgaacgaccttacaaat

SEQ ID NO: 6448615 - DNA, 16 bp, Homo sapiens
tgaacgagcagcccag

SEQ ID NO: 6448616 - DNA, 17 bp, Homo sapiens
tgaacgagcagcccagg

SEQ ID NO: 6448617 - DNA, 21 bp, Homo sapiens
tgaacgagcagcccagggcct

SEQ ID NO: 6448618 - DNA, 21 bp, Homo sapiens
tgaacgcacaacatgcacatt

SEQ ID NO: 6448619 - DNA, 22 bp, Homo sapiens
tgaacgctgtgatgctgtgtgc

SEQ ID NO: 6448620 - DNA, 23 bp, Homo sapiens
tgaacgctgtgatgctgtgtgcc

SEQ ID NO: 6448621 - DNA, 13 bp, Homo sapiens
tgaacggccttgc

SEQ ID NO: 6448622 - DNA, 14 bp, Homo sapiens
tgaacggccttgct

SEQ ID NO: 6448623 - DNA, 15 bp, Homo sapiens
tcccagcctggggct

SEQ ID NO: 6448624 - DNA, 23 bp, Homo sapiens
tcccagcctggggctccctctct

SEQ ID NO: 6448625 - DNA, 14 bp, Homo sapiens
tcccagcctggggg

SEQ ID NO: 6448626 - DNA, 22 bp, Homo sapiens
tcccagcctgggggccagtggg

SEQ ID NO: 6448627 - DNA, 14 bp, Homo sapiens
tcccagcctgtggt

SEQ ID NO: 6448628 - DNA, 15 bp, Homo sapiens
tcccagcctgtggtt

SEQ ID NO: 6448629 - DNA, 14 bp, Homo sapiens
tcccagccttgaga

SEQ ID NO: 6448630 - DNA, 13 bp, Homo sapiens
tcccagccttggc

SEQ ID NO: 6448631 - DNA, 19 bp, Homo sapiens
tcccagcgagccacaggaa

SEQ ID NO: 6448632 - DNA, 14 bp, Homo sapiens
tcccagcgctgctg

SEQ ID NO: 6448633 - DNA, 16 bp, Homo sapiens
tcccagcggcctcagg

SEQ ID NO: 6448634 - DNA, 18 bp, Homo sapiens
tcccagcggctggtgcag

SEQ ID NO: 6448635 - DNA, 20 bp, Homo sapiens
tcccagcggttcctgtgcag

SEQ ID NO: 6448636 - DNA, 16 bp, Homo sapiens
tcccagcgtgtgtatc

SEQ ID NO: 6448637 - DNA, 16 bp, Homo sapiens
tcccagctacacctga

SEQ ID NO: 6448638 - DNA, 16 bp, Homo sapiens
tcccagctacaccttt

SEQ ID NO: 6448639 - DNA, 22 bp, Homo sapiens
tcccagctacaggggaggctga

SEQ ID NO: 6448640 - DNA, 18 bp, Homo sapiens
tcccagctacccaggagg

SEQ ID NO: 6448641 - DNA, 16 bp, Homo sapiens
tcccagctacctcaac

SEQ ID NO: 6448642 - DNA, 16 bp, Homo sapiens
tcccagctactaggga

SEQ ID NO: 6448643 - DNA, 22 bp, Homo sapiens
tcccagctactcaagaggctga

SEQ ID NO: 6448644 - DNA, 14 bp, Homo sapiens
tcccagctactcag

SEQ ID NO: 6448645 - DNA, 21 bp, Homo sapiens
tcccagctactcagaagcctg

SEQ ID NO: 6448646 - DNA, 16 bp, Homo sapiens
tcccagctactcggga

SEQ ID NO: 6448647 - DNA, 23 bp, Homo sapiens
tcccagctactggggaggctgag

SEQ ID NO: 6448648 - DNA, 18 bp, Homo sapiens
tcccagctacttgggagc

SEQ ID NO: 6448649 - DNA, 22 bp, Homo sapiens
tcccagctacttgggagcctga

SEQ ID NO: 6448650 - DNA, 19 bp, Homo sapiens
tcccagctacttgggaggc

SEQ ID NO: 6448651 - DNA, 20 bp, Homo sapiens
tcccagctagaattcactcc

SEQ ID NO: 6448652 - DNA, 16 bp, Homo sapiens
tcccagctattcagga

SEQ ID NO: 6448653 - DNA, 18 bp, Homo sapiens
tcccagctattcaggagg

SEQ ID NO: 6448654 - DNA, 17 bp, Homo sapiens
tcccagctcacgtcaca

SEQ ID NO: 6448655 - DNA, 15 bp, Homo sapiens
tcccagctcactgca

SEQ ID NO: 6448656 - DNA, 16 bp, Homo sapiens
tcccagctcactgcag

SEQ ID NO: 6448657 - DNA, 19 bp, Homo sapiens
tcccagctcactgcagcct

SEQ ID NO: 6448658 - DNA, 21 bp, Homo sapiens
tcccagctcactgcagcctcg

SEQ ID NO: 6448659 - DNA, 22 bp, Homo sapiens
tcccagctcactgcagcctcga

SEQ ID NO: 6448660 - DNA, 15 bp, Homo sapiens
tcccagctcagtgcc

SEQ ID NO: 6448661 - DNA, 14 bp, Homo sapiens
tcccagctccaccc

SEQ ID NO: 6448662 - DNA, 21 bp, Homo sapiens
tcccagctcctttctcctgtg

SEQ ID NO: 6448663 - DNA, 23 bp, Homo sapiens
tcccagctcctttctcctgtgaa

SEQ ID NO: 6448664 - DNA, 19 bp, Homo sapiens
tcccagctctaccctgcat

SEQ ID NO: 6448665 - DNA, 15 bp, Homo sapiens
tcccagctctagcct

SEQ ID NO: 6448666 - DNA, 16 bp, Homo sapiens
tcccagctctagcctc

SEQ ID NO: 6448667 - DNA, 18 bp, Homo sapiens
tcccagctctagcctctg

SEQ ID NO: 6448668 - DNA, 18 bp, Homo sapiens
tcccagctctccctctgg

SEQ ID NO: 6448669 - DNA, 13 bp, Homo sapiens
tcccagctctctc

SEQ ID NO: 6448670 - DNA, 18 bp, Homo sapiens
tcccagctctctctcctg

SEQ ID NO: 6448671 - DNA, 17 bp, Homo sapiens
tcccagctgaaatactg

SEQ ID NO: 6448672 - DNA, 15 bp, Homo sapiens
tcccagctgaaggca

SEQ ID NO: 6448673 - DNA, 20 bp, Homo sapiens
tcccagctgacagtcctctc

SEQ ID NO: 6448674 - DNA, 13 bp, Homo sapiens
tcccagctgcccc

SEQ ID NO: 6448675 - DNA, 14 bp, Homo sapiens
tcccagctgcccct

SEQ ID NO: 6448676 - DNA, 16 bp, Homo sapiens
tcccagctgctttact

SEQ ID NO: 6448677 - DNA, 20 bp, Homo sapiens
tcccagctgctttacttaaa

SEQ ID NO: 6448678 - DNA, 13 bp, Homo sapiens
tcccagctggcag

SEQ ID NO: 6448679 - DNA, 17 bp, Homo sapiens
tcccagctggcagcgcc

SEQ ID NO: 6448680 - DNA, 18 bp, Homo sapiens
tcccagctgtaccggcca

SEQ ID NO: 6448681 - DNA, 17 bp, Homo sapiens
tcccagctgtgctctgg

SEQ ID NO: 6448682 - DNA, 21 bp, Homo sapiens
tcccagctgtgctctggacag

SEQ ID NO: 6448683 - DNA, 16 bp, Homo sapiens
tcccagctgtgctgtg

SEQ ID NO: 6448684 - DNA, 19 bp, Homo sapiens
tcccagcttgtaggagctg

SEQ ID NO: 6448685 - DNA, 22 bp, Homo sapiens
tcccagctttgggcacatgtat

SEQ ID NO: 6448686 - DNA, 20 bp, Homo sapiens
tcccaggaaagaagcatttc

SEQ ID NO: 6448687 - DNA, 14 bp, Homo sapiens
tcccaggaagcagg

SEQ ID NO: 6448688 - DNA, 15 bp, Homo sapiens
tcccaggaagcaggg

SEQ ID NO: 6448689 - DNA, 13 bp, Homo sapiens
tcccaggaagccg

SEQ ID NO: 6448690 - DNA, 18 bp, Homo sapiens
tcccaggaatatccagtg

SEQ ID NO: 6448691 - DNA, 18 bp, Homo sapiens
tcccaggaatatcccaaa

SEQ ID NO: 6448692 - DNA, 17 bp, Homo sapiens
tcccaggacaagcacga

SEQ ID NO: 6448693 - DNA, 23 bp, Homo sapiens
tcccaggaccacaggctcaggca

SEQ ID NO: 6448694 - DNA, 11 bp, Homo sapiens
tcccaggaccc

SEQ ID NO: 6448695 - DNA, 17 bp, Homo sapiens
tcccaggaccctccact

SEQ ID NO: 6448696 - DNA, 19 bp, Homo sapiens
tcccaggaccctgaagggg

SEQ ID NO: 6448697 - DNA, 14 bp, Homo sapiens
tcccaggaccctgg

SEQ ID NO: 6448698 - DNA, 20 bp, Homo sapiens
tcccaggaccctgggtcacc

SEQ ID NO: 6448699 - DNA, 21 bp, Homo sapiens
tcccaggaccctgggtcacct

SEQ ID NO: 6448700 - DNA, 16 bp, Homo sapiens
tcccaggacctgagcc

SEQ ID NO: 6448701 - DNA, 21 bp, Homo sapiens
tcccaggacctggagacagga

SEQ ID NO: 6448702 - DNA, 18 bp, Homo sapiens
tcccaggacgcagggaga

SEQ ID NO: 6448703 - DNA, 23 bp, Homo sapiens
tcccaggacgcagggagaccctg

SEQ ID NO: 6448704 - DNA, 13 bp, Homo sapiens
tcccaggagaaag

SEQ ID NO: 6448705 - DNA, 19 bp, Homo sapiens
tcccaggagatgggtccag

SEQ ID NO: 6448706 - DNA, 21 bp, Homo sapiens
tcccaggagatgggtccaggg

SEQ ID NO: 6448707 - DNA, 13 bp, Homo sapiens
tcccaggagcctg

SEQ ID NO: 6448708 - DNA, 18 bp, Homo sapiens
tcccaggagctgcccaga

SEQ ID NO: 6448709 - DNA, 23 bp, Homo sapiens
tcccaggagctgcccagagttgc

SEQ ID NO: 6448710 - DNA, 21 bp, Homo sapiens
tcccaggaggggcctctgaaa

SEQ ID NO: 6448711 - DNA, 11 bp, Homo sapiens
tcccaggaggt

SEQ ID NO: 6448712 - DNA, 18 bp, Homo sapiens
tcccaggaggtgcagtgg

SEQ ID NO: 6448713 - DNA, 17 bp, Homo sapiens
tcccaggaggtgcttga

SEQ ID NO: 6448714 - DNA, 18 bp, Homo sapiens
tcccaggagttctgctca

SEQ ID NO: 6448715 - DNA, 17 bp, Homo sapiens
tcccaggatcagcagaa

SEQ ID NO: 6448716 - DNA, 17 bp, Homo sapiens
tcccaggatcccctgct

SEQ ID NO: 6448717 - DNA, 12 bp, Homo sapiens
tcccaggatctc

SEQ ID NO: 6448718 - DNA, 13 bp, Homo sapiens
tcccaggatctcc

SEQ ID NO: 6448719 - DNA, 18 bp, Homo sapiens
tcccaggatctgctccaa

SEQ ID NO: 6448720 - DNA, 16 bp, Homo sapiens
tcccaggatgtacaag

SEQ ID NO: 6448721 - DNA, 18 bp, Homo sapiens
tcccaggcactgtactaa

SEQ ID NO: 6448722 - DNA, 20 bp, Homo sapiens
tcccaggcagcgccactgtc

SEQ ID NO: 6448723 - DNA, 14 bp, Homo sapiens
tcccaggcagggag

SEQ ID NO: 6448724 - DNA, 18 bp, Homo sapiens
tcccaggcatgcagctgc

SEQ ID NO: 6448725 - DNA, 19 bp, Homo sapiens
tcccaggcatgcagctgcc

SEQ ID NO: 6448726 - DNA, 20 bp, Homo sapiens
tcccaggcatgcagctgcct

SEQ ID NO: 6448727 - DNA, 21 bp, Homo sapiens
tcccaggcatgcagctgcctg

SEQ ID NO: 6448728 - DNA, 18 bp, Homo sapiens
tcccaggcattccccagg

SEQ ID NO: 6448729 - DNA, 21 bp, Homo sapiens
tcccaggcattccccaggagg

SEQ ID NO: 6448730 - DNA, 24 bp, Homo sapiens
tcccaggcattccccaggaggcca

SEQ ID NO: 6448731 - DNA, 11 bp, Homo sapiens
tcccaggccag

SEQ ID NO: 6448732 - DNA, 14 bp, Homo sapiens
tcccaggccagggc

SEQ ID NO: 6448733 - DNA, 15 bp, Homo sapiens
tcccaggccagggct

SEQ ID NO: 6448734 - DNA, 16 bp, Homo sapiens
tcccaggccagggctg

SEQ ID NO: 6448735 - DNA, 17 bp, Homo sapiens
tcccaggccagggctgg

SEQ ID NO: 6448736 - DNA, 18 bp, Homo sapiens
tcccaggccagtaaggga

SEQ ID NO: 6448737 - DNA, 12 bp, Homo sapiens
tcccaggcccac

SEQ ID NO: 6448738 - DNA, 20 bp, Homo sapiens
tcccaggcccactgtgcctc

SEQ ID NO: 6448739 - DNA, 16 bp, Homo sapiens
tcccaggccccagggg

SEQ ID NO: 6448740 - DNA, 20 bp, Homo sapiens
tcccaggccccaggggagaa

SEQ ID NO: 6448741 - DNA, 21 bp, Homo sapiens
tcccaggcccctggaggctgc

SEQ ID NO: 6448742 - DNA, 17 bp, Homo sapiens
tcccaggccctttggct

SEQ ID NO: 6448743 - DNA, 23 bp, Homo sapiens
tcccaggccgcaccatttctgtc

SEQ ID NO: 6448744 - DNA, 20 bp, Homo sapiens
tcccaggccgcatggcccct

SEQ ID NO: 6448745 - DNA, 21 bp, Homo sapiens
tcccaggccgcatggcccctc

SEQ ID NO: 6448746 - DNA, 17 bp, Homo sapiens
tcccaggccggcccaga

SEQ ID NO: 6448747 - DNA, 19 bp, Homo sapiens
tcccaggccggcccagatg

SEQ ID NO: 6448748 - DNA, 17 bp, Homo sapiens
tcccaggcctctgcccc

SEQ ID NO: 6448749 - DNA, 17 bp, Homo sapiens
tcccaggcctgcctgca

SEQ ID NO: 6448750 - DNA, 12 bp, Homo sapiens
tcccaggccttt

SEQ ID NO: 6448751 - DNA, 21 bp, Homo sapiens
tcccaggctctcaacagggga

SEQ ID NO: 6448752 - DNA, 21 bp, Homo sapiens
tcccaggctgccggctcccct

SEQ ID NO: 6448753 - DNA, 23 bp, Homo sapiens
tcccaggctgccggctcccctcg

SEQ ID NO: 6448754 - DNA, 22 bp, Homo sapiens
tcccaggctgctggagtgcagt

SEQ ID NO: 6448755 - DNA, 11 bp, Homo sapiens
tcccaggctgg

SEQ ID NO: 6448756 - DNA, 12 bp, Homo sapiens
tcccaggctgga

SEQ ID NO: 6448757 - DNA, 16 bp, Homo sapiens
tcccaggctggagagc

SEQ ID NO: 6448758 - DNA, 23 bp, Homo sapiens
tcccaggctggagtgcagtgaca

SEQ ID NO: 6448759 - DNA, 20 bp, Homo sapiens
tcccaggctgggctctgcct

SEQ ID NO: 6448760 - DNA, 21 bp, Homo sapiens
tcccaggctgggctctgcctg

SEQ ID NO: 6448761 - DNA, 16 bp, Homo sapiens
tcccaggctggggctg

SEQ ID NO: 6448762 - DNA, 15 bp, Homo sapiens
tcccaggcttcaccc

SEQ ID NO: 6448763 - DNA, 14 bp, Homo sapiens
tcccagggaaggac

SEQ ID NO: 6448764 - DNA, 16 bp, Homo sapiens
tcccagggaaggactt

SEQ ID NO: 6448765 - DNA, 19 bp, Homo sapiens
tcccagggaccagcacctt

SEQ ID NO: 6448766 - DNA, 16 bp, Homo sapiens
tcccagggagcaaggg

SEQ ID NO: 6448767 - DNA, 12 bp, Homo sapiens
tcccagggagtg

SEQ ID NO: 6448768 - DNA, 15 bp, Homo sapiens
tcccagggagtgagc

SEQ ID NO: 6448769 - DNA, 21 bp, Homo sapiens
tcccagggagtgagcagctac

SEQ ID NO: 6448770 - DNA, 22 bp, Homo sapiens
tcccagggagtgagcagctact

SEQ ID NO: 6448771 - DNA, 21 bp, Homo sapiens
tcccagggcaaatgtttacat

SEQ ID NO: 6448772 - DNA, 19 bp, Homo sapiens
tcccagggcacccaggcag

SEQ ID NO: 6448773 - DNA, 20 bp, Homo sapiens
tcccagggccagggccctgc

SEQ ID NO: 6448774 - DNA, 21 bp, Homo sapiens
tcccagggccagggccctgca

SEQ ID NO: 6448775 - DNA, 11 bp, Homo sapiens
tcccagggccc

SEQ ID NO: 6448776 - DNA, 22 bp, Homo sapiens
tcccagggcccgagcgcgtgcc

SEQ ID NO: 6448777 - DNA, 23 bp, Homo sapiens
tcccagggcccgagcgcgtgcct

SEQ ID NO: 6448778 - DNA, 18 bp, Homo sapiens
tcccagggccctcccagc

SEQ ID NO: 6448779 - DNA, 14 bp, Homo sapiens
tcccagggccctgg

SEQ ID NO: 6448780 - DNA, 18 bp, Homo sapiens
tcccagggcctcctgggg

SEQ ID NO: 6448781 - DNA, 16 bp, Homo sapiens
tcccagggcctgtctc

SEQ ID NO: 6448782 - DNA, 22 bp, Homo sapiens
tcccagggctacacagaccctg

SEQ ID NO: 6448783 - DNA, 22 bp, Homo sapiens
tcccagggctactcactcaagt

SEQ ID NO: 6448784 - DNA, 19 bp, Homo sapiens
tcccagggctctctggacc

SEQ ID NO: 6448785 - DNA, 20 bp, Homo sapiens
tcccagggctctgcaggcca

SEQ ID NO: 6448786 - DNA, 13 bp, Homo sapiens
tcccagggctgca

SEQ ID NO: 6448787 - DNA, 16 bp, Homo sapiens
tcccagggctggccct

SEQ ID NO: 6448788 - DNA, 17 bp, Homo sapiens
tcccagggctggcccta

SEQ ID NO: 6448789 - DNA, 15 bp, Homo sapiens
tcccagggctggctc

SEQ ID NO: 6448790 - DNA, 20 bp, Homo sapiens
tcccagggctggctctgcac

SEQ ID NO: 6448791 - DNA, 21 bp, Homo sapiens
tcccagggctggctctgcact

SEQ ID NO: 6448792 - DNA, 23 bp, Homo sapiens
tcccagggctggctctgcactaa

SEQ ID NO: 6448793 - DNA, 17 bp, Homo sapiens
tcccaggggagccagct

SEQ ID NO: 6448794 - DNA, 19 bp, Homo sapiens
tcccaggggagccagctgc

SEQ ID NO: 6448795 - DNA, 21 bp, Homo sapiens
tcccaggggcccaaggcggcc

SEQ ID NO: 6448796 - DNA, 22 bp, Homo sapiens
tcccaggggcccaaggcggccc

SEQ ID NO: 6448797 - DNA, 19 bp, Homo sapiens
tcccaggggctccacctgt

SEQ ID NO: 6448798 - DNA, 18 bp, Homo sapiens
tcccaggggctggcttca

SEQ ID NO: 6448799 - DNA, 18 bp, Homo sapiens
tcccaggggtctccctga

SEQ ID NO: 6448800 - DNA, 15 bp, Homo sapiens
tgaacggtgagcatt

SEQ ID NO: 6448801 - DNA, 18 bp, Homo sapiens
tgaacgtgccagcagccc

SEQ ID NO: 6448802 - DNA, 14 bp, Homo sapiens
tgaacgtgcttctt

SEQ ID NO: 6448803 - DNA, 15 bp, Homo sapiens
tgaacgtgcttcttt

SEQ ID NO: 6448804 - DNA, 17 bp, Homo sapiens
tgaacgtgcttctttgt

SEQ ID NO: 6448805 - DNA, 14 bp, Homo sapiens
tgaacgtggattgt

SEQ ID NO: 6448806 - DNA, 23 bp, Homo sapiens
tgaacgtggcccgcatgtgcatt

SEQ ID NO: 6448807 - DNA, 22 bp, Homo sapiens
tgaacgttctcaaaccctgttt

SEQ ID NO: 6448808 - DNA, 15 bp, Homo sapiens
tgaacgttttctaat

SEQ ID NO: 6448809 - DNA, 16 bp, Homo sapiens
tgaacgttttctaatt

SEQ ID NO: 6448810 - DNA, 19 bp, Homo sapiens
tgaacgttttctaattgct

SEQ ID NO: 6448811 - DNA, 19 bp, Homo sapiens
tgaactaaaaagagactgt

SEQ ID NO: 6448812 - DNA, 23 bp, Homo sapiens
tgaactaaaaagagactgtgcca

SEQ ID NO: 6448813 - DNA, 19 bp, Homo sapiens
tgaactaaactttcacacc

SEQ ID NO: 6448814 - DNA, 21 bp, Homo sapiens
tgaactaaagtgctgcactca

SEQ ID NO: 6448815 - DNA, 18 bp, Homo sapiens
tgaactaagaaacttttg

SEQ ID NO: 6448816 - DNA, 17 bp, Homo sapiens
tgaactaagttattgct

SEQ ID NO: 6448817 - DNA, 17 bp, Homo sapiens
tgaactaagttattgtt

SEQ ID NO: 6448818 - DNA, 16 bp, Homo sapiens
tgaactaagttttgtg

SEQ ID NO: 6448819 - DNA, 21 bp, Homo sapiens
tgaactacgcttgctcatttt

SEQ ID NO: 6448820 - DNA, 23 bp, Homo sapiens
tgaactagagactctgtgatcta

SEQ ID NO: 6448821 - DNA, 21 bp, Homo sapiens
tgaactatatccttcctagtg

SEQ ID NO: 6448822 - DNA, 21 bp, Homo sapiens
tgaactatcagggcaagctca

SEQ ID NO: 6448823 - DNA, 21 bp, Homo sapiens
tgaactatggacggtgctcca

SEQ ID NO: 6448824 - DNA, 21 bp, Homo sapiens
tgaactatgtcgatgcacagt

SEQ ID NO: 6448825 - DNA, 18 bp, Homo sapiens
tgaactattttaaataaa

SEQ ID NO: 6448826 - DNA, 24 bp, Homo sapiens
tgaactattttgaagaaaacacaa

SEQ ID NO: 6448827 - DNA, 14 bp, Homo sapiens
tgaactcaaactga

SEQ ID NO: 6448828 - DNA, 15 bp, Homo sapiens
tgaactcaagctgcg

SEQ ID NO: 6448829 - DNA, 18 bp, Homo sapiens
tgaactcaagctgcgttt

SEQ ID NO: 6448830 - DNA, 15 bp, Homo sapiens
tgaactcaccctggg

SEQ ID NO: 6448831 - DNA, 19 bp, Homo sapiens
tgaactcaccctgggagcc

SEQ ID NO: 6448832 - DNA, 18 bp, Homo sapiens
tgaactcagatctgtctg

SEQ ID NO: 6448833 - DNA, 20 bp, Homo sapiens
tgaactcagcacattcggga

SEQ ID NO: 6448834 - DNA, 17 bp, Homo sapiens
tgaactcagccaagcac

SEQ ID NO: 6448835 - DNA, 18 bp, Homo sapiens
tgaactcagccaagcaca

SEQ ID NO: 6448836 - DNA, 21 bp, Homo sapiens
tgaactcagccaagcacagtg

SEQ ID NO: 6448837 - DNA, 22 bp, Homo sapiens
tgaactcagccaagcacagtgg

SEQ ID NO: 6448838 - DNA, 23 bp, Homo sapiens
tgaactcagccaagcacagtggt

SEQ ID NO: 6448839 - DNA, 17 bp, Homo sapiens
tgaactcattctcttct

SEQ ID NO: 6448840 - DNA, 11 bp, Homo sapiens
tgaactccagg

SEQ ID NO: 6448841 - DNA, 14 bp, Homo sapiens
tgaactccatcatt

SEQ ID NO: 6448842 - DNA, 23 bp, Homo sapiens
tgaactccatcattcatccagga

SEQ ID NO: 6448843 - DNA, 16 bp, Homo sapiens
tgaactcctcaagggc

SEQ ID NO: 6448844 - DNA, 17 bp, Homo sapiens
tgaactcctcaagggca

SEQ ID NO: 6448845 - DNA, 14 bp, Homo sapiens
tgaactcctgccat

SEQ ID NO: 6448846 - DNA, 16 bp, Homo sapiens
tgaactcctggcctca

SEQ ID NO: 6448847 - DNA, 17 bp, Homo sapiens
tgaactcctggcctcaa

SEQ ID NO: 6448848 - DNA, 21 bp, Homo sapiens
tgaactctacgccactccaca

SEQ ID NO: 6448849 - DNA, 16 bp, Homo sapiens
tgaactctattttgat

SEQ ID NO: 6448850 - DNA, 23 bp, Homo sapiens
tgaactctcaaaagtctattttt

SEQ ID NO: 6448851 - DNA, 18 bp, Homo sapiens
tgaactctcccctcccca

SEQ ID NO: 6448852 - DNA, 12 bp, Homo sapiens
tgaactctgaga

SEQ ID NO: 6448853 - DNA, 17 bp, Homo sapiens
tgaactctgcaactgaa

SEQ ID NO: 6448854 - DNA, 16 bp, Homo sapiens
tgaactctgggctcaa

SEQ ID NO: 6448855 - DNA, 19 bp, Homo sapiens
tgaactctggtgctcctgc

SEQ ID NO: 6448856 - DNA, 17 bp, Homo sapiens
tgaactctgttccccca

SEQ ID NO: 6448857 - DNA, 21 bp, Homo sapiens
tgaactcttaggcacatcaat

SEQ ID NO: 6448858 - DNA, 14 bp, Homo sapiens
tgaactcttcagaa

SEQ ID NO: 6448859 - DNA, 19 bp, Homo sapiens
tgaactcttctgcaaaaat

SEQ ID NO: 6448860 - DNA, 14 bp, Homo sapiens
tgaactcttggcct

SEQ ID NO: 6448861 - DNA, 17 bp, Homo sapiens
tgaactctttgaatgac

SEQ ID NO: 6448862 - DNA, 19 bp, Homo sapiens
tgaactgaaacttttctaa

SEQ ID NO: 6448863 - DNA, 20 bp, Homo sapiens
tgaactgaaacttttctaaa

SEQ ID NO: 6448864 - DNA, 12 bp, Homo sapiens
tgaactgaacac

SEQ ID NO: 6448865 - DNA, 13 bp, Homo sapiens
tgaactgaacacc

SEQ ID NO: 6448866 - DNA, 14 bp, Homo sapiens
tgaactgaagcaga

SEQ ID NO: 6448867 - DNA, 11 bp, Homo sapiens
tgaactgaagg

SEQ ID NO: 6448868 - DNA, 15 bp, Homo sapiens
tgaactgaagtttca

SEQ ID NO: 6448869 - DNA, 23 bp, Homo sapiens
tgaactgacaggcagcctggaca

SEQ ID NO: 6448870 - DNA, 12 bp, Homo sapiens
tgaactgagaag

SEQ ID NO: 6448871 - DNA, 14 bp, Homo sapiens
tgaactgagcccca

SEQ ID NO: 6448872 - DNA, 15 bp, Homo sapiens
tgaactgagccccag

SEQ ID NO: 6448873 - DNA, 12 bp, Homo sapiens
tgaactgagccg

SEQ ID NO: 6448874 - DNA, 12 bp, Homo sapiens
tgaactgagctt

SEQ ID NO: 6448875 - DNA, 15 bp, Homo sapiens
tgaactgagcttgga

SEQ ID NO: 6448876 - DNA, 12 bp, Homo sapiens
tgaactgaggcc

SEQ ID NO: 6448877 - DNA, 16 bp, Homo sapiens
tgaactgaggccttgt

SEQ ID NO: 6448878 - DNA, 13 bp, Homo sapiens
tgaactgataaag

SEQ ID NO: 6448879 - DNA, 15 bp, Homo sapiens
tgaactgataatttt

SEQ ID NO: 6448880 - DNA, 19 bp, Homo sapiens
tgaactgatagttactgtt

SEQ ID NO: 6448881 - DNA, 20 bp, Homo sapiens
tgaactgattcacatctcat

SEQ ID NO: 6448882 - DNA, 14 bp, Homo sapiens
tgaactgattttta

SEQ ID NO: 6448883 - DNA, 14 bp, Homo sapiens
tgaactgcaaagct

SEQ ID NO: 6448884 - DNA, 13 bp, Homo sapiens
tgaactgcatcaa

SEQ ID NO: 6448885 - DNA, 21 bp, Homo sapiens
tgaactgctgccaactccatg

SEQ ID NO: 6448886 - DNA, 16 bp, Homo sapiens
tgaactgctgctggtc

SEQ ID NO: 6448887 - DNA, 23 bp, Homo sapiens
tgaactgcttttaaaagtgcaca

SEQ ID NO: 6448888 - DNA, 17 bp, Homo sapiens
tgaactggaagaaagca

SEQ ID NO: 6448889 - DNA, 17 bp, Homo sapiens
tgaactggaccctgttg

SEQ ID NO: 6448890 - DNA, 18 bp, Homo sapiens
tgaactggaccctgttgc

SEQ ID NO: 6448891 - DNA, 19 bp, Homo sapiens
tgaactggaccctgttgct

SEQ ID NO: 6448892 - DNA, 15 bp, Homo sapiens
tgaactggagagctt

SEQ ID NO: 6448893 - DNA, 17 bp, Homo sapiens
tgaactggcaattgtct

SEQ ID NO: 6448894 - DNA, 21 bp, Homo sapiens
tgaactggcaattgtctattt

SEQ ID NO: 6448895 - DNA, 16 bp, Homo sapiens
tgaactggcttgtaca

SEQ ID NO: 6448896 - DNA, 19 bp, Homo sapiens
tgaactggcttgtacattt

SEQ ID NO: 6448897 - DNA, 11 bp, Homo sapiens
tgaactgggca

SEQ ID NO: 6448898 - DNA, 23 bp, Homo sapiens
tgaactgggcacagattgaagaa

SEQ ID NO: 6448899 - DNA, 15 bp, Homo sapiens
tgaactgggcatttc

SEQ ID NO: 6448900 - DNA, 23 bp, Homo sapiens
tgaactgggtacttgtggacaca

SEQ ID NO: 6448901 - DNA, 13 bp, Homo sapiens
tgaactgtaaact

SEQ ID NO: 6448902 - DNA, 12 bp, Homo sapiens
tgaactgtacta

SEQ ID NO: 6448903 - DNA, 22 bp, Homo sapiens
tgaactgtagagtcctatttca

SEQ ID NO: 6448904 - DNA, 14 bp, Homo sapiens
tgaactgtgacagg

SEQ ID NO: 6448905 - DNA, 16 bp, Homo sapiens
tgaactgtggccacct

SEQ ID NO: 6448906 - DNA, 22 bp, Homo sapiens
tgaactgtgtgtaattgttcct

SEQ ID NO: 6448907 - DNA, 16 bp, Homo sapiens
tgaactgttaagaaat

SEQ ID NO: 6448908 - DNA, 22 bp, Homo sapiens
tgaactgttacaacttgtattt

SEQ ID NO: 6448909 - DNA, 16 bp, Homo sapiens
tgaactgttagaatgt

SEQ ID NO: 6448910 - DNA, 17 bp, Homo sapiens
tgaactgttagatgctg

SEQ ID NO: 6448911 - DNA, 16 bp, Homo sapiens
tgaactgttgtctggg

SEQ ID NO: 6448912 - DNA, 18 bp, Homo sapiens
tgaacttaaatgcccccc

SEQ ID NO: 6448913 - DNA, 12 bp, Homo sapiens
tgaacttaacat

SEQ ID NO: 6448914 - DNA, 19 bp, Homo sapiens
tgaacttaacatgctgtgt

SEQ ID NO: 6448915 - DNA, 21 bp, Homo sapiens
tgaacttaacatgctgtgtaa

SEQ ID NO: 6448916 - DNA, 18 bp, Homo sapiens
tgaacttaataactgtgt

SEQ ID NO: 6448917 - DNA, 22 bp, Homo sapiens
tgaacttaataactgtgtactg

SEQ ID NO: 6448918 - DNA, 16 bp, Homo sapiens
tgaacttacacttgga

SEQ ID NO: 6448919 - DNA, 16 bp, Homo sapiens
tgaacttattctgtag

SEQ ID NO: 6448920 - DNA, 21 bp, Homo sapiens
tgaacttcaaaagctttttga

SEQ ID NO: 6448921 - DNA, 18 bp, Homo sapiens
tgaacttcagctagagct

SEQ ID NO: 6448922 - DNA, 21 bp, Homo sapiens
tgaacttccaagctccaaatc

SEQ ID NO: 6448923 - DNA, 20 bp, Homo sapiens
tgaacttccaggaaagtgtg

SEQ ID NO: 6448924 - DNA, 22 bp, Homo sapiens
tgaacttccatttgtattcaaa

SEQ ID NO: 6448925 - DNA, 22 bp, Homo sapiens
tgaacttcctgcaggtaaacag

SEQ ID NO: 6448926 - DNA, 14 bp, Homo sapiens
tgaacttcgcatca

SEQ ID NO: 6448927 - DNA, 18 bp, Homo sapiens
tgaacttcgcatcaaaag

SEQ ID NO: 6448928 - DNA, 19 bp, Homo sapiens
tgaacttcgcatcaaaaga

SEQ ID NO: 6448929 - DNA, 18 bp, Homo sapiens
tgaacttctctcagactt

SEQ ID NO: 6448930 - DNA, 20 bp, Homo sapiens
tgaacttgaaaaaaaaaaac

SEQ ID NO: 6448931 - DNA, 21 bp, Homo sapiens
tgaacttgaaatatcctgctt

SEQ ID NO: 6448932 - DNA, 16 bp, Homo sapiens
tgaacttgaagctaac

SEQ ID NO: 6448933 - DNA, 23 bp, Homo sapiens
tgaacttgagctctgtaacttac

SEQ ID NO: 6448934 - DNA, 16 bp, Homo sapiens
tgaacttgaggacaca

SEQ ID NO: 6448935 - DNA, 18 bp, Homo sapiens
tgaacttgaggacacatg

SEQ ID NO: 6448936 - DNA, 19 bp, Homo sapiens
tgaacttgaggacacatgt

SEQ ID NO: 6448937 - DNA, 20 bp, Homo sapiens
tgaacttgaggacacatgtc

SEQ ID NO: 6448938 - DNA, 21 bp, Homo sapiens
tgaacttgaggacacatgtcc

SEQ ID NO: 6448939 - DNA, 22 bp, Homo sapiens
tgaacttgaggacacatgtcca

SEQ ID NO: 6448940 - DNA, 20 bp, Homo sapiens
tgaacttgagtaaataacaa

SEQ ID NO: 6448941 - DNA, 19 bp, Homo sapiens
tgaacttgattgcctatgg

SEQ ID NO: 6448942 - DNA, 16 bp, Homo sapiens
tgaacttgcaggcaag

SEQ ID NO: 6448943 - DNA, 16 bp, Homo sapiens
tgaacttggaagcaca

SEQ ID NO: 6448944 - DNA, 23 bp, Homo sapiens
tgaacttggtagttcataaaggt

SEQ ID NO: 6448945 - DNA, 12 bp, Homo sapiens
tgaacttggttc

SEQ ID NO: 6448946 - DNA, 18 bp, Homo sapiens
tgaacttgtagctgtaaa

SEQ ID NO: 6448947 - DNA, 20 bp, Homo sapiens
tgaacttgttacttgcagca

SEQ ID NO: 6448948 - DNA, 21 bp, Homo sapiens
tgaactttcattggatttttg

SEQ ID NO: 6448949 - DNA, 13 bp, Homo sapiens
tgaactttcctgg

SEQ ID NO: 6448950 - DNA, 21 bp, Homo sapiens
tgaactttcctggatgtctga

SEQ ID NO: 6448951 - DNA, 13 bp, Homo sapiens
tgaactttctccc

SEQ ID NO: 6448952 - DNA, 21 bp, Homo sapiens
tgaactttctcttcatacttt

SEQ ID NO: 6448953 - DNA, 19 bp, Homo sapiens
tgaactttgacctctgcag

SEQ ID NO: 6448954 - DNA, 20 bp, Homo sapiens
tgaactttgacctctgcagc

SEQ ID NO: 6448955 - DNA, 22 bp, Homo sapiens
tgaactttgacctctgcagcaa

SEQ ID NO: 6448956 - DNA, 16 bp, Homo sapiens
tgaactttgctgagcc

SEQ ID NO: 6448957 - DNA, 12 bp, Homo sapiens
tgaactttggaa

SEQ ID NO: 6448958 - DNA, 19 bp, Homo sapiens
tgaactttgtcattatgat

SEQ ID NO: 6448959 - DNA, 13 bp, Homo sapiens
tgaactttgtgct

SEQ ID NO: 6448960 - DNA, 14 bp, Homo sapiens
tgaacttttacaga

SEQ ID NO: 6448961 - DNA, 15 bp, Homo sapiens
tgaacttttacagaa

SEQ ID NO: 6448962 - DNA, 16 bp, Homo sapiens
tgaacttttacagaat

SEQ ID NO: 6448963 - DNA, 14 bp, Homo sapiens
tgaacttttcaaaa

SEQ ID NO: 6448964 - DNA, 21 bp, Homo sapiens
tgaacttttcaaaataaagct

SEQ ID NO: 6448965 - DNA, 11 bp, Homo sapiens
tgaacttttct

SEQ ID NO: 6448966 - DNA, 22 bp, Homo sapiens
tgaacttttgtaatttgaattg

SEQ ID NO: 6448967 - DNA, 23 bp, Homo sapiens
tgaacttttgtaatttgaattgg

SEQ ID NO: 6448968 - DNA, 15 bp, Homo sapiens
tgaacttttgtactg

SEQ ID NO: 6448969 - DNA, 19 bp, Homo sapiens
tgaactttttaaagaagtg

SEQ ID NO: 6448970 - DNA, 16 bp, Homo sapiens
tgaactttttaacaaa

SEQ ID NO: 6448971 - DNA, 17 bp, Homo sapiens
tgaactttttattgatt

SEQ ID NO: 6448972 - DNA, 13 bp, Homo sapiens
tgaagaaaaaagc

SEQ ID NO: 6448973 - DNA, 18 bp, Homo sapiens
tgaagaaaaaatacattt

SEQ ID NO: 6448974 - DNA, 19 bp, Homo sapiens
tgaagaaaaaatacatttt

SEQ ID NO: 6448975 - DNA, 17 bp, Homo sapiens
tgaagaaaaaatggcaa

SEQ ID NO: 6448976 - DNA, 22 bp, Homo sapiens
tgaagaaaaaattttaaaaatc

SEQ ID NO: 6448977 - DNA, 15 bp, Homo sapiens
tgaagaaaaagtaca

SEQ ID NO: 6448978 - DNA, 23 bp, Homo sapiens
tcccaggggtctccctgagcctg

SEQ ID NO: 6448979 - DNA, 19 bp, Homo sapiens
tcccaggggtctccctggc

SEQ ID NO: 6448980 - DNA, 15 bp, Homo sapiens
tcccagggtcccacc

SEQ ID NO: 6448981 - DNA, 19 bp, Homo sapiens
tcccagggttttaactttg

SEQ ID NO: 6448982 - DNA, 20 bp, Homo sapiens
tcccagggttttaactttgt

SEQ ID NO: 6448983 - DNA, 17 bp, Homo sapiens
tcccaggtaatttaaat

SEQ ID NO: 6448984 - DNA, 19 bp, Homo sapiens
tcccaggtaccagctgcgc

SEQ ID NO: 6448985 - DNA, 21 bp, Homo sapiens
tcccaggtaccagctgcgctt

SEQ ID NO: 6448986 - DNA, 19 bp, Homo sapiens
tcccaggtgaggaatttga

SEQ ID NO: 6448987 - DNA, 20 bp, Homo sapiens
tcccaggtgaggaatttgaa

SEQ ID NO: 6448988 - DNA, 16 bp, Homo sapiens
tcccaggtgcatttct

SEQ ID NO: 6448989 - DNA, 23 bp, Homo sapiens
tcccaggtgcgtgtgtctctgtc

SEQ ID NO: 6448990 - DNA, 22 bp, Homo sapiens
tcccaggtgttaacattccaag

SEQ ID NO: 6448991 - DNA, 23 bp, Homo sapiens
tcccaggtgttaacattccaaga

SEQ ID NO: 6448992 - DNA, 20 bp, Homo sapiens
tcccaggttgacaccattct

SEQ ID NO: 6448993 - DNA, 23 bp, Homo sapiens
tcccaggttgaggtgcgctcacc

SEQ ID NO: 6448994 - DNA, 14 bp, Homo sapiens
tcccaggttggcct

SEQ ID NO: 6448995 - DNA, 21 bp, Homo sapiens
tcccaggttggctctgccagt

SEQ ID NO: 6448996 - DNA, 18 bp, Homo sapiens
tcccaggtttcttctctg

SEQ ID NO: 6448997 - DNA, 23 bp, Homo sapiens
tcccagtacctcctgtctctggc

SEQ ID NO: 6448998 - DNA, 15 bp, Homo sapiens
tcccagtagaaaata

SEQ ID NO: 6448999 - DNA, 16 bp, Homo sapiens
tcccagtagaaaatat

SEQ ID NO: 6449000 - DNA, 20 bp, Homo sapiens
tcccagtagccaaggcccgg

SEQ ID NO: 6449001 - DNA, 19 bp, Homo sapiens
tcccagtatgttttaacaa

SEQ ID NO: 6449002 - DNA, 12 bp, Homo sapiens
tcccagtatttt

SEQ ID NO: 6449003 - DNA, 15 bp, Homo sapiens
tcccagtatttttat

SEQ ID NO: 6449004 - DNA, 15 bp, Homo sapiens
tcccagtcagaaata

SEQ ID NO: 6449005 - DNA, 14 bp, Homo sapiens
tcccagtcatttaa

SEQ ID NO: 6449006 - DNA, 22 bp, Homo sapiens
tcccagtcatttaataaatgtg

SEQ ID NO: 6449007 - DNA, 23 bp, Homo sapiens
tcccagtccacctgaggaactgt

SEQ ID NO: 6449008 - DNA, 14 bp, Homo sapiens
tcccagtcccagcc

SEQ ID NO: 6449009 - DNA, 23 bp, Homo sapiens
tcccagtccccagcccttcacat

SEQ ID NO: 6449010 - DNA, 19 bp, Homo sapiens
tcccagtccctcgccgtcc

SEQ ID NO: 6449011 - DNA, 21 bp, Homo sapiens
tcccagtccggtgccttccac

SEQ ID NO: 6449012 - DNA, 14 bp, Homo sapiens
tcccagtcctgcct

SEQ ID NO: 6449013 - DNA, 18 bp, Homo sapiens
tcccagtctacccagaga

SEQ ID NO: 6449014 - DNA, 22 bp, Homo sapiens
tcccagtctacccagagaagcc

SEQ ID NO: 6449015 - DNA, 18 bp, Homo sapiens
tcccagtctcatctcctg

SEQ ID NO: 6449016 - DNA, 22 bp, Homo sapiens
tcccagtctcatctcctgaccc

SEQ ID NO: 6449017 - DNA, 18 bp, Homo sapiens
tcccagtgaactcctgcc

SEQ ID NO: 6449018 - DNA, 22 bp, Homo sapiens
tcccagtgacttaggaggctga

SEQ ID NO: 6449019 - DNA, 23 bp, Homo sapiens
tcccagtgacttaggaggctgag

SEQ ID NO: 6449020 - DNA, 13 bp, Homo sapiens
tcccagtgagcct

SEQ ID NO: 6449021 - DNA, 22 bp, Homo sapiens
tcccagtgagcctctgcgcctc

SEQ ID NO: 6449022 - DNA, 14 bp, Homo sapiens
tcccagtggcctca

SEQ ID NO: 6449023 - DNA, 18 bp, Homo sapiens
tcccagtggcctcaaccc

SEQ ID NO: 6449024 - DNA, 22 bp, Homo sapiens
tcccagtggcctcaaccctccc

SEQ ID NO: 6449025 - DNA, 20 bp, Homo sapiens
tcccagtggcctggcttgtc

SEQ ID NO: 6449026 - DNA, 15 bp, Homo sapiens
tcccagtggctgctg

SEQ ID NO: 6449027 - DNA, 21 bp, Homo sapiens
tcccagtggctgctgcccagg

SEQ ID NO: 6449028 - DNA, 23 bp, Homo sapiens
tcccagtggctgctgcccaggcc

SEQ ID NO: 6449029 - DNA, 23 bp, Homo sapiens
tcccagtgggaggggcaggctga

SEQ ID NO: 6449030 - DNA, 22 bp, Homo sapiens
tcccagtgggtgatgcttttgc

SEQ ID NO: 6449031 - DNA, 15 bp, Homo sapiens
tcccagtgtcagtat

SEQ ID NO: 6449032 - DNA, 14 bp, Homo sapiens
tcccagtgtctggc

SEQ ID NO: 6449033 - DNA, 19 bp, Homo sapiens
tcccagtgtcttcctgtgg

SEQ ID NO: 6449034 - DNA, 20 bp, Homo sapiens
tcccagtgtcttcctgtggg

SEQ ID NO: 6449035 - DNA, 15 bp, Homo sapiens
tcccagttaaagatt

SEQ ID NO: 6449036 - DNA, 20 bp, Homo sapiens
tcccagttcaggagtcccaa

SEQ ID NO: 6449037 - DNA, 23 bp, Homo sapiens
tcccagttcaggagtcccaagga

SEQ ID NO: 6449038 - DNA, 17 bp, Homo sapiens
tcccagttgctgtcaca

SEQ ID NO: 6449039 - DNA, 17 bp, Homo sapiens
tcccagtttctcagaag

SEQ ID NO: 6449040 - DNA, 15 bp, Homo sapiens
tcccagtttctgctg

SEQ ID NO: 6449041 - DNA, 16 bp, Homo sapiens
tcccagtttctgctgt

SEQ ID NO: 6449042 - DNA, 17 bp, Homo sapiens
tcccataacccctagtc

SEQ ID NO: 6449043 - DNA, 22 bp, Homo sapiens
tcccataagctaagccttatgt

SEQ ID NO: 6449044 - DNA, 15 bp, Homo sapiens
tcccataagctatag

SEQ ID NO: 6449045 - DNA, 23 bp, Homo sapiens
tcccataagggtagccccctcat

SEQ ID NO: 6449046 - DNA, 15 bp, Homo sapiens
tcccataataaagca

SEQ ID NO: 6449047 - DNA, 14 bp, Homo sapiens
tcccataccatcac

SEQ ID NO: 6449048 - DNA, 14 bp, Homo sapiens
tcccatagtgctgg

SEQ ID NO: 6449049 - DNA, 16 bp, Homo sapiens
tcccatatctccttta

SEQ ID NO: 6449050 - DNA, 15 bp, Homo sapiens
tcccatatgcctggg

SEQ ID NO: 6449051 - DNA, 21 bp, Homo sapiens
tcccatcaaagaaccttgaag

SEQ ID NO: 6449052 - DNA, 14 bp, Homo sapiens
tcccatcacccctt

SEQ ID NO: 6449053 - DNA, 18 bp, Homo sapiens
tcccatcaccccttcccc

SEQ ID NO: 6449054 - DNA, 20 bp, Homo sapiens
tcccatcaccccttccccat

SEQ ID NO: 6449055 - DNA, 15 bp, Homo sapiens
tcccatcacccgcta

SEQ ID NO: 6449056 - DNA, 16 bp, Homo sapiens
tcccatcactgctgtc

SEQ ID NO: 6449057 - DNA, 22 bp, Homo sapiens
tcccatcactggagcaccaggc

SEQ ID NO: 6449058 - DNA, 13 bp, Homo sapiens
tcccatccagggc

SEQ ID NO: 6449059 - DNA, 18 bp, Homo sapiens
tcccatccatcagctccc

SEQ ID NO: 6449060 - DNA, 16 bp, Homo sapiens
tcccatcccagctgaa

SEQ ID NO: 6449061 - DNA, 18 bp, Homo sapiens
tcccatcccatcccgctc

SEQ ID NO: 6449062 - DNA, 13 bp, Homo sapiens
tcccatccccctg

SEQ ID NO: 6449063 - DNA, 12 bp, Homo sapiens
tcccatccctgc

SEQ ID NO: 6449064 - DNA, 14 bp, Homo sapiens
tcccatcctaccct

SEQ ID NO: 6449065 - DNA, 20 bp, Homo sapiens
tcccatcctaccctcgggcc

SEQ ID NO: 6449066 - DNA, 17 bp, Homo sapiens
tcccatcctcacccaga

SEQ ID NO: 6449067 - DNA, 16 bp, Homo sapiens
tcccatcctccagccc

SEQ ID NO: 6449068 - DNA, 18 bp, Homo sapiens
tcccatcctcttctttta

SEQ ID NO: 6449069 - DNA, 15 bp, Homo sapiens
tcccatcctggggca

SEQ ID NO: 6449070 - DNA, 15 bp, Homo sapiens
tcccatcctgtgtgt

SEQ ID NO: 6449071 - DNA, 20 bp, Homo sapiens
tcccatctaagctgcagctt

SEQ ID NO: 6449072 - DNA, 13 bp, Homo sapiens
tcccatctcacac

SEQ ID NO: 6449073 - DNA, 23 bp, Homo sapiens
tcccatctcacacatgagcatca

SEQ ID NO: 6449074 - DNA, 18 bp, Homo sapiens
tcccatctcacctctagg

SEQ ID NO: 6449075 - DNA, 15 bp, Homo sapiens
tcccatctcagaaga

SEQ ID NO: 6449076 - DNA, 16 bp, Homo sapiens
tcccatctccactgtt

SEQ ID NO: 6449077 - DNA, 15 bp, Homo sapiens
tcccatctccaggga

SEQ ID NO: 6449078 - DNA, 22 bp, Homo sapiens
tcccatctccttacctctggaa

SEQ ID NO: 6449079 - DNA, 14 bp, Homo sapiens
tcccatctccttcc

SEQ ID NO: 6449080 - DNA, 15 bp, Homo sapiens
tcccatctccttccc

SEQ ID NO: 6449081 - DNA, 14 bp, Homo sapiens
tcccatctcttcct

SEQ ID NO: 6449082 - DNA, 15 bp, Homo sapiens
tcccatctcttcctt

SEQ ID NO: 6449083 - DNA, 20 bp, Homo sapiens
tcccatctgaaccactttgc

SEQ ID NO: 6449084 - DNA, 14 bp, Homo sapiens
tcccatctgaagag

SEQ ID NO: 6449085 - DNA, 14 bp, Homo sapiens
tcccatctgccctc

SEQ ID NO: 6449086 - DNA, 17 bp, Homo sapiens
tcccatctgctcctccc

SEQ ID NO: 6449087 - DNA, 14 bp, Homo sapiens
tcccatctggctca

SEQ ID NO: 6449088 - DNA, 14 bp, Homo sapiens
tcccatctggcttt

SEQ ID NO: 6449089 - DNA, 21 bp, Homo sapiens
tcccatctggctttttctgcc

SEQ ID NO: 6449090 - DNA, 13 bp, Homo sapiens
tcccatctgggag

SEQ ID NO: 6449091 - DNA, 21 bp, Homo sapiens
tcccatctgtgaaaggaaaga

SEQ ID NO: 6449092 - DNA, 15 bp, Homo sapiens
tcccatcttccaagg

SEQ ID NO: 6449093 - DNA, 20 bp, Homo sapiens
tcccatcttggcctcccaga

SEQ ID NO: 6449094 - DNA, 12 bp, Homo sapiens
tcccatgaagcc

SEQ ID NO: 6449095 - DNA, 17 bp, Homo sapiens
tcccatgacccacccct

SEQ ID NO: 6449096 - DNA, 22 bp, Homo sapiens
tcccatgacccacccctgtgct

SEQ ID NO: 6449097 - DNA, 24 bp, Homo sapiens
tcccatgacccacccctgtgctcc

SEQ ID NO: 6449098 - DNA, 14 bp, Homo sapiens
tcccatgacccagg

SEQ ID NO: 6449099 - DNA, 18 bp, Homo sapiens
tcccatgaccttgacgtg

SEQ ID NO: 6449100 - DNA, 14 bp, Homo sapiens
tcccatgactgcac

SEQ ID NO: 6449101 - DNA, 21 bp, Homo sapiens
tcccatgactgcccagctctg

SEQ ID NO: 6449102 - DNA, 21 bp, Homo sapiens
tcccatgagaccctggtgcct

SEQ ID NO: 6449103 - DNA, 22 bp, Homo sapiens
tcccatgagaccctggtgcctg

SEQ ID NO: 6449104 - DNA, 16 bp, Homo sapiens
tcccatgagcctcagc

SEQ ID NO: 6449105 - DNA, 15 bp, Homo sapiens
tcccatgaggtcttc

SEQ ID NO: 6449106 - DNA, 15 bp, Homo sapiens
tcccatgatccagaa

SEQ ID NO: 6449107 - DNA, 19 bp, Homo sapiens
tcccatgatccctgtgttg

SEQ ID NO: 6449108 - DNA, 18 bp, Homo sapiens
tcccatgatgccgctctt

SEQ ID NO: 6449109 - DNA, 23 bp, Homo sapiens
tcccatgatgccgctcttctgtc

SEQ ID NO: 6449110 - DNA, 16 bp, Homo sapiens
tcccatgatttcatgt

SEQ ID NO: 6449111 - DNA, 18 bp, Homo sapiens
tcccatgcaccaacccac

SEQ ID NO: 6449112 - DNA, 16 bp, Homo sapiens
tcccatgcaggccctt

SEQ ID NO: 6449113 - DNA, 18 bp, Homo sapiens
tcccatgcataacacact

SEQ ID NO: 6449114 - DNA, 13 bp, Homo sapiens
tcccatgcctggt

SEQ ID NO: 6449115 - DNA, 16 bp, Homo sapiens
tcccatgcctgtctct

SEQ ID NO: 6449116 - DNA, 12 bp, Homo sapiens
tcccatgctcca

SEQ ID NO: 6449117 - DNA, 12 bp, Homo sapiens
tcccatgctgaa

SEQ ID NO: 6449118 - DNA, 20 bp, Homo sapiens
tcccatggacactccagtgc

SEQ ID NO: 6449119 - DNA, 21 bp, Homo sapiens
tcccatggacactccagtgcc

SEQ ID NO: 6449120 - DNA, 17 bp, Homo sapiens
tcccatggagccccagc

SEQ ID NO: 6449121 - DNA, 19 bp, Homo sapiens
tcccatggagccccagccc

SEQ ID NO: 6449122 - DNA, 19 bp, Homo sapiens
tcccatggatgtttcttct

SEQ ID NO: 6449123 - DNA, 21 bp, Homo sapiens
tcccatggatgtttcttcttt

SEQ ID NO: 6449124 - DNA, 13 bp, Homo sapiens
tcccatggccttc

SEQ ID NO: 6449125 - DNA, 14 bp, Homo sapiens
tcccatggccttcc

SEQ ID NO: 6449126 - DNA, 15 bp, Homo sapiens
tcccatggccttccc

SEQ ID NO: 6449127 - DNA, 12 bp, Homo sapiens
tcccatggctga

SEQ ID NO: 6449128 - DNA, 15 bp, Homo sapiens
tcccatggctgaagc

SEQ ID NO: 6449129 - DNA, 17 bp, Homo sapiens
tcccatggctgaagctg

SEQ ID NO: 6449130 - DNA, 21 bp, Homo sapiens
tcccatggctgaagctggagc

SEQ ID NO: 6449131 - DNA, 23 bp, Homo sapiens
tcccatggctgaagctggagcag

SEQ ID NO: 6449132 - DNA, 16 bp, Homo sapiens
tcccatggctttgtgc

SEQ ID NO: 6449133 - DNA, 23 bp, Homo sapiens
tcccatgggcagaggaccaggct

SEQ ID NO: 6449134 - DNA, 23 bp, Homo sapiens
tcccatgggctctggccccaaga

SEQ ID NO: 6449135 - DNA, 12 bp, Homo sapiens
tcccatggggaa

SEQ ID NO: 6449136 - DNA, 22 bp, Homo sapiens
tcccatgggggcacttgagttt

SEQ ID NO: 6449137 - DNA, 17 bp, Homo sapiens
tcccatggtagactgtg

SEQ ID NO: 6449138 - DNA, 16 bp, Homo sapiens
tcccatggtccctagc

SEQ ID NO: 6449139 - DNA, 17 bp, Homo sapiens
tcccatggtccctagca

SEQ ID NO: 6449140 - DNA, 16 bp, Homo sapiens
tcccatggtggcctca

SEQ ID NO: 6449141 - DNA, 21 bp, Homo sapiens
tcccatggtgtatgtggtttt

SEQ ID NO: 6449142 - DNA, 16 bp, Homo sapiens
tcccatgtaacagaaa

SEQ ID NO: 6449143 - DNA, 17 bp, Homo sapiens
tcccatgtaacagaaag

SEQ ID NO: 6449144 - DNA, 19 bp, Homo sapiens
tcccatgtaacagaaaggg

SEQ ID NO: 6449145 - DNA, 12 bp, Homo sapiens
tcccatgtattt

SEQ ID NO: 6449146 - DNA, 22 bp, Homo sapiens
tcccatgtatttatctctattt

SEQ ID NO: 6449147 - DNA, 14 bp, Homo sapiens
tcccatgtatttgt

SEQ ID NO: 6449148 - DNA, 16 bp, Homo sapiens
tcccatgtcacctcag

SEQ ID NO: 6449149 - DNA, 21 bp, Homo sapiens
tcccatgtcccagcctggcct

SEQ ID NO: 6449150 - DNA, 20 bp, Homo sapiens
tcccatgtcccgtgtctcct

SEQ ID NO: 6449151 - DNA, 21 bp, Homo sapiens
tcccatgtgagtccctgtgat

SEQ ID NO: 6449152 - DNA, 13 bp, Homo sapiens
tcccatgtgcatg

SEQ ID NO: 6449153 - DNA, 21 bp, Homo sapiens
tcccatgtggcttgtttgcct

SEQ ID NO: 6449154 - DNA, 20 bp, Homo sapiens
tcccatgtgggatgagtttt

SEQ ID NO: 6449155 - DNA, 19 bp, Homo sapiens
tgaagaaaaggttcttctt

SEQ ID NO: 6449156 - DNA, 18 bp, Homo sapiens
tgaagaaaagtgggccag

SEQ ID NO: 6449157 - DNA, 19 bp, Homo sapiens
tgaagaaaatccttcagca

SEQ ID NO: 6449158 - DNA, 15 bp, Homo sapiens
tgaagaaaatgaagc

SEQ ID NO: 6449159 - DNA, 14 bp, Homo sapiens
tgaagaaaatgact

SEQ ID NO: 6449160 - DNA, 15 bp, Homo sapiens
tgaagaaacaaggca

SEQ ID NO: 6449161 - DNA, 17 bp, Homo sapiens
tgaagaaacacagcatg

SEQ ID NO: 6449162 - DNA, 18 bp, Homo sapiens
tgaagaaacacagcatgc

SEQ ID NO: 6449163 - DNA, 15 bp, Homo sapiens
tgaagaaagagaagt

SEQ ID NO: 6449164 - DNA, 17 bp, Homo sapiens
tgaagaaagtaaaacca

SEQ ID NO: 6449165 - DNA, 18 bp, Homo sapiens
tgaagaaagtaaaaccat

SEQ ID NO: 6449166 - DNA, 20 bp, Homo sapiens
tgaagaaagtcaaaaaatta

SEQ ID NO: 6449167 - DNA, 22 bp, Homo sapiens
tgaagaaagtcaaaaaattatt

SEQ ID NO: 6449168 - DNA, 22 bp, Homo sapiens
tgaagaaagtcagctcttgtca

SEQ ID NO: 6449169 - DNA, 15 bp, Homo sapiens
tgaagaaatacagct

SEQ ID NO: 6449170 - DNA, 18 bp, Homo sapiens
tgaagaaatactgcactt

SEQ ID NO: 6449171 - DNA, 19 bp, Homo sapiens
tgaagaaatactgcactta

SEQ ID NO: 6449172 - DNA, 20 bp, Homo sapiens
tgaagaaatactgcacttac

SEQ ID NO: 6449173 - DNA, 20 bp, Homo sapiens
tgaagaaattataaagataa

SEQ ID NO: 6449174 - DNA, 22 bp, Homo sapiens
tgaagaaatttatgaagcagat

SEQ ID NO: 6449175 - DNA, 19 bp, Homo sapiens
tgaagaactgaggaggaaa

SEQ ID NO: 6449176 - DNA, 13 bp, Homo sapiens
tgaagaactgcac

SEQ ID NO: 6449177 - DNA, 15 bp, Homo sapiens
tgaagaactgcactt

SEQ ID NO: 6449178 - DNA, 16 bp, Homo sapiens
tgaagaactgcacttt

SEQ ID NO: 6449179 - DNA, 18 bp, Homo sapiens
tgaagaactgcaggccct

SEQ ID NO: 6449180 - DNA, 22 bp, Homo sapiens
tgaagaactggcatcttaaatc

SEQ ID NO: 6449181 - DNA, 18 bp, Homo sapiens
tgaagaactgttgcctaa

SEQ ID NO: 6449182 - DNA, 19 bp, Homo sapiens
tgaagaagaaccagcccag

SEQ ID NO: 6449183 - DNA, 17 bp, Homo sapiens
tgaagaagagtttgcaa

SEQ ID NO: 6449184 - DNA, 20 bp, Homo sapiens
tgaagaagcaccaatcatga

SEQ ID NO: 6449185 - DNA, 18 bp, Homo sapiens
tgaagaagccctgttctc

SEQ ID NO: 6449186 - DNA, 19 bp, Homo sapiens
tgaagaagccctgttctcg

SEQ ID NO: 6449187 - DNA, 12 bp, Homo sapiens
tgaagaagcctg

SEQ ID NO: 6449188 - DNA, 14 bp, Homo sapiens
tgaagaagcctttg

SEQ ID NO: 6449189 - DNA, 12 bp, Homo sapiens
tgaagaaggaag

SEQ ID NO: 6449190 - DNA, 16 bp, Homo sapiens
tgaagaaggaagctgt

SEQ ID NO: 6449191 - DNA, 22 bp, Homo sapiens
tgaagaaggaagctgtgttgaa

SEQ ID NO: 6449192 - DNA, 13 bp, Homo sapiens
tgaagaaggaatc

SEQ ID NO: 6449193 - DNA, 14 bp, Homo sapiens
tgaagaaggcaagg

SEQ ID NO: 6449194 - DNA, 19 bp, Homo sapiens
tgaagaagggggtgggggg

SEQ ID NO: 6449195 - DNA, 11 bp, Homo sapiens
tgaagaaggtg

SEQ ID NO: 6449196 - DNA, 23 bp, Homo sapiens
tgaagaagtcactgaacaaaacc

SEQ ID NO: 6449197 - DNA, 13 bp, Homo sapiens
tgaagaagttaat

SEQ ID NO: 6449198 - DNA, 14 bp, Homo sapiens
tgaagaatacatca

SEQ ID NO: 6449199 - DNA, 16 bp, Homo sapiens
tgaagaatacttctca

SEQ ID NO: 6449200 - DNA, 21 bp, Homo sapiens
tgaagaatacttctcattttt

SEQ ID NO: 6449201 - DNA, 14 bp, Homo sapiens
tgaagaatatttaa

SEQ ID NO: 6449202 - DNA, 16 bp, Homo sapiens
tgaagaatatttaaga

SEQ ID NO: 6449203 - DNA, 23 bp, Homo sapiens
tgaagaatatttaagaaaagcac

SEQ ID NO: 6449204 - DNA, 18 bp, Homo sapiens
tgaagaatctgcccctgt

SEQ ID NO: 6449205 - DNA, 21 bp, Homo sapiens
tgaagaatctgtttcccagca

SEQ ID NO: 6449206 - DNA, 11 bp, Homo sapiens
tgaagaatctt

SEQ ID NO: 6449207 - DNA, 18 bp, Homo sapiens
tgaagaatgcattcaaaa

SEQ ID NO: 6449208 - DNA, 14 bp, Homo sapiens
tgaagaatgggaaa

SEQ ID NO: 6449209 - DNA, 13 bp, Homo sapiens
tgaagaatgttaa

SEQ ID NO: 6449210 - DNA, 11 bp, Homo sapiens
tgaagaattaa

SEQ ID NO: 6449211 - DNA, 17 bp, Homo sapiens
tgaagaattaagataca

SEQ ID NO: 6449212 - DNA, 16 bp, Homo sapiens
tgaagaattattcagt

SEQ ID NO: 6449213 - DNA, 23 bp, Homo sapiens
tgaagaattattcagtgaatttg

SEQ ID NO: 6449214 - DNA, 10 bp, Homo sapiens
tgaagaattg

SEQ ID NO: 6449215 - DNA, 13 bp, Homo sapiens
tgaagaattgaaa

SEQ ID NO: 6449216 - DNA, 19 bp, Homo sapiens
tgaagaattgccaatcttg

SEQ ID NO: 6449217 - DNA, 20 bp, Homo sapiens
tgaagaattgccaatcttgt

SEQ ID NO: 6449218 - DNA, 15 bp, Homo sapiens
tgaagaatttaaaga

SEQ ID NO: 6449219 - DNA, 18 bp, Homo sapiens
tgaagacaaaaatactct

SEQ ID NO: 6449220 - DNA, 20 bp, Homo sapiens
tgaagacaaaaatactctaa

SEQ ID NO: 6449221 - DNA, 22 bp, Homo sapiens
tgaagacaaaaatactctaatt

SEQ ID NO: 6449222 - DNA, 11 bp, Homo sapiens
tgaagacaatg

SEQ ID NO: 6449223 - DNA, 17 bp, Homo sapiens
tgaagacaatgacttac

SEQ ID NO: 6449224 - DNA, 21 bp, Homo sapiens
tgaagacaatgacttactgta

SEQ ID NO: 6449225 - DNA, 23 bp, Homo sapiens
tgaagacaatgacttactgtaca

SEQ ID NO: 6449226 - DNA, 12 bp, Homo sapiens
tgaagacaatta

SEQ ID NO: 6449227 - DNA, 22 bp, Homo sapiens
tgaagacacgcccgactctctc

SEQ ID NO: 6449228 - DNA, 21 bp, Homo sapiens
tgaagacactgtcaatgaggt

SEQ ID NO: 6449229 - DNA, 20 bp, Homo sapiens
tgaagacactgtgcaggccc

SEQ ID NO: 6449230 - DNA, 14 bp, Homo sapiens
tgaagacagaacca

SEQ ID NO: 6449231 - DNA, 16 bp, Homo sapiens
tgaagacagagctaca

SEQ ID NO: 6449232 - DNA, 14 bp, Homo sapiens
tgaagacagaggca

SEQ ID NO: 6449233 - DNA, 19 bp, Homo sapiens
tgaagacagaggcagagat

SEQ ID NO: 6449234 - DNA, 14 bp, Homo sapiens
tgaagacagaggga

SEQ ID NO: 6449235 - DNA, 14 bp, Homo sapiens
tgaagacaggacag

SEQ ID NO: 6449236 - DNA, 20 bp, Homo sapiens
tgaagacattttttgctata

SEQ ID NO: 6449237 - DNA, 21 bp, Homo sapiens
tgaagacattttttgctataa

SEQ ID NO: 6449238 - DNA, 19 bp, Homo sapiens
tgaagaccaatcaaatata

SEQ ID NO: 6449239 - DNA, 20 bp, Homo sapiens
tgaagaccacatccacacac

SEQ ID NO: 6449240 - DNA, 14 bp, Homo sapiens
tgaagaccagagca

SEQ ID NO: 6449241 - DNA, 18 bp, Homo sapiens
tgaagaccagagcagttt

SEQ ID NO: 6449242 - DNA, 13 bp, Homo sapiens
tgaagaccagctg

SEQ ID NO: 6449243 - DNA, 21 bp, Homo sapiens
tgaagaccagctgtgtttctt

SEQ ID NO: 6449244 - DNA, 14 bp, Homo sapiens
tgaagaccagcttt

SEQ ID NO: 6449245 - DNA, 14 bp, Homo sapiens
tgaagacccagaca

SEQ ID NO: 6449246 - DNA, 19 bp, Homo sapiens
tgaagacccagtgtaaaga

SEQ ID NO: 6449247 - DNA, 23 bp, Homo sapiens
tgaagacccagtgtaaagaataa

SEQ ID NO: 6449248 - DNA, 21 bp, Homo sapiens
tgaagaccccagatgtgaggg

SEQ ID NO: 6449249 - DNA, 16 bp, Homo sapiens
tgaagaccctatctcc

SEQ ID NO: 6449250 - DNA, 17 bp, Homo sapiens
tgaagaccctatctccc

SEQ ID NO: 6449251 - DNA, 15 bp, Homo sapiens
tgaagacctaaagtg

SEQ ID NO: 6449252 - DNA, 16 bp, Homo sapiens
tgaagacctaaatgac

SEQ ID NO: 6449253 - DNA, 21 bp, Homo sapiens
tgaagacctaaatgacctcag

SEQ ID NO: 6449254 - DNA, 22 bp, Homo sapiens
tgaagacctaaccagggccaga

SEQ ID NO: 6449255 - DNA, 21 bp, Homo sapiens
tgaagacctttattcacccct

SEQ ID NO: 6449256 - DNA, 15 bp, Homo sapiens
tgaagacctttttct

SEQ ID NO: 6449257 - DNA, 22 bp, Homo sapiens
tgaagacctttttctgcactat

SEQ ID NO: 6449258 - DNA, 23 bp, Homo sapiens
tgaagacctttttctgcactata

SEQ ID NO: 6449259 - DNA, 17 bp, Homo sapiens
tgaagacggaaaacaat

SEQ ID NO: 6449260 - DNA, 21 bp, Homo sapiens
tgaagacgtggactcctcttg

SEQ ID NO: 6449261 - DNA, 21 bp, Homo sapiens
tgaagactagccccttttctg

SEQ ID NO: 6449262 - DNA, 22 bp, Homo sapiens
tgaagactatctttgaagccag

SEQ ID NO: 6449263 - DNA, 15 bp, Homo sapiens
tgaagactccagaaa

SEQ ID NO: 6449264 - DNA, 16 bp, Homo sapiens
tgaagactgagaactt

SEQ ID NO: 6449265 - DNA, 23 bp, Homo sapiens
tgaagactgcacaggtgacaagc

SEQ ID NO: 6449266 - DNA, 15 bp, Homo sapiens
tgaagactggaagct

SEQ ID NO: 6449267 - DNA, 18 bp, Homo sapiens
tgaagactggaagctaat

SEQ ID NO: 6449268 - DNA, 19 bp, Homo sapiens
tgaagacttaaaagagctc

SEQ ID NO: 6449269 - DNA, 19 bp, Homo sapiens
tgaagacttaactggccca

SEQ ID NO: 6449270 - DNA, 23 bp, Homo sapiens
tgaagacttaactggcccagaag

SEQ ID NO: 6449271 - DNA, 13 bp, Homo sapiens
tgaagagaaaaaa

SEQ ID NO: 6449272 - DNA, 21 bp, Homo sapiens
tgaagagaaaaaggctgaaaa

SEQ ID NO: 6449273 - DNA, 13 bp, Homo sapiens
tgaagagaaagac

SEQ ID NO: 6449274 - DNA, 21 bp, Homo sapiens
tgaagagaaagacagtatttg

SEQ ID NO: 6449275 - DNA, 24 bp, Homo sapiens
tgaagagaaccgagcaaagatcaa

SEQ ID NO: 6449276 - DNA, 20 bp, Homo sapiens
tgaagagaagggcagggctg

SEQ ID NO: 6449277 - DNA, 17 bp, Homo sapiens
tgaagagaatgtattct

SEQ ID NO: 6449278 - DNA, 19 bp, Homo sapiens
tgaagagaatgtattctgt

SEQ ID NO: 6449279 - DNA, 16 bp, Homo sapiens
tgaagagacaggcacc

SEQ ID NO: 6449280 - DNA, 22 bp, Homo sapiens
tgaagagagatatatctgaaaa

SEQ ID NO: 6449281 - DNA, 21 bp, Homo sapiens
tgaagagatttcaacaagaat

SEQ ID NO: 6449282 - DNA, 16 bp, Homo sapiens
tgaagagatttttcat

SEQ ID NO: 6449283 - DNA, 18 bp, Homo sapiens
tgaagagcgctcctctgc

SEQ ID NO: 6449284 - DNA, 20 bp, Homo sapiens
tgaagagcgctcctctgcct

SEQ ID NO: 6449285 - DNA, 12 bp, Homo sapiens
tgaagagctctt

SEQ ID NO: 6449286 - DNA, 14 bp, Homo sapiens
tgaagagctcttgg

SEQ ID NO: 6449287 - DNA, 20 bp, Homo sapiens
tgaagagctgtcttcccctg

SEQ ID NO: 6449288 - DNA, 22 bp, Homo sapiens
tgaagagctgtcttcccctgag

SEQ ID NO: 6449289 - DNA, 18 bp, Homo sapiens
tgaagagcttgctttgat

SEQ ID NO: 6449290 - DNA, 16 bp, Homo sapiens
tgaagaggaaaatgaa

SEQ ID NO: 6449291 - DNA, 19 bp, Homo sapiens
tgaagaggaaaatgaataa

SEQ ID NO: 6449292 - DNA, 20 bp, Homo sapiens
tgaagaggaaaatgaataat

SEQ ID NO: 6449293 - DNA, 18 bp, Homo sapiens
tgaagaggaacagtgtgg

SEQ ID NO: 6449294 - DNA, 13 bp, Homo sapiens
tgaagaggaaggg

SEQ ID NO: 6449295 - DNA, 22 bp, Homo sapiens
tgaagaggaccctgagtcccca

SEQ ID NO: 6449296 - DNA, 23 bp, Homo sapiens
tgaagaggagattggccagtgag

SEQ ID NO: 6449297 - DNA, 18 bp, Homo sapiens
tgaagaggcaagagacag

SEQ ID NO: 6449298 - DNA, 19 bp, Homo sapiens
tgaagaggcaagagacaga

SEQ ID NO: 6449299 - DNA, 17 bp, Homo sapiens
tgaagaggcgggccagc

SEQ ID NO: 6449300 - DNA, 13 bp, Homo sapiens
tgaagaggcttct

SEQ ID NO: 6449301 - DNA, 15 bp, Homo sapiens
tgaagagggaagcca

SEQ ID NO: 6449302 - DNA, 21 bp, Homo sapiens
tgaagagggacataagataaa

SEQ ID NO: 6449303 - DNA, 17 bp, Homo sapiens
tgaagagggagaaggga

SEQ ID NO: 6449304 - DNA, 14 bp, Homo sapiens
tgaagagggtagag

SEQ ID NO: 6449305 - DNA, 12 bp, Homo sapiens
tgaagaggtctg

SEQ ID NO: 6449306 - DNA, 20 bp, Homo sapiens
tgaagaggtctgattggctg

SEQ ID NO: 6449307 - DNA, 15 bp, Homo sapiens
tgaagaggtgaaatg

SEQ ID NO: 6449308 - DNA, 13 bp, Homo sapiens
tgaagagtagttt

SEQ ID NO: 6449309 - DNA, 19 bp, Homo sapiens
tgaagagtatccttccttc

SEQ ID NO: 6449310 - DNA, 20 bp, Homo sapiens
tgaagagtcagaactaactt

SEQ ID NO: 6449311 - DNA, 16 bp, Homo sapiens
tgaagagtgaagagca

SEQ ID NO: 6449312 - DNA, 16 bp, Homo sapiens
tgaagagtgagagggc

SEQ ID NO: 6449313 - DNA, 17 bp, Homo sapiens
tgaagagtgagagggca

SEQ ID NO: 6449314 - DNA, 21 bp, Homo sapiens
tgaagagtggaaatggggaac

SEQ ID NO: 6449315 - DNA, 23 bp, Homo sapiens
tgaagagtttaactttgggccca

SEQ ID NO: 6449316 - DNA, 19 bp, Homo sapiens
tgaagagtttgtaaatgac

SEQ ID NO: 6449317 - DNA, 22 bp, Homo sapiens
tgaagagtttttttctgtttat

SEQ ID NO: 6449318 - DNA, 17 bp, Homo sapiens
tgaagataaatgcttta

SEQ ID NO: 6449319 - DNA, 19 bp, Homo sapiens
tgaagataaatgctttaaa

SEQ ID NO: 6449320 - DNA, 21 bp, Homo sapiens
tgaagataaatgctttaaata

SEQ ID NO: 6449321 - DNA, 21 bp, Homo sapiens
tgaagataagtaatttacctg

SEQ ID NO: 6449322 - DNA, 17 bp, Homo sapiens
tgaagataatttgcata

SEQ ID NO: 6449323 - DNA, 23 bp, Homo sapiens
tgaagatacacattacagccagg

SEQ ID NO: 6449324 - DNA, 18 bp, Homo sapiens
tgaagataccatcagcaa

SEQ ID NO: 6449325 - DNA, 14 bp, Homo sapiens
tgaagatactgaaa

SEQ ID NO: 6449326 - DNA, 15 bp, Homo sapiens
tgaagatactgaaat

SEQ ID NO: 6449327 - DNA, 16 bp, Homo sapiens
tgaagatactgaaata

SEQ ID NO: 6449328 - DNA, 17 bp, Homo sapiens
tgaagatactttgtatt

SEQ ID NO: 6449329 - DNA, 14 bp, Homo sapiens
tgaagatagaagaa

SEQ ID NO: 6449330 - DNA, 16 bp, Homo sapiens
tgaagatagaagaaaa

SEQ ID NO: 6449331 - DNA, 16 bp, Homo sapiens
tgaagatatatttcac

SEQ ID NO: 6449332 - DNA, 22 bp, Homo sapiens
tcccatgtgtgactccagcctg

SEQ ID NO: 6449333 - DNA, 20 bp, Homo sapiens
tcccatgtgtgatgctgaca

SEQ ID NO: 6449334 - DNA, 21 bp, Homo sapiens
tcccattaatcatttccccat

SEQ ID NO: 6449335 - DNA, 14 bp, Homo sapiens
tcccattattcaaa

SEQ ID NO: 6449336 - DNA, 16 bp, Homo sapiens
tcccattattcaaagt

SEQ ID NO: 6449337 - DNA, 18 bp, Homo sapiens
tcccattattcaaagttg

SEQ ID NO: 6449338 - DNA, 18 bp, Homo sapiens
tcccattcacatgccctc

SEQ ID NO: 6449339 - DNA, 20 bp, Homo sapiens
tcccattcactagaaaatga

SEQ ID NO: 6449340 - DNA, 17 bp, Homo sapiens
tcccattcactcttcca

SEQ ID NO: 6449341 - DNA, 23 bp, Homo sapiens
tcccattcacttctgcattcctg

SEQ ID NO: 6449342 - DNA, 14 bp, Homo sapiens
tcccattcagtggc

SEQ ID NO: 6449343 - DNA, 14 bp, Homo sapiens
tcccattccctggg

SEQ ID NO: 6449344 - DNA, 15 bp, Homo sapiens
tcccattccctggga

SEQ ID NO: 6449345 - DNA, 17 bp, Homo sapiens
tcccattctagatcctg

SEQ ID NO: 6449346 - DNA, 14 bp, Homo sapiens
tcccattctatgtg

SEQ ID NO: 6449347 - DNA, 16 bp, Homo sapiens
tcccattcttggccca

SEQ ID NO: 6449348 - DNA, 21 bp, Homo sapiens
tcccattgcccagtgagccct

SEQ ID NO: 6449349 - DNA, 17 bp, Homo sapiens
tcccattggctttctct

SEQ ID NO: 6449350 - DNA, 17 bp, Homo sapiens
tcccattgtatttaaaa

SEQ ID NO: 6449351 - DNA, 21 bp, Homo sapiens
tcccattgtatttaaaacatt

SEQ ID NO: 6449352 - DNA, 13 bp, Homo sapiens
tcccattgtccct

SEQ ID NO: 6449353 - DNA, 21 bp, Homo sapiens
tcccattgtccctctgcccca

SEQ ID NO: 6449354 - DNA, 22 bp, Homo sapiens
tcccattgttggcgctgaggtg

SEQ ID NO: 6449355 - DNA, 15 bp, Homo sapiens
tcccatttagaatgg

SEQ ID NO: 6449356 - DNA, 21 bp, Homo sapiens
tcccatttagaatggtgattt

SEQ ID NO: 6449357 - DNA, 16 bp, Homo sapiens
tcccatttagtgtgaa

SEQ ID NO: 6449358 - DNA, 19 bp, Homo sapiens
tcccatttattattttaat

SEQ ID NO: 6449359 - DNA, 18 bp, Homo sapiens
tcccatttcctgatctag

SEQ ID NO: 6449360 - DNA, 15 bp, Homo sapiens
tcccatttccttgga

SEQ ID NO: 6449361 - DNA, 16 bp, Homo sapiens
tcccatttccttggag

SEQ ID NO: 6449362 - DNA, 16 bp, Homo sapiens
tcccatttccttgtct

SEQ ID NO: 6449363 - DNA, 23 bp, Homo sapiens
tcccatttctacctaagtcagct

SEQ ID NO: 6449364 - DNA, 18 bp, Homo sapiens
tcccatttctcactgaga

SEQ ID NO: 6449365 - DNA, 14 bp, Homo sapiens
tcccatttcttccc

SEQ ID NO: 6449366 - DNA, 15 bp, Homo sapiens
tcccatttcttgcta

SEQ ID NO: 6449367 - DNA, 20 bp, Homo sapiens
tcccatttgctgtctttttg

SEQ ID NO: 6449368 - DNA, 17 bp, Homo sapiens
tcccatttgtgccagag

SEQ ID NO: 6449369 - DNA, 19 bp, Homo sapiens
tcccatttgtgccagagga

SEQ ID NO: 6449370 - DNA, 15 bp, Homo sapiens
tcccatttgtgtttc

SEQ ID NO: 6449371 - DNA, 23 bp, Homo sapiens
tcccattttagaaaatcagattt

SEQ ID NO: 6449372 - DNA, 14 bp, Homo sapiens
tcccattttattaa

SEQ ID NO: 6449373 - DNA, 21 bp, Homo sapiens
tcccattttcagactgcttta

SEQ ID NO: 6449374 - DNA, 16 bp, Homo sapiens
tcccattttcatcctg

SEQ ID NO: 6449375 - DNA, 19 bp, Homo sapiens
tcccattttcatcctgagc

SEQ ID NO: 6449376 - DNA, 16 bp, Homo sapiens
tcccattttccccctg

SEQ ID NO: 6449377 - DNA, 13 bp, Homo sapiens
tcccattttgcaa

SEQ ID NO: 6449378 - DNA, 19 bp, Homo sapiens
tcccattttgcagatgaag

SEQ ID NO: 6449379 - DNA, 19 bp, Homo sapiens
tcccattttggaagttttc

SEQ ID NO: 6449380 - DNA, 20 bp, Homo sapiens
tcccattttggaagttttca

SEQ ID NO: 6449381 - DNA, 12 bp, Homo sapiens
tcccattttggt

SEQ ID NO: 6449382 - DNA, 17 bp, Homo sapiens
tccccaaaacaaagtct

SEQ ID NO: 6449383 - DNA, 21 bp, Homo sapiens
tccccaaaacctttccccaga

SEQ ID NO: 6449384 - DNA, 22 bp, Homo sapiens
tccccaaaacctttccccagac

SEQ ID NO: 6449385 - DNA, 13 bp, Homo sapiens
tccccaaaagaaa

SEQ ID NO: 6449386 - DNA, 23 bp, Homo sapiens
tccccaaaagaaaccatgacaaa

SEQ ID NO: 6449387 - DNA, 16 bp, Homo sapiens
tccccaaacaggacag

SEQ ID NO: 6449388 - DNA, 18 bp, Homo sapiens
tccccaaacaggacagca

SEQ ID NO: 6449389 - DNA, 16 bp, Homo sapiens
tccccaaacctgcaag

SEQ ID NO: 6449390 - DNA, 18 bp, Homo sapiens
tccccaaactgtgccctg

SEQ ID NO: 6449391 - DNA, 11 bp, Homo sapiens
tccccaaactt

SEQ ID NO: 6449392 - DNA, 22 bp, Homo sapiens
tccccaaacttatggacactgc

SEQ ID NO: 6449393 - DNA, 21 bp, Homo sapiens
tccccaaagccactggaagga

SEQ ID NO: 6449394 - DNA, 18 bp, Homo sapiens
tccccaaaggccaacagc

SEQ ID NO: 6449395 - DNA, 23 bp, Homo sapiens
tccccaaaggctttgccctgctg

SEQ ID NO: 6449396 - DNA, 20 bp, Homo sapiens
tccccaaaggtcaaaaacaa

SEQ ID NO: 6449397 - DNA, 16 bp, Homo sapiens
tccccaaatggctgct

SEQ ID NO: 6449398 - DNA, 18 bp, Homo sapiens
tccccaaatggctgcttt

SEQ ID NO: 6449399 - DNA, 17 bp, Homo sapiens
tccccaacacctgcctc

SEQ ID NO: 6449400 - DNA, 19 bp, Homo sapiens
tccccaacacctgcctctg

SEQ ID NO: 6449401 - DNA, 23 bp, Homo sapiens
tccccaacagcgacatagcccat

SEQ ID NO: 6449402 - DNA, 17 bp, Homo sapiens
tccccaacaggaatttt

SEQ ID NO: 6449403 - DNA, 20 bp, Homo sapiens
tccccaacatggatgtgttg

SEQ ID NO: 6449404 - DNA, 13 bp, Homo sapiens
tccccaaccacag

SEQ ID NO: 6449405 - DNA, 21 bp, Homo sapiens
tccccaacccccattctcatc

SEQ ID NO: 6449406 - DNA, 16 bp, Homo sapiens
tccccaacccctctcc

SEQ ID NO: 6449407 - DNA, 24 bp, Homo sapiens
tccccaacccctctccaggcctgt

SEQ ID NO: 6449408 - DNA, 15 bp, Homo sapiens
tccccaacccgtgcc

SEQ ID NO: 6449409 - DNA, 16 bp, Homo sapiens
tccccaaccctgcccc

SEQ ID NO: 6449410 - DNA, 20 bp, Homo sapiens
tccccaaccctgcccctgcc

SEQ ID NO: 6449411 - DNA, 13 bp, Homo sapiens
tccccaacctgca

SEQ ID NO: 6449412 - DNA, 18 bp, Homo sapiens
tccccaacgtcccctccg

SEQ ID NO: 6449413 - DNA, 19 bp, Homo sapiens
tccccaacgtcccctccgc

SEQ ID NO: 6449414 - DNA, 14 bp, Homo sapiens
tccccaactccatg

SEQ ID NO: 6449415 - DNA, 18 bp, Homo sapiens
tccccaactccctgccat

SEQ ID NO: 6449416 - DNA, 12 bp, Homo sapiens
tccccaactgct

SEQ ID NO: 6449417 - DNA, 23 bp, Homo sapiens
tccccaactgctccagcctctgc

SEQ ID NO: 6449418 - DNA, 20 bp, Homo sapiens
tccccaagcccaccaggtgt

SEQ ID NO: 6449419 - DNA, 12 bp, Homo sapiens
tccccaagctgg

SEQ ID NO: 6449420 - DNA, 15 bp, Homo sapiens
tccccaaggacccag

SEQ ID NO: 6449421 - DNA, 20 bp, Homo sapiens
tccccaaggatgaccacacc

SEQ ID NO: 6449422 - DNA, 21 bp, Homo sapiens
tccccaaggatgaccacaccc

SEQ ID NO: 6449423 - DNA, 18 bp, Homo sapiens
tccccaaggcactgagcg

SEQ ID NO: 6449424 - DNA, 18 bp, Homo sapiens
tccccaaggccacaggga

SEQ ID NO: 6449425 - DNA, 15 bp, Homo sapiens
tccccaaggcctctc

SEQ ID NO: 6449426 - DNA, 12 bp, Homo sapiens
tccccaaggctg

SEQ ID NO: 6449427 - DNA, 20 bp, Homo sapiens
tccccaagggccctggcacc

SEQ ID NO: 6449428 - DNA, 22 bp, Homo sapiens
tccccaagtacaaccacaccca

SEQ ID NO: 6449429 - DNA, 13 bp, Homo sapiens
tccccaataaagc

SEQ ID NO: 6449430 - DNA, 20 bp, Homo sapiens
tccccaataattgcagaact

SEQ ID NO: 6449431 - DNA, 23 bp, Homo sapiens
tccccaatatcttgcttgaactt

SEQ ID NO: 6449432 - DNA, 14 bp, Homo sapiens
tccccaatcagctc

SEQ ID NO: 6449433 - DNA, 15 bp, Homo sapiens
tccccaatccaaccc

SEQ ID NO: 6449434 - DNA, 18 bp, Homo sapiens
tccccaatccatgcttca

SEQ ID NO: 6449435 - DNA, 23 bp, Homo sapiens
tccccaatccatttggcagaact

SEQ ID NO: 6449436 - DNA, 14 bp, Homo sapiens
tccccaatccctga

SEQ ID NO: 6449437 - DNA, 17 bp, Homo sapiens
tccccaatgagacttgc

SEQ ID NO: 6449438 - DNA, 21 bp, Homo sapiens
tccccaatgagacttgccttc

SEQ ID NO: 6449439 - DNA, 23 bp, Homo sapiens
tccccaattatatctcccccact

SEQ ID NO: 6449440 - DNA, 14 bp, Homo sapiens
tccccaattatctt

SEQ ID NO: 6449441 - DNA, 11 bp, Homo sapiens
tccccacacag

SEQ ID NO: 6449442 - DNA, 22 bp, Homo sapiens
tccccacaccttccagggccct

SEQ ID NO: 6449443 - DNA, 22 bp, Homo sapiens
tccccacacgtgctcgcagcct

SEQ ID NO: 6449444 - DNA, 23 bp, Homo sapiens
tccccacacgtgctcgcagcctg

SEQ ID NO: 6449445 - DNA, 10 bp, Homo sapiens
tccccacact

SEQ ID NO: 6449446 - DNA, 15 bp, Homo sapiens
tccccacactccact

SEQ ID NO: 6449447 - DNA, 10 bp, Homo sapiens
tccccacaga

SEQ ID NO: 6449448 - DNA, 11 bp, Homo sapiens
tccccacagac

SEQ ID NO: 6449449 - DNA, 16 bp, Homo sapiens
tccccacagactgccc

SEQ ID NO: 6449450 - DNA, 21 bp, Homo sapiens
tccccacagactgccccagcc

SEQ ID NO: 6449451 - DNA, 23 bp, Homo sapiens
tccccacagactgccccagccaa

SEQ ID NO: 6449452 - DNA, 13 bp, Homo sapiens
tccccacagcagg

SEQ ID NO: 6449453 - DNA, 14 bp, Homo sapiens
tccccacagcctct

SEQ ID NO: 6449454 - DNA, 15 bp, Homo sapiens
tccccacagcctctg

SEQ ID NO: 6449455 - DNA, 18 bp, Homo sapiens
tccccacagctttgcacc

SEQ ID NO: 6449456 - DNA, 18 bp, Homo sapiens
tccccacagtcctcacag

SEQ ID NO: 6449457 - DNA, 17 bp, Homo sapiens
tccccacatatggcaca

SEQ ID NO: 6449458 - DNA, 15 bp, Homo sapiens
tccccaccaccccag

SEQ ID NO: 6449459 - DNA, 16 bp, Homo sapiens
tccccaccagagctgc

SEQ ID NO: 6449460 - DNA, 17 bp, Homo sapiens
tccccaccagatgctga

SEQ ID NO: 6449461 - DNA, 15 bp, Homo sapiens
tccccaccagcttta

SEQ ID NO: 6449462 - DNA, 20 bp, Homo sapiens
tccccaccagtctcacccac

SEQ ID NO: 6449463 - DNA, 21 bp, Homo sapiens
tccccaccagtctcacccact

SEQ ID NO: 6449464 - DNA, 18 bp, Homo sapiens
tccccacccaccaccgct

SEQ ID NO: 6449465 - DNA, 11 bp, Homo sapiens
tccccacccca

SEQ ID NO: 6449466 - DNA, 16 bp, Homo sapiens
tccccaccccacctca

SEQ ID NO: 6449467 - DNA, 18 bp, Homo sapiens
tccccaccccagtgggaa

SEQ ID NO: 6449468 - DNA, 17 bp, Homo sapiens
tccccaccccataagcc

SEQ ID NO: 6449469 - DNA, 23 bp, Homo sapiens
tccccaccccataagccctgaga

SEQ ID NO: 6449470 - DNA, 23 bp, Homo sapiens
tccccacccccctctctttctct

SEQ ID NO: 6449471 - DNA, 15 bp, Homo sapiens
tccccacccccgctg

SEQ ID NO: 6449472 - DNA, 19 bp, Homo sapiens
tccccacccctacccctgg

SEQ ID NO: 6449473 - DNA, 13 bp, Homo sapiens
tccccacccctgc

SEQ ID NO: 6449474 - DNA, 20 bp, Homo sapiens
tccccacccctgcctttgtt

SEQ ID NO: 6449475 - DNA, 13 bp, Homo sapiens
tccccacccgcct

SEQ ID NO: 6449476 - DNA, 17 bp, Homo sapiens
tccccacccgcctgcag

SEQ ID NO: 6449477 - DNA, 19 bp, Homo sapiens
tccccacccgcctgcagag

SEQ ID NO: 6449478 - DNA, 13 bp, Homo sapiens
tccccaccctcca

SEQ ID NO: 6449479 - DNA, 14 bp, Homo sapiens
tccccaccctccac

SEQ ID NO: 6449480 - DNA, 15 bp, Homo sapiens
tccccaccctccact

SEQ ID NO: 6449481 - DNA, 16 bp, Homo sapiens
tccccaccctccactc

SEQ ID NO: 6449482 - DNA, 17 bp, Homo sapiens
tccccaccctcctcttg

SEQ ID NO: 6449483 - DNA, 21 bp, Homo sapiens
tccccaccgcagacaggacca

SEQ ID NO: 6449484 - DNA, 24 bp, Homo sapiens
tccccaccgcagacaggaccaggg

SEQ ID NO: 6449485 - DNA, 23 bp, Homo sapiens
tccccaccgctgagaggctgcct

SEQ ID NO: 6449486 - DNA, 23 bp, Homo sapiens
tccccacctacccagctgatggg

SEQ ID NO: 6449487 - DNA, 17 bp, Homo sapiens
tccccacctcttccttc

SEQ ID NO: 6449488 - DNA, 13 bp, Homo sapiens
tccccacctgcac

SEQ ID NO: 6449489 - DNA, 12 bp, Homo sapiens
tccccacctgcg

SEQ ID NO: 6449490 - DNA, 14 bp, Homo sapiens
tccccacctgctca

SEQ ID NO: 6449491 - DNA, 22 bp, Homo sapiens
tccccacctggacacacactca

SEQ ID NO: 6449492 - DNA, 20 bp, Homo sapiens
tccccaccttcacctcggag

SEQ ID NO: 6449493 - DNA, 17 bp, Homo sapiens
tccccaccttccaagga

SEQ ID NO: 6449494 - DNA, 13 bp, Homo sapiens
tccccaccttccc

SEQ ID NO: 6449495 - DNA, 23 bp, Homo sapiens
tccccaccttcttgggactgctg

SEQ ID NO: 6449496 - DNA, 21 bp, Homo sapiens
tccccacgacccctgcctcga

SEQ ID NO: 6449497 - DNA, 20 bp, Homo sapiens
tccccacgagggctggctgg

SEQ ID NO: 6449498 - DNA, 21 bp, Homo sapiens
tccccacgagtcacctgcaag

SEQ ID NO: 6449499 - DNA, 22 bp, Homo sapiens
tccccacgagtcacctgcaagc

SEQ ID NO: 6449500 - DNA, 16 bp, Homo sapiens
tccccacgatgatatc

SEQ ID NO: 6449501 - DNA, 14 bp, Homo sapiens
tccccacgccacag

SEQ ID NO: 6449502 - DNA, 19 bp, Homo sapiens
tccccacgccacagccctt

SEQ ID NO: 6449503 - DNA, 22 bp, Homo sapiens
tccccacgccacagcccttttg

SEQ ID NO: 6449504 - DNA, 14 bp, Homo sapiens
tccccacgccccca

SEQ ID NO: 6449505 - DNA, 16 bp, Homo sapiens
tccccacgcccccatg

SEQ ID NO: 6449506 - DNA, 18 bp, Homo sapiens
tccccacgccctcccctc

SEQ ID NO: 6449507 - DNA, 19 bp, Homo sapiens
tccccacgccctcccctcc

SEQ ID NO: 6449508 - DNA, 22 bp, Homo sapiens
tccccacggggcctcgggacct

SEQ ID NO: 6449509 - DNA, 20 bp, Homo sapiens
tccccacgtggcacctcctc

SEQ ID NO: 6449510 - DNA, 20 bp, Homo sapiens
tgaagatatatttcactttt

SEQ ID NO: 6449511 - DNA, 21 bp, Homo sapiens
tgaagatcagaacattcagct

SEQ ID NO: 6449512 - DNA, 16 bp, Homo sapiens
tgaagatcagagctgc

SEQ ID NO: 6449513 - DNA, 21 bp, Homo sapiens
tgaagatcccaacatggtcct

SEQ ID NO: 6449514 - DNA, 22 bp, Homo sapiens
tgaagatcccaacatggtccta

SEQ ID NO: 6449515 - DNA, 19 bp, Homo sapiens
tgaagatccccaactgctc

SEQ ID NO: 6449516 - DNA, 21 bp, Homo sapiens
tgaagatccccaactgctcca

SEQ ID NO: 6449517 - DNA, 15 bp, Homo sapiens
tgaagatctaaactt

SEQ ID NO: 6449518 - DNA, 20 bp, Homo sapiens
tgaagatctaaataaaatgc

SEQ ID NO: 6449519 - DNA, 11 bp, Homo sapiens
tgaagatctca

SEQ ID NO: 6449520 - DNA, 17 bp, Homo sapiens
tgaagatctttatattt

SEQ ID NO: 6449521 - DNA, 14 bp, Homo sapiens
tgaagatctttgtt

SEQ ID NO: 6449522 - DNA, 20 bp, Homo sapiens
tgaagatgaaatatatattg

SEQ ID NO: 6449523 - DNA, 13 bp, Homo sapiens
tgaagatgatcat

SEQ ID NO: 6449524 - DNA, 22 bp, Homo sapiens
tgaagatgcaatcagacaagtg

SEQ ID NO: 6449525 - DNA, 19 bp, Homo sapiens
tgaagatgcattgtagttt

SEQ ID NO: 6449526 - DNA, 17 bp, Homo sapiens
tgaagatgcccctgctc

SEQ ID NO: 6449527 - DNA, 11 bp, Homo sapiens
tgaagatggcc

SEQ ID NO: 6449528 - DNA, 22 bp, Homo sapiens
tgaagatgggggcctctttcag

SEQ ID NO: 6449529 - DNA, 15 bp, Homo sapiens
tgaagatggtttcaa

SEQ ID NO: 6449530 - DNA, 21 bp, Homo sapiens
tgaagatggtttcaattcaga

SEQ ID NO: 6449531 - DNA, 14 bp, Homo sapiens
tgaagatgtctcct

SEQ ID NO: 6449532 - DNA, 16 bp, Homo sapiens
tgaagatgtctcctca

SEQ ID NO: 6449533 - DNA, 23 bp, Homo sapiens
tgaagatgtctcctcaagcctgt

SEQ ID NO: 6449534 - DNA, 13 bp, Homo sapiens
tgaagatgtgtaa

SEQ ID NO: 6449535 - DNA, 15 bp, Homo sapiens
tgaagatgttaaaat

SEQ ID NO: 6449536 - DNA, 18 bp, Homo sapiens
tgaagatgtttttagagg

SEQ ID NO: 6449537 - DNA, 18 bp, Homo sapiens
tgaagattaacactgaga

SEQ ID NO: 6449538 - DNA, 15 bp, Homo sapiens
tgaagattcaggctt

SEQ ID NO: 6449539 - DNA, 15 bp, Homo sapiens
tgaagattctcctgt

SEQ ID NO: 6449540 - DNA, 22 bp, Homo sapiens
tgaagattgtttatctagatgt

SEQ ID NO: 6449541 - DNA, 15 bp, Homo sapiens
tgaagatttcagagg

SEQ ID NO: 6449542 - DNA, 22 bp, Homo sapiens
tgaagatttgaggacttgttaa

SEQ ID NO: 6449543 - DNA, 19 bp, Homo sapiens
tgaagattttctttctctt

SEQ ID NO: 6449544 - DNA, 17 bp, Homo sapiens
tgaagcaaagcaccagc

SEQ ID NO: 6449545 - DNA, 14 bp, Homo sapiens
tgaagcaaatcaga

SEQ ID NO: 6449546 - DNA, 20 bp, Homo sapiens
tgaagcaaatcgaatgaaat

SEQ ID NO: 6449547 - DNA, 14 bp, Homo sapiens
tgaagcaaatgtgt

SEQ ID NO: 6449548 - DNA, 21 bp, Homo sapiens
tgaagcaacgataaaattaca

SEQ ID NO: 6449549 - DNA, 15 bp, Homo sapiens
tgaagcaagctgtgt

SEQ ID NO: 6449550 - DNA, 21 bp, Homo sapiens
tgaagcaagctgtgttacttg

SEQ ID NO: 6449551 - DNA, 13 bp, Homo sapiens
tgaagcaaggaag

SEQ ID NO: 6449552 - DNA, 20 bp, Homo sapiens
tgaagcaaggcggtggactt

SEQ ID NO: 6449553 - DNA, 12 bp, Homo sapiens
tgaagcaataac

SEQ ID NO: 6449554 - DNA, 18 bp, Homo sapiens
tgaagcaataactccaag

SEQ ID NO: 6449555 - DNA, 19 bp, Homo sapiens
tgaagcaataactccaagc

SEQ ID NO: 6449556 - DNA, 21 bp, Homo sapiens
tgaagcaataactccaagcag

SEQ ID NO: 6449557 - DNA, 22 bp, Homo sapiens
tgaagcaataactccaagcaga

SEQ ID NO: 6449558 - DNA, 18 bp, Homo sapiens
tgaagcaatggatatttg

SEQ ID NO: 6449559 - DNA, 23 bp, Homo sapiens
tgaagcaattagtctgaaactgg

SEQ ID NO: 6449560 - DNA, 21 bp, Homo sapiens
tgaagcacagagggctaggga

SEQ ID NO: 6449561 - DNA, 14 bp, Homo sapiens
tgaagcaccaggga

SEQ ID NO: 6449562 - DNA, 16 bp, Homo sapiens
tgaagcaccatggtgt

SEQ ID NO: 6449563 - DNA, 23 bp, Homo sapiens
tgaagcacctactatgtgctggg

SEQ ID NO: 6449564 - DNA, 23 bp, Homo sapiens
tgaagcacttaagtcttccttaa

SEQ ID NO: 6449565 - DNA, 13 bp, Homo sapiens
tgaagcagaatga

SEQ ID NO: 6449566 - DNA, 23 bp, Homo sapiens
tgaagcagaggaaggaaacatag

SEQ ID NO: 6449567 - DNA, 23 bp, Homo sapiens
tgaagcagagtcaagctgatgaa

SEQ ID NO: 6449568 - DNA, 12 bp, Homo sapiens
tgaagcagagtg

SEQ ID NO: 6449569 - DNA, 22 bp, Homo sapiens
tgaagcagatgcaaagaggcaa

SEQ ID NO: 6449570 - DNA, 16 bp, Homo sapiens
tgaagcagatttattt

SEQ ID NO: 6449571 - DNA, 18 bp, Homo sapiens
tgaagcagctctgccttc

SEQ ID NO: 6449572 - DNA, 17 bp, Homo sapiens
tgaagcagctttaaaca

SEQ ID NO: 6449573 - DNA, 19 bp, Homo sapiens
tgaagcaggttcccaagct

SEQ ID NO: 6449574 - DNA, 15 bp, Homo sapiens
tgaagcagtcagccc

SEQ ID NO: 6449575 - DNA, 13 bp, Homo sapiens
tgaagcagtcttg

SEQ ID NO: 6449576 - DNA, 13 bp, Homo sapiens
tgaagcagtgcct

SEQ ID NO: 6449577 - DNA, 18 bp, Homo sapiens
tgaagcagtgcctcgagg

SEQ ID NO: 6449578 - DNA, 21 bp, Homo sapiens
tgaagcagtgcctcgaggcac

SEQ ID NO: 6449579 - DNA, 16 bp, Homo sapiens
tgaagcagttcagaag

SEQ ID NO: 6449580 - DNA, 14 bp, Homo sapiens
tgaagcagttgtgt

SEQ ID NO: 6449581 - DNA, 18 bp, Homo sapiens
tgaagcataaagttacct

SEQ ID NO: 6449582 - DNA, 12 bp, Homo sapiens
tgaagcataatt

SEQ ID NO: 6449583 - DNA, 23 bp, Homo sapiens
tgaagcataatttgtttaaaatt

SEQ ID NO: 6449584 - DNA, 22 bp, Homo sapiens
tgaagcatagataatattgttt

SEQ ID NO: 6449585 - DNA, 20 bp, Homo sapiens
tgaagcatgaaactgtgtat

SEQ ID NO: 6449586 - DNA, 23 bp, Homo sapiens
tgaagcatgaacgtggattgtat

SEQ ID NO: 6449587 - DNA, 12 bp, Homo sapiens
tgaagcatgctt

SEQ ID NO: 6449588 - DNA, 18 bp, Homo sapiens
tgaagcatgctttgctgc

SEQ ID NO: 6449589 - DNA, 19 bp, Homo sapiens
tgaagcatgtttcatgttt

SEQ ID NO: 6449590 - DNA, 21 bp, Homo sapiens
tgaagcattctccccagtgta

SEQ ID NO: 6449591 - DNA, 22 bp, Homo sapiens
tgaagcatttcaaagccctgcc

SEQ ID NO: 6449592 - DNA, 14 bp, Homo sapiens
tgaagcattttata

SEQ ID NO: 6449593 - DNA, 18 bp, Homo sapiens
tgaagcattttataaatc

SEQ ID NO: 6449594 - DNA, 15 bp, Homo sapiens
tgaagccaaactgtt

SEQ ID NO: 6449595 - DNA, 12 bp, Homo sapiens
tgaagccaaaga

SEQ ID NO: 6449596 - DNA, 15 bp, Homo sapiens
tgaagccaaagccaa

SEQ ID NO: 6449597 - DNA, 14 bp, Homo sapiens
tgaagccaaatgaa

SEQ ID NO: 6449598 - DNA, 22 bp, Homo sapiens
tgaagccaactgacaaagatgc

SEQ ID NO: 6449599 - DNA, 23 bp, Homo sapiens
tgaagccaagtggggtgctggga

SEQ ID NO: 6449600 - DNA, 13 bp, Homo sapiens
tgaagccacagga

SEQ ID NO: 6449601 - DNA, 18 bp, Homo sapiens
tgaagccaccctgggcta

SEQ ID NO: 6449602 - DNA, 20 bp, Homo sapiens
tgaagccacctctctgcctg

SEQ ID NO: 6449603 - DNA, 17 bp, Homo sapiens
tgaagccacttggccca

SEQ ID NO: 6449604 - DNA, 16 bp, Homo sapiens
tgaagccagatccacc

SEQ ID NO: 6449605 - DNA, 12 bp, Homo sapiens
tgaagccagcct

SEQ ID NO: 6449606 - DNA, 11 bp, Homo sapiens
tgaagccagct

SEQ ID NO: 6449607 - DNA, 23 bp, Homo sapiens
tgaagccagctcacagtgctgtg

SEQ ID NO: 6449608 - DNA, 13 bp, Homo sapiens
tgaagccagctcc

SEQ ID NO: 6449609 - DNA, 15 bp, Homo sapiens
tgaagcccaaagcct

SEQ ID NO: 6449610 - DNA, 13 bp, Homo sapiens
tgaagcccaggag

SEQ ID NO: 6449611 - DNA, 19 bp, Homo sapiens
tgaagcccaggctgatgct

SEQ ID NO: 6449612 - DNA, 12 bp, Homo sapiens
tgaagcccccct

SEQ ID NO: 6449613 - DNA, 16 bp, Homo sapiens
tgaagcccccctttgg

SEQ ID NO: 6449614 - DNA, 20 bp, Homo sapiens
tgaagcccgtgtcctgcctt

SEQ ID NO: 6449615 - DNA, 15 bp, Homo sapiens
tgaagccctcccagg

SEQ ID NO: 6449616 - DNA, 17 bp, Homo sapiens
tgaagccgactctggcc

SEQ ID NO: 6449617 - DNA, 19 bp, Homo sapiens
tgaagccgactctggccct

SEQ ID NO: 6449618 - DNA, 15 bp, Homo sapiens
tgaagccgctcccgg

SEQ ID NO: 6449619 - DNA, 18 bp, Homo sapiens
tgaagccggacagctgcc

SEQ ID NO: 6449620 - DNA, 20 bp, Homo sapiens
tgaagccggacagctgccca

SEQ ID NO: 6449621 - DNA, 21 bp, Homo sapiens
tgaagccggacagctgcccag

SEQ ID NO: 6449622 - DNA, 15 bp, Homo sapiens
tgaagcctatttatt

SEQ ID NO: 6449623 - DNA, 22 bp, Homo sapiens
tgaagcctccacaccagctgct

SEQ ID NO: 6449624 - DNA, 15 bp, Homo sapiens
tgaagcctccgtgga

SEQ ID NO: 6449625 - DNA, 22 bp, Homo sapiens
tgaagcctccgtggaacattct

SEQ ID NO: 6449626 - DNA, 20 bp, Homo sapiens
tgaagcctctgccctgcctc

SEQ ID NO: 6449627 - DNA, 22 bp, Homo sapiens
tgaagcctgcgttggtccagag

SEQ ID NO: 6449628 - DNA, 13 bp, Homo sapiens
tgaagcctgctcc

SEQ ID NO: 6449629 - DNA, 20 bp, Homo sapiens
tgaagcctggacgcagccac

SEQ ID NO: 6449630 - DNA, 17 bp, Homo sapiens
tgaagcctggattccag

SEQ ID NO: 6449631 - DNA, 22 bp, Homo sapiens
tgaagcctggattccagcagtg

SEQ ID NO: 6449632 - DNA, 14 bp, Homo sapiens
tgaagcctgtgcca

SEQ ID NO: 6449633 - DNA, 17 bp, Homo sapiens
tgaagcctgtgccacct

SEQ ID NO: 6449634 - DNA, 19 bp, Homo sapiens
tgaagcctgtgcctcccag

SEQ ID NO: 6449635 - DNA, 13 bp, Homo sapiens
tgaagcctttatc

SEQ ID NO: 6449636 - DNA, 21 bp, Homo sapiens
tgaagcctttggtgaattcct

SEQ ID NO: 6449637 - DNA, 17 bp, Homo sapiens
tgaagccttttcctgag

SEQ ID NO: 6449638 - DNA, 15 bp, Homo sapiens
tgaagccttttgaaa

SEQ ID NO: 6449639 - DNA, 15 bp, Homo sapiens
tgaagcgaacatctt

SEQ ID NO: 6449640 - DNA, 16 bp, Homo sapiens
tgaagcggtcagactg

SEQ ID NO: 6449641 - DNA, 18 bp, Homo sapiens
tgaagcgtagtagtggaa

SEQ ID NO: 6449642 - DNA, 15 bp, Homo sapiens
tgaagcgtttttctc

SEQ ID NO: 6449643 - DNA, 14 bp, Homo sapiens
tgaagctaatacaa

SEQ ID NO: 6449644 - DNA, 15 bp, Homo sapiens
tgaagctaatgtcac

SEQ ID NO: 6449645 - DNA, 20 bp, Homo sapiens
tgaagctaattattttaatt

SEQ ID NO: 6449646 - DNA, 13 bp, Homo sapiens
tgaagctagaaac

SEQ ID NO: 6449647 - DNA, 17 bp, Homo sapiens
tgaagctagaaacaatc

SEQ ID NO: 6449648 - DNA, 14 bp, Homo sapiens
tgaagctagaggaa

SEQ ID NO: 6449649 - DNA, 21 bp, Homo sapiens
tgaagctatgtctctagcagt

SEQ ID NO: 6449650 - DNA, 16 bp, Homo sapiens
tgaagctattgatgtt

SEQ ID NO: 6449651 - DNA, 15 bp, Homo sapiens
tgaagctattggaat

SEQ ID NO: 6449652 - DNA, 13 bp, Homo sapiens
tgaagctcaactg

SEQ ID NO: 6449653 - DNA, 21 bp, Homo sapiens
tgaagctcacactgatgggct

SEQ ID NO: 6449654 - DNA, 22 bp, Homo sapiens
tgaagctcacactgatgggctg

SEQ ID NO: 6449655 - DNA, 23 bp, Homo sapiens
tgaagctcacctgttgcttacaa

SEQ ID NO: 6449656 - DNA, 19 bp, Homo sapiens
tgaagctcagtttggctgt

SEQ ID NO: 6449657 - DNA, 13 bp, Homo sapiens
tgaagctgaaaat

SEQ ID NO: 6449658 - DNA, 14 bp, Homo sapiens
tgaagctgaaaata

SEQ ID NO: 6449659 - DNA, 12 bp, Homo sapiens
tgaagctgcaca

SEQ ID NO: 6449660 - DNA, 15 bp, Homo sapiens
tgaagctgcctgctt

SEQ ID NO: 6449661 - DNA, 20 bp, Homo sapiens
tgaagctgctgcagccctgc

SEQ ID NO: 6449662 - DNA, 17 bp, Homo sapiens
tgaagctgctgcagctc

SEQ ID NO: 6449663 - DNA, 13 bp, Homo sapiens
tgaagctgctgga

SEQ ID NO: 6449664 - DNA, 13 bp, Homo sapiens
tgaagctgctgta

SEQ ID NO: 6449665 - DNA, 16 bp, Homo sapiens
tgaagctgctgtctct

SEQ ID NO: 6449666 - DNA, 18 bp, Homo sapiens
tgaagctgctgtgtcctc

SEQ ID NO: 6449667 - DNA, 20 bp, Homo sapiens
tgaagctggaagcactgctg

SEQ ID NO: 6449668 - DNA, 15 bp, Homo sapiens
tgaagctggagcagc

SEQ ID NO: 6449669 - DNA, 15 bp, Homo sapiens
tgaagctggggcttg

SEQ ID NO: 6449670 - DNA, 17 bp, Homo sapiens
tgaagcttatgtttctt

SEQ ID NO: 6449671 - DNA, 16 bp, Homo sapiens
tgaagcttattaatgc

SEQ ID NO: 6449672 - DNA, 21 bp, Homo sapiens
tgaagcttcatgcacttaaag

SEQ ID NO: 6449673 - DNA, 19 bp, Homo sapiens
tgaagcttgcaccttttca

SEQ ID NO: 6449674 - DNA, 21 bp, Homo sapiens
tgaagcttgcaccttttcatg

SEQ ID NO: 6449675 - DNA, 15 bp, Homo sapiens
tgaagcttgtgtatc

SEQ ID NO: 6449676 - DNA, 15 bp, Homo sapiens
tgaagctttaccagg

SEQ ID NO: 6449677 - DNA, 14 bp, Homo sapiens
tgaagctttatacg

SEQ ID NO: 6449678 - DNA, 20 bp, Homo sapiens
tgaagctttggttctctgat

SEQ ID NO: 6449679 - DNA, 21 bp, Homo sapiens
tgaaggaaaaacacaagcaaa

SEQ ID NO: 6449680 - DNA, 13 bp, Homo sapiens
tgaaggaaaaatt

SEQ ID NO: 6449681 - DNA, 14 bp, Homo sapiens
tgaaggaaacagtt

SEQ ID NO: 6449682 - DNA, 14 bp, Homo sapiens
tgaaggaaaggaag

SEQ ID NO: 6449683 - DNA, 12 bp, Homo sapiens
tgaaggaaataa

SEQ ID NO: 6449684 - DNA, 15 bp, Homo sapiens
tgaaggaaataaagg

SEQ ID NO: 6449685 - DNA, 23 bp, Homo sapiens
tgaaggaacacaaagatcaaatg

SEQ ID NO: 6449686 - DNA, 19 bp, Homo sapiens
tgaaggaacattccttagt

SEQ ID NO: 6449687 - DNA, 16 bp, Homo sapiens
tgaaggaatacaatat

SEQ ID NO: 6449688 - DNA, 21 bp, Homo sapiens
tgaaggaatagccagagagga

SEQ ID NO: 6449689 - DNA, 20 bp, Homo sapiens
tccccactaggttcttttcc

SEQ ID NO: 6449690 - DNA, 15 bp, Homo sapiens
tccccactccaccct

SEQ ID NO: 6449691 - DNA, 18 bp, Homo sapiens
tccccactccaccctgtt

SEQ ID NO: 6449692 - DNA, 19 bp, Homo sapiens
tccccactcccccacccat

SEQ ID NO: 6449693 - DNA, 15 bp, Homo sapiens
tccccactccctgtc

SEQ ID NO: 6449694 - DNA, 21 bp, Homo sapiens
tccccactcctccgagaccca

SEQ ID NO: 6449695 - DNA, 22 bp, Homo sapiens
tccccactcctcctccagccca

SEQ ID NO: 6449696 - DNA, 14 bp, Homo sapiens
tccccactctgctc

SEQ ID NO: 6449697 - DNA, 18 bp, Homo sapiens
tccccactctgctcccag

SEQ ID NO: 6449698 - DNA, 16 bp, Homo sapiens
tccccactgacagcct

SEQ ID NO: 6449699 - DNA, 14 bp, Homo sapiens
tccccactgcccca

SEQ ID NO: 6449700 - DNA, 18 bp, Homo sapiens
tccccactgcctactgca

SEQ ID NO: 6449701 - DNA, 20 bp, Homo sapiens
tccccactgcctactgcatc

SEQ ID NO: 6449702 - DNA, 22 bp, Homo sapiens
tccccactgcctgcccacccgt

SEQ ID NO: 6449703 - DNA, 12 bp, Homo sapiens
tccccactggag

SEQ ID NO: 6449704 - DNA, 13 bp, Homo sapiens
tccccactggagc

SEQ ID NO: 6449705 - DNA, 17 bp, Homo sapiens
tccccacttctgtgcca

SEQ ID NO: 6449706 - DNA, 19 bp, Homo sapiens
tccccacttgcagccctgt

SEQ ID NO: 6449707 - DNA, 21 bp, Homo sapiens
tccccacttgtccgctgggtg

SEQ ID NO: 6449708 - DNA, 17 bp, Homo sapiens
tccccagaaaggagact

SEQ ID NO: 6449709 - DNA, 19 bp, Homo sapiens
tccccagaactctgcctgc

SEQ ID NO: 6449710 - DNA, 21 bp, Homo sapiens
tccccagaactggctgggccc

SEQ ID NO: 6449711 - DNA, 21 bp, Homo sapiens
tccccagaagacacaggaaac

SEQ ID NO: 6449712 - DNA, 23 bp, Homo sapiens
tccccagaagacacaggaaacaa

SEQ ID NO: 6449713 - DNA, 22 bp, Homo sapiens
tccccagacagggctccagcct

SEQ ID NO: 6449714 - DNA, 21 bp, Homo sapiens
tccccagaccaaccctgggac

SEQ ID NO: 6449715 - DNA, 12 bp, Homo sapiens
tccccagaccag

SEQ ID NO: 6449716 - DNA, 14 bp, Homo sapiens
tccccagaccagta

SEQ ID NO: 6449717 - DNA, 23 bp, Homo sapiens
tccccagaccagtagtgaccaat

SEQ ID NO: 6449718 - DNA, 13 bp, Homo sapiens
tccccagacccag

SEQ ID NO: 6449719 - DNA, 14 bp, Homo sapiens
tccccagactcagc

SEQ ID NO: 6449720 - DNA, 21 bp, Homo sapiens
tccccagactcagctccagaa

SEQ ID NO: 6449721 - DNA, 19 bp, Homo sapiens
tccccagactctgcctaga

SEQ ID NO: 6449722 - DNA, 18 bp, Homo sapiens
tccccagacttgcactgg

SEQ ID NO: 6449723 - DNA, 17 bp, Homo sapiens
tccccagacttgttggc

SEQ ID NO: 6449724 - DNA, 11 bp, Homo sapiens
tccccagagag

SEQ ID NO: 6449725 - DNA, 12 bp, Homo sapiens
tccccagagcac

SEQ ID NO: 6449726 - DNA, 20 bp, Homo sapiens
tccccagagcagcttggccc

SEQ ID NO: 6449727 - DNA, 17 bp, Homo sapiens
tccccagagcccagctc

SEQ ID NO: 6449728 - DNA, 18 bp, Homo sapiens
tccccagagcccagctct

SEQ ID NO: 6449729 - DNA, 19 bp, Homo sapiens
tccccagagcccagctctt

SEQ ID NO: 6449730 - DNA, 18 bp, Homo sapiens
tccccagagccctgcagt

SEQ ID NO: 6449731 - DNA, 21 bp, Homo sapiens
tccccagagccctgcagtcac

SEQ ID NO: 6449732 - DNA, 17 bp, Homo sapiens
tccccagagctcccccg

SEQ ID NO: 6449733 - DNA, 22 bp, Homo sapiens
tccccagagctggcgctcagca

SEQ ID NO: 6449734 - DNA, 14 bp, Homo sapiens
tccccagagctgtg

SEQ ID NO: 6449735 - DNA, 17 bp, Homo sapiens
tccccagagttccccat

SEQ ID NO: 6449736 - DNA, 15 bp, Homo sapiens
tccccagatctccca

SEQ ID NO: 6449737 - DNA, 17 bp, Homo sapiens
tccccagatctcccact

SEQ ID NO: 6449738 - DNA, 17 bp, Homo sapiens
tccccagatctgtcctg

SEQ ID NO: 6449739 - DNA, 21 bp, Homo sapiens
tccccagcaagtgagagctgg

SEQ ID NO: 6449740 - DNA, 14 bp, Homo sapiens
tccccagcacctag

SEQ ID NO: 6449741 - DNA, 21 bp, Homo sapiens
tccccagcagggtcttttcat

SEQ ID NO: 6449742 - DNA, 20 bp, Homo sapiens
tccccagcatgcaccacggg

SEQ ID NO: 6449743 - DNA, 16 bp, Homo sapiens
tccccagccagaggtg

SEQ ID NO: 6449744 - DNA, 13 bp, Homo sapiens
tccccagccagcc

SEQ ID NO: 6449745 - DNA, 22 bp, Homo sapiens
tccccagccagcccttccctgg

SEQ ID NO: 6449746 - DNA, 19 bp, Homo sapiens
tccccagccagcctggctg

SEQ ID NO: 6449747 - DNA, 21 bp, Homo sapiens
tccccagccagcctggctggg

SEQ ID NO: 6449748 - DNA, 22 bp, Homo sapiens
tccccagccagggagcttgcca

SEQ ID NO: 6449749 - DNA, 19 bp, Homo sapiens
tccccagcccacctgctcc

SEQ ID NO: 6449750 - DNA, 21 bp, Homo sapiens
tccccagcccacctgctccca

SEQ ID NO: 6449751 - DNA, 13 bp, Homo sapiens
tccccagcccaga

SEQ ID NO: 6449752 - DNA, 14 bp, Homo sapiens
tccccagcccagca

SEQ ID NO: 6449753 - DNA, 22 bp, Homo sapiens
tccccagcccagggttccccca

SEQ ID NO: 6449754 - DNA, 23 bp, Homo sapiens
tccccagcccagggttcccccag

SEQ ID NO: 6449755 - DNA, 15 bp, Homo sapiens
tccccagccccaccc

SEQ ID NO: 6449756 - DNA, 17 bp, Homo sapiens
tccccagcccccaccca

SEQ ID NO: 6449757 - DNA, 14 bp, Homo sapiens
tccccagccccctc

SEQ ID NO: 6449758 - DNA, 18 bp, Homo sapiens
tccccagccccctcccac

SEQ ID NO: 6449759 - DNA, 23 bp, Homo sapiens
tccccagccccctggcatgtttc

SEQ ID NO: 6449760 - DNA, 17 bp, Homo sapiens
tccccagccccctggcc

SEQ ID NO: 6449761 - DNA, 15 bp, Homo sapiens
tccccagcccctagc

SEQ ID NO: 6449762 - DNA, 16 bp, Homo sapiens
tccccagcccctcctc

SEQ ID NO: 6449763 - DNA, 17 bp, Homo sapiens
tccccagcccctcctcc

SEQ ID NO: 6449764 - DNA, 15 bp, Homo sapiens
tccccagccctaaga

SEQ ID NO: 6449765 - DNA, 16 bp, Homo sapiens
tccccagccctcccca

SEQ ID NO: 6449766 - DNA, 14 bp, Homo sapiens
tccccagccctggg

SEQ ID NO: 6449767 - DNA, 15 bp, Homo sapiens
tccccagccctgggc

SEQ ID NO: 6449768 - DNA, 16 bp, Homo sapiens
tccccagccctgggct

SEQ ID NO: 6449769 - DNA, 16 bp, Homo sapiens
tccccagccctgtcct

SEQ ID NO: 6449770 - DNA, 12 bp, Homo sapiens
tccccagccctt

SEQ ID NO: 6449771 - DNA, 16 bp, Homo sapiens
tccccagcccttcaca

SEQ ID NO: 6449772 - DNA, 20 bp, Homo sapiens
tccccagcccttcctctgct

SEQ ID NO: 6449773 - DNA, 17 bp, Homo sapiens
tccccagcccttctgcc

SEQ ID NO: 6449774 - DNA, 19 bp, Homo sapiens
tccccagcccttctgcctt

SEQ ID NO: 6449775 - DNA, 22 bp, Homo sapiens
tccccagcccttctgcctttct

SEQ ID NO: 6449776 - DNA, 11 bp, Homo sapiens
tccccagccta

SEQ ID NO: 6449777 - DNA, 18 bp, Homo sapiens
tccccagcctacctctcc

SEQ ID NO: 6449778 - DNA, 20 bp, Homo sapiens
tccccagcctaggacgccaa

SEQ ID NO: 6449779 - DNA, 15 bp, Homo sapiens
tccccagcctctcct

SEQ ID NO: 6449780 - DNA, 20 bp, Homo sapiens
tccccagcctctcctccttg

SEQ ID NO: 6449781 - DNA, 14 bp, Homo sapiens
tccccagcctctct

SEQ ID NO: 6449782 - DNA, 17 bp, Homo sapiens
tccccagcctctcttcc

SEQ ID NO: 6449783 - DNA, 18 bp, Homo sapiens
tccccagcctctcttcct

SEQ ID NO: 6449784 - DNA, 22 bp, Homo sapiens
tccccagcctctcttcctatcc

SEQ ID NO: 6449785 - DNA, 13 bp, Homo sapiens
tccccagcctgcg

SEQ ID NO: 6449786 - DNA, 20 bp, Homo sapiens
tccccagcctgcgcctgctg

SEQ ID NO: 6449787 - DNA, 14 bp, Homo sapiens
tccccagcctggga

SEQ ID NO: 6449788 - DNA, 14 bp, Homo sapiens
tccccagcctgggc

SEQ ID NO: 6449789 - DNA, 15 bp, Homo sapiens
tccccagcctgggcc

SEQ ID NO: 6449790 - DNA, 16 bp, Homo sapiens
tccccagcctgggccc

SEQ ID NO: 6449791 - DNA, 22 bp, Homo sapiens
tccccagcgtcccagtctctgg

SEQ ID NO: 6449792 - DNA, 12 bp, Homo sapiens
tccccagctccc

SEQ ID NO: 6449793 - DNA, 13 bp, Homo sapiens
tccccagctccca

SEQ ID NO: 6449794 - DNA, 15 bp, Homo sapiens
tccccagctcccagg

SEQ ID NO: 6449795 - DNA, 17 bp, Homo sapiens
tccccagctcccaggac

SEQ ID NO: 6449796 - DNA, 14 bp, Homo sapiens
tccccagctcccca

SEQ ID NO: 6449797 - DNA, 19 bp, Homo sapiens
tccccagctccccaggact

SEQ ID NO: 6449798 - DNA, 15 bp, Homo sapiens
tccccagctccccca

SEQ ID NO: 6449799 - DNA, 19 bp, Homo sapiens
tccccagctcccttgggaa

SEQ ID NO: 6449800 - DNA, 20 bp, Homo sapiens
tccccagctcttctcttcct

SEQ ID NO: 6449801 - DNA, 12 bp, Homo sapiens
tccccagctgat

SEQ ID NO: 6449802 - DNA, 12 bp, Homo sapiens
tccccagctggt

SEQ ID NO: 6449803 - DNA, 14 bp, Homo sapiens
tccccagctggtgg

SEQ ID NO: 6449804 - DNA, 15 bp, Homo sapiens
tccccagctgtttat

SEQ ID NO: 6449805 - DNA, 24 bp, Homo sapiens
tccccaggaagcccactgcctcct

SEQ ID NO: 6449806 - DNA, 16 bp, Homo sapiens
tccccaggacttggtc

SEQ ID NO: 6449807 - DNA, 10 bp, Homo sapiens
tccccaggag

SEQ ID NO: 6449808 - DNA, 18 bp, Homo sapiens
tccccaggagctctctgc

SEQ ID NO: 6449809 - DNA, 15 bp, Homo sapiens
tccccaggaggccag

SEQ ID NO: 6449810 - DNA, 16 bp, Homo sapiens
tccccaggaggcctgg

SEQ ID NO: 6449811 - DNA, 18 bp, Homo sapiens
tccccaggaggcctgggc

SEQ ID NO: 6449812 - DNA, 16 bp, Homo sapiens
tccccaggatggactc

SEQ ID NO: 6449813 - DNA, 21 bp, Homo sapiens
tccccaggcatttgccaaggg

SEQ ID NO: 6449814 - DNA, 16 bp, Homo sapiens
tccccaggccaggcca

SEQ ID NO: 6449815 - DNA, 19 bp, Homo sapiens
tccccaggccaggccacca

SEQ ID NO: 6449816 - DNA, 22 bp, Homo sapiens
tccccaggccaggccaccagga

SEQ ID NO: 6449817 - DNA, 15 bp, Homo sapiens
tccccaggccaggtc

SEQ ID NO: 6449818 - DNA, 19 bp, Homo sapiens
tccccaggcccagccctcc

SEQ ID NO: 6449819 - DNA, 20 bp, Homo sapiens
tccccaggcccagccctcct

SEQ ID NO: 6449820 - DNA, 21 bp, Homo sapiens
tccccaggcccagccctcctt

SEQ ID NO: 6449821 - DNA, 20 bp, Homo sapiens
tccccaggccccaggaagcc

SEQ ID NO: 6449822 - DNA, 18 bp, Homo sapiens
tccccaggcctccagcct

SEQ ID NO: 6449823 - DNA, 15 bp, Homo sapiens
tccccaggcctggct

SEQ ID NO: 6449824 - DNA, 22 bp, Homo sapiens
tccccaggctgcccactctggg

SEQ ID NO: 6449825 - DNA, 13 bp, Homo sapiens
tccccaggctgga

SEQ ID NO: 6449826 - DNA, 22 bp, Homo sapiens
tccccagggaagaccctgaccg

SEQ ID NO: 6449827 - DNA, 16 bp, Homo sapiens
tccccagggaaggaaa

SEQ ID NO: 6449828 - DNA, 13 bp, Homo sapiens
tccccagggagct

SEQ ID NO: 6449829 - DNA, 18 bp, Homo sapiens
tccccagggagctctggg

SEQ ID NO: 6449830 - DNA, 19 bp, Homo sapiens
tccccagggagctctgggg

SEQ ID NO: 6449831 - DNA, 12 bp, Homo sapiens
tccccagggata

SEQ ID NO: 6449832 - DNA, 21 bp, Homo sapiens
tccccagggcacgtggttgag

SEQ ID NO: 6449833 - DNA, 12 bp, Homo sapiens
tccccagggcag

SEQ ID NO: 6449834 - DNA, 15 bp, Homo sapiens
tccccagggcccctc

SEQ ID NO: 6449835 - DNA, 21 bp, Homo sapiens
tccccagggcccctccctctg

SEQ ID NO: 6449836 - DNA, 19 bp, Homo sapiens
tccccagggctcccttatg

SEQ ID NO: 6449837 - DNA, 19 bp, Homo sapiens
tccccaggggaaaatgaag

SEQ ID NO: 6449838 - DNA, 23 bp, Homo sapiens
tccccaggggagagggtctggag

SEQ ID NO: 6449839 - DNA, 13 bp, Homo sapiens
tccccaggggcac

SEQ ID NO: 6449840 - DNA, 23 bp, Homo sapiens
tccccaggtccagctctggaggg

SEQ ID NO: 6449841 - DNA, 18 bp, Homo sapiens
tccccaggtccccaaact

SEQ ID NO: 6449842 - DNA, 20 bp, Homo sapiens
tccccaggtcctgtctctgc

SEQ ID NO: 6449843 - DNA, 17 bp, Homo sapiens
tccccaggtctctccac

SEQ ID NO: 6449844 - DNA, 19 bp, Homo sapiens
tccccaggtggctgaccca

SEQ ID NO: 6449845 - DNA, 18 bp, Homo sapiens
tccccaggtgtgtgcttt

SEQ ID NO: 6449846 - DNA, 19 bp, Homo sapiens
tccccagtactgaggtggt

SEQ ID NO: 6449847 - DNA, 21 bp, Homo sapiens
tccccagtagctgggattaca

SEQ ID NO: 6449848 - DNA, 14 bp, Homo sapiens
tccccagtccccag

SEQ ID NO: 6449849 - DNA, 18 bp, Homo sapiens
tccccagtccccagccct

SEQ ID NO: 6449850 - DNA, 19 bp, Homo sapiens
tccccagtccccagccctg

SEQ ID NO: 6449851 - DNA, 21 bp, Homo sapiens
tccccagtccccagccctggg

SEQ ID NO: 6449852 - DNA, 14 bp, Homo sapiens
tccccagtctctgg

SEQ ID NO: 6449853 - DNA, 10 bp, Homo sapiens
tccccagtga

SEQ ID NO: 6449854 - DNA, 14 bp, Homo sapiens
tccccagtgaaaac

SEQ ID NO: 6449855 - DNA, 19 bp, Homo sapiens
tccccagtgactccagggt

SEQ ID NO: 6449856 - DNA, 10 bp, Homo sapiens
tccccagtgc

SEQ ID NO: 6449857 - DNA, 21 bp, Homo sapiens
tccccagtgcctgccactctc

SEQ ID NO: 6449858 - DNA, 16 bp, Homo sapiens
tccccagtgtggactc

SEQ ID NO: 6449859 - DNA, 24 bp, Homo sapiens
tccccagtgtggactctggactgg

SEQ ID NO: 6449860 - DNA, 14 bp, Homo sapiens
tccccagtgtggcc

SEQ ID NO: 6449861 - DNA, 18 bp, Homo sapiens
tccccagttaatgtgcca

SEQ ID NO: 6449862 - DNA, 20 bp, Homo sapiens
tccccagttaatgtgccaaa

SEQ ID NO: 6449863 - DNA, 21 bp, Homo sapiens
tccccagttaatgtgccaaaa

SEQ ID NO: 6449864 - DNA, 15 bp, Homo sapiens
tccccagttccacag

SEQ ID NO: 6449865 - DNA, 17 bp, Homo sapiens
tccccagtttgcagaaa

SEQ ID NO: 6449866 - DNA, 19 bp, Homo sapiens
tccccataagacaaacact

SEQ ID NO: 6449867 - DNA, 20 bp, Homo sapiens
tccccataagacaaacactg

SEQ ID NO: 6449868 - DNA, 19 bp, Homo sapiens
tgaaggaatagcccgagga

SEQ ID NO: 6449869 - DNA, 22 bp, Homo sapiens
tgaaggaatatatggcagagtt

SEQ ID NO: 6449870 - DNA, 19 bp, Homo sapiens
tgaaggaatcattccagtg

SEQ ID NO: 6449871 - DNA, 20 bp, Homo sapiens
tgaaggaatcattccagtgc

SEQ ID NO: 6449872 - DNA, 22 bp, Homo sapiens
tgaaggaatttgattgctttgc

SEQ ID NO: 6449873 - DNA, 19 bp, Homo sapiens
tgaaggacacttcctgcct

SEQ ID NO: 6449874 - DNA, 14 bp, Homo sapiens
tgaaggaccccagg

SEQ ID NO: 6449875 - DNA, 15 bp, Homo sapiens
tgaaggaccccaggt

SEQ ID NO: 6449876 - DNA, 21 bp, Homo sapiens
tgaaggacctccccctgtgtg

SEQ ID NO: 6449877 - DNA, 20 bp, Homo sapiens
tgaaggactaatagaaaagt

SEQ ID NO: 6449878 - DNA, 19 bp, Homo sapiens
tgaaggactattaattcca

SEQ ID NO: 6449879 - DNA, 17 bp, Homo sapiens
tgaaggactgcagacag

SEQ ID NO: 6449880 - DNA, 18 bp, Homo sapiens
tgaaggactttggcccta

SEQ ID NO: 6449881 - DNA, 23 bp, Homo sapiens
tgaaggagaaaatagataattta

SEQ ID NO: 6449882 - DNA, 16 bp, Homo sapiens
tgaaggagaaataccc

SEQ ID NO: 6449883 - DNA, 20 bp, Homo sapiens
tgaaggagattttccttcct

SEQ ID NO: 6449884 - DNA, 14 bp, Homo sapiens
tgaaggaggccacc

SEQ ID NO: 6449885 - DNA, 16 bp, Homo sapiens
tgaaggaggccacctc

SEQ ID NO: 6449886 - DNA, 17 bp, Homo sapiens
tgaaggaggccacctcc

SEQ ID NO: 6449887 - DNA, 20 bp, Homo sapiens
tgaaggaggccacctcctaa

SEQ ID NO: 6449888 - DNA, 17 bp, Homo sapiens
tgaaggaggcggggctc

SEQ ID NO: 6449889 - DNA, 21 bp, Homo sapiens
tgaaggaggctccaggcagca

SEQ ID NO: 6449890 - DNA, 22 bp, Homo sapiens
tgaaggatcctggaaccactga

SEQ ID NO: 6449891 - DNA, 15 bp, Homo sapiens
tgaaggatctgtccg

SEQ ID NO: 6449892 - DNA, 19 bp, Homo sapiens
tgaaggatctgtccgacag

SEQ ID NO: 6449893 - DNA, 15 bp, Homo sapiens
tgaaggatgccaaga

SEQ ID NO: 6449894 - DNA, 17 bp, Homo sapiens
tgaaggatgggggctcc

SEQ ID NO: 6449895 - DNA, 21 bp, Homo sapiens
tgaaggatgggggctcctggc

SEQ ID NO: 6449896 - DNA, 13 bp, Homo sapiens
tgaaggattgcat

SEQ ID NO: 6449897 - DNA, 17 bp, Homo sapiens
tgaaggattgcatcctg

SEQ ID NO: 6449898 - DNA, 20 bp, Homo sapiens
tgaaggattgcatcctgctg

SEQ ID NO: 6449899 - DNA, 20 bp, Homo sapiens
tgaaggatttcttattttct

SEQ ID NO: 6449900 - DNA, 23 bp, Homo sapiens
tgaaggcaaaaactgtactgtgt

SEQ ID NO: 6449901 - DNA, 14 bp, Homo sapiens
tgaaggcaatgcca

SEQ ID NO: 6449902 - DNA, 14 bp, Homo sapiens
tgaaggcacctgcc

SEQ ID NO: 6449903 - DNA, 22 bp, Homo sapiens
tgaaggcacctgcccccacagc

SEQ ID NO: 6449904 - DNA, 15 bp, Homo sapiens
tgaaggcagaaagca

SEQ ID NO: 6449905 - DNA, 15 bp, Homo sapiens
tgaaggcagggctcc

SEQ ID NO: 6449906 - DNA, 16 bp, Homo sapiens
tgaaggcagggctcct

SEQ ID NO: 6449907 - DNA, 22 bp, Homo sapiens
tgaaggcagggctcctccctgg

SEQ ID NO: 6449908 - DNA, 14 bp, Homo sapiens
tgaaggcagtctga

SEQ ID NO: 6449909 - DNA, 16 bp, Homo sapiens
tgaaggccacttgagt

SEQ ID NO: 6449910 - DNA, 19 bp, Homo sapiens
tgaaggccatcatctctgt

SEQ ID NO: 6449911 - DNA, 23 bp, Homo sapiens
tgaaggcccaagagcagagtctg

SEQ ID NO: 6449912 - DNA, 12 bp, Homo sapiens
tgaaggcctgag

SEQ ID NO: 6449913 - DNA, 14 bp, Homo sapiens
tgaaggcctgaggt

SEQ ID NO: 6449914 - DNA, 17 bp, Homo sapiens
tgaaggcctggctggaa

SEQ ID NO: 6449915 - DNA, 20 bp, Homo sapiens
tgaaggccttcaacccgaga

SEQ ID NO: 6449916 - DNA, 19 bp, Homo sapiens
tgaaggcgtgcaaggggct

SEQ ID NO: 6449917 - DNA, 22 bp, Homo sapiens
tgaaggcgtgcaaggggctcag

SEQ ID NO: 6449918 - DNA, 20 bp, Homo sapiens
tgaaggctcgagcatgcctg

SEQ ID NO: 6449919 - DNA, 22 bp, Homo sapiens
tgaaggctgctgcaagtcattg

SEQ ID NO: 6449920 - DNA, 14 bp, Homo sapiens
tgaaggctgtacac

SEQ ID NO: 6449921 - DNA, 20 bp, Homo sapiens
tgaaggcttaattgactgaa

SEQ ID NO: 6449922 - DNA, 20 bp, Homo sapiens
tgaaggcttctctgttctac

SEQ ID NO: 6449923 - DNA, 18 bp, Homo sapiens
tgaagggaaacaaagaag

SEQ ID NO: 6449924 - DNA, 18 bp, Homo sapiens
tgaagggaaaggatattt

SEQ ID NO: 6449925 - DNA, 13 bp, Homo sapiens
tgaagggaaatca

SEQ ID NO: 6449926 - DNA, 17 bp, Homo sapiens
tgaagggaaatcaattt

SEQ ID NO: 6449927 - DNA, 21 bp, Homo sapiens
tgaagggaacagcctgagccg

SEQ ID NO: 6449928 - DNA, 19 bp, Homo sapiens
tgaagggaactagaggtgt

SEQ ID NO: 6449929 - DNA, 20 bp, Homo sapiens
tgaagggaagcccagcctgc

SEQ ID NO: 6449930 - DNA, 21 bp, Homo sapiens
tgaagggaaggcaaaggcaga

SEQ ID NO: 6449931 - DNA, 15 bp, Homo sapiens
tgaagggaagtgggg

SEQ ID NO: 6449932 - DNA, 20 bp, Homo sapiens
tgaagggacagctgctggga

SEQ ID NO: 6449933 - DNA, 17 bp, Homo sapiens
tgaagggaccctttggg

SEQ ID NO: 6449934 - DNA, 12 bp, Homo sapiens
tgaagggagaag

SEQ ID NO: 6449935 - DNA, 17 bp, Homo sapiens
tgaagggagaagacact

SEQ ID NO: 6449936 - DNA, 14 bp, Homo sapiens
tgaagggagagcca

SEQ ID NO: 6449937 - DNA, 16 bp, Homo sapiens
tgaagggaggtgggga

SEQ ID NO: 6449938 - DNA, 13 bp, Homo sapiens
tgaagggatgggg

SEQ ID NO: 6449939 - DNA, 22 bp, Homo sapiens
tgaagggatgggggaagatttt

SEQ ID NO: 6449940 - DNA, 15 bp, Homo sapiens
tgaagggcaagaaat

SEQ ID NO: 6449941 - DNA, 15 bp, Homo sapiens
tgaagggcaggtgct

SEQ ID NO: 6449942 - DNA, 21 bp, Homo sapiens
tgaagggcatacaatgaaaag

SEQ ID NO: 6449943 - DNA, 11 bp, Homo sapiens
tgaagggccag

SEQ ID NO: 6449944 - DNA, 16 bp, Homo sapiens
tgaagggccagagcca

SEQ ID NO: 6449945 - DNA, 18 bp, Homo sapiens
tgaagggccagagccagg

SEQ ID NO: 6449946 - DNA, 23 bp, Homo sapiens
tgaagggccttgagcatctggat

SEQ ID NO: 6449947 - DNA, 12 bp, Homo sapiens
tgaagggctgga

SEQ ID NO: 6449948 - DNA, 13 bp, Homo sapiens
tgaagggctggaa

SEQ ID NO: 6449949 - DNA, 14 bp, Homo sapiens
tgaaggggaaaacc

SEQ ID NO: 6449950 - DNA, 19 bp, Homo sapiens
tgaaggggcacaccactgc

SEQ ID NO: 6449951 - DNA, 18 bp, Homo sapiens
tgaaggggccagaccacg

SEQ ID NO: 6449952 - DNA, 13 bp, Homo sapiens
tgaaggggctggt

SEQ ID NO: 6449953 - DNA, 15 bp, Homo sapiens
tgaaggggcttctaa

SEQ ID NO: 6449954 - DNA, 21 bp, Homo sapiens
tgaagggggtaccttaagaga

SEQ ID NO: 6449955 - DNA, 15 bp, Homo sapiens
tgaaggggttttctt

SEQ ID NO: 6449956 - DNA, 14 bp, Homo sapiens
tgaagggtaaggga

SEQ ID NO: 6449957 - DNA, 20 bp, Homo sapiens
tgaagggtaatatggactca

SEQ ID NO: 6449958 - DNA, 16 bp, Homo sapiens
tgaagggtgacatccc

SEQ ID NO: 6449959 - DNA, 17 bp, Homo sapiens
tgaagggtgctcagtct

SEQ ID NO: 6449960 - DNA, 14 bp, Homo sapiens
tgaaggtaaataaa

SEQ ID NO: 6449961 - DNA, 20 bp, Homo sapiens
tgaaggtaaataaaaagaaa

SEQ ID NO: 6449962 - DNA, 23 bp, Homo sapiens
tgaaggtaatactataaatatat

SEQ ID NO: 6449963 - DNA, 16 bp, Homo sapiens
tgaaggtattggcctg

SEQ ID NO: 6449964 - DNA, 17 bp, Homo sapiens
tgaaggtattggcctgt

SEQ ID NO: 6449965 - DNA, 20 bp, Homo sapiens
tgaaggtattggcctgttca

SEQ ID NO: 6449966 - DNA, 16 bp, Homo sapiens
tgaaggtcccctggca

SEQ ID NO: 6449967 - DNA, 18 bp, Homo sapiens
tgaaggtcccctggcagt

SEQ ID NO: 6449968 - DNA, 17 bp, Homo sapiens
tgaaggtcctagcttta

SEQ ID NO: 6449969 - DNA, 21 bp, Homo sapiens
tgaaggtctcctaaaactggg

SEQ ID NO: 6449970 - DNA, 23 bp, Homo sapiens
tgaaggtctcctaaaactgggat

SEQ ID NO: 6449971 - DNA, 19 bp, Homo sapiens
tgaaggtcttgatttgttt

SEQ ID NO: 6449972 - DNA, 22 bp, Homo sapiens
tgaaggtctttgttatgacagt

SEQ ID NO: 6449973 - DNA, 15 bp, Homo sapiens
tgaaggtgacagcag

SEQ ID NO: 6449974 - DNA, 18 bp, Homo sapiens
tgaaggtgataagggaaa

SEQ ID NO: 6449975 - DNA, 15 bp, Homo sapiens
tgaaggtgcccagga

SEQ ID NO: 6449976 - DNA, 17 bp, Homo sapiens
tgaaggtgctgccaccc

SEQ ID NO: 6449977 - DNA, 13 bp, Homo sapiens
tgaaggtgggaaa

SEQ ID NO: 6449978 - DNA, 14 bp, Homo sapiens
tgaaggtgtcagaa

SEQ ID NO: 6449979 - DNA, 15 bp, Homo sapiens
tgaaggtgtcagaat

SEQ ID NO: 6449980 - DNA, 21 bp, Homo sapiens
tgaaggtgtgctacagaaaat

SEQ ID NO: 6449981 - DNA, 19 bp, Homo sapiens
tgaaggtgttgggtcagtg

SEQ ID NO: 6449982 - DNA, 15 bp, Homo sapiens
tgaaggttaaaggaa

SEQ ID NO: 6449983 - DNA, 16 bp, Homo sapiens
tgaaggttaggattta

SEQ ID NO: 6449984 - DNA, 18 bp, Homo sapiens
tgaaggttcccaaggaca

SEQ ID NO: 6449985 - DNA, 18 bp, Homo sapiens
tgaaggttggaactgctg

SEQ ID NO: 6449986 - DNA, 22 bp, Homo sapiens
tgaaggttggaactgctgccat

SEQ ID NO: 6449987 - DNA, 18 bp, Homo sapiens
tgaaggttgtggcctttg

SEQ ID NO: 6449988 - DNA, 13 bp, Homo sapiens
tgaaggtttttga

SEQ ID NO: 6449989 - DNA, 13 bp, Homo sapiens
tgaaggtttttgt

SEQ ID NO: 6449990 - DNA, 17 bp, Homo sapiens
tgaaggtttttgtaaag

SEQ ID NO: 6449991 - DNA, 19 bp, Homo sapiens
tgaaggtttttgtaaagat

SEQ ID NO: 6449992 - DNA, 23 bp, Homo sapiens
tgaaggttttttttttaagtgca

SEQ ID NO: 6449993 - DNA, 14 bp, Homo sapiens
tgaagtaaaactta

SEQ ID NO: 6449994 - DNA, 17 bp, Homo sapiens
tgaagtaaacagctgtg

SEQ ID NO: 6449995 - DNA, 14 bp, Homo sapiens
tgaagtaaactttt

SEQ ID NO: 6449996 - DNA, 16 bp, Homo sapiens
tgaagtaaactttttg

SEQ ID NO: 6449997 - DNA, 21 bp, Homo sapiens
tgaagtaaattaaacattttt

SEQ ID NO: 6449998 - DNA, 16 bp, Homo sapiens
tgaagtaaattatgta

SEQ ID NO: 6449999 - DNA, 14 bp, Homo sapiens
tgaagtaaattgaa

SEQ ID NO: 6450000 - DNA, 18 bp, Homo sapiens
tgaagtaacatgcatact

SEQ ID NO: 6450001 - DNA, 19 bp, Homo sapiens
tgaagtaacccctcctggc

SEQ ID NO: 6450002 - DNA, 21 bp, Homo sapiens
tgaagtaacccctcctggctg

SEQ ID NO: 6450003 - DNA, 18 bp, Homo sapiens
tgaagtaactataacaaa

SEQ ID NO: 6450004 - DNA, 21 bp, Homo sapiens
tgaagtaactataacaaaaaa

SEQ ID NO: 6450005 - DNA, 18 bp, Homo sapiens
tgaagtaacttgtcttaa

SEQ ID NO: 6450006 - DNA, 13 bp, Homo sapiens
tgaagtaagcaaa

SEQ ID NO: 6450007 - DNA, 14 bp, Homo sapiens
tgaagtaagcaaag

SEQ ID NO: 6450008 - DNA, 23 bp, Homo sapiens
tgaagtaagttctgaaaactgtt

SEQ ID NO: 6450009 - DNA, 14 bp, Homo sapiens
tgaagtaataactg

SEQ ID NO: 6450010 - DNA, 14 bp, Homo sapiens
tgaagtaatgaatt

SEQ ID NO: 6450011 - DNA, 20 bp, Homo sapiens
tgaagtaatgaatttttatg

SEQ ID NO: 6450012 - DNA, 18 bp, Homo sapiens
tgaagtacaaacatgaaa

SEQ ID NO: 6450013 - DNA, 20 bp, Homo sapiens
tgaagtacaaacatgaaaaa

SEQ ID NO: 6450014 - DNA, 16 bp, Homo sapiens
tgaagtacagtcccag

SEQ ID NO: 6450015 - DNA, 13 bp, Homo sapiens
tgaagtacatatt

SEQ ID NO: 6450016 - DNA, 23 bp, Homo sapiens
tgaagtaccaggccgtttgcttt

SEQ ID NO: 6450017 - DNA, 23 bp, Homo sapiens
tgaagtacccgttcacatttttg

SEQ ID NO: 6450018 - DNA, 17 bp, Homo sapiens
tgaagtactcatacatg

SEQ ID NO: 6450019 - DNA, 16 bp, Homo sapiens
tgaagtactgcaccca

SEQ ID NO: 6450020 - DNA, 19 bp, Homo sapiens
tgaagtactgcacccagca

SEQ ID NO: 6450021 - DNA, 20 bp, Homo sapiens
tgaagtacttaaacttccac

SEQ ID NO: 6450022 - DNA, 22 bp, Homo sapiens
tgaagtacttaattgaagcttt

SEQ ID NO: 6450023 - DNA, 15 bp, Homo sapiens
tgaagtagaagttac

SEQ ID NO: 6450024 - DNA, 18 bp, Homo sapiens
tgaagtagtgtgagtgtt

SEQ ID NO: 6450025 - DNA, 22 bp, Homo sapiens
tgaagtagtgtgagtgttagaa

SEQ ID NO: 6450026 - DNA, 14 bp, Homo sapiens
tgaagtataaatct

SEQ ID NO: 6450027 - DNA, 13 bp, Homo sapiens
tgaagtatacttt

SEQ ID NO: 6450028 - DNA, 21 bp, Homo sapiens
tgaagtatacttttcccctgt

SEQ ID NO: 6450029 - DNA, 22 bp, Homo sapiens
tgaagtatataatggtttcaaa

SEQ ID NO: 6450030 - DNA, 14 bp, Homo sapiens
tgaagtatattctt

SEQ ID NO: 6450031 - DNA, 22 bp, Homo sapiens
tgaagtatattcttattggaaa

SEQ ID NO: 6450032 - DNA, 23 bp, Homo sapiens
tgaagtatattcttattggaaat

SEQ ID NO: 6450033 - DNA, 20 bp, Homo sapiens
tgaagtatctaaaagtgtca

SEQ ID NO: 6450034 - DNA, 16 bp, Homo sapiens
tgaagtatctgtacct

SEQ ID NO: 6450035 - DNA, 13 bp, Homo sapiens
tgaagtatctttg

SEQ ID NO: 6450036 - DNA, 16 bp, Homo sapiens
tgaagtatgaagtctg

SEQ ID NO: 6450037 - DNA, 21 bp, Homo sapiens
tgaagtatgcactaatcaata

SEQ ID NO: 6450038 - DNA, 13 bp, Homo sapiens
tgaagtatggtgt

SEQ ID NO: 6450039 - DNA, 18 bp, Homo sapiens
tgaagtatggtgtgttca

SEQ ID NO: 6450040 - DNA, 17 bp, Homo sapiens
tgaagtattaagcctac

SEQ ID NO: 6450041 - DNA, 21 bp, Homo sapiens
tgaagtattacatgatttaaa

SEQ ID NO: 6450042 - DNA, 16 bp, Homo sapiens
tgaagtattgctgaaa

SEQ ID NO: 6450043 - DNA, 17 bp, Homo sapiens
tgaagtatttctcactc

SEQ ID NO: 6450044 - DNA, 20 bp, Homo sapiens
tgaagtattttgctggaata

SEQ ID NO: 6450045 - DNA, 21 bp, Homo sapiens
tccccataagacaaacactgc

SEQ ID NO: 6450046 - DNA, 23 bp, Homo sapiens
tccccataagacaaacactgcca

SEQ ID NO: 6450047 - DNA, 16 bp, Homo sapiens
tccccatacacacaca

SEQ ID NO: 6450048 - DNA, 23 bp, Homo sapiens
tccccatactcctatgatctgag

SEQ ID NO: 6450049 - DNA, 20 bp, Homo sapiens
tccccatagataggcccctg

SEQ ID NO: 6450050 - DNA, 23 bp, Homo sapiens
tccccatagctggtttttcccac

SEQ ID NO: 6450051 - DNA, 19 bp, Homo sapiens
tccccatatataaattatt

SEQ ID NO: 6450052 - DNA, 22 bp, Homo sapiens
tccccatatataaattattact

SEQ ID NO: 6450053 - DNA, 19 bp, Homo sapiens
tccccatatttgtgttcag

SEQ ID NO: 6450054 - DNA, 16 bp, Homo sapiens
tccccatcagctccca

SEQ ID NO: 6450055 - DNA, 19 bp, Homo sapiens
tccccatcatcccagctgc

SEQ ID NO: 6450056 - DNA, 19 bp, Homo sapiens
tccccatccagcgagagag

SEQ ID NO: 6450057 - DNA, 23 bp, Homo sapiens
tccccatcccattttcatcctga

SEQ ID NO: 6450058 - DNA, 16 bp, Homo sapiens
tccccatccccaccag

SEQ ID NO: 6450059 - DNA, 17 bp, Homo sapiens
tccccatccccaccagc

SEQ ID NO: 6450060 - DNA, 14 bp, Homo sapiens
tccccatccccatt

SEQ ID NO: 6450061 - DNA, 18 bp, Homo sapiens
tccccatccccttcctaa

SEQ ID NO: 6450062 - DNA, 22 bp, Homo sapiens
tccccatcccgaagccatcact

SEQ ID NO: 6450063 - DNA, 16 bp, Homo sapiens
tccccatcctccagag

SEQ ID NO: 6450064 - DNA, 17 bp, Homo sapiens
tccccatcctccagctt

SEQ ID NO: 6450065 - DNA, 19 bp, Homo sapiens
tccccatcctccagcttct

SEQ ID NO: 6450066 - DNA, 19 bp, Homo sapiens
tccccatcggccctgtccc

SEQ ID NO: 6450067 - DNA, 22 bp, Homo sapiens
tccccatcggccctgtcccctg

SEQ ID NO: 6450068 - DNA, 22 bp, Homo sapiens
tccccatctaggtcctggctgg

SEQ ID NO: 6450069 - DNA, 16 bp, Homo sapiens
tccccatctcactctt

SEQ ID NO: 6450070 - DNA, 19 bp, Homo sapiens
tccccatctccatttcaca

SEQ ID NO: 6450071 - DNA, 16 bp, Homo sapiens
tccccatctccctgcc

SEQ ID NO: 6450072 - DNA, 15 bp, Homo sapiens
tccccatctgtccag

SEQ ID NO: 6450073 - DNA, 16 bp, Homo sapiens
tccccatctgtccagc

SEQ ID NO: 6450074 - DNA, 15 bp, Homo sapiens
tccccatctgtgttc

SEQ ID NO: 6450075 - DNA, 20 bp, Homo sapiens
tccccatctttgatccttct

SEQ ID NO: 6450076 - DNA, 11 bp, Homo sapiens
tccccatgaca

SEQ ID NO: 6450077 - DNA, 20 bp, Homo sapiens
tccccatgccacgttccaca

SEQ ID NO: 6450078 - DNA, 12 bp, Homo sapiens
tccccatgccta

SEQ ID NO: 6450079 - DNA, 21 bp, Homo sapiens
tccccatgcctagcagagtgc

SEQ ID NO: 6450080 - DNA, 22 bp, Homo sapiens
tccccatgcctagcagagtgct

SEQ ID NO: 6450081 - DNA, 13 bp, Homo sapiens
tccccatgcctgt

SEQ ID NO: 6450082 - DNA, 18 bp, Homo sapiens
tccccatgcctgtggctg

SEQ ID NO: 6450083 - DNA, 18 bp, Homo sapiens
tccccatggaacagccct

SEQ ID NO: 6450084 - DNA, 19 bp, Homo sapiens
tccccatggaacagccctg

SEQ ID NO: 6450085 - DNA, 15 bp, Homo sapiens
tccccatggagccag

SEQ ID NO: 6450086 - DNA, 17 bp, Homo sapiens
tccccatggccctgagc

SEQ ID NO: 6450087 - DNA, 19 bp, Homo sapiens
tccccatggtagtttaaaa

SEQ ID NO: 6450088 - DNA, 22 bp, Homo sapiens
tccccatgtgcctgcaccagga

SEQ ID NO: 6450089 - DNA, 24 bp, Homo sapiens
tccccattagctttcaattccgta

SEQ ID NO: 6450090 - DNA, 13 bp, Homo sapiens
tccccattcagtg

SEQ ID NO: 6450091 - DNA, 19 bp, Homo sapiens
tccccattcattcctgatg

SEQ ID NO: 6450092 - DNA, 23 bp, Homo sapiens
tccccattctgtgtcccatgtcc

SEQ ID NO: 6450093 - DNA, 16 bp, Homo sapiens
tccccattgccttctg

SEQ ID NO: 6450094 - DNA, 15 bp, Homo sapiens
tccccatttcccatc

SEQ ID NO: 6450095 - DNA, 17 bp, Homo sapiens
tccccatttcccatctg

SEQ ID NO: 6450096 - DNA, 19 bp, Homo sapiens
tccccatttcccatctgca

SEQ ID NO: 6450097 - DNA, 19 bp, Homo sapiens
tccccattttataccaaag

SEQ ID NO: 6450098 - DNA, 15 bp, Homo sapiens
tccccattttctggt

SEQ ID NO: 6450099 - DNA, 15 bp, Homo sapiens
tcccccaaaaatttg

SEQ ID NO: 6450100 - DNA, 18 bp, Homo sapiens
tcccccaaacagcatgtg

SEQ ID NO: 6450101 - DNA, 15 bp, Homo sapiens
tcccccaaaccctgc

SEQ ID NO: 6450102 - DNA, 18 bp, Homo sapiens
tcccccaaaccctgcttc

SEQ ID NO: 6450103 - DNA, 12 bp, Homo sapiens
tcccccaaagtt

SEQ ID NO: 6450104 - DNA, 18 bp, Homo sapiens
tcccccaacacctgctgc

SEQ ID NO: 6450105 - DNA, 21 bp, Homo sapiens
tcccccaacccacctctggcc

SEQ ID NO: 6450106 - DNA, 23 bp, Homo sapiens
tcccccaacccacctctggccct

SEQ ID NO: 6450107 - DNA, 16 bp, Homo sapiens
tcccccaacccccacc

SEQ ID NO: 6450108 - DNA, 20 bp, Homo sapiens
tcccccaacccccaccccac

SEQ ID NO: 6450109 - DNA, 18 bp, Homo sapiens
tcccccaactctgagccc

SEQ ID NO: 6450110 - DNA, 22 bp, Homo sapiens
tcccccaagcatgggggacccc

SEQ ID NO: 6450111 - DNA, 16 bp, Homo sapiens
tcccccaccactcagg

SEQ ID NO: 6450112 - DNA, 16 bp, Homo sapiens
tcccccacccacctcc

SEQ ID NO: 6450113 - DNA, 16 bp, Homo sapiens
tcccccacccacctct

SEQ ID NO: 6450114 - DNA, 19 bp, Homo sapiens
tcccccacccatggggagg

SEQ ID NO: 6450115 - DNA, 19 bp, Homo sapiens
tcccccaccccctccccag

SEQ ID NO: 6450116 - DNA, 20 bp, Homo sapiens
tcccccaccccctccccagg

SEQ ID NO: 6450117 - DNA, 17 bp, Homo sapiens
tcccccacccctccacg

SEQ ID NO: 6450118 - DNA, 16 bp, Homo sapiens
tcccccaccctgtgcc

SEQ ID NO: 6450119 - DNA, 19 bp, Homo sapiens
tcccccaccctgtgcccct

SEQ ID NO: 6450120 - DNA, 22 bp, Homo sapiens
tcccccaccgcccactctccac

SEQ ID NO: 6450121 - DNA, 21 bp, Homo sapiens
tcccccaccggtccagctggc

SEQ ID NO: 6450122 - DNA, 18 bp, Homo sapiens
tcccccacctactctcag

SEQ ID NO: 6450123 - DNA, 16 bp, Homo sapiens
tcccccacctcttttc

SEQ ID NO: 6450124 - DNA, 22 bp, Homo sapiens
tcccccacctgacaatggcagc

SEQ ID NO: 6450125 - DNA, 17 bp, Homo sapiens
tcccccacgcctccatc

SEQ ID NO: 6450126 - DNA, 20 bp, Homo sapiens
tcccccacggccgtccctga

SEQ ID NO: 6450127 - DNA, 17 bp, Homo sapiens
tcccccacgtctctctg

SEQ ID NO: 6450128 - DNA, 19 bp, Homo sapiens
tcccccacgtctctctgcc

SEQ ID NO: 6450129 - DNA, 13 bp, Homo sapiens
tcccccactccca

SEQ ID NO: 6450130 - DNA, 19 bp, Homo sapiens
tcccccactctctcaccca

SEQ ID NO: 6450131 - DNA, 12 bp, Homo sapiens
tcccccactttc

SEQ ID NO: 6450132 - DNA, 19 bp, Homo sapiens
tcccccactttcaagacag

SEQ ID NO: 6450133 - DNA, 13 bp, Homo sapiens
tcccccagacaga

SEQ ID NO: 6450134 - DNA, 14 bp, Homo sapiens
tcccccagacagag

SEQ ID NO: 6450135 - DNA, 12 bp, Homo sapiens
tcccccagagca

SEQ ID NO: 6450136 - DNA, 15 bp, Homo sapiens
tcccccagagcatct

SEQ ID NO: 6450137 - DNA, 20 bp, Homo sapiens
tcccccagagcatctgcccc

SEQ ID NO: 6450138 - DNA, 23 bp, Homo sapiens
tcccccagagcatctgccccagg

SEQ ID NO: 6450139 - DNA, 13 bp, Homo sapiens
tcccccagagccc

SEQ ID NO: 6450140 - DNA, 17 bp, Homo sapiens
tcccccagagtgctgtc

SEQ ID NO: 6450141 - DNA, 22 bp, Homo sapiens
tcccccagcaaagcccccagag

SEQ ID NO: 6450142 - DNA, 12 bp, Homo sapiens
tcccccagcaga

SEQ ID NO: 6450143 - DNA, 21 bp, Homo sapiens
tcccccagcatcgggggcctg

SEQ ID NO: 6450144 - DNA, 23 bp, Homo sapiens
tcccccagcatcgggggcctgca

SEQ ID NO: 6450145 - DNA, 13 bp, Homo sapiens
tcccccagccact

SEQ ID NO: 6450146 - DNA, 14 bp, Homo sapiens
tcccccagccactc

SEQ ID NO: 6450147 - DNA, 12 bp, Homo sapiens
tcccccagccag

SEQ ID NO: 6450148 - DNA, 14 bp, Homo sapiens
tcccccagccagga

SEQ ID NO: 6450149 - DNA, 21 bp, Homo sapiens
tcccccagccatgccagctgg
